United States Patent 9,675,668 (MODIFIED POLYNUCLEOTIDES ENCODING HEPATITIS A VIRUS CELLULAR RECEPTOR 2) - sequence listing, part 18

SEQ ID NO: 37331 - DNA, 654 bp, Artificial Sequence; identical to SEQ ID NO: 37329
  Description of Artificial Sequence: Synthetic coding sequence

SEQ ID NO: 37332 - DNA, 705 bp, Artificial Sequence
  Description of Artificial Sequence: Synthetic coding sequence
atgaggaagccagacagcaagatcgtgctgctgggggacatgaatgtgggcaagaccagcctgctgcagcgctacatggagcggcgcttcccagacacagtgtccacagtgggcggggccttctacctgaagcagtggaggagctacaacatcagcatctgggacacagctggccgggagcagttccacggcctgggctccatgtactgcagaggagctgctgccatcatcctgacctatgatgtgaaccaccggcagagcctggtggagctggaggaccgcttcctgggcctgacagacacagccagcaaggactgcctgtttgccatcgtgggcaacaaggtggacctgacagaggagggcgccctggccggccaggagaaggaggagtgcagccccaacatggatgctggggacagagtgagcccccgggcccccaagcaggtgcagctggaggatgctgtggccctgtacaagaagatcctgaagtacaagatgctggatgagcaggatgtgcctgctgctgagcagatgtgctttgagaccagcgccaagacaggctacaacgtggacctgctgtttgagaccctgtttgacctggtggtgcccatgatcctgcagcagagagctgagcggcccagccacacagtggacatcagcagccacaagccacccaagaggaccaggagcggctgctgtgcctag

SEQ ID NO: 37333 - DNA, 657 bp, Artificial Sequence
  Description of Artificial Sequence: Synthetic coding sequence
atgacagatggagactatgactacctgatcaagctgctggccctgggggacagcggcgtgggcaagaccaccttcctgtaccgctacacagacaacaagttcaaccccaagttcatcaccaccgtgggcatcgacttccgggagaagagggtggtgtacaatgcccagggccccaacggcagcagcggcaaggccttcaaggtgcacctgcagctgtgggacacagctggccaggagcgcttccgcagcctgaccacagccttcttcagagatgccatgggcttcctgctgatgtttgacctgaccagccagcagagcttcctgaatgtgaggaactggatgagccagctgcaggccaatgcctactgtgagaacccagacatcgtgctgattggcaacaaggctgacctgcctgaccagcgggaggtgaatgaaaggcaggcccgggagctggccgacaagtatggcatcccctactttgagaccagcgctgccaccggccagaatgtggagaaggctgtggagaccctgctggacctgatcatgaagaggatggagcagtgtgtggagaagacccagatcccagacacagtgaatggaggcaacagcggcaacctggatggagagaagcccccagagaagaagtgcatctgctag

SEQ ID NO: 37334 - DNA, 654 bp, Artificial Sequence
  Description of Artificial Sequence: Synthetic coding sequence
atggagaccatctggatctaccagttccgcctcatcgtcatcggggacagcacagtgggcaagagctgcctgctgcaccgcttcacccagggccgcttccctggcctgcggagccctgcctgtgaccccaccgtgggcgtggacttcttcagccggctgctggagattgagcccgggaagaggatcaagctgcagctgtgggacacagctggccaggagcgcttccgcagcatcaccaggagctactacagaaacagcgtgggcggcttcctggtgtttgacatcaccaacagaagaagctttgaacatgtgaaggactggctggaggaggccaagatgtatgtgcagcccttccgcatcgtgttcctgctggtgggccacaagtgtgacctggccagccagaggcaggtgacccgggaggaggccgagaagctgtctgctgactgtggcatgaagtacatcgagaccagcgccaaggatgccaccaacgtggaggagagcttcaccatcctgacccgggacatctatgagctgatcaagaagggggagatctgcatccaggacggctgggagggcgtgaagagcggctttgtgcccaacacagtgcacagcagcgaggaggccgtgaagcccaggaaggagtgcttctgctag

SEQ ID NO: 37335 - DNA, 1737 bp, Artificial Sequence
  Description of Artificial Sequence: Synthetic coding sequence
atgaggcagcaggatgcccccaagcccaccccagctgcctgccgctgcagcggcctggccaggagagtgctgaccatcgcctttgccctgctgatcctgggcctgatgacctgggcctatgctgctggggtgcccctggccagtgacagatatggcctgctggccttcggcctgtatggagccttcctgagcgcccacctggtggcccagagcctgtttgcctacctggagcacagaagagtggccgccgccgcccggggccccctggatgctgccacagcccggtctgtggccctgaccatcagcgcctaccaggaggaccctgcctacctgcggcagtgcctggccagcgcccgggccctgctgtacccccgggcccggctgcgggtgctgatggtggtggatggcaacagagctgaggacctgtacatggtggacatgttccgggaggtgtttgctgatgaagatcctgccacctacgtgtgggatggcaactaccaccagccctgggagcctgctgctgctggagctgtgggcgctggggcctaccgggaggtggaggctgaagatcctggccgcctggccgtggaggccctggtgaggacccggcgctgtgtgtgtgtggcccagcgctggggcggcaagcgggaggtgatgtacacagccttcaaggccctgggggacagcgtggactatgtgcaggtgtgtgacagcgacacccggctggaccccatggccctgctggagctggtgcgggtgctggatgaggacccccgggtgggcgctgtgggcggagatgtgcgcatcctgaaccccctggacagctgggtgtccttcctgagcagcctgcgctactgggtggccttcaacgtggagcgggcctgccagagctacttccactgtgtgtcctgcatcagcggccccctgggcctgtacagaaacaacctgctgcagcagttcctggaggcctggtacaaccagaagttcctgggcacccactgcacctttggagatgacagacacctgaccaacaggatgctgtccatgggctacgccaccaagtacaccagccgcagccgctgctacagcgagacccccagcagcttcctgcgctggctgagccagcagacccgctggagcaagagctacttccgggagtggctgtacaatgccctgtggtggcaccgccaccacgcctggatgacctatgaagctgtggtgtctggcctcttccccttctttgtggccgccaccgtgctgcggctcttctacgccggccggccctgggccctgctgtgggtgctgctgtgtgtgcagggcgtggccctggccaaggccgcctttgctgcctggctgcggggctgcctgaggatggtgctgctgagcctgtatgcccccctgtacatgtgtggcctgctgcctgccaagttcctggccctggtgaccatgaaccagagcggctggggcaccagcggccgcaggaagctggccgccaactacgtgcccctgctgcccctggccctgtgggccctgctgctgctgggcggcctggtgcgctctgtggcccacgaggcccgggctgactggagcggccccagcagagctgctgaggcctaccacctggccgccggggccggggcctacgtgggctactgggtggccatgctgaccctgtactgggtgggcgtgcggcggctgtgcagaagaagaactggaggctacagagtgcaggtgtag

SEQ ID NO: 37336 - DNA, 834 bp, Artificial Sequence
  Description of Artificial Sequence: Synthetic coding sequence
atgtctgcccctggcagcccagaccaggcctatgacttcctgctgaagttcctgctggtgggggacagagatgtgggcaagtctgagatcctggagagcctgcaggatggagctgctgagagcccctacagccacctgggcggcatcgactacaagaccaccaccatcctgctggatggccagagggtgaagctgaagctgtgggacaccagcggccagggccgcttctgcaccatcttccgcagctacagcagaggagcccagggcgtcatcctggtgtatgacatcgccaaccgctggagctttgagggcatggaccgctggatcaagaagattgaggagcacgcccctggggtgcccaagatcctggtgggcaaccggctgcacctggccttcaagaggcaggtgccccgggagcaggcccaggcctatgcagagcggctgggcgtgaccttctttgaggtgagccccctgtgcaacttcaacatcatcgagagcttcacagagctggccagaattgtgctgctgcggcacaggatgaactggctgggccggcccagcaaggtgctgagcctgcaggacctgtgctgcaggaccatcgtgtcctgcacccctgtgcacctggtggacaagctgcccctgcccagcaccctgcggagccacctgaagagcttctccatggccaagggcctgaatgccaggatgatgaggggcctgagctacagcctgaccaccagcagcacccacaagagcagcctgtgcaaggtggagatcgtgtgccccccccagagcccccccaagaactgcaccaggaacagctgcaagatctcctag

SEQ ID NO: 37337 - DNA, 834 bp, Artificial Sequence; identical to SEQ ID NO: 37336
  Description of Artificial Sequence: Synthetic coding sequence

SEQ ID NO: 37338 - DNA, 837 bp, Artificial Sequence
  Description of Artificial Sequence: Synthetic coding sequence
atgtctgccctgggcagccctgtgcgggcctatgacttcctgctgaagttcctgctggtgggggacagtgatgtgggcaaaggagagatcctggccagcctgcaggatggagctgctgagagcccctacggccaccctgctggcatcgactacaagaccaccaccatcctgctggatggaagaagagtgaagctgcagctgtgggacaccagcggccagggccgcttctgcaccatcttccgcagctacagcagaggagcccagggcgtcatcctggtgtatgacatcgccaaccgctggagctttgatggcatcgaccgctggatcaaggagattgatgaacatgcccctggggtgcccaagatcctggtgggcaaccggctgcacctggccttcaagaggcaggtgcccacagagcaggcccaggcctatgcagagcggctgggcgtgaccttctttgaggtgagccccctgtgcaacttcaacatcacagagagcttcacagagctggccagaattgtgctgctgcggcacggcatggaccggctgtggaggcccagcaaggtgctgagcctgcaggacctgtgctgcagagctgtggtgtcctgcacccctgtgcacctggtggacaagctgcccctgcccatcgccctgcggagccacctgaagagcttctccatggccaacggcctgaatgccaggatgatgcatggaggcagctacagcctgaccaccagcagcacccacaagaggagcagcctgaggaaggtgaagctggtgcggcccccccagagcccccccaagaactgcaccaggaacagctgcaagatctcctag

SEQ ID NO: 37339 - DNA, 837 bp, Artificial Sequence; identical to SEQ ID NO: 37338
  Description of Artificial Sequence: Synthetic coding sequence

SEQ ID NO: 37340 - DNA, 1140 bp, Artificial Sequence
  Description of Artificial Sequence: Synthetic coding sequence
gagcagggcctgggcgcccgggccgcccccctgggcgccggccccccacccctgcggagcgccccccaggccggccacggctggggccggcgggctgtgaccatgtctgccctgggcagccctgtgcgggcctatgacttcctgctgaagttcctgctggtgggggacagtgatgtgggcaaaggagagatcctggccagcctgcaggatggagctgctgagagcccctacggccaccctgctggcatcgactacaagaccaccaccatcctgctggatggaagaagagtgaagctgcagctgtgggacaccagcggccagggccgcttctgcaccatcttccgcagctacagcagaggagcccagggcgtcatcctggtgtatgacatcgccaaccgctggagctttgatggcatcgaccgctggatcaaggagattgatgaacatgcccctggggtgcccaagatcctggtgggcaaccggctgcacctggccttcaagaggcaggtgcccacagagcaggcccaggcctatgcagagcggctgggcgtgaccttctttgaggtgagccccctgtgcaacttcaacatcacagagagcttcacagagctggccagaattgtgctgctgcggcacggcatggaccggctgtggaggcccagcaaggtgctgagcctgcaggacctgtgctgcagagctgtggtgtcctgcacccctgtgcacctggtggacaagctgcccctgcccatcgccctgcggagccacctgaagagcttctccatggccaacggcctgaatgccaggatgatgcatggaggcagctacagcctgaccaccagcagcacccacaagaggagcagcctgaggaaggtgaagctggtgcggcccccccagcccccccagaagctgcaccagaagcagctgcagaacttcctgaggaaggccctgaaggagaccaggaggaacctgagcagaagaagcagcgccctgcccccagctgctgggggctgcatcagtgaccccggcagcagcaggaggatgctgctggccaacgtgtgtgatgccttccgggtgatggagacccactaccctgtgggcctgcgcatcagcacctggatgtgcatgaagctgctcttctag

SEQ ID NO: 37341 - DNA, 846 bp, Artificial Sequence
  Description of Artificial Sequence: Synthetic coding sequence
atgggcagccagggcagccctgtgaagagctatgactacctgctgaagttcctgctggtgggggacagtgatgtgggcaaaggagagatcctggagagcctgcaggatggagctgctgagagcccctatgcctacagcaatggaattgactacaagaccaccaccatcctgctggatggaagaagagtgaagctggagctgtgggacaccagcggccagggccgcttctgcaccatcttccgcagctacagcagaggagcccagggcatcctgctggtgtatgacatcaccaaccgctggagctttgatggcatcgaccgctggatcaaggagattgatgaacatgcccctggggtgccccgcatcctggtgggcaaccggctgcacctggccttcaagaggcaggtgcccacagagcaggcccgggcctatgcagagaagaactgcatgaccttctttgaggtgagccccctgtgcaacttcaacgtcatcgagagcttcacagagctgagcagaattgtgctgatgagacatggcatggagaagatctggaggcccaacagagtcttcagcctgcaggacctgtgctgccgggccatcgtgtcctgcacccctgtgcacctgattgacaagctgcccctgcctgtgaccatcaagagccacctgaagagcttctccatggccaacggcatgaatgctgtgatgatgcacggccgcagctacagcctggccagcggggccggcggcggcggcagcaaaggaaacagcctgaagaggagcaagagcatccggcccccccagagccccccccagaactgcagccgcagcaactgcaagatctcctag

SEQ ID NO: 37342 - DNA, 846 bp, Artificial Sequence; identical to SEQ ID NO: 37341
  Description of Artificial Sequence: Synthetic coding sequence

SEQ ID NO: 37343 - DNA, 846 bp, Artificial Sequence; identical to SEQ ID NO: 37341
  Description of Artificial Sequence: Synthetic coding sequence

SEQ ID NO: 37344 - DNA, 846 bp, Artificial Sequence; identical to SEQ ID NO: 37341
  Description of Artificial Sequence: Synthetic coding sequence

SEQ ID NO: 37345 - DNA, 468 bp, Artificial Sequence
  Description of Artificial Sequence: Synthetic coding sequence
atggccggccctggccctggccctggggaccctgatgagcagtatgacttcctgttcaagctggtgctggtgggagatgcctctgtgggcaagacctgtgtggtgcagcgcttcaagacaggagccttcagcgagcggcagggcagcaccatcggcgtggacttcaccatgaagaccctggagatccagggcaagagggtgaagctgcagatctgggacacagctggccaggagcgcttccgcaccatcacccagagctactaccgcagcgccaacggggccatcctggcctatgacatcaccaagaggagcagcttcctgtctgtgccccactggattgaagatgtgaggaaatatgccggcagcaacatcgtgcagctgctgattgagatgcagagctgctacgtggcccaggccgacctggagctgctggccagcagcaaccccccagccagcaccagcaagtag

SEQ ID NO: 37346 - DNA, 639 bp, Artificial Sequence
  Description of Artificial Sequence: Synthetic coding sequence
atggccggccctggccctggccctggggaccctgatgagcagtatgacttcctgttcaagctggtgctggtgggagatgcctctgtgggcaagacctgtgtggtgcagcgcttcaagacaggagccttcagcgagcggcagggcagcaccatcggcgtggacttcaccatgaagaccctggagatccagggcaagagggtgaagctgcagatctgggacacagctggccaggagcgcttccgcaccatcacccagagctactaccgcagcgccaacggggccatcctggcctatgacatcaccaagaggagcagcttcctgtctgtgccccactggattgaagatgtgaggaaatatgccggcagcaacatcgtgcagctgctgattggcaacaagagtgacctgtctgagctgcgggaggtgtccctggccgaggcccagagcctggccgagcactatgacatcctgtgtgccatcgagaccagcgccaaggacagcagcaatgtggaggaggccttcctgcgggtggccacagagctgatcatgagacatggaggccccctcttcagcgagaagagcccagaccacatccagctgaacagcaaggacatcggggagggctggggctgcggctgctag

SEQ ID NO: 37347 - DNA, 639 bp, Artificial Sequence; identical to SEQ ID NO: 37346
  Description of Artificial Sequence: Synthetic coding sequence

SEQ ID NO: 37348 - DNA, 639 bp, Artificial Sequence; identical to SEQ ID NO: 37346
  Description of Artificial Sequence: Synthetic coding sequence

SEQ ID NO: 37349 - DNA, 639 bp, Artificial Sequence; identical to SEQ ID NO: 37346
  Description of Artificial Sequence: Synthetic coding sequence

SEQ ID NO: 37350 - DNA, 639 bp, Artificial Sequence; identical to SEQ ID NO: 37346
  Description of Artificial Sequence: Synthetic coding sequence

SEQ ID NO: 37351 - DNA, 261 bp, Artificial Sequence
  Description of Artificial Sequence: Synthetic coding sequence
atggccggccctggccctggccctggggaccctgatgagcagtatgacttcctgttcaagctggtgctggtgggagatgcctctgtgggcaagacctgtgtggtgcagcgcttcaagacaggagccttcagcgagcggcagggcagcaccatcggcgtggacttcaccatgaagaccctggagatccagggcaagagggtgaagctgcagatctgggacacagctggccaggagcgcttccgcaccatcacccagagctag

SEQ ID NO: 37352 - DNA, 624 bp, Artificial Sequence
  Description of Artificial Sequence: Synthetic coding sequence
atggccaagacctatgactacctgttcaagctgctgctgattggagacagcggcgtgggcaagacctgcctgctcttccgcttctctgaagatgccttcaacaccaccttcatcagcaccatcggcatcgacttcaagatccgcaccatcgagctggatggcaagaagatcaagctgcagatctgggacacagctggccaggagcgcttccgcaccatcaccacagcctactacagaggagccatgggcatcatgctggtgtatgacatcaccaatgagaagagctttgacaacatcaagaactggatccggaacatcgaggagcacgccagcagtgatgtggagaggatgatcctgggcaacaagtgtgacatgaatgacaagaggcaggtgtccaaggagcggggggagaagctggccattgattatggcatcaagttcctggagaccagcgccaagagcagcgccaacgtggaggaggccttcttcaccctggcccgggacatcatgaccaagctgaacaggaagatgaatgacagcaacagcgctggagctgggggccctgtgaagatcacagaaaatagaagcaagaagaccagcttcttccgctgcagcctgctgtag

SEQ ID NO: 37353 - DNA, 573 bp, Artificial Sequence
  Description of Artificial Sequence: Synthetic coding sequence
atggccaagacctatgactacctgttcaagctgctgctgattggagacagcggcgtgggcaagacctgcctgctcttccgcttctctgaagatgccttcaacaccaccttcatcagcaccatcggcatcgacttcaagatccgcaccatcgagctggatggcaagaagatcaagctgcagatctgggacacagctggccaggagcgcttccgcaccatcaccacagcctactacagaggagccatgggcatcatgctggtgtatgacatcaccaatgagaagagctttgacaacatcaagaactggatccggaacatcgaggagcacgccagcagtgatgtggagaggatgatcctgggcaacaagtgtgacatgaatgacaagaggcaggtgtccaaggagcggggggagaagctggccattgattatggcatcaagttcctggagaccagcgccaagagcagcgccaacgtggaggagaatgacagcaacagcgctggggccggcggccctgtgaagatcacagagaacagaagcaagaagaccagcttcttccgctgcagcctgctgtag

SEQ ID NO: 37354 - DNA, 966 bp, Artificial Sequence
  Description of Artificial Sequence: Synthetic coding sequence
atgaagcagctgcctgtgctggagcccggggacaagcccaggaaggccacctggtacaccctgactgtgcctggggacagcccctgtgcccgggtgggccacagctgcagctacctgccccctgtgggcaatgccaagaggggcaaggtgttcatcgtgggcggggccaaccccaacagaagcttcagtgatgtgcacaccatggacctggagaccaggacctggaccaccccagaggtgaccagccccccacccagccccaggaccttccacaccagcagcgctgccatcggcaaccagctgtatgtgtttggaggaggagagcggggggcccagcctgtgcaggacaccaagctgcacgtgtttgatgccaacaccctgacctggagccagcctgagaccctgggcaacccccccagccccaggcatggccacgtgatggtggccgccggcaccaagctgttcatccatggaggcctggccggggaccgcttctatgatgacctgcactgcatcgacatcagtgacatgaagtggcagaagctgaaccccactggagctgccccagctggctgtgccgcccacagcgctgtggccatgggcaagcacgtgtacatctttggaggcatgaccccagctggggccctggacaccatgtaccagtaccacacagaggagcagcactggaccctgctgaagtttgacaccctgctgcccccaggccgcctggaccacagcatgtgcatcatcccctggcctgtgacctgtgccagcgagaaggaggacagcaacagcctgaccctgaaccacgaggccgagaaggaggacagcgctgacaaggtgatgagccacagcggggacagccatgaggagagccagacagccaccctgctgtgcctggtgtttggaggcatgaacacagaaggagagatctatgatgactgcatcgtgacagtggtggactag

SEQ ID NO: 37355 - DNA, 1119 bp, Artificial Sequence
  Description of Artificial Sequence: Synthetic coding sequence
atgaagcagctgcctgtgctggagcccggggacaagcccaggaaggccacctggtacaccctgactgtgcctggggacagcccctgtgcccgggtgggccacagctgcagctacctgccccctgtgggcaatgccaagaggggcaaggtgttcatcgtgggcggggccaaccccaacagaagcttcagtgatgtgcacaccatggacctgggcaagcaccagtgggacctggacacctgcaagggcctgctgcccaggtatgaacatgccagcttcatccccagctgcaccccagaccgcatctgggtgtttggaggagccaaccagagcggcaacagaaactgcctgcaggtgctgaaccctgagaccaggacctggaccaccccagaggtgaccagccccccacccagccccaggaccttccacaccagcagcgctgccatcggcaaccagctgtatgtgtttggaggaggagagcggggggcccagcctgtgcaggacaccaagctgcacgtgtttgatgccaacaccctgacctggagccagcctgagaccctgggcaacccccccagccccaggcatggccacgtgatggtggccgccggcaccaagctgttcatccacggcggcctggccggggaccgcttctatgatgacctgcactgcatcgacatcagtgacatgaagtggcagaagctgaaccccaccggggccgccccagctggctgtgccgcccacagcgctgtggccatgggcaagcacgtgtacatctttggaggcatgaccccagctggggccctggacaccatgtaccagtaccacacagaggagcagcactggaccctgctgaagtttgacaccctgctgcccccaggccgcctggaccacagcatgtgcatcatcccctggcctgtgacctgtgccagcgagaaggaggacagcaacagcctgaccctgaaccatgaagctgagaaggaggacagcgctgacaaggtgatgagccacagcggggacagccatgaggagagccagacagccaccctgctgtgcctggtgtttggaggcatgaacacagaaggagagatctatgatgactgcatcgtgacagtggtggactag

SEQ ID NO: 37356 - DNA, 465 bp, Artificial Sequence
  Description of Artificial Sequence: Synthetic coding sequence
atgaagcagctgcctgtgctggagcccggggacaagcccaggaaggccacctggtacaccctgactgtgcctggggacagcccctgtgcccgggtgggccacagctgcagctacctgccccctgtgggcaatgccaagaggggcaaggtgttcatcgtgggcggggccaaccccaacagaagcttcagtgatgtgcacaccatggacctgggcaagcaccagtgggacctggacacctgcaagggcctgctgcccaggtatgaacatgccagcttcatccccagctgcaccccagaccgcatctgggtgtttggaggagccaaccagagcggcaacagaaactgcctgcaggtgctgaacccagccttcaagtcctggggcttctggacagtgctggccaaccccaagtaccacctgcacagcagcctgatgttcaagccaggccggggcccccggcagaagtag

SEQ ID NO: 37357 - DNA, 465 bp, Artificial Sequence; identical to SEQ ID NO: 37356
  Description of Artificial Sequence: Synthetic coding sequence

SEQ ID NO: 37358 - DNA, 1119 bp, Artificial Sequence; identical to SEQ ID NO: 37355
  Description of Artificial Sequence: Synthetic coding sequence

SEQ ID NO: 37359 - DNA, 735 bp, Artificial Sequence
  Description of Artificial Sequence: Synthetic coding sequence
ggccggggcagcccagacaccggcagcatcaccgtgtctggccgggagagcgagagcttccggggcgtgggccccagccgggtgcagaggacaggcaagggcctgccctggctgcggcccggccactttgaccgcatcagcctcttcttcccagaccctgtgtcctaccccctggagctgcccagaggagatgagatctgctgggccggcagcggcggctgctgcggccgcagccggccccgggaggccagcctgacagagctgtggaccctgggcacagctgtgtctggcctgggccgccgctacaccctgactgtgcctggggacagcccctgtgcccgggtgggccacagctgcagctacctgccccctgtgggcaatgccaagaggggcaaggtgttcatcgtgggcggggccaaccccaacagaagcttcagtgatgtgcacaccatggacctgggcaagcaccagtgggacctggacacctgcaagggcctgctgcccaggtatgagcacgccagcttcatccccagctgcaccccagaccgcatctgggtgtttggaggagccaaccagagcggcaacagaaactgcctgcaggtgctgaaccctgagaccaggacctggaccaccccagaggtgaccagccccccacccagccccaggaccttccacaccagcagcgctgccatcggcaaccagctgtatgtgtttggaggaggagagcggggctag

SEQ ID NO: 37360 - DNA, 606 bp, Artificial Sequence
  Description of Artificial Sequence: Synthetic coding sequence
atggccggcaagagcagcctcttcaaggtgatcctgctgggagatggaggagtgggcaagagcagcctgatgaacagatatgtgaccaacaagtttgacacccagctgttccacaccatcggcgtggagttcctgaacaaggacctggaggtggatggccactttgtgaccatgcagatctgggacacagctggccaggagcgcttccgcagcctgcggacccccttctaccggggcagtgactgctgcctgctgaccttctctgtggatgacagccagagcttccagaacctgagcaactggaagaaggagttcatctactatgcagatgtgaaggagcctgagagcttcccctttgtgatcctgggcaacaagattgacatcagcgagcggcaggtgtccacagaggaggcccaggcctggtgccgggacaatggagactacccctactttgagaccagcgccaaggatgccaccaacgtggccgccgcctttgaggaggccgtgcggcgggtgctggccacagaggacagaagtgaccacctgatccagacagacacagtgaacctgcacaggaagcccaagcccagcagcagctgctgctag

SEQ ID NO: 37361 - DNA, 1506 bp, Artificial Sequence
  Description of Artificial Sequence: Synthetic coding sequence
atgggctgcggcctgaggaagctggaggaccctgatgacagcagccctgggaagatcttcagcaccctgaagaggccccaggtggagaccaagacagaatttgcctatgaatatgtgctgctggacttcaccctgcaggccagcagcaaccctgaggtgatcaagatcaacagcatcctggacatcgtgaccaaggtggagaactactacctgaagggctacatcgtgggcgccatccaccctgtgatccagcctgtgggccagaggaagcacctgcctgccagctacctgtacagagtggtgctgctgcggctgaagctgagccccaagaacagcgctgcccccagcggccagaggcggccccggctggtgattgaagaatgtcccctgaccagcgaggcccagaccaatgatgctgccaaggagctgattgagaagatcaacgtggccgccaagaggggcatgaagtttgtgggcttcatcagccagcactacagccccagcaagttctgcaatggcaccaaccatgatggagacatcgagagcatgctgcacgtgcgccacggcagtgatgagaactgccgctcctggaatgaaggcaccctgagcggccagagcagcgagagcggcatcgaggaggagctgcaccatgaaagtggccagtaccagatggagcagaatggcagccccaccagcagcaagagcaggaaaggagaggccagtgacaacaagctgtacacagtgttcaatgcctttgatgatgacagcacctcctgggcctaccaggagggcatcctgtccatgaaggtgaccaggaaaggatctgtcatcagcaccctggatgctgactggctggagctgaccaccttctactacaagcagggcctgagcctgattgacagctttgtgttctgggagaccagcaaaggagagcacctgcccaagagcctggagggcttcttcatctatgaggaggagggcagcggcgtgcccggcagcagcaggaaaggaaatgatgccatcgtggtggagcagtggacagtgattgagggctgtgagatcaagacagattatggccccctgctgcacaccctggccgagtttggctggctgctgacctctgtgctgcccacccctgtgctgcggcatgattctgagggcaacctggccaccaagcagatcgtgttcctgcagaggcctgtgatgtggaacagcgctgcccagaccccagacaagaaggccagccgccacatcaagggggaggacaagaacaaggccaccagccgcagcatcggcctggacaccaccagcagccagcctgctgagagccgccacctgcctgaagaatgtcggctgagccccagccgggagtgctggaccaaggagggccgcctggcccagcacaacagcttcagcggcttcagcagcagtgacaacgtgctgcgggagctggatgatggccagtttgaccaggaggatggagtgacccaggtgacctgcatgtag

SEQ ID NO: 37362 - DNA, 1737 bp, Artificial Sequence
  Description of Artificial Sequence: Synthetic coding sequence
atgggctgcggcctgaacaagctggagaagagagatgagaagaggcctggcaacatctacagcaccctgaagaggccccaggtggagaccaagattgatgtgtcctatgagtaccgcttcctggagttcaccaccctgtctgctgctgagctgcccggcagcagcgctgtgcggctggccagcctgcgggacctgcctgcccagctgctggagctgtaccagcagggcttcagcctggccgccctgcacccctttgtgcagcccacccatgagcgggagaagacccccctggagcacatcttccgggccatcctgatcaagaagacagacaggagccagaagacagacctgcacaatgaaggctacatcctggagctggactgctgcagcagcctggaccaccccacagaccagaagctgatccctgagttcatcaagaagatccaggaggccgccagccagggcctgaagtttgtgggcgtcatcccccagtaccacagctctgtgaacagcgctggcagcagcgcccctgtgtccacagccaacagcacagaagatgccagagatgccaagaatgcccggggggaccacgccagcctggagaatgagaagccaggcactggagatgtgtgcagcgccccagctggaagaaaccagagccctgagcccagcagcggccccagaggagaggtgcccctggccaagcagcccagcagccccagcggggagggagatggaggagagctgagcccccagggcgtgtccaagaccctggatggccctgagagcaaccccctggaggtgcatgaggagcccctgagcggcaagatggagatcttcaccctcttcaacaagcccaagagccaccagaagtgccggcagtactaccctgtgaccatccccctgcacgtgtccaagaatggccagacagtgtctggcctggatgccaactggctggagcacatgtctgaccacttcaggaagggcggcatgctggtgaatgctgtgttctacctgggcatcgtgaatgacagcctgcacggcctgacagatggagtcttcatctttgaggccgtgtccacagaggacagcaagaccatccagggctatgatgccatcgtggtggagcagtggacagtgctggagggcgtggaggtgcagacagattatgtgcccctgctgaacagcctggccgcctacggctggcagctgacctgtgtgctgcccacccctgtggtgaagaccaccagcgagggctctgtgtccaccaagcagatcgtgttcctgcagaggccctgcctgccccagaagatcaagaagaaggagagcaagttccagtggaggttcagccgggaggagatgcacaaccggcagatgaggaagagcaagggcaagctgagcgcccgggacaagcagcaggccgaggagaatgagaagaacctggaggaccagagcagcaaggccggggacatgggcaactgtgtgtctggccagcagcaggagggcggcgtgtctgaggagatgaagggccctgtgcaggaggacaagggggagcagctgagccctgggggcctgctgtgtggggtgggcgtggagggggaggccgtgcagaatggacctgccagccacagccgggccctggtgggcatctgcaccggccacagcaaccctggagaagatgccagagatggagatgctgaggaggtgcgggagctgggcaccgtggaggagaactag

SEQ ID NO: 37363 - DNA, 345 bp, Artificial Sequence
  Description of Artificial Sequence: Synthetic coding sequence
atgggctgcggcctgaacaagctggagaagagagatgagaagaggcctggcaacatctacagcaccctgaagaggccccaggtggagaccaagattgatgtgtcctatgagtaccgcttcctggagttcaccaccctgtctgctgctgagctgcccggcagcagcgctgtgcggctggccagcctgcgggacctgcctgcccagctgctggagctgtaccagcagggcttcagcctggccgccctgcacccctttgtgcagcccacccatgagcgggagaagacccccctggagcacatcttccgggccatcctgatcaagaagacagacaggagccagaagtag

SEQ ID NO: 37364 - DNA, 450 bp, Artificial Sequence
  Description of Artificial Sequence: Synthetic coding sequence
atgggctgcggcctgaacaagctggagaagagagatgagaagaggcctggcaacatctacagcaccctgaagaggccccaggtggagaccaagattgatgtgtcctatgagtaccgcttcctggagttcaccaccctgtctgctgctgagctgcccggcagcagcgctgtgcggctggccagcctgcgggacctgcctgcccagctgctggagctgtaccagcagggcttcagcctggccgccctgcacccctttgtgcagcccacccatgagcgggagaagacccccctggagcacatcttccgggccatcctgatcaagaagacagacaggagccagaagacagacctgcacaatgaaggctacatcctggagctggactgctgcagcagcctggaccaccccacagaccagaagctgatccctgagttcatcaagaagatccagtag

SEQ ID NO: 37365 - DNA, 450 bp, Artificial Sequence; identical to SEQ ID NO: 37364
  Description of Artificial Sequence: Synthetic coding sequence

SEQ ID NO: 37366 - DNA, 828 bp, Artificial Sequence
  Description of Artificial Sequence: Synthetic coding sequence
atgggctgcggcctgaacaagctggagaagagagatgagaagaggcctggcaacatctacagcaccctgaagaggccccaggtggagaccaagattgatgtgtcctatgagtaccgcttcctggagttcaccaccctgtctgctgctgagctgcccggcagcagcgctgtgcggctggccagcctgcgggacctgcctgcccagctgctggagctgtaccagcagggcttcagcctggccgccctgcacccctttgtgcagcccacccatgagcgggagaagacccccctggagcacatcttccgggccatcctgatcaagaagacagacaggagccagaagacagacctgcacaatgaaggctacatcctggagctggactgctgcagcagcctggaccaccccacagaccagaagctgatccctgagttcatcaagaagatccaggaggccgccagccagggcctgaagtttgtgggcgtcatcccccagtaccacagctctgtgaacagcgctggcagcagcgcccctgtgtccacagccaacagcacagaagatgccagagatgccaagaatgcccggggggaccacgccagcctggagaatgagaagccaggcactggagatgtgtgcagcgccccagctggaagaaaccagagccctgagcccagcagcggccccagaggagaggtgcccctggccaagcagcccagcagccccagcggggagggagatggaggagagctgagcccccagggcgtgtccaagaccctggatggccctgagagcaaccccctggaggtgcatgaggagcccctgagcggctag

SEQ ID NO: 37367 - DNA, 1647 bp, Artificial Sequence
  Description of Artificial Sequence: Synthetic coding sequence
atggacctgatgaatggccaggccagctctgtgaacattgctgccacagccagcgagggccagatcaccctgatggatgtgcctgtgttcaaggccatccagccagatgagctgagcagctgtggctggaacaagaaggagaagtacagcagcgccccaaatgctgtggccttcacccggcgcttcaaccacgtgtccttctgggtggtgcgggagatcctgcacgcccagaccctgaagatccgggcagaggtgctgagccactacatcaagacagccaagaagctgtatgagctgaacaacctgcacgccctgatggctgtggtgtctggcctgcagagcgcccccatcttccggctgaccaagacctgggccctgctgagcaggaaggacaagaccacctttgagaagctggagtatgtgatgagcaaagaagacaactacaagaggctgcgggactacatcagcagcctgaagatgaccccctgcatcccctacctgggcatctacctgagtgacctgacctacattgattctgcctaccccagcacaggcagcatcctggagaatgagcagaggagcaacctgatgaacaacatcctgcgcatcatcagtgacctgcagcagagctgtgaatatgacatccccatgctgccccacgtgcagaagtacctgaacagcgtgcagtacatcgaggagctgcagaagtttgtggaggatgacaactacaagctgagcctgaagattgagcccggcaccagcacccccaggtctgctgccagccgggaggacctggtgggccctgaggtgggcgccagcccccagagcggcaggaagtctgtggccgctgagggcgccctgctgccccagaccccacccagccccaggaacctgatcccccacggccacaggaagtgccacagcctgggctacaacttcatccacaagatgaacacagctgagttcaagagcgccaccttccccaatgccggccccaggcacctgctggatgattctgtgatggagccccacgcccccagccggggccaggccgagagcagcaccctgagcagcggcatcagcatcggcagcagtgatggcagcgagctgtctgaggagacctcctggccagcctttgaaagaaaccggctgtaccacagcctgggccctgtgaccagggtggccagaaatggctaccgcagccacatgaaggccagcagcagcgctgagagcgaggacctggccgtgcacctgtacccaggagctgtgaccatccagggcgtgctgcggaggaagaccctgctgaaggagggcaagaagcccaccgtggcctcctggaccaagtactgggccgccctgtgtggcacccagctgttctactatgctgccaagagcctgaaggccacagagaggaagcacttcaagagcaccagcaacaagaatgtgtctgtgattggctggatggtgatgatggctgatgatcctgagcacccagacctcttcctgctgacagacagcgagaagggcaacagctacaagttccaggccggcaacaggatgaatgccatgctgtggttcaagcacctgtctgctgcctgccagagcaacaagcagcaggtgcccaccaacctgatgacctttgaatag

SEQ ID NO: 37368 - DNA, 1674 bp, Artificial Sequence
  Description of Artificial Sequence: Synthetic coding sequence
atggacctgatgaatggccaggccagctctgtgaacattgctgccacagccagcgagaagagcagcagcagcgagagcctgagtgacaagggcagcgagctgaagaagagctttgatgctgtggtgtttgatgtgctgaaggtgaccccagaggagtatgccggccagatcaccctgatggatgtgcctgtgttcaaggccatccagccagatgagctgagcagctgtggctggaacaagaaggagaagtacagcagcgccccaaatgctgtggccttcacccggcgcttcaaccacgtgtccttctgggtggtgcgggagatcctgcacgcccagaccctgaagatccgggcagaggtgctgagccactacatcaagacagccaagaagctgtatgagctgaacaacctgcacgccctgatggctgtggtgtctggcctgcagagcgcccccatcttccggctgaccaagacctgggccctgctgagcaggaaggacaagaccacctttgagaagctggagtatgtgatgagcaaggaggacaactacaagaggctgcgggactacatcagcagcctgaagatgaccccctgcatcccctacctgggcatctacctgagtgacctgacctacatcgacagcgcctaccccagcacaggcagcatcctggagaatgagcagaggagcaacctgatgaacaacatcctgcgcatcatcagtgacctgcagcagagctgtgaatatgacatccccatgctgccccacgtgcagaagtacctgaacagcgtgcagtacatcgaggagctgcagaagtttgtggaggatgacaactacaagctgagcctgaagattgagcccggcaccagcacccccaggtctgctgccagccgggaggacctggtgggccctgaggtgggcgccagcccccagagcggcaggaagtctgtggccgctgagggcgccctgctgccccagaccccacccagccccaggaacctgatcccccacggccacaggaagtgccacagcctgggctacaacttcatccacaagatgaacacagctgagttcaagagcgccaccttccccaatgccggccccaggcacctgctggatgacagcgtgatggagccccacgcccccagccggggccaggccgagagcagcaccctgagcagcggcatcagcatcggcagcagtgatggcagcgagctgtctgaggagacctcctggccagcctttgagagcagcgctgagagcgaggacctggccgtgcacctgtacccaggagctgtgaccatccagggcgtgctgcggaggaagaccctgctgaaggagggcaagaagcccaccgtggcctcctggaccaagtactgggccgccctgtgtggcacccagctgttctactatgctgccaagagcctgaaggccacagagaggaagcacttcaagagcaccagcaacaagaatgtgtctgtcatcggctggatggtgatgatggctgatgatcctgagcacccagacctcttcctgctgacagattctgagaagggcaacagctacaagttccaggccggcaacaggatgaatgccatgctgtggttcaagcacctgtctgctgcctgccagagcaacaagcagcaggtgcccaccaacctgatgacctttgaatag

SEQ ID NO: 37369 - DNA, 1752 bp, Artificial Sequence
  Description of Artificial Sequence: Synthetic coding sequence
atggacctgatgaatggccaggccagctctgtgaacattgctgccacagccagcgagaagagcagcagcagcgagagcctgagtgacaagggcagcgagctgaagaagagctttgatgctgtggtgtttgatgtgctgaaggtgaccccagaggagtatgccggccagatcaccctgatggatgtgcctgtgttcaaggccatccagccagatgagctgagcagctgtggctggaacaagaaggagaagtacagcagcgccccaaatgctgtggccttcacccggcgcttcaaccacgtgtccttctgggtggtgcgggagatcctgcacgcccagaccctgaagatccgggcagaggtgctgagccactacatcaagacagccaagaagctgtatgagctgaacaacctgcacgccctgatggctgtggtgtctggcctgcagagcgcccccatcttccggctgaccaagacctgggccctgctgagcaggaaggacaagaccacctttgagaagctggagtatgtgatgagcaaggaggacaactacaagaggctgcgggactacatcagcagcctgaagatgaccccctgcatcccctacctgggcatctacctgagtgacctgacctacatcgacagcgcctaccccagcacaggcagcatcctggagaatgagcagaggagcaacctgatgaacaacatcctgcgcatcatcagtgacctgcagcagagctgtgaatatgacatccccatgctgccccacgtgcagaagtacctgaacagcgtgcagtacatcgaggagctgcagaagtttgtggaggatgacaactacaagctgagcctgaagattgagcccggcaccagcacccccaggtctgctgccagccgggaggacctggtgggccctgaggtgggcgccagcccccagagcggcaggaagtctgtggccgctgagggcgccctgctgccccagaccccacccagccccaggaacctgatcccccacggccacaggaagtgccacagcctgggctacaacttcatccacaagatgaacacagctgagttcaagagcgccaccttccccaatgccggccccaggcacctgctggatgacagcgtgatggagccccacgcccccagccggggccaggccgagagcagcaccctgagcagcggcatcagcatcggcagcagtgatggcagcgagctgtctgaggagacctcctggccagcctttgagaggaacagactctaccacagcctgggccctgtgaccagggtggccagaaatggctaccgcagccacatgaaggccagcagcagcgctgagagcgaggacctggccgtgcacctgtacccaggagctgtgaccatccagggcgtgctgcggaggaagaccctgctgaaggagggcaagaagcccaccgtggcctcctggaccaagtactgggccgccctgtgtggcacccagctgttctactatgctgccaagagcctgaaggccacagagaggaagcacttcaagagcaccagcaacaagaatgtgtctgtcatcggctggatggtgatgatggctgatgatcctgagcacccagacctcttcctgctgacagattctgagaagggcaacagctacaagttccaggccggcaacaggatgaatgccatgctgtggttcaagcacctgtctgctgcctgccagagcaacaagcagcaggtgcccaccaacctgatgacctttgaatag

SEQ ID NO: 37370 - DNA, 699 bp, Artificial Sequence
  Description of Artificial Sequence: Synthetic coding sequence
atgaacacagctgagttcaagagcgccaccttccccaatgccggccccaggcacctgctggatgattctgtgatggagccccacgcccccagccggggccaggccgagagcagcaccctgagcagcggcatcagcatcggcagcagtgatggcagcgagctgtctgaggagacctcctggccagcctttgaaagaaaccggctgtaccacagcctgggccctgtgaccagggtggccagaaatggctaccgcagccacatgaaggccagcagcagcgctgagagcgaggacctggccgtgcacctgtacccaggagctgtgaccatccagggcgtgctgcggaggaagaccctgctgaaggagggcaagaagcccaccgtggcctcctggaccaagtactgggccgccctgtgtggcacccagctgttctactatgctgccaagagcctgaaggccacagagaggaagcacttcaagagcaccagcaacaagaatgtgtctgtgattggctggatggtgatgatggctgatgatcctgagcacccagacctcttcctgctgacagacagcgagaagggcaacagctacaagttccaggccggcaacaggatgaatgccatgctgtggttcaagcacctgtctgctgcctgccagagcaacaagcagcaggtgcccaccaacctgatgacctttgaatag

SEQ ID NO: 37371 - DNA, 2388 bp, Artificial Sequence
  Description of Artificial Sequence: Synthetic coding sequence
atggagggcctgaccctgagtgatgctgagcagaagtactacagcgacctcttctcctactgtgacatcgagagcaccaagaaggtggtggtgaatggccgggtgctggagctgttccgggccgcccagctgcccaatgatgtggtgctgcagatcatggagctgtgtggggccacccggctgggctacttcggccgcagccagttctacatcgccctgaagctggtggccgtggcccagagcggcttccccctgcgggtggagagcatcaacacagtgaaggacctgcccctgcccaggtttgtggccagcaagaatgagcaggagagcagacatgctgccagctacagcagtgacagcgagaaccagggcagctacagcggggtcatccccccacctcctggccggggccaggtgaagaagggctctgtgtcccatgacacagtgcagcccaggaccagcgcagatgcccaggagcccgccagccctgtggtgagcccccagcagagcccccccaccagcccccacacctggaggaagcacagccgccaccccagcggcggcaacagcgagcggcccctggccggccctggccccttctggagcccctttggagaggcccagagcggcagcagcgctggagatgctgtgtggagcggccacagccccccaccaccccaggagaactgggtgtcctttgctgacaccccacccaccagcaccctgctgaccatgcacccagcctctgtgcaggaccagaccaccgtgaggacagtggccagcgccaccacagccatcgagatccggcggcagagcagcagctatgatgacccctggaagatcacagatgagcagaggcagtactacgtgaaccagttcaagaccatccagcctgacctgaatggcttcatccctggcagcgctgccaaggagttcttcaccaagagcaagctgcccatcctggagctgagccacatctgggagctgagtgactttgacaaggatggagccctgaccctggatgagttctgtgccgccttccacctggtggtggccaggaagaatggctatgacctgcctgagaagctgcctgagagcctgatgcccaagctgattgacctggaggacagcgcagatgtgggggaccagcccggggaggtgggctacagcggcagccctgctgaggccccacccagcaagagccccagcatgcccagcctgaaccagacctggccagagctgaaccagagcagcgagcagtgggagaccttcagcgagaggagcagcagcagccagaccctgacccagtttgacagcaacatcgccccagctgaccctgacacagccatcgtgcaccctgtgcccatccgcatgacccccagcaagatccacatgcaggagatggagctgaagaggactggaagtgaccacaccaaccccaccagccccctgctggtgaagcccagcgacctgctggaggagaacaagatcaacagctctgtgaagtttgccagcggcaacacagtggatggctacagcagcagtgacagcttcaccagtgaccctgagcagatcggcagcaatgtgacccggcagaggagccacagcggcaccagcccagacaacacagcccctcctcctcctccaccccggccccagcccagccacagccgcagcagcagcctggacatgaacagaaccttcaccgtgaccaccggccagcagcaggccggcgtggtggcccaccccccagctgtgcccccccggccccagcccagccaggcccctggccctgctgtgcacaggcctgtggatgctgatggcctcatcacccacaccagcaccagcccccagcagatccctgagcagcccaactttgctgacttcagccagtttgaggtgtttgctgccagcaatgtgaatgatgagcaggatgatgaggccgagaagcaccctgaggtgctgcctgctgagaaggccagtgaccctgccagcagcctgcgggtggccaagacagacagcaagacagaggagaagacagctgccagcgccccagccaacgtgtccaagggcaccacccccctggcccccccacccaagcctgtgagaagaaggctgaagtcagaagatgagctgcggcctgaggtggatgagcacacccagaagacaggagtgctggccgctgtgctggccagccagcccagcatccccaggtctgtgggcaaggacaagaaggccatccaggccagcatcagaagaaacaaggagaccaacacagtgctggcccggctgaacagcgagctgcagcagcagctgaaggatgtgctggaggagcgcatcagcctggaggtgcagctggagcagctgcggcccttcagccacctgtag

SEQ ID NO: 37372 - DNA, 2310 bp, Artificial Sequence
  Description of Artificial Sequence: Synthetic coding sequence
atggagggcctgaccctgagtgatgctgagcagaagtactacagcgacctcttctcctactgtgacatcgagagcaccaagaaggtggtggtgaatggccgggtgctggagctgttccgggccgcccagctgcccaatgatgtggtgctgcagatcatggagctgtgtggggccacccggctgggctacttcggccgcagccagttctacatcgccctgaagctggtggccgtggcccagagcggcttccccctgcgggtggagagcatcaacacagtgaaggacctgcccctgcccaggtttgtggccagcaagaatgagcaggagagcagacatgctgccagctacagcagtgacagcgagaaccagggcagctacagcggggtcatccccccacctcctggccggggccaggtgaagaagggctctgtgtcccatgacacagtgcagcccaggaccagcgcagatgcccaggagcccgccagccctgtggtgagcccccagcagagcccccccaccagcccccacacctggaggaagcacagccgccaccccagcggcggcaacagcgagcggcccctggccggccctggccccttctggagcccctttggagaggcccagagcggcagcagcgctggagatgctgtgtggagcggccacagccccccaccaccccaggagaactgggtgtcctttgctgacaccccacccaccagcaccctgctgaccatgcacccagcctctgtgcaggaccagaccaccgtgaggacagtggccagcgccaccacagccatcgagatccggcggcagagcagcagctatgatgacccctggaagatcacagatgagcagaggcagtactacgtgaaccagttcaagaccatccagcctgacctgaatggcttcatccctggcagcgctgccaaggagttcttcaccaagagcaagctgcccatcctggagctgagccacatctgggagctgagtgactttgacaaggatggagccctgaccctggatgagttctgtgccgccttccacctggtggtggccaggaagaatggctatgacctgcctgagaagctgcctgagagcctgatgcccaagctgattgacctggaggacagcgcagatgtgggggaccagcccggggaggtgggctacagcggcagccctgctgaggccccacccagcaagagccccagcatgcccagcctgaaccagacctggccagagctgaaccagagcagcgaggacacagccatcgtgcaccctgtgcccatccgcatgacccccagcaagatccacatgcaggagatggagctgaagaggacaggcagtgaccacaccaaccccaccagccccctgctggtgaagcccagcgacctgctggaggagaacaagatcaacagctctgtgaagtttgccagcggcaacacagtggctgatggctacagcagcagtgacagcttcaccagtgaccctgagcagatcggcagcaatgtgacccggcagaggagccacagcggcaccagcccagacaacacagcccctcctcctcctccaccccggccccagcccagccacagccgcagcagcagcctggacatgaacagaaccttcaccgtgaccaccggccagcagcaggccggcgtggtggcccaccccccagctgtgcccccccggccccagcccagccaggcccctggccctgctgtgcacaggcctgtggatgctgatggcctcatcacccacaccagcaccagcccccagcagatccctgagcagcccaactttgctgacttcagccagtttgaggtgtttgctgccagcaatgtgaatgatgagcaggatgatgaggccgagaagcaccctgaggtgctgcctgctgagaaggccagtgaccctgccagcagcctgcgggtggccaagacagacagcaagacagaggagaagacagctgccagcgccccagccaacgtgtccaagggcaccacccccctggcccccccacccaagcctgtgagaagaaggctgaagtcagaagatgagctgcggcctgaggtggatgagcacacccagaagacaggagtgctggccgctgtgctggccagccagcccagcatccccaggtctgtgggcaaggacaagaaggccatccaggccagcatcagaagaaacaaggagaccaacacagtgctggcccggctgaacagcgagctgcagcagcagctgaaggatgtgctggaggagcgcatcagcctggaggtgcagctggagcagctgcggcccttcagccacctgtag

SEQ ID NO: 37373 - DNA, 2235 bp, Artificial Sequence
  Description of Artificial Sequence: Synthetic coding sequence
atggagctgtgtggggccacccggctgggctacttcggccgcagccagttctacatcgccctgaagctggtggccgtggcccagagcggcttccccctgcgggtggagagcatcaacacagtgaaggacctgcccctgcccaggtttgtggccagcaagaatgagcaggagagcagacatgctgccagctacagcagtgacagcgagaaccagggcagctacagcggggtcatccccccacctcctggccggggccaggtgaagaagggctctgtgtcccatgacacagtgcagcccaggaccagcgcagatgcccaggagcccgccagccctgtggtgagcccccagcagagcccccccaccagcccccacacctggaggaagcacagccgccaccccagcggcggcaacagcgagcggcccctggccggccctggccccttctggagcccctttggagaggcccagagcggcagcagcgctggagatgctgtgtggagcggccacagccccccaccaccccaggagaactgggtgtcctttgctgacaccccacccaccagcaccctgctgaccatgcacccagcctctgtgcaggaccagaccaccgtgaggacagtggccagcgccaccacagccatcgagatccggcggcagagcagcagctatgatgacccctggaagatcacagatgagcagaggcagtactacgtgaaccagttcaagaccatccagcctgacctgaatggcttcatccctggcagcgctgccaaggagttcttcaccaagagcaagctgcccatcctggagctgagccacatctgggagctgagtgactttgacaaggatggagccctgaccctggatgagttctgtgccgccttccacctggtggtggccaggaagaatggctatgacctgcctgagaagctgcctgagagcctgatgcccaagctgattgacctggaggacagcgcagatgtgggggaccagcccggggaggtgggctacagcggcagccctgctgaggccccacccagcaagagccccagcatgcccagcctgaaccagacctggccagagctgaaccagagcagcgagcagtgggagaccttcagcgagaggagcagcagcagccagaccctgacccagtttgacagcaacatcgccccagctgaccctgacacagccatcgtgcaccctgtgcccatccgcatgacccccagcaagatccacatgcaggagatggagctgaagaggactggaagtgaccacaccaaccccaccagccccctgctggtgaagcccagcgacctgctggaggagaacaagatcaacagctctgtgaagtttgccagcggcaacacagtggctgatggctacagcagcagtgacagcttcaccagtgaccctgagcagatcggcagcaatgtgacccggcagaggagccacagcggcaccagcccagacaacacagcccctcctcctcctccaccccggccccagcccagccacagccgcagcagcagcctggacatgaacagaaccttcaccgtgaccaccggccagcagcaggccggcgtggtggcccaccccccagctgtgcccccccggccccagcccagccaggcccctggccctgctgtgcacaggcctgtggatgctgatggcctcatcacccacaccagcaccagcccccagcagatccctgagcagcccaactttgctgacttcagccagtttgaggtgtttgctgccagcaatgtgaatgatgagcaggatgatgaagctgagaagcaccctgaggtgctgcctgctgagaaggccagtgaccctgccagcagcctgcgggtggccaagacagacagcaagacagaggagaagacagctgccagcgccccagccaacgtgtccaagggcaccacccccctggcccccccacccaagcctgtgagaagaaggctgaagtcagaagatgagctgcggcctgaggtggatgagcacacccagaagacaggagtgctggccgctgtgctggccagccagcccagcatccccaggtctgtgggcaaggacaagaaggccatccaggccagcatcagaagaaacaaggagaccaacacagtgctggcccggctgaacagcgagctgcagcagcagctgaaggatgtgctggaggagcgcatcagcctggaggtgcagctggagcagctgcggcccttcagccacctgtag

SEQ ID NO: 37374 - DNA, 2118 bp, Artificial Sequence
  Description of Artificial Sequence: Synthetic coding sequence
atggagggcctgaccctgagtgatgctgagcagaagtactacagcgacctcttctcctactgtgacatcgagagcaccaagaaggtggtggtgaatggccgggtgctggagctgttccgggccgcccagctgcccaatgatgtggtgctgcagatcatggagctgtgtggggccacccggctgggctacttcggccgcagccagttctacatcgccctgaagctggtggccgtggcccagagcggcttccccctgcgggtggagagcatcaacacagtgaaggacctgcccctgcccaggtttgtggccagcaagaatgagcaggagagcagacatgctgccagctacagcagtgacagcgagaaccagggcagctacagcggggtcatccccccacctcctggccggggccaggtgaagaagggctctgtgtcccatgacacagtgcagcccaggaccagcgcagatgcccaggagcccgccagccctgtggtgagcccccagcagagcccccccaccagcccccacacctggaggaagcacagccgccaccccagcggcggcaacagcgagcggcccctggccggccctggccccttctggagcccctttggagaggcccagagcggcagcagcgctggagatgctgtgtggagcggccacagccccccaccaccccaggagaactgggtgtcctttgctgacaccccacccaccagcaccctgctgaccatgcacccagcctctgtgcaggaccagaccaccgtgaggacagtggccagcgccaccacagccatcgagatccggcggcagagcagcagctatgatgacccctggaagatcacagatgagcagaggcagtactacgtgaaccagttcaagaccatccagcctgacctgaatggcttcatccctggcagcgctgccaaggagttcttcaccaagagcaagctgcccatcctggagctgagccacatctgggagctgagtgactttgacaaggatggagccctgaccctggatgagttctgtgccgccttccacctggtggtggccaggaagaatggctatgacctgcctgagaagctgcctgagagcctgatgcccaagctgattgacctggaggacagcgcagatgtgggggaccagcccggggaggtgggctacagcggcagccctgctgaggccccacccagcaagagccccagcatgcccagcctgaaccagacctggccagagctgaaccagagcagcgaggacacagccatcgtgcaccctgtgcccatccgcatgacccccagcaagatccacatgcaggagatggagctgaagaggacaggcagtgaccacaccaaccccaccagccccctgctggtgaagcccagcgacctgctggaggagaacaagatcaacagctctgtgaagtttgccagcggcaacacagtgggccagcagcaggccggcgtggtggcccaccccccagctgtgcccccccggccccagcccagccaggcccctggccctgctgtgcacaggcctgtggatgctgatggcctcatcacccacaccagcaccagcccccagcagatccctgagcagcccaactttgctgacttcagccagtttgaggtgtttgctgccagcaatgtgaatgatgagcaggatgatgaggccgagaagcaccctgaggtgctgcctgctgagaaggccagtgaccctgccagcagcctgcgggtggccaagacagacagcaagacagaggagaagacagctgccagcgccccagccaacgtgtccaagggcaccacccccctggcccccccacccaagcctgtgagaagaaggctgaagtcagaagatgagctgcggcctgaggtggatgagcacacccagaagacaggagtgctggccgctgtgctggccagccagcccagcatccccaggtctgtgggcaaggacaagaaggccatccaggccagcatcagaagaaacaaggagaccaacacagtgctggcccggctgaacagcgagctgcagcagcagctgaaggatgtgctggaggagcgcatcagcctggaggtgcagctggagcagctgcggcccttcagccacctgtag

SEQ ID NO: 37375 - DNA, 2391 bp, Artificial Sequence
  Description of Artificial Sequence: Synthetic coding sequence
atggagggcctgaccctgagtgatgctgagcagaagtactacagcgacctcttctcctactgtgacatcgagagcaccaagaaggtggtggtgaatggccgggtgctggagctgttccgggccgcccagctgcccaatgatgtggtgctgcagatcatggagctgtgtggggccacccggctgggctacttcggccgcagccagttctacatcgccctgaagctggtggccgtggcccagagcggcttccccctgcgggtggagagcatcaacacagtgaaggacctgcccctgcccaggtttgtggccagcaagaatgagcaggagagcagacatgctgccagctacagcagtgacagcgagaaccagggcagctacagcggggtcatccccccacctcctggccggggccaggtgaagaagggctctgtgtcccatgacacagtgcagcccaggaccagcgcagatgcccaggagcccgccagccctgtggtgagcccccagcagagcccccccaccagcccccacacctggaggaagcacagccgccaccccagcggcggcaacagcgagcggcccctggccggccctggccccttctggagcccctttggagaggcccagagcggcagcagcgctggagatgctgtgtggagcggccacagccccccaccaccccaggagaactgggtgtcctttgctgacaccccacccaccagcaccctgctgaccatgcacccagcctctgtgcaggaccagaccaccgtgaggacagtggccagcgccaccacagccatcgagatccggcggcagagcagcagctatgatgacccctggaagatcacagatgagcagaggcagtactacgtgaaccagttcaagaccatccagcctgacctgaatggcttcatccctggcagcgctgccaaggagttcttcaccaagagcaagctgcccatcctggagctgagccacatctgggagctgagtgactttgacaaggatggagccctgaccctggatgagttctgtgccgccttccacctggtggtggccaggaagaatggctatgacctgcctgagaagctgcctgagagcctgatgcccaagctgattgacctggaggacagcgcagatgtgggggaccagcccggggaggtgggctacagcggcagccctgctgaggccccacccagcaagagccccagcatgcccagcctgaaccagacctggccagagctgaaccagagcagcgagcagtgggagaccttcagcgagaggagcagcagcagccagaccctgacccagtttgacagcaacatcgccccagctgaccctgacacagccatcgtgcaccctgtgcccatccgcatgacccccagcaagatccacatgcaggagatggagctgaagaggactggaagtgaccacaccaaccccaccagccccctgctggtgaagcccagcgacctgctggaggagaacaagatcaacagctctgtgaagtttgccagcggcaacacagtggctgatggctacagcagcagtgacagcttcaccagtgaccctgagcagatcggcagcaatgtgacccggcagaggagccacagcggcaccagcccagacaacacagcccctcctcctcctccaccccggccccagcccagccacagccgcagcagcagcctggacatgaacagaaccttcaccgtgaccaccggccagcagcaggccggcgtggtggcccaccccccagctgtgcccccccggccccagcccagccaggcccctggccctgctgtgcacaggcctgtggatgctgatggcctcatcacccacaccagcaccagcccccagcagatccctgagcagcccaactttgctgacttcagccagtttgaggtgtttgctgccagcaatgtgaatgatgagcaggatgatgaagctgagaagcaccctgaggtgctgcctgctgagaaggccagtgaccctgccagcagcctgcgggtggccaagacagacagcaagacagaggagaagacagctgccagcgccccagccaacgtgtccaagggcaccacccccctggcccccccacccaagcctgtgagaagaaggctgaagtcagaagatgagctgcggcctgaggtggatgagcacacccagaagacaggagtgctggccgctgtgctggccagccagcccagcatccccaggtctgtgggcaaggacaagaaggccatccaggccagcatcagaagaaacaaggagaccaacacagtgctggcccggctgaacagcgagctgcagcagcagctgaaggatgtgctggaggagcgcatcagcctggaggtgcagctggagcagctgcggcccttcagccacctgtag

SEQ ID NO: 37376 - DNA, 441 bp, Artificial Sequence
  Description of Artificial Sequence: Synthetic coding sequence
gagctgaaccagagcagcgagtgggagaccttcagcgagaggagcagcagcagccagaccctgacccagtttgacagcaacatcgccccagctgaccctgacacagccatcgtgcaccctgtgcccatccgcatgacccccagcaagatccacatgcaggagatggagctgaagaggacaggcagtgaccacaccaaccccaccagccccctgctggtgaagcccagcgacctgctggaggagaacaagatcaacagctctgtgaagtttgccagcggcaacacagtgggccagcagcaggccggcgtggtggcccaccccccagctgtgcccccccggccccagcccagccaggcccctggccctgctgtgcacaggcctgtggatgctgatggcctcatcacccacaccagcaccagcccccagcagatccctgagtag

SEQ ID NO: 37377 - DNA, 1398 bp, Artificial Sequence
  Description of Artificial Sequence: Synthetic coding sequence
atgaccaccatccccaggaagggcagcagccacctgcccggcagcctgcacacctgcaagctgaagctgcaggaggaccggcggcagcaggagaagtctgtgattgcccagcccatctttgtgtttgagaagggggagcagaccttcaagaggcctgctgaggacaccctgtatgaggccgctgagcctgagtgcaatggcttccccaccaagagggtgcgcagcagcagcttcaccttccacatcacagacagccagagccagggcgtgaggaagaacaacgtgttcatgaccagcgccctggtgcagagctctgtggacatcaagtctgctgagcagggccctgtgaagcacagcaagcacgtgatccggcctgccatcctgcagctgccccaggcccggagctgtgccaaggtgaggaagaccttcggccacaaggccctggagagctgcaagaccaaggagaagaccaacaacaagatcagcgagggcaacagctacctgctgtctgagaacctgagccgggcccgcatctctgtgcagctgagcaccaaccaggacttcctgggcgccacctctgtgggctgccagcccaatgaagacaagtgcagcttcaagagctgcagcagcaactttgtgtttggagagaacatggtggagcgggtgctgggcacccagaagctgacccagccccagctggagaatgacagctatgccaaggagaagcccttcaagagcatccccaagtttcctgtgaacttcctgagcagcaggacagacagcatcaagaacaccagcctcatcgagagcgctgctgccttcagcagccagcccagcaggaagtgcctgctggagaagattgatgtgatcactggagaggagacagagcacaacgtgctgaagatcaactgcaagctgttcatcttcaacaagaccacccagagctggattgagcggggccggggcaccctgcggctgaatgacacagccagcacagactgtggcaccctgcagagccgcctcatcatgaggaaccagggcagcctgcggctcatcctgaacagcaagctgtgggcccagatgaagatccagagggccaaccacaagaatgtgcgcatcacagccacagacctggaggactacagcatcaagatcttcctgatccaggccagcgcccaggacacagcctacctgtatgctgccatccaccaccggctggtggccctgcagagcttcaacaagcagagagatgtgaaccaggccgagagcctgtctgaaacagcccagcagctgaactgtgagagctgtgatgaaaatgaagatgacttcatccaggtgaccaagaatggaagtgaccccagctcctggacccaccggcagagcgtggcctgcagctag

SEQ ID NO: 37378 - DNA, 327 bp, Artificial Sequence
  Description of Artificial Sequence: Synthetic coding sequence
atgaccaccatccccaggaagggcagcagccacctgcccggcagcctgcacacctgcaagctgaagctgcaggaggaccggcggcagcaggagaagtctgtgattgcccagcccatctttgtgtttgagaagggggagcagaccttcaagaggcctgctgaggacaccctgtatgaggccgctgagcctgagtgcaatggcttccccaccaagagggtgcgcagcagcagcttcaccttccacatcacagacagccagagccagggcgtgaggaagaacaacgtgttcatgaccagcgccctggtgcagagctctgtggacatctag

SEQ ID NO: 37379 - DNA, 1473 bp, Artificial Sequence
  Description of Artificial Sequence: Synthetic coding sequence
atgaccaccatccccaggaagggcagcagccacctgcccggcagcctgcacacctgcaagctgaagctgcaggaggaccggcggcagcaggagaagtctgtgattgcccagcccatctttgtgtttgagaagggggagcagaccttcaagaggcctgctgaggacaccctgtatgaggccgctgagcctgagtgcaatggcttccccaccaagagggtgcgcagcagcagcttcaccttccacatcacagacagccagagccagggcgtgtccaccctgagccagaagcagatgcgctgcagctctgtgaccaacctgcccaccttcccccacagcggccctgtgaggaagaacaacgtgttcatgaccagcgccctggtgcagagctctgtggacatcaagtctgctgagcagggccctgtgaagcacagcaagcacgtgatccggcctgccatcctgcagctgccccaggcccggagctgtgccaaggtgaggaagaccttcggccacaaggccctggagagctgcaagaccaaggagaagaccaacaacaagatcagcgagggcaacagctacctgctgtctgagaacctgagccgggcccgcatctctgtgcagctgagcaccaaccaggacttcctgggcgccacctctgtgggctgccagcccaatgaagataaatgttccttcaagagctgcagcagcaactttgtgtttggagagaacatggtggagcgggtgctgggcacccagaagctgacccagccccagctggagaatgacagctatgccaaggagaagcccttcaagagcatccccaagtttcctgtgaacttcctgagcagcaggacagacagcatcaagaacaccagcctgattgaatctgctgctgccttcagcagccagcccagcaggaagtgcctgctggagaagattgatgtgatcaccggggaggagacagagcacaacgtgctgaagatcaactgcaagctgttcatcttcaacaagaccacccagagctggattgaaagaggccggggcaccctgcggctgaatgacacagccagcacagactgtggcaccctgcagagccgcctcatcatgaggaaccagggcagcctgcggctcatcctgaacagcaagctgtgggcccagatgaagatccagagggccaaccacaagaatgtgcgcatcacagccacagacctggaggactacagcatcaagatcttcctgatccaggccagcgcccaggacacagcctacctgtatgctgccatccaccaccggctggtggccctgcagagcttcaacaagcagagagatgtgaaccaggccgagagcctgtctgaaacagcccagcagctgaactgtgagagctgtgatgaaaatgaagatgacttcatccaggtgaccaagaatggaagtgaccccagctcctggacccaccggcagagcgtggcctgcagctag

SEQ ID NO: 37380 - DNA, 4500 bp, Artificial Sequence
  Description of Artificial Sequence: Synthetic coding sequence
atgaagcccctggccatcccagccaaccacggcgtgatgggccagcaggagaagcacagcctgcctgctgacttcaccaagctgcacctgacagacagcctgcacccccaggtgacccacgtgagcagcagccacagcggctgcagcatcaccagtgacagcggcagcagcagcctgagtgacatctaccaggccacagagagcgaggccggggacatggacctgagcggcctgcctgagacagctgtggacagtgaagatgatgatgatgaggaggacatcgagcgggccagtgaccccctgatgagccgggacatcgtgcgggactgcctggagaaggaccccatcgacagaacagatgatgacatcgagcagctgctggagttcatgcaccagctgcctgcctttgccaacatgaccatgtctgtgcggcgggagctgtgtgctgtgatggtgtttgctgtggtggagagagctggcaccatcgtgctgaatgatggagaggagctggacagctggagcgtcatcctgaatggatctgtggaggtgacctacccagatggcaaggccgagatcctgtgcatgggcaacagctttggagtgagccccaccatggacaaggagtacatgaagggcgtgatgaggaccaaggtggatgactgccagtttgtgtgcatcgcccagcaggactactgccgcatcctgaaccaggtggagaagaacatgcagaaggtggaggaggagggggagatcgtgatggtgaaggagcaccgggagctggacagaacaggcaccaggaagggccacatcgtcatcaagggcaccagcgagcggctgaccatgcacctggtggaggagcacagcgtggtggaccccaccttcatcgaggacttcctgctgacctaccgcaccttcctgagcagccccatggaggtgggcaagaagctgctggagtggttcaatgaccccagcctgcgggacaaggtgaccagggtggtgctgctgtgggtgaacaaccacttcaatgactttgaaggagaccctgccatgacccgcttcctggaggagtttgagaacaacctggagcgggagaagatgggcggccacctgcggctgctgaacatcgcctgtgccgccaaggccaagaggcggctgatgaccctgaccaagcccagccgggaggcccccctgcccttcatcctgctgggcggcagcgagaagggcttcggcatctttgtggacagcgtggacagcggcagcaaggccacagaagctggcctgaagagaggagaccagatcctggaggtgaatggccagaactttgagaacatccagctgagcaaggccatggagatcctgaggaacaacacccacctgagcatcaccgtgaagaccaacctgtttgtgttcaaggagctgctgacccggctgtctgaggagaagagaaatggagccccccacctgcccaagattggagacatcaagaaggccagccgctacagcatcccagacctggccgtggatgtggagcaggtgattggcctggagaaggtgaacaagaagagcaaggccaacacagtgggcggcaggaacaagctgaagaagatcctggacaagacccgcatcagcatcctgccccagaagccctacaatgacattggaattggccagagccaggatgacagcatcgtgggcctgcggcagaccaagcacatccccacagccctgcctgtgtctggcaccctgagcagcagcaacccagacctgctgcagagccaccaccgcatcctggacttcagcgccaccccagacctgcctgaccaggtgctgcgggtcttcaaggctgaccagcagagccgctacatcatgatcagcaaggacaccacagccaaggaggtggtgatccaggccatccgggagtttgctgtgacagccaccccagaccagtacagcctgtgtgaggtgtctgtgaccccagagggcgtcatcaagcagaggcggctgcctgaccagctgagcaagctggccgaccgcatccagctgagcggccgctactacctgaagaacaacatggagacagagaccctgtgcagtgatgaagatgcccaggagctgctgcgggagagccagatcagcctgctgcagctgagcacagtggaggtggccacccagctgtccatgaggaactttgagctgttcaggaacatcgagcccacagagtacattgatgacctcttcaagctgcggagcaagaccagctgtgccaacctgaagagatttgaggaggtgatcaaccaggagaccttctgggtggccagcgagatcctgcgggagaccaaccagctgaagaggatgaagatcatcaagcacttcatcaagatcgccctgcactgccgggagtgcaagaacttcaacagcatgtttgccatcatcagcggcctgaacctggcccctgtggcccggctgcggaccacctgggagaagctgcccaacaagtatgagaagctgttccaggacctgcaggacctgtttgaccccagcaggaacatggccaagtacagaaatgtgctgaacagccagaacctgcagccccccatcatccccctcttccctgtgatcaagaaggacctgaccttcctgcacgagggcaatgacagcaaggtggatggcctggtgaactttgagaagctgaggatgattgccaaggagatccgccacgtgggccgcatggcctctgtgaacatggaccctgccctgatgttccgcaccaggaagaagaagtggaggagcctgggcagcctgagccagggcagcaccaatgccaccgtgctggatgtggcccagacaggaggccacaagaagagggtgagaagaagcagcttcctgaatgccaagaagctgtatgaagatgcccagatggccaggaaggtgaagcagtacctgagcaacctggagctggagatggatgaggagagcctgcagaccctgagcctgcagtgtgagcccgccaccaacaccctgcccaagaaccctggggacaagaagcctgtgaagtctgagaccagccctgtggccccccgggccggcagccagcagaaggcccagagcctgccccagccccagcagcagcccccaccagcccacaagatcaaccagggcctgcaggtgcctgctgtgtccctgtaccccagcaggaagaaggtgcctgtgaaggacctgccccccttcggcatcaacagcccccaggccctgaagaagatcctgagcctgtctgaggagggcagcctggagcggcacaagaagcaggccgaggacaccatcagcaatgccagcagccagctgagcagcccccccaccagcccccagagcagccccaggaagggctacaccctggcccccagcggcaccgtggacaacttcagtgacagcggccacagcgagatcagcagccgcagcagcatcgtgagcaacagcagctttgacagcgtgcctgtgtccctgcatgatgaaagacggcagaggcacagcgtgtccatcgtggagaccaacctgggcatgggccgcatggagaggaggaccatgattgaaccagaccagtacagcctgggcagctatgcccccatgtctgagggccggggcctgtatgccacagccaccgtcatcagcagccccagcacagaggagctgagccaggaccagggcgaccgggccagcctggatgctgctgacagcggccggggctcctggaccagctgcagcagcggcagccatgacaacatccagaccatccagcaccagaggtcctgggagaccctgcccttcggccacacccactttgactacagcggggaccctgctggcctgtgggccagcagcagccacatggaccagatcatgttcagtgaccacagcaccaagtacaaccggcagaaccagagccgggagagcctggagcaggcccagagccgggcctcctgggccagcagcacaggctactggggagaagattctgagggggacaccggcaccatcaagaggcggggcggcaaggatgtgtccattgaggccgagagcagcagcctgacctctgtgaccacagaggagaccaagcctgtgcccatgcctgcccacatcgctgtggccagcagcaccaccaagggcctgattgccaggaaggagggccgctaccgggagcccccacccaccccacctggctacatcggcatccccatcacagacttccctgagggccacagccacccagccaggaagcccccagactacaacgtggccctgcagaggagcaggatggtggcccggagcagtgacacagctggccccagctctgtgcagcagccccacggccaccccaccagcagcaggcctgtgaacaagccccagtggcacaagcccaatgaaagtgacccccggctggccccctaccagagccagggcttcagcacagaggaggatgaagatgagcaggtgtctgctgtgtag

SEQ ID NO: 37381 - DNA, 2646 bp, Artificial Sequence
  Description of Artificial Sequence: Synthetic coding sequence
atggtgctgcggaggatgcaccggcccaggagctgcagctaccagctgctgctggagcaccagaggcccagctgcatccagggcctgcgctggacccccctgaccaacagcgaggagagcctggacttcagcgagagcctggagcaggccagcacagagcgggtgctgcgggccggccggcagctgcaccgccacctgctggccacctgccccaacctgatccgggacaggaagtaccacctgcggctgtaccggcagtgctgcagcggccgggagctggtggatggcatcctggccctgggcctgggcgtgcacagccgcagccaggtggtgggcatctgccaggtgctgctggatgaaggagccctgtgccacgtgaagcatgactgggccttccaggacagagatgcccagttctaccgcttccctggccctgagcctgagcctgtgaggacccatgagatggaggaggagctggccgaggccgtggccctgctgagccagaggggcccagatgccctgctgactgtggccctgaggaagcccccaggccagaggacagatgaggagctggacctgatctttgaggagctgctgcacatcaaggctgtggcccacctgagcaacagcgtgaagcgggagctggccgctgtgctgctgtttgagccccacagcaaggccggcaccgtgctcttcagccagggcgacaagggcacctcctggtacatcatctggaagggctctgtgaatgtggtgacccacggcaagggcctggtgaccaccctgcatgaaggagatgactttggccagctggccctggtgaatgatgccccccgggccgccaccatcatcctgcgggaggacaactgccacttcctgcgggtggacaagcaggacttcaaccgcatcatcaaggatgtggaggccaagaccatgaggctggaggagcacggcaaggtggtgctggtgctggagcgggccagccagggcgccggccccagccggccccccaccccaggaagaaaccgctacacagtgatgagcggcaccccagagaagatcctggagctgctgctggaggccatgggccctgacagcagcgcccatgaccccacagagaccttcctgagtgacttcctgctgacccacagggtcttcatgcccagcgcccagctgtgtgccgccctgctgcaccacttccacgtggagcctgctgggggcagcgagcaggagaggagcacctacgtgtgcaacaagaggcagcagatcctgcggctggtgtcccagtgggtggccctgtatggctccatgctgcacacagatcctgtggccaccagcttcctgcagaagctgagtgacctggtgggccgggacacccggctgagcaacctgctgcgggagcagtggccagagcggcggcgctgccaccggctggagaatggctgtggaaatgccagcccccagatgaaggccaggaacctgcctgtgtggctgcccaaccaggatgagcccctgcccggcagcagctgtgccatccaggtgggggacaaggtgccctatgacatctgcaggccagaccacagcgtgctgaccctgcagctgcctgtgacagcctctgtgcgggaggtgatggccgccctggcccaggaggatggctggaccaagggccaggtgctggtgaaggtgaacagcgctggagatgccatcggcctgcagccagatgcccggggcgtggccaccagcctgggcctgaatgaaaggctgtttgtggtgaacccccaggaggtgcatgagctgatcccccacccagaccagctgggccccaccgtgggcagcgctgagggcctggacctggtgtctgccaaggacctggccggccagctgacagaccatgactggagcctcttcaacagcatccaccaggtggagctgatccactacgtgctgggcccccagcacctgagagatgtgaccacagccaacctggagcgcttcatgaggcgcttcaatgagctgcagtactgggtggccacagagctgtgcctgtgccctgtgcccggcccccgggcccagctgctgaggaagttcatcaagctggccgcccacctgaaggagcagaagaacctgaacagcttctttgctgtgatgtttggcctgagcaacagcgccatcagccggctggcccacacctgggagcggctgccccacaaggtgaggaagctgtacagcgccctggagcggctgctggaccccagctggaaccaccgggtgtaccgcctggccctggccaagctgagcccccctgtgatccccttcatgcccctgctgctgaaggacatgaccttcatccacgagggcaaccacaccctggtggagaacctgatcaactttgagaagatgaggatgatggcccgggccgccaggatgctgcaccactgccgcagccacaaccctgtgcccctgagccccctgcggagccgggtgagccacctgcacgaggacagccaggtggcccgcatcagcacctgcagcgagcagagcctgagcaccaggagccctgccagcacctgggcctacgtgcagcagctgaaggtgattgacaaccagcgggagctgagccggctgagccgggagctggagccctag

SEQ ID NO: 37382 - DNA, 2646 bp, Artificial Sequence; identical to SEQ ID NO: 37381
  Description of Artificial Sequence: Synthetic coding sequence

SEQ ID NO: 37383 - DNA, 2772 bp, Artificial Sequence
  Description of Artificial Sequence: Synthetic coding sequence
atgaaggtgggctggccaggagagagctgctggcaggtgggcctggccgtggaggacagccctgccctgggcgccccccgggtgggcgccctgcctgatgtggtgcctgagggcaccctgctgaacatggtgctgcggaggatgcaccggcccaggagctgcagctaccagctgctgctggagcaccagaggcccagctgcatccagggcctgcgctggacccccctgaccaacagcgaggagagcctggacttcagcgagagcctggagcaggccagcacagagcgggtgctgcgggccggccggcagctgcaccgccacctgctggccacctgccccaacctgatccgggacaggaagtaccacctgcggctgtaccggcagtgctgcagcggccgggagctggtggatggcatcctggccctgggcctgggcgtgcacagccgcagccaggtggtgggcatctgccaggtgctgctggatgaaggagccctgtgccacgtgaagcatgactgggccttccaggacagagatgcccagttctaccgcttccctggccctgagcctgagcctgtgaggacccatgagatggaggaggagctggccgaggccgtggccctgctgagccagaggggcccagatgccctgctgactgtggccctgaggaagcccccaggccagaggacagatgaggagctggacctgatctttgaggagctgctgcacatcaaggctgtggcccacctgagcaacagcgtgaagcgggagctggccgctgtgctgctgtttgagccccacagcaaggccggcaccgtgctcttcagccagggcgacaagggcacctcctggtacatcatctggaagggctctgtgaatgtggtgacccacggcaagggcctggtgaccaccctgcatgaaggagatgactttggccagctggccctggtgaatgatgccccccgggccgccaccatcatcctgcgggaggacaactgccacttcctgcgggtggacaagcaggacttcaaccgcatcatcaaggatgtggaggccaagaccatgaggctggaggagcacggcaaggtggtgctggtgctggagcgggccagccagggcgccggccccagccggccccccaccccaggaagaaaccgctacacagtgatgagcggcaccccagagaagatcctggagctgctgctggaggccatgggccctgacagcagcgcccatgaccccacagagaccttcctgagtgacttcctgctgacccacagggtcttcatgcccagcgcccagctgtgtgccgccctgctgcaccacttccacgtggagcctgctgggggcagcgagcaggagaggagcacctacgtgtgcaacaagaggcagcagatcctgcggctggtgtcccagtgggtggccctgtatggctccatgctgcacacagatcctgtggccaccagcttcctgcagaagctgagtgacctggtgggccgggacacccggctgagcaacctgctgcgggagcagtggccagagcggcggcgctgccaccggctggagaatggctgtggaaatgccagcccccagatgaaggccaggaacctgcctgtgtggctgcccaaccaggatgagcccctgcccggcagcagctgtgccatccaggtgggggacaaggtgccctatgacatctgcaggccagaccacagcgtgctgaccctgcagctgcctgtgacagcctctgtgcgggaggtgatggccgccctggcccaggaggatggctggaccaagggccaggtgctggtgaaggtgaacagcgctggagatgccatcggcctgcagccagatgcccggggcgtggccaccagcctgggcctgaatgaaaggctgtttgtggtgaacccccaggaggtgcatgagctgatcccccacccagaccagctgggccccaccgtgggcagcgctgagggcctggacctggtgtctgccaaggacctggccggccagctgacagaccatgactggagcctcttcaacagcatccaccaggtggagctgatccactacgtgctgggcccccagcacctgagagatgtgaccacagccaacctggagcgcttcatgaggcgcttcaatgagctgcagtactgggtggccacagagctgtgcctgtgccctgtgcccggcccccgggcccagctgctgaggaagttcatcaagctggccgcccacctgaaggagcagaagaacctgaacagcttctttgctgtgatgtttggcctgagcaacagcgccatcagccggctggcccacacctgggagcggctgccccacaaggtgaggaagctgtacagcgccctggagcggctgctggaccccagctggaaccaccgggtgtaccgcctggccctggccaagctgagcccccctgtgatccccttcatgcccctgctgctgaaggacatgaccttcatccacgagggcaaccacaccctggtggagaacctgatcaactttgagaagatgaggatgatggcccgggccgccaggatgctgcaccactgccgcagccacaaccctgtgcccctgagccccctgcggagccgggtgagccacctgcacgaggacagccaggtggcccgcatcagcacctgcagcgagcagagcctgagcaccaggagccctgccagcacctgggcctacgtgcagcagctgaaggtgattgacaaccagcgggagctgagccggctgagccgggagctggagccctag

SEQ ID NO: 37384 - DNA, 1797 bp, Artificial Sequence
  Description of Artificial Sequence: Synthetic coding sequence
atgaaggtgggctggccaggagagagctgctggcaggtgggcctggccgtggaggacagccctgccctgggcgccccccgggtgggcgccctgcctgatgtggtgcctgagggcaccctgctgaacatggtgctgcggaggatgcaccggcccaggagctgcagctaccagctgctgctggagcaccagaggcccagctgcatccagggcctgcgctggacccccctgaccaacagcgaggagagcctggacttcagcgagagcctggagcaggccagcacagagcgggtgctgcgggccggccggcagctgcaccgccacctgctggccacctgccccaacctgatccgggacaggaagtaccacctgcggctgtaccggcagtgctgcagcggccgggagctggtggatggcatcctggccctgggcctgggcgtgcacagccgcagccaggtggtgggcatctgccaggtgctgctggatgaaggagccctgtgccacgtgaagcatgactgggccttccaggacagagatgcccagttctaccgcttccctggccctgagcctgagcctgtgaggacccatgagatggaggaggagctggccgaggccgtggccctgctgagccagaggggcccagatgccctgctgactgtggccctgaggaagcccccaggccagaggacagatgaggagctggacctgatctttgaggagctgctgcacatcaaggctgtggcccacctgagcaacagcgtgaagcgggagctggccgctgtgctgctgtttgagccccacagcaaggccggcaccgtgctcttcagccagggcgacaagggcacctcctggtacatcatctggaagggctctgtgaatgtggtgacccacggcaagggcctggtgaccaccctgcatgaaggagatgactttggccagctggccctggtgaatgatgccccccgggccgccaccatcatcctgcgggaggacaactgccacttcctgcgggtggacaagcaggacttcaaccgcatcatcaaggatgtggaggccaagaccatgaggctggaggagcacggcaaggtggtgctggtgctggagcgggccagccagggcgccggccccagccggccccccaccccaggaagaaaccgctacacagtgatgagcggcaccccagagaagatcctggagctgctgctggaggccatgggccctgacagcagcgcccatgaccccacagagaccttcctgagtgacttcctgctgacccacagggtcttcatgcccagcgcccagctgtgtgccgccctgctgcaccacttccacgtggagcctgctgggggcagcgagcaggagaggagcacctacgtgtgcaacaagaggcagcagatcctgcggctggtgtcccagtgggtggccctgtatggctccatgctgcacacagatcctgtggccaccagcttcctgcagaagctgagtgacctggtgggccgggacacccggctgagcaacctgctgcgggagcagtggccagagcggcggcgctgccaccggctggagaatggctgtggaaatgccagcccccagatgaaggtgtctgcctggccccagttcctgagcagcgcccctcctggcctgcaggccccacccagccccccagaccctgagggcctgtgtggccggggcaagctgagcagccaccgccacaccctgggcagcctcatcggcgtgcatggagccctggccgcctgtggggccctgggccaggccgtgcctggaggagctgaggcctag

SEQ ID NO: 37385 - DNA, 2607 bp, Artificial Sequence
  Description of Artificial Sequence: Synthetic coding sequence
atggcccagcgggaggagatcaagaggcccctgtgggagaccgtgggctggccaggagagagctgctggcaggtgggcctggccgtggaggacagccctgccctgggcgccccccgggtgggcgccctgcctgatgtggtgcctgagggcaccctgctgaacatggtgctgcggaggatgcaccggcccaggagctgcagctaccagctgctgctggagcaccagaggcccagctgcatccagggcctgcgctggacccccctgaccaacagcgaggagagcctggacttcagcgagagcctggagcaggccagcacagagcgggtgctgcgggccggccggcagctgcaccgccacctgctggccacctgccccaacctgatccgggacaggaagtaccacctgcggctgtaccggcagtgctgcagcggccgggagctggtggatggcatcctggccctgggcctgggcgtgcacagccgcagccaggtggtgggcatctgccaggtgctgctggatgaaggagccctgtgccacgtgaagcatgactgggccttccaggacagagatgcccagttctaccgcttccctggccctgagcctgagcctgtgaggacccatgagatggaggaggagctggccgaggccgtggccctgctgagccagaggggcccagatgccctgctgactgtggccctgaggaagcccccaggccagaggacagatgaggagctggacctgatctttgaggagctgctgcacatcaaggctgtggcccacctgagcaacagcgtgaagcgggagctggccgctgtgctgctgtttgagccccacagcaaggccggcaccgtgctcttcagccagggcgacaagggcacctcctggtacatcatctggaagggctctgtgaatgtggtgacccacggcaagggcctggtgaccaccctgcatgaaggagatgactttggccagctggccctggtgaatgatgccccccgggccgccaccatcatcctgcgggaggacaactgccacttcctgcgggtggacaagcaggacttcaaccgcatcatcaaggatgtggaggccaagaccatgaggctggaggagcacggcaaggtggtgctggtgctggagcgggccagccagggcgccggccccagccggccccccaccccaggaagaaaccgctacacagtgatgagcggcaccccagagaagatcctggagctgctgctggaggccatgggccctgacagcagcgcccatgaccccacagagaccttcctgagtgacttcctgctgacccacagggtcttcatgcccagcgcccagctgtgtgccgccctgctgcaccacttccacgtggagcctgctgggggcagcgagcaggagaggagcacctacgtgtgcaacaagaggcagcagatcctgcggctggtgtcccagtgggtggccctgtatggctccatgctgcacacagatcctgtggccaccagcttcctgcagaagctgagtgacctggtgggccgggacacccggctgagcaacctgctgcgggagcagtggccagagcggcggcgctgccaccggctggagaatggctgtggaaatgccagcccccagatgaaggccaggaacctgcctgtgtggctgcccaaccaggatgagcccctgcccggcagcagctgtgccatccaggtgggggacaaggatgccatcggcctgcagccagatgcccggggcgtggccaccagcctgggcctgaatgaaagactctttgtggtgaacccccaggaggtgcatgagctgatcccccacccagaccagctgggccccaccgtgggcagcgctgagggcctggacctggtgtctgccaaggacctggccggccagctgacagaccatgactggagcctcttcaacagcatccaccaggtggagctgatccactacgtgctgggcccccagcacctgagagatgtgaccacagccaacctggagcgcttcatgaggcgcttcaatgagctgcagtactgggtggccacagagctgtgcctgtgccctgtgcccggcccccgggcccagctgctgaggaagttcatcaagctggccgcccacaacagcgccatcagccggctggcccacacctgggagcggctgccccacaaggtgaggaagctgtacagcgccctggagcggctgctggaccccagctggaaccaccgggtgtaccgcctggccctggccaagctgagcccccctgtgatccccttcatgcccctgctgctgaaggacatgaccttcatccacgagggcaaccacaccctggtggagaacctgatcaactttgagaagatgaggatgatggcccgggccgccaggatgctgcaccactgccgcagccacaaccctgtgcccctgagccccctgcggagccgggtgagccacctgcacgaggacagccaggtggcccgcatcagcacctgcagcgagcagagcctgagcaccaggagccctgccagcacctgggcctacgtgcagcagctgaaggtgattgacaaccagcgggagctgagccggctgagccgggagctggagccctag

SEQ ID NO: 37386 - DNA, 2646 bp, Artificial Sequence; identical to SEQ ID NO: 37381
  Description of Artificial Sequence: Synthetic coding sequence

SEQ ID NO: 37387 - DNA, 2772 bp, Artificial Sequence; identical to SEQ ID NO: 37383
  Description of Artificial Sequence: Synthetic coding sequence

SEQ ID NO: 37388 - DNA, 672 bp, Artificial Sequence
  Description of Artificial Sequence: Synthetic coding sequence
atggtgctgcggaggatgcaccggcccaggagctgcagctaccagctgctgctggagcaccagaggcccagctgcatccagggcctgcgctggacccccctgaccaacagcgaggagagcctggacttcagcgagagcctggagcaggccagcacagagcgggtgctgcgggccggccggcagctgcaccgccacctgctggccacctgccccaacctgatccgggacaggaagtaccacctgcggctgtaccggcagtgctgcagcggccgggagctggtggatggcatcctggccctgggcctgggcgtgcacagccgcagccaggtggtgggcatctgccaggtgctgctggatgaaggagccctgtgccacgtgaagcatgactgggccttccaggacagagatgcccagttctaccgcttccctggccctgagcctgagcctgtgaggacccatgagatggaggaggagctggccgaggccgtggccctgctgagccagaggggcccagatgccctgctgactgtggccctgaggaagcccccaggccagaggacagatgaggagctggacctgatctttgaggagctgctgcacatcaaggctgtggcccacctgagcaacagcgtgaagcgggagctggccgctgtgctgctgtttgagccctag

SEQ ID NO: 37389 - DNA, 426 bp, Artificial Sequence
  Description of Artificial Sequence: Synthetic coding sequence
atggtgctgcggaggatgcaccggcccaggagctgcagctaccagctgctgctggagcaccagaggcccagctgcatccagggcctgcgctggacccccctgaccaacagcgaggagagcctggacttcagcgagagcctggagcaggccagcacagagcgggtgctgcgggccggccggcagctgcaccgccacctgctggccacctgccccaacctgatccgggacaggaagtaccacctgcggctgtaccggcagtgctgcagcggccgggagctggtggatggcatcctggccctgggcctgggcgtgcacagccgcagccaggtggtgggcatctgccaggtgctgctggatgaaggagccctgtgccacgtgaagcatgactgggccttccaggacagagatgcccagttctacagatag

SEQ ID NO: 37390 - DNA, 1713 bp, Artificial Sequence
  Description of Artificial Sequence: Synthetic coding sequence
atgaggctggaggagcacggcaaggtggtgctggtgctggagcgggccagccagggcgccggccccagcaggcctcccaccccaggcaggaaccgctacacagtgatgagcggcaccccagagaagatcctggagctgctgctggaggccatgggccctgacagcagcgcccatgaccccacagagaccttcctgagtgacttcctgctgacccacagggtcttcatgcccagcgcccagctgtgtgccgccctgctgcaccacttccacgtggagcctgctgggggcagcgagcaggagaggagcacctacgtgtgcaacaagaggcagcagatcctgcggctggtgtcccagtgggtggccctgtatggctccatgctgcacacagatcctgtggccaccagcttcctgcagaagctgagtgacctggtgggccgggacacccggctgagcaacctgctgcgggagcagtggccagagcggcggcgctgccaccggctggagaatggctgtggaaatgccagcccccagatgaaggccaggaacctgcctgtgtggctgcccaaccaggatgagcccctgcccggcagcagctgtgccatccaggtgggggacaaggtgccctatgacatctgcaggccagaccacagcgtgctgaccctgcagctgcctgtgacagcctctgtgcgggaggtgatggccgccctggcccaggaggatggctggaccaagggccaggtgctggtgaaggtgaacagcgctggagatgccatcggcctgcagccagatgcccggggcgtggccaccagcctgggcctgaatgaaagactctttgtggtgaacccccaggaggtgcatgagctgatcccccacccagaccagctgggccccaccgtgggcagcgctgagggcctggacctggtgtctgccaaggacctggccggccagctgacagaccatgactggagcctcttcaacagcatccaccaggtggagctgatccactacgtgctgggcccccagcacctgagagatgtgaccacagccaacctggagcgcttcatgaggcgcttcaatgagctgcagtactgggtggccacagagctgtgcctgtgccctgtgcccggcccccgggcccagctgctgaggaagttcatcaagctggccgcccacctgaaggagcagaagaacctgaacagcttctttgctgtgatgtttggcctgagcaacagcgccatcagccggctggcccacacctgggagcggctgccccacaaggtgaggaagctgtacagcgccctggagcggctgctggaccccagctggaaccaccgggtgtaccgcctggccctggccaagctgagcccccctgtgatccccttcatgcccctgctgctgaaggacatgaccttcatccacgagggcaaccacaccctggtggagaacctgatcaactttgagaagatgaggatgatggcccgggccgccaggatgctgcaccactgccgcagccacaaccctgtgcccctgagccccctgcggagccgggtgagccacctgcacgaggacagccaggtggcccgcatcagcacctgcagcgagcagagcctgagcaccaggagccctgccagcacctgggcctacgtgcagcagctgaaggtgattgacaaccagcgggagctgagccggctgagccgggagctggagccctag

SEQ ID NO: 37391 - DNA, 2646 bp, Artificial Sequence; identical to SEQ ID NO: 37381
  Description of Artificial Sequence: Synthetic coding sequence

SEQ ID NO: 37392 - DNA, 3033 bp, Artificial Sequence
  Description of Artificial Sequence: Synthetic coding sequence
atggtggccgcccacgccgcccacagcagcagcagcgctgagtggatcgcctgcctggacaagaggcccctggagaggagcagtgaagatgtggacatcatcttcacccggctgaaggaggtgaaggcctttgagaagttccaccccaacctgctgcaccagatctgcctgtgtggctactatgagaacctggagaagggcatcaccctcttccggcagggcgacatcggcaccaactggtatgctgtgctggccggcagcctggatgtgaaggtgtctgagaccagcagccaccaggatgctgtgaccatctgcaccctgggcattggaacagcctttggagagagcatcctggacaacacccccaggcatgccaccatcgtgacccgggagagcagcgagctgctgcgcatcgagcagaaggacttcaaggccctgtgggagaagtaccggcagtacatggccggcctgctggccccaccctacggcgtgatggagaccggcagcaacaatgacaacatcttcaaggagatgacccccctcatcgagccccacgtgcccctgcggcctgccaacaccatcaccaaggtgcccagcgagaagatcctgcgggccggcaagatcctgagaaatgccatcctgagccgggccccccacatgatccgggacaggaagtaccacctgaagacctaccggcagtgctgcgtgggcacagagctggtggactggatgatgcagcagaccccctgtgtgcacagcaggacccaggccgtgggcatgtggcaggtgctgctggaggatggagtgctgaaccacgtggaccaggagcaccacttccaggacaagtacctgttctaccgcttcctggatgatgaacatgaagatgcccccctgcccacagaggaggagaagaaggaatgtgatgaggagctgcaggacaccatgctgctgctgagccagatgggcccagatgcccacatgaggatgatcctgaggaagcccccaggccagaggacagtggatgacctggagatcatctatgaggagctgctgcacatcaaggccctgagccacctgagcaccaccgtgaagcgggagctggccggcgtgctgatctttgagagccacgccaagggcggcaccgtgctcttcaaccagggcgaggagggcacctcctggtacatcatcctgaagggctctgtgaatgtggtgatctacggcaagggcgtggtgtgcaccctgcatgaaggagatgactttgggaagctggccctggtgaatgatgccccccgggccgccagcatcgtgctgcgggaggacaactgccacttcctgcgggtggacaaggaggacttcaaccgcatcctgagagatgtggaggccaacacagtgcggctgaaggagcatgaccaggatgtgctggtgctggagaaggtgcctgctggcaacagagccagcaaccagggcaacagccagccccagcagaagtacacagtgatgagcggcaccccagagaagatcctggagcacttcctggagaccatccggctggaggccaccctgaatgaggccacagattctgtgctgaatgacttcatcatgatgcactgtgtgttcatgcccaacacccagctgtgcccagccctggtggcccactaccacgcccagcccagccagggcacagagcaggagaagatggactatgccctgaacaacaagagaagagtcatccggctggtgctgcagtgggccgccatgtatggagacctgctgcaggaggatgatgtgtccatggccttcctggaggagttctacgtgtctgtgtctgatgatgccaggatgattgctgccctgaaggagcagctgcctgagctggagaagatcgtgaagcagatcagtgaagatgccaaggccccccagaagaagcacaaggtgctgctgcagcagttcaacacaggagatgagcgggcccagaagaggcagcccatccggggcagtgatgaggtgctcttcaaggtgtactgcatggaccacacctacaccaccatccgggtgcctgtggccacctctgtgaaggaggtgatctctgctgtggccgacaagctgggcagcggggagggcctcatcatcgtgaagatgagcagtggaggagagaaggtggtgctgaagcccaatgatgtgtctgtgttcaccaccctgaccatcaatggccgcctgtttgcctgcccccgggagcagtttgacagcctgacccccctgcctgagcaggagggccccaccgtgggcaccgtgggcacctttgagctgatgagcagcaaggacctggcctaccagatgaccatctatgactgggagctgttcaactgtgtgcatgagctggagctgatctaccacaccttcggccgccacaacttcaagaagaccacagccaacctggacctcttcctgcggcgcttcaatgagatccagttctgggtggtgacagagatctgcctgtgcagccagctgagcaagagggtgcagctgctgaagaagttcatcaagattgctgcccactgcaaggagtacaagaacctgaacagcttctttgccatcgtgatgggcctgagcaatgtggccgtgtcccggctggccctgacctgggagaagctgcccagcaagttcaagaagttctatgcagagtttgagagcctgatggaccccagcaggaaccaccgggcctaccgcctgactgtggccaagctggagcccccactcatccccttcatgcccctgctgatcaaggacatgaccttcacccatgagggcaacaagaccttcatcgacaacctggtgaactttgagaagatgaggatgattgccaacacagccaggacagtgcgctactaccgcagccagcccttcaacccagatgctgcccaggccaacaagaaccaccaggatgtgcgctcctatgtgcggcagctgaatgtcatcgacaaccagaggaccctgagccagatgagccaccggctggagccccggcggccctag

SEQ ID NO: 37393 - DNA, 3036 bp, Artificial Sequence
  Description of Artificial Sequence: Synthetic coding sequence
atggtggccgcccacgccgcccacagcagcagcagcgctgagtggatcgcctgcctggacaagaggcccctggagaggagcagtgaagatgtggacatcatcttcacccggctgaaggaggtgaaggcctttgagaagttccaccccaacctgctgcaccagatctgcctgtgtggctactatgagaacctggagaagggcatcaccctcttccggcagggcgacatcggcaccaactggtatgctgtgctggccggcagcctggatgtgaaggtgtctgagaccagcagccaccaggatgctgtgaccatctgcaccctgggcattggaacagcctttggagagagcatcctggacaacacccccaggcatgccaccatcgtgacccgggagagcagcgagctgctgcgcatcgagcagaaggacttcaaggccctgtgggagaagtaccggcagtacatggccggcctgctggccccaccctacggcgtgatggagaccggcagcaacaatgaccgcatcccagacaaggagaacacccccctgattgagccccacgtgcccctgcggcctgccaacaccatcaccaaggtgcccagcgagaagatcctgcgggccggcaagatcctgagaaatgccatcctgagccgggccccccacatgatccgggacaggaagtaccacctgaagacctaccggcagtgctgcgtgggcacagagctggtggactggatgatgcagcagaccccctgtgtgcacagcaggacccaggccgtgggcatgtggcaggtgctgctggaggatggagtgctgaaccacgtggaccaggagcaccacttccaggacaagtacctgttctaccgcttcctggatgatgaacatgaagatgcccccctgcccacagaggaggagaagaaggaatgtgatgaggagctgcaggacaccatgctgctgctgagccagatgggcccagatgcccacatgaggatgatcctgaggaagcccccaggccagaggacagtggatgacctggagatcatctatgaggagctgctgcacatcaaggccctgagccacctgagcaccaccgtgaagcgggagctggccggcgtgctgatctttgagagccacgccaagggcggcaccgtgctcttcaaccagggcgaggagggcacctcctggtacatcatcctgaagggctctgtgaatgtggtgatctatggaaaaggagtggtgtgcaccctgcacgagggagatgactttgggaagctggccctggtgaatgatgcccccagggctgccagcatcgtgctgcgggaggacaactgccacttcctgcgggtggacaaggaggacttcaaccgcatcctgagagatgtggaggccaacacagtgcggctgaaggagcatgaccaggatgtgctggtgctggagaaggtgcctgctggcaacagagccagcaaccagggcaacagccagccccagcagaagtacacagtgatgagcggcaccccagagaagatcctggagcacttcctggagaccatccggctggaggccaccctgaatgaggccacagacagcgtgctgaatgacttcatcatgatgcactgtgtgttcatgcccaacacccagctgtgcccagccctggtggcccactaccacgcccagcccagccagggcacagagcaggagaagatggactatgccctgaacaacaagagaagagtcatccggctggtgctgcagtgggccgccatgtacggggacctgctgcaggaggatgatgtgtccatggccttcctggaggagttctacgtgtctgtgtctgatgatgccaggatgattgctgccctgaaggagcagctgcctgagctggagaagatcgtgaagcagatcagtgaagatgccaaggccccccagaagaagcacaaggtgctgctgcagcagttcaacacaggagatgagcgggcccagaagaggcagcccatccggggcagtgatgaggtgctcttcaaggtgtactgcatggaccacacctacaccaccatccgggtgcctgtggccacctctgtgaaggaggtgatctctgctgtggccgacaagctgggcagcggggagggcctcatcatcgtgaagatgagcagcggcggggagaaggtggtgctgaagcccaatgatgtgtctgtgttcaccaccctgaccatcaatggccgcctgtttgcctgcccccgggagcagtttgacagcctgacccccctgcctgagcaggagggccccaccgtgggcaccgtgggcacctttgagctgatgagcagcaaggacctggcctaccagatgaccatctatgactgggagctgttcaactgtgtgcatgagctggagctgatctaccacaccttcggccgccacaacttcaagaagaccacagccaacctggacctcttcctgcggcgcttcaatgagatccagttctgggtggtgacagagatctgcctgtgcagccagctgagcaagagggtgcagctgctgaagaagttcatcaagattgctgcccactgcaaggagtacaagaacctgaacagcttctttgccatcgtgatgggcctgagcaatgtggccgtgtcccggctggccctgacctgggagaagctgcccagcaagttcaagaagttctacgccgagtttgagagcctgatggaccccagcaggaaccaccgggcctaccgcctgactgtggccaagctggagcccccactcatccccttcatgcccctgctgatcaaggacatgaccttcacccatgagggcaacaagaccttcatcgacaacctggtgaactttgagaagatgaggatgattgccaacacagccaggacagtgcgctactaccgcagccagcccttcaacccagatgctgcccaggccaacaagaaccaccaggatgtgcgctcctatgtgcggcagctgaatgtgattgacaaccagaggaccctgagccagatgagccaccggctggagccccggcggccctag

SEQ ID NO: 37394 - DNA, 2604 bp, Artificial Sequence
  Description of Artificial Sequence: Synthetic coding sequence
atgctgtacaagaagtaccggcagtacatggccggcctgctggccccaccctacggcgtgatggagaccggcagcaacaatgaccgcatcccagacaaggagaacacccccctgattgagccccacgtgcccctgcggcctgccaacaccatcaccaaggtgcccagcgagaagatcctgcgggccggcaagatcctgagaaatgccatcctgagccgggccccccacatgatccgggacaggaagtaccacctgaagacctaccggcagtgctgcgtgggcacagagctggtggactggatgatgcagcagaccccctgtgtgcacagcaggacccaggccgtgggcatgtggcaggtgctgctggaggatggagtgctgaaccacgtggaccaggagcaccacttccaggacaagtacctgttctaccgcttcctggatgatgaacatgaagatgcccccctgcccacagaggaggagaagaaggaatgtgatgaggagctgcaggacaccatgctgctgctgagccagatgggcccagatgcccacatgaggatgatcctgaggaagcccccaggccagaggacagtggatgacctggagatcatctatgaggagctgctgcacatcaaggccctgagccacctgagcaccaccgtgaagcgggagctggccggcgtgctgatctttgagagccacgccaagggcggcaccgtgctcttcaaccagggcgaggagggcacctcctggtacatcatcctgaagggctctgtgaatgtggtgatctatggaaaaggagtggtgtgcaccctgcacgagggagatgactttgggaagctggccctggtgaatgatgcccccagggctgccagcatcgtgctgcgggaggacaactgccacttcctgcgggtggacaaggaggacttcaaccgcatcctgagagatgtggaggccaacacagtgcggctgaaggagcatgaccaggatgtgctggtgctggagaaggtgcctgctggcaacagagccagcaaccagggcaacagccagccccagcagaagtacacagtgatgagcggcaccccagagaagatcctggagcacttcctggagaccatccggctggaggccaccctgaatgaggccacagacagcgtgctgaatgacttcatcatgatgcactgtgtgttcatgcccaacacccagctgtgcccagccctggtggcccactaccacgcccagcccagccagggcacagagcaggagaagatggactatgccctgaacaacaagagaagagtcatccggctggtgctgcagtgggccgccatgtacggggacctgctgcaggaggatgatgtgtccatggccttcctggaggagttctacgtgtctgtgtctgatgatgccaggatgattgctgccctgaaggagcagctgcctgagctggagaagatcgtgaagcagatcagtgaagatgccaaggccccccagaagaagcacaaggtgctgctgcagcagttcaacacaggagatgagcgggcccagaagaggcagcccatccggggcagtgatgaggtgctcttcaaggtgtactgcatggaccacacctacaccaccatccgggtgcctgtggccacctctgtgaaggaggtgatctctgctgtggccgacaagctgggcagcggggagggcctcatcatcgtgaagatgagcagcggcggggagaaggtggtgctgaagcccaatgatgtgtctgtgttcaccaccctgaccatcaatggccgcctgtttgcctgcccccgggagcagtttgacagcctgacccccctgcctgagcaggagggccccaccgtgggcaccgtgggcacctttgagctgatgagcagcaaggacctggcctaccagatgaccatctatgactgggagctgttcaactgtgtgcatgagctggagctgatctaccacaccttcggccgccacaacttcaagaagaccacagccaacctggacctcttcctgcggcgcttcaatgagatccagttctgggtggtgacagagatctgcctgtgcagccagctgagcaagagggtgcagctgctgaagaagttcatcaagattgctgcccactgcaaggagtacaagaacctgaacagcttctttgccatcgtgatgggcctgagcaatgtggccgtgtcccggctggccctgacctgggagaagctgcccagcaagttcaagaagttctacgccgagtttgagagcctgatggaccccagcaggaaccaccgggcctaccgcctgactgtggccaagctggagcccccactcatccccttcatgcccctgctgatcaaggacatgaccttcacccatgagggcaacaagaccttcatcgacaacctggtgaactttgagaagatgaggatgattgccaacacagccaggacagtgcgctactaccgcagccagcccttcaacccagatgctgcccaggccaacaagaaccaccaggatgtgcgctcctatgtgcggcagctgaatgtgattgacaaccagaggaccctgagccagatgagccaccggctggagccccggcggccctag

SEQ ID NO: 37395 - DNA, 2832 bp, Artificial Sequence
  Description of Artificial Sequence: Synthetic coding sequence
atggtggccgcccacgccgcccacagcagcagcagcgctgagtggatcgcctgcctggacaagaggcccctggagaggagcagtgaagatgtggacatcatcttcacccggctgaaggaggtgaaggcctttgagaagttccaccccaacctgctgcaccagatctgcctgtgtggctactatgagaacctggagaagggcatcaccctcttccggcagggcgacatcggcaccaactggtatgctgtgctggccggcagcctggatgtgaaggtgtctgagaccagcagccaccaggatgctgtgaccatctgcaccctgggcattggaacagcctttggagagagcatcctggacaacacccccaggcatgccaccatcgtgacccgggagagcagcgagctgctgcgcatcgagcagaaggacttcaaggccctgtgggagaagtaccggcagtacatggccggcctgctggccccaccctacggcgtgatggagaccggcagcaacaatgaccgcatcccagacaaggagaacacccccctgattgagccccacgtgcccctgcggcctgccaacaccatcaccaaggtgcccagcgagaagatcctgcgggccggcaagatcctgagaaatgccatcctgagccgggccccccacatgatccgggacaggaagtaccacctgaagacctaccggcagtgctgcgtgggcacagagctggtggactggatgatgcagcagaccccctgtgtgcacagcaggacccaggccgtgggcatgtggcaggtgctgctggaggatggagtgctgaaccacgtggaccaggagcaccacttccaggacaagtacctgttctaccgcttcctggatgatgaacatgaagatgcccccctgcccacagaggaggagaagaaggaatgtgatgaggagctgcaggacaccatgctgctgctgagccagatgggcccagatgcccacatgaggatgatcctgaggaagcccccaggccagaggacagtggatgacctggagatcatctatgaggagctgctgcacatcaaggccctgagccacctgagcaccaccgtgaagcgggagctggccggcgtgctgatctttgagagccacgccaagggcggcaccgtgctcttcaaccagggcgaggagggcacctcctggtacatcatcctgaagggctctgtgaatgtggtgatctatggaaaaggagtggtgtgcaccctgcacgagggagatgactttgggaagctggccctggtgaatgatgcccccagggctgccagcatcgtgctgcgggaggacaactgccacttcctgcgggtggacaaggaggacttcaaccgcatcctgagagatgtggaggccaacacagtgcggctgaaggagcatgaccaggatgtgctggtgctggagaaggtgcctgctggcaacagagccagcaaccagggcaacagccagccccagcagaagtacacagtgatgagcggcaccccagagaagatcctggagcacttcctggagaccatccggctggaggccaccctgaatgaggccacagacagcgtgctgaatgacttcatcatgatgcactgtgtgttcatgcccaacacccagctgtgcccagccctggtggcccactaccacgcccagcccagccagggcacagagcaggagaagatggactatgccctgaacaacaagagaagagtcatccggctggtgctgcagtgggccgccatgtacggggacctgctgcaggaggatgatgtgtccatggccttcctggaggagttctacgtgtctgtgtctgatgatgccaggatgattgctgccctgaaggagcagctgcctgagctggagaagatcgtgaagcagatcagtgaagatgccaaggccccccagaagaagcacaaggtgctgctgcagcagttcaacacaggagatgagcgggcccagaagaggcagcccatccggggcagtgatgaggtgctcttcaaggtgtactgcatggaccacacctacaccaccatccgggtgcctgtggccacctctgtgaaggaggtgatctctgctgtggccgacaagctgggcagcggggagggcctcatcatcgtgaagatgagcagcggcggggagaaggtggtgctgaagcccaatgatgtgtctgtgttcaccaccctgaccatcaatggccgcctgtttgcctgcccccgggagcagtttgacagcctgacccccctgcctgagcaggagggccccaccgtgggcaccgtgggcacctttgagctgatgagcagcaaggacctggcctaccagatgaccatctatgactgggagctgttcaactgtgtgcatgagctggagctgatctaccacaccttcggccgccacaacttcaagaagaccacagccaacctggacctcttcctgcggcgcttcaatgagatccagttctgggtggtgacagagatctgcctgtgcagccagctgagcaagagggtgcagctgctgaagaagttcatcaagattgctgcccactgcaaggagtacaagaacctgaacagcttctttgccatcgtgatgggcctgagcaatgtggccgtgtcccggctggccctgacctgggagaggatgattgccaacacagccaggacagtgcgctactaccgcagccagcccttcaacccagatgctgcccaggccaacaagaaccaccaggatgtgcgctcctatgtgcggcagctgaatgtgattgacaaccagaggaccctgagccagatgagccaccggctggagccccggcggccctag

SEQ ID NO: 37396 - DNA, 2376 bp, Artificial Sequence
  Description of Artificial Sequence: Synthetic coding sequence
atgatccgggacaggaagtaccacctgaagacctaccggcagtgctgcgtgggcacagagctggtggactggatgatgcagcagaccccctgtgtgcacagcaggacccaggccgtgggcatgtggcaggtgctgctggaggatggagtgctgaaccacgtggaccaggagcaccacttccaggacaagtacctgttctaccgcttcctggatgatgaacatgaagatgcccccctgcccacagaggaggagaagaaggaatgtgatgaggagctgcaggacaccatgctgctgctgagccagatgggcccagatgcccacatgaggatgatcctgaggaagcccccaggccagaggacagtggatgacctggagatcatctatgaggagctgctgcacatcaaggccctgagccacctgagcaccaccgtgaagcgggagctggccggcgtgctgatctttgagagccacgccaagggcggcaccgtgctcttcaaccagggcgaggagggcacctcctggtacatcatcctgaagggctctgtgaatgtggtgatctatggaaaaggagtggtgtgcaccctgcacgagggagatgactttgggaagctggccctggtgaatgatgcccccagggctgccagcatcgtgctgcgggaggacaactgccacttcctgcgggtggacaaggaggacttcaaccgcatcctgagagatgtggaggccaacacagtgcggctgaaggagcatgaccaggatgtgctggtgctggagaaggtgcctgctggcaacagagccagcaaccagggcaacagccagccccagcagaagtacacagtgatgagcggcaccccagagaagatcctggagcacttcctggagaccatccggctggaggccaccctgaatgaggccacagacagcgtgctgaatgacttcatcatgatgcactgtgtgttcatgcccaacacccagctgtgcccagccctggtggcccactaccacgcccagcccagccagggcacagagcaggagaagatggactatgccctgaacaacaagagaagagtcatccggctggtgctgcagtgggccgccatgtacggggacctgctgcaggaggatgatgtgtccatggccttcctggaggagttctacgtgtctgtgtctgatgatgccaggatgattgctgccctgaaggagcagctgcctgagctggagaagatcgtgaagcagatcagtgaagatgccaaggccccccagaagaagcacaaggtgctgctgcagcagttcaacacaggagatgagcgggcccagaagaggcagcccatccggggcagtgatgaggtgctcttcaaggtgtactgcatggaccacacctacaccaccatccgggtgcctgtggccacctctgtgaaggaggtgatctctgctgtggccgacaagctgggcagcggggagggcctcatcatcgtgaagatgagcagcggcggggagaaggtggtgctgaagcccaatgatgtgtctgtgttcaccaccctgaccatcaatggccgcctgtttgcctgcccccgggagcagtttgacagcctgacccccctgcctgagcaggagggccccaccgtgggcaccgtgggcacctttgagctgatgagcagcaaggacctggcctaccagatgaccatctatgactgggagctgttcaactgtgtgcatgagctggagctgatctaccacaccttcggccgccacaacttcaagaagaccacagccaacctggacctcttcctgcggcgcttcaatgagatccagttctgggtggtgacagagatctgcctgtgcagccagctgagcaagagggtgcagctgctgaagaagttcatcaagattgctgcccactgcaaggagtacaagaacctgaacagcttctttgccatcgtgatgggcctgagcaatgtggccgtgtcccggctggccctgacctgggagaagctgcccagcaagttcaagaagttctacgccgagtttgagagcctgatggaccccagcaggaaccaccgggcctaccgcctgactgtggccaagctggagcccccactcatccccttcatgcccctgctgatcaaggacatgaccttcacccatgagggcaacaagaccttcatcgacaacctggtgaactttgagaagatgaggatgattgccaacacagccaggacagtgcgctactaccgcagccagcccttcaacccagatgctgcccaggccaacaagaaccaccaggatgtgcgctcctatgtgcggcagctgaatgtgattgacaaccagaggaccctgagccagatgagccaccggctggagccccggcggccctag

SEQ ID NO: 37397 - DNA, 2523 bp, Artificial Sequence
  Description of Artificial Sequence: Synthetic coding sequence
atggccggcctgctggccccaccctatggagtgatggagaccggcagcaacaatgaccgcatcccagacaaggaaaatgtgcccagcgagaagatcctgcgggccggcaagatcctgagaaatgccatcctgagccgggccccccacatgatccgggacaggaagtaccacctgaagacctaccggcagtgctgcgtgggcacagagctggtggactggatgatgcagcagaccccctgtgtgcacagcaggacccaggccgtgggcatgtggcaggtgctgctggaggatggagtgctgaaccacgtggaccaggagcaccacttccaggacaagtacctgttctaccgcttcctggatgatgaacatgaagatgcccccctgcccacagaggaggagaagaaggaatgtgatgaggagctgcaggacaccatgctgctgctgagccagatgggcccagatgcccacatgaggatgatcctgaggaagcccccaggccagaggacagtggatgacctggagatcatctatgaggagctgctgcacatcaaggccctgagccacctgagcaccaccgtgaagcgggagctggccggcgtgctgatctttgagagccacgccaagggcggcaccgtgctcttcaaccagggcgaggagggcacctcctggtacatcatcctgaagggctctgtgaatgtggtgatctacggcaagggcgtggtgtgcaccctgcatgaaggagatgactttgggaagctggccctggtgaatgatgccccccgggccgccagcatcgtgctgcgggaggacaactgccacttcctgcgggtggacaaggaggacttcaaccgcatcctgagagatgtggaggccaacacagtgcggctgaaggagcatgaccaggatgtgctggtgctggagaaggtgcctgctggcaacagagccagcaaccagggcaacagccagccccagcagaagtacacagtgatgagcggcaccccagagaagatcctggagcacttcctggagaccatccggctggaggccaccctgaatgaggccacagattctgtgctgaatgacttcatcatgatgcactgtgtgttcatgcccaacacccagctgtgcccagccctggtggcccactaccacgcccagcccagccagggcacagagcaggagaagatggactatgccctgaacaacaagagaagagtcatccggctggtgctgcagtgggccgccatgtatggagacctgctgcaggaggatgatgtgtccatggccttcctggaggagttctacgtgtctgtgtctgatgatgccaggatgattgctgccctgaaggagcagctgcctgagctggagaagatcgtgaagcagatcagtgaagatgccaaggccccccagaagaagcacaaggtgctgctgcagcagttcaacacaggagatgagcgggcccagaagaggcagcccatccggggcagtgatgaggtgctcttcaaggtgtactgcatggaccacacctacaccaccatccgggtgcctgtggccacctctgtgaaggaggtgatctctgctgtggccgacaagctgggcagcggggagggcctcatcatcgtgaagatgagcagtggaggagagaaggtggtgctgaagcccaatgatgtgtctgtgttcaccaccctgaccatcaatggccgcctgtttgcctgcccccgggagcagtttgacagcctgacccccctgcctgagcaggagggccccaccgtgggcaccgtgggcacctttgagctgatgagcagcaaggacctggcctaccagatgaccatctatgactgggagctgttcaactgtgtgcatgagctggagctgatctaccacaccttcggccgccacaacttcaagaagaccacagccaacctggacctcttcctgcggcgcttcaatgagatccagttctgggtggtgacagagatctgcctgtgcagccagctgagcaagagggtgcagctgctgaagaagttcatcaagattgctgcccactgcaaggagtacaagaacctgaacagcttctttgccatcgtgatgggcctgagcaatgtggccgtgtcccggctggccctgacctgggagaagctgcccagcaagttcaagaagttctatgcagagtttgagagcctgatggaccccagcaggaaccaccgggcctaccgcctgactgtggccaagctggagcccccactcatccccttcatgcccctgctgatcaaggacatgaccttcacccatgagggcaacaagaccttcatcgacaacctggtgaactttgagaagatgaggatgattgccaacacagccaggacagtgcgctactaccgcagccagcccttcaacccagatgctgcccaggccaacaagaaccaccaggatgtgcgctcctatgtgcggcagctgaatgtcatcgacaaccagaggaccctgagccagatgagccaccggctggagccccggcggccctag

SEQ ID NO: 37398 - DNA, 2577 bp, Artificial Sequence
  Description of Artificial Sequence: Synthetic coding sequence
atggccggcctgctggccccaccctatggagtgatggagaccggcagcaacaatgaccgcatcccagacaaggagaacacccccctcatcgagccccacgtgcccctgcggcctgccaacaccatcaccaaggtgcccagcgagaagatcctgcgggccggcaagatcctgagaaatgccatcctgagccgggccccccacatgatccgggacaggaagtaccacctgaagacctaccggcagtgctgcgtgggcacagagctggtggactggatgatgcagcagaccccctgtgtgcacagcaggacccaggccgtgggcatgtggcaggtgctgctggaggatggagtgctgaaccacgtggaccaggagcaccacttccaggacaagtacctgttctaccgcttcctggatgatgaacatgaagatgcccccctgcccacagaggaggagaagaaggaatgtgatgaggagctgcaggacaccatgctgctgctgagccagatgggcccagatgcccacatgaggatgatcctgaggaagcccccaggccagaggacagtggatgacctggagatcatctatgaggagctgctgcacatcaaggccctgagccacctgagcaccaccgtgaagcgggagctggccggcgtgctgatctttgagagccacgccaagggcggcaccgtgctcttcaaccagggcgaggagggcacctcctggtacatcatcctgaagggctctgtgaatgtggtgatctacggcaagggcgtggtgtgcaccctgcatgaaggagatgactttgggaagctggccctggtgaatgatgccccccgggccgccagcatcgtgctgcgggaggacaactgccacttcctgcgggtggacaaggaggacttcaaccgcatcctgagagatgtggaggccaacacagtgcggctgaaggagcatgaccaggatgtgctggtgctggagaaggtgcctgctggcaacagagccagcaaccagggcaacagccagccccagcagaagtacacagtgatgagcggcaccccagagaagatcctggagcacttcctggagaccatccggctggaggccaccctgaatgaggccacagattctgtgctgaatgacttcatcatgatgcactgtgtgttcatgcccaacacccagctgtgcccagccctggtggcccactaccacgcccagcccagccagggcacagagcaggagaagatggactatgccctgaacaacaagagaagagtcatccggctggtgctgcagtgggccgccatgtatggagacctgctgcaggaggatgatgtgtccatggccttcctggaggagttctacgtgtctgtgtctgatgatgccaggatgattgctgccctgaaggagcagctgcctgagctggagaagatcgtgaagcagatcagtgaagatgccaaggccccccagaagaagcacaaggtgctgctgcagcagttcaacacaggagatgagcgggcccagaagaggcagcccatccggggcagtgatgaggtgctcttcaaggtgtactgcatggaccacacctacaccaccatccgggtgcctgtggccacctctgtgaaggaggtgatctctgctgtggccgacaagctgggcagcggggagggcctcatcatcgtgaagatgagcagtggaggagagaaggtggtgctgaagcccaatgatgtgtctgtgttcaccaccctgaccatcaatggccgcctgtttgcctgcccccgggagcagtttgacagcctgacccccctgcctgagcaggagggccccaccgtgggcaccgtgggcacctttgagctgatgagcagcaaggacctggcctaccagatgaccatctatgactgggagctgttcaactgtgtgcatgagctggagctgatctaccacaccttcggccgccacaacttcaagaagaccacagccaacctggacctcttcctgcggcgcttcaatgagatccagttctgggtggtgacagagatctgcctgtgcagccagctgagcaagagggtgcagctgctgaagaagttcatcaagattgctgcccactgcaaggagtacaagaacctgaacagcttctttgccatcgtgatgggcctgagcaatgtggccgtgtcccggctggccctgacctgggagaagctgcccagcaagttcaagaagttctatgcagagtttgagagcctgatggaccccagcaggaaccaccgggcctaccgcctgactgtggccaagctggagcccccactcatccccttcatgcccctgctgatcaaggacatgaccttcacccatgagggcaacaagaccttcatcgacaacctggtgaactttgagaagatgaggatgattgccaacacagccaggacagtgcgctactaccgcagccagcccttcaacccagatgctgcccaggccaacaagaaccaccaggatgtgcgctcctatgtgcggcagctgaatgtcatcgacaaccagaggaccctgagccagatgagccaccggctggagccccggcggccctag

SEQ ID NO: 37399 - DNA, 1200 bp, Artificial Sequence
  Description of Artificial Sequence: Synthetic coding sequence
atgtttgtgtttgtgctgacccccctcatcgagccccacgtgcccctgcggcctgccaacaccatcaccaaggtgcccagcgagaagatcctgcgggccggcaagatcctgagaaatgccatcctgagccgggccccccacatgatccgggacaggaagtaccacctgaagacctaccggcagtgctgcgtgggcacagagctggtggactggatgatgcagcagaccccctgtgtgcacagcaggacccaggccgtgggcatgtggcaggtgctgctggaggatggagtgctgaaccacgtggaccaggagcaccacttccaggacaagtacctgttctaccgcttcctggatgatgaacatgaagatgcccccctgcccacagaggaggagaagaaggaatgtgatgaggagctgcaggacaccatgctgctgctgagccagatgggcccagatgcccacatgaggatgatcctgaggaagcccccaggccagaggacagtggatgacctggagatcatctatgaggagctgctgcacatcaaggccctgagccacctgagcaccaccgtgaagcgggagctggccggcgtgctgatctttgagagccacgccaagggcggcaccgtgctcttcaaccagggcgaggagggcacctcctggtacatcatcctgaagggctctgtgaatgtggtgatctacggcaagggcgtggtgtgcaccctgcatgaaggagatgactttgggaagctggccctggtgaatgatgccccccgggccgccagcatcgtgctgcgggaggacaactgccacttcctgcgggtggacaaggaggacttcaaccgcatcctgagagatgtggaggccaacacagtgcggctgaaggagcatgaccaggatgtgctggtgctggagaaggtgcctgctggcaacagagccagcaaccagggcaacagccagccccagcagaagtacacagtgatgagcggcaccccagagaagatcctggagcacttcctggagaccatccggctggaggccaccctgaatgaggccacagattctgtgctgaatgacttcatcatgatgcactgtgtgttcatgcccaacacccagctgtgcccagccctggtggcccactaccacgcccagcccagccgctacagaactggagaaaatggcctgtgcccccagcagtag

SEQ ID NO: 37400 - DNA, 2577 bp, Artificial Sequence; identical to SEQ ID NO: 37398
  Description of Artificial Sequence: Synthetic coding sequence

SEQ ID NO: 37401 - DNA, 552 bp, Artificial Sequence
  Description of Artificial Sequence: Synthetic coding sequence
atgagggagtacaaggtggtggtgctgggcagcggaggagtgggcaagagcgccctgactgtgcagtttgtgacaggcagcttcatcgagaagtatgaccccaccatcgaggacttctacaggaaggagattgaggtggacagcagccccagcgtgctggagatcctggacacagctggaacagagcagtttgcctccatgagggacctgtacatcaagaatggccagggcttcatcctggtgtacagcctggtgaaccagcagagcttccaggacatcaagcccatgagggaccagatcatccgggtgaagagatatgaaagagtgcccatgatcctggtgggcaacaaggtggacctggagggggagcgggaggtgtcctatggagagggcaaggccctggccgaggagtggagctgccccttcatggagaccagcgccaagaacaaggcctctgtggatgagctgtttgctgagatcgtgcggcagatgaactatgctgcccagcccaatggagatgagggctgctgcagcgcctgcgtcatcctgtag

SEQ ID NO: 37402 - DNA, 552 bp, Artificial Sequence
  Description of Artificial Sequence: Synthetic coding sequence
atgagggagtacaaggtggtggtgctgggcagcggaggagtgggcaagagcgccctgactgtgcagtttgtgacaggcaccttcatcgagaagtatgaccccaccatcgaggacttctacaggaaggagattgaggtggacagcagccccagcgtgctggagatcctggacacagctggaacagagcagtttgcctccatgagggacctgtacatcaagaatggccagggcttcatcctggtgtacagcctggtgaaccagcagagcttccaggacatcaagcccatgagggaccagatcgtgcgggtgaagagatatgagaaggtgcccctcatcctggtgggcaacaaggtggacctggagcctgagcgggaggtgatgagcagcgagggccgggccctggcccaggagtggggctgccccttcatggagaccagcgccaagagcaagtccatggtggatgagctgtttgctgagatcgtgcggcagatgaactacagcagcctgcctgagaagcaggaccagtgctgcaccacctgtgtggtgcagtag

SEQ ID NO: 37403 - DNA, 552 bp, Artificial Sequence; identical to SEQ ID NO: 37402
  Description of Artificial Sequence: Synthetic coding sequence

SEQ ID NO: 37404 - DNA, 1023 bp, Artificial Sequence
  Description of Artificial Sequence: Synthetic coding sequence
atgcacacagacctggacacagacatggacatggacacagagaccacagccctgtgccccagcggcagccggcgggccagccccccaggcacccccaccccagaggctgatgccaccctgctgaagaagtctgagaagctgctggccgagctggacaggagcggcctgcccagcgcccctggggcccccaggagaagaggctccatgcctgtgccctacaagcaccagctgcggcgggcccaggccgtggatgagctggactggccaccccaggccagcagcagcggcagcagtgacagcctgggcagcggggaggccgccccagcccagaaggatggcatcttcaaggtgatgctggtgggggagagcggcgtgggcaagagcaccctggccggcaccttcggcggcctgcagggcgacagcgcccacgagcctgagaaccctgaggacacctatgaaagacgcatcatggtggacaaggaggaggtgaccctggtggtgtatgacatctgggagcagggagatgctgggggctggctgcgggaccactgcctgcagacaggagatgccttcctgattgtgttttctgtgacagaccggcgctccttcagcaaggtgcctgagaccctgctgcggctgcgggccggccggccccaccacgacctgcctgtgatcctggtgggcaacaagagtgacctggcccggagccgggaggtgtccctggaggagggccgccacctggccggcaccctgagctgcaagcacatcgagaccagcgctgccctgcaccacaacacccgggagctgtttgagggcgctgtgcggcagatccggctgcggcggggcagaaatcatgctgggggccagaggccagaccccggcagccctgagggccctgcccccccagcccggcgggagagcctgaccaagaaggccaagcgcttcctggccaacctggtgcccagaaatgccaagttcttcaagcagaggagccgcagctgccacgacctgtctgtgctgtag

SEQ ID NO: 37405 - DNA, 666 bp, Artificial Sequence
  Description of Artificial Sequence: Synthetic coding sequence
atgcacacagacctggacacagacatggacatggacacagagaccacagccctgtgccccagcggcagccggcgggccagccccccaggcacccccaccccagaggctgatgccaccctgctgaagaagtctgagaagctgctggccgagctggacaggagcggcctgcccagcgcccctggggcccccaggagaagaggctccatgcctgtgccctacaagcaccagctgcggcgggcccaggccgtggatgagctggactggccaccccaggccagcagcagcggcagcagtgacagcctgggcagcggggaggccgccccagcccagaaggatggcatcttcaaggtgatgctggtgggggagagcggcgtgggcaagagcaccctggccggcaccttcggcggcctgcagggcgacagcgcccacgagcctgagaaccctgggggctgccggcgggtggccgccggccccctgcccagcgaccggggccgcctgagccaccggctgctgagccaccggcccacagagttcctgcagagcagccgggaccccaccagcgcccctggctgggaggccgccccccggcccacccgctacccccgctggaagcaggagcggctgggccccctgcccggcggcatcaccggcggctgtgtgtcctag

SEQ ID NO: 37406 - DNA, 897 bp, Artificial Sequence
  Description of Artificial Sequence: Synthetic coding sequence
atgaccctgaacacagagcaggaggccaagacccccctgcacagaagagccagcacccccctgcccctgagcccccggggccaccagcccggccgcctgagcacagtgcccagcacccagagccagcacccccggctgggccagagcgccagcctgaacccccccacccagaagcccagccctgccccagatgactggagcagcgagagcagtgacagcgagggctcctgggaggccctgtacagagtggtgctgctgggggaccccggggtgggcaagaccagcctggccagcctgtttgctgggaagcaggagcgggacctgcacgagcagctgggggaggatgtgtatgaaagaaccctgactgtggatggagaggacaccaccctggtggtggtggacacctgggaggccgagaagctggacaagtcctggagccaggagagctgcctgcagggcggcagcgcctacgtgattgtgtacagcattgctgaccggggcagctttgaaagtgccagcgagctgcgcatccagctgcggaggacccaccaggccgaccacgtgcccatcatcctggtgggcaacaaggctgacctggcccgctgccgggaggtgtctgtggaggagggccgggcctgtgctgtggtgtttgactgcaagttcatcgagaccagcgccaccctgcagcacaacgtggccgagctgtttgagggcgtggtgcggcagctgcggctgcggcggcgggacagcgctgccaaggagcccccagcccccaggaggcctgccagcctggcccagagggcccggcgcttcctggcccggctgacagcccggagcgcccggcggcgggccctgaaggcccggagcaagagctgccacaacctggccgtgctgtag

SEQ ID NO: 37407 - DNA, 2352 bp, Artificial Sequence
  Description of Artificial Sequence: Synthetic coding sequence
atggagagccctggagagagcggggccggcagccctggggcccccagccccagcagcttcaccaccggccacctggcccgggagaagccagcccaggaccccctgtatgatgtgcccaatgccagcggcggccaggccggcggcccccagaggcctggccgggtggtgtccctgcgggagcggctgctgctgaccaggcctgtgtggctgcagctgcaggccaatgctgctgctgccctgcacatgctgaggacagagcccccaggcaccttcctggtgaggaagagcaacacccggcagtgccaggccctgtgcatgaggctgcctgaggccagcggccccagctttgtgagcagccactacatcctggagagccctgggggcgtgtccctggagggcagcgagctgatgtttcctgacctggtgcagctgatctgtgcctactgccacacccgggacatcctgctgctgcccctgcagctgccccgggccatccaccacgccgccacccacaaggagctggaggccatcagccacctgggcatcgagttctggagcagcagcctgaacatcaaggcccagaggggccctgctgggggccctgtgctgccccagctgaaggcccggagcccccaggagctggaccagggcaccggggccgccctgtgcttcttcaaccccctcttccctggggacctgggccccaccaagcgggagaagttcaagaggagcttcaaggtgcgggtgtccacagagaccagcagccccctgagccccccagctgtgcccccacctcctgtgcctgtgctgcctggagctgtgcccagccagacagagcggctgcccccctgccagctgctgcggcgggagagctctgtgggctacagagtgcctgctggcagcggccccagcctgccccccatgcccagcctgcaggaggtggactgtggcagccccagcagcagcgaggaggagggcgtgcccggcagccggggcagccctgccaccagcccccacctgggcagaagaagacccctgctgcgctccatgtctgctgccttctgcagcctgctggcccctgagcggcaggtgggccgggctgctgctgccctgatgcaggacagacacacagctgctggccagctggtgcaggacctgctgacccaggtgcgggccggccctgagccccaggagctgcagggcatccggcaggccctgagccgggcccgggccatgctgtctgctgagctgggccctgagaagctgctgagccccaagaggctggagcacgtgctggagaagagcctgcactgcagcgtgctgaagcccctgcggcccatcctggccgcccggctgcggcggcggctggccgcagatggcagcctgggccgcctggccgagggcctgcggctggcccgggcccagggccctggggccttcggcagccacctgagcctgcccagccctgtggagctggagcaggtgcggcagaagctgctgcagctgctgcggacctacagccccagcgcccaggtgaagaggctgctgcaggcctgcaagctgctgtacatggccctgcggacccaggagggggagggcgctggagcagatgagttcctgcccctgctgagcctggtgctggcccactgtgacctgcctgagctgctgctggaggccgagtacatgtctgagctgctggagcccagcctgctgaccggggagggcggctactacctgaccagcctgagcgccagcctggccctgctgagcggcctgggccaggcccacaccctgcccctgagccctgtgcaggagctgcggcgcagcctgagcctgtgggagcagaggcggctgcctgccacccactgcttccagcacctgctgcgggtggcctaccaggaccccagcagcggctgcaccagcaagaccctggccgtgcccccagaggccagcatcgccaccctgaaccagctgtgtgccaccaagttccgggtgacccagcccaacaccttcggcctcttcctgtacaaggagcagggctaccaccggctgcccccaggggccctggcccaccggctgcccaccaccggctacctggtgtaccgccgggcagagtggccagagacccagggcgctgtgacagaggaggagggcagcggccagagcgaggcccggagcagaggagaggagcagggctgccagggagatggagatgctggggtgaaggccagcccccgggacatccgggagcagagcgagaccacagctgagggcggccagggccaggcccaggagggccctgcccagcccggggagcctgaggccgagggcagcagagctgctgaggagtag

SEQ ID NO: 37408 - DNA, 1818 bp, Artificial Sequence
  Description of Artificial Sequence: Synthetic coding sequence
atgaggctgcctgaggccagcggccccagctttgtgagcagccactacatcctggagagccctggaggagtgtccctggagggcagcgagctgatgtttcctgacctggtgcagctgatctgtgcctactgccacacccgggacatcctgctgctgcccctgcagctgccccgggccatccaccacgccgccacccacaaggagctggaggccatcagccacctgggcatcgagttctggagcagcagcctgaacatcaaggcccagaggggccctgctgggggccctgtgctgccccagctgaaggcccggagcccccaggagctggaccagggcactggagctgccctgtgcttcttcaaccccctcttccctggggacctgggccccaccaagcgggagaagttcaagaggagcttcaaggtgcgggtgtccacagagaccagcagccccctgagccccccagctgtgcccccacctcctgtgcctgtgctgcccggggctgtgcccagccagacagagcggctgcccccctgccagctgctgcggcgggagagctctgtgggctacagagtgcctgctggcagcggccccagcctgccccccatgcccagcctgcaggaggtggactgtggcagccccagcagcagcgaggaggagggcgtgcccggcagccggggcagccctgccaccagcccccacctgggcagaagaagacccctgctgcgctccatgtctgctgccttctgcagcctgctggcccctgagcggcaggtgggccgggctgctgctgccctgatgcaggacagacacacagctgctggccagctggtgcaggacctgctgacccaggtgcgggccggccctgagccccaggagctgcagggcatccggcaggccctgagccgggcccgggccatgctgtctgctgagctgggccctgagaagctgctgagccccaagaggctggagcacgtgctggagaagagcctgcactgcagcgtgctgaagcccctgcggcccatcctggccgcccggctgcggcggcggctggccgcagatggcagcctgggccgcctggccgagggcctgcggctggcccgggcccagggccctggggccttcggcagccacctgagcctgcccagccctgtggagctggagcaggtgcggcagaagctgctgcagctgctgcggacctacagccccagcgcccaggtgaagaggctgctgcaggcctgcaagctgctgtacatggccctgcggacccaggagggggagggcgctggagcagatgagttcctgcccctgctgagcctggtgctggcccactgtgacctgcctgagctgctgctggaggccgagtacatgtctgagctgctggagcccagcctgctgactggagagggcggctactacctgaccagcctgagcgccagcctggccctgctgagcggcctgggccaggcccacaccctgcccctgagccctgtgcaggagctgcggcgcagcctgagcctgtgggagcagaggcggctgcctgccacccactgcttccagcacctgctgcgggtggcctaccaggaccccagcagcggctgcaccagcaagaccctggccgtgcccccagaggccagcatcgccaccctgaaccagctgtgtgccaccaagttccgggtgacccagcccaacaccttcggcctcttcctgcagggcaaccagaggcagcgggaggccggccagcagaggagcagcctgaagtggccagagggcagctttggagctggggaccctgagcctgctgagaagagcttctag

SEQ ID NO: 37409 - DNA, 1935 bp, Artificial Sequence
  Description of Artificial Sequence: Synthetic coding sequence
atggagcagctgagtgatgaggagattgaccatggagcagaagaagattctgacaaggaggaccaggacctggacaagatgtttggagcctggctgggggagctggacaagctgacccagagcctggacagcgacaagcccatggagcctgtgaagaggagccccctgcggcaggagaccaacatggccaacttctcctaccgcttcagcatctacaacctgaatgaggccctgaaccagggcgagaccgtggacctggatgccctgatggctgacctgtgcagcattgagcaggagctgagcagcatcggcagcggcaacagcaagaggcagatcacagagaccaaggccacccagaagctgcctgtgagccgccacaccctgaagcacggcaccctgaagggcctgagcagcagcagcaacagaattgccaagcccagccacgccagctacagcctggatgatgtgacagcccagctggagcaggccagcctgtccatggatgaggccgcccagcagagcgtgctggaggacaccaagcccctggtgaccaaccagcacagaagaacagccagcgctggcaccgtgtctgatgctgaggtgcacagcatcagcaacagcagccacagcagcatcaccagcgctgccagctccatggacagcctggacatcgacaaggtgacccggccccaggagctggacctgacccaccagggccagcccatcacagaacatgccatcagcctgcgctgcagcagcaagcaggccaagaggcacatcgacttcacagaggagcaggccgagctgaccccccacagctacctggaccgggagaccagcctgctgctgaggaacattgctgggaagcccagccacctgctgaccaaggaggagcaggccgccaagctgaaggccgagaagatccgggtggccctggagaagatcaaggaggcccaggtgaagaagctggtgatccgggtgcacatgtctgatgacagcagcaagaccatgatggtggatgagcggcagacagtgcggcaggtgctggacaacctgatggacaagagccactgcggctacagcctggactggagcctggtggagaccgtgtctgagctgcagatggagcgcatctttgaggaccacgagaacctggtggagaacctgctgaactggacccgggacagccagaacaagctgatcttcatggagcgcatcgagaagtatgccctcttcaagaacccccagaactacctgctgggcaagaaggagacagctgagatggctgacaggaacaaggaggtgctgctggaggagtgcttctgtggcagctctgtgacagtgcctgagattgaaggagtgctgtggctgaaggatgatggcaagaagtcctggaagaagcgctacttcctgctgcgggccagcggcatctactacgtgcccaagggcaaggccaaggtgtcccgggacctggtgtgcttcctgcagctggaccacgtgaatgtgtactacggccaggactacagaaacaagtacaaggcccccacagactactgcctggtgctgaagcacccccagatccagaagaagagccagtacatcaagtacctgtgctgtgatgatgtgaggaccctgcaccagtgggtgaatggcatccgcatcgccaagtatggcaagcagctgtacatgaactaccaggaggccctgaagaggacagagagcgcctatgactggaccagcctgagcagcagcagcatcaagagcggcagcagcagcagcagcatccctgagagccagagcaaccacagcaaccagagcgacagcggcgtgtctgacacccagcctgctggccacgtgcgcagccagagcatcgtgtcctctgtgttcagcgaggcctggaagaggggcacccagctggaggagagcagcaagtag

SEQ ID NO: 37410 - DNA, 3753 bp, Artificial Sequence
  Description of Artificial Sequence: Synthetic coding sequence
atggagcagctgagtgatgaggagattgaccatggagcagaagaagattctgacaaggaggaccaggacctggacaagatgtttggagcctggctgggggagctggacaagctgacccagagcctggacagcgacaagcccatggagcctgtgaagaggagccccctgcggcaggagaccaacatggccaacttctcctaccgcttcagcatctacaacctgaatgaggccctgaaccagggcgagaccgtggacctggatgccctgatggctgacctgtgcagcattgagcaggagctgagcagcatcggcagcggcaacagcaagaggcagatcacagagaccaaggccacccagaagctgcctgtgagccgccacaccctgaagcacggcaccctgaagggcctgagcagcagcagcaacagaattgccaagcccagccacgccagctacagcctggatgatgtgacagcccagctggagcaggccagcctgtccatggatgaggccgcccagcagagcgtgctggaggacaccaagcccctggtgaccaaccagcacagaagaacagccagcgctggcaccgtgtctgatgctgaggtgcacagcatcagcaacagcagccacagcagcatcaccagcgctgccagctccatggacagcctggacatcgacaaggtgacccggccccaggagctggacctgacccaccagggccagcccatcacagaggaggagcaggccgccaagctgaaggccgagaagatccgggtggccctggagaagatcaaggaggcccaggtgaagaagctggtgatccgggtgcacatgtctgatgacagcagcaagaccatgatggtggatgagcggcagacagtgcggcaggtgctggacaacctgatggacaagagccactgcggctacagcctggactggagcctggtggagaccgtgtctgagctgcagatggagcgcatctttgaggaccacgagaacctggtggagaacctgctgaactggacccgggacagccagaacaagctgatcttcatggagcgcatcgagaagtatgccctcttcaagaacccccagaactacctgctgggcaagaaggagacagctgagatggctgacaggaacaaggaggtgctgctggaggagtgcttctgtggcagctctgtgacagtgcctgagattgaaggagtgctgtggctgaaggatgatggcaagaagtcctggaagaagcgctacttcctgctgcgggccagcggcatctactacgtgcccaagggcaaggccaaggtgtcccgggacctggtgtgcttcctgcagctggaccacgtgaatgtgtactacggccaggactacagaaacaagtacaaggcccccacagactactgcctggtgctgaagcacccccagatccagaagaagagccagtacatcaagtacctgtgctgtgatgatgtgaggaccctgcaccagtgggtgaatggcatccgcatcgccaagtatggcaagcagctgtacatgaactaccaggaggccctgaagaggacagagagcgcctatgactggaccagcctgagcagcagcagcatcaagagcggcagcagcagcagcagcatccctgagagccagagcaaccacagcaaccagagcgacagcggcgtgtctgacacccagcctgctggccacgtgcgcagccagagcatcgtgtcctctgtgttcagcgaggcctggaagaggggcacccagctggaggagagcagcaaggccaggatggagagcatgaaccggccctacaccagcctggtgccccccctgagcccccagcccaagatcgtgaccccctacacagccagccagcccagcccccccctgcccccacctcctcctcctcctcctcctcctcctcctcctcctcctcctcctcctccacccctgcccagccagagcgcccccagcgctggcagcgctgcccccatgtttgtgaagtacagcaccatcacccggctgcagaatgccagccagcacagcggggccctcttcaagccacccaccccacctgtgatgcagagccagagcgtgaagccccagatcctggtgccccccaacggggtggtgcccccacctcctcctcctcctcctccacccaccccaggcagcgccatggcccagctgaagccagccccctgtgcccccagcctgccccagttcagcgcccctcctccacccctgaagatccaccaggtgcagcacatcacccaggtggccccacccaccccacctcctcctccacccatcccagcccccctgcccccccaggccccacccaagcccctggtgaccatcccagcccccaccagcaccaagacagtggcccctgtggtgacccaggccgccccacccacccccaccccacctgtgcccccagccaagaagcagcctgccttccctgccagctacatcccccccagcccccccaccccacctgtgcctgtgcccccacccaccctgcccaagcagcagagcttctgtgccaagcccccacccagccccctgagccctgtgcccagcgtggtgaagcagatcgccagccagttccccccaccacccaccccaccagccatggagagccagcccctgaagcctgtgcctgccaacgtggccccccagagccccccagctgtgaaggccaagcccaagtggcagcccagcagcatccctgtgcccagcccagacttccccccacctcctcctgagagcagcctggtgttccccccacctccacccagccctgtgcctgcccctcctcctcctcctccacccacagccagccccaccccagacaagagcggcagccctgggaagaagaccagcaagaccagcagccctgggggcaagaagcccccacccaccccccagaggaacagcagcatcaagagcagcagtggagctgagcaccctgagcccaagaggcccagcgtggacagcctggtgtccaagttcaccccacctgctgagagcggcagccccagcaaggagaccctgcccccacctgctgccccacccaagccaggcaagctgaacctgtctggagtgaacctgcccggggtgctgcagcagggctgtgtgtctgccaaggcccctgtgctgagcggccggggcaaggacagcgtggtggagttccccagccccccaagtgacagcgacttccccccacctcctcctgagacagagctgcccctgccccccatcgagatcccagctgtgttcagcggcaacaccagccccaaggtggccgtggtgaacccccagccccagcagtggagcaagatgtctgtgaagaaggcccccccacccacccggcccaagagaaatgacagcacccggctgacccaggccgagatcagcgagcagcccaccatggccaccgtggtgccccaggtgcccaccagccccaagagcagcctgtctgtgcagcccggcttcctggccgacctgaacagaaccctgcagaggaagagcatcaccaggcatggcagcctgagcagcaggatgagcagagctgagcccacagccaccatggatgacatggccctgcccccacctcctcctgagctgctgagtgaccagcagaaggccggctacggcggcagccacatcagcggctacgccaccctgcggcggggccccccaccagccccacccaagagggaccagaacaccaagctgagccgggactggtag

SEQ ID NO: 37411 - DNA, 1854 bp, Artificial Sequence
  Description of Artificial Sequence: Synthetic coding sequence
atggagcagctgagtgatgaggagattgaccatggagcagaagaagattctgacaaggaggaccaggacctggacaagatgtttggagcctggctgggggagctggacaagctgacccagagcctggacagcgacaagcccatggagcctgtgaagaggagccccctgcggcaggagaccaacatggccaacttctcctaccgcttcagcatctacaacctgaatgaggccctgaaccagggcgagaccgtggacctggatgccctgatggctgacctgtgcagcattgagcaggagctgagcagcatcggcagcggcaacagcaagaggcagatcacagagaccaaggccacccagaagctgcctgtgagccgccacaccctgaagcacggcaccctgaagggcctgagcagcagcagcaacagaattgccaagcccagccacgccagctacagcctggatgatgtgacagcccagctggagcaggccagcctgtccatggatgaggccgcccagcagagcgtgctggaggacaccaagcccctggtgaccaaccagcacagaagaacagccagcgctggcaccgtgtctgatgctgaggtgcacagcatcagcaacagcagccacagcagcatcaccagcgctgccagctccatggacagcctggacatcgacaaggtgacccggccccaggagctggacctgacccaccagggccagcccatcacagagcacagctacctggaccgggagaccagcctgctgctgagaaatattgctgggaagcccagccacctgctgaccaaggaggagcaggccgccaagctgaaggccgagaagatccgggtggccctggagaagatcaaggaggcccaggtgaagaagctggtgatccgggtgcacatgtctgatgacagcagcaagaccatgatggtggatgagcggcagacagtgcggcaggtgctggacaacctgatggacaagagccactgcggctacagcctggactggagcctggtggagaccgtgtctgagctgcagatggagcgcatctttgaagatcatgagaacctggtggagaacctgctgaactggacccgggacagccagaacaagctgatcttcatggagagaattgagaagtatgccctcttcaagaacccccagaactacctgctgggcaagaaggagacagctgagatggctgacaggaacaaggaggtgctgctggaggagtgcttctgtggcagctctgtgacagtgcctgagattgagggcgtgctgtggctgaaggatgatggcaagaagtcctggaagaagcgctacttcctgctgcgggccagcggcatctactacgtgcccaagggcaaggccaaggtgtcccgggacctggtgtgcttcctgcagctggaccacgtgaatgtgtactacggccaggactacagaaacaagtacaaggcccccacagactactgcctggtgctgaagcacccccagatccagaagaagagccagtacatcaagtacctgtgctgtgatgatgtgaggaccctgcaccagtgggtgaatggcatcagaattgccaagtatggcaagcagctgtacatgaactaccaggaggccctgaagaggacagaaagtgcctatgactggaccagcctgagcagcagcagcatcaagagcggcagcagcagcagcagcatccctgagagccagagcaaccacagcaaccagagcgacagcggcgtgtctgacacccagcctgctggccacgtgcgcagccagagcatcgtgagcagcgtcttcagcgaggcctggaagaggggcacccagctggaggagagcagcaagtag

SEQ ID NO: 37412 - DNA, 1860 bp, Artificial Sequence
  Description of Artificial Sequence: Synthetic coding sequence
atggagcagctgagtgatgaggagattgaccatggagcagaagaagattctgacaaggaggaccaggacctggacaagatgtttggagcctggctgggggagctggacaagctgacccagagcctggacagcgacaagcccatggagcctgtgaagaggagccccctgcggcaggagaccaacatggccaacttctcctaccgcttcagcatctacaacctgaatgaggccctgaaccagggcgagaccgtggacctggatgccctgatggctgacctgtgcagcattgagcaggagctgagcagcatcggcagcggcaacagcaagaggcagatcacagagaccaaggccacccagaagctgcctgtgagccgccacaccctgaagcacggcaccctgaagggcctgagcagcagcagcaacagaattgccaagcccagccacgccagctacagcctggatgatgtgacagcccagctggagcaggccagcctgtccatggatgaggccgcccagcagagcgtgctggaggacaccaagcccctggtgaccaaccagcacagaagaacagccagcgctggcaccgtgtctgatgctgaggtgcacagcatcagcaacagcagccacagcagcatcaccagcgctgccagctccatggacagcctggacatcgacaaggtgacccggccccaggagctggacctgacccaccagggccagcccatcacagaacatgccatcagcctgcgctgcagcagcaagcaggccaagaggcacatcgacttcacagaggagcaggccgagctgaccccagaggagcaggccgccaagctgaaggccgagaagatccgggtggccctggagaagatcaaggaggcccaggtgaagaagctggtgatccgggtgcacatgtctgatgacagcagcaagaccatgatggtggatgagcggcagacagtgcggcaggtgctggacaacctgatggacaagagccactgcggctacagcctggactggagcctggtggagaccgtgtctgagctgcagatggagcgcatctttgaagatcatgagaacctggtggagaacctgctgaactggacccgggacagccagaacaagctgatcttcatggagagaattgagaagtatgccctcttcaagaacccccagaactacctgctgggcaagaaggagacagctgagatggctgacaggaacaaggaggtgctgctggaggagtgcttctgtggcagctctgtgacagtgcctgagattgagggcgtgctgtggctgaaggatgatggcaagaagtcctggaagaagcgctacttcctgctgcgggccagcggcatctactacgtgcccaagggcaaggccaaggtgtcccgggacctggtgtgcttcctgcagctggaccacgtgaatgtgtactacggccaggactacagaaacaagtacaaggcccccacagactactgcctggtgctgaagcacccccagatccagaagaagagccagtacatcaagtacctgtgctgtgatgatgtgaggaccctgcaccagtgggtgaatggcatcagaattgccaagtatggcaagcagctgtacatgaactaccaggaggccctgaagaggacagaaagtgcctatgactggaccagcctgagcagcagcagcatcaagagcggcagcagcagcagcagcatccctgagagccagagcaaccacagcaaccagagcgacagcggcgtgtctgacacccagcctgctggccacgtgcgcagccagagcatcgtgagcagcgtcttcagcgaggcctggaagaggggcacccagctggaggagagcagcaagtag

SEQ ID NO: 37413 - DNA, 3909 bp, Artificial Sequence
  Description of Artificial Sequence: Synthetic coding sequence
atggagcagctgagtgatgaggagattgaccatggagcagaagaagattctgacaaggaggaccaggacctggacaagatgtttggagcctggctgggggagctggacaagctgacccagagcctggacagcgacaagcccatggagcctgtgaagaggagccccctgcggcaggagaccaacatggccaacttctcctaccgcttcagcatctacaacctgaatgaggccctgaaccagggcgagaccgtggacctggatgccctgatggctgacctgtgcagcattgagcaggagctgagcagcatcggcagcggcaacagcaagaggcagatcacagagaccaaggccacccagaagctgcctgtgagccgccacaccctgaagcacggcaccctgaagggcctgagcagcagcagcaacagaattgccaagcccagccacgccagctacagcctggatgatgtgacagcccagctggagcaggccagcctgtccatggatgaggccgcccagcagagcgtgctggaggacaccaagcccctggtgaccaaccagcacagaagaacagccagcgctggcaccgtgtctgatgctgaggtgcacagcatcagcaacagcagccacagcagcatcaccagcgctgccagctccatggacagcctggacatcgacaaggtgacccggccccaggagctggacctgacccaccagggccagcccatcacagaacatgccatcagcctgcgctgcagcagcaagcaggccaagaggcacatcgacttcacagaggagcaggccgagctgaccccccacagctacctggaccgggagaccagcctgctgctgaggaacattgctgggaagcccagccacctgctgaccaaggaggagcaggccgccaagctgaaggccgagaagatccgggtggccctggagaagatcaaggaggcccaggtgaagaagctggtgatccgggtgcacatgtctgatgacagcagcaagaccatgatggtggatgagcggcagacagtgcggcaggtgctggacaacctgatggacaagagccactgcggctacagcctggactggagcctggtggagaccgtgtctgagctgcagatggagcgcatctttgaggaccacgagaacctggtggagaacctgctgaactggacccgggacagccagaacaagctgatcttcatggagcgcatcgagaagtatgccctcttcaagaacccccagaactacctgctgggcaagaaggagacagctgagatggctgacaggaacaaggaggtgctgctggaggagtgcttctgtggcagctctgtgacagtgcctgagattgaaggagtgctgtggctgaaggatgatggcaagaagtcctggaagaagcgctacttcctgctgcgggccagcggcatctactacgtgcccaagggcaaggccaaggtgtcccgggacctggtgtgcttcctgcagctggaccacgtgaatgtgtactacggccaggactacagaaacaagtacaaggcccccacagactactgcctggtgctgaagcacccccagatccagaagaagagccagtacatcaagtacctgtgctgtgatgatgtgaggaccctgcaccagtgggtgaatggcatccgcatcgccaagtatggcaagcagctgtacatgaactaccaggaggccctgaagaggacagagagcgcctatgactggaccagcctgagcagcagcagcatcaagagcggcagcagcagcagcagcatccctgagagccagagcaaccacagcaaccagagcgacagcggcgtgtctgacacccagcctgctggccacgtgcgcagccagagcatcgtgtcctctgtgttcagcgaggcctggaagaggggcacccagctggaggagagcagcaaggccaggatggagagcatgaaccggccctacaccagcctggtgccccccctgagcccccagcccaagatcgtgaccccctacacagccagccagcccagcccccccctgcccccacctcctcctcctcctcctcctcctcctcctcctcctcctcctcctcctccacccctgcccagccagagcgcccccagcgctggcagcgctgcccccatgtttgtgaagtacagcaccatcacccggctgcagaatgccagccagcacagcggggccctcttcaagccacccaccccacctgtgatgcagagccagagcgtgaagccccagatcctggtgccccccaacggggtggtgcccccacctcctcctcctcctcctccacccaccccaggcagcgccatggcccagctgaagccagccccctgtgcccccagcctgccccagttcagcgcccctcctccacccctgaagatccaccaggtgcagcacatcacccaggtggccccacccaccccacctcctcctccacccatcccagcccccctgcccccccaggccccacccaagcccctggtgaccatcccagcccccaccagcaccaagacagtggcccctgtggtgacccaggccgccccacccacccccaccccacctgtgcccccagccaagaagcagcctgccttccctgccagctacatcccccccagcccccccaccccacctgtgcctgtgcccccacccaccctgcccaagcagcagagcttctgtgccaagcccccacccagccccctgagccctgtgcccagcgtggtgaagcagatcgccagccagttccccccaccacccaccccaccagccatggagagccagcccctgaagcctgtgcctgccaacgtggccccccagagccccccagctgtgaaggccaagcccaagtggcagcccagcagcatccctgtgcccagcccagacttccccccacctcctcctgagagcagcctggtgttccccccacctccacccagccctgtgcctgcccctcctcctcctcctccacccacagccagccccaccccagacaagagcggcagccctgggaagaagaccagcaagaccagcagccctgggggcaagaagcccccacccaccccccagaggaacagcagcatcaagagcagcagtggagctgagcaccctgagcccaagaggcccagcgtggacagcctggtgtccaagttcaccccacctgctgagagcggcagccccagcaaggagaccctgcccccacctgctgccccacccaagccaggcaagctgaacctgtctggagtgaacctgcccggggtgctgcagcagggctgtgtgtctgccaaggcccctgtgctgagcggccggggcaaggacagcgtggtggagttccccagccccccaagtgacagcgacttccccccacctcctcctgagacagagctgcccctgccccccatcgagatcccagctgtgttcagcggcaacaccagccccaaggtggccgtggtgaacccccagccccagcagtggagcaagatgtctgtgaagaaggcccccccacccacccggcccaagagaaatgacagcacccggctgacccaggccgagatcagcgagcagcccaccatggccaccgtggtgccccaggtgcccaccagccccaagagcagcctgtctgtgcagcccggcttcctggccgacctgaacagaaccctgcagaggaagagcatcaccaggcatggcagcctgagcagcaggatgagcagagctgagcccacagccaccatggatgacatggccctgcccccacctcctcctgagctgctgagtgaccagcagaaggccggctacggcggcagccacatcagcggctacgccaccctgcggcggggccccccaccagccccacccaagagggaccagaacaccaagctgagccgggactggtag

SEQ ID NO: 37414 - DNA, 1875 bp, Artificial Sequence
  Description of Artificial Sequence: Synthetic coding sequence
atggagcagctgagtgatgaggagattgaccatggagcagaagaagattctgacaaggaggaccaggacctggacaagatgtttggagcctggctgggggagctggacaagctgacccagagcctggacagcgacaagcccatggagcctgtgaagaggagccccctgcggcaggagaccaacatggccaacttctcctaccgcttcagcatctacaacctgaatgaggccctgaaccagggcgagaccgtggacctggatgccctgatggctgacctgtgcagcattgagcaggagctgagcagcatcggcagcggcaacagcaagaggcagatcacagagaccaaggccacccagaagctgcctgtgagccgccacaccctgaagcacggcaccctgaagggcctgagcagcagcagcaacagaattgccaagcccagccacgccagctacagcctggatgatgtgacagcccagctggagcaggccagcctgtccatggatgaggccgcccagcagagcgtgctggaggacaccaagcccctggtgaccaaccagcacagaagaacagccagcgctggcaccgtgtctgatgctgaggtgcacagcatcagcaacagcagccacagcagcatcaccagcgctgccagctccatggacagcctggacatcgacaaggtgacccggccccaggagctggacctgacccaccagggccagcccatcacagaacatgccatcagcctgcgctgcagcagcaagcaggccaagaggcacatcgacttcacagaggagcaggccgagctgaccccagaggagcaggccgccaagctgaaggccgagaagatccgggtggccctggagaagatcaaggaggcccaggtgaagaagctggtgatccgggtgcacatgtctgatgacagcagcaagaccatgatggtggatgagcggcagacagtgcggcaggtgctggacaacctgatggacaagagccactgcggctacagcctggactggagcctggtggagaccgtgtctgagctgcagatggagcgcatctttgaagatcatgagaacctggtggagaacctgctgaactggacccgggacagccagaacaagctgatcttcatggagagaattgagaagtatgccctcttcaagaacccccagaactacctgctgggcaagaaggagacagctgagatggctgacaggaacaaggaggtgctgctggaggagtgcttctgtggcagctctgtgacagtgcctgagattgagggcgtgctgtggctgaaggatgatggcaagaagtcctggaagaagcgctacttcctgctgcgggccagcggcatctactacgtgcccaagggcaaggccaaggtgtcccgggacctggtgtgcttcctgcagctggaccacgtgaatgtgtactacggccaggactacagaaacaagtacaaggcccccacagactactgcctggtgctgaagcacccccagatccagaagaagagccagtacatcaagtacctgtgctgtgatgatgtgaggaccctgcaccagtgggtgaatggcatcagaattgccaagtatggcaagcagctgtacatgaactaccaggaggccctgaagaggacagaaagtgcctatgactggaccagcctgagcagcagcagcatcaagagcggcagcagcagcagcagcatccctgagagccagagcaaccacagcaaccagagcgacagcggcgtgtctgacacccagcctgctggccacgtgcgcagccagagcatcgtgagcagcgtcttcagcgaggcctggaagaggggcacccagctggaggagagcagcaaggtgacagccagcttctag

SEQ ID NO: 37415 - DNA, 1794 bp, Artificial Sequence
  Description of Artificial Sequence: Synthetic coding sequence
atggagcagctgagtgatgaggagattgaccatggagcagaagaagattctgacaaggaggaccaggacctggacaagatgtttggagcctggctgggggagctggacaagctgacccagagcctggacagcgacaagcccatggagcctgtgaagaggagccccctgcggcaggagaccaacatggccaacttctcctaccgcttcagcatctacaacctgaatgaggccctgaaccagggcgagaccgtggacctggatgccctgatggctgacctgtgcagcattgagcaggagctgagcagcatcggcagcggcaacagcaagaggcagatcacagagaccaaggccacccagaagctgcctgtgagccgccacaccctgaagcacggcaccctgaagggcctgagcagcagcagcaacagaattgccaagcccagccacgccagctacagcctggatgatgtgacagcccagctggagcaggccagcctgtccatggatgaggccgcccagcagagcgtgctggaggacaccaagcccctggtgaccaaccagcacagaagaacagccagcgctggcaccgtgtctgatgctgaggtgcacagcatcagcaacagcagccacagcagcatcaccagcgctgccagctccatggacagcctggacatcgacaaggtgacccggccccaggagctggacctgacccaccagggccagcccatcacagaggaggagcaggccgccaagctgaaggccgagaagatccgggtggccctggagaagatcaaggaggcccaggtgaagaagctggtgatccgggtgcacatgtctgatgacagcagcaagaccatgatggtggatgagcggcagacagtgcggcaggtgctggacaacctgatggacaagagccactgcggctacagcctggactggagcctggtggagaccgtgtctgagctgcagatggagcgcatctttgaggaccacgagaacctggtggagaacctgctgaactggacccgggacagccagaacaagctgatcttcatggagcgcatcgagaagtatgccctcttcaagaacccccagaactacctgctgggcaagaaggagacagctgagatggctgacaggaacaaggaggtgctgctggaggagtgcttctgtggcagctctgtgacagtgcctgagattgaaggagtgctgtggctgaaggatgatggcaagaagtcctggaagaagcgctacttcctgctgcgggccagcggcatctactacgtgcccaagggcaaggccaaggtgtcccgggacctggtgtgcttcctgcagctggaccacgtgaatgtgtactacggccaggactacagaaacaagtacaaggcccccacagactactgcctggtgctgaagcacccccagatccagaagaagagccagtacatcaagtacctgtgctgtgatgatgtgaggaccctgcaccagtgggtgaatggcatccgcatcgccaagtatggcaagcagctgtacatgaactaccaggaggccctgaagaggacagagagcgcctatgactggaccagcctgagcagcagcagcatcaagagcggcagcagcagcagcagcatccctgagagccagagcaaccacagcaaccagagcgacagcggcgtgtctgacacccagcctgctggccacgtgcgcagccagagcatcgtgtcctctgtgttcagcgaggcctggaagaggggcacccagctggaggagagcagcaaggtgacagccagcttctag

SEQ ID NO: 37416 - DNA, 1779 bp, Artificial Sequence
  Description of Artificial Sequence: Synthetic coding sequence
atggagcagctgagtgatgaggagattgaccatggagcagaagaagattctgacaaggaggaccaggacctggacaagatgtttggagcctggctgggggagctggacaagctgacccagagcctggacagcgacaagcccatggagcctgtgaagaggagccccctgcggcaggagaccaacatggccaacttctcctaccgcttcagcatctacaacctgaatgaggccctgaaccagggcgagaccgtggacctggatgccctgatggctgacctgtgcagcattgagcaggagctgagcagcatcggcagcggcaacagcaagaggcagatcacagagaccaaggccacccagaagctgcctgtgagccgccacaccctgaagcacggcaccctgaagggcctgagcagcagcagcaacagaattgccaagcccagccacgccagctacagcctggatgatgtgacagcccagctggagcaggccagcctgtccatggatgaggccgcccagcagagcgtgctggaggacaccaagcccctggtgaccaaccagcacagaagaacagccagcgctggcaccgtgtctgatgctgaggtgcacagcatcagcaacagcagccacagcagcatcaccagcgctgccagctccatggacagcctggacatcgacaaggtgacccggccccaggagctggacctgacccaccagggccagcccatcacagaggaggagcaggccgccaagctgaaggccgagaagatccgggtggccctggagaagatcaaggaggcccaggtgaagaagctggtgatccgggtgcacatgtctgatgacagcagcaagaccatgatggtggatgagcggcagacagtgcggcaggtgctggacaacctgatggacaagagccactgcggctacagcctggactggagcctggtggagaccgtgtctgagctgcagatggagcgcatctttgaggaccacgagaacctggtggagaacctgctgaactggacccgggacagccagaacaagctgatcttcatggagcgcatcgagaagtatgccctcttcaagaacccccagaactacctgctgggcaagaaggagacagctgagatggctgacaggaacaaggaggtgctgctggaggagtgcttctgtggcagctctgtgacagtgcctgagattgaaggagtgctgtggctgaaggatgatggcaagaagtcctggaagaagcgctacttcctgctgcgggccagcggcatctactacgtgcccaagggcaaggccaaggtgtcccgggacctggtgtgcttcctgcagctggaccacgtgaatgtgtactacggccaggactacagaaacaagtacaaggcccccacagactactgcctggtgctgaagcacccccagatccagaagaagagccagtacatcaagtacctgtgctgtgatgatgtgaggaccctgcaccagtgggtgaatggcatccgcatcgccaagtatggcaagcagctgtacatgaactaccaggaggccctgaagaggacagagagcgcctatgactggaccagcctgagcagcagcagcatcaagagcggcagcagcagcagcagcatccctgagagccagagcaaccacagcaaccagagcgacagcggcgtgtctgacacccagcctgctggccacgtgcgcagccagagcatcgtgtcctctgtgttcagcgaggcctggaagaggggcacccagctggaggagagcagcaagtag

SEQ ID NO: 37417 - DNA, 270 bp, Artificial Sequence
  Description of Artificial Sequence: Synthetic coding sequence
atggagcagctgagtgatgaggagattgaccatggagcagaagaagattctgacaaggaggaccaggacctggacaagatgtttggagcctggctgggggagctggacaagctgacccagagcctggacagcgacaagcccatggagcctgtgaagaggagccccctgcggcaggagaccaacatggccaacttctcctaccgcttcagcatctacaacctgaatgccctgaaccagggcgagaccgtggacctggatgccctgatgtag

SEQ ID NO: 37418 - DNA, 1860 bp, Artificial Sequence; identical to SEQ ID NO: 37412
  Description of Artificial Sequence: Synthetic coding sequence

SEQ ID NO: 37419 - DNA, 519 bp, Artificial Sequence
  Description of Artificial Sequence: Synthetic coding sequence
atggagcagctgagtgatgaggagattgaccatggagcagaagaagattctgacaaggaggaccaggacctggacaagatgtttggagcctggctgggggagctggacaagctgacccagagcctggacagcgacaagcccatggagcctgtgaagaggagccccctgcggcaggagaccaacatggccaacttctcctaccgcttcagcatctacaacctgaatgaggccctgaaccagggcgagaccgtggacctggatgccctgatggctgacctgtgcagcattgagcaggagctgagcagcatcggcagcggcaacagcaagaggcagatcacagagaccaaggccacccagaagctgcctgtgagccgccacaccctgaagcacggcaccctgaagggcctgagcagcagcagcaacagaattgccaagcccagccacgccagctacagcctggatgatgtgacagcccagctggagcaggccagcctgtccatggatgaggccgcccagtag

SEQ ID NO: 37420 - DNA, 1869 bp, Artificial Sequence
  Description of Artificial Sequence: Synthetic coding sequence
atggagcagctgagtgatgaggagattgaccatggagcagaagaagattctgacaaggaggaccaggacctggacaagatgtttggagcctggctgggggagctggacaagctgacccagagcctggacagcgacaagcccatggagcctgtgaagaggagccccctgcggcaggagaccaacatggccaacttctcctaccgcttcagcatctacaacctgaatgaggccctgaaccagggcgagaccgtggacctggatgccctgatggctgacctgtgcagcattgagcaggagctgagcagcatcggcagcggcaacagcaagaggcagatcacagagaccaaggccacccagaagctgcctgtgagccgccacaccctgaagcacggcaccctgaagggcctgagcagcagcagcaacagaattgccaagcccagccacgccagctacagcctggatgatgtgacagcccagctggagcaggccagcctgtccatggatgaggccgcccagcagagcgtgctggaggacaccaagcccctggtgaccaaccagcacagaagaacagccagcgctggcaccgtgtctgatgctgaggtgcacagcatcagcaacagcagccacagcagcatcaccagcgctgccagctccatggacagcctggacatcgacaaggtgacccggccccaggagctggacctgacccaccagggccagcccatcacagagcacagctacctggaccgggagaccagcctgctgctgagaaatattgctgggaagcccagccacctgctgaccaaggaggagcaggccgccaagctgaaggccgagaagatccgggtggccctggagaagatcaaggaggcccaggtgaagaagctggtgatccgggtgcacatgtctgatgacagcagcaagaccatgatggtggatgagcggcagacagtgcggcaggtgctggacaacctgatggacaagagccactgcggctacagcctggactggagcctggtggagaccgtgtctgagctgcagatggagcgcatctttgaagatcatgagaacctggtggagaacctgctgaactggacccgggacagccagaacaagctgatcttcatggagagaattgagaagtatgccctcttcaagaacccccagaactacctgctgggcaagaaggagacagctgagatggctgacaggaacaaggaggtgctgctggaggagtgcttctgtggcagctctgtgacagtgcctgagattgagggcgtgctgtggctgaaggatgatggcaagaagtcctggaagaagcgctacttcctgctgcgggccagcggcatctactacgtgcccaagggcaaggccaaggtgtcccgggacctggtgtgcttcctgcagctggaccacgtgaatgtgtactacggccaggactacagaaacaagtacaaggcccccacagactactgcctggtgctgaagcacccccagatccagaagaagagccagtacatcaagtacctgtgctgtgatgatgtgaggaccctgcaccagtgggtgaatggcatcagaattgccaagtatggcaagcagctgtacatgaactaccaggaggccctgaagaggacagaaagtgcctatgactggaccagcctgagcagcagcagcatcaagagcggcagcagcagcagcagcatccctgagagccagagcaaccacagcaaccagagcgacagcggcgtgtctgacacccagcctgctggccacgtgcgcagccagagcatcgtgagcagcgtcttcagcgaggcctggaagaggggcacccagctggaggagagcagcaaggtgacagccagcttctag

SEQ ID NO: 37421 - DNA, 1854 bp, Artificial Sequence; identical to SEQ ID NO: 37411
  Description of Artificial Sequence: Synthetic coding sequence

SEQ ID NO: 37422 - DNA, 1950 bp, Artificial Sequence
  Description of Artificial Sequence: Synthetic coding sequence
atggagcagctgagtgatgaggagattgaccatggagcagaagaagattctgacaaggaggaccaggacctggacaagatgtttggagcctggctgggggagctggacaagctgacccagagcctggacagcgacaagcccatggagcctgtgaagaggagccccctgcggcaggagaccaacatggccaacttctcctaccgcttcagcatctacaacctgaatgaggccctgaaccagggcgagaccgtggacctggatgccctgatggctgacctgtgcagcattgagcaggagctgagcagcatcggcagcggcaacagcaagaggcagatcacagagaccaaggccacccagaagctgcctgtgagccgccacaccctgaagcacggcaccctgaagggcctgagcagcagcagcaacagaattgccaagcccagccacgccagctacagcctggatgatgtgacagcccagctggagcaggccagcctgtccatggatgaggccgcccagcagagcgtgctggaggacaccaagcccctggtgaccaaccagcacagaagaacagccagcgctggcaccgtgtctgatgctgaggtgcacagcatcagcaacagcagccacagcagcatcaccagcgctgccagctccatggacagcctggacatcgacaaggtgacccggccccaggagctggacctgacccaccagggccagcccatcacagaacatgccatcagcctgcgctgcagcagcaagcaggccaagaggcacatcgacttcacagaggagcaggccgagctgaccccccacagctacctggaccgggagaccagcctgctgctgaggaacattgctgggaagcccagccacctgctgaccaaggaggagcaggccgccaagctgaaggccgagaagatccgggtggccctggagaagatcaaggaggcccaggtgaagaagctggtgatccgggtgcacatgtctgatgacagcagcaagaccatgatggtggatgagcggcagacagtgcggcaggtgctggacaacctgatggacaagagccactgcggctacagcctggactggagcctggtggagaccgtgtctgagctgcagatggagcgcatctttgaggaccacgagaacctggtggagaacctgctgaactggacccgggacagccagaacaagctgatcttcatggagcgcatcgagaagtatgccctcttcaagaacccccagaactacctgctgggcaagaaggagacagctgagatggctgacaggaacaaggaggtgctgctggaggagtgcttctgtggcagctctgtgacagtgcctgagattgaaggagtgctgtggctgaaggatgatggcaagaagtcctggaagaagcgctacttcctgctgcgggccagcggcatctactacgtgcccaagggcaaggccaaggtgtcccgggacctggtgtgcttcctgcagctggaccacgtgaatgtgtactacggccaggactacagaaacaagtacaaggcccccacagactactgcctggtgctgaagcacccccagatccagaagaagagccagtacatcaagtacctgtgctgtgatgatgtgaggaccctgcaccagtgggtgaatggcatccgcatcgccaagtatggcaagcagctgtacatgaactaccaggaggccctgaagaggacagagagcgcctatgactggaccagcctgagcagcagcagcatcaagagcggcagcagcagcagcagcatccctgagagccagagcaaccacagcaaccagagcgacagcggcgtgtctgacacccagcctgctggccacgtgcgcagccagagcatcgtgtcctctgtgttcagcgaggcctggaagaggggcacccagctggaggagagcagcaaggtgacagccagcttctag

SEQ ID NO: 37423 - DNA, 2073 bp, Artificial Sequence
  Description of Artificial Sequence: Synthetic coding sequence
atgggcagcagcggcctgggcaaggccgccaccctggatgagctgctgtgcacctgcatcgagatgtttgatgacaacggggagctggacaacagctacctgcccagaattgtgctgctgatgcaccgctggtacctgagcagcacagagctggccgagaagctgctgtgcatgtacagaaatgccactggagagagctgcaatgagttccggctgaagatctgctacttcatgagatactggatcctgaagtttcctgctgagttcaacctggacctgggcctcatccgcatgacagaggagttccgggaggtggccagccagctgggctatgagaagcacgtgtccctgattgacatcagcagcatccccagctatgactggatgagaagagtgacccagaggaagaaggtgtccaagaagggcaaggcctgcctgctgtttgaccacctggagcccatcgagctggccgagcacctgaccttcctggagcacaagagcttccgccgcatctccttcacagactaccagagctatgtgatccacggctgcctggagaacaaccccaccctggagaggagcatcgccctcttcaacggcatcagcaagtgggtgcagctgatggtgctgagcaagcccaccccccagcagagagctgaggtgatcaccaagttcatcaacgtggccaagaagctgctgcagctgaagaacttcaacaccctgatggctgtggtgggcggcctgagccacagcagcatcagccggctgaaggagacccacagccacctgagcagcgaggtgaccaagaactggaatgagatgacagagctggtgagcagcaatggaaactactgcaactacaggaaggcctttgctgactgtgatggcttcaagatccccatcctgggcgtgcacctgaaggacctgattgctgtgcacgtgatcttcccagactggacagaggagaacaaggtgaacatcgtgaagatgcaccagctgtctgtgaccctgtctgagctggtgtccctgcagaatgccagccaccacctggagcccaacatggacctgatcaacctgctgaccctgagcctggacctgtaccacacagaagatgacatctacaagctgagcctggtgctggagcccaggaacagcaagagccagcccaccagccccaccacccccaacaagcctgtggtgcccctggagtgggccctgggcgtgatgcccaagccagaccccaccgtcatcaacaagcacatcaggaagctggtggagagcgtcttcaggaactatgaccatgaccatgatggctacatcagccaggaggactttgagagcattgctgccaacttccccttcctggacagcttctgtgtgctggacaaggaccaggacggcctcatcagcaaggatgagatgatggcctacttcctgcgggccaagagccagctgcactgcaagatgggccctggcttcatccacaacttccaggagatgacctacctgaagcccaccttctgtgagcactgtgccggcttcctgtggggcatcatcaagcagggctacaagtgcaaggactgtggggccaactgccacaagcagtgcaaggacctgctggtgctggcctgcagaagatttgcccgggcccccagcctgagcagcggccacggcagcctgcccggcagccccagcctgcccccagcccaggatgaggtgtttgagttccctggggtgacagctggccaccgggacctggacagccgggccatcaccctggtgacaggcagcagcaggaagatctctgtgcggctgcagagggccaccaccagccaggccacccagacagagcctgtgtggagcgaggccggctggggagacagcggcagccacaccttccccaagatgaagagcaagttccatgacaaggccgccaaggacaagggctttgccaagtgggagaatgagaagccccgggtgcacgccggcgtggatgtggtggaccggggcacagaatttgagctggaccaggatgaaggagaggagacccggcaggatggagaagatggatag

SEQ ID NO: 37424 - DNA, 2073 bp, Artificial Sequence; identical to SEQ ID NO: 37423
  Description of Artificial Sequence: Synthetic coding sequence

SEQ ID NO: 37425 - DNA, 2070 bp, Artificial Sequence
  Description of Artificial Sequence: Synthetic coding sequence
atgggcagcagcggcctgggcaaggccgccaccctggatgagctgctgtgcacctgcatcgagatgtttgatgacaacggggagctggacaacagctacctgcccagaattgtgctgctgatgcaccgctggtacctgagcagcacagagctggccgagaagctgctgtgcatgtacagaaatgccactggagagagctgcaatgagttccggctgaagatctgctacttcatgagatactggatcctgaagtttcctgctgagttcaacctggacctgggcctcatccgcatgacagaggagttccgggaggtggccagccagctgggctatgagaagcacgtgtccctgattgacatcagcagcatccccagctatgactggatgagaagagtgacccagaggaagaaggtgtccaagaagggcaaggcctgcctgctgtttgaccacctggagcccatcgagctggccgagcacctgaccttcctggagcacaagagcttccgccgcatctccttcacagactaccagagctatgtgatccacggctgcctggagaacaaccccaccctggagaggagcatcgccctcttcaacggcatcagcaagtgggtgcagctgatggtgctgagcaagcccaccccccagcagagagctgaggtgatcaccaagttcatcaacgtggccaagaagctgctgcagctgaagaacttcaacaccctgatggctgtggtgggcggcctgagccacagcagcatcagccggctgaaggagacccacagccacctgagcagcgaggtgaccaagaactggaatgagatgacagagctggtgagcagcaatggaaactactgcaactacaggaaggcctttgctgactgtgatggcttcaagatccccatcctgggcgtgcacctgaaggacctgattgctgtgcacgtgatcttcccagactggacagaggagaacaaggtgaacatcgtgaagatgcaccagctgtctgtgaccctgtctgagctggtgtccctgcagaatgccagccaccacctggagcccaacatggacctgatcaacctgctgaccctgagcctggacctgtaccacacagaagatgacatctacaagctgagcctggtgctggagcccaggaacagcaagagccccaccagccccaccacccccaacaagcctgtggtgcccctggagtgggccctgggcgtgatgcccaagccagaccccaccgtcatcaacaagcacatcaggaagctggtggagagcgtcttcagaaattatgaccatgaccatgatggctacatcagccaggaggactttgagagcattgctgccaacttccccttcctggacagcttctgtgtgctggacaaggaccaggacggcctcatcagcaaggatgagatgatggcctacttcctgcgggccaagagccagctgcactgcaagatgggccctggcttcatccacaacttccaggagatgacctacctgaagcccaccttctgtgagcactgtgccggcttcctgtggggcatcatcaagcagggctacaagtgcaaggactgtggggccaactgccacaagcagtgcaaggacctgctggtgctggcctgccgccgctttgcccgggcccccagcctgagcagcggccacggcagcctgcccggcagccccagcctgcccccagcccaggatgaggtgtttgagttccctggggtgacagctggccaccgggacctggacagccgggccatcaccctggtgacaggcagcagcaggaagatctctgtgcggctgcagagggccaccaccagccaggccacccagacagagcctgtgtggagcgaggccggctggggagacagcggcagccacaccttccccaagatgaagagcaagttccatgacaaggccgccaaggacaagggctttgccaagtgggagaatgagaagccccgggtgcatgctggggtggatgtggtggaccggggcacagaatttgagctggaccaggatgaaggagaggagacccggcaggatggagaagatggatag

SEQ ID NO: 37426 - DNA, 342 bp, Artificial Sequence
  Description of Artificial Sequence: Synthetic coding sequence
atgggcagcagcggcctgggcaaggccgccaccctggatgagctgctgtgcacctgcatcgagatgtttgatgacaacggggagctggacaacagctacctgcccagaattgtgctgctgatgcaccgctggtacctgagcagcacagagctggccgagaagctgctgtgcatgtacagaaatgccactggagagagctgcaatgagttccggctgaagatctgctacttcatgagatactggatcctgaagtttcctgctgagttcaacctggacctgggcctcatccgcatgacagaggagttccgggaggtggccagccagctgggctatgagaagtag

SEQ ID NO: 37427 - DNA, 105 bp, Artificial Sequence
  Description of Artificial Sequence: Synthetic coding sequence
atgggcagcagcggcctgggcaaggccgccaccctggatgagctgctgtgcacctgcatcgagatgtttgatgacaacggggagctggacaacagctacctgtag

SEQ ID NO: 37428 - DNA, 519 bp, Artificial Sequence
  Description of Artificial Sequence: Synthetic coding sequence
atgggcagcagcggcctgggcaaggccgccaccctggatgagctgctgtgcacctgcatcgagatgtttgatgacaacggggagctggacaacagctacctgcccagaattgtgctgctgatgcaccgctggtacctgagcagcacagagctggccgagaagctgctgtgcatgtacagaaatgccactggagagagctgcaatgagttccggctgaagatctgctacttcatgagatactggatcctgaagtttcctgctgagttcaacctggacctgggcctcatccgcatgacagaggagttccgggaggtggccagccagctgggctatgagaagcacgtgtccctgattgacatcagcagcatccccagctatgactggatgagaagagtgacccagaggaagaaggtgtccaagaagggcaaggcctgcctgctgtttgaccacctggagcccatcgagctggccgagcacctgaccttcctggagcacaagagcttccgccgcatctcctag

SEQ ID NO: 37429 - DNA, 234 bp, Artificial Sequence
  Description of Artificial Sequence: Synthetic coding sequence
atgggcagcagcggcctgggcaaggccgccaccctggatgagctgctgtgcacctgcatcgagatgtttgatgacaacggggagctggacaacagctacctgcccagaattgtgctgctgatgcaccgctggtacctgagcagcacagagctggccgagaagctgctgtgcatgtacagaaatgccactggagagagctgcaatgagttccggctgaagatctgctacttctag

SEQ ID NO: 37430 - DNA, 339 bp, Artificial Sequence
  Description of Artificial Sequence: Synthetic coding sequence
atgggcagcagcggcctgggcaaggccgccaccctggatgagctgctgtgcacctgcatcgagatgtttgatgacaacggggagctggacaacagctacctgcccagaattgtgctgctgatgcaccgctggtacctgagcagcacagagctggccgagaagctgctgtgcatgtacagaaatgccactggagagagctgcaatgagttccggctgaagatctgctacttcatgagatactggatcctgaagtttcctgctgagttcaacctggacctgggcctcatccgcatgacagaggagttccgggaggtggccagccagctgggctatgaatag

SEQ ID NO: 37431 - DNA, 552 bp, Artificial Sequence
  Description of Artificial Sequence: Synthetic coding sequence
atgcccctggtgcgctacaggaaggtggtgatcctgggctaccgctgtgtgggcaagaccagcctggcccaccagtttgtggagggggagttcagcgagggctatgaccccaccgtggagaacacctacagcaagatcgtgaccctgggcaaggatgagttccacctgcacctggtggacacagctggccaggatgagtacagcatcctgccctacagcttcatcatcggcgtgcacggctacgtgctggtgtacagcgtgaccagcctgcacagcttccaggtgattgagagcctgtaccagaagctgcacgagggccacggcaagaccagggtgcctgtggtgctggtgggcaacaaggctgacctgagccctgagcgggaggtgcaggccgtggagggcaagaagctggccgagagctggggcgccaccttcatggagagcagcgcccgggagaaccagctgacccagggcatcttcaccaaggtgatccaggagatcgcccgggtggagaacagctatggccaggagcggcgctgccacctgatgtag

SEQ ID NO: 37432 - DNA, 633 bp, Artificial Sequence
  Description of Artificial Sequence: Synthetic coding sequence
atgacagctgcccaggccgccggggaggaggcccctcctggggtgcgctctgtgaaggtggtgctggtgggagatggcggctgtgggaagaccagcctgctgatggtgtttgctgatggagccttccctgagagctacacccccaccgtgtttgagcgctacatggtgaacctgcaggtgaagggcaagcctgtgcacctgcacatctgggacacagctggccaggatgattatgaccggctgcggcccctcttctacccagatgcctctgtgctgctgctgtgctttgatgtgaccagccccaacagctttgacaacatcttcaaccgctggtacccagaggtgaaccacttctgcaagaaggtgcccatcatcgtggtgggctgcaagacagacctgtgcaaggacaagagcctggtgaacaagctgcggagaaatggcctggagcctgtgacctaccaccggggccaggagatggcccggtctgtgggcgctgtggcctacctggagtgcagcgcccggctgcatgacaacgtgcatgctgtgttccaggaggccgctgaggtggccctgagcagccggggcaggaacttctggaggcgcatcacccagggcttctgtgtggtgacctag

SEQ ID NO: 37433 - DNA, 636 bp, Artificial Sequence
  Description of Artificial Sequence: Synthetic coding sequence
atggatgcccctggggccctggcccagacagctgcccctggccctggcaggaaggagctgaagatcgtcatcgtgggagatggcggctgtgggaagaccagcctgctgatggtgtacagccagggcagcttccctgagcactacgcccccagcgtgtttgagaagtacacagcctctgtgacagtgggcagcaaggaggtgaccctgaacctgtatgacacagctggccaggaggactatgaccggctgcggcccctgagctaccagaacacccacctggtgctgatctgctatgatgtgatgaaccccaccagctatgacaacgtgctgatcaagtggttccctgaggtgacccacttctgccggggcatccccatggtgctgattggctgcaagacagacctgaggaaggacaaggagcagctgaggaagctgcgggccgcccagctggagcccatcacctacatgcagggcctgagcgcctgtgagcagatccgggccgccctgtacctggagtgcagcgccaagttcagagaaaatgtggaggatgtgttccgggaggccgccaaggtggccctgagcgccctgaagaaggcccagaggcagaagaagaggcggctgtgcctgctgctgtag

SEQ ID NO: 37434 - DNA, 342 bp, Artificial Sequence
  Description of Artificial Sequence: Synthetic coding sequence
atggatgcccctggggccctggcccagacagctgcccctggccctggcaggaaggagctgaagatcgtcatcgtgggagatggcggctgtgggaagaccagcctgctgatggtgtacagccagggcagcttccctgagcactacgcccccagcgtgtttgagaagtacacagcctctgtgacagtgggcagcaaggaggtgaccctgaacctgtatgacacagctggccaggaggactatgaccggctgcggcccctgagctaccagaacacccacctggtgctgatctgctatgatgtgatgaaccccaccagctatgacaacgtgctgatcaaggtgtag

SEQ ID NO: 37435 - DNA, 576 bp, Artificial Sequence
  Description of Artificial Sequence: Synthetic coding sequence
atgcagagcatcaagtgtgtggtggtgggagatggagctgtgggcaagacctgcctgctgatctgctacaccaccaatgccttccccaaggagtacatccccaccgtgtttgacaactacagcgcccagagcgctgtggatggccgcacagtgaacctgaacctgtgggacacagctggccaggaggagtatgaccggctgcggaccctgagctacccccagaccaacgtgtttgtgatctgcttcagcatcgccagccccccatcctatgaaaatgtgcgccacaagtggcaccctgaggtgtgccaccactgcccagatgtgcccatcctgctggtgggcaccaagaaggacctgcgggcccagcctgacaccctgcggcggctgaaggagcagggccaggcccccatcaccccccagcagggccaggccctggccaagcagatccatgctgtgcgctacctggagtgcagcgccctgcagcaggatggagtgaaggaggtgtttgctgaggccgtgcgggctgtgctgaaccccacccccatcaagaggggccgcagctgcatcctgctgtag

SEQ ID NO: 37436 - DNA, 576 bp, Artificial Sequence; identical to SEQ ID NO: 37435
  Description of Artificial Sequence: Synthetic coding sequence

SEQ ID NO: 37437 - DNA, 576 bp, Artificial Sequence; identical to SEQ ID NO: 37435
  Description of Artificial Sequence: Synthetic coding sequence

SEQ ID NO: 37438 - DNA, 576 bp, Artificial Sequence; identical to SEQ ID NO: 37435
  Description of Artificial Sequence: Synthetic coding sequence

SEQ ID NO: 37439 - DNA, 576 bp, Artificial Sequence
  Description of Artificial Sequence: Synthetic coding sequence
atgctgagcagcatcaagtgtgtgctggtgggggacagcgctgtgggcaagaccagcctgctggtgcgcttcaccagcgagaccttccctgaggcctacaagcccaccgtgtatgaaaatactggagtggatgtgttcatggatggcatccagatcagcctgggcctgtgggacacagctggaaatgatgccttccgcagcatccggcccctgagctaccagcaggctgatgtggtgctgatgtgctacagcgtggccaaccacaacagcttcctgaacctgaagaacaagtggattggagagatccgcagcaacctgccctgcacccctgtgctggtggtggccacccagacagaccagcgggagatgggcccccaccgggccagctgtgtgaatgccatggagggcaagaagctggcccaggatgtgcgggccaagggctacctggagtgcagcgccctgagcaacagaggagtgcagcaggtgtttgaatgtgctgtgaggacagctgtgaaccaggccaggagaagaaacagaagaagactcttcagcatcaatgaatgcaagatcttctag

SEQ ID NO: 37440 - DNA, 312 bp, Artificial Sequence
  Description of Artificial Sequence: Synthetic coding sequence
atgctgagcagcatcaagtgtgtgctggtgggggacagcgctgtgggcaagaccagcctgctggtgcgcttcaccagcgagaccttccctgaggcctacaagcccaccgtgtatgaaaatactggagtggatgtgttcatggatggcatccagatcagcctgggcctgtgggacacagctggaaatgatgccttccgcagcatccggcccctgagctaccagcaggctgatgtggtgctgatgtgctacagcgtggccaaccacaacagcttcctgaacctgaagaacaagtggattggagagatcagatag

SEQ ID NO: 37441 - DNA, 576 bp, Artificial Sequence; identical to SEQ ID NO: 37439
  Description of Artificial Sequence: Synthetic coding sequence

SEQ ID NO: 37442 - DNA, 330 bp, Artificial Sequence
  Description of Artificial Sequence: Synthetic coding sequence
atgctgagcagcatcaagtgtgtgctggtgggggacagcgctgtgggcaagaccagcctgctggtgcgcttcaccagcgagaccttccctgaggcctacaagcccaccgtgtatgaaaatactggagtggatgtgttcatggatggcatccagatcagcctgggcctgtgggacacagctggaaatgatgccttccgcagcatccggcccctgagctaccagcaggctgatgtggtgctgatgtgctacagcgtggccaaccacaacagcttcctgaacctgaagaacaagtggattggagagatccgcagcaacctgccctgcacctag

SEQ ID NO: 37443 - DNA, 51 bp, Artificial Sequence
  Description of Artificial Sequence: Synthetic coding sequence
atgctgagcagcatcaagtgtgtgctggtgggggacagcgctgtgggctag

SEQ ID NO: 37444 - DNA, 21 bp, Artificial Sequence
  Description of Artificial Sequence: Synthetic coding sequence
atgctgagcagcatcaagtag

SEQ ID NO: 37445 - DNA, 645 bp, Artificial Sequence
  Description of Artificial Sequence: Synthetic coding sequence
atgaactgcaaggagggcacagacagcagctgtggctgcagaggaaatgatgagaagaagatgctgaagtgtgtggtggtgggagatggagctgtgggcaagacctgcctgctgatgtcctatgccaatgatgccttccctgaggagtatgtgcccaccgtgtttgaccactatgctgtgacagtgacagtgggcggcaagcagcacctgctgggcctgtatgacacagctggccaggaggactacaaccagctgcggcccctgagctaccccaacacagatgtgttcctgatctgcttctctgtggtgaacccagccagctaccacaacgtgcaggaggagtgggtgcctgagctgaaggactgcatgcctcatgtgccctacgtgctgattggcacccagattgacctgagagatgaccccaagaccctggcccggctgctgtacatgaaggagaagcccctgacctatgaacatggagtgaagctggccaaggccatcggggcccagtgctacctggagtgcagcgccctgacccagaagggcctgaaggctgtgtttgatgaggccatcctgaccatcttccaccccaagaagaagaagaagcgctgcagcgagggccacagctgctgcagcatcatctag

SEQ ID NO: 37446 - DNA, 618 bp, Artificial Sequence
  Description of Artificial Sequence: Synthetic coding sequence
atggcccacggccctggggccctgatgctgaagtgtgtggtggtgggagatggagctgtgggcaagacctgcctgctgatgtcctatgccaatgatgccttccctgaggagtatgtgcccaccgtgtttgaccactatgctgtgtctgtgacagtgggcggcaagcagtacctgctgggcctgtatgacacagctggccaggaggactatgaccggctgcggcccctgagctaccccatgacagatgtgttcctgatctgcttctctgtggtgaacccagccagcttccagaatgtgaaggaggagtgggtgcctgagctgaaggagtatgccccaaatgtgcccttcctgctgattggcacccagattgacctgagagatgaccccaagaccctggcccggctgaatgacatgaaggagaagcccatctgtgtggagcagggccagaagctggccaaggagattggagcctgctgctacgtggagtgcagcgccctgacccagaagggcctgaagacagtgtttgatgaggccatcatcgccatcctgacccccaagaagcacacagtgaagaagagaattggcagccgctgcatcaactgctgcctgatcacctag

SEQ ID NO: 37447 - DNA, 915 bp, Artificial Sequence
  Description of Artificial Sequence: Synthetic coding sequence
atggctgtgaccaaggagctgctgcagatggacctgtatgccctgctgggcatcgaggagaaggctgctgacaaggaggtgaagaaggcctaccggcagaaggccctgagctgccacccagacaagaacccagacaaccccagggctgctgagctgttccaccagctgagccaggccctggaggtgctgacagatgctgctgcccgggccgcctatgacaaggtgaggaaggccaagaagcaggccgctgagaggacccagaagctggatgagaagaggaagaaggtgaagctggacctggaggcccgggagcggcaggcccaggcccaggagagcgaggaggaggaggagagccgcagcaccaggaccctggagcaggagattgaaaggctgcgggaggagggcagccggcagctggaggagcagcagaggctcatccgggagcagatccggcaggagcgggaccagaggctgcggggcaaggcagaaaatacagagggccagggcacccccaagctgaagctgaagtggaagtgcaagaaggaggatgagagcaagggcggctacagcaaggatgtgctgctgcggctgctgcagaagtatggagaggtgctgaacctggtgctgagcagcaagaagccaggcacagctgtggtggagtttgccaccgtgaaggctgctgagctggccgtgcagaatgaggtgggcctggtggacaaccccctgaagatctcctggctggagggccagccccaggatgctgtgggccgcagccacagcggcctgagcaagggctctgtgctgtctgagcgggactatgagagcctggtgatgatgaggatgaggcaggccgctgagcggcagcagctgattgccaggatgcagcaggaggaccaggagggcccccccacctag

SEQ ID NO: 37448 - DNA, 258 bp, Artificial Sequence
  Description of Artificial Sequence: Synthetic coding sequence
atggctgtggaggaggagctgaagaaggaccacgccgagatgcaggccgtgattgatgccaagcagaagatcattgatgcccaggtgatcaatggagatgagatcatccagacaggcaagacagacagagtgcccggcttcagccagcaccagacagatgaaagagctgaccccagcgagggcgctgtgcagcacgccggcccccagtggcacctgccccaccagccccaccaggccttccaccacggggagtggtag

SEQ ID NO: 37449 - DNA, 3843 bp, Artificial Sequence
  Description of Artificial Sequence: Synthetic coding sequence
atggagctgagccccagcagtggaggagctgctgaggccctgtcctggccagagatgtttcctgccctggagagtgacagccccctgcccccagaggacctggatgctgtggtgcctgtgtctggagctgtggccggcggcatgctggaccgcatcctgctggagagcgtgtgccagcagcagagctgggtgcgggtgtatgatgtgaagggcccccccacccaccggctgagctgtggccagagcccctacacagagaccaccacctgggagaggaagtactgcatcctgacagacagccagctggtgctgctgaacaaggagaaggagatccctgtggagggcggccaggagcagcagacagacagcaccaagggccgctgcctgcggaggacagtgtctgtgcccagcgagggccagtttcctgagtacccacctgagggcgccaccaagctggaggtgcctgctgagaggagcccccggcggcgcagcatcagcggcaccagcaccagcgagaagcccaacagcatggacacagccaacaccagccccttcaaggtgcccggcttcttcagcaagaggctgaagggcagcatcaagaggaccaagagccagagcaagctggacaggaacaccagcttccggctgcccagcctgcggagcacagatgacaggagccggggcctgcccaagctgaaggagagccgcagccatgagagcctgctgagcccctgcagcacagtggagtgcctggacctgggccgcggggagcctgtgtctgtgaagcccctgcacagcagcatcctgggccaggacttctgctttgaggtgacctacctgagcggcagcaagtgcttcagctgcaacagcgccagcgagcgggacaagtggatggagaacctgcggaggacagtgcagcccaacaaggacaactgcagaagagcagaaaatgtgctgcggctgtggatcatcgaggccaaggacctggcccccaagaagaagtacttctgtgagctgtgcctggatgacaccctgtttgcccggaccaccagcaagaccaaggctgacaacatcttctggggcgagcactttgagttcttcagcctgccccccctgcacagcatcaccgtgcacatctacaaggatgtggagaagaagaagaagaaggacaagaacaactacgtgggcctggtgaacatccccacagcctctgtgacaggccggcagtttgtggagaagtggtaccctgtgtccacccccacccccaacaagggcaagacaggaggccccagcatccgcatcaagagccgcttccagaccatcaccatcctgcccatggagcagtacaaggagtttgctgagtttgtgaccagcaactacaccatgctgtgcagcgtgctggagcctgtgatctctgtgaggaacaaggaggagctggcctgtgccctggtgcacatcctgcagagcacaggccgggccaaggacttcctgacagacctggtgatgtctgaggtggacagatgtggggagcatgatgtgctgatcttccgggagaacaccatcgccaccaagagcattgaggagtacctgaagctggtgggccagcagtacctgcatgatgccctgggggagttcatcaaggccctgtatgaaagtgatgagaactgtgaggtggaccccagcaagtgcagcagcagcgagctgattgaccaccagagcaacctgaagatgtgctgtgagctggccttctgcaagatcatcaacagctactgtgtgttcccccgggagctgaaggaggtgtttgcctcctggaagcagcagtgcctgaacagaggcaagcaggacatcagcgagcggctcatcagcgccagcctcttcctgcgcttcctgtgcccagccatcatgagccccagcctcttcaacctgatgcaggagtacccagatgacaggaccagcaggaccctgaccctcatcgccaaggtgatccagaacctggccaactttgccaagtttggaaacaaggaggagtacatggccttcatgaatgacttcctggagcacgagtggggcggcatgaagcgcttcctgctggagatcagcaacccagacaccatcagcaacaccccaggctttgatggctacatcgacctgggccgggagctgtctgtgctgcacagcctgctgtgggaggtggtgtcccagctggacaaggccaccgtggccaagctgggccccctgccccgggtgctggccgacatcaccaagagcctgaccaaccccacccccatccagcagcagctgcggcgcttcacagagcacaacagcagccccaacgtgtctggcagcctgagcagcggcctgcagaagatctttgaggaccccacagacagcgacctgcacaagctgaagagccccagccaggacaacacagacagctacttccggggcaagaccctgctgctggtgcagcaggccagcagccagagcatgacctacagcgagaaggatgagcgggagagcagcctgcccaacggccgctctgtgtccctgatggacctgcaggacacccacgccgcccaggtggagcacgcctctgtgatgctggatgtgcccatccggctgaccggcagccagctgagcatcacccaggtggccagcatcaagcagctgcgggagacccagagcaccccccagagcgccccccaggtgcggcggcccctgcacccagccctgaaccagcccggcggcctgcagcccctgtccttccagaaccctgtgtaccacctgaacaaccccatcccagccatgcccaaggccagcattgacagcagcctggagaacctgagcacagccagcagccgcagccagagcaacagcgaggacttcaagctgagcggccccagcaacagctccatggaggacttcaccaagaggagcacccagagcgaggacttcagcagaagacacacagtgcctgacagacacatccccctggccctgccccggcagaacagcacaggccaggcccagatcaggaaggtggaccagggcggcctgggcgcccgggccaaggccccacccagcctgccccacagcgccagcctgcggagcacaggctccatgtctgtggtgtctgctgccctggtggccgagcctgtgcagaatggcagccgcagccggcagcagagcagcagcagccgggagagccctgtgcccaaggtgcgggccatccagaggcagcagacccagcaggtgcagagccctgtggacagcgccaccatgagccctgtggagaggacagctgcctgggtgctgaacaacggccagtatgaggaggatgtggaggagacagagcagaacctggatgaggccaagcatgctgagaagtatgagcaggagatcaccaagctgaaggagcggctgcgggtgagcagccggcggctggaggagtatgaaagaaggctgctggtgcaggagcagcagatgcagaagctgctgctggagtacaaggcccggctggaggacagcgaggagcggctgcggcggcagcaggaggagaaggacagccagatgaagagcatcatcagccggctgatggctgtggaggaggagctgaagaaggaccacgccgagatgcaggccgtgattgatgccaagcagaagatcattgatgcccaggagaagagaattgtgtccctggacagcgccaacacccggctgatgtctgccctgacccaggtgaaggagcgctacagcatgcaggtgagaaatggcatcagccccaccaaccccaccaagctgagcatcacagaaaatggagagttcaagaacagcagctgctag

SEQ ID NO: 37450 - DNA, 2082 bp, Artificial Sequence
  Description of Artificial Sequence: Synthetic coding sequence
tgagaagtgtttgcctcctggaagcagcagtgcctgaacagaggcaagcaggacatcagcgagcggctcatcagcgccagcctcttcctgcgcttcctgtgcccagccatcatgagccccagcctcttcaacctgatgcaggagtacccagatgacaggaccagcaggaccctgaccctgattgccaaggtgatccagaacctggccaactttgccaagtttggaaacaaggaggagtacatggccttcatgaatgacttcctggagcacgagtggggcggcatgaagcgcttcctgctggagatcagcaacccagacaccatcagcaacaccccaggctttgatggctacatcgacctgggccgggagctgtctgtgctgcacagcctgctgtgggaggtggtgtcccagctggacaagggggagaacagcttcctgcaggccaccgtggccaagctgggccccctgccccgggtgctggccgacatcaccaagagcctgaccaaccccacccccatccagcagcagctgcggcgcttcacagagcacaacagcagccccaacgtgtctggcagcctgagcagcggcctgcagaagatctttgaggaccccacagacagcgacctgcacaagctgaagagccccagccaggacaacacagacagctacttccggggcaagaccctgctgctggtgcagcaggccagcagccagagcatgacctacagcgagaaggatgagcgggagagcagcctgcccaacggccgctctgtgtccctgatggacctgcaggacacccacgccgcccaggtggagcacgcctctgtgatgctggatgtgcccatccggctgaccggcagccagctgagcatcacccaggtggccagcatcaagcagctgcgggagacccagagcaccccccagagcgccccccaggtgcggcggcccctgcacccagccctgaaccagcccggcggcctgcagcccctgtccttccagaaccctgtgtaccacctgaacaaccccatcccagccatgcccaaggccagcattgacagcagcctggagaacctgagcacagccagcagccgcagccagagcaacagcgaggacttcaagctgagcggccccagcaacagctccatggaggacttcaccaagaggagcacccagagcgaggacttcagcagaagacacacagtgcctgacagacacatccccctggccctgccccggcagaacagcacaggccaggcccagatcaggaaggtggaccagggcggcctgggcgcccgggccaaggccccacccagcctgccccacagcgccagcctgcggagcacaggctccatgtctgtggtgtctgctgccctggtggccgagcctgtgcagaatggcagccgcagccggcagcagagcagcagcagccgggagagccctgtgcccaaggtgcgggccatccagaggcagcagacccagcaggtgcagagccctgtggacagcgccaccatgagccctgtggagaggacagctgcctgggtgctgaacaacggccagtatgaggaggatgtggaggagacagagcagaacctggatgaggccaagcatgctgagaagtatgagcaggagatcaccaagctgaaggagcggctgcgggtgagcagccggcggctggaggagtatgaaagaaggctgctggtgcaggagcagcagatgcagaagctgctgctggagtacaaggcccggctggaggacagcgaggagcggctgcggcggcagcaggaggagaaggacagccagatgaagagcatcatcagccggctgatggctgtggaggaggagctgaagaaggaccacgccgagatgcaggccgtgattgatgccaagcagaagatcattgatgcccaggtgatcaatggagatgagatcatccagacaggcaagacagacagagtgcccggcttcagccagcaccagacagatgaaagagctgaccccagcgagggcgctgtgcagcacgccggcccccagtggcacctgccccaccagccccaccaggccttccaccacggggagtggtag

SEQ ID NO: 37451 - DNA, 3810 bp, Artificial Sequence
  Description of Artificial Sequence: Synthetic coding sequence
atgtttcctgccctggagagtgacagccccctgcccccagaggacctggatgctgtggtgcctgtgtctggagctgtggccggcggcatgctggaccgcatcctgctggagagcgtgtgccagcagcagagctgggtgcgggtgtatgatgtgaagggcccccccacccaccggctgagctgtggccagagcccctacacagagaccaccacctgggagaggaagtactgcatcctgacagacagccagctggtgctgctgaacaaggagaaggagatccctgtggagggcggccaggagcagcagacagacagcaccaagggccgctgcctgcggaggacagtgtctgtgcccagcgagggccagtttcctgagtacccacctgagggcgccaccaagctggaggtgcctgctgagaggagcccccggcggcgcagcatcagcggcaccagcaccagcgagaagcccaacagcatggacacagccaacaccagccccttcaaggtgcccggcttcttcagcaagaggctgaagggcagcatcaagaggaccaagagccagagcaagctggacaggaacaccagcttccggctgcccagcctgcggagcacagatgacaggagccggggcctgcccaagctgaaggagagccgcagccatgagagcctgctgagcccctgcagcacagtggagtgcctggacctgggccgcggggagcctgtgtctgtgaagcccctgcacagcagcatcctgggccaggacttctgctttgaggtgacctacctgagcggcagcaagtgcttcagctgcaacagcgccagcgagcgggacaagtggatggagaacctgcggaggacagtgcagcccaacaaggacaactgcagaagagcagaaaatgtgctgcggctgtggatcatcgaggccaaggacctggcccccaagaagaagtacttctgtgagctgtgcctggatgacaccctgtttgcccggaccaccagcaagaccaaggctgacaacatcttctggggcgagcactttgagttcttcagcctgccccccctgcacagcatcaccgtgcacatctacaaggatgtggagaagaagaagaagaaggacaagaacaactacgtgggcctggtgaacatccccacagcctctgtgacaggccggcagtttgtggagaagtggtaccctgtgtccacccccacccccaacaagggcaagacaggaggccccagcatccgcatcaagagccgcttccagaccatcaccatcctgcccatggagcagtacaaggagtttgctgagtttgtgaccagcaactacaccatgctgtgcagcgtgctggagcctgtgatctctgtgaggaacaaggaggagctggcctgtgccctggtgcacatcctgcagagcacaggccgggccaaggacttcctgacagacctggtgatgtctgaggtggacagatgtggggagcatgatgtgctgatcttccgggagaacaccatcgccaccaagagcattgaggagtacctgaagctggtgggccagcagtacctgcatgatgccctgggggagttcatcaaggccctgtatgaaagtgatgagaactgtgaggtggaccccagcaagtgcagcagcagcgagctgattgaccaccagagcaacctgaagatgtgctgtgagctggccttctgcaagatcatcaacagctactgtgtgttcccccgggagctgaaggaggtgtttgcctcctggaagcagcagtgcctgaacagaggcaagcaggacatcagcgagcggctcatcagcgccagcctcttcctgcgcttcctgtgcccagccatcatgagccccagcctcttcaacctgatgcaggagtacccagatgacaggaccagcaggaccctgaccctcatcgccaaggtgatccagaacctggccaactttgccaagtttggaaacaaggaggagtacatggccttcatgaatgacttcctggagcacgagtggggcggcatgaagcgcttcctgctggagatcagcaacccagacaccatcagcaacaccccaggctttgatggctacatcgacctgggccgggagctgtctgtgctgcacagcctgctgtgggaggtggtgtcccagctggacaagggagaaaattccttcctgcaggccaccgtggccaagctgggccccctgccccgggtgctggccgacatcaccaagagcctgaccaaccccacccccatccagcagcagctgcggcgcttcacagagcacaacagcagccccaacgtgtctggcagcctgagcagcggcctgcagaagatctttgaggaccccacagacagcgacctgcacaagctgaagagccccagccaggacaacacagacagctacttccggggcaagaccctgctgctggtgcagcaggccagcagccagagcatgacctacagcgagaaggatgagcgggagagcagcctgcccaacggccgctctgtgtccctgatggacctgcaggacacccatgctgcccaggtggagcacgcctctgtgatgctggatgtgcccatccggctgaccggcagccagctgagcatcacccaggtggccagcatcaagcagctgcgggagacccagagcaccccccagagcgccccccaggtgagaagacccctgcacccagccctgaaccagcccggcggcctgcagcccctgtccttccagaaccctgtgtaccacctgaacaaccccatcccagccatgcccaaggccagcattgacagcagcctggagaacctgagcacagccagcagccgcagccagagcaacagcgaggacttcaagctgagcggccccagcaacagctccatggaggacttcaccaagaggagcacccagagcgaggacttcagccgccgccacacagtgcctgacagacacatccccctggccctgccccggcagaacagcacaggccaggcccagatcaggaaggtggaccagggcggcctgggcgcccgggccaaggccccacccagcctgccccacagcgccagcctgcggagcacaggctccatgtctgtggtgtctgctgccctggtggccgagcctgtgcagaatggcagccgcagccggcagcagagcagcagcagccgggagagccctgtgcccaaggtgcgggccatccagaggcagcagacccagcaggtgcagagccctgtggacagcgccaccatgagccctgtggagaggacagctgcctgggtgctgaacaacggccagtatgaagaagatgtggaggagacagagcagaacctggatgaggccaagcacgccgagaagtatgagcaggagatcaccaagctgaaggagcggctgcgggtgagcagccggcggctggaggagtatgaaagaaggctgctggtgcaggagcagcagatgcagaagctgctgctggagtacaaggcccggctggaggacagcgaggagcggctgcggcggcagcaggaggagaaggacagccagatgaagagcatcatcagccggctgatggctgtggaggaggagctgaagaaggaccatgctgagatgcaggccgtgattgatgccaagcagaagatcattgatgcccaggagaagagaattgtgtccctggacagcgccaacacccggctgatgtctgccctgacccaggtgaaggagcgctacagcatgcaggtgagaaatggcatcagccccaccaaccccaccaagctgagcatcacagaaaatggagagttcaagaacagcagctgctag

SEQ ID NO: 37452 - DNA, 3420 bp, Artificial Sequence
  Description of Artificial Sequence: Synthetic coding sequence
atgcagaccccagaggtgcctgctgagaggagcccccggcggcgcagcatcagcggcaccagcaccagcgagaagcccaacagcatggacacagccaacaccagccccttcaaggtgcccggcttcttcagcaagaggctgaagggcagcatcaagaggaccaagagccagagcaagctggacaggaacaccagcttccggctgcccagcctgcggagcacagatgacaggagccggggcctgcccaagctgaaggagagccgcagccatgagagcctgctgagcccctgcagcacagtggagtgcctggacctgggccgcggggagcctgtgtctgtgaagcccctgcacagcagcatcctgggccaggacttctgctttgaggtgacctacctgagcggcagcaagtgcttcagctgcaacagcgccagcgagcgggacaagtggatggagaacctgcggaggacagtgcagcccaacaaggacaactgcagaagagcagaaaatgtgctgcggctgtggatcatcgaggccaaggacctggcccccaagaagaagtacttctgtgagctgtgcctggatgacaccctgtttgcccggaccaccagcaagaccaaggctgacaacatcttctggggcgagcactttgagttcttcagcctgccccccctgcacagcatcaccgtgcacatctacaaggatgtggagaagaagaagaagaaggacaagaacaactacgtgggcctggtgaacatccccacagcctctgtgacaggccggcagtttgtggagaagtggtaccctgtgtccacccccacccccaacaagggcaagacaggaggccccagcatccgcatcaagagccgcttccagaccatcaccatcctgcccatggagcagtacaaggagtttgctgagtttgtgaccagcaactacaccatgctgtgcagcgtgctggagcctgtgatctctgtgaggaacaaggaggagctggcctgtgccctggtgcacatcctgcagagcacaggccgggccaaggacttcctgacagacctggtgatgtctgaggtggacagatgtggggagcatgatgtgctgatcttccgggagaacaccatcgccaccaagagcattgaggagtacctgaagctggtgggccagcagtacctgcatgatgccctgggggagttcatcaaggccctgtatgaaagtgatgagaactgtgaggtggaccccagcaagtgcagcagcagcgagctgattgaccaccagagcaacctgaagatgtgctgtgagctggccttctgcaagatcatcaacagctactgtgtgttcccccgggagctgaaggaggtgtttgcctcctggaagcagcagtgcctgaacagaggcaagcaggacatcagcgagcggctcatcagcgccagcctcttcctgcgcttcctgtgcccagccatcatgagccccagcctcttcaacctgatgcaggagtacccagatgacaggaccagcaggaccctgaccctcatcgccaaggtgatccagaacctggccaactttgccaagtttggaaacaaggaggagtacatggccttcatgaatgacttcctggagcacgagtggggcggcatgaagcgcttcctgctggagatcagcaacccagacaccatcagcaacaccccaggctttgatggctacatcgacctgggccgggagctgtctgtgctgcacagcctgctgtgggaggtggtgtcccagctggacaagggagaaaattccttcctgcaggccaccgtggccaagctgggccccctgccccgggtgctggccgacatcaccaagagcctgaccaaccccacccccatccagcagcagctgcggcgcttcacagagcacaacagcagccccaacgtgtctggcagcctgagcagcggcctgcagaagatctttgaggaccccacagacagcgacctgcacaagctgaagagccccagccaggacaacacagacagctacttccggggcaagaccctgctgctggtgcagcaggccagcagccagagcatgacctacagcgagaaggatgagcgggagagcagcctgcccaacggccgctctgtgtccctgatggacctgcaggacacccatgctgcccaggtggagcacgcctctgtgatgctggatgtgcccatccggctgaccggcagccagctgagcatcacccaggtggccagcatcaagcagctgcgggagacccagagcaccccccagagcgccccccaggtgagaagacccctgcacccagccctgaaccagcccggcggcctgcagcccctgtccttccagaaccctgtgtaccacctgaacaaccccatcccagccatgcccaaggccagcattgacagcagcctggagaacctgagcacagccagcagccgcagccagagcaacagcgaggacttcaagctgagcggccccagcaacagctccatggaggacttcaccaagaggagcacccagagcgaggacttcagccgccgccacacagtgcctgacagacacatccccctggccctgccccggcagaacagcacaggccaggcccagatcaggaaggtggaccagggcggcctgggcgcccgggccaaggccccacccagcctgccccacagcgccagcctgcggagcacaggctccatgtctgtggtgtctgctgccctggtggccgagcctgtgcagaatggcagccgcagccggcagcagagcagcagcagccgggagagccctgtgcccaaggtgcgggccatccagaggcagcagacccagcaggtgcagagccctgtggacagcgccaccatgagccctgtggagaggacagctgcctgggtgctgaacaacggccagtatgaagaagatgtggaggagacagagcagaacctggatgaggccaagcacgccgagaagtatgagcaggagatcaccaagctgaaggagcggctgcgggtgagcagccggcggctggaggagtatgaaagaaggctgctggtgcaggagcagcagatgcagaagctgctgctggagtacaaggcccggctggaggacagcgaggagcggctgcggcggcagcaggaggagaaggacagccagatgaagagcatcatcagccggctgatggctgtggaggaggagctgaagaaggaccatgctgagatgcaggccgtgattgatgccaagcagaagatcattgatgcccaggagaagagaattgtgtccctggacagcgccaacacccggctgatgtctgccctgacccaggtgaaggagcgctacagcatgcaggtgagaaatggcatcagccccaccaaccccaccaagctgagcatcacagaaaatggagagttcaagaacagcagctgctag

SEQ ID NO: 37453 - DNA, 3036 bp, Artificial Sequence
  Description of Artificial Sequence: Synthetic coding sequence
atggacccccccagccccagcaggaccagccagacccagcccacagccaccagccccctgaccagctaccgctggcacactggaggcggcggggagaaggctgctgggggcttccgctggggccgctttgctggctggggccgggccctgagccaccaggagcccatggtgtccacccagcctgcccccaggagcatcttccggcgggtgctgagcgccccacccaaggagagcaggaccagccggctgcggctgagcaaggccctgtggggccgccacaagaaccccccacctgagccagaccctgagcctgagcaggaggcccctgagctggagcctgagcctgagctggagccccccaccccccagatccctgaggcccccaccccaaatgtgcctgtgtgggacattggaggcttcaccctgctggatggcaagctggtgctgctgggcggggaggaggagggcccccggcggccccgggtgggcagcgccagcagcgagggcagcatccacgtggccatgggcaacttccgggaccctgacaggatgcctgggaagacagagcctgagacagctggccccaaccaggtgcacaacgtgcggggcctgctgaagaggctgaaggagaagaagaaggcccggctggagcccagagatggcccccccagcgccctgggcagccgggagagcctggccaccctgtctgagctggacctgggcgctgagagagatgtgcgcatctggcccctgcaccccagcctgctgggggagccccactgcttccaggtgacctggacaggaggcagccgctgcttcagctgccgctctgctgctgagcgggaccgctggattgaggacctgcggcggcagttccagcccacccaggacaacgtggagcgggaggagacctggctgtctgtgtgggtgcatgaggccaagggcctgcccagggctgctgctggggcccctggggtgcgggcagagctgtggctggatggagccctgctggccaggacagccccccgggccggccctggccagctgttctgggccgagcgcttccactttgaggccctgcccccagcccggcggctgagcctgcggctgcggggcctgggccctggcagcgctgtgctgggccgggtggccctggccctggaggagctggatgccccccgggccccagctgctggcctggagcgctggttccccctgctgggcgccccagctggagctgccctgcgggcccgcatccgggcccggcggctgcgggtgctgcccagcgagcgctacaaggagctggccgagttcctgaccttccactacgcccggctgtgtggggccctggagcccgccctgcctgcccaggccaaggaggagctggccgccgccatggtgcgggtgctgcgggccaccggccgggcccaggccctggtgacagacctgggcacagctgagctggcccgctgtggcggccgggaggccctgctcttccgggagaacaccctggccaccaaggccattgatgagtacatgaagctggtggcccaggactacctgcaggagaccctgggccaggtggtgcggcggctgtgtgccagcacagaggactgtgaggtggaccccagcaaatgtcctgccagcgagctgcctgagcaccaggcccggctgaggaacagctgtgaggaggtgtttgagaccatcatccacagctatgactggttccctgctgagctgggcatcgtgttcagctcctggagggaggcctgcaaggagcggggcagcgaggtgctgggcccccggctggtgtgtgccagcctcttcctgcggctgctgtgcccagccatcctggcccccagcctgtttggcctggccccagaccacccagcccctggccctgcccggaccctgaccctgattgccaaggtgatccagaacctggccaacagagccccctttggagagaaggaggcctacatgggcttcatgaacagcttcctggaggagcacggccctgccatgcagtgcttcctggaccaggtggccatggtggatgtggatgctgcccccagcggctaccagggcagcggggacctggccctgcagctggccgtgctgcacgcccagctgtgcaccatctttgctgagctggaccagaccacccgggacaccctggagcccctgcccaccatcctgcgggccatcgaggagggccagcctgtgctggtgtctgtgcccatgaggctgcccctgcccccagcccaggtgcacagcagcctgtctgctggggagaagccaggcttcctggccccccgggacctgcccaagcacacccccctcatcagcaagagccagagcctgcggtctgtgcggcgctctgagagctgggcccggcccaggccagatgaggagcggcccctgcggcggcccaggcctgtgcagaggacccagagcgtgcctgtgagaagacctgcccggcggcggcagagcgctggcccctggccccggcccaagggcagcctgtccatgggccctgccccccgggcccggccctggacccgggacagcgccagcctgcccaggaagcccagcgtgccctggcagaggcagatggaccagccccaggacaggaaccaggccctgggcacccacaggcctgtgaacaagctggccgagctgcagtgtgaggtggccgccctgcgggaggagcagaaggtgctgagccggctggtggagagcctgagcacccagatccgggccctgacagagcagcaggagcagctgcggggccagctgcaggacctggacagccggctgcgggccggcagcagcgagtttgattctgagcacaacctgaccagcaatgaaggccacagcctgaagaacctggagcaccggctgaatgagatggagaggacccaggcccagctgagagatgctgtgcagagcctgcagctgagccccaggacccggggctcctggagccagccccagcccctgaaggccccctgcctgaatggagacaccacctag

SEQ ID NO: 37454 - DNA, 711 bp, Artificial Sequence
  Description of Artificial Sequence: Synthetic coding sequence
atggagcgctggctgttcctgggcgccacagaggagggccccaagaggaccatggacagcggcaccaggcctgtgggcagctgctgcagcagccctgctggcctgagccgggagtacaagctggtgatgctgggcgctgggggcgtgggcaagagcgccatgaccatgcagttcatcagccaccgcttcccagaagatcatgaccccaccattgaagatgcctacaagatccgcatcagaattgatgatgagcccgccaacctggacatcctggacacagctggccaggccgagttcaccgccatgagggaccagtacatgagagctggggagggcttcatcatctgctacagcatcacagaccggcgctccttccacgaggtgcgggagttcaagcagctgatctacagagtgagaagaacagatgacacccctgtggtgctggtgggcaacaagagtgacctgaagcagctgcggcaggtgaccaaggaggagggcctggccctggcccgggagttcagctgccccttctttgagaccagcgctgcctaccgctactacattgatgatgtgttccacgccctggtgcgggagatccggaggaaggagaaggaggccgtgctggccatggagaagaagagcaagcccaagaacagcgtgtggaagaggctgaagagccccttcaggaagaagaaggacagcgtgacctag

SEQ ID NO: 37455 - DNA, 660 bp, Artificial Sequence
  Description of Artificial Sequence: Synthetic coding sequence
atggattctggcaccaggcctgtgggcagctgctgcagcagccctgctggcctgagccgggagtacaagctggtgatgctgggcgctgggggcgtgggcaagagcgccatgaccatgcagttcatcagccaccgcttccctgaggaccatgaccccaccattgaagatgcctacaagatccgcatcagaattgatgatgagcccgccaacctggacatcctggacacagctggccaggccgagttcaccgccatgagggaccagtacatgagagctggggagggcttcatcatctgctacagcatcacagacagaagaagcttccacgaggtgcgggagttcaagcagctgatctacagagtgcggaggacagatgacacccctgtggtgctggtgggcaacaagagtgacctgaagcagctgcggcaggtgaccaaggaggagggcctggccctggcccgggagttcagctgccccttctttgagaccagcgctgcctaccgctactacattgatgatgtgttccacgccctggtgcgggagatccggaggaaggagaaggaggccgtgctggccatggagaagaagagcaagcccaagaacagcgtgtggaagaggctgaagagccccttcaggaagaagaaggacagcgtgacctag

SEQ ID NO: 37456 - DNA, 552 bp, Artificial Sequence
  Description of Artificial Sequence: Synthetic coding sequence
atgaccatgcagttcatcagccaccgcttccctgaggaccatgaccccaccattgaagatgcctacaagatccgcatcagaattgatgatgagcccgccaacctggacatcctggacacagctggccaggccgagttcaccgccatgagggaccagtacatgagagctggggagggcttcatcatctgctacagcatcacagacagaagaagcttccacgaggtgcgggagttcaagcagctgatctacagagtgcggaggacagatgacacccctgtggtgctggtgggcaacaagagtgacctgaagcagctgcggcaggtgaccaaggaggagggcctggccctggcccgggagttcagctgccccttctttgagaccagcgctgcctaccgctactacattgatgatgtgttccacgccctggtgcgggagatccggaggaaggagaaggaggccgtgctggccatggagaagaagagcaagcccaagaacagcgtgtggaagaggctgaagagccccttcaggaagaagaaggacagcgtgacctag

SEQ ID NO: 37457 - DNA, 462 bp, Artificial Sequence
  Description of Artificial Sequence: Synthetic coding sequence
atggaggtggagaatgaggccagctgcagccctggcagcgccagcggcggcagccgggagtacaaggtggtgatgctgggcgctgggggcgtgggcaagagcgccatgaccatgcagttcatcagccaccagttcccagactaccatgaccccaccattgaagatgcctacaagacccaggtgagaattgacaatgaaccagcctacctggacatcctggacacagctggccaggccgagttcaccgccatgagggagcagtacatgagaggaggagagggcttcatcatctgctacagcgtgacagaccggcagagcttccaggaggccgccaagttcaaggagctgatcttccaggtgcgccacacctatgagatccccctggtgctggtgggcaacaagattgacctggagcagttccggcagcccaccctgaaggagtttggccgggaggagttctag

SEQ ID NO: 37458 - DNA, 654 bp, Artificial Sequence
  Description of Artificial Sequence: Synthetic coding sequence
atggaggtggagaatgaggccagctgcagccctggcagcgccagcggcggcagccgggagtacaaggtggtgatgctgggcgctgggggcgtgggcaagagcgccatgaccatgcagttcatcagccaccagttcccagactaccatgaccccaccattgaagatgcctacaagacccaggtgagaattgacaatgaaccagcctacctggacatcctggacacagctggccaggccgagttcaccgccatgagggagcagtacatgagaggaggagagggcttcatcatctgctacagcgtgacagaccggcagagcttccaggaggccgccaagttcaaggagctgatcttccaggtgcgccacacctatgagatccccctggtgctggtgggcaacaagattgacctggagcagttccggcaggtgtccacagaggagggcctgagcctggcccaggagtacaactgtggcttctttgagaccagcgctgccctgcgcttctgcattgatgatgccttccacggcctggtgcgggagatcaggaagaaggagagcatgcccagcctgatggagaagaagctgaagaggaaggacagcctgtggaagaagctgaagggcagcctgaagaagaagcgggagaacatgacctag

SEQ ID NO: 37459 - DNA, 240 bp, Artificial Sequence
  Description of Artificial Sequence: Synthetic coding sequence
atgcctgtggccgtgggcccctacggccagagccagcccagctgctttgacagagtgaagatgggctttgtgatgggctgtgctgtgggcatggctgctggggccctgtttggcaccttcagctgcctgagaattggcatgaggggccgggagctgatgggcggcatcggcaagaccatgatgcagagcggcggcaccttcggcaccttcatggccatcggcatgggcatccgctgctag

SEQ ID NO: 37460 - DNA, 240 bp, Artificial Sequence; identical to SEQ ID NO: 37459
  Description of Artificial Sequence: Synthetic coding sequence

SEQ ID NO: 37461 - DNA, 240 bp, Artificial Sequence; identical to SEQ ID NO: 37459
  Description of Artificial Sequence: Synthetic coding sequence

SEQ ID NO: 37462 - DNA, 240 bp, Artificial Sequence; identical to SEQ ID NO: 37459
  Description of Artificial Sequence: Synthetic coding sequence

SEQ ID NO: 37463 - DNA, 792 bp, Artificial Sequence
  Description of Artificial Sequence: Synthetic coding sequence
atgaggatcttccggccctggaggctgcgctgcccagccctgcacctgcccagcctgagcgtcttcagcctgcgctggaagctgcccagcctgaccacagatgagaccatgtgcaagtctgtgaccacagatgagtggaagaaggtgttctatgagaagatggaggaggccaagccagctgacagctgggacctgatcatcgaccccaacctgaagcacaacgtgctgagccctggctggaagcagtacctggagctgcacgccagcggccgcttccactgctcctggtgctggcacacctggcagagcccctacgtggtgatcctcttccacatgttcctggaccgggcccagagagctggctctgtgaggatgagggtcttcaagcagctgtgctatgaatgtggcacagcccggctggatgagagctccatgctggaggagaacatcgagggcctggtggacaacctgatcaccagcctgcgggagcagtgctacggggagcggggcggccagtaccgcatccacgtggccagccggcaggacaacagaagacacagaggagagttctgtgaggcctgccaggagggcatcgtgcactggaagcccagcgagaagctgctggaggaggaggccaccacctacaccttcagccgggcccccagccccaccaagagccaggaccagacaggcagcggctggaacttctgcagcatcccctggtgcctcttctgggccaccgtgctgctgctgatcatctacctgcagttctccttccgcagctctgtgtag

SEQ ID NO: 37464 - DNA, 678 bp, Artificial Sequence
  Description of Artificial Sequence: Synthetic coding sequence
atgtgcaccagcctgaccacctgtgagtggaagaaggtgttctatgagaagatggaggtggccaagccagctgacagctgggagctgatcatcgaccccaacctgaagcccagcgagctggcccctggctggaagcagtacctggagcagcacgccagcggccgcttccactgctcctggtgctggcacacctggcagagcgcccacgtggtgatcctcttccacatgttcctggaccgggcccagagagctggctctgtgaggatgagggtcttcaagcagctgtgctatgaatgtggcacagcccggctggatgagagctccatgctggaggagaacatcgagggcctggtggacaacctgatcaccagcctgcgggagcagtgctatgaggaggatggcggccagtaccgcatccacgtggccagcaggccagattctggcccccacagagctgagttctgtgaggcctgccaggagggcatcgtgcactggaagcccagcgagaagctgctggaggaggaggtgaccacctacaccagcgaggccagcaagccccgggcccaggccggcagcggctacaacttcctgagcctgcgctggtgcctcttctgggccagcctgtgcctgctggtggtgtacctgcagttctccttcctgagccctgccttcttctag

SEQ ID NO: 37465 - DNA, 2016 bp, Artificial Sequence
  Description of Artificial Sequence: Synthetic coding sequence
atgcagcctgacatgagcctgaatgtcatcaagatgaagagcagtgacttcctggagagcgctgagctggacagcggcggctttgggaaggtgtccctgtgcttccacaggacccagggcctgatgatcatgaagacagtgtacaagggccccaactgcatcgagcacaatgaggccctgctggaggaggccaagatgatgaaccggctgcggcacagccgggtggtgaagctgctgggcgtcatcatcgaggagggcaagtacagcctggtgatggagtacatggagaagggcaacctgatgcacgtgctgaaggccgagatgagcacccccctgtctgtgaagggccgcatcatcctggagatcatcgagggcatgtgctacctgcacggcaagggcgtcatccacaaggacctgaagccagagaacatcctggtggacaatgacttccacatcaagattgctgacctgggcctggccagcttcaagatgtggagcaagctgaacaatgaggagcacaatgagctgcgggaggtggatggaacagccaagaagaatggaggcaccctgtactacatggcccctgagcacctgaatgatgtgaatgccaagcccacagagaagagtgatgtgtacagctttgctgtggtgctgtgggccatctttgccaacaaggagccctatgaaaatgccatctgtgagcagcagctgatcatgtgcatcaagagcggcaacagaccagatgtggatgacatcacagagtactgcccccgggagatcatcagcctgatgaagctgtgctgggaggccaaccctgaggcccggcccaccttccctggcatcgaggagaagttccggcccttctacctgagccagctggaggagagcgtggaggaggatgtgaagagcctgaagaaggagtacagcaatgaaaatgctgtggtgaagaggatgcagagcctgcagctggactgtgtggccgtgcccagcagccgcagcaacagcgccacagagcagcccggcagcctgcacagcagccagggcctgggcatgggccctgtggaggagagctggtttgcccccagcctggagcacccccaggaggagaatgagcccagcctgcagagcaagctgcaggatgaggccaactaccacctgtatggcagcaggatggaccggcagaccaagcagcagccccggcagaatgtggcctacaaccgggaggaggagaggagaagaagagtgtcccatgacccctttgcccagcagaggccctatgagaacttccagaacacagagggcaaaggaacagcctacagcagcgctgccagccatggaaatgctgtgcaccagcccagcggcctgaccagccagccccaggtgctgtaccagaacaacggcctgtacagcagccacggcttcggcacccggcccctggaccctggaacagctggcccccgggtgtggtaccggcccatccccagccacatgcccagcctgcacaacatccctgtgcctgagaccaactacctgggcaacacccccaccatgcccttcagcagcctgcccccaacagatgagagcatcaagtacaccatctacaacagcacaggcatccagattggagcctacaactacatggagattggaggcaccagcagcagcctgctggacagcaccaacaccaacttcaaggaggagcctgctgccaagtaccaggccatctttgacaacaccaccagcctgacagacaagcacctggaccccatccgggagaacctgggcaagcactggaagaactgtgccaggaagctgggcttcacccagagccagattgatgaaattgaccatgactatgaaagagatggcctgaaggagaaggtgtaccagatgctgcagaagtgggtgatgagggagggcatcaagggggccaccgtgggcaagctggcccaggccctgcaccagtgcagcagaattgacctgctgagcagcctcatctacgtgtcccagaactag

SEQ ID NO: 37466 - DNA, 2016 bp, Artificial Sequence; identical to SEQ ID NO: 37465
  Description of Artificial Sequence: Synthetic coding sequence

SEQ ID NO: 37467 - DNA, 822 bp, Artificial Sequence
  Description of Artificial Sequence: Synthetic coding sequence
atgagccctgcctgccgggtgaacagcaagaccaagcccaccaccatcttcatggccgccgcctggacaggaagaagaaacagcagcccagacaggatgtggctgaccacagaaagaagaaaaggagatgctggcagccccatgaccctgctgcaccggcccagcggcctgaccagccagccccaggtgctgtaccagaacaacggcctgtacagcagccacggcttcggcacccggcccctggaccctggaacagctggcccccgggtgtggtaccggcccatccccagccacatgcccagcctgcacaacatccctgtgcctgagaccaactacctgggcaacacccccaccatgcccttcagcagcctgcccccaacagatgagagcatcaagtacaccatctacaacagcacaggcatccagattggagcctacaactacatggagattggaggcaccagcagcagcctgctggacagcaccaacaccaacttcaaggaggagcctgctgccaagtaccaggccatctttgacaacaccaccagcctgacagacaagcacctggaccccatccgggagaacctgggcaagcactggaagaactgtgccaggaagctgggcttcacccagagccagattgatgaaattgaccatgactatgaaagagatggcctgaaggagaaggtgtaccagatgctgcagaagtgggtgatgagggagggcatcaagggggccaccgtgggcaagctggcccaggccctgcaccagtgcagcagaattgacctgctgagcagcctcatctacgtgtcccagaactag

SEQ ID NO: 37468 - DNA, 1878 bp, Artificial Sequence
  Description of Artificial Sequence: Synthetic coding sequence
atgcagcctgacatgagcctgaatgtcatcaagatgaagagcagtgacttcctggagagcgctgagctggacagcggcggctttgggaaggtgtccctgtgcttccacaggacccagggcctgatgatcatgaagacagtgtacaagggccccaactgcatcgagcacaatgaggccctgctggaggaggccaagatgatgaaccggctgcggcacagccgggtggtgaagctgctgggcgtcatcatcgaggagggcaagtacagcctggtgatggagtacatggagaagggcaacctgatgcacgtgctgaaggccgagattgctgacctgggcctggccagcttcaagatgtggagcaagctgaacaatgaggagcacaatgagctgcgggaggtggatggaacagccaagaagaatggaggcaccctgtactacatggcccctgagcacctgaatgatgtgaatgccaagcccacagagaagagtgatgtgtacagctttgctgtggtgctgtgggccatctttgccaacaaggagccctatgaaaatgccatctgtgagcagcagctgatcatgtgcatcaagagcggcaacagaccagatgtggatgacatcacagagtactgcccccgggagatcatcagcctgatgaagctgtgctgggaggccaaccctgaggcccggcccaccttccctggcatcgaggagaagttccggcccttctacctgagccagctggaggagagcgtggaggaggatgtgaagagcctgaagaaggagtacagcaatgaaaatgctgtggtgaagaggatgcagagcctgcagctggactgtgtggccgtgcccagcagccgcagcaacagcgccacagagcagcccggcagcctgcacagcagccagggcctgggcatgggccctgtggaggagagctggtttgcccccagcctggagcacccccaggaggagaatgagcccagcctgcagagcaagctgcaggatgaggccaactaccacctgtatggcagcaggatggaccggcagaccaagcagcagccccggcagaatgtggcctacaaccgggaggaggagaggagaagaagagtgtcccatgacccctttgcccagcagaggccctatgagaacttccagaacacagagggcaaaggaacagcctacagcagcgctgccagccatggaaatgctgtgcaccagcccagcggcctgaccagccagccccaggtgctgtaccagaacaacggcctgtacagcagccacggcttcggcacccggcccctggaccctggaacagctggcccccgggtgtggtaccggcccatccccagccacatgcccagcctgcacaacatccctgtgcctgagaccaactacctgggcaacacccccaccatgcccttcagcagcctgcccccaacagatgagagcatcaagtacaccatctacaacagcacaggcatccagattggagcctacaactacatggagattggaggcaccagcagcagcctgctggacagcaccaacaccaacttcaaggaggagcctgctgccaagtaccaggccatctttgacaacaccaccagcctgacagacaagcacctggaccccatccgggagaacctgggcaagcactggaagaactgtgccaggaagctgggcttcacccagagccagattgatgaaattgaccatgactatgaaagagatggcctgaaggagaaggtgtaccagatgctgcagaagtgggtgatgagggagggcatcaagggggccaccgtgggcaagctggcccaggccctgcaccagtgcagcagaattgacctgctgagcagcctcatctacgtgtcccagaactag

SEQ ID NO: 37469 - DNA, 522 bp, Artificial Sequence
  Description of Artificial Sequence: Synthetic coding sequence
atgcagagcgagctgtgctttgctgacatccatgacagtgatggcagcagcagcagcagccaccagagcctgaagagcacagccaagtgggccgccagcctggagaacctgctggaggaccctgagggcgtgaagcgcttccgggagttcctgaagaaggagttcagcgaggagaatgtgctcttctggctggcctgtgaggacttcaagaagatgcaggacaagacccagatgcaggagaaggccaaggagatctacatgaccttcctgagcagcaaggccagcagccaggtgaatgtggagggccagagccggctgaatgagaagatcctggaggagccccaccccctgatgttccagaagctgcaggaccagatcttcaacctgatgaagtatgacagctacagccgcttcctgaagagtgacctcttcctgaagcacaagaggacagaggaggaggaggaggacctgcctgatgcccagacagctgccaagagggccagccgcatctacaacacctag

SEQ ID NO: 37470 - DNA, 546 bp, Artificial Sequence
  Description of Artificial Sequence: Synthetic coding sequence
atgttcaacagagctgtgtcccggctgagcaggaagaggcctcccagcgacatccatgacagtgatggcagcagcagcagcagccaccagagcctgaagagcacagccaagtgggccgccagcctggagaacctgctggaggaccctgagggcgtgaagcgcttccgggagttcctgaagaaggagttcagcgaggagaatgtgctcttctggctggcctgtgaggacttcaagaagatgcaggacaagacccagatgcaggagaaggccaaggagatctacatgaccttcctgagcagcaaggccagcagccaggtgaatgtggagggccagagccggctgaatgagaagatcctggaggagccccaccccctgatgttccagaagctgcaggaccagatcttcaacctgatgaagtatgacagctacagccgcttcctgaagagtgacctcttcctgaagcacaagaggacagaggaggaggaggaggacctgcctgatgcccagacagctgccaagagggccagccgcatctacaacacctag

SEQ ID NO: 37471 - DNA, 504 bp, Artificial Sequence
  Description of Artificial Sequence: Synthetic coding sequence
atggagcacatccatgacagtgatggcagcagcagcagcagccaccagagcctgaagagcacagccaagtgggccgccagcctggagaacctgctggaggaccctgagggcgtgaagcgcttccgggagttcctgaagaaggagttcagcgaggagaatgtgctcttctggctggcctgtgaggacttcaagaagatgcaggacaagacccagatgcaggagaaggccaaggagatctacatgaccttcctgagcagcaaggccagcagccaggtgaatgtggagggccagagccggctgaatgagaagatcctggaggagccccaccccctgatgttccagaagctgcaggaccagatcttcaacctgatgaagtatgacagctacagccgcttcctgaagagtgacctcttcctgaagcacaagaggacagaggaggaggaggaggacctgcctgatgcccagacagctgccaagagggccagccgcatctacaacacctag

SEQ ID NO: 37472 - DNA, 1341 bp, Artificial Sequence
  Description of Artificial Sequence: Synthetic coding sequence
atggagcgggtggtggtgtccatgcaggaccctgaccagggcgtgaagatgaggagccagaggctgctggtgaccgtcatcccccatgctgtgacaggcagtgatgtggtgcagtggctggcccagaagttctgtgtgtctgaggaggaggccctgcacctgggcgctgtgctggtgcagcacggctacatctaccccctgcgggaccccaggagcctgatgctgcggccagatgagaccccctaccgcttccagaccccctacttctggaccagcaccctgcggcctgctgctgagctggactatgccatctacctggccaagaagaacatcaggaagaggggcaccctggtggactatgagaaggactgctatgaccggctgcacaagaagatcaaccacgcctgggacctggtgctgatgcaggcccgggagcagctgcgggccgccaagcagaggagcaaaggagaccggctggtgattgcctgccaggagcagacctactggctggtgaaccggcccccacctggggccccagatgtgctggagcagggccctggccggggcagctgtgccgccagccgggtgctgatgaccaagtctgctgacttccacaagcgggagattgagtacttcaggaaggccctgggccgcaccagggtgaagagctctgtgtgcctggaggcctacctgtccttctgtggccagaggggcccccatgaccccctggtgtctggctgcctgcccagcaacccctggatcagtgacaatgatgcctactgggtgatgaatgcccccaccgtggccgcccccaccaagctgcgggtggagcgctggggcttctccttccgggagctgctggaggaccctgtgggccgggcccacttcatggacttcctgggcaaggagttctctggagagaacctgtccttctgggaggcctgtgaggagctgcgctacggggcccaggcccaggtgcccaccctggtggatgctgtgtatgagcagttcctggcccctggggccgcccactgggtgaacatcgacagcaggaccatggagcagaccctggagggcctgcggcagccccaccgctacgtgctggatgatgcccagctgcacatctacatgctgatgaagaaggacagctacccccgcttcctgaagagtgacatgtacaaggccctgctggccgaggccggcatccccctggagatgaagagaagagtcttccccttcacctggaggcccaggcacagcagccccagccctgccctgctgcccacccctgtggagcccacagctgcctgtggccctggaggaggagatggagtggcctag

SEQ ID NO: 37473 - DNA, 786 bp, Artificial Sequence
  Description of Artificial Sequence: Synthetic coding sequence
atggctgctggccctgcccctcctcctggccggccccgggcccagatgccccacctgaggaagatggagcgggtggtggtgtccatgcaggaccctgaccagggcgtgaagatgaggagccagaggctgctggtgaccgtcatcccccatgctgtgactggaagtgatgtggtgcagtggctggcccagaagttctgtgtgtctgaggaggaggccctgcacctgggcgctgtgctggtgcagcacggctacatctaccccctgcgggaccccaggagcctgatgctgcggccagatgagaccccctaccgcttccagaccccctacttctggaccagcaccctgcggcctgctgctgagctggactatgccatctacctggccaagaagaacatcaggaagaggggcaccctggtggactatgagaaggactgctatgaccggctgcacaagaagatcaaccacgcctgggacctggtgctgatgcaggcccgggagcagctgcgggccgccaagcagaggagcaagggggaccggctggtgattgcctgccaggagcagacctactggctggtgaacagacctcctcctggggccccagatgtgctggagcagggccctggccggggcagctgtgccgccagccgggtgctgatggtggaggccagcaggacccggggcaccaggcctgagggcgccagcgagcccaggagcagcaagaccctgtgcagcaaccagagccacccagaccccaccagcggcaagatgcacctggagccccactag

SEQ ID NO: 37474 - DNA, 1404 bp, Artificial Sequence
  Description of Artificial Sequence: Synthetic coding sequence
atggctgctggccctgcccctcctcctggccggccccgggcccagatgccccacctgaggaagatggagcgggtggtggtgtccatgcaggaccctgaccagggcgtgaagatgaggagccagaggctgctggtgaccgtcatcccccatgctgtgactggaagtgatgtggtgcagtggctggcccagaagttctgtgtgtctgaggaggaggccctgcacctgggcgctgtgctggtgcagcacggctacatctaccccctgcgggaccccaggagcctgatgctgcggccagatgagaccccctaccgcttccagaccccctacttctggaccagcaccctgcggcctgctgctgagctggactatgccatctacctggccaagaagaacatcaggaagaggggcaccctggtggactatgagaaggactgctatgaccggctgcacaagaagatcaaccacgcctgggacctggtgctgatgcaggcccgggagcagctgcgggccgccaagcagaggagcaagggggaccggctggtgattgcctgccaggagcagacctactggctggtgaacagacctcctcctggggccccagatgtgctggagcagggccctggccggggcagctgtgccgccagccgggtgctgatgaccaagtctgctgacttccacaagcgggagattgagtacttcaggaaggccctgggccgcaccagggtgaagagctctgtgtgcctggaggcctacctgtccttctgtggccagaggggcccccatgaccccctggtgtctggctgcctgcccagcaacccctggatcagtgacaatgatgcctactgggtgatgaatgcccccaccgtggccgcccccaccaagctgcgggtggagcgctggggcttctccttccgggagctgctggaggaccctgtgggccgggcccacttcatggacttcctgggcaaggagttcagcggggagaacctgtccttctgggaggcctgtgaggagctgcgctatggagcccaggcccaggtgcccaccctggtggatgctgtgtatgagcagttcctggcccctggagctgcccactgggtgaacatcgacagcaggaccatggagcagaccctggagggcctgcggcagccccacagatatgtgctggatgatgcccagctgcacatctacatgctgatgaagaaggacagctacccccgcttcctgaagagtgacatgtacaaggccctgctggccgaggccggcatccccctggagatgaagagaagagtcttccccttcacctggaggcccaggcacagcagccccagccctgccctgctgcccacccctgtggagcccacagctgcctgtggccctggaggaggagatggagtggcctag

SEQ ID NO: 37475 - DNA, 405 bp, Artificial Sequence
  Description of Artificial Sequence: Synthetic coding sequence
atggccaccagcacccgctgtgccacccctgtggccagctgcagcggccagacccggcggcccaccggcagccgcagcggcagcggcgtgcaggtgggcgctgggggcacccccacccccacccacccagcctaccagctgggggagaccggcggggcccccagcctgctgggcctggagtgggacagcgccatgagcccctgggccggcggccccagccccccaccccagaagtcctggacagccagcacagatgtggtgcggaggacccggctgagagatggagcctctgtgttcctgggcaccacagctggcccccacaagggcagctatgtgcagaggatcctgcccagctcctggggcagcctgggccctggccctgagggcggcgctgtgaaggcctag

SEQ ID NO: 37476 - DNA, 480 bp, Artificial Sequence
  Description of Artificial Sequence: Synthetic coding sequence
atgagcagaagaaactgctggatctgcaagatgtgcagagatgagagcaagaggcctcccagcaacctgaccctggaggaggtgctgcagtgggcccagagctttgagaacctgatggccaccaagtatggccctgtggtgtatgctgcctacctgaagatggagcacagtgatgagaacatccagttctggatggcctgtgagacctacaagaagatcgccagccgctggagccgcatcagccgggccaagaagctgtacaagatctacatccagccccagagcccccgggagatcaacatcgacagcagcacccgggagaccatcatccggaacatccaggagcccacagagacctgctttgaggaggcccagaagatcgtgtacatgcacatggagcgggacagctacccccgcttcctgaagtctgagatgtaccagaagctgctgaagaccatgcagagcaacaacagcttctag

SEQ ID NO: 37477 - DNA, 480 bp, Artificial Sequence; identical to SEQ ID NO: 37476
  Description of Artificial Sequence: Synthetic coding sequence

SEQ ID NO: 37478 - DNA, 1788 bp, Artificial Sequence
  Description of Artificial Sequence: Synthetic coding sequence
atgaccatgaccctgcacaccaaggccagcggcatggccctgctgcaccagatccagggcaatgagctggagcccctgaaccggccccagctgaagatccccctggagcggcccctgggggaggtgtacctggacagcagcaagccagctgtgtacaactacccagagggcgccgcctatgagttcaatgctgctgctgctgccaatgcccaggtgtatggccagacaggcctgccctacggccctggcagcgaggccgccgccttcggcagcaatggcctgggcggcttcccccccctgaacagcgtgagccccagccccctgatgctgctgcaccccccaccccagctgagccccttcctgcagccccacggccagcaggtgccctactacctggagaatgagcccagcggctacacagtgcgggaggccggccccccagccttctaccggcccaacagcgacaacagacggcagggcggccgggagcggctggccagcaccaatgacaagggctccatggccatggagagcgccaaggagacccgctactgtgctgtgtgcaatgactatgccagcggctaccactatggagtgtggagctgtgagggctgcaaggccttcttcaagaggagcatccagggccacaatgactacatgtgcccagccaccaaccagtgcaccatcgacaagaacagaaggaagagctgccaggcctgccgcctgaggaagtgctatgaggtgggcatgatgaagggcggcatcaggaaggacagaagaggaggccgcatgctgaagcacaagaggcagagagatgatggagagggccgcggggaggtgggcagcgctggggacatgagagctgccaacctgtggcccagccccctgatgatcaagaggagcaagaagaacagcctggccctgagcctgacagctgaccagatggtgtctgccctgctggatgctgagccccccatcctgtacagtgaatatgaccccacccggcccttcagcgaggcctccatgatgggcctgctgaccaacctggccgaccgggagctggtgcacatgatcaactgggccaagagggtgcccggctttgtggacctgaccctgcatgaccaggtgcacctgctggagtgtgcctggctggagatcctgatgattggcctggtgtggaggtccatggagcaccctgggaagctgctgtttgcccccaacctgctgctggacaggaaccagggcaaatgtgtggagggcatggtggagatctttgacatgctgctggccaccagcagccgcttcaggatgatgaacctgcagggcgaggagtttgtgtgcctgaagagcatcatcctgctgaacagcggcgtgtacaccttcctgagcagcaccctgaagagcctggaggagaaggaccacatccaccgggtgctggacaagatcacagacaccctcatccacctgatggccaaggccggcctgaccctgcagcagcagcaccagaggctggcccagctgctgctgatcctgagccacatccgccacatgagcaacaagggcatggagcacctgtacagcatgaagtgcaagaatgtggtgcccctgtatgacctgctgctggagatgctggatgcccaccggctgcacgcccccaccagccggggcggggcctctgtggaggagacagaccagagccacctggccacagctggcagcaccagcagccacagcctgcagaagtactacatcactggagaggccgagggcttccctgccaccgtgtag

SEQ ID NO: 37479 - DNA, 633 bp, Artificial Sequence
  Description of Artificial Sequence: Synthetic coding sequence
atgaggaagaggcagcagagccagaatgaaggcaccccagctgtgtcccaggcccctggcaaccagaggcccaacaacacctgctgcttctgctggtgctgctgctgcagctgcagctgcctgactgtgagaaatgaggagcggggggagaatgccggccggcccacccacaccaccaagatggagagcatccaggtgctggaggagtgccagaaccccacagctgaggaggtgctgtcctggagccagaactttgacaagatgatgaaggccccagctggaagaaacctcttccgggagttcctgaggacagagtacagcgaggagaacctgctcttctggctggcctgtgaggacctgaagaaggagcagaacaagaaggtgattgaggagaaggccaggatgatctatgaggactacatcagcatcctgagccccaaggaggtgtccctggacagccgggtgcgggaggtgatcaacagaaacctgctggaccccaacccccacatgtatgaagatgcccagctgcagatctacaccctgatgcaccgggacagcttcccccgcttcctgaacagccagatctacaagagctttgtggagagcacagctggcagcagcagcgagagctag

SEQ ID NO: 37480 - DNA, 708 bp, Artificial Sequence
  Description of Artificial Sequence: Synthetic coding sequence
atggagaccaccctgctcttcttcagccagatcaacatgtgtgagagcaaggagaagaccttcttcaagctgatccacggcagcggcaaggaggagaccagcaaggaggccaagatccgggccaaggagaagaggaaccggctgagcctgctggtgcagaagccagagttccacgaggacaccaggagcagccgcagcggccacctggccaaggagaccagggtgtccccagaggaggccgtgaagtggggcgagagctttgacaagctgctgagccacagagatggcctggaggccttcacccgcttcctgaagacagagttctctgaagaaaatattgagttctggatcgcctgtgaggacttcaagaagagcaagggcccccagcagatccacctgaaggccaaggccatctatgagaagttcatccagacagatgcccccaaggaggtgaacctggacttccacaccaaggaggtgatcaccaacagcatcacccagcccaccctgcacagctttgatgctgcccagagccgggtgtaccagctgatggagcaggacagctacacccgcttcctgaagagtgacatctacctggacctgatggagggccggccccagaggcccaccaacctgcggcggcgcagccgctccttcacctgcaatgagttccaggatgtgcagagtgatgtggccatctggctgtag

SEQ ID NO: 37481 - DNA, 654 bp, Artificial Sequence
  Description of Artificial Sequence: Synthetic coding sequence
atgcccacccctcatgaagctgagaagcagatcaccggccctgaggaggccgaccggccccccagcatgagcagccatgacacagccagccctgctgcccccagcaggaacccctgctgcctgtgctggtgctgctgctgcagctgctcctggaaccaggagcggcggcgggcctggcaggccagccgggagagcaagctgcagcccctgcccagctgtgaggtgtgtgccacccccagccctgaggaggtgcagagctgggcccagagctttgacaagctgatgcacagccctgctggccgcagcgtcttccgggccttcctgaggacagagtacagcgaggagaacatgctgttctggctggcctgtgaggagctgaaggccgaggccaaccagcacgtggtggatgagaaggcccggctcatctatgaggactatgtgtccatcctgagccccaaggaggtgtccctggacagccgggtgcgggagggcatcaacaagaagatgcaggagcccagcgcccacacctttgatgatgcccagctgcagatctacaccctgatgcaccgggacagctacccccgcttcctgagcagccccacctaccgggccctgctgctgcagggccccagccagagcagcagcgaggcctag

SEQ ID NO: 37482 - DNA, 654 bp, Artificial Sequence; identical to SEQ ID NO: 37481
  Description of Artificial Sequence: Synthetic coding sequence

SEQ ID NO: 37483 - DNA, 726 bp, Artificial Sequence
  Description of Artificial Sequence: Synthetic coding sequence
atgaggacagcagatggaggagagcctgctggggccagcagccctgctggccgggtggatggcggcctgcagatgggcagcgagaggatggagatgaggaagaggcagatgcctgctgcccaggacacccctggggccgcccctggccagcctggagctggcagccggggcagcaatgcctgctgcttctgctggtgctgctgctgcagctgcagctgcctgactgtgaggaaccaggaggaccagaggcccaccatcgccagccatgagctgcgggctgacctgcccacctgggaggagagccctgcccccaccctggaggaggtgaatgcctgggcccagagctttgacaagctgatggtgaccccagctggaagaaatgccttccgggagttcctgaggacagagttcagcgaggagaacatgctgttctggatggcctgtgaggagctgaagaaggaggccaacaagaacatcatcgaggagaaggcccgcatcatctatgaggactacatcagcatcctgagccccaaggaggtgtccctggacagccgggtgcgggaggtgatcaacagaaacatggtggagcccagccagcacatctttgatgatgcccagctgcagatctacaccctgatgcaccgggacagctacccccgcttcatgaacagcgctgtgtacaaggacctgctgcagagcctgtctgagaagagcattgaggcctag

SEQ ID NO: 37484 - DNA, 1167 bp, Artificial Sequence
  Description of Artificial Sequence: Synthetic coding sequence
atgccccagctgagccaggacaaccaggagtgcctgcagaagcacttcagccggcccagcatctggacccagttcctgcccctcttccgggcccagcgctacaacacagacatccaccagatcacagaaaatgaaggagacctgcgggctgtgcctgacatcaagagcttccccccagcccagctgcctgacagccctgctgcccccaagctgtttggcctgctgagcagccccctgagcagcctggcccgcttcttcagccacctgctgcggcggcccccacctgaggccccccggcggcggctggacttcagccccctgctgcctgccctgcctgctgcccggctgagccggggccacgaggagctgcccggccgcctgagcctgctgctgggcgccgccctggccctgcccggccggcccagcggcggccggcccctgcggcccccccaccctgtggccaagccccgggaggaggatgccacagctggccagagcagccccatgccccagatgggcagcgagaggatggagatgaggaagaggcagatgcctgctgcccaggacaccccaggagctgcccctggccagcccggggccggcagccggggcagcaatgcctgctgcttctgctggtgctgctgctgcagctgcagctgcctgactgtgaggaaccaggaggaccagaggcccaccatcgccagccatgagctgcgggctgacctgcccacctgggaggagagccctgcccccaccctggaggaggtgaatgcctgggcccagagctttgacaagctgatggtgaccccagctggaagaaatgccttccgggagttcctgaggacagagttcagcgaggagaacatgctgttctggatggcctgtgaggagctgaagaaggaggccaacaagaacatcatcgaggagaaggcccgcatcatctatgaggactacatcagcatcctgagccccaaggaggtgtccctggacagccgggtgcgggaggtgatcaacagaaacatggtggagcccagccagcacatctttgatgatgcccagctgcagatctacaccctgatgcaccgggacagctacccccgcttcatgaacagcgctgtgtacaaggacctgctgcagagcctgtctgagaagagcattgaggcctag

SEQ ID NO: 37485 - DNA, 3795 bp, Artificial Sequence
  Description of Artificial Sequence: Synthetic coding sequence
atgcctgagaagaggctgacagctgagccccccaccatcacagaggaggagtttgaggacagcctggccacagatgacttcctggtggactacttcaatgagttcctgagcctgcccaccttcagcgaggccatccgcttcaatgctgactatggagtgtttgaggtggccaatgatgccccccagttcctggagaagcagctgaagaagatcctgcagaaccagcagcccaggaaccccatctatgatgtggtgaggaagggcaagaatgaggtgaagcctgtgcagatgaatgccccagatgaagatgagaccatcaacgtgaactacaacatcatgtgcctgagccgggaggagggcatcaagtggatcaagaaggagcggctgcctgccttcctggagagtgactgctactttgagtaccgcctggccaagctggtgtcccaggtgcgctggagcaagagcggcatgaacttcaccgtgggcagcaacttcagcccctggatcgtgaagaagccacccagcctgcccccaccagccacagaggaggacaacctggtgatcatgaagaagttctacgtgtccctgggggaggccagctacacccagaccaaggactggtttgccctggccaagcagagccagcagacagtgtccaccttcagcctgccctgctgcgtgccctacaacaagctgaagagccctgccatcagctctgtgtctgagaacttcatctttgatgatggagtgcaccccaggaccaagaaggaccccagcaagaccaacaagctgatcagcgagtttgaggaggaggagggggaggaggaggaggtgtctgtgtccctgcaggacacccccagccaggccctgctgcgggtgtacctggagaagaagcaggatgtggatgagagcctgaccatgcacttcagcacctgtgaggagttcctgagcagctacatctacttcatcctgcggggggccatccagcagatcgtgggcaagcctgtgggggagaccccagactacatcaacttcaacaacatcaccaaggtgtcctttgatgactgctttgagagcatccacggcaagaacttcctgtctgagctggtgcagaccaccaaggagaggtctgaggagattgagcagaccagcctgagcagcaagaatgaatctgctggccctgagagcagagctgactggtgcatcagccacaggacctatgacatcggcaacaggaaggagtttgagcgcttcaagaagttcatcaagggcaccctgggggagcgctactggtggctgtggatggacatcgagcggctgaaggtgctgaaggaccccggccgccaccagaggcacctggagaagatgaagaagtgctacctggtgtccaatggagactactacctgtctgctgagatcctgagcaagttcaagctgctggatggcagccagtggaatgaggagcacctgaggaacatccagagcgaggtgctgaagcccctgctgctgtactgggccccccgcttctgtgtgacccacagcgccagcaccaagtatgccagcgctgagctgaagttctggcacctgcggcaggccaagcccaggaaggacatcgaccccttcccccagatggccaccctgctgcccctgcggcccaagagctgcatcccccagatccctgagatccagaaggaggagttcagcctgagccagccccccaagagccccaacaagagccctgaggtgaagacagccacccagaagccctggaagcgggagctgctgtacccaggcagcagcaaggatgatgtgattgagaagggcagcaagtacatgtctgagagcagcaaggtgatccacctgaccagcttcacagacatcagtgaatgtctgaagccccagctggacagaagatatgcctacacagaggagccccgggtgaagacagtgtctgatgtgggcgccctgggcggcagtgacatggagaacctgctgcagagcctgtatgtggagaacagagctggcttcttcttcaccaagttctgtgagcacagcggcaacaagctgtggaagaacagcgtgtacttctggtttgacctgcaggcctaccaccagctgttctaccaggagaccctgcagcccttcaaggtgtgcaagcaggcccagtacctgtttgccacctacgtggcccccagcgccaccctggacatcggcctgcagcaggagaagaagaaggagatctacatgaagatccagcccccatttgaggacctgtttgacacagctgaggagtacatcctgctgctgctgctggagccctggaccaagatggtgaagagtgaccagatcgcctacaagaaggtggagctggtggaggagacccggcagctggacagcacctacttcaggaagctgcaggccctgcacaaggagaccttcagcaagaaggccgaggacaccacctgtgagatcggcaccggcatcctgagcctgagcaatgtgtccaagaggacagagtactgggacaacgtgcctgctgagtacaagcacttcaagttcagtgacctgctgaacaacaagctggagtttgagcacttccggcagttcctggagacccacagcagctccatggacctgatgtgctggacagacatcgagcagttccgccgcatcacctacagagacaggaaccagaggaaggccaagagcatctacatcaagaacaagtacctgaacaagaagtacttcttcggccccaacagccctgccagcctgtaccagcagaaccaggtgatgcacctgagcggcggctggggcaagatcctgcacgagcagctggatgcccctgtgctggtggagatccagaagcacgtgcagaaccggctggagaatgtgtggctgcccctcttcctggccagcgagcagtttgctgcccggcagaagatcaaggtgcagatgaaggacattgctgaggagctgctgctgcagaaggccgagaagaagattggagtgtggaagcctgtggagagcaagtggatcagcagcagctgcaagatcatcgccttcaggaaggccctgctgaaccctgtgaccagccggcagttccagagatttgtggccctgaagggggacctgctggagaatggcctgctcttctggcaggaggtgcagaagtacaaggacctgtgccacagccactgtgatgagagcgtcatccagaagaagatcaccaccatcatcaactgcttcatcaacagcagcatccccccagccctgcagattgacatccctgtggagcaggcccagaagatcatcgagcacaggaaggagctgggcccctacgtgttccgggaggcccagatgaccatcttcggcgtgctcttcaagttctggccccagttctgtgagttcaggaagaacctgacagatgagaacatcatgtctgtgctggagcggcggcaggagtacaacaagcagaagaagaagctggccgtgctggaggatgagaagagcggcaaggatggcatcaagcagtatgccaacacctctgtgcctgccatcaagacagccctgctgagtgacagcttcctgggcctgcagccctacggccggcagcccacctggtgctacagcaagtacatcgaggccctggagcaggagcgcatcctgctgaagatccaggaggagctggagaagaagctgtttgctggcctgcagcccctgaccaacttcaaggccagcagcagcaccatgagcctgaagaagaacatgtctgcccacagcagccagaagtag

SEQ ID NO: 37486 - DNA, 3756 bp, Artificial Sequence
  Description of Artificial Sequence: Synthetic coding sequence
atgcctgagaagaggctgacagctgagccccccaccatcacagaggaggagtttgaggacagcctggccacagatgacttcctggtggactacttcaatgagttcctgagcctgcccaccttcagcgaggccatccgcttcaatgctgactatggagtgtttgaggtggccaatgatgccccccagttcctggagaagcagctgaagaagatcctgcagaaccagcagcccaggaaccccatctatgatgtggtgaggaagggcaagaatgaggtgaagcctgtgcagatgaatgccccagatgaagatgagaccatcaacgtgaactacaacatcatgtgcctgagccgggaggagggcatcaagtggatcaagaaggagcggctgcctgccttcctggagagtgactgctactttgagtaccgcctggccaagctggtgtcccaggtgcgctggagcaagagcggcatgaacttcaccgtgggcagcaacttcagcccctggatcgtgaagaagccacccagcctgcccccaccagccacagaggaggacaacctggccagctacacccagaccaaggactggtttgccctggccaagcagagccagcagacagtgtccaccttcagcctgccctgctgcgtgccctacaacaagctgaagagccctgccatcagctctgtgtctgagaacttcatctttgatgatggagtgcaccccaggaccaagaaggaccccagcaagaccaacaagctgatcagcgagtttgaggaggaggagggggaggaggaggaggtgtctgtgtccctgcaggacacccccagccaggccctgctgcgggtgtacctggagaagaagcaggatgtggatgagagcctgaccatgcacttcagcacctgtgaggagttcctgagcagctacatctacttcatcctgcggggggccatccagcagatcgtgggcaagcctgtgggggagaccccagactacatcaacttcaacaacatcaccaaggtgtcctttgatgactgctttgagagcatccacggcaagaacttcctgtctgagctggtgcagaccaccaaggagaggtctgaggagattgagcagaccagcctgagcagcaagaatgaatctgctggccctgagagcagagctgactggtgcatcagccacaggacctatgacatcggcaacaggaaggagtttgagcgcttcaagaagttcatcaagggcaccctgggggagcgctactggtggctgtggatggacatcgagcggctgaaggtgctgaaggaccccggccgccaccagaggcacctggagaagatgaagaagtgctacctggtgtccaatggagactactacctgtctgctgagatcctgagcaagttcaagctgctggatggcagccagtggaatgaggagcacctgaggaacatccagagcgaggtgctgaagcccctgctgctgtactgggccccccgcttctgtgtgacccacagcgccagcaccaagtatgccagcgctgagctgaagttctggcacctgcggcaggccaagcccaggaaggacatcgaccccttcccccagatggccaccctgctgcccctgcggcccaagagctgcatcccccagatccctgagatccagaaggaggagttcagcctgagccagccccccaagagccccaacaagagccctgaggtgaagacagccacccagaagccctggaagcgggagctgctgtacccaggcagcagcaaggatgatgtgattgagaagggcagcaagtacatgtctgagagcagcaaggtgatccacctgaccagcttcacagacatcagtgaatgtctgaagccccagctggacagaagatatgcctacacagaggagccccgggtgaagacagtgtctgatgtgggcgccctgggcggcagtgacatggagaacctgctgcagagcctgtatgtggagaacagagctggcttcttcttcaccaagttctgtgagcacagcggcaacaagctgtggaagaacagcgtgtacttctggtttgacctgcaggcctaccaccagctgttctaccaggagaccctgcagcccttcaaggtgtgcaagcaggcccagtacctgtttgccacctacgtggcccccagcgccaccctggacatcggcctgcagcaggagaagaagaaggagatctacatgaagatccagcccccatttgaggacctgtttgacacagctgaggagtacatcctgctgctgctgctggagccctggaccaagatggtgaagagtgaccagatcgcctacaagaaggtggagctggtggaggagacccggcagctggacagcacctacttcaggaagctgcaggccctgcacaaggagaccttcagcaagaaggccgaggacaccacctgtgagatcggcaccggcatcctgagcctgagcaatgtgtccaagaggacagagtactgggacaacgtgcctgctgagtacaagcacttcaagttcagtgacctgctgaacaacaagctggagtttgagcacttccggcagttcctggagacccacagcagccgctggatcctgtgtgccggccagaccctgagcagcagcggggagacctacagagacaggaaccagaggaaggccaagagcatctacatcaagaacaagtacctgaacaagaagtacttcttcggccccaacagccctgccagcctgtaccagcagaaccaggtgatgcacctgagcggcggctggggcaagatcctgcacgagcagctggatgcccctgtgctggtggagatccagaagcacgtgcagaaccggctggagaatgtgtggctgcccctcttcctggccagcgagcagtttgctgcccggcagaagatcaaggtgcagatgaaggacattgctgaggagctgctgctgcagaaggccgagaagaagattggagtgtggaagcctgtggagagcaagtggatcagcagcagctgcaagatcatcgccttcaggaaggccctgctgaaccctgtgaccagccggcagttccagagatttgtggccctgaagggggacctgctggagaatggcctgctcttctggcaggaggtgcagaagtacaaggacctgtgccacagccactgtgatgaatctgtcatccagaagaagatcaccaccatcatcaactgcttcatcaacagcagcatccccccagccctgcagattgacatccctgtggagcaggcccagaagatcatcgagcacaggaaggagctgggcccctacgtgttccgggaggcccagatgaccatctttggagtgctcttcaagttctggccccagttctgtgagttcaggaagaacctgacagatgagaacatcatgtctgtgctggagcggcggcaggagtacaacaagcagaagaagaagctggccgtgctggaggatgagaagagcggcaaggatggcatcaagcagtatgccaacacctctgtgcctgccatcaagacagccctgctgagtgacagcttcctgggcctgcagccctacggccggcagcccacctggtgctacagcaagtacatcgaggccctggagcaggagcgcatcctgctgaagatccaggaggagctggagaagaagctgtttgctggcctgcagcccctgaccaacttcaaggccagcagcagcaccatgagcctgaagaagaacatgtctgcccacagcagccagaagtag

SEQ ID NO: 37487 - DNA, 597 bp, Artificial Sequence
  Description of Artificial Sequence: Synthetic coding sequence
atgtggaacaccctgaccaggagcctgagtgaccaccctgtgggcaaggacccccaggccatgaggacaggccagaggcagaacaagggcatgaggacccggctgggctgcctgagccacaagagtgacagctgcagcgacttcaccgccatcctgcctgacaagcccaacagagccctgaagaggctgagcacagaggaggccacccgctgggccgacagctttgatgtgctgctgagccacaagtatggagtggccgccttccgggccttcctgaagacagagttcagcgaggagaacctggagttctggctggcctgtgaggagttcaagaagaccaggagcacagccaagctggtgtccaaggcccaccgcatctttgaggagtttgtggatgtgcaggccccccgggaggtgaacatcgacttccagacccgggaggccaccaggaagaacctgcaggagcccagcctgacctgctttgaccaggcccagggcaaggtgcacagcctgatggagaaggacagctacccccgcttcctgcggagcaagatgtacctggacctgctgagccagagccagaggcggctgtcctag

SEQ ID NO: 37488 - DNA, 543 bp, Artificial Sequence
  Description of Artificial Sequence: Synthetic coding sequence
atggccgccctgctgatgcccaggagaaataaaggcatgaggacccggctgggctgcctgagccacaagagtgacagctgcagcgacttcaccgccatcctgcctgacaagcccaacagagccctgaagaggctgagcacagaggaggccacccgctgggccgacagctttgatgtgctgctgagccacaagtatggagtggccgccttccgggccttcctgaagacagagttcagcgaggagaacctggagttctggctggcctgtgaggagttcaagaagaccaggagcacagccaagctggtgtccaaggcccaccgcatctttgaggagtttgtggatgtgcaggccccccgggaggtgaacatcgacttccagacccgggaggccaccaggaagaacctgcaggagcccagcctgacctgctttgaccaggcccagggcaaggtgcacagcctgatggagaaggacagctacccccgcttcctgcggagcaagatgtacctggacctgctgagccagagccagaggcggctgtcctag

SEQ ID NO: 37489 - DNA, 543 bp, Artificial Sequence; identical to SEQ ID NO: 37488
  Description of Artificial Sequence: Synthetic coding sequence

SEQ ID NO: 37490 - DNA, 543 bp, Artificial Sequence; identical to SEQ ID NO: 37488
  Description of Artificial Sequence: Synthetic coding sequence

SEQ ID NO: 37491 - DNA, 174 bp, Artificial Sequence
  Description of Artificial Sequence: Synthetic coding sequence
atggccgccctgctgatgcccaggagaaataaaggcatgaggacccggctgggctgcctgagccacaagagtgacagctgcagcgacttcaccgccatcctgcctgacaagcccaacagagccctgaagaggctgagcacagaggaggccacccgctgggccgacagcttctag

SEQ ID NO: 37492 - DNA, 2274 bp, Artificial Sequence
  Description of Artificial Sequence: Synthetic coding sequence
atgaccagcggctctgtgttcttctacatcctgatctttgggaagtacttcagccatggaggcggccaggatgtgaagtgcagcctgggctacttcccctgtggcaacatcaccaagtgcctgccccagctgctgcactgcaatggagtggatgactgtggcaaccaggctgatgaggacaactgtggggacaacaacggctggagcctgcagtttgacaagtactttgccagctactacaagatgaccagccagtacccctttgaggccgagaccccagagtgcctggtgggctctgtgcctgtgcagtgcctgtgccagggcctggagctggactgtgatgagaccaacctgcgggctgtgcccagcgtgagcagcaatgtgacagccatgagcctgcagtggaacctgatcaggaagctgcccccagactgcttcaagaactaccatgacctgcagaagctgtacctgcagaacaacaagatcaccagcatcagcatctatgccttccggggcctgaacagcctgaccaagctgtacctgagccacaaccgcatcaccttcctgaagccaggagtgtttgaggacctgcaccggctggagtggctgatcatcgaggacaaccacctgagccgcatcagcccccccaccttctacggcctgaacagcctcatcctgctggtgctgatgaacaacgtgctgacccggctgcctgacaagcccctgtgccagcacatgccccggctgcactggctggacctggagggcaaccacatccacaacctgaggaacctgaccttcatcagctgcagcaacctgactgtgctggtgatgaggaagaacaagatcaaccacctgaatgaaaacacctttgcccccctgcagaagctggatgagctggacctgggcagcaacaagattgagaacctgcccccactcatcttcaaggacctgaaggagctgagccagctgaacctgagctacaaccccatccagaagatccaggccaaccagtttgactacctggtgaagctgaagagcctgagcctggagggcatcgagatcagcaacatccagcagaggatgttccggcccctgatgaacctgagccacatctacttcaagaagttccagtactgcggctacgcccctcatgtgcgcagctgcaagcccaacacagatggcatcagcagcctggagaacctgctggccagcatcatccagagggtgtttgtgtgggtggtgtctgctgtgacctgctttggaaacatctttgtgatctgcatgaggccctacatccgctctgagaacaagctgtatgccatgagcatcatcagcctgtgctgtgccgactgcctgatgggcatctacctgtttgtgattggaggctttgacctgaagttccggggggagtacaacaagcacgcccagctgtggatggagagcacccactgccagctggtgggcagcctggccatcctgagcacagaggtgtctgtgctgctgctgaccttcctgaccctggagaagtacatctgcatcgtgtaccccttccgctgtgtgcggcctggaaaatgtaggaccatcaccgtgctgatcctgatctggatcaccggcttcatcgtggccttcatccccctgagcaacaaggagttcttcaagaactactacggcaccaacggggtgtgcttccccctgcacagcgaggacacagagagcatcggggcccagatctacagcgtggccatcttcctgggcatcaacctggccgccttcatcatcatcgtgttctcctatggctccatgttctacagcgtgcaccagagcgccatcacagccacagagatccggaaccaggtgaagaaggagatgatcctggccaagcgcttcttcttcatcgtgttcacagatgccctgtgctggatccccatctttgtggtgaagttcctgagcctgctgcaggtggagatccctggcaccatcacctcctgggtggtgatcttcatcctgcccatcaacagcgccctgaaccccatcctgtacaccctgaccacccggcccttcaaggagatgatccaccgcttctggtacaactaccggcagaggaagtccatggacagcaagggccagaagacctacgcccccagcttcatctgggtggagatgtggcccctgcaggagatgcctcctgagctgatgaagccagacctcttcacctacccctgtgagatgagcctcatcagccagagcacccggctgaacagctacagctag

SEQ ID NO: 37493 - DNA, 570 bp, Artificial Sequence
  Description of Artificial Sequence: Synthetic coding sequence
atgaccagcggctctgtgttcttctacatcctgatctttgggaagtacttcagccatggaggcggccaggatgtgaagtgcagcctgggctacttcccctgtggcaacatcaccaagtgcctgccccagctgctgcactgcaatggagtggatgactgtggcaaccaggctgatgaggacaactgtggggacaacaacggctggagcctgcagtttgacaagtactttgccagctactacaagatgaccagccagtacccctttgaggccgagaccccagagtgcctggtgggctctgtgcctgtgcagtgcctgtgccagggcctggagctggactgtgatgagaccaacctgcgggctgtgcccagcgtgagcagcaatgtgacagccatgagcctgcagtggaacctgatcaggaagctgcccccagactgcttcaagaactaccatgacctgcagaagctgtacctgcagaacaacaagatcaccagcatcagcatctatgccttccggggcctgaacagcctgaccaagctgagcagagctgtgaaggatggcagcgagaagtag

SEQ ID NO: 37494 - DNA, 1884 bp, Artificial Sequence
  Description of Artificial Sequence: Synthetic coding sequence
aggaccatggtgacctgcacccagaacatgaaggccgccctgaagagcctgctgtaccacagcaggaacctgggctacctgcagaacaacaagatcaccagcatcagcatctatgccttccggggcctgaacagcctgaccaagctgtacctgagccacaaccgcatcaccttcctgaagccaggagtgtttgaggacctgcaccggctggagtggctgatcatcgaggacaaccacctgagccgcatcagcccccccaccttctacggcctgaacagcctcatcctgctggtgctgatgaacaacgtgctgacccggctgcctgacaagcccctgtgccagcacatgccccggctgcactggctggacctggagggcaaccacatccacaacctgaggaacctgaccttcatcagctgcagcaacctgactgtgctggtgatgaggaagaacaagatcaaccacctgaatgaaaacacctttgcccccctgcagaagctggatgagctggacctgggcagcaacaagattgagaacctgcccccactcatcttcaaggacctgaaggagctgagccagctgaacctgagctacaaccccatccagaagatccaggccaaccagtttgactacctggtgaagctgaagagcctgagcctggagggcatcgagatcagcaacatccagcagaggatgttccggcccctgatgaacctgagccacatctacttcaagaagttccagtactgcggctacgcccctcatgtgcgcagctgcaagcccaacacagatggcatcagcagcctggagaacctgctggccagcatcatccagagggtgtttgtgtgggtggtgtctgctgtgacctgctttggaaacatctttgtgatctgcatgaggccctacatccgctctgagaacaagctgtatgccatgagcatcatcagcctgtgctgtgccgactgcctgatgggcatctacctgtttgtgattggaggctttgacctgaagttccggggggagtacaacaagcacgcccagctgtggatggagagcacccactgccagctggtgggcagcctggccatcctgagcacagaggtgtctgtgctgctgctgaccttcctgaccctggagaagtacatctgcatcgtgtaccccttccgctgtgtgcggcctggaaaatgtaggaccatcaccgtgctgatcctgatctggatcaccggcttcatcgtggccttcatccccctgagcaacaaggagttcttcaagaactactacggcaccaacggggtgtgcttccccctgcacagcgaggacacagagagcatcggggcccagatctacagcgtggccatcttcctgggcatcaacctggccgccttcatcatcatcgtgttctcctatggctccatgttctacagcgtgcaccagagcgccatcacagccacagagatccggaaccaggtgaagaaggagatgatcctggccaagcgcttcttcttcatcgtgttcacagatgccctgtgctggatccccatctttgtggtgaagttcctgagcctgctgcaggtggagatccctggcaccatcacctcctgggtggtgatcttcatcctgcccatcaacagcgccctgaaccccatcctgtacaccctgaccacccggcccttcaaggagatgatccaccgcttctggtacaactaccggcagaggaagtccatggacagcaagggccagaagacctacgcccccagcttcatctgggtggagatgtggcccctgcaggagatgcctcctgagctgatgaagccagacctcttcacctacccctgtgagatgagcctcatcagccagagcacccggctgaacagctacagctag

SEQ ID NO: 37495 - DNA, 1959 bp, Artificial Sequence
  Description of Artificial Sequence: Synthetic coding sequence
atgaccagccagtacccctttgaagctgagaccccagaatgtctggtgggctctgtgcctgtgcagtgcctgtgccagggcctggagctggactgtgatgagaccaacctgcgggctgtgcccagcgtgagcagcaatgtgacagccatgagcctgcagtggaacctgatcaggaagctgcccccagactgcttcaagaactaccatgacctgcagaagctgtacctgcagaacaacaagatcaccagcatcagcatctatgccttccggggcctgaacagcctgaccaagctgtacctgagccacaaccgcatcaccttcctgaagccaggagtgtttgaggacctgcaccggctggagtggctgatcatcgaggacaaccacctgagccgcatcagcccccccaccttctacggcctgaacagcctcatcctgctggtgctgatgaacaacgtgctgacccggctgcctgacaagcccctgtgccagcacatgccccggctgcactggctggtgatgaggaagaacaagatcaaccacctgaatgaaaacacctttgcccccctgcagaagctggatgagctggacctgggcagcaacaagattgagaacctgcccccactcatcttcaaggacctgaaggagctgagccagctgaacctgagctacaaccccatccagaagatccaggccaaccagtttgactacctggtgaagctgaagagcctgagcctggagggcatcgagatcagcaacatccagcagaggatgttccggcccctgatgaacctgagccacatctacttcaagaagttccagtactgcggctacgccccccacgtgcgcagctgcaagcccaacacagatggcatcagcagcctggagaacctgctggccagcatcatccagagggtgtttgtgtgggtggtgtctgctgtgacctgcttcggcaacatcttcgtcatctgcatgaggccctacatccgctctgagaacaagctgtatgccatgagcatcatcagcctgtgctgtgccgactgcctgatgggcatctacctgtttgtgattggaggctttgacctgaagttccggggggagtacaacaagcacgcccagctgtggatggagagcacccactgccagctggtgggcagcctggccatcctgagcacagaggtgtctgtgctgctgctgaccttcctgaccctggagaagtacatctgcatcgtgtaccccttccgctgtgtgcggcctgggaagtgcaggaccatcaccgtgctgatcctgatctggatcaccggcttcatcgtggccttcatccccctgagcaacaaggagttcttcaagaactactacggcaccaatggagtgtgcttccccctgcacagcgaggacacagagagcattggagcccagatctacagcgtggccatcttcctgggcatcaacctggccgccttcatcatcatcgtgttctcctatggctccatgttctacagcgtgcaccagagcgccatcacagccacagagatccggaaccaggtgaagaaggagatgatcctggccaagcgcttcttcttcatcgtgttcacagatgccctgtgctggatccccatctttgtggtgaagttcctgagcctgctgcaggtggagatccctggcaccatcacctcctgggtggtgatcttcatcctgcccatcaacagcgccctgaaccccatcctgtacaccctgaccacccggcccttcaaggagatgatccaccgcttctggtacaactaccggcagaggaagtccatggacagcaagggccagaagacctacgcccccagcttcatctgggtggagatgtggcccctgcaggagatgcctcctgagctgatgaagccagacctcttcacctacccctgtgagatgagcctcatcagccagagcacccggctgaacagctacagctag

SEQ ID NO: 37496 - DNA, 474 bp, Artificial Sequence
  Description of Artificial Sequence: Synthetic coding sequence
atgaccagcggctctgtgttcttctacatcctgatctttgggaagtacttcagccatggaggcggccaggatgtgaagtgcagcctgggctacttcccctgtggcaacatcaccaagtgcctgccccagctgctgcactgcaatggagtggatgactgtggcaaccaggctgatgaggacaactgtggggacaacaacggctggagcctgcagtttgacaagtactttgccagctactacaagatgaccagccagtacccctttgaggccgagaccccagagtgcctggtgggctctgtgcctgtgcagtgcctgtgccagggcctggagctggactgtgatgagaccaacctgcgggctgtgcccagcgtgagcagcaatgtgacagccatgagcctgcagtggaacctgatcaggaagctgcccccagactgcttcaagaactaccatgacctgcagaagctgaccctgtag

SEQ ID NO: 37497 - DNA, 2265 bp, Artificial Sequence
  Description of Artificial Sequence: Synthetic coding sequence
atgattgtgttcctggtgttcaagcacctgttcagcctgcggctcatcaccatgttcttcctgctgcacttcatcgtgctgatcaacgtgaaggactttgccctgacccagggctccatgatcacccccagctgccagaagggctacttcccctgtggcaacctgaccaagtgcctgccccgggccttccactgtgatggcaaggatgactgtggaaatggagcagatgaggagaactgtggggacaccagcggctgggccaccatcttcggcaccgtgcacggcaatgccaacagcgtggccctgacccaggagtgcttcctgaagcagtacccccagtgctgtgactgcaaggagacagagctggagtgtgtgaatggagacctgaagtctgtgcccatgatcagcaacaacgtgaccctgctgagcctgaagaagaacaagatccacagcctgcctgacaaggtgttcatcaagtacaccaagctgaagaagatcttcctgcagcacaactgcatccgccacatcagcaggaaggccttcttcggcctgtgcaacctgcagatcctgtacctgaaccacaactgcatcaccaccctgcggcccggcatcttcaaggacctgcaccagctgacctggctgatcctggatgacaaccccatcacccgcatcagccagaggctcttcaccggcctgaacagcctcttcttcctgtccatggtgaacaactacctggaggccctgcccaagcagatgtgtgcccagatgccccagctgaactgggtggacctggagggcaaccgcatcaagtacctgaccaacagcaccttcctgagctgtgacagcctgactgtgctcttcctgcccaggaaccagattggatttgtgcctgagaagaccttcagcagcctgaagaacctgggggagctggacctgagcagcaacaccatcacagagctgagcccccacctgttcaaggacctgaagctgctgcagaagctgaacctgagcagcaaccccctgatgtacctgcacaagaaccagtttgagagcctgaagcagctgcagagcctggacctggagagaattgagatccccaacatcaacaccaggatgttccagcccatgaagaacctgagccacatctacttcaagaacttccgctactgcagctatgcccctcatgtgcgcatctgcatgcccctgacagatggcatcagcagctttgaggacctgctggccaacaacatcctgcgcatctttgtgtgggtgattgccttcatcacctgctttggaaacctgtttgtgattggcatgaggagcttcatcaaggccgagaacaccacccacgccatgagcatcaagatcctgtgctgtgccgactgcctgatgggcgtgtacctgttctttgtgggcatctttgacatcaagtaccggggccagtaccagaagtatgccctgctgtggatggagagcgtgcagtgccgcctgatgggcttcctggccatgctgagcacagaggtgtctgtgctgctgctgacctacctgaccctggagaagttcctggtgattgtgttccccttcagcaacatccggcctgggaagaggcagaccagcgtcatcctgatctgcatctggatggccggcttcctgattgctgtgatccccttctggaacaaggactactttggaaacttctacggcaagaatggagtgtgcttccccctgtactatgaccagacagaggacatcggcagcaagggctacagcctgggcatcttcctgggcgtgaacctgctggccttcctgatcatcgtgttctcctacatcaccatgttctgcagcatccagaagacagccctgcagaccacagaggtgaggaactgcttcggccgggaggtggccgtggccaaccgcttcttcttcatcgtgttcagtgatgccatctgctggatccctgtgtttgtggtgaagatcctgagcctcttccgggtggagatcccagacaccatgacctcctggatcgtcatcttcttcctgcctgtgaacagcgccctgaaccccatcctgtacaccctgaccaccaacttcttcaaggacaagctgaagcagctgctgcacaagcaccagaggaagagcatcttcaagatcaagaagaagagcctgagcaccagcatcgtgtggattgaggacagcagcagcctgaagctgggcgtgctgaacaagatcaccctgggggacagcatcatgaagcctgtgtcctag

SEQ ID NO: 37498 - DNA, 2193 bp, Artificial Sequence
  Description of Artificial Sequence: Synthetic coding sequence
atgattgtgttcctggtgttcaagcacctgttcagcctgcggctcatcaccatgttcttcctgctgcacttcatcgtgctgatcaacgtgaaggactttgccctgacccagggctccatgatcacccccagctgccagaagggctacttcccctgtggcaacctgaccaagtgcctgccccgggccttccactgtgatggcaaggatgactgtggaaatggagcagatgaggagaactgtggggacaccagcggctgggccaccatcttcggcaccgtgcacggcaatgccaacagcgtggccctgacccaggagtgcttcctgaagcagtacccccagtgctgtgactgcaaggagacagagctggagtgtgtgaatggagacctgaagtctgtgcccatgatcagcaacaacgtgaccctgctgagcctgaagaagaacaagatccacagcctgcctgacaaggtgttcatcaagtacaccaagctgaagaagatcttcctgcagcacaactgcatccgccacatcagcaggaaggccttcttcggcctgtgcaacctgcagatcctgtacctgaaccacaactgcatcaccaccctgcggcccggcatcttcaaggacctgcaccagctgacctggctgatcctggatgacaaccccatcacccgcatcagccagaggctcttcaccggcctgaacagcctcttcttcctgtccatggtgaacaactacctggaggccctgcccaagcagatgtgtgcccagatgccccagctgaactgggtggacctggagggcaaccgcatcaagtacctgaccaacagcaccttcctgagctgtgacagcctgactgtgctggacctgagcagcaacaccatcacagagctgagcccccacctgttcaaggacctgaagctgctgcagaagctgaacctgagcagcaaccccctgatgtacctgcacaagaaccagtttgagagcctgaagcagctgcagagcctggacctggagagaattgagatccccaacatcaacaccaggatgttccagcccatgaagaacctgagccacatctacttcaagaacttccgctactgcagctatgcccctcatgtgcgcatctgcatgcccctgacagatggcatcagcagctttgaggacctgctggccaacaacatcctgcgcatctttgtgtgggtgattgccttcatcacctgctttggaaacctgtttgtgattggcatgaggagcttcatcaaggccgagaacaccacccacgccatgagcatcaagatcctgtgctgtgccgactgcctgatgggcgtgtacctgttctttgtgggcatctttgacatcaagtaccggggccagtaccagaagtatgccctgctgtggatggagagcgtgcagtgccgcctgatgggcttcctggccatgctgagcacagaggtgtctgtgctgctgctgacctacctgaccctggagaagttcctggtgattgtgttccccttcagcaacatccggcctgggaagaggcagaccagcgtcatcctgatctgcatctggatggccggcttcctgattgctgtgatccccttctggaacaaggactactttggaaacttctacggcaagaatggagtgtgcttccccctgtactatgaccagacagaggacatcggcagcaagggctacagcctgggcatcttcctgggcgtgaacctgctggccttcctgatcatcgtgttctcctacatcaccatgttctgcagcatccagaagacagccctgcagaccacagaggtgaggaactgcttcggccgggaggtggccgtggccaaccgcttcttcttcatcgtgttcagtgatgccatctgctggatccctgtgtttgtggtgaagatcctgagcctcttccgggtggagatcccagacaccatgacctcctggatcgtcatcttcttcctgcctgtgaacagcgccctgaaccccatcctgtacaccctgaccaccaacttcttcaaggacaagctgaagcagctgctgcacaagcaccagaggaagagcatcttcaagatcaagaagaagagcctgagcaccagcatcgtgtggattgaggacagcagcagcctgaagctgggcgtgctgaacaagatcaccctgggggacagcatcatgaagcctgtgtcctag

SEQ ID NO: 37499 - DNA, 1410 bp, Artificial Sequence
  Description of Artificial Sequence: Synthetic coding sequence
atgcagatggctgatgctgccaccatcgccaccatgaacaaggccgccggcggggacaagctggccgagctgttcagcctggtgcctgacctgctggaggccgccaacaccagcggaaatgccagcctgcagctgcctgacctgtggtgggagctgggcctggagctgcctgatggagcccctcctggccaccccccaggcagcggcggcgctgagagcgctgacacagaggcccgggtgcgcatcctgatctctgtggtgtactgggtggtgtgtgccctgggcctggccggcaacctgctggtgctgtacctgatgaagtccatgcagggctggaggaagagcagcatcaacctgtttgtgaccaacctggccctgacagacttccagtttgtgctgaccctgcccttctgggccgtggagaatgccctggacttcaagtggccctttgggaaggccatgtgcaagatcgtgtccatggtgacctccatgaacatgtatgcctctgtgttcttcctgacagccatgtctgtgacccgctaccacagcgtggccagcgccctgaagagccacaggacccggggccacggccgcggggactgctgcggccgcagcctgggggacagctgctgcttcagcgccaaggccctgtgtgtgtggatctgggccctggccgccctggccagcctgcccagcgccatcttcagcaccaccgtgaaggtgatgggagaggagctgtgcctggtgcgcttcccagacaagctgctgggccgggaccggcagttctggctgggcctgtaccacagccagaaggtgctgctgggctttgtgctgcccctgggcatcatcatcctgtgctacctgctgctggtgcgcttcatcgctgacagaagagctgctggcaccaagggcggcgctgctgtggccggcggccggcccaccggggccagcgcccggcggctgagcaaggtgaccaagtctgtgaccatcgtggtgctgtccttcttcctgtgctggctgcccaaccaggccctgaccacctggagcatcctgatcaagttcaatgctgtgcccttcagccaggagtacttcctgtgccaggtgtatgccttccctgtgtctgtgtgcctggcccacagcaacagctgcctgaaccctgtgctgtactgcctggtgagaagagagttcaggaaggccctgaagagcctgctgtggagaattgccagccccagcatcacctccatgaggcccttcaccgccaccaccaagccagagcacgaggaccagggcctgcaggccccagcccctcctcatgctgctgctgagccagacctgctgtactacccacctggggtggtggtgtacagcggcggccgctatgacctgctgcccagcagcagcgcctactag

SEQ ID NO: 37500 - DNA, 1125 bp, Artificial Sequence
  Description of Artificial Sequence: Synthetic coding sequence
atgcccaccctgaacaccagcgccagcccccccaccttcttctgggccaatgccagcggcggctctgtgctgtctgcagatgatgcccccatgcctgtgaagttcctggccctgcggctgatggtggccctggcctacggcctggtgggcgccatcggcctgctgggcaacctggccgtgctgtgggtgctgagcaactgtgcccggcgggcccctggcccccccagcgacacctttgtgttcaacctggccctggccgacctgggcctggccctgaccctgcccttctgggccgctgagagcgccctggacttccactggccctttggaggagccctgtgcaagatggtgctgacagccaccgtgctgaatgtgtatgccagcatcttcctgatcacagccctgtctgtggcccgctactgggtggtggccatggctgctggccctggcacccacctgagcctcttctgggcccgcatcgccaccctggccgtgtgggccgctgctgccctggtgacagtgcccacagctgtgtttggagtggagggggaggtgtgtggggtgcggctgtgcctgctgcgcttccccagccgctactggctgggcgcctaccagctgcagagggtggtgctggccttcatggtgcccctgggcgtcatcaccaccagctacctgctgctgctggccttcctgcagaggcggcagaggcggcggcaggacagccgggtggtggcccggtctgtgcgcatcctggtggccagcttcttcctgtgctggttccccaaccacgtggtgaccctgtggggcgtgctggtgaagtttgacctggtgccctggaacagcaccttctacaccatccagacctacgtgtttcctgtgaccacctgcctggcccacagcaacagctgcctgaaccctgtgctgtactgcctgctgcggcgggagccccggcaggccctggccggcaccttccgggacctgcggctgcggctgtggccccagggcggcggctgggtgcagcaggtggccctgaagcaggtgggccgccgctgggtggccagcaacccccgggagagccggcccagcaccctgctgaccaacctggaccggggcaccccaggatag

SEQ ID NO: 37501 - DNA, 816 bp, Artificial Sequence
  Description of Artificial Sequence: Synthetic coding sequence
atggccccccgggccctgcccggcagcgctgtgctggccgctgctgtgtttgtgggcggcgctgtgagcagccccctggtggccccagacaatggcagcagcaggaccctgcacagcaggacagagaccacccccagccccagcaatgacacaggaaatggccaccctgagtacatcgcctatgccctggtgcctgtgttcttcatcatgggcctgtttggagtgctgatctgccacctgctgaagaagaagggctaccgctgcaccacagaggccgagcaggacatcgaggaggagaaggtggagaagattgagctgaatgattctgtgaatgaaaacagcgacacagtgggccagatcgtgcactacatcatgaagaatgaggccaatgctgatgtgctgaaggccatggtggccgacaacagcctgtatgaccctgagagccctgtgacccccagcaccccaggcagcccccctgtgtccccaggccccctgagccctgggggcaccccaggcaagcacgtgtgtggccaccacctgcacacagtgggcggcgtggtggagagagatgtgtgccaccgctgccgccacaagcgctggcacttcatcaagcccaccaacaagagccgggagagccggccccggcggcagggcgaggtgacagtgctgtctgtgggccgcttccgggtgaccaaggtggagcacaagagcaaccagaaggagcggcgcagcctgatgtctgtgtctggagctgagaccgtgaatggagaggtgcctgccacccctgtgaagcgggagaggagcggcacagaatag

SEQ ID NO: 37502 - DNA, 816 bp, Artificial Sequence; identical to SEQ ID NO: 37501
  Description of Artificial Sequence: Synthetic coding sequence

SEQ ID NO: 37503 - DNA, 363 bp, Artificial Sequence
  Description of Artificial Sequence: Synthetic coding sequence
atgaatgccaccttcctgaaccacagcggcctggaggaggtggatggagtgggcggcggggccggggccgccctgggcaacagaacccacggcctgggcacctggctgggctgctgccctgggggcgcccccctggccgccagtgatggagtgcctgctggcctggccccagatgagaggagcctgtgggtgtcccgggtggcccagattgctgtgctgtgtgtgctgagcctgactgtggtgtttggagtcttcttcctgggctgcaacctgctgatcaagtctgagagcatgatcaacttcctggtgcaggagcggcggcccagcaaggatgtgggcgccgccatcctgggcctgtactag

SEQ ID NO: 37504 - DNA, 717 bp, Artificial Sequence
  Description of Artificial Sequence: Synthetic coding sequence
atgggcgtggagaacagcgccaaggagggggaccccggcaccatcttcttcttccgggagggcgctgctgtgttctggaatgtgaaggacaagaccatgaagcacgtgatgaaggtgctggagaagcatgagatccagccctatgagatcgccctggtgcactgggagaatgaggagctgaactacatcaagattgagggccagagcaagctgcacagaggagagatcaagctgaacagcgagctggacctggatgatgccatcctggagaagtttgccttcagcaatgccctgtgcctgtctgtgaagctggccatctgggaggccagcctggacaagttcatcgagagcatccagagcatccctgaggccctgaaggccggcaagaaggtgaagctgagccatgaggaggtgatgcagaagatcggggagctgtttgccctgcggcaccgcatcaacctgagcagtgacttcctgatcaccccagacttctactgggaccgggagaacctggagggcctgtatgacaagacctgccagttcctgagcatcggccggcgggtgaaggtgatgaatgagaagctgcagcactgcatggagctgacagacctgatgaggaaccacctgaatgagaagagggccctgcggctggagtggatgatcgtcatcctgatcaccatcgaggtgatgtttgagctgggccgggtcttcttctag

SEQ ID NO: 37505 - DNA, 423 bp, Artificial Sequence
  Description of Artificial Sequence: Synthetic coding sequence
atgcccttctgcaagacaggcaacctgggcagcatcctggacaagttcatcgagagcatccagagcatccctgaggccctgaaggccggcaagaaggtgaagctgagccatgaggaggtgatgcagaagatcggggagctgtttgccctgcggcaccgcatcaacctgagcagtgacttcctgatcaccccagacttctactgggaccgggagaacctggagggcctgtatgacaagacctgccagttcctgagcatcggccggcgggtgaaggtgatgaatgagaagctgcagcactgcatggagctgacagacctgatgaggaaccacctgaatgagaagagggccctgcggctggagtggatgatcgtcatcctgatcaccatcgaggtgatgtttgagctgggccgggtcttcttctag

SEQ ID NO: 37506 - DNA, 1350 bp, Artificial Sequence
  Description of Artificial Sequence: Synthetic coding sequence
atgcctgccaccctgctgcgggctgtggcccggagccaccacatcctgagcaaggcccaccagtgcagaagaattggccacctgatgctgaagcccctgaaggagtttgagaacaccacctgcagcaccctgaccatccggcagagcctggacctcttcctgcctgacaagacagccagcggcctgaacaagagccagatcctggagatgaaccagaagaagagtgacacctccatgctgagccccctgaatgctgcccgctgccaggatgagaaggcccacctgcccaccatgaagagctttggcacccacagaagagtgacccacaagcccaacctgctgggcagcaagtggttcatcaagatcctgaagaggcacttcagctctgtgtccacagagacctttgtgcccaagcaggacttcccccaggtgaagaggcccctgaaggccagcaggacccggcagcccagcaggaccaacctgcctgtgctgtctgtgaatgaagacctgatgcactgcacagcctttgccacagcagatgagtaccacctgggcaacctgagccaggacctggccagccacggctacgtggaggtgaccagcctgcccagagatgctgccaacatcctggtgatgggcgtggagaacagcgccaaggagggggaccccggcaccatcttcttcttccgggagggcgctgctgtgttctggaatgtgaaggacaagaccatgaagcacgtgatgaaggtgctggagaagcatgagatccagccctatgaaattgccctggtgcactgggagaatgaggagctgaactacatcaagattgagggccagagcaagctgcacagaggagagatcaagctgaacagcgagctggacctggatgatgccatcctggagaagtttgccttcagcaatgccctgtgcctgtctgtgaagctggccatctgggaggccagcctggacaagttcatcgagagcatccagagcatccctgaggccctgaaggccggcaagaaggtgaagctgagccatgaggaggtgatgcagaagattggagagctgtttgccctgcggcaccgcatcaacctgagcagtgacttcctgatcaccccagacttctactgggaccgggagaacctggagggcctgtatgacaagacctgccagttcctgagcattggaagaagagtgaaggtgatgaatgagaagctgcagcactgcatggagctgacagacctgatgaggaaccacctgaatgagaagagggccctgcggctggagtggatgatcgtcatcctgatcaccatcgaggtgatgtttgagctgggccgggtcttcttctag

SEQ ID NO: 37507 - DNA, 636 bp, Artificial Sequence
  Description of Artificial Sequence: Synthetic coding sequence
atgcactgcacagcctttgccacagcagatgagtaccacctgggcaacctgagccaggacctggccagccacggctacgtggaggtgaccagcctgcccagagatgctgccaacatcctggtgatgggcgtggagaacagcgccaaggagggggaccccggcaccatcttcttcttccgggagggcgctgctgtgttctggaatgtgaaggacaagaccatgaagcacgtgatgaaggtgctggagaagcatgagatccagccctatgaaattgccctggtgcactgggagaatgaggagctgaactacatcaagattgagggccagagcaagctgcacagaggagagatcaagctgaacagcgagctggacctggatgatgccatcctggagaagtttgccttcagcaatgccctgtgcctgtctgtgaagctggccatctgggaggccagcctggacaagttcatcgagagcatccagagcatccctgaggccctgaaggccggcaagaaggtgaagctgagccatgaggaggtgatgcagaagattggagagctgtttgccctgcggcaccgcatcaacctgagcagtgacttcctgatcaccccagacttctactgggaccgggagaactag

SEQ ID NO: 37508 - DNA, 591 bp, Artificial Sequence
  Description of Artificial Sequence: Synthetic coding sequence
atgtctgagggggacagcgtgggggagagcgtgcacggcaagcccagcgtggtgtaccgcttcttcacccggctgggccagatctaccagagctggctggacaagagcaccccctacacagctgtgcgctgggtggtgaccctgggcctgagctttgtgtacatgatccgggtgtacctgctgcagggctggtacatcgtgacctacgccctgggcatctaccacctgaacctcttcatcgccttcctgagccccaaggtggaccccagcctgatggaggacagtgatgatggccccagcctgcccaccaagcagaatgaggagttccggcccttcatccggcggctgcctgagttcaagttctggcacgccgccaccaagggcatcctggtggccatggtgtgcaccttctttgatgccttcaacgtgcctgtgttctggcccatcctggtgatgtacttcatcatgctgttctgcatcaccatgaagaggcagatcaagcacatgatcaagtaccgctacatccccttcacccacggcaagaggcgctaccggggcaaggaggatgctgggaaggcctttgccagctag

SEQ ID NO: 37509 - DNA, 564 bp, Artificial Sequence
  Description of Artificial Sequence: Synthetic coding sequence
atgtctgagggggacagcgtgggggagagcgtgcacggcaagcccagcgtggtgtaccgcttcttcacccggctgggccagatctaccagagctggctggacaagagcaccccctacacagctgtgcgctgggtggtgaccctgggcctgagctttgtgtacatgatccgggtgtacctgctgcagggctggtacatcgtgacctacgccctgggcatctaccacctgaacctcttcatcgccttcctgagccccaaggtggaccccagcctgatggaggacagtgatgatggccccagcctgcccaccaagcagaatgaggagttccggcccttcatccggcggctgcctgagttcaagttctgggatgcctctgtgtgtggagatggccgctgcagctgcaaggccggcggcggccggcaggtgcctggagctggctgccgctgtggggccaacctgctgagccccctggagggcatgaggctgccccgggccagcctgtggctgtggagcgtgctgagcagcaccctgagcaccagccgctgcagcggccgcttctggtag

SEQ ID NO: 37510 - DNA, 354 bp, Artificial Sequence
  Description of Artificial Sequence: Synthetic coding sequence
atgtctgagggggacagcgtgggggagagcgtgcacggcaagcccagcgtggtgtaccgcttcttcacccggctgggccagatctaccagagctggctggacaagagcaccccctacacagctgtgcgctgggtggtgaccctgggcctgagctttgtgtacatgatccgggtgtacctgctgcagatgacagtgctgcgctacccacccaacagaaccaggaacagcgcccccagctttgagggcagccagagcctgaactttggcatgaggctgccccgggccagcctgtggctgtggagcgtgctgagcagcaccctgagcaccagccgctgcagcggccgcttctggtag

SEQ ID NO: 37511 - DNA, 354 bp, Artificial Sequence; identical to SEQ ID NO: 37510
  Description of Artificial Sequence: Synthetic coding sequence

SEQ ID NO: 37512 - DNA, 645 bp, Artificial Sequence
  Description of Artificial Sequence: Synthetic coding sequence
atgtctgagggggacagcgtgggggagagcgtgcacggcaagcccagcgtggtgtaccgcttcttcacccggctgggccagatctaccagagctggctggacaagagcaccccctacacagctgtgcgctgggtggtgaccctgggcctgagctttgtgtacatgatccgggtgtacctgctgcagggctggtacatcgtgacctacgccctgggcatctaccacctgaacctcttcatcgccttcctgagccccaaggtggaccccagcctgatggaggacagtgatgatggccccagcctgcccaccaagcagaatgaggagttccggcccttcatccggcggctgcctgagttcaagttctggcacgccgccaccaagggcatcctggtggccatggtgtgcaccttctttgatgccttcaacgtgcctgtgttctggcccatcctggtgatgtacttcatcatgctgttctgcatcaccatgaagaggcagatcaagcacatgatcaagtaccgctacatccccttcacccacggcaagaggcgctaccggggcaaggaggatgctgggaagcccagccctgcccggagcggcacagaggccgccagccgggtggccaggacagtgctgagccactgctag

SEQ ID NO: 37513 - DNA, 477 bp, Artificial Sequence
  Description of Artificial Sequence: Synthetic coding sequence
atgtctgagggggacagcgtgggggagagcgtgcacggcaagcccagcgtggtgtaccgcttcttcacccggctgggccagatctaccagagctggctggacaagagcaccccctacacagctgtgcgctgggtggtgaccctgggcctgagctttgtgtacatgatccgggtgtacctgctgcagggctggtacatcgtgacctacgccctgggcatctaccacctgaacctcttcatcgccttcctgagccccaaggtggaccccagcctgatggaggacagtgatgatggccccagcctgcccaccaagcagaatgaggagttccggcccttcatccggcggctgcctgagttcaagttctggcacgccgccaccaagggcatcctggtggccatggtgtgcaccttctttgatgccttcaacgtgcctgtgttctggcccatcctggtgatgtacttcatcatgctgttctag

SEQ ID NO: 37514 - DNA, 1110 bp, Artificial Sequence
  Description of Artificial Sequence: Synthetic coding sequence
atggcctacagcacagtgcagagggtggccctggccagcggcctggtgctggccctgagcctgctgctgcccaaggccttcctgagccggggcaagaggcaggagcccccacccaccccagagggcaagctgggccgcttcccccccatgatgcaccaccaccaggcccccagtgatggccagacccctggggcccgcttccagaggagccacctggccgaggcctttgccaaggccaagggcagcggcggcggggccggcggcggcggcagcggccggggcctgatgggccagatcatccccatctacggcttcggcatcttcctgtacatcctgtacatcctcttcaagctgagcaagggcaagaccacagcagaagatggcaagtgctacacagccatgcctggcaacacccacaggaagatcaccagctttgagctggcccagctgcaggagaagctgaaggagacagaagctgccatggagaagctgatcaacagagtgggccccaatggagagagccgggcccagacagtgaccagtgaccaggagaagaggctgctgcaccagctgcgggagatcaccagggtgatgaaggagggcaagttcatcgaccgcttcagccctgagaaggaggccgaggaggccccctacatggaggactgggagggctacccagaggagacctaccccatctatgacctgagtgactgcatcaagaggcggcaggagaccatcctggtggactacccagaccccaaggagctgtctgctgaggagattgctgagaggatgggcatgattgaggaggaggagagtgaccacctgggctgggagagcctgcccacagacccccgggcccaggaggacaacagcgtgaccagctgtgaccccaagccagagacctgcagctgctgcttccatgaagatgaagatcctgctgtgctggccgagaatgccggcttctctgctgacagctacccagagcaggaggagaccaccaaggaggagtggagccaggacttcaaggatgagggcctgggcatcagcacagacaaggcctacacaggctccatgctgaggaagaggaacccccagggcctggagtag

SEQ ID NO: 37515 - DNA, 564 bp, Artificial Sequence
  Description of Artificial Sequence: Synthetic coding sequence
atggcctacagcacagtgcagagggtggccctggccagcggcctggtgctggccctgagcctgctgctgcccaaggccttcctgagccggggcaagaggcaggagcccccacccaccccagagggctacccagaggagacctaccccatctatgacctgagtgactgcatcaagaggcggcaggagaccatcctggtggactacccagaccccaaggagctgtctgctgaggagattgctgagaggatgggcatgattgaggaggaggagagtgaccacctgggctgggagagcctgcccacagacccccgggcccaggaggacaacagcgtgaccagctgtgaccccaagccagagacctgcagctgctgcttccatgaagatgaagatcctgctgtgctggccgagaatgccggcttctctgctgacagctacccagagcaggaggagaccaccaaggaggagtggagccaggacttcaaggatgagggcctgggcatcagcacagacaaggcctacacaggctccatgctgaggaagaggaacccccagggcctggagtag

SEQ ID NO: 37516 - DNA, 1107 bp, Artificial Sequence
  Description of Artificial Sequence: Synthetic coding sequence
atggcctacagcacagtgcagagggtggccctggccagcggcctggtgctggccctgagcctgctgctgcccaaggccttcctgagccggggcaagaggcaggagcccccacccaccccagagggcaagctgggccgcttcccccccatgatgcaccaccaccaggcccccagtgatggccagacccctggggcccgcttccagaggagccacctggccgaggcctttgccaaggccaagggcagcggcggcggggccggcggcggcggcagcggccggggcctgatgggccagatcatccccatctacggcttcggcatcttcctgtacatcctgtacatcctcttcaagctgagcaagggcaagaccacagcagaagatggcaagtgctacacagccatgcctggcaacacccacaggaagatcaccagctttgagctggcccagctgcaggagaagctgaaggagacagaagctgccatggagaagctgatcaacagagtgggccccaatggagagcgggcccagacagtgaccagtgaccaggagaagaggctgctgcaccagctgcgggagatcaccagggtgatgaaggagggcaagttcatcgaccgcttcagccctgagaaggaggccgaggaggccccctacatggaggactgggagggctacccagaggagacctaccccatctatgacctgagtgactgcatcaagaggcggcaggagaccatcctggtggactacccagaccccaaggagctgtctgctgaggagattgctgagaggatgggcatgattgaggaggaggagagtgaccacctgggctgggagagcctgcccacagacccccgggcccaggaggacaacagcgtgaccagctgtgaccccaagccagagacctgcagctgctgcttccatgaagatgaggaccctgctgtgctggctgaaaatgccggcttctctgctgacagctacccagagcaggaggagaccaccaaggaggagtggagccaggacttcaaggatgagggcctgggcatcagcacagacaaggcctacacaggctccatgctgaggaagaggaacccccagggcctggagtag

SEQ ID NO: 37517 - DNA, 624 bp, Artificial Sequence
  Description of Artificial Sequence: Synthetic coding sequence
atgtgccgcctgaagaggcaggagtttgtgatcagccgggcccagacagtgaccagtgaccaggagaagaggctgctgcaccagctgcgggagatcaccagggtgatgaaggagggcaagttcatcgaccgcttcagccctgagaaggaggccgaggaggccccctacatggaggactgggagggctacccagaggagacctaccccatctatgacctgagtgactgcatcaagaggcggcaggagaccatcctggtggactacccagaccccaaggagctgtctgctgaggagattgctgagaggatgggcatgattgaggaggaggagagtgaccacctgggctgggagagcctgcccacagacccccgggcccaggaggacaacagcgtgaccagctgtgaccccaagccagagacctgcagctgctgcttccatgaagatgaagatcctgctgtgctggccgagaatgccggcttctctgctgacagctacccagagcaggaggagaccaccaaggaggagtggagccaggacttcaaggatgagggcctgggcatcagcacagacaaggcctacacaggctccatgctgaggaagaggaacccccagggcctggagtag

SEQ ID NO: 37518 - DNA, 387 bp, Artificial Sequence
  Description of Artificial Sequence: Synthetic coding sequence
atggcctacagcacagtgcagagggtggccctggccagcggcctggtgctggccctgagcctgctgctgcccaaggccttcctgagccggggcaagaggcaggagcccccacccaccccagagggcaagctgggccgcttcccccccatgatgcaccaccaccaggcccccagtgatggccagacccctggggcccgcttccagaggagccacctggccgaggcctttgccaaggccaagggcagcggcggcggggccggcggcggcggcagcggccggggcctgatgggccagatcatccccatctacggcttcggcatcttcctgtacatcctgtacatcctcttcaaggtgagccgcatcatcctgatcatcctgcaccagtag

SEQ ID NO: 37519 - DNA, 963 bp, Artificial Sequence
  Description of Artificial Sequence: Synthetic coding sequence
atgatgcaccaccaccaggcccccagtgatggccagacccctggggcccgcttccagaggagccacctggccgaggcctttgccaaggccaagggcagcggcggcggggccggcggcggcggcagcggccggggcctgatgggccagatcatccccatctacggcttcggcatcttcctgtacatcctgtacatcctcttcaagctgagcaagggcaagaccacagcagaagatggcaagtgctacacagccatgcctggcaacacccacaggaagatcaccagctttgagctggcccagctgcaggagaagctgaaggagacagaggccgccatggagaagctgatcaacagagtgggccccaacggggagagccgggcccagacagtgaccagtgaccaggagaagaggctgctgcaccagctgcgggagatcaccagggtgatgaaggagggcaagttcatcgaccgcttcagccctgagaaggaggccgaggaggccccctacatggaggactgggagggctacccagaggagacctaccccatctatgacctgagtgactgcatcaagaggcggcaggagaccatcctggtggactacccagaccccaaggagctgtctgctgaggagattgctgagaggatgggcatgattgaggaggaggagagtgaccacctgggctgggagagcctgcccacagacccccgggcccaggaggacaacagcgtgaccagctgtgaccccaagccagagacctgcagctgctgcttccatgaagatgaggaccctgctgtgctggctgaaaatgccggcttctctgctgacagctacccagagcaggaggagaccaccaaggaggagtggagccaggacttcaaggatgagggcctgggcatcagcacagacaaggcctacacaggctccatgctgaggaagaggaacccccagggcctggagtag

SEQ ID NO: 37520 - DNA, 990 bp, Artificial Sequence
  Description of Artificial Sequence: Synthetic coding sequence
atggcctacagcacagtgcagagggtggccctggccagcggcctggtgctggccctgagcctgctgctgcccaaggccttcctgagccggggcaagaggcaggagcccccacccaccccagagggcaagctgggccgcttcccccccatgatgcaccaccaccaggcccccagtgatggccagacccctggggcccgcttccagaggagccacctggccgaggcctttgccaaggccaagggcagcggcggcggggccggcggcggcggcagcggccggggcctgatgggccagatcatccccatctacggcttcggcatcttcctgtacatcctgtacatcctcttcaagctgagcaagggcaagaccacagcagaagatggcaagtgctacacagccatgcctggcaacacccacaggaagatcaccagctttgagctggcccagctgcaggagaagctgaaggagacagaagctgccatggagaagctgatcaacagagtgggccccaatggagagagcacccagacagaccacagtgatgtgtatgtgcactgcctgggcgtcttcaccaccaagtggctggactgcctgatcttcctgagccgggcccagacagtgaccagtgaccaggagaagaggctgctgcaccagctgcgggagatcaccagggtgatgaaggagggcaagttcatcgaccgcttcagccctgagaaggaggccgaggaggccccctacatggaggactgggagggctacccagaggagacctaccccatctatgacctgagtgactgcatcaagaggcggcaggagaccatcctggtggactacccagaccccaaggagctgtctgctgaggagattgctgagaggatgggcatgattgaggaggaggagagtgaccacctgggctgggagagcctgcccacagacccccgggcccaggaggacaacagcgtgaccagctgtgaccccaagcctgtgtag

SEQ ID NO: 37521 - DNA, 867 bp, Artificial Sequence
  Description of Artificial Sequence: Synthetic coding sequence
atggcctacagcacagtgcagagggtggccctggccagcggcctggtgctggccctgagcctgctgctgcccaaggccttcctgagccggggcaagaggcaggagcccccacccaccccagagggcaagctgggccgcttcccccccatgatgcaccaccaccaggcccccagtgatggccagacccctggggcccgcttccagaggagccacctggccgaggcctttgccaaggccaagggcagcggcggcggggccggcggcggcggcagcggccggggcctgatgggccagatcatccccatctacggcttcggcatcttcctgtacatcctgtacatcctcttcaagctgagcaagggcaagaccacagcagaagatggcaagtgctacacagccatgcctggcaacacccacaggaagatctcctacccagaggagacctaccccatctatgacctgagtgactgcatcaagaggcggcaggagaccatcctggtggactacccagaccccaaggagctgtctgctgaggagattgctgagaggatgggcatgattgaggaggaggagagtgaccacctgggctgggagagcctgcccacagacccccgggcccaggaggacaacagcgtgaccagctgtgaccccaagccagagacctgcagctgctgcttccatgaagatgaggaccctgctgtgctggctgaaaatgccggcttctctgctgacagctacccagagcaggaggagaccaccaaggaggagtggagccaggacttcaaggatgagggcctgggcatcagcacagacaaggcctacacaggctccatgctgaggaagaggaacccccagggcctggagtag

SEQ ID NO: 37522 - DNA, 1614 bp, Artificial Sequence
  Description of Artificial Sequence: Synthetic coding sequence
atggagcccagggctgtggccgaggccgtggagaccggggaggaggatgtgatcatggaggccctgcggagctacaaccaggagcacagccagagcttcacctttgatgatgcccagcaggaggacaggaagaggctggccgagctgctggtgtctgtgctggagcagggcctgccccccagccacagggtcatctggctgcagagcgtgcgcatcctgagccgggacaggaactgcctggaccccttcaccagccggcagagcctgcaggccctggcctgctacgccgacatctctgtgtctgagggctctgtgcctgagagcgctgacatggatgtggtgctggagagcctgaagtgcctgtgcaacctggtgctgagcagccctgtggcccagatgctggccgctgaggcccggctggtggtgaagctgacagagcgggtgggcctgtaccgggagaggagcttcccccatgatgtgcagttctttgacctgcggctgctcttcctgctgacagccctgaggacagatgtgcggcagcagctgttccaggagctgaagggcgtgcggctgctgacagacaccctggagctgaccctgggcgtgaccccagagggcaaccccccacccaccctgctgcccagccaggagacagagcgggccatggagatcctgaaggtgctcttcaacatcaccctggacagcatcaagggggaggtggatgaagaagatgctgccctgtaccgccacctgggcaccctgctgcggcactgtgtgatgattgccacagctggggacagaacagaggagttccacggccatgctgtgaacctgctgggcaacctgcccctgaagtgcctggatgtgctgctgaccctggagccccacggggacagcacagagttcatgggcgtgaacatggatgtgatccgggccctgctgatcttcctggagaagaggctgcacaagacccaccggctgaaggagagcgtggcccctgtgctgtctgtgctgacagaatgtgccaggatgcacaggcctgccaggaagttcctgaaggcccagggctggcccccaccccaggtgctgccccccctgagagatgtgaggaccaggcctgaggtgggggagatgctgaggaacaagctggtgcggctgatgacccacctggacacagatgtgaagagggtggccgctgagttcctgtttgtgctgtgcagcgagagcgtgccccgcttcatcaagtacacaggctatggaaatgctgctggcctgctggccgcccggggcctgatggccggcggccggcctgagggccagtacagtgaagatgaggacacagacacagatgagtacaaggaggccaaggccagcatcaaccctgtgacaggccgggtggaggagaagccacccaaccccatggagggcatgacagaggagcagaaggagcacgaggccatgaagctggtgaccatgtttgacaagctgagcaggaacagagtcatccagcccatgggcatgagcccccggggccacctgaccagcctgcaggatgccatgtgtgagaccatggagcagcagctgagcagtgaccctgacagcgaccctgactag

SEQ ID NO: 37523 - DNA, 1596 bp, Artificial Sequence
  Description of Artificial Sequence: Synthetic coding sequence
atggagcccagggctgtggccgaggccgtggagaccggggaggaggatgtgatcatggaggccctgcggagctacaaccaggagcacagccagagcttcacctttgatgatgcccagcaggaggacaggaagaggctggccgagctgctggtgtctgtgctggagcagggcctgccccccagccacagggtcatctggctgcagagcgtgcgcatcctgagccgggacaggaactgcctggaccccttcaccagccggcagagcctgcaggccctggcctgctacgccgacatctctgtgtctgagggctctgtgcctgagagcgctgacatggatgtggtgctggagagcctgaagtgcctgtgcaacctggtgctgagcagccctgtggcccagatgctggccgctgaggcccggctggtggtgaagctgacagagcgggtgggcctgtaccgggagaggagcttcccccatgatgtgcagttctttgacctgcggctgctcttcctgctgacagccctgaggacagatgtgcggcagcagctgttccaggagctgaagggcgtgcggctgctgacagacaccctggagctgaccctgggcgtgaccccagagggcaaccccccacccaccctgctgcccagccaggagacagagcgggccatggagatcctgaaggtgctcttcaacatcaccctggacagcatcaagggggaggtggatgaagaagatgctgccctgtaccgccacctgggcaccctgctgcggcactgtgtgatgattgccacagctggggacagaacagaggagttccacggccatgctgtgaacctgctgggcaacctgcccctgaagtgcctggatgtgctgctgaccctggagccccacggggacagcacagagttcatgggcgtgaacatggatgtgatccgggccctgctgatcttcctggagaagaggctgcacaagacccaccggctgaaggagagcgtggcccctgtgctgtctgtgctgacagaatgtgccaggatgcacaggcctgccaggaagttcctgaaggcccaggtgctgccccccctgagagatgtgaggaccaggcctgaggtgggggagatgctgaggaacaagctggtgcggctgatgacccacctggacacagatgtgaagagggtggccgctgagttcctgtttgtgctgtgcagcgagagcgtgccccgcttcatcaagtacacaggctatggaaatgctgctggcctgctggccgcccggggcctgatggccggcggccggcctgagggccagtacagtgaagatgaggacacagacacagatgagtacaaggaggccaaggccagcatcaaccctgtgacaggccgggtggaggagaagccacccaaccccatggagggcatgacagaggagcagaaggagcacgaggccatgaagctggtgaccatgtttgacaagctgagcaggaacagagtcatccagcccatgggcatgagcccccggggccacctgaccagcctgcaggatgccatgtgtgagaccatggagcagcagctgagcagtgaccctgacagcgaccctgactag

SEQ ID NO: 37524 - DNA, 1491 bp, Artificial Sequence
  Description of Artificial Sequence: Synthetic coding sequence
atgctggccagcaagctgtgtgagggcatcttcaaggtgctgatcaaggacatccccaccacctgccaggtgtcctgcctggaggtgctgcgcatcctgagccgggacaagaaggtgctggtgcctgtgaccaccaaggagaacatgcagatcctgctgcggctggccaagctgaatgagctggatgacagcctggagaaggtgtctgagttccctgtgattgtggagagcctgaagtgcctgtgcaacatcgtgttcaacagccagatggcccagcagctgagcctggagctgaacctggccgccaagctgtgcaacctgctgaggaagtgcaaggacaggaagttcatcaatgacatcaagtgctttgacctgcggctgctcttcctgctgagcctgctgcacacagacatccgcagccagctgcgctatgagctgcagggcctgcccctgctgacccagatcctggagagcgccttcagcatcaagtggacagatgaatatgagagcgccatcgaccacaatggaccacccctgagcccccaggagacagactgtgccatcgaggccctgaaggccctcttcaacgtgacagtggacagctggaaggtgcacaaggagagtgacagccaccagttccgggtgatggctgctgtgctgcggcactgcctgctgattgtgggccccacagaggacaagacagaggagctgcacagcaatgctgtgaacctgctgagcaatgtgcctgtgtcctgcctggatgtgctgatctgccccctgacccatgaggagacagcccaggaggccaccaccctggatgagctgcccagcaacaagacagctgagaaggagaccgtgctgaagaacaacaccatggtgtacaacggcatgaacatggaggccatccacgtgctgctgaacttcatggagaagagaattgacaagggcagcagctaccgggagggcctgacccctgtgctgagcctgctgacagagtgcagccgggcccacaggaacatcaggaagttcctgaaggaccaggtgctgccccccctgagagatgtgaccaacagacctgaggtgggcagcacagtgaggaacaagctggtgcggctgatgacccacgtggacctgggcgtgaagcagattgctgctgagttcctgtttgtgctgtgcaaggagcgggtggacagcctgctgaagtacacaggctatggaaatgctgctggcctgctggccgcccggggcctgctggccggcggccgcggggacaactggtacagtgaagatgaggacacagacacagaggagtacaagaatgccaagcccaacatcaacctgatcaccggccacctggaggagcccatgcccaaccccattgatgagatgacagaggagcagaaggagtatgaggccatgaagctggtgaacatgctggacaagctgagccggcgggcagatgtgaaggacctgcaccaggacggcggctag

SEQ ID NO: 37525 - DNA, 1683 bp, Artificial Sequence
  Description of Artificial Sequence: Synthetic coding sequence
atggatgaggagcgggccctgtacatcgtgcgggccggggaggccggggccatcgagcgggtgctgcgggactacagcgacaagcaccgggccaccttcaagtttgagagcacagatgaggacaagaggaagaagctgtgtgagggcatcttcaaggtgctgatcaaggacatccccaccacctgccaggtgtcctgcctggaggtgctgcgcatcctgagccgggacaagaaggtgctggtgcctgtgaccaccaaggagaacatgcagatcctgctgcggctggccaagctgaatgagctggatgacagcctggagaaggtgtctgagttccctgtgattgtggagagcctgaagtgcctgtgcaacatcgtgttcaacagccagatggcccagcagctgagcctggagctgaacctggccgccaagctgtgcaacctgctgaggaagtgcaaggacaggaagttcatcaatgacatcaagtgctttgacctgcggctgctcttcctgctgagcctgctgcacacagacatccgcagccagctgcgctatgagctgcagggcctgcccctgctgacccagatcctggagagcgccttcagcatcaagtggacagatgaatatgagagcgccatcgaccacaatggaccacccctgagcccccaggagacagactgtgccatcgaggccctgaaggccctcttcaacgtgacagtggacagctggaaggtgcacaaggagagtgacagccaccagttccgggtgatggctgctgtgctgcggcactgcctgctgattgtgggccccacagaggacaagacagaggagctgcacagcaatgctgtgaacctgctgagcaatgtgcctgtgtcctgcctggatgtgctgatctgccccctgacccatgaggagacagcccaggaggccaccaccctggatgagctgcccagcaacaagacagctgagaaggagaccgtgctgaagaacaacaccatggtgtacaacggcatgaacatggaggccatccacgtgctgctgaacttcatggagaagagaattgacaagggcagcagctaccgggagggcctgacccctgtgctgagcctgctgacagagtgcagccgggcccacaggaacatcaggaagttcctgaaggaccaggtgctgccccccctgagagatgtgaccaacagacctgaggtgggcagcacagtgaggaacaagctggtgcggctgatgacccacgtggacctgggcgtgaagcagattgctgctgagttcctgtttgtgctgtgcaaggagcgggtggacagcctgctgaagtacacaggctatggaaatgctgctggcctgctggccgcccggggcctgctggccggcggccgcggggacaactggtacagtgaagatgaggacacagacacagaggagtacaagaatgccaagcccaacatcaacctgatcaccggccacctggaggagcccatgcccaaccccattgatgagatgacagaggagcagaaggagtatgaggccatgaagctggtgaacatgctggacaagctgagccgggaggagctgctgaagcccatgggcctgaagccagatggcaccatcacccccctggaggaggccctgaaccagtacagcgtcatcgaggagaccagcagtgacacagactag

SEQ ID NO: 37526 - DNA, 1563 bp, Artificial Sequence
  Description of Artificial Sequence: Synthetic coding sequence
atggatgaggagcgggccctgtacatcgtgcgggccggggaggccggggccatcgagcgggtgctgcgggactacagcgacaagcaccgggccaccttcaagtttgagagcacagatgaggacaagaggaagaagctgtgtgagggcatcttcaaggtgctgatcaaggacatccccaccacctgccaggtgtcctgcctggaggtgctgcgcatcctgagccgggacaagaaggtgctggtgcctgtgaccaccaaggagaacatgcagatcctgctgcggctggccaagctgaatgagctggatgacagcctggagaaggtgtctgagttccctgtgattgtggagagcctgaagtgcctgtgcaacatcgtgttcaacagccagatggcccagcagctgagcctggagctgaacctggccgccaagctgtgcaacctgctgaggaagtgcaaggacaggaagttcatcaatgacatcaagtgctttgacctgcggctgctcttcctgctgagcctgctgcacacagacatccgcagccagctgcgctatgagctgcagggcctgcccctgctgacccagatcctggagagcgccttcagcatcaagtggacagatgaatatgagagcgccatcgaccacaatggaccacccctgagcccccaggagacagactgtgccatcgaggccctgaaggccctcttcaacgtgacagtggacagctggaaggtgcacaaggagagtgacagccaccagttccgggtgatggctgctgtgctgcggcactgcctgctgattgtgggccccacagaggacaagacagaggagctgcacagcaatgctgtgaacctgctgagcaatgtgcctgtgtcctgcctggatgtgctgatctgccccctgacccatgaggagacagcccaggaggccaccaccctggatgagctgcccagcaacaagacagctgagaaggagaccgtgctgaagaacaacaccatggtgtacaacggcatgaacatggaggccatccacgtgctgctgaacttcatggagaagagaattgacaagggcagcagctaccgggagggcctgacccctgtgctgagcctgctgacagagtgcagccgggcccacaggaacatcaggaagttcctgaaggaccaggtgctgccccccctgagagatgtgaccaacagacctgaggtgggcagcacagtgaggaacaagctggtgcggctgatgacccacgtggacctgggcgtgaagcagattgctgctgagttcctgtttgtgctgtgcaaggagcgggtggacagcctgctgaagtacacaggctatggaaatgctgctggcctgctggccgcccggggcctgctggccggcggccgcggggacaactggtacagtgaagatgaggacacagacacagaggagtacaagaatgccaagcccaaggaggagctgctgaagcccatgggcctgaagccagatggcaccatcacccccctggaggaggccctgaaccagtacagcgtcatcgaggagaccagcagtgacacagactag

SEQ ID NO: 37527 - DNA, 987 bp, Artificial Sequence
  Description of Artificial Sequence: Synthetic coding sequence
atgatgtggaggcccagcgtgctgctgctgctgctgctgctgcggcacggggcccagggcaagcccagcccagatgctggcccccacggccagggccgggtgcaccaggccgcccccctgagtgatgcccctcatgatgatgcccacggcaacttccagtatgaccacgaggccttcctgggccgggaggtggccaaggagtttgaccagctgaccccagaggagagccaggcccggctgggcagaattgtggacaggatggacagagctggagatggagatggctgggtgtccctggccgagctgcgggcctggatcgcccacacccagcagaggcacatccgggacagcgtgtctgctgcctgggacacctatgacacagacagagatggccgggtgggctgggaggagctgagaaatgccacctacggccactacgcccctggagaggagttccatgatgtggaggatgctgagacctacaagaagatgctggccagagatgagcggcgcttccgggtggccgaccaggatggagacagcatggccacccgggaggagctgacagccttcctgcaccctgaggagttcccccacatgagggacatcgtgattgctgagaccctggaggacctggacaggaacaaggatggctacgtgcaggtggaggagtacatcgctgacctgtacagcgctgagcccggggaggaggagcccgcctgggtgcagacagagcggcagcagttccgggacttccgggacctgaacaaggatggccacctggatggcagcgaggtgggccactgggtgctgcccccagcccaggaccagcccctggtggaggccaaccacctgctgcatgaaagtgacacagacaaggatggccgcctgagcaaggccgagatcctgggcaactggaacatgtttgtgggcagccaggccaccaactatggagaggacctgaccaggcaccatgatgagctgtag

SEQ ID NO: 37528 - DNA, 1326 bp, Artificial Sequence
  Description of Artificial Sequence: Synthetic coding sequence
atgctgaggaagggctgctgcgtggagctgctgctgctgctggtggccgctgagctgcccctgggcggcggctgcccccgggactgtgtgtgctacccagcccccatgacagtgtcctgccaggcccacaactttgctgccatccctgagggcatccctgtggacagcgagagggtcttcctgcagaacaaccgcatcggcctgctgcagcccggccacttcagccctgccatggtgaccctgtggatctacagcaacaacatcacctacatccaccccagcacctttgagggctttgtgcacctggaggagctggacctgggggacaaccggcagctgcggaccctggcccctgagaccttccagggcctggtgaagctgcacgccctgtacctgtacaagtgtggcctgagcgccctgcctgctggggtgtttggaggcctgcacagcctgcagtacctgtacctgcaggacaaccacatcgagtacctgcaggatgacatctttgtggacctggtgaacctgagccacctgttcctgcacggcaacaagctgtggagcctgggccctggcaccttccggggcctggtgaacctggaccggctgctgctgcacgagaaccagctgcagtgggtgcaccacaaggccttccatgacctgcggcggctgaccaccctcttcctgttcaacaacagcctgtctgagctgcagggagaatgtctggcccccctgggcgccctggagttcctgcggctgaatggaaacccctgggactgtggctgccgggcccggagcctgtgggagtggctgcagcgcttccggggcagcagcagcgctgtgccctgtgtgtccccaggcctgcggcacggccaggacctgaagctgctgcgggcagaggacttcaggaactgcaccggccctgccagcccccaccagatcaagagccacaccctgaccaccacagaccgggccgccaggaaggagcaccacagcccccacggccccaccaggagcaagggccacccccacggccccaggcctggccacaggaagccaggcaagaactgcaccaaccccaggaacagaaaccagatcagcaaggccggggccggcaagcaggcccctgagctgcctgactatgccccagactaccagcacaagttctcctttgacatcatgcccacagcccggcccaagaggaaaggaaaatgtgcccggaggacccccatccgggcccccagcggcgtgcagcaggccagcagcgccagcagcctgggcgccagcctgctggcctggaccctgggcctggccgtgaccctgaggtag

SEQ ID NO: 37529 - DNA, 1263 bp, Artificial Sequence
  Description of Artificial Sequence: Synthetic coding sequence
atgctgcccggcctgcggcggctgctgcaggccccagccagcgcctgcctgctgctgatgctgctggccctgcccctggccgcccccagctgccccatgctgtgcacctgctacagcagccccccaacagtgtcctgccaggccaacaacttcagctctgtgcccctgagcctgccccccagcacccagaggctcttcctgcagaacaacctgatccgcaccctgcggcccggcaccttcggcagcaacctgctgaccctgtggctgttcagcaacaacctgagcaccatctacccaggcaccttccgccacctgcaggccctggaggagctggacctgggggacaacagacacctgcggagcctggagccagacaccttccagggcctggagcggctgcagagcctgcacctgtaccgctgccagctgagcagcctgcccggcaacatcttccggggcctggtgtccctgcagtacctgtacctgcaggagaacagcctgctgcacctgcaggatgacctgtttgctgacctggccaacctgagccacctgttcctgcacggcaaccggctgcggctgctgacagaacatgtgttccggggcctgggcagcctggaccggctgctgctgcacggcaaccggctgcagggcgtgcacagagctgccttccggggcctgagccggctgaccatcctgtacctgttcaacaacagcctggccagcctgcctggagaggccctggccgacctgcccagcctggagttcctgcggctgaatgccaacccctgggcctgtgactgccgggcccggcccctgtgggcctggttccagagggcccgggtgagcagcagtgatgtgacctgtgccaccccacctgagcggcagggccgggacctgcgggccctgcgggaggccgacttccaggcctgccccccagctgcccccacccggcccggcagccgggcccggggcaacagcagcagcaaccacctgtatggagtggccgaggccggggcccccccagctgaccccagcaccctgtacagagacctgcctgctgaggacagccggggccggcagggcggagatgcccccacagaagatgactactggggcggctatggaggagaggaccagagaggagagcagatgtgccctggggccgcctgccaggcccccccagacagccggggccctgccctgtctgctggcctgcccagccccctgctgtgcctgctgctgctggtgccccaccacctgtag

SEQ ID NO: 37530 - DNA, 1014 bp, Artificial Sequence
  Description of Artificial Sequence: Synthetic coding sequence
atgctgaggaacaacctgggcaacagcagtgacagcaagaatgaagatggcagcgtcttcagccagacagagcacaacatcgtggccacctacctgatcatggccggcatgatcagcatcatcagcaacatcatcgtgctgggcatcttcatcaagtacaaggagctgcggacccccaccaatgccatcatcatcaacctggccgtgacagacatcggcgtgagcagcatcggctaccccatgtctgctgccagtgacctgtatggctcctggaagtttggctacgccggctgccaggtgtatgccggcctgaacatcttcttcggcatggccagcatcggcctgctgactgtggtggccgtggaccgctacctgaccatctgcctgcctgatgtgggccgcaggatgaccaccaacacctacatcggcctcatcctgggcgcctggatcaatggcctcttctgggccctgatgcccatcatcggctgggccagctatgccccagaccccactggagccacctgcaccatcaactggaggaagaatgacaggagctttgtgtcctacaccatgaccgtcatcgccatcaacttcatcgtgcccctgactgtgatgttctactgctactaccacgtgaccctgagcatcaagcaccacaccaccagtgactgcacagagagcctgaacagagactggagcgaccagattgatgtgaccaagatgtctgtcatcatgatctgcatgttcctggtggcctggagcccctacagcatcgtgtgcctgtgggccagctttggagaccccaagaagatccccccacccatggccatcatcgcccccctgtttgccaagagcagcaccttctacaacccctgcatctacgtggtggccaacaagaagttccggcgggccatgctggccatgttcaagtgccagacccaccagaccatgcctgtgaccagcatcctgcccatggatgtgtcccagaaccccctggccagcggccgcatctag

SEQ ID NO: 37531 - DNA, 792 bp, Artificial Sequence
  Description of Artificial Sequence: Synthetic coding sequence
atgaggcgcatcagcctgaccagcagccctgtgcggctgctgctcttcctgctgctgctgctgattgccctggagatcatggtgggcggccacagcctgtgcttcaacttcaccatcaagagcctgagcaggcctggccagccctggtgtgaggcccaggtgttcctgaacaagaacctcttcctgcagtacaacagcgacaacaacatggtgaagcccctgggcctgctgggcaagaaggtgtatgccaccagcacctggggcgagctgacccagaccctgggggaggtgggccgggacctgaggatgctgctgtgtgacatcaagccccagatcaagaccagtgaccccagcaccctgcaggtggagatgttctgccagcgggaggccgagcgctgcaccggggcctcctggcagtttgccaccaatggagagaagagcctgctgtttgatgccatgaacatgacctggacagtcatcaaccacgaggccagcaagatcaaggagacctggaagaaggaccggggcctggagaagtacttcaggaagctgagcaagggggactgtgaccactggctgcgggagttcctgggccactgggaggccatgcctgagcccaccgtgtcccctgtgaatgccagtgacatccactggagcagcagcagcctgcctgaccgctggatcatcctgggcgccttcatcctgctggtgctgatgggcatcgtgctgatctgtgtgtggtggcagaatggagagtggcaggccggcctgtggcccctgcggaccagctag

SEQ ID NO: 37532 - DNA, 684 bp, Artificial Sequence
  Description of Artificial Sequence: Synthetic coding sequence
atgaggcgcatcagcctgaccagcagccctgtgcggctgctgctcttcctgctgctgctgctgattgccctggagatcatgtacaacagcgacaacaacatggtgaagcccctgggcctgctgggcaagaaggtgtatgccaccagcacctggggcgagctgacccagaccctgggggaggtgggccgggacctgaggatgctgctgtgtgacatcaagccccagatcaagaccagtgaccccagcaccctgcaggtggagatgttctgccagcgggaggccgagcgctgcaccggggcctcctggcagtttgccaccaatggagagaagagcctgctgtttgatgccatgaacatgacctggacagtcatcaaccacgaggccagcaagatcaaggagacctggaagaaggaccggggcctggagaagtacttcaggaagctgagcaagggggactgtgaccactggctgcgggagttcctgggccactgggaggccatgcctgagcccaccgtgtcccctgtgaatgccagtgacatccactggagcagcagcagcctgcctgaccgctggatcatcctgggcgccttcatcctgctggtgctgatgggcatcgtgctgatctgtgtgtggtggcagaatggagagtggcaggccggcctgtggcccctgcggaccagctag

SEQ ID NO: 37533 - DNA, 354 bp, Artificial Sequence
  Description of Artificial Sequence: Synthetic coding sequence
atgaggcgcatcagcctgaccagcagccctgtgcggctgctgctcttcctgctgctgctgctgattgccctggagatcatggtgggcggccacagcctgtgcttcaacttcaccatcaagagcctgagcaggcctggccagccctggtgtgaggcccaggtgttcctgaacaagaacctcttcctgcagtacaacagcgacaacaacatggtgaagcccctgggcctgctgggcaagaagatcctgcccctgtgcaagagccgctgctttgtgaatgtgaagcagaatggagccctggtgcaccctggcagcagcccccccatggagaggaaccccagcagcctgacccagtag

SEQ ID NO: 37534 - DNA, 630 bp, Artificial Sequence
  Description of Artificial Sequence: Synthetic coding sequence
atgaggcgcatcagcctgaccagcagccctgtgcggctgctgctcttcctgctgctgctgctgattgccctggagatcatggtgggcggccacagcctgtgcttcaacttcaccatcaagagcctgagcaggcctggccagccctggtgtgaggcccaggtgttcctgaacaagaacctcttcctgcagtacaacagcgacaacaacatggtgaagcccctgggcctgctgggcaagaaggtgtatgccaccagcacctggggcgagctgacccagaccctgggggaggtgggccgggacctgaggatgctgctgtgtgacatcaagccccagatcaagaccagtgaccccagcaccctgcaggtggagatgttctgccagcgggaggccgagcgctgcaccggggcctcctggcagtttgccaccaatggagagaagagcctgctgtttgatgccatgaacatgacctggacagtcatcaaccacgaggccagcaagatcaaggagacctggaagaaggaccggggcctggagaagtacttcaggaagctgagcaagggggactgtgaccactggctgcgggagttcctgggccactgggaggccatgcctgagcccactggaaattag

SEQ ID NO: 37535 - DNA, 243 bp, Artificial Sequence
  Description of Artificial Sequence: Synthetic coding sequence
atgaggcgcatcagcctgaccagcagccctgtgcggctgctgctcttcctgctgctgctgctgattgccctggagatcatggtgggcggccacagcctgtgcttcaacttcaccatcaagagcctgagcaggcctggccagccctggtgtgaggcccaggtgttcctgaacaagaacctcttcctgcagtacaacagcgacaacaacatggtgaagcccctgggcctgctgggcaagaagtag

SEQ ID NO: 37536 - DNA, 639 bp, Artificial Sequence
  Description of Artificial Sequence: Synthetic coding sequence
atgaggcgcatcagcctgaccagcagccctgtgcggctgctgctcttcctgctgctgctgctgattgccctggagatcatggtgggcggccacagcctgtgcttcaacttcaccatcaagagcctgagcaggcctggccagccctggtgtgaggcccaggtgttcctgaacaagaacctcttcctgcagtacaacagcgacaacaacatggtgaagcccctgggcctgctgggcaagaaggtgtatgccaccagcacctggggcgagctgacccagaccctgggggaggtgggccgggacctgaggatgctgctgtgtgacatcaagccccagatcaagaccagtgaccccagcaccctgcaggtggagatgttctgccagcgggaggccgagcgctgcaccggggcctcctggcagtttgccaccaatggagagaagagcctgctgtttgatgccatgaacatgacctggacagtcatcaaccacgaggccagcaagatcaaggagacctggaagaaggaccggggcctggagaagtacttcaggaagctgagcaagggggactgtgaccactggctgcgggagttcctgggccactgggaggccatgcctgagcccactggaagaagaagcacctag

SEQ ID NO: 37537 - DNA, 1005 bp, Artificial Sequence
  Description of Artificial Sequence: Synthetic coding sequence
atggctgctgctgccagccctgccttcctgctgcggctgcccctgctgctgctgctgagctcctggtgcaggacaggcctggccgacccccacagcctgtgctatgacatcaccgtcatccccaagttccggcccggcccccgctggtgtgctgtgcagggccaggtggatgagaagaccttcctgcactatgactgtggcagcaagacagtgacccctgtgagccccctgggcaagaagctgaatgtgaccacagcctggaaggcccagaaccctgtgctgcgggaggtggtggacatcctgacagagcagctgctggacatccagctggagaactacatccccaaggagcccctgaccctgcaggccaggatgagctgtgagcagaaggccgagggccacggcagcggctcctggcagctgagctttgatggccagatcttcctgctgtttgattctgagaacaggatgtggaccaccgtgcaccctggggccaggaagatgaaggagaagtgggagaatgacaaggacatgaccatgtccttccactacatctccatgggagactgcaccggctggctggaggacttcctgatgggcatggacagcaccctggagcccagcgctggggccccacccaccatgagcagcggcacagcccagccccgggccacagccaccaccctcatcctgtgctgcctgctgatcatgtgcctgctgatctgcagccgccacagcctgacccagagccacggccaccacccccagagcctgcagcccccaccccacccccccctgctgcaccccacctggctgctgcggcgggtgctgtggagcgacagctaccagatcgccaagaggcccctgagcggcggccacgtgaccagggtgaccctgcccatcattggagatgacagccacagcctgccctgccccctggccctgtacaccatcaacaacggggccgcccgctacagcgagcccctgcaggtgtccatctcctag

SEQ ID NO: 37538 - DNA, 663 bp, Artificial Sequence
  Description of Artificial Sequence: Synthetic coding sequence
atgagccgctacctgctgcccctgagcgccctgggcaccgtggccggggctgctgtgctgctgaaggactatgtgactggaggagcctgccccagcaaggccaccatccctgggaagacagtcatcgtgactggagccaacacaggcatcggcaagcagacagccctggagctggcccggcggggcggcaacatcatcctggcctgccgggacatggagaagtgtgaggccgccgccaaggacatccggggggagaccctgaaccaccacgtgaatgcccggcacctggacctggccagcctgaagagcatccgggagtttgctgccaagatcatcgaggaggaggagcgggtggacatcctgatcaacaatgccggcgtgatgcgctgcccccactggaccacagaagatggctttgagatgcagtttggagtgaaccacctgggccacttcctgctgaccaacctgctgctggacaagctgaaggccagcgcccccagccgcatcatcaacctgagcagcctggcccacgtggccggccacatcgactttgatgacctgaactggcagaccaggaagtacaacaccaaggccgcctactgccagagcaagctggccatcgtgctcttcaccaaggagctgagccggcggctgcagggctag

SEQ ID NO: 37539 - DNA, 783 bp, Artificial Sequence
  Description of Artificial Sequence: Synthetic coding sequence
atggagaagtgtgaggccgccgccaaggacatccggggggagaccctgaaccaccacgtgaatgcccggcacctggacctggccagcctgaagagcatccgggagtttgctgccaagatcatcgaggaggaggagcgggtggacatcctgatcaacaatgctggggtgatgcgctgcccccactggaccacagaagatggctttgagatgcagtttggagtgaaccacctgggccacttcctgctgaccaacctgctgctggacaagctgaaggccagcgcccccagccgcatcatcaacctgagcagcctggcccacgtggccggccacatcgactttgatgacctgaactggcagaccaggaagtacaacaccaaggccgcctactgccagagcaagctggccatcgtgctcttcaccaaggagctgagccggcggctgcagggcagcggcgtgacagtgaatgccctgcaccctggggtggccaggacagagctgggccgccacacaggcatccacggcagcaccttcagcagcaccaccctgggccccatcttctggctgctggtgaagagccctgagctggccgcccagcccagcacctacctggccgtggccgaggagctggctgatgtgtctgggaagtactttgatggcctgaagcagaaggccccagcccctgaggccgaggatgaggaggtggcccggcggctgtgggccgagagcgcccggctggtgggcctggaggcccccagcgtgcgggagcagcccctgcccaggtag

SEQ ID NO: 37540 - DNA, 996 bp, Artificial Sequence
  Description of Artificial Sequence: Synthetic coding sequence
atgagccgctacctgctgcccctgagcgccctgggcaccgtggccggggctgctgtgctgctgaaggactatgtgactggaggagcctgccccagcaaggccaccatccctgggaagacagtcatcgtgactggagccaacacaggcatcggcaagcagacagccctggagctggcccggcggggcggcaacatcatcctggcctgccgggacatggagaagtgtgaggccgccgccaaggacatccggggggagaccctgaaccaccacgtgaatgcccggcacctggacctggccagcctgaagagcatccgggagtttgctgccaagatcatcgaggaggaggagcgggtggacatcctgatcaacaatgccggcgtgatgcgctgcccccactggaccacagaagatggctttgagatgcagtttggagtgaaccacctgggccacttcctgctgaccaacctgctgctggacaagctgaaggccagcgcccccagccgcatcatcaacctgagcagcctggcccacgtggccggccacatcgactttgatgacctgaactggcagaccaggaagtacaacaccaaggccgcctactgccagagcaagctggccatcgtgctcttcaccaaggagctgagccggcggctgcagggcagcggcgtgacagtgaatgccctgcaccctggggtggccaggacagagctgggccgccacacaggcatccacggcagcaccttcagcagcaccaccctgggccccatcttctggctgctggtgaagagccctgagctggccgcccagcccagcacctacctggccgtggccgaggagctggctgatgtgtctgggaagtactttgatggcctgaagcagaaggccccagcccctgaggctgaagatgaggaggtggcccggcggctgtgggccgagagcgcccggctggtgggcctggaggcccccagcgtgcgggagcagcccctgcccaggtag

SEQ ID NO: 37541 - DNA, 1011 bp, Artificial Sequence
  Description of Artificial Sequence: Synthetic coding sequence
atggctgtggccacagctgctgctgtgctggccgccctgggcggggccctgtggctggccgccaggagatttgtgggcccccgggtgcagaggctgcggcggggcggggaccccggcctgatgcacggcaagacagtgctgatcactggagccaacagcggcctgggccgggccacagctgctgagctgctgcggctgggcgcccgggtcatcatgggctgccgggaccgggcccgggcagaggaggccgccggccagctgcggcgggagctgcggcaggccgcagaatgtggccctgagcccggggtgtctggagtgggggagctgattgtgcgggagctggacctggccagcctgcggtctgtgcgggccttctgccaggagatgctgcaggaggagccccggctggatgtgctgatcaacaatgccggcatcttccagtgcccctacatgaagacagaagatggctttgagatgcagtttggagtgaaccacctgggccacttcctgctgaccaacctgctgctgggcctgctgaagagcagcgcccccagcagaattgtggtggtgagcagcaagctgtacaagtatggagacatcaactttgatgacctgaacagcgagcagagctacaacaagagcttctgctacagccgcagcaagctggccaacatcctcttcacccgggagctggcccggcggctggagggcaccaacgtgacagtgaatgtgctgcaccctggcatcgtgaggaccaacctgggccgccacatccacatccccctgctggtgaagcccctcttcaacctggtgtcctgggccttcttcaagacccctgtggagggcgcccagaccagcatctacctggccagcagccctgaggtggagggcgtgtctggccgctactttggagactgcaaggaggaggagctgctgcccaaggccatggatgaatctgtggccaggaagctgtgggacatcagcgaggtgatggtgggcctgctgaagtag

SEQ ID NO: 37542 - DNA, 954 bp, Artificial Sequence
  Description of Artificial Sequence: Synthetic coding sequence
atgtggctgtacctggccgtgtttgtgggcctgtactacctgctgcactggtaccgggagcggcaggtgctgagccacctgcgggacaagtatgtgttcatcaccggctgtgacagcggctttgggaagctgctggcccggcagctggatgcccggggcctgcgggtgctggccgcctgcctgacagagaagggagctgagcagctgcggggccagaccagtgaccggctggagaccgtgaccctggatgtgaccaagacagaatctgtggccgctgctgcccagtgggtgaaggaatgtgtgcgggacaagggcctgtggggcctggtgaacaatgccggcatcagcctgcccacagccccaaatgagctgctgaccaagcaggactttgtgaccatcctggatgtgaacctgctgggcgtgattgatgtgaccctgagcctgctgcccctggtgagaagagcccggggccgggtggtgaatgtgtcctctgtgatgggccgggtgtccctgtttggaggcggctactgcatcagcaaatatggagtggaggccttcagtgacagcctgcggcgggagctgagctactttggagtgaaggtggccatgattgagcccggctacttcaagacagctgtgaccagcaaggagcgcttcctgaagagcttcctggagatctgggacaggagcagccctgaggtgaaggaggcctacggggagaagtttgtggccgactacaagaagtctgctgagcagatggagcagaagtgcacccaggacctgagcctggtgaccaactgcatggagcacgccctgattgcctgccaccccaggacccgctacagcgctggctgggatgccaagctgctgtacctgcccatgagctacatgcccaccttcctggtggatgccatcatgtactgggtgagccccagccctgccaaggccctgtag

SEQ ID NO: 37543 - DNA, 1446 bp, Artificial Sequence
  Description of Artificial Sequence: Synthetic coding sequence
atgtggctgcccctggtgctgctgctggccgtgctgctgctggccgtgctgtgcaaggtgtacctgggcctcttcagcggcagcagccccaaccccttctctgaagatgtgaagaggcccccagcccccctggtgacagacaaggaggccaggaagaaggtgctgaagcaggccttcagcgccaaccaggtgcctgagaagctggatgtggtggtgattggcagcggctttggaggcctggccgctgctgccatcctggccaaggccggcaagagggtgctggtgctggagcagcacaccaaggccggcggctgctgccacaccttcggcaagaatggcctggagtttgacaccggcatccactacatcggccgcatggaggagggcagcatcggccgcttcatcctggaccagatcacagagggccagctggactgggcccccctgagcagcccctttgacatcatggtgctggagggccccaacggcaggaaggagtaccccatgtacagcggggagaaggcctacatccagggcctgaaggagaagttcccccaggaggaggccatcatcgacaagtacatcaagctggtgaaggtggtgtcctctggggcccctcatgccatcctgctgaagttcctgcccctgcctgtggtgcagctgctggacagatgtggcctgctgacccgcttcagccccttcctgcaggccagcacccagagcctggccgaggtgctgcagcagctgggcgccagcagcgagctgcaggccgtgctgagctacatcttccccacctacggcgtgacccccaaccacagcgccttctccatgcacgccctgctggtgaaccactacatgaagggcggcttctacccccggggcggcagcagcgagatcgccttccacaccatccctgtgatccagagagctgggggcgctgtgctgaccaaggccaccgtgcagagcgtgctgctggacagcgctgggaaggcctgtggggtgtctgtgaagaagggccacgagctggtgaacatctactgccccatcgtggtgtccaatgccggcctcttcaacacctatgagcacctgctgcctggaaatgcccgctgcctgcccggggtgaagcagcagctgggcaccgtgcggcccggcctgggcatgacctctgtgttcatctgcctgcggggcaccaaggaggacctgcacctgcccagcaccaactactacgtgtactatgacacagacatggaccaggccatggagagatatgtgtccatgccccgggaggaggccgctgagcacatccccctgctcttctttgccttccccagcgccaaggaccccacctgggaggaccgcttccctggaggagaatgtgactgccgcatccccacccaccagcctgtgctgagcggctgcagcccccgctgcctgctgcggggctag

SEQ ID NO: 37544 - DNA, 1833 bp, Artificial Sequence
  Description of Artificial Sequence: Synthetic coding sequence
atgtggctgcccctggtgctgctgctggccgtgctgctgctggccgtgctgtgcaaggtgtacctgggcctcttcagcggcagcagccccaaccccttctctgaagatgtgaagaggcccccagcccccctggtgacagacaaggaggccaggaagaaggtgctgaagcaggccttcagcgccaaccaggtgcctgagaagctggatgtggtggtgattggcagcggctttggaggcctggccgctgctgccatcctggccaaggccggcaagagggtgctggtgctggagcagcacaccaaggccggcggctgctgccacaccttcggcaagaatggcctggagtttgacaccggcatccactacatcggccgcatggaggagggcagcatcggccgcttcatcctggaccagatcacagagggccagctggactgggcccccctgagcagcccctttgacatcatggtgctggagggccccaacggcaggaaggagtaccccatgtacagcggggagaaggcctacatccagggcctgaaggagaagttcccccaggaggaggccatcatcgacaagtacatcaagctggtgaaggtggtgtcctctggggcccctcatgccatcctgctgaagttcctgcccctgcctgtggtgcagctgctggacagatgtggcctgctgacccgcttcagccccttcctgcaggccagcacccagagcctggccgaggtgctgcagcagctgggcgccagcagcgagctgcaggccgtgctgagctacatcttccccacctacggcgtgacccccaaccacagcgccttctccatgcacgccctgctggtgaaccactacatgaagggcggcttctacccccggggcggcagcagcgagatcgccttccacaccatccctgtgatccagagagctgggggcgctgtgctgaccaaggccaccgtgcagagcgtgctgctggacagcgctgggaaggcctgtggggtgtctgtgaagaagggccacgagctggtgaacatctactgccccatcgtggtgtccaatgccggcctcttcaacacctatgagcacctgctgcctggaaatgcccgctgcctgcccggggtgaagcagcagctgggcaccgtgcggcccggcctgggcatgacctctgtgttcatctgcctgcggggcaccaaggaggacctgcacctgcccagcaccaactactacgtgtactatgacacagacatggaccaggccatggagagatatgtgtccatgccccgggaggaggccgctgagcacatccccctgctcttctttgccttccccagcgccaaggaccccacctgggaggaccgcttccctggccgcagcaccatgatcatgctgatccccacagcctatgagtggtttgaggagtggcaggccgagctgaagggcaagaggggcagtgactatgagaccttcaagaacagctttgtggaggcctccatgtctgtggtgctgaagctgttcccccagctggagggcaaggtggagagcgtgacagctggcagccccctgaccaaccagttctacctggccgcccccaggggggcctgctatggagctgaccatgacctgggccgcctgcacccctgtgtgatggccagcctgcgggcccagagccccatccccaacctgtacctgaccggccaggacatcttcacctgtggcctggtgggcgccctgcagggcgccctgctgtgcagcagcgccatcctgaagaggaacctgtacagcgacctgaagaacctggacagccgcatccgggcccagaagaagaagaactag

SEQ ID NO: 37545 - DNA, 1650 bp, Artificial Sequence
  Description of Artificial Sequence: Synthetic coding sequence
atgtggctgcccctggtgctgctgctggccgtgctgctgctggccgtgctgtgcaaggtgtacctgggcctcttcagcggcagcagccccaaccccttctctgaagatgtgaagaggcccccagcccccctggtgacagacaaggaggccaggaagaaggtgctgaagcagggcatccactacatcggccgcatggaggagggcagcatcggccgcttcatcctggaccagatcacagagggccagctggactgggcccccctgagcagcccctttgacatcatggtgctggagggccccaatggaaggaaggagtaccccatgtacagcggggagaaggcctacatccagggcctgaaggagaagttcccccaggaggaggccatcatcgacaagtacatcaagctggtgaaggtggtgagcagcggggccccccacgccatcctgctgaagttcctgcccctgcctgtggtgcagctgctggacagatgtggcctgctgacccgcttcagccccttcctgcaggccagcacccagagcctggccgaggtgctgcagcagctgggcgccagcagcgagctgcaggccgtgctgagctacatcttccccacctatggagtgacccccaaccacagcgccttctccatgcacgccctgctggtgaaccactacatgaagggcggcttctacccccggggcggcagcagcgagatcgccttccacaccatccctgtgatccagagagctggaggagctgtgctgaccaaggccaccgtgcagagcgtgctgctggacagcgctgggaaggcctgtggggtgtctgtgaagaagggccacgagctggtgaacatctactgccccatcgtggtgtccaatgccggcctcttcaacacctatgagcacctgctgcctggaaatgcccgctgcctgcccggggtgaagcagcagctgggcaccgtgcggcccggcctgggcatgaccagcgtcttcatctgcctgcggggcaccaaggaggacctgcacctgcccagcaccaactactacgtgtactatgacacagacatggaccaggccatggagcgctacgtgtccatgccccgggaggaggccgctgagcacatccccctgctcttctttgccttccccagcgccaaggaccccacctgggaggaccgcttccctggccgcagcaccatgatcatgctgatccccacagcctatgagtggtttgaggagtggcaggccgagctgaagggcaagaggggcagtgactatgagaccttcaagaacagctttgtggaggcctccatgtctgtggtgctgaagctgttcccccagctggagggcaaggtggagagcgtgacagctggcagccccctgaccaaccagttctacctggccgcccccaggggggcctgctacggggctgaccatgacctgggccgcctgcacccctgtgtgatggccagcctgcgggcccagagccccatccccaacctgtacctgaccggccaggacatcttcacctgtggcctggtgggcgccctgcagggcgccctgctgtgcagcagcgccatcctgaagaggaacctgtacagcgacctgaagaacctggacagccgcatccgggcccagaagaagaagaactag

SEQ ID NO: 37546 - DNA, 699 bp, Artificial Sequence
  Description of Artificial Sequence: Synthetic coding sequence
atgaaggagcggcgggccccccagcctgtggtggcccgctgcaagctggtgctggtgggagatgtgcagtgtgggaagacagccatgctgcaggtgctggccaaggactgctacccagagacctacgtgcccaccgtgtttgagaactacacagcctgcctggagacagaggagcagagggtggagctgagcctgtgggacaccagcggcagcccctactatgacaacgtgcggcccctgtgctacagcgacagtgatgctgtgctgctgtgctttgacatcagcaggcctgagaccgtggacagcgccctgaagaagtggaggacagagatcctggactactgccccagcaccagggtgctgctgattggctgcaagacagacctgaggacagacctgagcaccctgatggagctgagccaccagaagcaggcccccatctcctatgagcagggctgtgccatcgccaagcagctgggcgctgagatctacctggagggcagcgccttcaccagcgagaagagcatccacagcatcttcagaacagcctccatgctgtgcctgaacaagcccagccccctgccccagaagagccctgtgcgcagcctgagcaagaggctgctgcacctgcccagccgctctgagctgatcagcagcaccttcaagaaggagaaggccaagagctgcagcatcatgtag

SEQ ID NO: 37547 - DNA, 381 bp, Artificial Sequence
  Description of Artificial Sequence: Synthetic coding sequence
tggaggacagagatcctggactactgccccagcaccagggtgctgctgattggctgcaagacagacctgaggacagacctgagcaccctgatggagctgagccaccagaagcaggcccccatctcctatgagcagggctgtgccatcgccaagcagctgggcgctgagatctacctggagggcagcgccttcaccagcgagaagagcatccacagcatcttcagaacagcctccatgctgtgcctgaacaagcccagccccctgccccagaagagccctgtgcgcagcctgagcaagaggctgctgcacctgcccagccgctctgagctgatcagcagcaccttcaagaaggagaaggccaagagctgcagcatcatgtag

SEQ ID NO: 37548 - DNA, 924 bp, Artificial Sequence
  Description of Artificial Sequence: Synthetic coding sequence
atgaccaaggccggcagcaaaggaggcaacctgcgggacaagctggatggaaatgagctggacctgagcctgagtgacctgaatgaggtgcctgtgaaggagctggccgccctgcccaaggccaccatcctggacctgagctgcaacaagctgaccaccctgcccagcgacttctgtggcctgacccacctggtgaagctggacctgagcaagaacaagctgcagcagctgcctgctgactttggccgcctggtgaacctgcagcacctggacctgctgaacaacaagctggtgaccctgcctgtgtcctttgcccagctgaagaacctgaagtggctggacctgaaggacaaccccctggaccctgtgctggccaaggtggccggggactgcctggatgagaagcagtgcaagcagtgtgccaacaaggtgctgcagcacatgaaggctgtgcaggccgaccaggagcgggagcggcagaggcggctggaggtggagcgggaggccgagaagaagcgggaggccaagcagagggccaaggaggcccaggagcgggagctgaggaagcgggagaaggccgaggagaaggagaggaggaggaaggagtatgatgccctgaaggccgccaagcgggagcaggagaagaagcccaagaaggaggccaaccaggcccccaagagcaagagcggcagccggcccaggaagcccccacccaggaagcacaccaggtcctgggccgtgctgaagctgctgctgctgctgctgctgtttggagtggccggcggcctggtggcctgccgggtgacagagctgcagcagcagcccctgtgcacctctgtgaacaccatctatgacaatgctgtgcagggcctgcggagacatgagatcctgcagtgggtgctgcagacagacagccagcagtag

SEQ ID NO: 37549 - DNA, 687 bp, Artificial Sequence
  Description of Artificial Sequence: Synthetic coding sequence
atggagggccagagcggccgctgcaagatcgtggtggtgggagatgctgaatgtgggaagacagccctgctgcaggtgtttgccaaggatgcctacccaggcagctatgtgcccaccgtgtttgagaactacacagccagctttgaaattgacaagagaagaattgagctgaacatgtgggacaccagcggcagcagctactatgacaacgtgcggcccctggcctacccagacagtgatgctgtgctgatctgctttgacatcagcaggcctgagaccctggacagcgtgctgaagaagtggcagggcgagacccaggagttctgccccaatgccaaggtggtgctggtgggctgcaagctggacatgaggacagacctggccaccctgcgggagctgagcaagcagaggctcatccctgtgacccatgagcaggtgggcaccgtgctggccaagcaggtgggcgctgtgtcctatgtggagtgcagcagccgcagcagcgagaggtctgtgagagatgtgttccacgtggccaccgtggccagcctgggccggggccaccggcagctgcggaggacagacagccggcggggcatgcagaggtctgcccagctgagcggccgcccagacagaggaaatgaaggagagatccacaaggaccgggccaagagctgcaacctgatgtag

SEQ ID NO: 37550 - DNA, 684 bp, Artificial Sequence
  Description of Artificial Sequence: Synthetic coding sequence
atggagggccagagcggccgctgcaagatcgtggtggtgggagatgctgaatgtgggaagacagccctgctgcaggtgtttgccaaggatgcctacccaggcagctatgtgcccaccgtgtttgagaactacacagccagctttgaaattgacaagagaagaattgagctgaacatgtgggacaccagcggcagcagctactatgacaacgtgcggcccctggcctacccagacagtgatgctgtgctgatctgctttgacatcagcaggcctgagaccctggacagcgtgctgaagaagtggcagggcgagacccaggagttctgccccaatgccaaggtggtgctggtgggctgcaagctggacatgaggacagacctggccaccctgcgggagctgagcaagcagaggctcatccctgtgacccatgagcagggcaccgtgctggccaagcaggtgggcgctgtgtcctatgtggagtgcagcagccgcagcagcgagaggtctgtgagagatgtgttccacgtggccaccgtggccagcctgggccggggccaccggcagctgcggaggacagacagcagaagaggcatgcagaggtctgcccagctgagcggccgcccagacagaggaaatgaaggagagatccacaaggaccgggccaagagctgcaacctgatgtag

SEQ ID NO: 37551 - DNA, 6264 bp, Artificial Sequence
  Description of Artificial Sequence: Synthetic coding sequence
atggagacagaaagtgagagcagcaccctgggagatgacagcgtcttctggctggagagcgaggtgatcatccaggtgacagactgtgaggaggaggagcgggaggagaagttcaggaagatgaagagctctgtgcacagtgaagaagatgactttgtgcctgagctgcacagaaatgtgcacccccgggagaggccagactgggaggagaccctgagcgccatggcccggggagcagatgtgcctgagatccctggggacctgaccctgaagacctgtggcagcacagcctccatgaaggtgaagcacgtgaagaagctgcccttcaccaagggccacttccccaagatggctgaatgtgcccacttccactatgaaaatgtggagtttggcagcatccagctgagcctgtctgaggagcagaatgaggtgatgaagaatggctgtgagagcaaggagctggtgtacctggtgcagatcgcctgccagggcaagtcctggatcgtgaagaggagctatgaggacttccgggtgctggacaagcacctgcacctgtgcatctatgaccggcgcttcagccagctgtctgagctgcccaggagtgacaccctgaaggacagccctgagagcgtgacccagatgctgatggcctacctgagccggctgagcgccatcgccggcaacaagatcaactgtggccctgccctgacctggatggagattgacaacaagggcaaccacctgctggtgcatgaggagagcagcatcaacaccccagctgtgggcgccgcccacgtgatcaagcgctacacagcccgggccccagatgagctgaccctggaggtgggggacatcgtgtctgtgattgacatgccacccaaggtgctgagcacctggtggaggggcaagcacggcttccaggtgggcctcttccctggccactgtgtggagctgatcaaccagaaggtgccccagagcgtgaccaacagcgtgcccaagcctgtgtccaagaagcacggcaagctgatcaccttcctgcggaccttcatgaagagccggcccaccaagcagaagctgaagcagaggggcatcctgaaggagcgggtgtttggctgtgacctgggggagcacctgctgaacagcggctttgaggtgccccaggtgctgcagagctgcacagccttcatcgagagatatggaattgtggatggcatctaccgcctgtctggagtggccagcaacatccagaggctgcggcatgaatttgacagcgagcacgtgcctgacctgaccaaggagccctacgtgcaggacatccacagcgtgggcagcctgtgcaagctgtacttccgggagctgcccaaccccctgctgacctaccagctgtatgagaagttcagtgatgctgtgtctgctgccacagatgaggagcggctcatcaagatccatgatgtgatccagcagctgcccccaccccactaccgcaccctggagttcctgatgaggcacctgagcctgctggccgactactgcagcatcaccaacatgcacgccaagaacctggccatcgtgtgggcccccaacctgctgcggagcaagcagattgaaagtgcctgcttctctggaacagctgccttcatggaggtgcgcatccagagcgtggtggtggagttcatcctgaaccacgtggatgtgctcttcagcggccgcatctccatggccatgcaggagggcgccgccagcctgagccggcccaagagcctgctggtgagcagccccagcaccaagctgctgaccctggaggaggcccaggcccggacccaggcccaggtgaacagccccatcgtgacagagaacaagtacatcgaggtgggggagggccctgctgccctgcagggcaagttccacaccatcatcgagttccccctggagaggaagaggccccagaacaagatgaagaagagccctgtgggctcctggaggagcttcttcaacctgggcaagagcagctctgtgtccaagaggaagctgcagagaaatgaaagtgagcccagcgagatgaaggccatggccctgaagggcggccgggcagagggcaccctgcggagcgccaagtctgaggagagcctgaccagcctgcatgctgtggatggagacagcaagctgttccggccccggcggcccaggagcagcagtgatgccctgagcgccagcttcaacggggagatgctgggcaaccgctgcaacagctatgacaacctgccccatgacaatgaaagtgaggaggagggcggcctgctgcacatcccagccctgatgagcccccacagcgcagaagatgtggacctgagccccccagacatcggcgtggccagcctggactttgaccccatgtccttccagtgcagcccccccaaggccgagagcgagtgcctggagagcggggccagcttcctggacagccctggctacagcaaggacaagcccagcgccaacaagaaggatgctgagaccggcagcagccagtgccagaccccaggcagcacagccagcagcgagcctgtgagccccctgcaggagaagctgagccccttcttcaccctggacctgagccccacagaggacaagagcagcaagcccagcagcttcacagagaaggtggtgtatgccttcagccccaagattggaaggaagctgagcaagagccccagcatgagcatcagcgagcccatctctgtgaccctgcccccccgggtgtctgaggtgattggaacagtgagcaacaccacagcccagaatgccagcagcagcacctgggacaagtgtgtggaggagagagatgccaccaacagaagccccacccagatcgtgaagatgaagaccaatgagaccgtggcccaggaggcctatgagagcgaggtgcagcccctggaccaggtggccgctgaggaggtggagctgcccgggaaggaggaccagagcgtgagcagcagccagagcaaggctgtggccagcggccagacccagacaggagctgtgacccatgaccccccccaggacagcgtgcctgtgtcctctgtgtccctcatccccccacctcctccacccaagaatgtggccaggatgctggccctggccctggccgagagcgcccagcaggccagcacccagagcctgaagaggcctggcaccagccaggccggctacaccaactacggggacattgctgtggccaccacagaggacaacctgagcagcagctacagcgctgtggccctggacaaggcctacttccagacagacaggcctgctgagcagttccacctgcagaacaatgcccctggcaactgtgaccaccccctgcctgagaccacagccactggagaccccacccacagcaacaccacagagagcggggagcagcaccaccaggtggacctgaccggcaaccagccccaccaggcctacctgagcggggaccctgagaaggcccgcatcacctctgtgcccctggacagcgagaagagtgatgaccacgtgtccttccctgaggaccagagcggcaagaacagcatgcccaccgtgtccttcctggaccaggaccagagccccccacgcttctacagcggggaccagcccccatcctacctgggcgcctctgtggacaagctgcaccaccccctggagtttgctgacaagagccccaccccacccaacctgcccagcgacaagatctacccaccttctggcagccctgaggagaacaccagcacagccaccatgacctacatgaccaccaccccagccacagcccagatgagcaccaaggaggcctcctgggatgtggccgagcagcccaccacagctgactttgctgctgccaccctgcagaggacccacaggaccaaccggcccctgcccccaccacccagccagaggtctgctgagcagccccctgtggtgggccaggtgcaggccgccaccaacatcggcctgaacaacagccacaaggtgcagggcgtggtgcctgtgcctgagcggcccccagagccccgggccatggatgatcctgccagcgccttcatcagtgacagcggggctgctgctgcccagtgccccatggccacagctgtgcagcccggcctgcctgagaaggtgagagatggagcccgggtgcccctgctgcacctgcgggcagagagcgtgcctgcccacccctgtggcttccctgcccccctgccccccaccaggatgatggagagcaagatgattgctgccatccacagcagcagcgcagatgccaccagcagcagcaactaccacagctttgtgacagccagcagcacctctgtggatgatgccctgcccctgcccctgcctgtgccccagcccaagcacgccagccagaagacagtgtacagcagctttgcccggccagatgtgaccacagagcccttcggccctgacaactgcctgcacttcaacatgacccccaactgccagtaccggccccagagcgtgcccccccaccacaacaagctggagcagcaccaggtgtatggagcccggtctgagcccccagcctccatgggcctgcgctacaacacctacgtggcccctggaagaaatgccagcggccaccacagcaagccctgcagccgggtggagtatgtgagcagcctgagcagctctgtgaggaacacctgctacccagaggacatccccccctaccccaccatcagaagagtgcagagcctgcacgccccacccagctccatgatccgctctgtgcccatcagcaggacagaggtgcccccagatgatgagcccgcctactgcccccggcccctgtaccagtacaagccctaccagagcagccaggcccggagtgactaccacgtgacccagctgcagccctactttgaaaatggccgggtgcactaccgctacagcccctacagcagcagcagcagcagctactacagcccagatggagccctgtgtgatgtggatgcctatggaacagtgcagctgcggcccctgcaccggctgcccaacagagactttgccttctacaacccccggctgcagggcaagagcctgtacagctatgccggcctggccccccggccccgggccaacgtgacaggctacttcagccccaatgaccacaacgtggtgtccatgcccccagctgctgatgtgaagcacacctacacctcctgggacctggaggacatggagaagtacaggatgcagagcatccggcgggagagccgggcccggcagaaggtgaagggccctgtgatgagccagtatgacaacatgaccccagctgtgcaggatgacctgggcggcatctacgtgatccacctgcggagcaagagtgaccccgggaagacaggcctgctgtctgtggccgagggcaaggagagcagacatgctgccaaggccatcagccctgagggggaggaccgcttctacagaagacaccctgaggccgagatggaccgggcccaccaccacggcggccacggcagcacccagcctgagaagcccagcctgccccagaagcagagcagcctgcggagcaggaagctgcctgacatgggctgcagcctgcctgagcaccgggcccaccaggaggccagccaccggcagttctgtgagagcaagaatggaccaccctacccccagggcgccggccagctggactatggcagcaagggcatcccagacaccagcgagcctgtgtcctaccacaacagcggcgtgaagtatgctgccagcggccaggagagcctgcggctgaaccacaaggaggtgcggctgagcaaggagatggagcggccctgggtgcggcagcccagcgcccctgagaagcacagccgggactgctacaaggaggaggagcacctgacccagagcatcgtgcccccacccaagccagagaggagccacagcctgaagctgcaccacacccagaatgtggagcgggaccccagcgtgctgtaccagtaccagccccacggcaagaggcagagctctgtgacagtggtgtcccagtatgacaacctggaggactaccacagcctgccccagcaccagaggggcgtgtttggaggcggcggcatgggcacctacgtgcccccaggcttcccccacccccagagcaggacctacgccacagccctgggccagggcgccttcctgcctgctgagctgagcctgcagcaccctgagacccagatccacgccgagtag

SEQ ID NO: 37552 - DNA, 969 bp, Artificial Sequence
  Description of Artificial Sequence: Synthetic coding sequence
atgccacccaaggtgctgagcacctggtggaggggcaagcacggcttccaggtgggcctcttccctggccactgtgtggagctgatcaaccagaaggtgccccagagcgtgaccaacagcgtgcccaagcctgtgtccaagaagcacggcaagctgatcaccttcctgcggaccttcatgaagagccggcccaccaagcagaagctgaagcagaggggcatcctgaaggagcgggtgtttggctgtgacctgggggagcacctgctgaacagcggctttgaggtgccccaggtgctgcagagctgcacagccttcatcgagagatatggaattgtggatggcatctaccgcctgtctggagtggccagcaacatccagaggctgcggcatgaatttgacagcgagcacgtgcctgacctgaccaaggagccctacgtgcaggacatccacagcgtgggcagcctgtgcaagctgtacttccgggagctgcccaaccccctgctgacctaccagctgtatgagaagttcagtgatgctgtgtctgctgccacagatgaggagcggctcatcaagatccatgatgtgatccagcagctgcccccaccccactaccgcaccctggagttcctgatgaggcacctgagcctgctggccgactactgcagcatcaccaacatgcacgccaagaacctggccatcgtgtgggcccccaacctgctgcggagcaagcagattgaaagtgcctgcttctctggaacagctgccttcatggaggtgcgcatccagagcgtggtggtggagttcatcctgaaccacgtggatgtgctgctgccccacttcagcgccaggacagagctgattgtgcccttccccctgcggctgcccaggaagcagttcaccccacccctgctgggccccatgagccccctgaaccccctggtgcagatcaccgtgtgcatcagcatctag

SEQ ID NO: 37553 - DNA, 2865 bp, Artificial Sequence
  Description of Artificial Sequence: Synthetic coding sequence
gactatgaggagaccagcaagaaggaggcccggggagcagatgtgcctgagatccctggggacctgaccctgaagacctgtggcagcacagcctccatgaaggtgaagcacgtgaagaagctgcccttcaccaagggccacttccccaagatggctgaatgtgcccacttccactatgaaaatgtggagtttggcagcatccagctgagcctgtctgaggagcagaatgaggtgatgaagaatggctgtgagagcaaggagctggtgtacctggtgcagatcgcctgccagggcaagtcctggatcgtgaagaggagctatgaggacttccgggtgctggacaagcacctgcacctgtgcatctatgaccggcgcttcagccagctgtctgagctgcccaggagtgacaccctgaaggacagccctgagagcgtgacccagatgctgatggcctacctgagccggctgagcgccatcgccggcaacaagatcaactgtggccctgccctgacctggatggagattgacaacaagggcaaccacctgctggtgcatgaggagagcagcatcaacaccccagctgtgggcgccgcccacgtgatcaagcgctacacagcccgggccccagatgagctgaccctggaggtgggggacatcgtgtctgtgattgacatgccacccaaggtgctgagcacctggtggaggggcaagcacggcttccaggtgggcctcttccctggccactgtgtggagctgatcaaccagaaggtgccccagagcgtgaccaacagcgtgcccaagcctgtgtccaagaagcacggcaagctgatcaccttcctgcggaccttcatgaagagccggcccaccaagcagaagctgaagcagaggggcatcctgaaggagcgggtgtttggctgtgacctgggggagcacctgctgaacagcggctttgaggtgccccaggtgctgcagagctgcacagccttcatcgagagatatggaattgtggatggcatctaccgcctgtctggagtggccagcaacatccagaggctgcggcatgaatttgacagcgagcacgtgcctgacctgaccaaggagccctacgtgcaggacatccacagcgtgggcagcctgtgcaagctgtacttccgggagctgcccaaccccctgctgacctaccagctgtatgagaagttcagtgatgctgtgtctgctgccacagatgaggagcggctcatcaagatccatgatgtgatccagcagctgcccccaccccactaccgcaccctggagttcctgatgaggcacctgagcctgctggccgactactgcagcatcaccaacatgcacgccaagaacctggccatcgtgtgggcccccaacctgctgcggagcaagcagattgaaagtgcctgcttctctggaacagctgccttcatggaggtgcgcatccagagcgtggtggtggagttcatcctgaaccacgtggatgtgctcttcagcggccgcatctccatggccatgcaggagggcgccgccagcctgagccggcccaagagcctgctggtgagcagccccagcaccaagctgctgaccctggaggaggcccaggcccggacccaggcccaggtgaacagccccatcgtgacagagaacaagtacatcgaggtgggggagggccctgctgccctgcagggcaagttccacaccatcatcgagttccccctggagaggaagaggccccagaacaagatgaagaagagccctgtgggctcctggaggagcttcttcaacctgggcaagagcagctctgtgtccaagaggaagctgcagagaaatgaaagtgagcccagcgagatgaaggccatggccctgaagggcggccgggcagagggcaccctgcggagcgccaagtctgaggagagcctgaccagcctgcatgctgtggatggagacagcaagctgttccggccccggcggcccaggagcagcagtgatgccctgagcgccagcttcaacggggagatgctgggcaaccgctgcaacagctatgacaacctgccccatgacaatgaaagtgaggaggagggcggcctgctgcacatcccagccctgatgagcccccacagcgcagaagatgtggacctgagccccccagacatcggcgtggccagcctggactttgaccccatgtccttccagtgcagcccccccaaggccgagagcgagtgcctggagagcggggccagcttcctggacagccctggctacagcaaggacaagcccagcgccaacaagaaggatgctgagaccggcagcagccagtgccagaccccaggcagcacagccagcagcgagcctgtgagccccctgcaggagaagctgagccccttcttcaccctggacctgagccccacagaggacaagagcagcaagcccagcagcttcacagagaaggtggtgtatgccttcagccccaagattggaaggaagctgagcaagagccccagcatgagcatcagcgagcccatctctgtgaccctgcccccccgggtgtctgaggtgattggaacagtgagcaacaccacagcccagaatgccagcagcagcacctgggacaagtgtgtggaggagagagatgccaccaacagaagccccacccagatcgtgaagatgaagaccaatgagaccgtggcccaggaggcctatgagagcgaggtgcagcccctggaccaggtggccgctgaggaggtggagctgcccgggaaggaggaccagagcgtgagcagcagccagagcaaggctgtggccagcggccagacccagacaggcaccgtgtgcttcccccccttcttcctgtag

SEQ ID NO: 37554 - DNA, 5217 bp, Artificial Sequence
  Description of Artificial Sequence: Synthetic coding sequence
atgaagagccggcccaccaagcagaagctgaagcagaggggcatcctgaaggagcgggtgtttggctgtgacctgggggagcacctgctgaacagcggctttgaggtgccccaggtgctgcagagctgcacagccttcatcgagagatatggcatcgtggatggcatctaccgcctgagcggcgtggccagcaacatccagaggctgcggcatgaatttgattctgaacatgtgcctgacctgaccaaggagccctacgtgcaggacatccacagcgtgggcagcctgtgcaagctgtacttccgggagctgcccaaccccctgctgacctaccagctgtatgagaagttcagtgatgctgtgtctgctgccacagatgaggagcggctcatcaagatccatgatgtgatccagcagctgcccccaccccactaccgcaccctggagttcctgatgaggcacctgagcctgctggccgactactgcagcatcaccaacatgcacgccaagaacctggccatcgtgtgggcccccaacctgctgcggagcaagcagatcgagagcgcctgcttcagcggcacagctgccttcatggaggtgcgcatccagagcgtggtggtggagttcatcctgaaccacgtggatgtgctcttcagcggccgcatctccatggccatgcaggagggcgccgccagcctgagccggcccaagagcctgctggtgagcagccccagcaccaagctgctgaccctggaggaggcccaggcccggacccaggcccaggtgaacagccccatcgtgacagagaacaagtacatcgaggtgggggagggccctgctgccctgcagggcaagttccacaccatcatcgagttccccctggagaggaagaggccccagaacaagatgaagaagagccctgtgggctcctggaggagcttcttcaacctgggcaagagcagctctgtgtccaagaggaagctgcagagaaatgaaagtgagcccagcgagatgaaggccatggccctgaagggcggccgggcagagggcaccctgcggagcgccaagtctgaggagagcctgaccagcctgcatgctgtggatggagacagcaagctgttccggccccggcggcccaggagcagcagtgatgccctgagcgccagcttcaatggagagatgctgggcaaccgctgcaacagctatgacaacctgccccatgacaatgaaagtgaggaggagggcggcctgctgcacatcccagccctgatgagcccccacagcgcagaagatgtggacctgagccccccagacattggagtggccagcctggactttgaccccatgtccttccagtgcagcccccccaaggccgagagtgaatgtctggagagcggggccagcttcctggacagccctggctacagcaaggacaagcccagcgccaacaagaaggatgctgagaccggcagcagccagtgccagaccccaggcagcacagccagcagcgagcctgtgagccccctgcaggagaagctgagccccttcttcaccctggacctgagccccacagaggacaagagcagcaagcccagcagcttcacagagaaggtggtgtatgccttcagccccaagattggaaggaagctgagcaagagccccagcatgagcatcagcgagcccatctctgtgaccctgcccccccgggtgtctgaggtgattggcaccgtgagcaacaccacagcccagaatgccagcagcagcacctgggacaagtgtgtggaggagagagatgccaccaacagaagccccacccagatcgtgaagatgaagaccaatgaaacagtggcccaggaggcctatgaaagtgaggtgcagcccctggaccaggtggccgctgaggaggtggagctgcccgggaaggaggaccagagcgtgagcagcagccagagcaaggctgtggccagcggccagacccagacaggagctgtgacccatgaccccccccaggacagcgtgcctgtgtcctctgtgtccctcatccccccacctcctccacccaagaatgtggccaggatgctggccctggccctggccgagagcgcccagcaggccagcacccagagcctgaagaggcctggcaccagccaggccggctacaccaactatggagacattgctgtggccaccacagaggacaacctgagcagcagctacagcgctgtggccctggacaaggcctacttccagacagacaggcctgctgagcagttccacctgcagaacaatgcccctggcaactgtgaccaccccctgcctgagaccacagccaccggggaccccacccacagcaacaccacagaaagtggagagcagcaccaccaggtggacctgactggaaaccagccccaccaggcctacctgagcggggaccctgagaaggcccgcatcacctctgtgcccctggacagcgagaagagtgatgaccacgtgtccttccctgaggaccagagcggcaagaacagcatgcccaccgtgtccttcctggaccaggaccagagccccccacgcttctacagcggggaccagccccccagctacctgggcgcctctgtggacaagctgcaccaccccctggagtttgctgacaagagccccaccccacccaacctgcccagcgacaagatctacccacccagcggcagccctgaggagaacaccagcacagccaccatgacctacatgaccaccaccccagccacagcccagatgagcaccaaggaggcctcctgggatgtggccgagcagcccaccacagctgactttgctgctgccaccctgcagaggacccacaggaccaaccggcccctgcccccaccacccagccagaggtctgctgagcagccccctgtggtgggccaggtgcaggccgccaccaacatcggcctgaacaacagccacaaggtgcagggcgtggtgcctgtgcctgagaggcctcctgagccccgggccatggatgatcctgccagcgccttcatcagtgacagcggggctgctgctgcccagtgccccatggccacagctgtgcagcccggcctgcctgagaaggtgagagatggagcccgggtgcccctgctgcacctgcgggcagagagcgtgcctgcccacccctgtggcttccctgcccccctgccccccaccaggatgatggagagcaagatgattgctgccatccacagcagcagcgcagatgccaccagcagcagcaactaccacagctttgtgacagccagcagcacctctgtggatgatgccctgcccctgcccctgcctgtgccccagcccaagcacgccagccagaagacagtgtacagcagctttgcccggccagatgtgaccacagagccctttggaccagacaactgcctgcacttcaacatgacccccaactgccagtaccggccccagagcgtgcccccccaccacaacaagctggagcagcaccaggtgtatggagcccggtctgagcccccagcctccatgggcctgcgctacaacacctacgtggcccctggaagaaatgccagcggccaccacagcaagccctgcagccgggtggagtatgtgagcagcctgagcagctctgtgaggaacacctgctacccagaggacatccccccctaccccaccatccggcgggtgcagagcctgcacgccccacccagctccatgatccgctctgtgcccatcagcaggacagaggtgcccccagatgatgagcccgcctactgcccccggcccctgtaccagtacaagccctaccagagcagccaggcccggagtgactaccacgtgacccagctgcagccctactttgaaaatggccgggtgcactaccgctacagcccctacagcagcagcagcagcagctactacagcccagatggagccctgtgtgatgtggatgcctacggcaccgtgcagctgcggcccctgcaccggctgcccaacagagactttgccttctacaacccccggctgcagggcaagagcctgtacagctatgccggcctggccccccggccccgggccaacgtgacaggctacttcagccccaatgaccacaacgtggtgtccatgcctcctgctgctgatgtgaagcacacctacacctcctgggacctggaggacatggagaagtacaggatgcagagcatcagaagagagagccgggcccggcagaaggtgaagggccctgtgatgagccagtatgacaacatgaccccagctgtgcaggatgacctgggcggcatctacgtgatccacctgcggagcaagagtgaccccgggaagacaggcctgctgtctgtggccgagggcaaggagagcagacatgctgccaaggccatcagcccagaaggagaagatcgcttctaccgccgccaccctgaggccgagatggaccgggcccaccaccacggcggccacggcagcacccagcctgagaagcccagcctgccccagaagcagagcagcctgcggagcaggaagctgcctgacatgggctgcagcctgcctgagcaccgggcccaccaggaggccagccaccggcagttctgtgagagcaagaatggccccccctacccccagggcgccggccagctggactatggcagcaagggcatcccagacaccagcgagcctgtgtcctaccacaacagcggcgtgaagtatgctgccagcggccaggagagcctgcggctgaaccacaaggaggtgcggctgagcaaggagatggagcggccctgggtgcggcagcccagcgcccctgagaagcacagccgggactgctacaaggaggaggagcacctgacccagagcatcgtgcccccacccaagccagagaggagccacagcctgaagctgcaccacacccagaatgtggagcgggaccccagcgtgctgtaccagtaccagccccacggcaagaggcagagctctgtgacagtggtgtcccagtatgacaacctggaggactaccacagcctgccccagcaccagaggggcgtgtttggaggcggcggcatgggcacctacgtgcccccaggcttcccccacccccagagcaggacctacgccacagccctgggccagggcgccttcctgcctgctgagctgagcctgcagcaccctgagacccagatccatgctgagtag

SEQ ID NO: 37555 - DNA, 2841 bp, Artificial Sequence
  Description of Artificial Sequence: Synthetic coding sequence
atggccgcccacggcaagctgcggcgggagcggggcctgcaggccgagtatgagacccaggtgaaggagatgcgctggcagctgtctgagcagctgcgctgcctggagctgcagggcgagctgcggcgggagctgctgcaggagctggccgagttcatgagaagaagagctgaggtggagctggagtacagccggggcctggagaagctggccgagcgcttcagcagccggggcggccgcctgggcagcagccgggagcaccagagcttcaggaaggagcccagcctgctgagccccctgcactgctgggccgtgctgctgcagcacacccggcagcagagccgggagagcgctgccctgtctgaggtgctggccggccccctggcccagaggctgagccacatcgcagaagatgtgggccgcctggtgaagaagagccgggacctggagcagcagctgcaggatgagctgctggaggtggtgtctgagctgcagacagccaagaagacctaccaggcctaccacatggagagcgtgaatgctgaggccaagctgcgggaggccgagcggcaggaggagaagagagctggccgctctgtgcccaccaccacagctggggccacagaggccggccccctgaggaagagcagcctgaagaagggcggccgcctggtggagaagaggcaggccaagttcatggagcacaagctgaagtgcaccaaggccagaaatgagtacctgctgagcctggcctctgtgaatgctgctgtgagcaactactacctgcatgatgtgctggacctgatggactgctgtgacaccggcttccacctggccctgggccaggtgctgcggagctacacagctgctgagagcaggacccaggccagccaggtgcagggcctgggcagcctggaggaggccgtggaggccctggaccccccaggggacaaggccaaggtgctggaggtgcacgccaccgtcttctgcccccccctgcgctttgactaccacccccatgatggagatgaggtggccgagatctgtgtggagatggagctgagagatgagatcctgccccgggcccagaacatccagagccggctggaccggcagaccatcgagacagaggaggtgaacaagaccctgaaggccaccctgcaggccctgctggaggtggtggccagtgatgatggagatgtgctggacagcttccagaccagccccagcacagagagcctgaagagcaccagcagtgaccccggcagccggcaggccggcagaagaagaggccagcagcaggagacagagaccttctacctgaccaagctgcaggagtacctgagcggccgcagcatcctggccaagctgcaggccaagcatgagaagctgcaggaggccctgcagagaggagacaaggaggagcaggaggtgtcctggacccagtacacccagaggaagttccagaagagccggcagccccggcccagcagccagtacaaccagaggctgtttggaggagacatggagaagttcatccagagcagcggccagcctgtgcccctggtggtggagagctgcatccgcttcatcaacctgaatggcctgcagcacgagggcatcttccgggtgtctggggcccagctgcgggtgtctgagatcagagatgcctttgagcggggggaggaccccctggtggagggctgcacagcccatgacctggacagcgtggccggcgtgctgaagctgtacttccgcagcctggagcccccactcttccccccagacctgtttggagagctgctggccagcagcgagctggaggccacagctgagcgggtggagcacgtgtcccggctgctgtggaggctgcctgcccctgtgctggtggtgctgcgctacctgttcaccttcctgaaccacctggcccagtacagtgatgagaacatgatggacccctacaacctggccgtgtgcttcggccccaccctgctgcctgtgcctgctggccaggaccctgtggccctgcagggccgggtgaaccagctggtgcagaccctcatcgtgcagcctgacagagtcttcccccccctgaccagcctgcccggccctgtgtatgagaagtgcatggccccacccagcgccagctgcctgggagatgcccagctggagagcctgggcgctgacaatgaacctgagctggaggccgagatgcctgcccaggaggatgacctggagggcgtggtggaggccgtggcctgctttgcctacacaggccgcacagcccaggagctgtccttcagaagaggagatgtgctgcggctgcacgagcgggccagcagtgactggtggagaggagagcacaacggcatgaggggcctcatcccccacaagtacatcaccctgcctgctggaacagagaagcaggtggtgggcgccggcctgcagacagctggggagagcggcagcagccctgagggcctgctggccagcgagctggtgcacaggcctgagccctgcaccagccctgaggccatgggccccagcggccacagaagacgctgcctggtgcctgccagccctgagcagcacgtggaggtggacaaggctgtggcccagaacatggattctgtgttcaaggagctgctgggcaagacctctgtgcggcagggcctgggccctgccagcaccaccagccccagccctggccccaggagccccaaggccccacccagcagccggctgggcagaaataaaggcttcagccggggccctggggccccagccagccccagcgccagccacccccagggcctggacaccacccccaagccccactag

SEQ ID NO: 37556 - DNA, 2778 bp, Artificial Sequence
  Description of Artificial Sequence: Synthetic coding sequence
atggccgcccacggcaagctgcggcgggagcggggcctgcaggccgagtatgagacccaggtgaaggagatgcgctggcagctgtctgagcagctgcgctgcctggagctgcagggcgagctgcggcgggagctgctgcaggagctggccgagttcatgagaagaagagctgaggtggagctggagtacagccggggcctggagaagctggccgagcgcttcagcagccggggcggccgcctgggcagcagccgggagcaccagagcttcaggaaggagcccagcctgctgagccccctgcactgctgggccgtgctgctgcagcacacccggcagcagagccgggagagcgctgccctgtctgaggtgctggccggccccctggcccagaggctgagccacatcgcagaagatgtgggccgcctggtgaagaaggccaagaagacctaccaggcctaccacatggagagcgtgaatgctgaggccaagctgcgggaggccgagcggcaggaggagaagagagctggccgctctgtgcccaccaccacagctggggccacagaagctggccccctgaggaagagcagcctgaagaagggcggccgcctggtggagaagaggcaggccaagttcatggagcacaagctgaagtgcaccaaggccagaaatgagtacctgctgagcctggcctctgtgaatgctgctgtgagcaactactacctgcatgatgtgctggacctgatggactgctgtgacaccggcttccacctggccctgggccaggtgctgcggagctacacagctgctgagagcaggacccaggccagccaggtgcagggcctgggcagcctggaggaggccgtggaggccctggaccccccaggggacaaggccaaggtgctggaggtgcacgccaccgtcttctgcccccccctgcgctttgactaccacccccatgatggagatgaggtggccgagatctgtgtggagatggagctgagagatgagatcctgccccgggcccagaacatccagagccggctggaccggcagaccattgaaacagaggaggtgaacaagaccctgaaggccaccctgcaggccctgctggaggtggtggccagtgatgatggagatgtgctggacagcttccagaccagccccagcacagagagcctgaagagcaccagcagtgaccccggcagccggcaggccggcagaagaagaggccagcagcaggagacagagaccttctacctgaccaagctgcaggagtacctgagcggccgcagcatcctggccaagctgcaggccaagcatgagaagctgcaggaggccctgcagagaggagacaaggaggagcaggaggtgtcctggacccagtacacccagaggaagttccagaagagccggcagccccggcccagcagccagtacaaccagaggctgtttggaggagacatggagaagttcatccagagcagcggccagcctgtgcccctggtggtggagagctgcatccgcttcatcaacctgaatggcctgcagcacgagggcatcttccgggtgtctggggcccagctgcgggtgtctgagatcagagatgcctttgaaagaggagaggaccccctggtggagggctgcacagcccatgacctggacagcgtggccggcgtgctgaagctgtacttccgcagcctggagcccccactcttccccccagacctgtttggagagctgctggccagcagcgagctggaggccacagctgagcgggtggagcacgtgtcccggctgctgtggaggctgcctgcccctgtgctggtggtgctgcgctacctgttcaccttcctgaaccacctggcccagtacagtgatgagaacatgatggacccctacaacctggccgtgtgcttcggccccaccctgctgcctgtgcctgctggccaggaccctgtggccctgcagggccgggtgaaccagctggtgcagaccctgattgtgcagcctgacagagtcttcccccccctgaccagcctgcccggccctgtgtatgagaagtgcatggcccctccttctgccagctgcctgggagatgcccagctggagagcctgggcgctgacaatgaacctgagctggaggccgagatgcctgcccaggaggatgacctggagggcgtggtggaggccgtggcctgctttgcctacacaggccgcacagcccaggagctgtccttcagaagaggagatgtgctgcggctgcacgagcgggccagcagtgactggtggagaggagagcacaacggcatgaggggcctcatcccccacaagtacatcaccctgcctgctggaacagagaagcaggtggtgggcgccggcctgcagacagctggggagagcggcagcagccctgagggcctgctggccagcgagctggtgcacaggcctgagccctgcaccagccctgaggccatgggccccagcggccacagaagacgctgcctggtgcctgccagccctgagcagcacgtggaggtggacaaggctgtggcccagaacatggacagcgtcttcaaggagctgctgggcaagacctctgtgcggcagggcctgggccctgccagcaccaccagccccagccctggccccaggagccccaaggccccacccagcagccggctgggcaggaacaagggcttcagccggggccctggggccccagccagccccagcgccagccacccccagggcctggacaccacccccaagccccactag

SEQ ID NO: 37557 - DNA, 2961 bp, Artificial Sequence
  Description of Artificial Sequence: Synthetic coding sequence
atggccgcccacggcaagctgcggcgggagcggggcctgcaggccgagtatgagacccaggtgaaggagatgcgctggcagctgtctgagcagctgcgctgcctggagctgcagggcgagctgcggcgggagctgctgcaggagctggccgagttcatgagaagaagagctgaggtggagctggagtacagccggggcctggagaagctggccgagcgcttcagcagccggggcggccgcctgggcagcagccgggagcaccagagcttcaggaaggagcccagcctgctgagccccctgcactgctgggccgtgctgctgcagcacacccggcagcagagccgggagagcgctgccctgtctgaggtgctggccggccccctggcccagaggctgagccacatcgcagaagatgtgggccgcctggtgaagaagagccgggacctggagcagcagctgcaggatgagctgctggaggtggtgtctgagctgcagacagccaagaagacctaccaggcctaccacatggagagcgtgaatgctgaggccaagctgcgggaggccgagcggcaggaggagaagagagctggccgctctgtgcccaccaccacagctggggccacagaggccggccccctgaggaagagcagcctgaagaagggcggccgcctggtggagaagctgtggccaccccagaggcctgtggccgccagcagctgtgcccctgtgtgctggctgcaggccggcttcctggtgcaccccccctggtggggcgccatgtgtgcccccagcacccaccagaggcaggccaagttcatggagcacaagctgaagtgcaccaaggccagaaatgagtacctgctgagcctggcctctgtgaatgctgctgtgagcaactactacctgcatgatgtgctggacctgatggactgctgtgacaccggcttccacctggccctgggccaggtgctgcggagctacacagctgctgagagcaggacccaggccagccaggtgcagggcctgggcagcctggaggaggccgtggaggccctggaccccccaggggacaaggccaaggtgctggaggtgcacgccaccgtcttctgcccccccctgcgctttgactaccacccccatgatggagatgaggtggccgagatctgtgtggagatggagctgagagatgagatcctgccccgggcccagaacatccagagccggctggaccggcagaccatcgagacagaggaggtgaacaagaccctgaaggccaccctgcaggccctgctggaggtggtggccagtgatgatggagatgtgctggacagcttccagaccagccccagcacagagagcctgaagagcaccagcagtgaccccggcagccggcaggccggcagaagaagaggccagcagcaggagacagagaccttctacctgaccaagctgcaggagtacctgagcggccgcagcatcctggccaagctgcaggccaagcatgagaagctgcaggaggccctgcagagaggagacaaggaggagcaggaggtgtcctggacccagtacacccagaggaagttccagaagagccggcagccccggcccagcagccagtacaaccagaggctgtttggaggagacatggagaagttcatccagagcagcggccagcctgtgcccctggtggtggagagctgcatccgcttcatcaacctgaatggcctgcagcacgagggcatcttccgggtgtctggggcccagctgcgggtgtctgagatcagagatgcctttgagcggggggaggaccccctggtggagggctgcacagcccatgacctggacagcgtggccggcgtgctgaagctgtacttccgcagcctggagcccccactcttccccccagacctgtttggagagctgctggccagcagcgagctggaggccacagctgagcgggtggagcacgtgtcccggctgctgtggaggctgcctgcccctgtgctggtggtgctgcgctacctgttcaccttcctgaaccacctggcccagtacagtgatgagaacatgatggacccctacaacctggccgtgtgcttcggccccaccctgctgcctgtgcctgctggccaggaccctgtggccctgcagggccgggtgaaccagctggtgcagaccctcatcgtgcagcctgacagagtcttcccccccctgaccagcctgcccggccctgtgtatgagaagtgcatggccccacccagcgccagctgcctgggagatgcccagctggagagcctgggcgctgacaatgaacctgagctggaggccgagatgcctgcccaggaggatgacctggagggcgtggtggaggccgtggcctgctttgcctacacaggccgcacagcccaggagctgtccttcagaagaggagatgtgctgcggctgcacgagcgggccagcagtgactggtggagaggagagcacaacggcatgaggggcctcatcccccacaagtacatcaccctgcctgctggaacagagaagcaggtggtgggcgccggcctgcagacagctggggagagcggcagcagccctgagggcctgctggccagcgagctggtgcacaggcctgagccctgcaccagccctgaggccatgggccccagcggccacagaagacgctgcctggtgcctgccagccctgagcagcacgtggaggtggacaaggctgtggcccagaacatggattctgtgttcaaggagctgctgggcaagacctctgtgcggcagggcctgggccctgccagcaccaccagccccagccctggccccaggagccccaaggccccacccagcagccggctgggcagaaataaaggcttcagccggggccctggggccccagccagccccagcgccagccacccccagggcctggacaccacccccaagccccactag

SEQ ID NO: 37558 - DNA, 2307 bp, Artificial Sequence
  Description of Artificial Sequence: Synthetic coding sequence
atggccgcccacggcaagctgcggcgggagcggggcctgcaggccgagtatgagacccaggtgaaggagatgcgctggcagctgtctgagcagctgcgctgcctggagctgcagggcgagctgcggcgggagctgctgcaggagctggccgagttcatgagaagaagagctgaggtggagctggagtacagccggggcctggagaagctggccgagcgcttcagcagccggggcggccgcctgggcagcagccgggagcaccagagcttcaggaaggagcccagcctgctgagccccctgcactgctgggccgtgctgctgcagcacacccggcagcagagccgggagagcgctgccctgtctgaggtgctggccggccccctggcccagaggctgagccacatcgcagaagatgtgggccgcctggtgaagaagagccgggacctggagcagcagctgcaggatgagctgctggaggtggtgtctgagctgcagacagtggccgagatctgtgtggagatggagctgagagatgagatcctgccccgggcccagaacatccagagccggctggaccggcagaccatcgagacagaggaggtgaacaagaccctgaaggccaccctgcaggccctgctggaggtggtggccagtgatgatggagatgtgctggacagcttccagaccagccccagcacagagagcctgaagagcaccagcagtgaccccggcagccggcaggccggcagaagaagaggccagcagcaggagacagagaccttctacctgaccaagctgcaggagtacctgagcggccgcagcatcctggccaagctgcaggccaagcatgagaagctgcaggaggccctgcagagaggagacaaggaggagcaggaggtgtcctggacccagtacacccagaggaagttccagaagagccggcagccccggcccagcagccagtacaaccagaggctgtttggaggagacatggagaagttcatccagagcagcggccagcctgtgcccctggtggtggagagctgcatccgcttcatcaacctgaatggcctgcagcacgagggcatcttccgggtgtctggggcccagctgcgggtgtctgagatcagagatgcctttgagcggggggaggaccccctggtggagggctgcacagcccatgacctggacagcgtggccggcgtgctgaagctgtacttccgcagcctggagcccccactcttccccccagacctgtttggagagctgctggccagcagcgagctggaggccacagctgagcgggtggagcacgtgtcccggctgctgtggaggctgcctgcccctgtgctggtggtgctgcgctacctgttcaccttcctgaaccacctggcccagtacagtgatgagaacatgatggacccctacaacctggccgtgtgcttcggccccaccctgctgcctgtgcctgctggccaggaccctgtggccctgcagggccgggtgaaccagctggtgcagaccctcatcgtgcagcctgacagagtcttcccccccctgaccagcctgcccggccctgtgtatgagaagtgcatggccccacccagcgccagctgcctgggagatgcccagctggagagcctgggcgctgacaatgaacctgagctggaggccgagatgcctgcccaggaggatgacctggagggcgtggtggaggccgtggcctgctttgcctacacaggccgcacagcccaggagctgtccttcagaagaggagatgtgctgcggctgcacgagcgggccagcagtgactggtggagaggagagcacaacggcatgaggggcctcatcccccacaagtacatcaccctgcctgctggaacagagaagcaggtggtgggcgccggcctgcagacagctggggagagcggcagcagccctgagggcctgctggccagcgagctggtgcacaggcctgagccctgcaccagccctgaggccatgggccccagcggccacagaagacgctgcctggtgcctgccagccctgagcagcacgtggaggtggacaaggctgtggcccagaacatggattctgtgttcaaggagctgctgggcaagacctctgtgcggcagggcctgggccctgccagcaccaccagccccagccctggccccaggagccccaaggccccacccagcagccggctgggcagaaataaaggcttcagccggggccctggggccccagccagccccagcgccagccacccccagggcctggacaccacccccaagccccactag

SEQ ID NO: 37559 - DNA, 2772 bp, Artificial Sequence
  Description of Artificial Sequence: Synthetic coding sequence
atgcgctggcagctgtctgagcagctgcgctgcctggagctgcagggcgagctgcggcgggagctgctgcaggagctggccgagttcatgagaagaagagctgaggtggagctggagtacagccggggcctggagaagctggccgagcgcttcagcagcagaggaggccgcctgggcagcagccgggagcaccagagcttcaggaaggagcccagcctgctgagccccctgcactgctgggccgtgctgctgcagcacacccggcagcagagccgggagagcgctgccctgtctgaggtgctggccggccccctggcccagaggctgagccacatcgccgaggatgtgggccgcctggtgaagaagagccgggacctggagcagcagctgcaggatgagctgctggaggtggtgtctgagctgcagacagccaagaagacctaccaggcctaccacatggagagcgtgaatgctgaggccaagctgcgggaggccgagcggcaggaggagaagagagctggccgctctgtgcccaccaccacagctggggccacagaagctggccccctgaggaagagcagcctgaagaagggcggccgcctggtggagaagaggcaggccaagttcatggagcacaagctgaagtgcaccaaggccagaaatgagtacctgctgagcctggcctctgtgaatgctgctgtgagcaactactacctgcatgatgtgctggacctgatggactgctgtgacaccggcttccacctggccctgggccaggtgctgcggagctacacagctgctgagagcaggacccaggccagccaggtgcagggcctgggcagcctggaggaggccgtggaggccctggaccccccaggggacaaggccaaggtgctggaggtgcacgccaccgtcttctgcccccccctgcgctttgactaccacccccatgatggagatgaggtggccgagatctgtgtggagatggagctgagagatgagatcctgccccgggcccagaacatccagagccggctggaccggcagaccattgaaacagaggaggtgaacaagaccctgaaggccaccctgcaggccctgctggaggtggtggccagtgatgatggagatgtgctggacagcttccagaccagccccagcacagagagcctgaagagcaccagcagtgaccccggcagccggcaggccggcagaagaagaggccagcagcaggagacagagaccttctacctgaccaagctgcaggagtacctgagcggccgcagcatcctggccaagctgcaggccaagcatgagaagctgcaggaggccctgcagagaggagacaaggaggagcaggaggtgtcctggacccagtacacccagaggaagttccagaagagccggcagccccggcccagcagccagtacaaccagaggctgtttggaggagacatggagaagttcatccagagcagcggccagcctgtgcccctggtggtggagagctgcatccgcttcatcaacctgaatggcctgcagcacgagggcatcttccgggtgtctggggcccagctgcgggtgtctgagatcagagatgcctttgaaagaggagaggaccccctggtggagggctgcacagcccatgacctggacagcgtggccggcgtgctgaagctgtacttccgcagcctggagcccccactcttccccccagacctgtttggagagctgctggccagcagcgagctggaggccacagctgagcgggtggagcacgtgtcccggctgctgtggaggctgcctgcccctgtgctggtggtgctgcgctacctgttcaccttcctgaaccacctggcccagtacagtgatgagaacatgatggacccctacaacctggccgtgtgcttcggccccaccctgctgcctgtgcctgctggccaggaccctgtggccctgcagggccgggtgaaccagctggtgcagaccctgattgtgcagcctgacagagtcttcccccccctgaccagcctgcccggccctgtgtatgagaagtgcatggcccctccttctgccagctgcctgggagatgcccagctggagagcctgggcgctgacaatgaacctgagctggaggccgagatgcctgcccaggaggatgacctggagggcgtggtggaggccgtggcctgctttgcctacacaggccgcacagcccaggagctgtccttcagaagaggagatgtgctgcggctgcacgagcgggccagcagtgactggtggagaggagagcacaacggcatgaggggcctcatcccccacaagtacatcaccctgcctgctggaacagagaagcaggtggtgggcgccggcctgcagacagctggggagagcggcagcagccctgagggcctgctggccagcgagctggtgcacaggcctgagccctgcaccagccctgaggccatgggccccagcggccacagaagacgctgcctggtgcctgccagccctgagcagcacgtggaggtggacaaggctgtggcccagaacatggacagcgtcttcaaggagctgctgggcaagacctctgtgcggcagggcctgggccctgccagcaccaccagccccagccctggccccaggagccccaaggccccacccagcagccggctgggcaggaacaagggcttcagccggggccctggggccccagccagccccagcgccagccacccccagggcctggacaccacccccaagccccactag

SEQ ID NO: 37560 - DNA, 2817 bp, Artificial Sequence
  Description of Artificial Sequence: Synthetic coding sequence
atgttcagaagaaggacctgtggcacagaggccagcctgcgctggagccacagcagccgctctgagatccggctgggccgctctgagagcctgaagggccgggaggagatgaagaggagcaggaaggccgagaatgtgcccaggagcagaagtgatgtggacatggatgctgctgctgaggccacccggctgcaccagagcgccagcagcagcaccagcagcctgagcaccaggagcctggagaaccccaccccacccttcacccccaagatgggcagaagaagcattgagagccccagcctgggcttctgcacagacaccctgctgccccacctgctggaggatgacctgggccagctgagtgacctggagcctgagccagatgcccagaactggcagcacacagtgggcaaggatgtggtggccggcctgacccagcgggagattgaccggcaggaggtgatcaatgagctgtttgtgacagaggccagccacctgcggaccctgcgggtgctggacctgatcttctaccagaggatgaagaaggagaacctgatgccccgggaggagctggcccggctcttccccaacctgcctgagctgattgagatccacaacagctggtgtgaggccatgaagaagctgcgggaggagggccccatcatcaaggagatcagtgacctgatgctggccaggtttgatggccctgcccgggaggagctgcagcaggtggccgcccagttctgcagctaccagagcatcgccctggagctgatcaagaccaagcagaggaaggagagccgcttccagctgttcatgcaggaggccgagagccacccccagtgccggcggctgcagctgcgggacctgatcatcagcgagatgcagaggctgaccaagtaccccctgctgctggagagcatcatcaagcacacagagggcggcaccagcgagcacgagaagctgtgccgggcccgggaccagtgccgggagatcctgaagtatgtgaatgaagctgtgaagcagacagagaacagacaccggctggagggctaccagaagaggctggatgccacagccctggagcgggccagcaaccccctggccgctgagttcaagagcctggacctgaccaccaggaagatgatccacgagggccccctgacctggaggatcagcaaggacaagaccctggacctgcacgtgctgctgctggaggacctgctggtgctgctgcagaagcaggatgagaagctgctgctgaagtgccacagcaagacagctgtgggcagcagtgacagcaagcagaccttcagccctgtgctgaagctgaatgctgtgctgatccgctctgtggccacagacaagagggccttcttcatcatctgcaccagcaagctgggccccccccagatctatgagctggtggccctgaccagcagtgacaagaacacctggatggagctgctggaggaggccgtgagaaatgccaccaggcaccctggagctgcccccatgcctgtgcaccccccacctcctggcccccgggagcccgcccagcagggccccacccccagccgggtggagctggatgacagtgatgtgttccatggagagcctgagcctgaggagctgcccggcggcaccggcagccagcagagggtgcagggcaagcaccaggtgctgctggaggaccctgagcaggagggcagcgctgaggaggaggagctgggcgtgctgccctgccccagcaccagcctggatggagagaacagaggcatccgcaccaggaaccccatccacctggccttccctggccccctcttcatggagggcctggccgacagcgccctggaggatgtggagaacctgcggcacctgatcctgtggagcctgctgcccggccacaccatggagacccaggccgcccaggagccagaagatgacctgacccccaccccatctgtcatctctgtgaccagccacccctgggaccccggcagccctggccaggcccctcctggaggagagggggacaacacccagctggccggcctggagggggagaggcctgagcaggaggacatgggcctgtgcagcctggagcacctgccccccaggaccagaaattctggcatctgggagagccctgagctggacaggaacctggctgaagatgccagcagcacagaggccgccggcggctacaaggtggtgaggaaggccgaggtggccggcagcaaggtggtgcctgccctgcctgagagcggccagagcgagcccggccccccagaggtggagggcggcaccaaggccactggaaactgcttctacgtgtccatgcccagcggccccccagacagcagcacagaccacagcgaggcccccatgagccccccccagcctgacagcctgcctgctggccagacagagccccagccccagctgcagggcggcaatgatgacccccggcggcccagccgcagcccccccagcctggccctgagagatgtgggcatgatcttccacaccatcgagcagctgaccctgaagctgaaccggctgaaggacatggagctggcccaccgggagctgctgaagagcctgggcggggagagcagcggcggcaccacccctgtgggcagcttccacacagaagctgcccgctggacagatggcagcctgagccccccagccaaggagcccctggccagtgacagcaggaacagccatgagctgggcccctgcccagaagatggcagtgatgcccccctggaggacagcacagcagatgctgctgccagccctggcccctag

SEQ ID NO: 37561 - DNA, 4569 bp, Artificial Sequence
  Description of Artificial Sequence: Synthetic coding sequence
atgtctgtgcggctgccccagagcattgaccggctgagcagcctgagcagcctgggggacagcgcccctgagaggaagagccccagccaccaccggcagcccagtgatgccagcgagaccaccggcctggtgcagagatgtgtgatcatccagaaggaccagcacggcttcggcttcaccgtgtctggggaccgcatcgtgctggtgcagagcgtgcggcctgggggcgccgccatgaaggccggcgtgaaggagggggaccgcatcatcaaggtgaatggcaccatggtgaccaacagcagccacctggaggtggtgaagctgatcaagagcggggcctacgtggccctgaccctgctgggcagcagccccagctccatgggcatcagcggcctgcagcaggaccccagccctgctggggccccccgcatcaccagcgtcatccccagccccccacctcctccacccctgcccccaccccagaggatcaccggccccaagcccctgcaggaccctgaggtgcagaagcacgccacccagatcctgaggaacatgctgcggcaggaggagaaggagctgcaggacatcctgcccctgtatggagacaccagccagaggcccagcgagggccgcctgagcctggacagccaggagggggacagcggcctggacagcggcacagagcgcttccccagcctgtctgagagcctgatgaacagaaacagcgtgctgagtgaccccggcctggacagccccaggaccagccctgtgatcatggcccgggtggcccagcaccaccggcggcagggcagtgatgctgctgtgcccagcactggagaccagggcgtggaccagagccccaagcccctcatcatcggccctgaggaggactatgaccccggctacttcaacaatgaaagtgacatcatcttccaggacctggagaagctgaagagcaggcctgcccacctgggcgtcttcctgcgctacatcttcagccaggccgaccccagccccctgctcttctacctgtgtgccgaggtgtaccagcaggccagccccaaggacagccgcagcctgggcaaggacatctggaacatcttcctggagaagaatgcccccctgcgggtgaagatccctgagatgctgcaggccgagattgacagccggctgaggaacagtgaagatgcccggggcgtgctgtgtgaggcccaggaggccgccatgcctgagatccaggagcagatccatgactaccgcaccaagaggaccctgggcctgggcagcctgtatggagaaaatgacctgctggacctggatggagaccccctgcgggagcggcaggtggccgagaagcagctggccgccctgggggacatcctgagcaaatatgaggaggacagaagtgcccccatggactttgccctgaacacctacatgagccatgctggcatccggctgcgggaggcccggcccagcaacacagctgagaaggcccagagcgccccagacaaggacaagtggctgcccttcttccccaagaccaagaagagcagcaacagcaagaaggagaaggatgccctggaggacaagaagaggaaccccatcctgaagtacatcggcaagcccaagagcagcagccagagcaccttccacatccccctgagccctgtggaggtgaagccaggaaatgtgaggaacatcatccagcactttgagaacaaccagcagtatgatgcccctgagcccggcacccagaggctgagcacaggcagcttccctgaggacctgctggagagtgacagcagccgctctgagatccggctgggccgctctgagagcctgaagggccgggaggagatgaagaggagcaggaaggccgagaatgtgcccaggagcagaagtgatgtggacatggatgctgctgctgaggccacccggctgcaccagagcgccagcagcagcaccagcagcctgagcaccaggagcctggagaaccccaccccacccttcacccccaagatgggcagaagaagcattgagagccccagcctgggcttctgcacagacaccctgctgccccacctgctggaggatgacctgggccagctgagtgacctggagcctgagccagatgcccagaactggcagcacacagtgggcaaggatgtggtggccggcctgacccagcgggagattgaccggcaggaggtgatcaatgagctgtttgtgacagaggccagccacctgcggaccctgcgggtgctggacctgatcttctaccagaggatgaagaaggagaacctgatgccccgggaggagctggcccggctcttccccaacctgcctgagctgattgagatccacaacagctggtgtgaggccatgaagaagctgcgggaggagggccccatcatcaaggagatcagtgacctgatgctggccaggtttgatggccctgcccgggaggagctgcagcaggtggccgcccagttctgcagctaccagagcatcgccctggagctgatcaagaccaagcagaggaaggagagccgcttccagctgttcatgcaggaggccgagagccacccccagtgccggcggctgcagctgcgggacctgatcatcagcgagatgcagaggctgaccaagtaccccctgctgctggagagcatcatcaagcacacagagggcggcaccagcgagcacgagaagctgtgccgggcccgggaccagtgccgggagatcctgaagtatgtgaatgaagctgtgaagcagacagagaacagacaccggctggagggctaccagaagaggctggatgccacagccctggagcgggccagcaaccccctggccgctgagttcaagagcctggacctgaccaccaggaagatgatccacgagggccccctgacctggaggatcagcaaggacaagaccctggacctgcacgtgctgctgctggaggacctgctggtgctgctgcagaagcaggatgagaagctgctgctgaagtgccacagcaagacagctgtgggcagcagtgacagcaagcagaccttcagccctgtgctgaagctgaatgctgtgctgatccgctctgtggccacagacaagagggccttcttcatcatctgcaccagcaagctgggccccccccagatctatgagctggtggccctgaccagcagtgacaagaacacctggatggagctgctggaggaggccgtgagaaatgccaccaggcaccctggagctgcccccatgcctgtgcaccccccacctcctggcccccgggagcccgcccagcagggccccacccccagccgggtggagctggatgacagtgatgtgttccatggagagcctgagcctgaggagctgcccggcggcaccggcagccagcagagggtgcagggcaagcaccaggtgctgctggaggaccctgagcaggagggcagcgctgaggaggaggagctgggcgtgctgccctgccccagcaccagcctggatggagagaacagaggcatccgcaccaggaaccccatccacctggccttccctggccccctcttcatggagggcctggccgacagcgccctggaggatgtggagaacctgcggcacctgatcctgtggagcctgctgcccggccacaccatggagacccaggccgcccaggagccagaagatgacctgacccccaccccatctgtcatctctgtgaccagccacccctgggaccccggcagccctggccaggcccctcctggaggagagggggacaacacccagctggccggcctggagggggagaggcctgagcaggaggacatgggcctgtgcagcctggagcacctgccccccaggaccagaaattctggcatctgggagagccctgagctggacaggaacctggctgaagatgccagcagcacagaggccgccggcggctacaaggtggtgaggaaggccgaggtggccggcagcaaggtggtgcctgccctgcctgagagcggccagagcgagcccggccccccagaggtggagggcggcaccaaggccactggaaactgcttctacgtgtccatgcccagcggccccccagacagcagcacagaccacagcgaggcccccatgagccccccccagcctgacagcctgcctgctggccagacagagccccagccccagctgcagggcggcaatgatgacccccggcggcccagccgcagcccccccagcctggccctgagagatgtgggcatgatcttccacaccatcgagcagctgaccctgaagctgaaccggctgaaggacatggagctggcccaccgggagctgctgaagagcctgggcggggagagcagcggcggcaccacccctgtgggcagcttccacacagaagctgcccgctggacagatggcagcctgagccccccagccaaggagcccctggccagtgacagcaggaacagccatgagctgggcccctgcccagaagatggcagtgatgcccccctggaggacagcacagcagatgctgctgccagccctggcccctag

SEQ ID NO: 37562 - DNA, 4689 bp, Artificial Sequence
  Description of Artificial Sequence: Synthetic coding sequence
atgtctgtgcggctgccccagagcattgaccggctgagcagcctgagcagcctgggggacagcgcccctgagaggaagagccccagccaccaccggcagcccagtgatgccagcgagaccaccggcctggtgcagagatgtgtgatcatccagaaggaccagcacggcttcggcttcaccgtgtctggggaccgcatcgtgctggtgcagagcgtgcggcctgggggcgccgccatgaaggccggcgtgaaggagggggaccgcatcatcaaggtgaatggcaccatggtgaccaacagcagccacctggaggtggtgaagctgatcaagagcggggcctacgtggccctgaccctgctgggcagcagccccagctccatgggcatcagcggcctgcagcaggaccccagccctgctggggccccccgcatcaccagcgtcatccccagccccccacctcctccacccctgcccccaccccagaggatcaccggccccaagcccctgcaggaccctgaggtgcagaagcacgccacccagatcctgaggaacatgctgcggcaggaggagaaggagctgcagaggatctgtgaggtgtacagcaggaacccagccagcctgctggaggagcagatcgagggcgccaggagaagagtgacccagctgcagctgaagatccagcaggagaccggcggctctgtggacatcctgcccctgtatggagacaccagccagaggcccagcgagggccgcctgagcctggacagccaggagggggacagcggcctggacagcggcacagagcgcttccccagcctgtctgagagcctgatgaacagaaacagcgtgctgagtgaccccggcctggacagccccaggaccagccctgtgatcatggcccgggtggcccagcaccaccggcggcagggcagtgatgctgctgtgcccagcactggagaccagggcgtggaccagagccccaagcccctcatcatcggccctgaggaggactatgaccccggctacttcaacaatgaaagtgacatcatcttccaggacctggagaagctgaagagcaggcctgcccacctgggcgtcttcctgcgctacatcttcagccaggccgaccccagccccctgctcttctacctgtgtgccgaggtgtaccagcaggccagccccaaggacagccgcagcctgggcaaggacatctggaacatcttcctggagaagaatgcccccctgcgggtgaagatccctgagatgctgcaggccgagattgacagccggctgaggaacagtgaagatgcccggggcgtgctgtgtgaggcccaggaggccgccatgcctgagatccaggagcagatccatgactaccgcaccaagaggaccctgggcctgggcagcctgtatggagaaaatgacctgctggacctggatggagaccccctgcgggagcggcaggtggccgagaagcagctggccgccctgggggacatcctgagcaaatatgaggaggacagaagtgcccccatggactttgccctgaacacctacatgagccatgctggcatccggctgcgggaggcccggcccagcaacacagctgagaaggcccagagcgccccagacaaggacaagtggctgcccttcttccccaagaccaagaagagcagcaacagcaagaaggagaaggatgccctggaggacaagaagaggaaccccatcctgaagtacatcggcaagcccaagagcagcagccagagcaccttccacatccccctgagccctgtggaggtgaagccaggaaatgtgaggaacatcatccagcactttgagaacaaccagcagtatgatgcccctgagcccggcacccagaggctgagcacaggcagcttccctgaggacctgctggagagtgacagcagccgctctgagatccggctgggccgctctgagagcctgaagggccgggaggagatgaagaggagcaggaaggccgagaatgtgcccaggagcagaagtgatgtggacatggatgctgctgctgaggccacccggctgcaccagagcgccagcagcagcaccagcagcctgagcaccaggagcctggagaaccccaccccacccttcacccccaagatgggcagaagaagcattgagagccccagcctgggcttctgcacagacaccctgctgccccacctgctggaggatgacctgggccagctgagtgacctggagcctgagccagatgcccagaactggcagcacacagtgggcaaggatgtggtggccggcctgacccagcgggagattgaccggcaggaggtgatcaatgagctgtttgtgacagaggccagccacctgcggaccctgcgggtgctggacctgatcttctaccagaggatgaagaaggagaacctgatgccccgggaggagctggcccggctcttccccaacctgcctgagctgattgagatccacaacagctggtgtgaggccatgaagaagctgcgggaggagggccccatcatcaaggagatcagtgacctgatgctggccaggtttgatggccctgcccgggaggagctgcagcaggtggccgcccagttctgcagctaccagagcatcgccctggagctgatcaagaccaagcagaggaaggagagccgcttccagctgttcatgcaggaggccgagagccacccccagtgccggcggctgcagctgcgggacctgatcatcagcgagatgcagaggctgaccaagtaccccctgctgctggagagcatcatcaagcacacagagggcggcaccagcgagcacgagaagctgtgccgggcccgggaccagtgccgggagatcctgaagtatgtgaatgaagctgtgaagcagacagagaacagacaccggctggagggctaccagaagaggctggatgccacagccctggagcgggccagcaaccccctggccgctgagttcaagagcctggacctgaccaccaggaagatgatccacgagggccccctgacctggaggatcagcaaggacaagaccctggacctgcacgtgctgctgctggaggacctgctggtgctgctgcagaagcaggatgagaagctgctgctgaagtgccacagcaagacagctgtgggcagcagtgacagcaagcagaccttcagccctgtgctgaagctgaatgctgtgctgatccgctctgtggccacagacaagagggccttcttcatcatctgcaccagcaagctgggccccccccagatctatgagctggtggccctgaccagcagtgacaagaacacctggatggagctgctggaggaggccgtgagaaatgccaccaggcaccctggagctgcccccatgcctgtgcaccccccacctcctggcccccgggagcccgcccagcagggccccacccccagccgggtggagctggatgacagtgatgtgttccatggagagcctgagcctgaggagctgcccggcggcaccggcagccagcagagggtgcagggcaagcaccaggtgctgctggaggaccctgagcaggagggcagcgctgaggaggaggagctgggcgtgctgccctgccccagcaccagcctggatggagagaacagaggcatccgcaccaggaaccccatccacctggccttccctggccccctcttcatggagggcctggccgacagcgccctggaggatgtggagaacctgcggcacctgatcctgtggagcctgctgcccggccacaccatggagacccaggccgcccaggagccagaagatgacctgacccccaccccatctgtcatctctgtgaccagccacccctgggaccccggcagccctggccaggcccctcctggaggagagggggacaacacccagctggccggcctggagggggagaggcctgagcaggaggacatgggcctgtgcagcctggagcacctgccccccaggaccagaaattctggcatctgggagagccctgagctggacaggaacctggctgaagatgccagcagcacagaggccgccggcggctacaaggtggtgaggaaggccgaggtggccggcagcaaggtggtgcctgccctgcctgagagcggccagagcgagcccggccccccagaggtggagggcggcaccaaggccactggaaactgcttctacgtgtccatgcccagcggccccccagacagcagcacagaccacagcgaggcccccatgagccccccccagcctgacagcctgcctgctggccagacagagccccagccccagctgcagggcggcaatgatgacccccggcggcccagccgcagcccccccagcctggccctgagagatgtgggcatgatcttccacaccatcgagcagctgaccctgaagctgaaccggctgaaggacatggagctggcccaccgggagctgctgaagagcctgggcggggagagcagcggcggcaccacccctgtgggcagcttccacacagaagctgcccgctggacagatggcagcctgagccccccagccaaggagcccctggccagtgacagcaggaacagccatgagctgggcccctgcccagaagatggcagtgatgcccccctggaggacagcacagcagatgctgctgccagccctggcccctag

SEQ ID NO: 37563 - DNA, 1743 bp, Artificial Sequence
  Description of Artificial Sequence: Synthetic coding sequence
atgagaggaggccacaagggcggccgctgtgcctgccccagggtcatcaggaaggtgctggccaagtgtggctgctgctttgcccggggcggccgggagagctacagcattgctggcagcgagggcagcatcagcgccagcgctgccagcggcctggccgcccccagcggccccagcagcggcctgagcagcggcccctgcagccctggccccccaggccctgtgtctggcctgcggcgctggctggaccacagcaagcactgcctgtctgtggagacagaagctgacagcggccaggccggcccctatgagaactggatgctggagcccgccctggccaccggggaggagctgcctgagctgaccctgctgaccaccctgctggagggccctggggacaagacccagcccccagaggaggagaccctgagccaggcccctgagagcgaggaggagcagaagaagaaggccctggagaggtccatgtatgtgctgtctgagctggtggagacagagaagatgtatgtggatgacctgggccagatcgtggagggctacatggccaccatggccgcccagggcgtgcctgagagcctgcggggccgggacagaattgtgtttggaaacatccagcagatctatgagtggcaccgggactacttcctgcaggagctgcagcgctgcctgaaggaccctgactggctggcccagctgttcatcaagcatgagcggcggctgcacatgtatgtggtgtactgccagaacaagcccaagtcagaacatgtggtgtctgaatttggagacagctactttgaggagctgcggcagcagctgggccaccggctgcagctgaatgacctgctgatcaagcctgtgcagaggatcatgaagtaccagctgctgctgaaggacttcctgaagtactacaacagagctggcatggacacagctgacctggagcaggccgtggaggtgatgtgctttgtgcccaagcgctgcaatgacatgatgaccctgggccgcctgcggggctttgagggcaagctgacagcccagggcaagctgctgggccaggacaccttctgggtgacagagcctgaggccggcggcctgctgagcagccggggccgggagaggagggtcttcctgtttgagcagatcatcatcttcagcgaggccctgggcggcggcgtgcggggcggcacccagcccggctacgtgtacaagaacagcatcaaggtgtcctgcctgggcctggagggcaacctgcagggcgacccctgccgctttgccctgaccagccggggccctgagggcggcatccagcgctacgtgctgcaggccgctgaccctgccatcagccaggcctggatcaagcacgtggcccagatcctggagagccagagggacttcctgaatgccctgcagagccccatcgagtaccagaggcgggagagccagaccaacagcctgggccggccccggggccctggggtgggcagccctggccgcatccagctgggggaccaggcccagggcagcacccacacccccatcaatggcagcctgcccagcctgctgctgagccccaagggggaggtggcccgggccctgctgcccctggacaagcaggccctgggggacatcccccaggcccctcatgacagcccccctgtgagccccacccccaagaccccaccctgccaggcccggctggccaagctggatgaagatgagctgtag

SEQ ID NO: 37564 - DNA, 921 bp, Artificial Sequence
  Description of Artificial Sequence: Synthetic coding sequence
atgaggagcagccctggcctgtgcagccccccacctgaggaggagaccctgagccaggcccctgagagcgaggaggagcagaagaagaaggccctggagaggtccatgtatgtgctgtctgagctggtggagacagagaagatgtatgtggatgacctgggccagatcgtggagggctacatggccaccatggccgcccagggcgtgcctgagagcctgcggggccgggacagaattgtgtttggaaacatccagcagatctatgagtggcaccgggactacttcctgcaggagctgcagcgctgcctgaaggaccctgactggctggcccagctgttcatcaagcatgagcggcggctgcacatgtatgtggtgtactgccagaacaagcccaagtcagaacatgtggtgtctgaatttggagacagctactttgaggagctgcggcagcagctgggccaccggctgcagctgaatgacctgctgatcaagcctgtgcagaggatcatgaagtaccagctgctgctgaaggacttcctgaagtactacaacagagctggcatggacacagctgacctggagggcaagctgacagcccagggcaagctgctgggccaggacaccttctgggtgacagagcctgaggccggcggcctgctgagcagccggggccgggagaggagggtcttcctgtttgagcagatcatcatcttcagcgaggccctgggcggcggcgtgcggggcggcacccagcccggctacgtgtacaagaacagcatgaggcaggtgttctgccagatgcaggagctgccccagctgtggcacatcagccgggtggactttgtgagaaatgccatcaccccccggctgcccccactcatcctgctggccagccctgccagcgccctgaaccagacctag

SEQ ID NO: 37565 - DNA, 1860 bp, Artificial Sequence
  Description of Artificial Sequence: Synthetic coding sequence
atgaagcccccagacaggcctgcccctggccgcacagaccgcatcctgggcgtgatgggcggcatgctgcgggcctgtgccctgcccggccaggagggccccccccggcgcagccccctgggcctggtgggcacagagcctgagagcgagaggacagaaggagaccacagaagagaccgggagcacgaggtgctggccggggccctgcagcctgagagctacagcattgctggcagcgagggcagcatcagcgccagcgctgccagcggcctggccgcccccagcggccccagcagcggcctgagcagcggcccctgcagccctggccccccaggccctgtgtctggcctgcggcgctggctggaccacagcaagcactgcctgtctgtggagacagaggccgacagcggccaggccggcccctatgagaactggatgctggagcccgccctggccactggagaggagctgcctgagctgaccctgctgaccaccctgctggagggccctggggacaagacccagcccccagaggaggagaccctgagccaggcccctgagagcgaggaggagcagaagaagaaggccctggagaggtccatgtatgtgctgtctgagctggtggagacagagaagatgtatgtggatgacctgggccagatcgtggagggctacatggccaccatggccgcccagggcgtgcctgagagcctgcggggccgggaccgcatcgtgtttggaaacatccagcagatctatgagtggcaccgggactacttcctgcaggagctgcagcgctgcctgaaggaccctgactggctggcccagctgttcatcaagcatgaaagaaggctgcacatgtatgtggtgtactgccagaacaagcccaagtctgagcacgtggtgtctgaatttggagacagctactttgaggagctgcggcagcagctgggccaccggctgcagctgaatgacctgctgatcaagcctgtgcagaggatcatgaagtaccagctgctgctgaaggacttcctgaagtactacaacagagctggcatggacacagctgacctggagcaggccgtggaggtgatgtgctttgtgcccaagcgctgcaatgacatgatgaccctgggccgcctgcggggctttgagggcaagctgacagcccagggcaagctgctgggccaggacaccttctgggtgacagagcctgaggccggcggcctgctgagcagccggggccgggagcggcgggtcttcctgtttgagcagatcatcatcttcagcgaggccctgggcggcggcgtgcggggcggcacccagcccggctacgtgtacaagaacagcatcaaggtgtcctgcctgggcctggagggcaacctgcagggcgacccctgccgctttgccctgaccagccggggccctgagggcggcatccagagatatgtgctgcaggccgctgaccctgccatcagccaggcctggatcaagcacgtggcccagatcctggagagccagagggacttcctgaatgccctgcagagccccatcgagtaccagaggcgggagagccagaccaacagcctgggccggccccggggccctggggtgggcagccctggccgcatccagctgggggaccaggcccagggcagcacccacacccccatcaatggcagcctgcccagcctgctgctgagccccaagggggaggtggcccgggccctgctgcccctggacaagcaggccctgggggacatcccccaggcccctcatgacagcccccctgtgagccccacccccaagaccccaccctgccaggcccggctggccaagctggatgaagatgagctgtag

SEQ ID NO: 37566 - DNA, 5064 bp, Artificial Sequence
  Description of Artificial Sequence: Synthetic coding sequence
atggagctgagctgcagcgaggcccccctgtatggccagatgatgatctatgccaagtttgacaagaatgtgtacctgcctgaagatgctgagttctacttcacctatgatggcagccaccagagacatgtgatgattgctgagagaattgaagataatgtgctgcagagctctgtgcccggccacggcctgcaggagaccgtgacagtgtctgtgtgcctgtgcagcgagggctacagccctgtgaccatgggcagcggctctgtgacctacgtggacaacatggcctgccgcctggcccggctgctggtgacccaggccaaccggctgacagcctgcagccaccagaccctgctgaccccatttgccctgacagctggggccctgcctgccctggatgaggagctggtgctggccctgacccacctggagctgcccctggagtggacagtgctgggcagcagcagcctggaggtgagcagccaccgggagagcctgctgcacctggccatgcgctggggcctggccaagctgagccagttcttcctgtgcctgcccggcggcgtgcaggccctggccctgcccaatgaggagggcgccacccccctggacctggccctgcgggagggccacagcaagctggtggaggatgtgaccaacttccagggccgctggagccccagcttcagccgggtgcagctgtctgaggaggccagcctgcactacatccacagcagcgagaccctgaccctgaccctgaaccacacagctgagcacctgctggaggccgacatcaagctgttcaggaagtacttctgggaccgggccttcctggtgaaggcctttgagcctgaggcccggcctgaggagaggacagccatgcccagcagtggagctgagacagaggaggagatcaagaacagcgtgagcagccgctctgctgctgagaaggaggacatcaagagggtgaagagcctggtggtgcagcacaatgaacatgaggaccagcacagcctggacctggacaggagctttgacatcctgaagaagagcaagccacccagcaccctgctggccgccggccgcctgagtgacatgctgaatggaggagatgaggtgtatgccaactgcatggtgattgaccaggtgggggacctggacatctcctacatcaacatcgagggcatcacagccaccaccagccctgagagccggggctgcaccctgtggccccagagcagcaagcacaccctgcccacagagaccagccccagcgtgtaccccctgtctgaaaatgtggagggcacagcccacacagaggcccagcagagcttcatgagccccagcagcagctgtgccagcaacctgaacctgagctttggctggcacggctttgagaaggagcagagccacctgaagaagaggagcagcagcctggatgccctggatgctgacagcgagggggagggccacagcgagcccagccacatctgctacaccccaggcagccagagcagcagcaggacaggcatccccagcggagatgagctggacagctttgagaccaacacagagccagacttcaacatcagcagagctgagagcctgcccctgagcagcaacctgcagagcaaggagagcctgctgagcggcgtgcgcagccgcagctacagctgcagcagccccaagatcagcctgggcaagacccggctggtgcgggagctgactgtgtgcagcagcagcgaggagcagagggcctacagcctgtctgagcccccaagagaaaatcgcatccaggaggaggagtgggacaagtacatcatcccagccaagtctgagagcgagaagtacaaggtgtccaggaccttctccttcctgatgaacaggatgaccagccccaggaacaagagcaagaccaagagcaaggatgccaaggacaaggagaagctgaacagacaccagtttgcccctggcaccttctctggagtgctgcagtgcctggtgtgtgacaagaccctgctgggcaaggagagcctgcagtgcagcaactgcaatgccaacgtgcacaagggctgcaaggatgctgccccagcctgcaccaagaagttccaggagaagtacaacaagaacaagccccagaccatcctgggcaacagcagcttccgggacatcccccagcccggcctgagcctgcaccccagcagctctgtgcctgtgggcctgcccactggaagaagagagaccgtgggccaggtgcaccccctgagccgctctgtgcccggcaccaccctggagagcttccgccgcagcgccaccagcctggagagcgagagtgaccacaacagctgccgcagccgcagccacagtgatgagctgctgcagagcatgggcagcagccccagcacagagagcttcatcatggaggatgtggtggacagcagcctgtggagcgacctgagcagtgatgcccaggagtttgaggccgagagctggagcctggtggtggaccccagcttctgcaaccggcaggagaaggatgtgatcaagaggcaggacgtcatctttgagctgatgcagacagagatgcaccacatccagaccctcttcatcatgtctgagatcttcaggaagggcatgaaggaggagctgcagctggaccacagcacagtggacaagatcttcccctgcctggatgagctgctggagatccaccgccacttcttctacagcatgaaggagcggcggcaggagagctgtgccggcagtgacaggaacttcgtcatcgacagaattggagacatcctggtgcagcagttcagcgaggagaatgccagcaagatgaagaagatctatggagagttctgctgccaccacaaggaggccgtgaacctcttcaaggagctgcagcagaacaagaagttccagaacttcatcaagctgaggaacagcaacctgctggccaggagaagaggcatccctgagtgcatcctgctggtgacccagaggatcaccaagtaccctgtgctggtggagcgcatcctgcagtacaccaaggagaggacagaggagcacaaggacctgaggaaggccctgtgcctgatcaaggacatgattgccaccgtggacctgaaggtgaatgaatatgagaagaaccagaagtggctggagatcctgaacaagattgagaacaagacctacaccaagctgaagaatggacatgtgttcaggaagcaggccctgatgtctgaggagaggaccctgctgtatgatggcctggtgtactggaagacagccaccggccgcttcaaggacatcctggccctgctgctgacagatgtgctgctcttcctgcaggagaaggaccagaagtacatctttgctgctgtggaccagaagcccagcgtcatcagcctgcagaagctgattgcccgggaggtggccaatgaggagcggggcatgttcctgatcagcgccagcagcgctggccctgagatgtatgagatccacaccaacagcaaggaggagaggaacaactggatgaggcgcatccagcaggccgtggagagctgcccagaggagaagggcggccgcaccagcgagagtgatgaggacaagaggaaggccgaggcccgggtggccaagatccagcagtgccaggagatcctgaccaaccaggaccagcagatctgtgcctacctggaggagaagctgcacatctatgcagagctgggggagctgagcggctttgaagatgtgcacctggagccccacctgctgatcaagccagaccccggggagcccccccaggccgccagcctgctggccgccgccctgaaggaggccctggtgactggaggccgggagggccggggctgcagtgatgtggaccccggcatccagggcgtggtgacagacctggccgtgtctgatgctggggagaaggtggagtgcaggaacttccctggcagcagccagagcgagatcatccaggccatccagaacctgacccggctgctgtacagcctgcaggccgccctgaccatccaggacagccacatcgagatccaccggctggtgctgcagcagcaggagggcctgagcctgggccacagcatcctgcggggcggccccctgcaggaccagaagagcagagatgctgaccggcagcacgaggagctggccaacgtgcaccagctgcagcaccagctgcagcaggagcagaggcgctggctgcggcgctgtgagcagcagcagagggcccaggccacccgggagagctggctgcaggagcgggagcgggagtgccagagccaggaggagctgctgctgcggagcagaggagagctggacctgcagctgcaggagtaccagcacagcctggagcggctgcgggagggccagaggctggtggagcgggagcaggccaggatgagggcccagcagagcctgctgggccactggaagcacggccggcagaggagcctgcctgctgtgctgctgcccggcggccctgaggtgatggagctgaacagaagtgagagcctgtgccacgagaacagcttcttcatcaatgaggccctggtgcagatgtccttcaacaccttcaacaagctgaaccccagcgtcatccaccaggatgccacctaccccaccacccagagccacagcgacctggtgaggaccagcgagcaccaggtggacctgaaggtggaccccagccagcccagcaatgtgagccacaagctgtggacagctgctggcagcggccaccagatcctgcccttccacgagagcagcaaggacagctgcaagaatggcagctccatgaccaagtgcagctgcaccctgaccagccccccaggcctgtggacaggcaccaccagcaccctgaaggacctggacaccagccacacagagagccccacccctcatgacagcaacagccaccggccccagctgcaggccttcatcacagaggccaagctgaacctgcccaccaggaccatgacccggcaggatggagaaacaggagatggagccaaggagaacatcgtgtacctgtag

SEQ ID NO: 37567 - DNA, 4956 bp, Artificial Sequence
  Description of Artificial Sequence: Synthetic coding sequence
atggagctgagctgcagcgaggcccccctgtatggccagatgatgatctatgccaagtttgacaagaatgtgtacctgcctgaagatgctgagttctacttcacctatgatggcagccaccagagacatgtgatgattgctgagagaattgaagataatgtgctgcagagctctgtgcccggccacggcctgcaggagaccgtgacagtgtctgtgtgcctgtgcagcgagggctacagccctgtgaccatgggcagcggctctgtgacctacgtggacaacatggcctgccgcctggcccggctgctggtgacccaggccaaccggctgacagcctgcagccaccagaccctgctgaccccatttgccctgacagctggggccctgcctgccctggatgaggagctggtgctggccctgacccacctggagctgcccctggagtggacagtgctgggcagcagcagcctggaggtgagcagccaccgggagagcctgctgcacctggccatgcgctggggcctggccaagctgagccagttcttcctgtgcctgcccggcggcgtgcaggccctggccctgcccaatgaggagggcgccacccccctggacctggccctgcgggagggccacagcaagctggtggaggatgtgaccaacttccagggccgctggagccccagcttcagccgggtgcagctgtctgaggaggccagcctgcactacatccacagcagcgagaccctgaccctgaccctgaaccacacagctgagcacctgctggaggccgacatcaagctgttcaggaagtacttctgggaccgggccttcctggtgaaggcctttgagcctgaggcccggcctgaggagaggacagccatgcccagcagtggagctgagacagaggaggagatcaagaacagcgtgagcagccgctctgctgctgagaaggaggacatcaagagggtgaagagcctggtggtgcagcacaatgaacatgaggaccagcacagcctggacctggacaggagctttgacatcctgaagaagagcaagccacccagcaccctgctggccgccggccgcctgagtgacatgctgaatggaggagatgaggtgtatgccaactgcatggtgattgaccaggtgggggacctggacatctcctacatcaacatcgagggcatcacagccaccaccagccctgagagccggggctgcaccctgtggccccagagcagcaagcacaccctgcccacagagaccagccccagcgtgtaccccctgtctgaaaatgtggagggcacagcccacacagaggcccagcagagcttcatgagccccagcagcagctgtgccagcaacctgaacctgagctttggctggcacggctttgagaaggagcagagccacctgaagaagaggagcagcagcctggatgccctggatgctgacagcgagggggagggccacagcgagcccagccacatctgctacaccccaggcagccagagcagcagcaggacaggcatccccagcggagatgagctggacagctttgagaccaacacagagccagacttcaacatcagcagagctgagagcctgcccctgagcagcaacctgcagagcaaggagagcctgctgagcggcgtgcgcagccgcagctacagctgcagcagccccaagatcagcctgggcaagacccggctggtgcgggagctgactgtgtgcagcagcagcgaggagcagagggcctacagcctgtctgagcccccaagagaaaatcgcatccaggaggaggagtgggacaagtacatcatcccagccaagtctgagagcgagaagtacaaggtgtccaggaccttctccttcctgatgaacaggatgaccagccccaggaacaagagcaagaccaagagcaaggatgccaaggacaaggagaagctgaacagacaccagtttgcccctggcaccttctctggagtgctgcagtgcctggtgtgtgacaagaccctgctgggcaaggagagcctgcagtgcagcaactgcaatgccaacgtgcacaagggctgcaaggatgctgccccagcctgcaccaagaagttccaggagaagtacaacaagaacaagccccagaccatcctgggcaacagcagcttccgggacatcccccagcccggcctgagcctgcaccccagcagctctgtgcctgtgggcctgcccactggaagaagagagaccgtgggccaggtgcaccccctgagccgctctgtgcccggcaccaccctggagagcttccgccgcagcgccaccagcctggagagcgagagtgaccacaacagctgccgcagccgcagccacagtgatgagctgctgcagagcatgggcagcagccccagcacagagagcttcatcatggaggatgtggtggacagcagcctgtggagcgacctgagcagtgatgcccaggagtttgaggccgagagctggagcctggtggtggaccccagcttctgcaaccggcaggagaaggatgtgatcaagaggcaggacgtcatctttgagctgatgcagacagagatgcaccacatccagaccctcttcatcatgtctgagatcttcaggaagggcatgaaggaggagctgcagctggaccacagcacagtggacaagatcttcccctgcctggatgagctgctggagatccaccgccacttcttctacagcatgaaggagcggcggcaggagagctgtgccggcagtgacaggaacttcgtcatcgacagaattggagacatcctggtgcagcagttcagcgaggagaatgccagcaagatgaagaagatctatggagagttctgctgccaccacaaggaggccgtgaacctcttcaaggagctgcagcagaacaagaagttccagaacttcatcaagctgaggaacagcaacctgctggccaggagaagaggcatccctgagtgcatcctgctggtgacccagaggatcaccaagtaccctgtgctggtggagcgcatcctgcagtacaccaaggagaggacagaggagcacaaggacctgaggaaggccctgtgcctgatcaaggacatgattgccaccgtggacctgaaggtgaatgaatatgagaagaaccagaagtggctggagatcctgaacaagattgagaacaagacctacaccaagctgaagaatggacatgtgttcaggaagcaggccctgatgtctgaggagaggaccctgctgtatgatggcctggtgtactggaagacagccaccggccgcttcaaggacatcctggccctgctgctgacagatgtgctgctcttcctgcaggagaaggaccagaagtacatctttgctgctgtggaccagaagcccagcgtcatcagcctgcagaagctgattgcccgggaggtggccaatgaggagcggggcatgttcctgatcagcgccagcagcgctggccctgagatgtatgagatccacaccaacagcaaggaggagaggaacaactggatgaggcgcatccagcaggccgtggagagctgcccagaggagaagggcggccgcaccagcgagagtgatgaggacaagaggaaggccgaggcccgggtggccaagatccagcagtgccaggagatcctgaccaaccaggaccagcagatctgtgcctacctggaggagaagctgcacatctatgcagagctgggggagctgagcggctttgaagatgtgcacctggagccccacctgctgatcaagccagaccccggggagcccccccaggccgccagcctgctggccgccgccctgaaggaggccgagagcctgcaggtggccgtgaaggccagccagatgggcgctgtgtcccagagctgtgaggacagctgtggggacagcgtgctggccgacaccctgagcagccatgatgtgcccggcagccccacagccagcctggtgactggaggccgggagggccggggctgcagtgatgtggaccccggcatccagggcgtggtgacagacctggccgtgtctgatgctggggagaaggtggagtgcaggaacttccctggcagcagccagagcgagatcatccaggccatccagaacctgacccggctgctgtacagcctgcaggccgccctgaccatccaggacagccacatcgagatccaccggctggtgctgcagcagcaggagggcctgagcctgggccacagcatcctgcggggcggccccctgcaggaccagaagagcagagatgctgaccggcagcacgaggagctggccaacgtgcaccagctgcagcaccagctgcagcaggagcagaggcgctggctgcggcgctgtgagcagcagcagagggcccaggccacccgggagagctggctgcaggagcgggagcgggagtgccagagccaggaggagctgctgctgcggagcagaggagagctggacctgcagctgcaggagtaccagcacagcctggagcggctgcgggagggccagaggctggtggagcgggagcaggccaggatgagggcccagcagagcctgctgggccactggaagcacggccggcagaggagcctgcctgctgtgctgctgcccggcggccctgaggtgatggagctgaacagaagtgagagcctgtgccacgagaacagcttcttcatcaatgaggccctggtgcagatgtccttcaacaccttcaacaagctgaaccccagcgtcatccaccaggatgccacctaccccaccacccagagccacagcgacctggtgaggaccagcgagcaccaggtggacctgaaggtggaccccagccagcccagcaatgtgagccacaagctgtggacagctgctggcagcggccaccagatcctgcccttccacgagagcagcaaggacagctgcaagaatggaaattag

SEQ ID NO: 37568 - DNA, 5118 bp, Artificial Sequence
  Description of Artificial Sequence: Synthetic coding sequence
atggagctgagctgcagcgaggcccccctgtatggccagatgatgatctatgccaagtttgacaagaatgtgtacctgcctgaagatgctgagttctacttcacctatgatggcagccaccagagacatgtgatgattgctgagagaattgaagataatgtgctgcagagctctgtgcccggccacggcctgcaggagaccgtgacagtgtctgtgtgcctgtgcagcgagggctacagccctgtgaccatgggcagcggctctgtgacctacgtggacaacatggcctgccgcctggcccggctgctggtgacccaggccaaccggctgacagcctgcagccaccagaccctgctgaccccatttgccctgacagctggggccctgcctgccctggatgaggagctggtgctggccctgacccacctggagctgcccctggagtggacagtgctgggcagcagcagcctggaggtgagcagccaccgggagagcctgctgcacctggccatgcgctggggcctggccaagctgagccagttcttcctgtgcctgcccggcggcgtgcaggccctggccctgcccaatgaggagggcgccacccccctggacctggccctgcgggagggccacagcaagctggtggaggatgtgaccaacttccagggccgctggagccccagcttcagccgggtgcagctgtctgaggaggccagcctgcactacatccacagcagcgagaccctgaccctgaccctgaaccacacagctgagcacctgctggaggccgacatcaagctgttcaggaagtacttctgggaccgggccttcctggtgaaggcctttgagcctgaggcccggcctgaggagaggacagccatgcccagcagtggagctgagacagaggaggagatcaagaacagcgtgagcagccgctctgctgctgagaaggaggacatcaagagggtgaagagcctggtggtgcagcacaatgaacatgaggaccagcacagcctggacctggacaggagctttgacatcctgaagaagagcaagccacccagcaccctgctggccgccggccgcctgagtgacatgctgaatggaggagatgaggtgtatgccaactgcatggtgattgaccaggtgggggacctggacatctcctacatcaacatcgagggcatcacagccaccaccagccctgagagccggggctgcaccctgtggccccagagcagcaagcacaccctgcccacagagaccagccccagcgtgtaccccctgtctgaaaatgtggagggcacagcccacacagaggcccagcagagcttcatgagccccagcagcagctgtgccagcaacctgaacctgagctttggctggcacggctttgagaaggagcagagccacctgaagaagaggagcagcagcctggatgccctggatgctgacagcgagggggagggccacagcgagcccagccacatctgctacaccccaggcagccagagcagcagcaggacaggcatccccagcggagatgagctggacagctttgagaccaacacagagccagacttcaacatcagcagagctgagagcctgcccctgagcagcaacctgcagagcaaggagagcctgctgagcggcgtgcgcagccgcagctacagctgcagcagccccaagatcagcctgggcaagacccggctggtgcgggagctgactgtgtgcagcagcagcgaggagcagagggcctacagcctgtctgagcccccaagagaaaatcgcatccaggaggaggagtgggacaagtacatcatcccagccaagtctgagagcgagaagtacaaggtgtccaggaccttctccttcctgatgaacaggatgaccagccccaggaacaagagcaagaccaagagcaaggatgccaaggacaaggagaagctgaacagacaccagtttgcccctggcaccttctctggagtgctgcagtgcctggtgtgtgacaagaccctgctgggcaaggagagcctgcagtgcagcaactgcaatgccaacgtgcacaagggctgcaaggatgctgccccagcctgcaccaagaagttccaggagaagtacaacaagaacaagccccagaccatcctgggcaacagcagcttccgggacatcccccagcccggcctgagcctgcaccccagcagctctgtgcctgtgggcctgcccactggaagaagagagaccgtgggccaggtgcaccccctgagccgctctgtgcccggcaccaccctggagagcttccgccgcagcgccaccagcctggagagcgagagtgaccacaacagctgccgcagccgcagccacagtgatgagctgctgcagagcatgggcagcagccccagcacagagagcttcatcatggaggatgtggtggacagcagcctgtggagcgacctgagcagtgatgcccaggagtttgaggccgagagctggagcctggtggtggaccccagcttctgcaaccggcaggagaaggatgtgatcaagaggcaggacgtcatctttgagctgatgcagacagagatgcaccacatccagaccctcttcatcatgtctgagatcttcaggaagggcatgaaggaggagctgcagctggaccacagcacagtggacaagatcttcccctgcctggatgagctgctggagatccaccgccacttcttctacagcatgaaggagcggcggcaggagagctgtgccggcagtgacaggaacttcgtcatcgacagaattggagacatcctggtgcagcagttcagcgaggagaatgccagcaagatgaagaagatctatggagagttctgctgccaccacaaggaggccgtgaacctcttcaaggagctgcagcagaacaagaagttccagaacttcatcaagctgaggaacagcaacctgctggccaggagaagaggcatccctgagtgcatcctgctggtgacccagaggatcaccaagtaccctgtgctggtggagcgcatcctgcagtacaccaaggagaggacagaggagcacaaggacctgaggaaggccctgtgcctgatcaaggacatgattgccaccgtggacctgaaggtgaatgaatatgagaagaaccagaagtggctggagatcctgaacaagattgagaacaagacctacaccaagctgaagaatggacatgtgttcaggaagcaggccctgatgtctgaggagaggaccctgctgtatgatggcctggtgtactggaagacagccaccggccgcttcaaggacatcctggccctgctgctgacagatgtgctgctcttcctgcaggagaaggaccagaagtacatctttgctgctgtggaccagaagcccagcgtcatcagcctgcagaagctgattgcccgggaggtggccaatgaggagcggggcatgttcctgatcagcgccagcagcgctggccctgagatgtatgagatccacaccaacagcaaggaggagaggaacaactggatgaggcgcatccagcaggccgtggagagctgcccagaggagaagggcggccgcaccagcgagagtgatgaggacaagaggaaggccgaggcccgggtggccaagatccagcagtgccaggagatcctgaccaaccaggaccagcagatctgtgcctacctggaggagaagctgcacatctatgcagagctgggggagctgagcggctttgaagatgtgcacctggagccccacctgctgatcaagccagaccccggggagcccccccaggccgccagcctgctggccgccgccctgaaggaggccgagagcctgcaggtggccgtgaaggccagccagatgggcgctgtgtcccagagctgtgaggacagctgtggggacagcgtgctggccgacaccctgagcagccatgatgtgcccggcagccccacagccagcctggtgactggaggccgggagggccggggctgcagtgatgtggaccccggcatccagggcgtggtgacagacctggccgtgtctgatgctggggagaaggtggagtgcaggaacttccctggcagcagccagagcgagatcatccaggccatccagaacctgacccggctgctgtacagcctgcaggccgccctgaccatccaggacagccacatcgagatccaccggctggtgctgcagcagcaggagggcctgagcctgggccacagcatcctgcggggcggccccctgcaggaccagaagagcagagatgctgaccggcagcacgaggagctggccaacgtgcaccagctgcagcaccagctgcagcaggagcagaggcgctggctgcggcgctgtgagcagcagcagagggcccaggccacccgggagagctggctgcaggagcgggagcgggagtgccagagccaggaggagctgctgctgcggagcagaggagagctggacctgcagctgcaggagtaccagcacagcctggagcggctgcgggagggccagaggctggtggagcgggagcaggccaggatgagggcccagcagagcctgctgggccactggaagcacggccggcagaggagcctgcctgctgtgctgctgcccggcggccctgaggtgatggagctgaacagaagtgagagcctgtgccacgagaacagcttcttcatcaatgaggccctggtgcagatgtccttcaacaccttcaacaagctgaaccccagcgtcatccaccaggatgccacctaccccaccacccagagccacagcgacctggtgaggaccagcgagcaccaggtggacctgaaggtggaccccagccagcccagcaatgtgagccacaagctgtggacagctgctggcagcggccaccagatcctgcccttccacgagagcagcaaggacagctgcaagaatgacctggacaccagccacacagagagccccacccctcatgacagcaacagccaccggccccagctgcaggccttcatcacagaggccaagctgaacctgcccaccaggaccatgacccggcaggatggagaaacaggagatggagccaaggagaacatcgtgtacctgtag

SEQ ID NO: 37569 - DNA, 252 bp, Artificial Sequence
  Description of Artificial Sequence: Synthetic coding sequence
atggagctgagctgcagcgaggcccccctgtatggccagatgatgatctatgccaagtttgacaagaatgtgtacctgcctgaagatgctgagttctacttcacctatgatggcagccaccagagacatgtgatgattgctgagagaattgaagataatgtgctgcagagctctgtgcccggccacggcctgcaggagaccgtgacagtgtctgtgtgcctgtgcagcgagggctacagccctgtgacctag

SEQ ID NO: 37570 - DNA, 5118 bp, Artificial Sequence; identical to SEQ ID NO: 37568
  Description of Artificial Sequence: Synthetic coding sequence

SEQ ID NO: 37571 - DNA, 5196 bp, Artificial Sequence
  Description of Artificial Sequence: Synthetic coding sequence
atggagctgagctgcagcgaggcccccctgtatggccagatgatgatctatgccaagtttgacaagaatgtgtacctgcctgaagatgctgagttctacttcacctatgatggcagccaccagagacatgtgatgattgctgagagaattgaagataatgtgctgcagagctctgtgcccggccacggcctgcaggagaccgtgacagtgtctgtgtgcctgtgcagcgagggctacagccctgtgaccatgggcagcggctctgtgacctacgtggacaacatggcctgccgcctggcccggctgctggtgacccaggccaaccggctgacagcctgcagccaccagaccctgctgaccccatttgccctgacagctggggccctgcctgccctggatgaggagctggtgctggccctgacccacctggagctgcccctggagtggacagtgctgggcagcagcagcctggaggtgagcagccaccgggagagcctgctgcacctggccatgcgctggggcctggccaagctgagccagttcttcctgtgcctgcccggcggcgtgcaggccctggccctgcccaatgaggagggcgccacccccctggacctggccctgcgggagggccacagcaagctggtggaggatgtgaccaacttccagggccgctggagccccagcttcagccgggtgcagctgtctgaggaggccagcctgcactacatccacagcagcgagaccctgaccctgaccctgaaccacacagctgagcacctgctggaggccgacatcaagctgttcaggaagtacttctgggaccgggccttcctggtgaaggcctttgagcctgaggcccggcctgaggagaggacagccatgcccagcagtggagctgagacagaggaggagatcaagaacagcgtgagcagccgctctgctgctgagaaggaggacatcaagagggtgaagagcctggtggtgcagcacaatgaacatgaggaccagcacagcctggacctggacaggagctttgacatcctgaagaagagcaagccacccagcaccctgctggccgccggccgcctgagtgacatgctgaatggaggagatgaggtgtatgccaactgcatggtgattgaccaggtgggggacctggacatctcctacatcaacatcgagggcatcacagccaccaccagccctgagagccggggctgcaccctgtggccccagagcagcaagcacaccctgcccacagagaccagccccagcgtgtaccccctgtctgaaaatgtggagggcacagcccacacagaggcccagcagagcttcatgagccccagcagcagctgtgccagcaacctgaacctgagctttggctggcacggctttgagaaggagcagagccacctgaagaagaggagcagcagcctggatgccctggatgctgacagcgagggggagggccacagcgagcccagccacatctgctacaccccaggcagccagagcagcagcaggacaggcatccccagcggagatgagctggacagctttgagaccaacacagagccagacttcaacatcagcagagctgagagcctgcccctgagcagcaacctgcagagcaaggagagcctgctgagcggcgtgcgcagccgcagctacagctgcagcagccccaagatcagcctgggcaagacccggctggtgcgggagctgactgtgtgcagcagcagcgaggagcagagggcctacagcctgtctgagcccccaagagaaaatcgcatccaggaggaggagtgggacaagtacatcatcccagccaagtctgagagcgagaagtacaaggtgtccaggaccttctccttcctgatgaacaggatgaccagccccaggaacaagagcaagaccaagagcaaggatgccaaggacaaggagaagctgaacagacaccagtttgcccctggcaccttctctggagtgctgcagtgcctggtgtgtgacaagaccctgctgggcaaggagagcctgcagtgcagcaactgcaatgccaacgtgcacaagggctgcaaggatgctgccccagcctgcaccaagaagttccaggagaagtacaacaagaacaagccccagaccatcctgggcaacagcagcttccgggacatcccccagcccggcctgagcctgcaccccagcagctctgtgcctgtgggcctgcccactggaagaagagagaccgtgggccaggtgcaccccctgagccgctctgtgcccggcaccaccctggagagcttccgccgcagcgccaccagcctggagagcgagagtgaccacaacagctgccgcagccgcagccacagtgatgagctgctgcagagcatgggcagcagccccagcacagagagcttcatcatggaggatgtggtggacagcagcctgtggagcgacctgagcagtgatgcccaggagtttgaggccgagagctggagcctggtggtggaccccagcttctgcaaccggcaggagaaggatgtgatcaagaggcaggacgtcatctttgagctgatgcagacagagatgcaccacatccagaccctcttcatcatgtctgagatcttcaggaagggcatgaaggaggagctgcagctggaccacagcacagtggacaagatcttcccctgcctggatgagctgctggagatccaccgccacttcttctacagcatgaaggagcggcggcaggagagctgtgccggcagtgacaggaacttcgtcatcgacagaattggagacatcctggtgcagcagttcagcgaggagaatgccagcaagatgaagaagatctatggagagttctgctgccaccacaaggaggccgtgaacctcttcaaggagctgcagcagaacaagaagttccagaacttcatcaagctgaggaacagcaacctgctggccaggagaagaggcatccctgagtgcatcctgctggtgacccagaggatcaccaagtaccctgtgctggtggagcgcatcctgcagtacaccaaggagaggacagaggagcacaaggacctgaggaaggccctgtgcctgatcaaggacatgattgccaccgtggacctgaaggtgaatgaatatgagaagaaccagaagtggctggagatcctgaacaagattgagaacaagacctacaccaagctgaagaatggacatgtgttcaggaagcaggccctgatgtctgaggagaggaccctgctgtatgatggcctggtgtactggaagacagccaccggccgcttcaaggacatcctggccctgctgctgacagatgtgctgctcttcctgcaggagaaggaccagaagtacatctttgctgctgtggaccagaagcccagcgtcatcagcctgcagaagctgattgcccgggaggtggccaatgaggagcggggcatgttcctgatcagcgccagcagcgctggccctgagatgtatgagatccacaccaacagcaaggaggagaggaacaactggatgaggcgcatccagcaggccgtggagagctgcccagaggagaagggcggccgcaccagcgagagtgatgaggacaagaggaaggccgaggcccgggtggccaagatccagcagtgccaggagatcctgaccaaccaggaccagcagatctgtgcctacctggaggagaagctgcacatctatgcagagctgggggagctgagcggctttgaagatgtgcacctggagccccacctgctgatcaagccagaccccggggagcccccccaggccgccagcctgctggccgccgccctgaaggaggccgagagcctgcaggtggccgtgaaggccagccagatgggcgctgtgtcccagagctgtgaggacagctgtggggacagcgtgctggccgacaccctgagcagccatgatgtgcccggcagccccacagccagcctggtgactggaggccgggagggccggggctgcagtgatgtggaccccggcatccagggcgtggtgacagacctggccgtgtctgatgctggggagaaggtggagtgcaggaacttccctggcagcagccagagcgagatcatccaggccatccagaacctgacccggctgctgtacagcctgcaggccgccctgaccatccaggacagccacatcgagatccaccggctggtgctgcagcagcaggagggcctgagcctgggccacagcatcctgcggggcggccccctgcaggaccagaagagcagagatgctgaccggcagcacgaggagctggccaacgtgcaccagctgcagcaccagctgcagcaggagcagaggcgctggctgcggcgctgtgagcagcagcagagggcccaggccacccgggagagctggctgcaggagcgggagcgggagtgccagagccaggaggagctgctgctgcggagcagaggagagctggacctgcagctgcaggagtaccagcacagcctggagcggctgcgggagggccagaggctggtggagcgggagcaggccaggatgagggcccagcagagcctgctgggccactggaagcacggccggcagaggagcctgcctgctgtgctgctgcccggcggccctgaggtgatggagctgaacagaagtgagagcctgtgccacgagaacagcttcttcatcaatgaggccctggtgcagatgtccttcaacaccttcaacaagctgaaccccagcgtcatccaccaggatgccacctaccccaccacccagagccacagcgacctggtgaggaccagcgagcaccaggtggacctgaaggtggaccccagccagcccagcaatgtgagccacaagctgtggacagctgctggcagcggccaccagatcctgcccttccacgagagcagcaaggacagctgcaagaatggcagctccatgaccaagtgcagctgcaccctgaccagccccccaggcctgtggacaggcaccaccagcaccctgaaggacctggacaccagccacacagagagccccacccctcatgacagcaacagccaccggccccagctgcaggccttcatcacagaggccaagctgaacctgcccaccaggaccatgacccggcaggatggagaaacaggagatggagccaaggagaacatcgtgtacctgtag

SEQ ID NO: 37572 - DNA, 948 bp, Artificial Sequence
  Description of Artificial Sequence: Synthetic coding sequence
atgcagaggaggagccggggcatcaacacaggcctcatcctgctgctgagccagatcttccacgtgggcatcaacaacatcccccctgtgaccctggccaccctggccctgaacatctggttcttcctgaacccccagaagcccctgtacagcagctgcctgtctgtggagaagtgctaccagcagaaggactggcagaggctgctgctgagccccctgcaccacgcagatgactggcacctgtacttcaacatggcctccatgctgtggaagggcatcaacctggagcggcggctgggcagccgctggtttgcctacgtgatcacagccttctctgtgctgactggagtggtgtacctgctgctgcagtttgctgtggccgagttcatggatgagccagacttcaagaggagctgtgctgtgggcttcagcggcgtgctgtttgccctgaaggtgctgaacaaccactactgccctgggggctttgtgaacatcctgggcttccctgtgcccaacagatttgcctgctgggtggagctggtggccatccacctgttcagccctggcaccagctttgctggccacctggccggcatcctggtgggcctgatgtacacccagggccccctgaagaagatcatggaggcctgtgccggcggcttcagcagctctgtgggctacccaggccggcagtactacttcaacagcagcggcagcagcggctaccaggactactacccccacggccgcccagaccactatgaggaggcccccagaaattatgacacctacacagctggcctgtctgaggaggagcagctggagcgggccctgcaggccagcctgtgggaccggggcaacaccaggaacagccccccaccctacggcttccacctgagccctgaggagatgaggcggcagaggctgcacagatttgacagccagtag

SEQ ID NO: 37573 - DNA, 948 bp, Artificial Sequence; identical to SEQ ID NO: 37572
  Description of Artificial Sequence: Synthetic coding sequence

SEQ ID NO: 37574 - DNA, 456 bp, Artificial Sequence
  Description of Artificial Sequence: Synthetic coding sequence
atgcagaggaggagccggggcatcaacacaggcctcatcctgctgctgagccagatcttccacgtgggcatcaacaacatcccccctgtgaccctggccaccctggccctgaacatctggttcttcctgaacccccagaagcccctgtacagcagctgcctgtctgtggagaagtgctaccagcagaaggactggcagaggctgctgctgagccccctgcaccacgcagatgactggcacctgtacttcaacatggcctccatgctgtggaagggcatcaacctggagcggcggctgggcagccgctggtttgcctacgtgatcacagccttctctgtgctgactggagtggtgtacctgctgctgcagtttgctgtggccgagttcatggatgagccagacttcaagaggagctgtgctgtgggcttcagcggcgtgctgtttgccctgaagtag

SEQ ID NO: 37575 - DNA, 405 bp, Artificial Sequence
  Description of Artificial Sequence: Synthetic coding sequence
atgcagaggaggagccggggcatcaacacaggcctcatcctgctgctgagccagatcttccacgtgggcatcaacaacatcccccctgtgaccctggccaccctggccctgaacatctggttcttcctgaacccccagaagcccctgtacagcagctgcctgtctgtggagaagtgctaccagcagaaggactggcagaggctgctgctgagccccctgcaccacgcagatgactggcacctgtacttcaacatggcctccatgctgtggaagggcatcaacctggagcggcggctgggcagccgctggtttgcctacgtgatcacagccttctctgtgctgactggagtggtgtacctgctgctgcagtttgctgtggccgagttcatggatgagccagactag

SEQ ID NO: 37576 - DNA, 165 bp, Artificial Sequence
  Description of Artificial Sequence: Synthetic coding sequence
atgcagaggaggagccggggcatcaacacaggcctcatcctgctgctgagccagatcttccacgtgggcatcaacaacatcccccctgtgaccctggccaccctggccctgaacatctggttcttcctgaacccccagaagcccctgtacagcagctgcctgtag

SEQ ID NO: 37577 - DNA, 153 bp, Artificial Sequence
  Description of Artificial Sequence: Synthetic coding sequence
atgcagaggaggagccggggcatcaacacaggcctcatcctgctgctgagccagatcttccacgtgggcatcaacaacatcccccctgtgaccctggccaccctggccctgaacatctggttcttcctgaacccccagaagcccctgtactag

SEQ ID NO: 37578 - DNA, 21 bp, Artificial Sequence
  Description of Artificial Sequence: Synthetic coding sequence
atgcagaggaggagcaggtag

SEQ ID NO: 37579 - DNA, 375 bp, Artificial Sequence
  Description of Artificial Sequence: Synthetic coding sequence
atgcagaggaggagccggggcatcaacacaggcctcatcctgctgctgagccagatcttccacgtgggcatcaacaacatcccccctgtgaccctggccaccctggccctgaacatctggttcttcctgaacccccagaagcccctgtacagcagctgcctgtctgtggagaagtgctaccagcagaaggactggcagaggctgctgctgagccccctgcaccacgcagatgactggcacctgtacttcaacatggcctccatgctgtggaagggcatcaacctggagcggcggctgggcagccgctggtttgcctacgtgatcacagccttctctgtgctgactggagtggtgtacctgctgctgcagttctag

SEQ ID NO: 37580 - DNA, 1095 bp, Artificial Sequence
  Description of Artificial Sequence: Synthetic coding sequence
atggccgccagcggccctggctgccgctcctggtgcctgtgcccagaggtgcccagcgccaccttcttcaccgccctgctgagcctgctggtgtctggccccaggctcttcctgctgcagcagcccctggcccccagcggcctgaccctgaagtctgaggccctgaggaactggcaggtgtaccgcctggtgacctacatctttgtgtatgagaaccccatcagcctgctgtgtggggccatcatcatctggaggtttgctggcaactttgagaggacagtgggcaccgtgcgccactgcttcttcaccgtcatctttgccatcttcagcgccatcatcttcctgagctttgaagctgtgagcagcctgagcaagctgggggaggtggaggatgcccggggcttcacccctgtggcctttgccatgctgggcgtgaccaccgtgcgcagcaggatgagaagagccctggtgtttggcatggtggtgcccagcgtgctggtgccctggctgctgctgggcgcctcctggctgatcccccagaccagcttcctgagcaatgtgtgtggcctgagcatcggcctggcctacggcctgacctactgctacagcattgacctgtctgagcgggtggccctgaagctggaccagaccttccccttcagcctgatgaggcgcatctctgtgttcaagtatgtgtctggcagcagcgctgagaggagagctgcccagagcaggaagctgaaccctgtgcccggcagctaccccacccagagctgccacccccacctgagccccagccaccctgtgtcccagacccagcacgccagcggccagaagctggcctcctggcccagctgcaccccaggccacatgcccaccctgcccccctaccagcctgccagcggcctgtgctacgtgcagaaccacttcggccccaaccccaccagcagctctgtgtacccagccagcgctggcaccagcctgggcatccagccccccacccctgtgaacagccctggcaccgtgtacagcggggccctgggcaccccaggagctgctggcagcaaggagagcagccgggtgcccatgccctag

SEQ ID NO: 37581 - DNA, 672 bp, Artificial Sequence
  Description of Artificial Sequence: Synthetic coding sequence
atgctgggcgtgaccaccgtgcgcagcaggatgaggcgggccctggtgtttggcatggtggtgcccagcgtgctggtgccctggctgctgctgggcgcctcctggctgatcccccagaccagcttcctgagcaatgtgtgtggcctgagcatcggcctggcctacggcctgacctactgctacagcattgacctgtctgagcgggtggccctgaagctggaccagaccttccccttcagcctgatgaggcgcatcagcgtcttcaagtatgtgtctggcagcagcgctgagcggcgggccgcccagagcaggaagctgaaccctgtgcccggcagctaccccacccagagctgccacccccacctgagccccagccaccctgtgtcccagacccagcacgccagcggccagaagctggcctcctggcccagctgcaccccaggccacatgcccaccctgcccccctaccagcctgccagcggcctgtgctacgtgcagaaccacttcggccccaaccccaccagcagctctgtgtacccagccagcgctggcaccagcctgggcatccagccccccacccctgtgaacagccctggcaccgtgtacagcggggccctgggcaccccaggagctgctggcagcaaggagagcagccgggtgcccatgccctag

SEQ ID NO: 37582 - DNA, 1305 bp, Artificial Sequence
  Description of Artificial Sequence: Synthetic coding sequence
atgggccggggcctgtgggaggcctggcccccagctggcagcagcgctgtggccaagggcaactgccgggaggaggccgagggcgctgaggaccggcagcctgccagcagaagaggagctggcaccacagctgccatggccgccagcggccctggctgccgctcctggtgcctgtgcccagaggtgcccagcgccaccttcttcaccgccctgctgagcctgctggtgtctggccccaggctcttcctgctgcagcagcccctggcccccagcggcctgaccctgaagtctgaggccctgaggaactggcaggtgtaccgcctggtgacctacatctttgtgtatgagaaccccatcagcctgctgtgtggggccatcatcatctggaggtttgctggcaactttgagaggacagtgggcaccgtgcgccactgcttcttcaccgtcatctttgccatcttcagcgccatcatcttcctgagctttgaggccgtgagcagcctgagcaagctgggggaggtggaggatgcccggggcttcacccctgtggcctttgccatgctgggcgtgaccaccgtgcgcagcaggatgaggcgggccctggtgtttggcatggtggtgcccagcgtgctggtgccctggctgctgctgggcgcctcctggctgatcccccagaccagcttcctgagcaatgtgtgtggcctgagcatcggcctggcctacccccacctgctgctcttccaccggcccctgcgggccagcggcacagaggcccggagtgacctgcccctgcagccagatgaggaggacatccgggtgcaggtgcggctgcgggtcttcagccgggaggagggcagccctgagcctgagacagagcccggggcctggctgctgccccacacagagctgccccccagccctgtgcccaagccaccctgtgtgcctgatgctgcccggcagtggagcgaggccggcctgctggccagctgcaccccaggccacatgcccaccctgcccccctaccagcctgccagcggcctgtgctacgtgcagaaccacttcggccccaaccccaccagcagctctgtgtacccagccagcgctggcaccagcctgggcatccagccccccacccctgtgaacagccctggcaccgtgtacagcggggccctgggccaccagggcctgcaggcccccaggagccccccaggcagcccctgcccagagcgcatcagccgggaggtgatcagcctgggcctgctgaaggtgctgcccaagagcctgctgaccaaggtgacctactag

SEQ ID NO: 37583 - DNA, 672 bp, Artificial Sequence; identical to SEQ ID NO: 37581
  Description of Artificial Sequence: Synthetic coding sequence

SEQ ID NO: 37584 - DNA, 1185 bp, Artificial Sequence
  Description of Artificial Sequence: Synthetic coding sequence
atggagctgtctgctgtgggggagcgggtgtttgctgctgagagcatcatcaagaggcgcatcaggaagggccgcatcgagtacctggtgaagtggaagggctgggccatcaagtacagcacctgggagcctgaggagaacatcctggacagccggctgattgctgcctttgagcagaaggagcgggagcgggagctgtatggccccaagaagaggggccccaagcccaagaccttcctgctgaagcccagcgccagcgccagcagccccaagctgcacagcagcgctgctgtgcaccggctgaagaaggacatccgccgctgccacaggatgagcagaagacccctgcccaggccagacccccagggcggcagccctggcctgcggccccccatcagccccttcagcgagaccgtgcgcatcatcaacaggaaggtgaagccccgggagcccaagaggaaccgcatcatcctgaacctgaaggtgattgacaagggagctgggggcggcggggccggccagggcgctggggccctggcccggcccaaggtgcccagcaggaacagagtgattggcaagagcaagaagttcagcgagagcgtgctgcggacccagatccgccacatgaagtttggagcctttgccctgtacaagcccccaccagcccccctggtggcccccagccctgggaaggccgaggccagcgcccctggccctggcctgctgctggccgccccagctgccccctatgatgcccggagcagcggcagcagcggctgccccagccccaccccccagagcagtgaccctgatgacaccccacccaagctgctgcctgagaccgtgagccccagcgcccccagctggagggagcctgaggtgctggacctgagcctgcccccagagagcgctgccaccagcaagagggcccctcctgaggtgacagctgctgctggccctgccccacccacagcccctgagcctgctggggccagcagcgagcctgaggccggggactggaggcctgagatgagcccctgcagcaatgtggtggtgacagatgtgaccagcaacctgctgactgtgaccatcaaggagttctgcaacccagaagattttgagaaggtggccgccggcgtggccggggccgccggcggcggcggcagcatcggggccagcaagtag

SEQ ID NO: 37585 - DNA, 411 bp, Artificial Sequence
  Description of Artificial Sequence: Synthetic coding sequence
atgcacgcccggggcccccacggccagctgagccctgccctgcccctggccagctctgtgctgatgctgctgatgagcaccctgtggctggtgggcgccggccctggcctggtgctggcccctgagctgctgctggacccctggcaggtgcaccggctgctgacccacgccctgggccacacagccctgcccggcctgctgctgagcctgctgctgctgcccaccgtgggctggcagcaggagtgccacctgggcaccctgcgcttcctgcacgccagcgccctgctggccctggccagcggcctgctggccgtgctgctggccggcctgggcctgagcagcgctgctggcagctgtggctacatgcctgtgcacctggccatgctggccggggagggccaccggccctag

SEQ ID NO: 37586 - DNA, 588 bp, Artificial Sequence
  Description of Artificial Sequence: Synthetic coding sequence
atgcacgcccggggcccccacggccagctgagccctgccctgcccctggccagctctgtgctgatgctgctgatgagcaccctgtggctggtgggcgccggccctggcctggtgctggcccctgagctgctgctggacccctggcaggtgcaccggctgctgacccacgccctgggccacacagccctgcccggcctgctgctgagcctgctgctgctgcccaccgtgggctggcagcaggagtgccacctgggcaccctgcgcttcctgcacgccagcgccctgctggccctggccagcggcctgctggccgtgctgctggccggcctgggcctgagcagcgctgctggcagctgtggctacatgcctgtgcacctggccatgctggccggggagggccaccggccccggcggcccaggggggccctgcccccctggctgagcccctggctgctgctggccctgacccccctgctgagcagcgagccccccttcctgcagctgctgtgtggcctgctggccggcctggcctatgctgctggggccttccgctggctggagcccagcgagcggcggctgcaggtgtag

SEQ ID NO: 37587 - DNA, 912 bp, Artificial Sequence
  Description of Artificial Sequence: Synthetic coding sequence
atgaagggcaaggaggagaaggagggcggggcccggctgggcgccggcggcggcagccctgagaagagccccagcgcccaggagctgaaggagcagggcaaccggctgtttgtgggcaggaagtacccagaggccgccgcctgctacggccgggccatcaccaggaaccccctggtggccgtgtactacaccaacagagccctgtgctacctgaagatgcagcagcacgagcaggccctggccgactgccggcgggccctggagctggatggccagagcgtgaaggcccacttcttcctgggccagtgccagctggagatggagagctatgatgaggccatcgccaacctgcagagggcctacagcctggccaaggagcagaggctgaactttggagatgacatccccagcgccctgagaattgccaagaagaagcgctggaacagcattgaggagcggcgcatccaccaggagagcgagctgcacagctacctgagccggctgattgctgctgagcgggagcgggagctggaggagtgccagaggaaccacgagggagatgaagatgacagccacgtgcgggcccagcaggcctgcatcgaggccaagcatgacaagtacatggctgacatggatgagctgttcagccaggtggatgagaagaggaagaagagggacatcccagactacctgtgtgggaagatcagctttgagctgatgagggagccctgcatcacccccagcggcatcacctatgacaggaaggacatcgaggagcacctgcagagggtgggccactttgatcctgtgaccaggagccccctgacccaggagcagctgatccccaacctggccatgaaggaggtgattgatgccttcatcagtgaaaatggctgggtggaggactactag

SEQ ID NO: 37588 - DNA, 1122 bp, Artificial Sequence
  Description of Artificial Sequence: Synthetic coding sequence
atggacaggagcagcctgctgcagctgatccaggagcagcagctggaccctgagaacacaggcttcatcggggctgacaccttcaccggcctggtgcacagccatgagctgcccctggaccctgccaagctggacatgctggtggccctggcccagagcaatgagcagggccaggtgtgctaccaggagctggtggacctgatcagcagcaagaggagcagcagcttcaagagggccatcgccaacggccagagggccctgcccagagatggccccctggatgagcccggcctgggcgtgtacaagagatttgtgcgctacgtggcctatgagatcctgccctgtgaggtggaccggcgctggtacttctaccgccacaggagctgccccccacctgtgttcatggcctctgtgaccctggcccagatcatcgtgttcctgtgctatggagcccggctgaacaagtgggtgctgcagacctaccaccctgagtacatgaagagccccctggtgtaccaccctggccaccgggcccgggcctggaggttcctgacctacatgttcatgcacgtgggcctggagcagctgggcttcaatgccctgctgcagctgatgattggagtgcccctggagatggtgcacggcctgctgcgcatcagcctgctgtacctggccggcgtgctggccggcagcctgactgtgtccatcacagacatgagggcccctgtggtgggcggcagcggaggagtgtatgccctgtgcagcgcccacctggccaacgtggtgatgaactgggccggcatgcgctgcccctacaagctgctgaggatggtgctggccctggtgtgcatgagcagcgaggtgggccgggctgtgtggctgcgcttcagcccccccctgcctgccagcggcccccagcccagcttcatggcccacctggccggggctgtggtgggcgtgtccatgggcctgaccatcctgcggagctatgaggagcggctgcgggaccagtgtggctggtgggtggtgctgctggcctacggcaccttcctgctgtttgctgtgttctggaatgtgtttgcctatgacctgctgggcgcccacatccccccaccaccctag

SEQ ID NO: 37589 - DNA, 933 bp, Artificial Sequence
  Description of Artificial Sequence: Synthetic coding sequence
atggacaggagcagcctgctgcagctgatccaggagcagcagctggaccctgagaacacaggcttcatcggggctgacaccttcaccggcctggtgcacagccatgagctgcccctggaccctgccaagctggacatgctggtggccctggcccagagcaatgagcagggccaggtgtgctaccaggagctggtggacctgatcagcagcaagaggagcagcagcttcaagagggccatcgccaacggccagagggccctgcccagagatggccccctggatgagcccggcctgggcgtgtacaagagatttgtgcgctacgtggcctatgagatcctgccctgtgaggtggaccggcgctggtacttctaccgccacaggagctgccccccacctgtgttcatggcctctgtgaccctggcccagatcatcgtgttcctgtgctatggagcccggctgaacaagtgggtgctgcagacctaccaccctgagtacatgaagagccccctggtgtaccaccctggccaccgggcccgggcctggaggttcctgacctacatgttcatgcacgtgggcctggagcagctgggcttcaatgccctgctgcagctgatgattggagtgcccctggagatggtgcacggcctgctgcgcatcagcctgctgtacctggccggcgtgctggccggcagcctgactgtgtccatcacagacatgagggcccctgtggtgggcggcagcggaggagtgtatgccctgtgcagcgcccacctggccaacgtggtgatggtgacaggcctgcccggcggcggccgcggggagggcccccaggtgtccctgaccaccagccggctgcacacccccatcgagctgggctgggatgagatgagcctgcaggtggccgaggatggagctggcctgggcgtgcagtag

SEQ ID NO: 37590 - DNA, 912 bp, Artificial Sequence
  Description of Artificial Sequence: Synthetic coding sequence
atggctgctgtgcatgacctggagatggagagcatgaacctgaacatgggccgggagatgaaggaggagctggaggaggaggagaagatgagagaagatggcggcggcaaggaccgggccaagagcaagaaggtgcaccgcatcgtgtccaagtggatgctgcctgagaagagccggggcacctacctggagcgggccaactgcttccccccacctgtgttcatcatcagcatcagcctggccgagctggccgtgttcatctactatgctgtgtggaagccccagaagcagtggatcaccctggacaccggcatcctggagagccccttcatctacagccctgagaagcgggaggaggcctggaggttcatctcctacatgctggtgcatgctggggtgcagcacatcctgggcaacctgtgcatgcagctggtgctgggcatccccctggagatggtgcacaagggcctgcgggtgggcctggtgtacctggccggcgtgattgctggcagcctggccagcagcatctttgaccccctgcgctacctggtgggcgccagcggaggagtgtatgccctgatgggcggctacttcatgaatgtgctggtgaacttccaggagatgatcccagccttcggcatcttccggctgctgatcatcatcctgatcatcgtgctggacatgggctttgccctgtaccgccgcttctttgtgcctgaagatggcagccctgtgtcctttgctgcccacatcgccggcggctttgctggcatgagcatcggctacacagtgttcagctgctttgacaaggccctgctgaaggacccccgcttctggatcgccatcgccgcctacctggcctgtgtgctgtttgctgtgttcttcaacatcttcctgagccctgccaactag

SEQ ID NO: 37591 - DNA, 1152 bp, Artificial Sequence
  Description of Artificial Sequence: Synthetic coding sequence
atgcagctgggcaagaggcacaagctgaccaccaagtctgtgtgccacggcaagggcgtggtgatccgggtgctggccctgcccggccccagctgggtgagaagaagaagagagggcaaggccctggagagcagccgctgtgcccggcagccccgggaggagcggcagcctgaggacctgggccccccagctgtgccctgggacagctgccccagcggggaggagggcggccccaggaccatggctgctgtgcatgacctggagatggagagcatgaacctgaacatgggccgggagatgaaggaggagctggaggaggaggagaagatgagagaagatggcggcggcaaggaccgggccaagagcaagaaggtgcaccgcatcgtgtccaagtggatgctgcctgagaagagccggggcacctacctggagcgggccaactgcttccccccacctgtgttcatcatcagcatcagcctggccgagctggccgtgttcatctactatgctgtgtggaagccccagaagcagtggatcaccctggacaccggcatcctggagagccccttcatctacagccctgagaagcgggaggaggcctggaggttcatctcctacatgctggtgcatgctggggtgcagcacatcctgggcaacctgtgcatgcagctggtgctgggcatccccctggagatggtgcacaagggcctgcgggtgggcctggtgtacctggccggcgtgattgctggcagcctggccagcagcatctttgaccccctgcgctacctggtgggcgccagcggaggagtgtatgccctgatgggcggctacttcatgaatgtgctggtgaacttccaggagatgatcccagccttcggcatcttccggctgctgatcatcatcctgatcatcgtgctggacatgggctttgccctgtaccgccgcttctttgtgcctgaagatggcagccctgtgtcctttgctgcccacatcgccggcggctttgctggcatgagcatcggctacacagtgttcagctgctttgacaaggccctgctgaaggacccccgcttctggatcgccatcgccgcctacctggcctgtgtgctgtttgctgtgttcttcaacatcttcctgagccctgccaactag

SEQ ID NO: 37592 - DNA, 912 bp, Artificial Sequence; identical to SEQ ID NO: 37590
  Description of Artificial Sequence: Synthetic coding sequence

SEQ ID NO: 37593 - DNA, 1113 bp, Artificial Sequence
  Description of Artificial Sequence: Synthetic coding sequence
atgaccaccacctacatgctgagcaagaaccccctggaggtgtttgacatctgccgcttcaacacctgcaactttgggaaggccctggagagcagccgctgtgcccggcagccccgggaggagcggcagcctgaggacctgggccccccagctgtgccctgggacagctgccccagcggggaggagggcggccccaggaccatggctgctgtgcatgacctggagatggagagcatgaacctgaacatgggccgggagatgaaggaggagctggaggaggaggagaagatgagagaagatggcggcggcaaggaccgggccaagagcaagaaggtgcacagaattgtgtccaagtggatgctgcctgagaagagccggggcacctacctggagcgggccaactgcttccccccacctgtgttcatcatcagcatcagcctggccgagctggccgtgttcatctactatgctgtgtggaagccccagaagcagtggatcaccctggacaccggcatcctggagagccccttcatctacagccctgagaagcgggaggaggcctggaggttcatctcctacatgctggtgcacgccggcgtgcagcacatcctgggcaacctgtgcatgcagctggtgctgggcatccccctggagatggtgcacaagggcctgcgggtgggcctggtgtacctggccggcgtgattgctggcagcctggccagcagcatctttgaccccctgcgctacctggtgggcgccagcggcggcgtgtatgccctgatgggcggctacttcatgaatgtgctggtgaacttccaggagatgatcccagccttcggcatcttccggctgctgatcatcatcctgatcatcgtgctggacatgggctttgccctgtaccgccgcttctttgtgcctgaagatggcagccctgtgtcctttgctgcccacatcgccggcggctttgctggcatgagcatcggctacaccgtcttcagctgctttgacaaggccctgctgaaggacccccgcttctggatcgccatcgccgcctacctggcctgtgtgctgtttgctgtgttcttcaacatcttcctgagccctgccaactag

SEQ ID NO: 37594 - DNA, 1215 bp, Artificial Sequence
  Description of Artificial Sequence: Synthetic coding sequence
atgggagagcaccccagccctggccctgctgtggccgcctgtgccgaggccgagcgcatcgaggagctggagcctgaggccgaggagcggctgcctgctgcccctgaggaccactggaaggtgctgtttgaccagtttgaccccggcaacacaggctacatcagcacaggcaagttccgcagcctgctggagagccacagcagcaagctggacccccacaagcgggaggtgctgctggccctggccgacagccatgctgatggccagatcggctaccaggactttgtgtccctgatgagcaacaagaggagcaacagcttccggcaggccatcctgcagggcaacagaaggctgagcagcaaggccctgctggaggagaagggcctgagcctgagccagaggctcatccgccacgtggcctatgagaccctgccccgggagattgacaggaagtggtactatgacagctacacctgctgccccccaccctggttcatgatcaccgtgaccctgctggaggtggccttcttcctgtacaacggggtgtccctgggccagtttgtgctgcaggtgacccacccccgctacctgaagaacagcctggtgtaccacccccagctgcgggcccaggtgtggagatacctgacctacatcttcatgcacgccggcatcgagcacctgggcctgaatgtggtgctgcagctgctggtgggcgtgcccctggagatggtgcatggagccacccgcatcggcctggtgtatgtggccggcgtggtggccggcagcctggccgtgtctgtggccgacatgacagcccctgtggtgggcagcagcggcggcgtgtatgccctggtgtctgcccacctggccaacatcgtgatgaactggagcggcatgaagtgccagttcaagctgctgaggatggctgtggccctgatctgcatgtccatggagtttggccgggctgtgtggctgcgcttccaccccagcgcctacccaccctgcccccaccccagctttgtggcccacctgggcggcgtggccgtgggcatcaccctgggcgtggtggtgctgagaaattatgagcagaggctgcaggaccagagcctgtggtggatctttgtggccatgtacacagtgtttgtgctgtttgctgtgttctggaacatctttgcctacaccctgctggacctgaagctgcccccacctccttag

SEQ ID NO: 37595 - DNA, 1287 bp, Artificial Sequence
  Description of Artificial Sequence: Synthetic coding sequence
atgggagagcaccccagccctggccctgctgtggccgcctgtgccgaggccgagcgcatcgaggagctggagcctgaggccgaggagcggctgcctgctgcccctgaggaccactggaaggtgctgtttgaccagtttgaccccggcaacacaggctacatcagcacaggcaagttccgcagcctgctggagagccacagcagcaagctggacccccacaagcgggaggtgctgctggccctggccgacagccatgctgatggccagatcggctaccaggactttgtgtccctgatgagcaacaagaggagcaacagcttccggcaggccatcctgcagggcaacagaaggctgagcagcaaggccctgctggaggagaagggcctgagcctgagccagaggctcatccgccacgtggcctatgagaccctgccccgggagattgacaggaagtggtactatgacagctacacctgctgccccccaccctggttcatgatcaccgtgaccctgctggaggtggccttcttcctgtacaacggggtgtccctgggccagtttgtgctgcaggtgacccacccccgctacctgaagaacagcctggtgtaccacccccagctgcgggcccaggtgtggagatacctgacctacatcttcatgcacgccggcatcgagcacctgggcctgaatgtggtgctgcagctgctggtgggcgtgcccctggagatggtgcatggagccacccgcatcggcctggtgtatgtggccggcgtggtggccgagctggtgagacatgaggtgcctgtgcaggccgctgctgatggctgcggcccctacctgtatgaacatggagtgtgggccggccgggtggcccccctgccccctgtgggcctgagccctgtgcccagccccaagctgtgtggggccctgggctggaggggccggggccaccaccctggccggggcggccctgaggagctgcgggcagaggcccctggccctgtgacagtggtggacttctgtggccacgtgcaccggctgcgggctgtgcgctgcctgctggagcacctgtgcctgcaccctgctggcctgaaggctgctgccagccccctgcgggccggcggccccaggagcggccggggcggcaagagcagcacccaccgggagcggctgcggggcttcttcagcagccctgcccagctgggccgggctgacaaggaccggcggctgtgggccaccgtgatgtttgtgttccgcttcggccacacagtggagaccctcttctag

SEQ ID NO: 37596 - DNA, 921 bp, Artificial Sequence
  Description of Artificial Sequence: Synthetic coding sequence
atgagcaacaagaggagcaacagcttccggcaggccatcctgcagggcaacagaaggctgagcagcaaggccctgctggaggagaagggcctgagcctgagccagaggctcatccgccacgtggcctatgagaccctgccccgggagattgacaggaagtggtactatgacagctacacctgctgccccccaccctggttcatgatcaccgtgaccctgctggaggtggccttcttcctgtacaacggggtgtccctgggccagtttgtgctgcaggtgacccacccccgctacctgaagaacagcctggtgtaccacccccagctgcgggcccaggtgtggagatacctgacctacatcttcatgcacgccggcatcgagcacctgggcctgaatgtggtgctgcagctgctggtgggcgtgcccctggagatggtgcatggagccacccgcatcggcctggtgtatgtggccggcgtggtggccggcagcctggccgtgtctgtggccgacatgacagcccctgtggtgggcagcagcggcggcgtgtatgccctggtgtctgcccacctggccaacatcgtgatgaactggagcggcatgaagtgccagttcaagctgctgaggatggctgtggccctgatctgcatgtccatggagtttggccgggctgtgtggctgcgcttccaccccagcgcctacccaccctgcccccaccccagctttgtggcccacctgggcggcgtggccgtgggcatcaccctgggcgtggtggtgctgagaaattatgagcagaggctgcaggaccagagcctgtggtggatctttgtggccatgtacacagtgtttgtgctgtttgctgtgttctggaacatctttgcctacaccctgctggacctgaagctgcccccacctccttag

SEQ ID NO: 37597 - DNA, 1191 bp, Artificial Sequence
  Description of Artificial Sequence: Synthetic coding sequence
atgggagagcaccccagccctggccctgctgtggccgcctgtgccgaggccgagcgcatcgaggagctggagcctgaggccgaggagcggctgcctgctgcccctgaggactttgaccccggcaacacaggctacatcagcacaggcaagttccgcagcctgctggagagccacagcagcaagctggacccccacaagcgggaggtgctgctggccctggccgacagccatgctgatggccagatcggctaccaggactttgtgtccctgatgagcaacaagaggagcaacagcttccggcaggccatcctgcagggcaacagaaggctgagcagcaaggccctgctggaggagaagggcctgagcctgagccagaggctcatccgccacgtggcctatgagaccctgccccgggagattgacaggaagtggtactatgacagctacacctgctgccccccaccctggttcatgatcaccgtgaccctgctggaggtggccttcttcctgtacaacggggtgtccctgggccagtttgtgctgcaggtgacccacccccgctacctgaagaacagcctggtgtaccacccccagctgcgggcccaggtgtggagatacctgacctacatcttcatgcacgccggcatcgagcacctgggcctgaatgtggtgctgcagctgctggtgggcgtgcccctggagatggtgcatggagccacccgcatcggcctggtgtatgtggccggcgtggtggccggcagcctggccgtgtctgtggccgacatgacagcccctgtggtgggcagcagcggcggcgtgtatgccctggtgtctgcccacctggccaacatcgtgatgaactggagcggcatgaagtgccagttcaagctgctgaggatggctgtggccctgatctgcatgtccatggagtttggccgggctgtgtggctgcgcttccaccccagcgcctacccaccctgcccccaccccagctttgtggcccacctgggcggcgtggccgtgggcatcaccctgggcgtggtggtgctgagaaattatgagcagaggctgcaggaccagagcctgtggtggatctttgtggccatgtacacagtgtttgtgctgtttgctgtgttctggaacatctttgcctacaccctgctggacctgaagctgcccccacctccttag

SEQ ID NO: 37598 - DNA, 927 bp, Artificial Sequence
  Description of Artificial Sequence: Synthetic coding sequence
atgtgcctgctgctgagcagcgctgtgtttggagtgaagtacaacctgctggcccacaccaccctgaccctggagagcgctgaggacagcttcaagacccacaacctgagcatcaatggaaatgaggagagcagcttctggctgcccctgtatggcaacatgtgctgccgcctggtggcccagcctgcctgcatggctgaagatgcctttgctggcttcctgaaccagcagcagatggtggagggcctcatctcctggaggcggctgtactgtgtgctgcggggcggcaagctgtactgcttctacagccctgaggagattgaggccaaggtggagcccgccctggtggtgcccatcaacaagagcctggtgctgtttgaggacagcctggagggcatccagctggccatcagccagagcttcaaggagacccgcatccgggccatggacaaggatgccaagaagaggatccacaacttcagcgtcatcaaccctgtgcccggccaggccatcacccagatctttgctgtggacaaccgggaggacctgcagaagtggatggaggccttctggcagcacttctttgacctgagccagtggaagcactgctgtgaggagctgatgaagattgagatcatgagccccaggaagccacccctcttcctgaccaaggaggccacctctgtgtaccatgacatgagcattgacagccccatgaagctggagagcctgacagacatcatccagaagaagattgaggagaccaacggccagttcctgattggccagcacgaggagagcctgcccccaccctgggccaccctgtttgatggcaaccaccagatggtgatccagaagaagaacaacagcaaccagctgcacaacctgcagaagctgcctgccaccagcaagttcctgttcacctag

SEQ ID NO: 37599 - DNA, 1830 bp, Artificial Sequence
  Description of Artificial Sequence: Synthetic coding sequence
atggagggccccagcctgcggggccctgccctgcggctggccggcctgcccacccagcaggactgcaacatccaggagaagattgacctggagatccgcatgagggagggcatctggaagctgctgagcctgagcacccagaaggaccaggtgctgcatgctgtgaagaacctgatggtgtgcaatgcccggctgatggcctacaccagcgagctgcagaagctggaggagcagatcgccaaccagacaggccgctgtgatgtgaagtttgagagcaaggagaggacagcctgcaagggcaagatcgccatcagtgacatccgcatccccctgatgtggaaggacagcgaccacttcagcaacaaggagaggagccgccgctatgccatcttctgcctcttcaagatgggcgccaacgtgtttgacacagatgtggtgaatgtggacaagaccatcacagacatctgctttgaaaatgtgaccatcttcaatgaggccggccctgacttccagatcaaggtggaggtgtacagctgctgcacagaggagagcagcatcaccaacacccccaagaagctggccaagaagctgaagaccagcatcagcaaggccaccgggaagaagatcagctctgtgctgcaggaggaggatgatgagatgtgcctgctgctgagcagcgctgtgtttggagtgaagtacaacctgctggcccacaccaccctgaccctggagagcgcagaagattccttcaagacccacaacctgagcatcaatggaaatgaggagagcagcttctggctgcccctgtatggcaacatgtgctgccgcctggtggcccagcctgcctgcatggccgaggatgcctttgctggcttcctgaaccagcagcagatggtggagggcctcatctcctggaggcggctgtactgtgtgctgcggggcggcaagctgtactgcttctacagccctgaggagattgaggccaaggtggagcccgccctggtggtgcccatcaacaaggagacccgcatccgggccatggacaaggatgccaagaagaggatccacaacttcagcgtcatcaaccctgtgcccggccaggccatcacccagatctttgctgtggacaaccgggaggacctgcagaagtggatggaggccttctggcagcacttctttgacctgagccagtggaagcactgctgtgaggagctgatgaagattgagatcatgagccccaggaagccacccctcttcctgaccaaggaggccacctctgtgtaccatgacatgagcattgacagccccatgaagctggagagcctgacagacatcatccagaagaagattgaggagaccaacggccagttcctgattggccagcacgaggagagcctgcccccaccctgggccaccctgtttgatggcaaccaccagatggtgatccagaagaaggtgctgtacccagccagcgagcccctgcatgatgagaagggcaagaagaggcaggcccccctgcccccaagtgacaagctgcccttcagcctgaagagccagagcaacacagaccagctggtgaaggacaactggggcaagacctctgtgtcccagaccagcagcctggacaccaagctgagcaccctgatgcaccacctgcagaagcccatggccgcccccaggaagctgctgcctgcccggaggaaccggctgagtgatggagagcacacagacaccaagaccaactttgaggccaagcctgtgcctgccccccggcagaagagcatcaaggacatcctggaccccaggtcctggctgcaggcccaggtgtag

SEQ ID NO: 37600 - DNA, 492 bp, Artificial Sequence
  Description of Artificial Sequence: Synthetic coding sequence
atggagggccccagcctgcggggccctgccctgcggctggccggcctgcccacccagcaggactgcaacatccaggagaagattgacctggagatccgcatgagggagggcatctggaagctgctgagcctgagcacccagaaggaccaggtgctgcatgctgtgaagaacctgatggtgtgcaatgcccggctgatggcctacaccagcgagctgcagaagctggaggagcagatcgccaaccagacaggccgctgtgatgtgaagtttgagagcaaggagaggacagcctgcaagggcaagatcgccatcagtgacatccgcatccccctgatgtggaaggacagcgaccacttcagcaacaaggagaggagccgccgctatgccatcttctgcctcttcaagatgggcgccaacgtgtttgacacagatgtggtgaatgtggacaagaccatcacagacatctgctttgaaaatgtgaccatcctgtag

SEQ ID NO: 37601 - DNA, 1584 bp, Artificial Sequence
  Description of Artificial Sequence: Synthetic coding sequence
atggagggccccagcctgcggggccctgccctgcggctggccggcctgcccacccagcaggactgcaacatccaggagaagattgacctggagatccgcatgagggagggcatctggaagctgctgagcctgagcacccagaaggaccaggtgctgcatgctgtgaagaacctgatggtgtgcaatgcccggctgatggcctacaccagcgagctgcagaagctggaggagcagatcgccaaccagacaggccgctgtgatgtgaagtttgagagcaaggagaggacagcctgcaagggcaagatcgccatcagtgacatccgcatccccctgatgtggaaggacagcgaccacttcagcaacaaggagaggagccgccgctatgccatcttctgcctcttcaagatgggcgccaacgtgtttgacacagatgtggtgaatgtggacaagaccatcacagacatctgctttgaaaatgtgaccatcttcaatgaggccggccctgacttccagatcaaggtggaggtgtacagctgctgcacagaggagagcagcatcaccaacacccccaagaagctggccaagaagctgaagaccagcatcagcaaggccaccgggaagaagatcagctctgtgctgcaggaggaggatgatgagatgtgcctgctgctgagcagcgctgtgtttggagtgaagtacaacctgctggcccacaccaccctgaccctggagagcgcagaagattccttcaagacccacaacctgagcatcaatggaaatgaggagagcagcttctggctgcccctgtatggcaacatgtgctgccgcctggtggcccagcctgcctgcatggccgaggatgcctttgctggcttcctgaaccagcagcagatggtggagggcctcatctcctggaggcggctgtactgtgtgctgcggggcggcaagctgtactgcttctacagccctgaggagattgaggccaaggtggagcccgccctggtggtgcccatcaacaagagcctggtgctgtttgaggacagcctggagggcatccagctggccatcagccagagcttcaaggagacccgcatccgggccatggacaaggatgccaagaagaggatccacaacttcagcgtcatcaaccctgtgcccggccaggccatcacccagatctttgctgtggacaaccgggaggacctgcagaagtggatggaggccttctggcagcacttctttgacctgagccagtggaagcactgctgtgaggagctgatgaagattgagatcatgagccccaggaagcccccactcttcctgaccaaggaggccacctctgtgtaccatgacatgagcattgacagccccatgaagctggagagcctgacagacatcatccagaagaagattgaggagaccaacggccagttcctgattggccagcacgaggagagcctgcccccaccctgggccaccctgtttgatggcaaccaccagatggtgatccagaagaagaacaacagcaaccagctgcacaacctgcagaagctgcctgccaccagcaagttcctgttcacctag

SEQ ID NO: 37602 - DNA, 297 bp, Artificial Sequence
  Description of Artificial Sequence: Synthetic coding sequence
atggccagcctgctgtgctgcggccccaagctggccgcctgtggcatcgtgctgagcgcctggggcgtcatcatgctgatcatgctgggcatcttcttcaacgtgcacagcgctgtgctgattgaagatgtgcccttcacagagaaggactttgaaaatggcccccagaacatctacaacctgtatgagcaggtgtcctacaactgcttcatcgctgctggcctgtacctgctgctgggcggcttctccttctgccaggtgcggctgaacaagaggaaggagtacatggtgaggtag

SEQ ID NO: 37603 - DNA, 414 bp, Artificial Sequence
  Description of Artificial Sequence: Synthetic coding sequence
atgggctggctgcggcccggcccccggcccctgtgccccccagcccgggcctcctgggccttcagccaccgcttccccagccccctggccccccggcgcagccccacccccttcttcatggccagcctgctgtgctgcggccccaagctggccgcctgtggcatcgtgctgagcgcctggggcgtcatcatgctgatcatgctgggcatcttcttcaacgtgcacagcgctgtgctgattgaagatgtgcccttcacagagaaggactttgaaaatggcccccagaacatctacaacctgtatgagcaggtgtcctacaactgcttcatcgccgccggcctgtacctgctgctgggcggcttctccttctgccaggtgcggctgaacaagaggaaggagtacatggtgaggtag

SEQ ID NO: 37604 - DNA, 471 bp, Artificial Sequence
  Description of Artificial Sequence: Synthetic coding sequence
atgcagatctttgtgaagaccctgaccgggaagaccatcaccctggaggtggagcccagcgacaccattgaaaatgtgaaggccaagatccaggacaaggagggcatccccccagaccagcagaggctcatctttgctgggaagcagctggaggatggccgcaccctgagtgactacaacatccagaaggagagcaccctgcacctggtgctgcggctgcggggcggggccaagaagaggaagaagaagagctacaccacccccaagaagaacaagcacaagaggaagaaggtgaagctggccgtgctgaagtactacaaggtggatgaaaatggcaagatcagccggctgcggcgggagtgccccagtgatgaatgtggggccggggtcttcatggccagccactttgacagacactactgtgggaagtgctgcctgacctactgcttcaacaagccagaggacaagtag

SEQ ID NO: 37605 - DNA, 471 bp, Artificial Sequence; identical to SEQ ID NO: 37604
  Description of Artificial Sequence: Synthetic coding sequence

SEQ ID NO: 37606 - DNA, 471 bp, Artificial Sequence; identical to SEQ ID NO: 37604
  Description of Artificial Sequence: Synthetic coding sequence

SEQ ID NO: 37607 - DNA, 321 bp, Artificial Sequence
  Description of Artificial Sequence: Synthetic coding sequence
atgcagatctttgtgaagaccctgaccgggaagaccatcaccctggaggtggagcccagcgacaccattgaaaatgtgaaggccaagatccaggacaaggagggcatccccccagaccagcagaggctcatctttgctgggaagcagctggaggatggccgcaccctgagtgactacaacatccagaaggagagcaccctgcacctggtgctgcggctgcggggcggggccaagaagaggaagaagaagagctacaccacccccaagaagaacaagcacaagaggaagaaggtgaagctggccgtgctgaagtactactag

SEQ ID NO: 37608 - DNA, 1428 bp, Artificial Sequence
  Description of Artificial Sequence: Synthetic coding sequence
atgcctggcatcagcgcccggggcctgagccatgagggcaggaagcagctggccgtgaacctgaccagggtgctggccctgtaccgcagcatcctggatgcctacatcatcgagttcttcacagacaacctgtgggacaccctgccctgctcctggcaggaggccctggatggcctgaagccaccccagctggccaccatgctgctgggcatgcctggagagggggaggtggtgcgctacagatctgtgtggcccctgaccctgctggccctgaagagcacagcctgtgccctggccttcaccaggatgcctggcttccagacccccagcgagttcctggagaaccccagccagagcagccggctgacagcccccttcaggaagcacgtgcggcccaagaagcagcacgagatccggcggctgggggagctggtgaagaagctgagtgacttcaccggctgcacccaggtggtggatgtgggcagcggccagggccacctgagccgcttcatggccctgggcctgggcctgatggtgaagagcattgaaggagaccagaggctggtggagcgggcccagaggctggaccaggagctgctgcaggccctggagaaggaggagaagaggaacccccaggtggtgcagaccagccccaggcacagcccccaccacgtggtgcgctgggtggaccccacagccctgtgtgaggagctgctgctgcccctggagaacccctgccagggccgggcccggctgctgctgaccggcctgcacgcctgtggggacctgtctgtggccctgctgcggcacttcagctgctgcccagaggtggtggccctggcctctgtgggctgctgctacatgaagctgagtgaccccggcggctaccccctgagccagtgggtggccggcctgcccggctatgagctgccctaccgcctgcgggagggcgcctgccacgccctggaggagtatgcagagcggctgcagaaggccggccctggcctgcggacccactgctacagagctgccctggagaccgtcatccggcgggcccggcctgagctgcggcggcctggggtgcagggcatcccccgggtgcatgagctgaagattgaggagtatgtgcagaggggcctgcagagggtgggcctggacccccagctgcccctgaacctggccgccctgcaggcccacgtggcccaggagaacagagtggtggccttcttcagcctggccctgctgctggcccccctggtggagaccctcatcctgctggaccggctgctgtacctgcaggagcagggcttccacgccgagctgctgcccatcttcagccctgagctgagccccaggaacctggtgctggtggccaccaagatgcccctgggccaggccctgtctgtgctggagacagaggacagctag

SEQ ID NO: 37609 - DNA, 834 bp, Artificial Sequence
  Description of Artificial Sequence: Synthetic coding sequence
atgcctggcatcagcgcccggggcctgagccatgagggcaggaagcagctggccgtgaacctgaccagggtgctggccctgtaccgcagcatcctggatgcctacatcatcgagttcttcacagacaacctgtgggacaccctgccctgctcctggcaggaggccctggatggcctgaagccaccccagctggccaccatgctgctgggcatgcctggagagggggaggtggtgcgctacagatctgtgtggcccctgaccctgctggccctgaagagcacagcctgtgccctggccttcaccaggatgcctggcttccagacccccagcgagttcctggagaaccccagccagagcagccggctgacagcccccttcaggaagcacgtgcggcccaagaagcagcacgagatccggcggctgggggagctggtgaagaagctgagtgacttcaccggctgcacccaggtggtggatgtgggcagcggccagggccacctgagccgcttcatggccctgggcctgggcctgatggtgaagagcattgaaggagaccagaggctggtggagcgggcccagaggctggaccaggagctgctgcaggccctggagaaggaggagaagaggaacccccagatctgtgccgccggggccacagccagcggggcccggagccctgctgccacagaaagtggctgccccagcggcccccggggccctggagagccctgtggcggcctgctgcagcccggcagcacagcctgccccactggaggagatgcctacagcacaggccctgctgctgtgcccagcggcaccggcttcccctgctag

SEQ ID NO: 37610 - DNA, 3594 bp, Artificial Sequence
  Description of Artificial Sequence: Synthetic coding sequence
atgggccgcagcggcaagctgcccagcggcgtgtctgccaagctgaagcgctggaagaagggccacagcagtgacagcaacccagccatctgccgccaccggcaggccgcccggagccgcttcttcagccggcccagcggccgcagtgacctgactgtggatgctgtgaagctgcacaatgagctgcagagcggcagcctgcggctgggcaagtctgaggcccctgagacccccatggaggaggaggccgagctggtgctgacagagaagagcagcggcaccttcctgagcggcctgagtgactgcaccaacgtgaccttcagcaaggtgcagcgcttctgggagagcaacagcgctgcccacaaggagatctgtgctgtgctggccgctgtgacagaggtgatccgcagccagggcggcaaggagacagaaacagagtactttgctgccctgatcaggaaggccgcccagcacggcgtgtgcagcgtgctgaagggcagcgagttcatgtttgagaaggccccagcccaccaccctgctgccatcagcacagccaagttctgcatccaggagattgagaagagcggcggcagcaaggaggccaccaccaccctgcacatgctgaccctgctgaaggacctgctgccctgcttccctgagggcctggtgaagagctgcagcgagaccctgctgcgggtgatgaccctgagccacgtgctggtgacagcctgtgccatgcaggccttccacagcctcttccacgcccggcccggcctgagcaccctgtctgctgagctgaatgcccagatcatcacagccctgtatgactatgtgcccagtgaaaatgacctgcagcccctgctggcctggctgaaggtgatggagaaggcccacatcaacctggtgcggctgcagtgggacctgggcctgggccacctgccccgcttctttggaacagctgtgacctgcctgctgagcccccacagccaggtgctgacagctgccacccagagcctgaaggagatcctgaaggaatgtgtggccccccacatggctgacatcggctctgtgaccagcagcgccagcggccctgcccagagcgtggccaagatgttccgggctgtggaggagggcctgacctacaagttccacgccgcctggagctctgtgctgcagctgctgtgtgtgttctttgaggcctgtggccggcaggcccaccctgtgatgaggaagtgcctgcagagcctgtgtgacctgcggctgagcccccacttcccccacacagctgccctggaccaggccgtgggcgctgctgtgacctccatgggccctgaggtggtgctgcaggccgtgcccctggagattgatggcagcgaggagaccctggacttccccaggtcctggctgctgcctgtgatccgggaccacgtgcaggagacccggctgggcttcttcaccacctacttcctgcccctggccaacaccctgaagagcaaggccatggacctggcccaggccggcagcacagtggagagcaagatctatgacaccctgcagtggcagatgtggaccctgctgcccggcttctgcacccggcccacagatgtggccatctccttcaagggcctggcccggaccctgggcatggccatcagcgagaggccagacctgcgggtgacagtgtgccaggccctgcggaccctcatcaccaagggctgccaggccgaggccgacagagctgaggtgtccagatttgccaagaacttcctgcccatcctcttcaacctgtatggccagcctgtggccgccggggacaccccagccccccggcgggctgtgctggagaccatccgcacctacctgaccatcacagacacccagctggtgaacagcctgctggagaaggccagcgagaaggtgctggaccctgccagcagtgacttcacccggctgtctgtgctggacctggtggtggccctggccccctgtgctgatgaagctgccatcagcaagctgtacagcaccatccggccctacctggagagcaaggcccatggagtgcagaagaaggcctacagagtgctggaggaggtgtgtgccagcccccagggccctggggccctgtttgtgcagagccacctggaggacctgaagaagaccctgctggacagcctgcggagcaccagcagccctgccaagaggccccggctgaagtgcctgctgcacatcgtgaggaagctgtctgctgagcacaaggagttcatcacagccctgatccctgaggtgatcctgtgcaccaaggaggtgtctgtgggcgccaggaagaatgcctttgccctgctggtggagatgggccacgccttcctgcgcttcggcagcaaccaggaggaggccctgcagtgctacctggtgctgatctacccaggcctggtgggcgctgtgaccatggtgtcctgcagcatcctggccctgacccacctgctgtttgagttcaagggcctgatgggcaccagcacagtggagcagctgctggagaatgtgtgcctgctgctggccagcaggaccagagatgtggtgaagagcgccctgggcttcatcaaggtggccgtgacagtgatggatgtggcccacctggccaagcacgtgcagctggtgatggaggccatcggcaagctgagtgatgacatgagaagacacttcaggatgaagctgaggaacctcttcaccaagttcatcaggaagtttggatttgagctggtgaagaggctgctgcctgaggagtaccaccgggtgctggtgaacatcaggaaggccgaggcccgggccaagaggcaccgggccctgagccaggccgctgtggaggaggaggaggaggaggaggaggaggaggagcccgcccagggcaaaggagacagcattgaggagatcctggccgacagtgaagatgaggaggacaatgaggaggaggagaggagccggggcaaggagcagaggaagctggcccggcagaggagccgggcctggctgaaggagggcggcggagatgagcccctgaacttcctggaccccaaggtggcccagagggtgctggccacccagcccggccctggccggggcaggaagaaggaccacggcttcaaggtgtctgcagatggccgcctcatcatccgggaggaggctgatggcaacaagatggaggaggaggagggcgccaagggggaggatgaggagatggctgaccccatggaggatgtgatcatccggaacaagaagcaccagaagctgaagcaccagaaggaggccgaggaggaggagctggagatccccccccagtaccaggccggcggcagcggcatccacaggcctgtggccaagaaggccatgcctggagctgagtacaaggccaagaaggccaagggagatgtgaagaagaagggccgcccagacccctatgcctacatccccctgaacagaagcaagctgaacagaaggaagaagatgaagctgcagggccagttcaagggcctggtgaaggccgcccggcggggcagccaggtgggccacaagaacagaaggaaggacagaagaccctag

SEQ ID NO: 37611 - DNA, 3894 bp, Artificial Sequence
  Description of Artificial Sequence: Synthetic coding sequence
atgggccgcagcggcaagctgcccagcggcgtgtctgccaagctgaagcgctggaagaagggccacagcagtgacagcaacccagccatctgccgccaccggcaggccgcccggagccgcttcttcagccggcccagcggccgcagtgacctgactgtggatgctgtgaagctgcacaatgagctgcagagcggcagcctgcggctgggcaagtctgaggcccctgagacccccatggaggaggaggccgagctggtgctgacagagaagagcagcggcaccttcctgagcggcctgagtgactgcaccaacgtgaccttcagcaaggtgcagcgcttctgggagagcaacagcgctgcccacaaggagatctgtgctgtgctggccgctgtgacagaggtgatccgcagccagggcggcaaggagacagaaacagagtactttgctgccctgatgaccaccatggaggccgtggagagccctgagagcctggccgctgtggcctacctgctgaacctggtgctgaagagggtgcccagccctgtgctgatcaagaagttcagtgacaccagcaaggccttcatggacatcatgtctgcccaggccagcagcggcagcacctctgtgctgcgctgggtgctgagctgcctggccaccctgctgaggaagcaggacctggaggcctggggctaccctgtgaccctgcaggtgtaccacggcctgctgtccttcaccgtgcaccccaagcccaagatcaggaaggccgcccagcacggcgtgtgcagcgtgctgaagggcagcgagttcatgtttgagaaggccccagcccaccaccctgctgccatcagcacagccaagttctgcatccaggagattgagaagagcggcggcagcaaggaggccaccaccaccctgcacatgctgaccctgctgaaggacctgctgccctgcttccctgagggcctggtgaagagctgcagcgagaccctgctgcgggtgatgaccctgagccacgtgctggtgacagcctgtgccatgcaggccttccacagcctcttccacgcccggcccggcctgagcaccctgtctgctgagctgaatgcccagatcatcacagccctgtatgactatgtgcccagtgaaaatgacctgcagcccctgctggcctggctgaaggtgatggagaaggcccacatcaacctggtgcggctgcagtgggacctgggcctgggccacctgccccgcttctttggaacagctgtgacctgcctgctgagcccccacagccaggtgctgacagctgccacccagagcctgaaggagatcctgaaggaatgtgtggccccccacatggctgacatcggctctgtgaccagcagcgccagcggccctgcccagagcgtggccaagatgttccgggctgtggaggagggcctgacctacaagttccacgccgcctggagctctgtgctgcagctgctgtgtgtgttctttgaggcctgtggccggcaggcccaccctgtgatgaggaagtgcctgcagagcctgtgtgacctgcggctgagcccccacttcccccacacagctgccctggaccaggccgtgggcgctgctgtgacctccatgggccctgaggtggtgctgcaggccgtgcccctggagattgatggcagcgaggagaccctggacttccccaggtcctggctgctgcctgtgatccgggaccacgtgcaggagacccggctgggcttcttcaccacctacttcctgcccctggccaacaccctgaagagcaaggccatggacctggcccaggccggcagcacagtggagagcaagatctatgacaccctgcagtggcagatgtggaccctgctgcccggcttctgcacccggcccacagatgtggccatctccttcaagggcctggcccggaccctgggcatggccatcagcgagaggccagacctgcgggtgacagtgtgccaggccctgcggaccctcatcaccaagggctgccaggccgaggccgacagagctgaggtgtccagatttgccaagaacttcctgcccatcctcttcaacctgtatggccagcctgtggccgccggggacaccccagccccccggcgggctgtgctggagaccatccgcacctacctgaccatcacagacacccagctggtgaacagcctgctggagaaggccagcgagaaggtgctggaccctgccagcagtgacttcacccggctgtctgtgctggacctggtggtggccctggccccctgtgctgatgaagctgccatcagcaagctgtacagcaccatccggccctacctggagagcaaggcccatggagtgcagaagaaggcctacagagtgctggaggaggtgtgtgccagcccccagggccctggggccctgtttgtgcagagccacctggaggacctgaagaagaccctgctggacagcctgcggagcaccagcagccctgccaagaggccccggctgaagtgcctgctgcacatcgtgaggaagctgtctgctgagcacaaggagttcatcacagccctgatccctgaggtgatcctgtgcaccaaggaggtgtctgtgggcgccaggaagaatgcctttgccctgctggtggagatgggccacgccttcctgcgcttcggcagcaaccaggaggaggccctgcagtgctacctggtgctgatctacccaggcctggtgggcgctgtgaccatggtgtcctgcagcatcctggccctgacccacctgctgtttgagttcaagggcctgatgggcaccagcacagtggagcagctgctggagaatgtgtgcctgctgctggccagcaggaccagagatgtggtgaagagcgccctgggcttcatcaaggtggccgtgacagtgatggatgtggcccacctggccaagcacgtgcagctggtgatggaggccatcggcaagctgagtgatgacatgagaagacacttcaggatgaagctgaggaacctcttcaccaagttcatcaggaagtttggatttgagctggtgaagaggctgctgcctgaggagtaccaccgggtgctggtgaacatcaggaaggccgaggcccgggccaagaggcaccgggccctgagccaggccgctgtggaggaggaggaggaggaggaggaggaggaggagcccgcccagggcaaaggagacagcattgaggagatcctggccgacagtgaagatgaggaggacaatgaggaggaggagaggagccggggcaaggagcagaggaagctggcccggcagaggagccgggcctggctgaaggagggcggcggagatgagcccctgaacttcctggaccccaaggtggcccagagggtgctggccacccagcccggccctggccggggcaggaagaaggaccacggcttcaaggtgtctgcagatggccgcctcatcatccgggaggaggctgatggcaacaagatggaggaggaggagggcgccaagggggaggatgaggagatggctgaccccatggaggatgtgatcatccggaacaagaagcaccagaagctgaagcaccagaaggaggccgaggaggaggagctggagatccccccccagtaccaggccggcggcagcggcatccacaggcctgtggccaagaaggccatgcctggagctgagtacaaggccaagaaggccaagggagatgtgaagaagaagggccgcccagacccctatgcctacatccccctgaacagaagcaagctgaacagaaggaagaagatgaagctgcagggccagttcaagggcctggtgaaggccgcccggcggggcagccaggtgggccacaagaacagaaggaaggacagaagaccctag

SEQ ID NO: 37612 - DNA, 3711 bp, Artificial Sequence
  Description of Artificial Sequence: Synthetic coding sequence
atgggccgcagcggcaagctgcccagcggcgtgtctgccaagctgaagcgctggaagaagggccacagcagtgacagcaacccagccatctgccgccaccggcaggccgcccggagccgcttcttcagccggcccagcggccgcagtgacctgactgtggatgctgtgaagctgcacaatgagctgcagagcggcagcctgcggctgggcaagtctgaggcccctgagacccccatggaggaggaggccgagctggtgctgacagagaagagcagcggcaccttcctgagcggcctgagtgactgcaccaacgtgaccttcagcaaggtgcagcgcttctgggagagcaacagcgctgcccacaaggagatctgtgctgtgctggccgctgtgacagaggtgatccgcagccagggcggcaaggagacagaaacagagtactttgctgccctggtgctgagctgcctggccaccctgctgaggaagcaggacctggaggcctggggctaccctgtgaccctgcaggtgtaccacggcctgctgtccttcaccgtgcaccccaagcccaagatcaggaaggccgcccagcacggcgtgtgcagcgtgctgaagggcagcgagttcatgtttgagaaggccccagcccaccaccctgctgccatcagcacagccaagttctgcatccaggagattgagaagagcggcggcagcaaggaggccaccaccaccctgcacatgctgaccctgctgaaggacctgctgccctgcttccctgagggcctggtgaagagctgcagcgagaccctgctgcgggtgatgaccctgagccacgtgctggtgacagcctgtgccatgcaggccttccacagcctcttccacgcccggcccggcctgagcaccctgtctgctgagctgaatgcccagatcatcacagccctgtatgactatgtgcccagtgaaaatgacctgcagcccctgctggcctggctgaaggtgatggagaaggcccacatcaacctggtgcggctgcagtgggacctgggcctgggccacctgccccgcttcttcggcacagctgtgacctgcctgctgagcccccacagccaggtgctgacagctgccacccagagcctgaaggagatcctgaaggaatgtgtggccccccacatggctgacatcggctctgtgaccagcagcgccagcggccctgcccagagcgtggccaagatgttccgggctgtggaggagggcctgacctacaagttccacgccgcctggagctctgtgctgcagctgctgtgtgtgttctttgaggcctgtggccggcaggcccaccctgtgatgaggaagtgcctgcagagcctgtgtgacctgcggctgagcccccacttcccccacacagctgccctggaccaggccgtgggcgctgctgtgacctccatgggccctgaggtggtgctgcaggccgtgcccctggagattgatggcagcgaggagaccctggacttccccaggtcctggctgctgcccgtcatccgggaccacgtgcaggagacccggctgggcttcttcaccacctacttcctgcccctggccaacaccctgaagagcaaggccatggacctggcccaggccggcagcacagtggagagcaagatctatgacaccctgcagtggcagatgtggaccctgctgcccggcttctgcacccggcccacagatgtggccatctccttcaagggcctggcccggaccctgggcatggccatcagcgagaggccagacctgcgggtgacagtgtgccaggccctgcggaccctcatcaccaagggctgccaggccgaggccgacagagctgaggtgtccagatttgccaagaacttcctgcccatcctcttcaacctgtatggccagcctgtggccgccggggacaccccagcccccaggagagctgtgctggagaccatccgcacctacctgaccatcacagacacccagctggtgaacagcctgctggagaaggccagcgagaaggtgctggaccctgccagcagtgacttcacccggctgtctgtgctggacctggtggtggccctggccccctgtgctgatgaggccgccatcagcaagctgtacagcaccatccggccctacctggagagcaaggcccacggcgtgcagaagaaggcctacagagtgctggaggaggtgtgtgccagcccccagggccctggggccctgtttgtgcagagccacctggaggacctgaagaagaccctgctggacagcctgcggagcaccagcagccctgccaagaggccccggctgaagtgcctgctgcacatcgtgaggaagctgtctgctgagcacaaggagttcatcacagccctgatccctgaggtgatcctgtgcaccaaggaggtgtctgtgggcgccaggaagaatgcctttgccctgctggtggagatgggccacgccttcctgcgcttcggcagcaaccaggaggaggccctgcagtgctacctggtgctgatctacccaggcctggtgggcgctgtgaccatggtgtcctgcagcatcctggccctgacccacctgctgtttgagttcaagggcctgatgggcaccagcacagtggagcagctgctggagaatgtgtgcctgctgctggccagcaggaccagagatgtggtgaagagcgccctgggcttcatcaaggtggccgtgacagtgatggatgtggcccacctggccaagcacgtgcagctggtgatggaggccatcggcaagctgagtgatgacatgaggaggcacttcaggatgaagctgaggaacctcttcaccaagttcatcaggaagtttggatttgagctggtgaagaggctgctgcctgaggagtaccaccgggtgctggtgaacatcaggaaggccgaggcccgggccaagaggcaccgggccctgagccaggccgctgtggaggaggaggaggaggaggaggaggaggaggagcccgcccagggcaagggggacagcattgaggagatcctggccgacagtgaagatgaagaagataatgaggaggaggagaggagccggggcaaggagcagaggaagctggcccggcagaggagccgggcctggctgaaggagggcggcggagatgagcccctgaacttcctggaccccaaggtggcccagagggtgctggccacccagcccggccctggccggggcaggaagaaggaccacggcttcaaggtgtctgcagatggccgcctcatcatccgggaggaggctgatggcaacaagatggaggaggaggagggcgccaagggagaagatgaggagatggctgaccccatggaggatgtgatcatccggaacaagaagcaccagaagctgaagcaccagaaggaggccgaggaggaggagctggagatccccccccagtaccaggccggcggcagcggcatccacaggcctgtggccaagaaggccatgcctggagctgagtacaaggccaagaaggccaagggagatgtgaagaagaagggccgcccagacccctatgcctacatccccctgaacagaagcaagctgaacagaaggaagaagatgaagctgcagggccagttcaagggcctggtgaaggccgcccggcggggcagccaggtgggccacaagaacagaaggaaggaccggcggccctag

SEQ ID NO: 37613 - DNA, 3048 bp, Artificial Sequence
  Description of Artificial Sequence: Synthetic coding sequence
atggacatcatgtctgcccaggccagcagcggcagcacctctgtgctgcgctgggtgctgagctgcctggccaccctgctgaggaagcaggacctggaggcctggggctaccctgtgaccctgcaggtgtaccacggcctgctgtccttcaccgtgcaccccaagcccaagctggtgacagcctgtgccatgcaggccttccacagcctcttccacgcccggcccggcctgagcaccctgtctgctgagctgaatgcccagatcatcacagccctgtatgactatgtgcccagtgaaaatgacctgcagcccctgctggcctggctgaaggtgatggagaaggcccacatcaacctggtgcggctgcagtgggacctgggcctgggccacctgccccgcttctttggaacagctgtgacctgcctgctgagcccccacagccaggtgctgacagctgccacccagagcctgaaggagatcctgaaggaatgtgtggccccccacatggctgacatcggctctgtgaccagcagcgccagcggccctgcccagagcgtggccaagatgttccgggctgtggaggagggcctgacctacaagttccacgccgcctggagctctgtgctgcagctgctgtgtgtgttctttgaggcctgtggccggcaggcccaccctgtgatgaggaagtgcctgcagagcctgtgtgacctgcggctgagcccccacttcccccacacagctgccctggaccaggccgtgggcgctgctgtgacctccatgggccctgaggtggtgctgcaggccgtgcccctggagattgatggcagcgaggagaccctggacttccccaggtcctggctgctgcctgtgatccgggaccacgtgcaggagacccggctgggcttcttcaccacctacttcctgcccctggccaacaccctgaagagcaaggccatggacctggcccaggccggcagcacagtggagagcaagatctatgacaccctgcagtggcagatgtggaccctgctgcccggcttctgcacccggcccacagatgtggccatctccttcaagggcctggcccggaccctgggcatggccatcagcgagaggccagacctgcgggtgacagtgtgccaggccctgcggaccctcatcaccaagggctgccaggccgaggccgacagagctgaggtgtccagatttgccaagaacttcctgcccatcctcttcaacctgtatggccagcctgtggccgccggggacaccccagccccccggcgggctgtgctggagaccatccgcacctacctgaccatcacagacacccagctggtgaacagcctgctggagaaggccagcgagaaggtgctggaccctgccagcagtgacttcacccggctgtctgtgctggacctggtggtggccctggccccctgtgctgatgaagctgccatcagcaagctgtacagcaccatccggccctacctggagagcaaggcccatggagtgcagaagaaggcctacagagtgctggaggaggtgtgtgccagcccccagggccctggggccctgtttgtgcagagccacctggaggacctgaagaagaccctgctggacagcctgcggagcaccagcagccctgccaagaggccccggctgaagtgcctgctgcacatcgtgaggaagctgtctgctgagcacaaggagttcatcacagccctgatccctgaggtgatcctgtgcaccaaggaggtgtctgtgggcgccaggaagaatgcctttgccctgctggtggagatgggccacgccttcctgcgcttcggcagcaaccaggaggaggccctgcagtgctacctggtgctgatctacccaggcctggtgggcgctgtgaccatggtgtcctgcagcatcctggccctgacccacctgctgtttgagttcaagggcctgatgggcaccagcacagtggagcagctgctggagaatgtgtgcctgctgctggccagcaggaccagagatgtggtgaagagcgccctgggcttcatcaaggtggccgtgacagtgatggatgtggcccacctggccaagcacgtgcagctggtgatggaggccatcggcaagctgagtgatgacatgagaagacacttcaggatgaagctgaggaacctcttcaccaagttcatcaggaagtttggatttgagctggtgaagaggctgctgcctgaggagtaccaccgggtgctggtgaacatcaggaaggccgaggcccgggccaagaggcaccgggccctgagccaggccgctgtggaggaggaggaggaggaggaggaggaggaggagcccgcccagggcaaaggagacagcattgaggagatcctggccgacagtgaagatgaggaggacaatgaggaggaggagaggagccggggcaaggagcagaggaagctggcccggcagaggagccgggcctggctgaaggagggcggcggagatgagcccctgaacttcctggaccccaaggtggcccagagggtgctggccacccagcccggccctggccggggcaggaagaaggaccacggcttcaaggtgtctgcagatggccgcctcatcatccgggaggaggctgatggcaacaagatggaggaggaggagggcgccaagggggaggatgaggagatggctgaccccatggaggatgtgatcatccggaacaagaagcaccagaagctgaagcaccagaaggaggccgaggaggaggagctggagatccccccccagtaccaggccggcggcagcggcatccacaggcctgtggccaagaaggccatgcctggagctgagtacaaggccaagaaggccaagggagatgtgaagaagaagggccgcccagacccctatgcctacatccccctgaacagaagcaagctgaacagaaggaagaagatgaagctgcagggccagttcaagggcctggtgaaggccgcccggcggggcagccaggtgggccacaagaacagaaggaaggacagaagaccctag

SEQ ID NO: 37614 - DNA, 849 bp, Artificial Sequence
  Description of Artificial Sequence: Synthetic coding sequence
atggctgctgctgccccagacagccgggtgtctgaggaggagaacctgaagaagacccccaagaagaagatgaagatggtgactggagctgtggcctctgtgctggaggatgaggccacagacaccagtgacagcgagggcagctgtggcagcgagaaggaccacttctacagtgatgatgatgccattgaagctgacagtgaaggagatgctgagccctgtgacaaggaaaatgaaaatgatggagagagctctgtgggcaccaacatgggctgggcagatgccatggccaaggtgctgaacaagaagaccccagagagcaagcccaccatcctggtgaagaacaagaagctggagaaggagaaggagaagctgaagcaggagcggctggagaagatcaagcagagggacaagaggctggagtgggagatgatgtgccgggtgaagccagatgtggtgcaggacaaggagacagagaggaacctgcagagaattgccacccggggcgtggtgcagctgttcaatgctgtgcagaagcaccagaagaatgtggatgagaaggtgaaggaggccggcagctccatgaggaagagggccaagctgatcagcacagtgtccaagaaggacttcatctctgtgctgcggggcatggatggcagcaccaatgaaacagccagcagcaggaagaagcccaaggccaagcagacagaggtgaagtctgaggagggccctggctggaccatcctgagagatgacttcatgatgggcgcctccatgaaggactgggacaaggagagtgatggcccagatgacagcaggcctgagagcgccagtgacagcgacacctag

SEQ ID NO: 37615 - DNA, 729 bp, Artificial Sequence
  Description of Artificial Sequence: Synthetic coding sequence
atgtgggccgctgctgggggcctgtggaggagcagagctggcctgcgggccctcttccgcagcagagatgctgccctcttccctggctgtgagcggggcctgcactgcagcgctgtgtcctgcaagaactggctgaagaagtttgccagcaagaccaagaagaaggtgtggtatgagagccccagcctgggcagccacagcacctacaagcccagcaagctggagttcctgatgaggagcaccagcaagaagaccaggaaggaggaccacgcccggctgcgggccctgaatggcctgctgtacaaggccctgacagacctgctgtgcaccccagaggtgtcccaggagctgtatgacctgaatgtggagctgagcaaggtgtccctgaccccagacttcagcgcctgccgggcctactggaagaccaccctgtctgctgagcagaatgcccacatggaggccgtgctgcagaggtctgctgcccacatgagcctcatctcctactggcagagccagaccctggaccccggcatgaaggagaccaccctgtacaagatgatcagcggcaccctgatgccccacaacccagctgccccccagagccggccccaggcccctgtgtgtgtgggcagcatcatgaggaggagcaccagccggctgtggagcaccaagggcggcaagatcaagggcagcggggcctggtgtggccggggccgctggctgtcctag

SEQ ID NO: 37616 - DNA, 1032 bp, Artificial Sequence
  Description of Artificial Sequence: Synthetic coding sequence
atgtgggccgctgctgggggcctgtggaggagcagagctggcctgcgggccctcttccgcagcagagatgctgccctcttccctggctgtgagcggggcctgcactgcagcgctgtgtcctgcaagaactggctgaagaagtttgccagcaagaccaagaagaaggtgtggtatgagagccccagcctgggcagccacagcacctacaagcccagcaagctggagttcctgatgaggagcaccagcaagaagaccaggaaggaggaccacgcccggctgcgggccctgaatggcctgctgtacaaggccctgacagacctgctgtgcaccccagaggtgtcccaggagctgtatgacctgaatgtggagctgagcaaggtgtccctgaccccagacttcagcgcctgccgggcctactggaagaccaccctgtctgctgagcagaatgcccacatggaggccgtgctgcagaggtctgctgcccacatgaggcacctgctgatgagccagcagaccctgagaaatgtgccccccatcgtgtttgtgcaggacaagggaaatgctgccctggccgagctggaccagctgctggccgtggccgactttggccccagagatgagcgggacaactttgtgcagaatgacttccgggaccctgatgccccccagccctgtggcaccacagagcccaccaccagcagcagcctgtgtggcatcgaccacgaggccctgaacaagcagatcatggagtacaagaggaggaaggacaagggcctgggcggcctggtgtggcagggccaggtggccgagctgaccacccagatgaagaagggcaggaagagggccaagccccggctggagcaggacagcagcctgaagagctacctgtctggagaggaggtggaggatgacctggacctggtgggcgccccagaatatgagtgctacgccccagacacagaggagctggaggccgagcggggcggcggccgcacagaagatggccacagctgtggggccagccgggagtag

SEQ ID NO: 37617 - DNA, 2058 bp, Artificial Sequence
  Description of Artificial Sequence: Synthetic coding sequence
atgtggctgaagctgttcttcctgctgctgtacttcctggtgctgtttgtgctggcccgcttctttgaggccatcgtgtggtatgagaccggcatctttgccacccagctggtggaccctgtggccctgtccttcaagaagctgaagaccatcctggagtgccggggcctgggctacagcggcctgcctgagaagaaggatgtgcgggagctggtggagaagagcggggacctgatggagggggagctgtacagcgccctgaaggaggaggaggccagcgagagcgtgagcagcaccaacttcagcggggagatgcacttctatgagctggtggaggacaccaaggatggcatctggctggtgcaggtgattgccaatgacaggagccccctggtgggcaagatccactgggagaagatggtgaagaaggtgtccagatttggcatcagaacaggcaccttcaactgcagcagtgacccccgctactgcagaagaagaggctgggtgcgcagcaccctcatcatgtctgtgccccagaccagcaccagcaagggcaaggtgatgctgaaggagtacagcggcaggaagattgaggtggagcacatcttcaagtggatcacagcccacgccgccagccgcatcaagaccatctacaatgctgagcacctgaaggaggagtggaacaagagtgaccagtactggctgaagatctacctgtttgccaacctggaccagcccccagccttcttcagcgccctgagcatcaagttcaccggccgggtggagttcatctttgtgaatgtggagaactgggacaacaagagctacatgacagacatcggcatctacaacatgcccagctacatcctgcggaccccagagggcatctaccgctatggcaaccacactggagagttcatcagcctgcaggccatggacagcttcctgcggagcctgcagcctgaggtgaatgacctgtttgtgctgagcctggtgctggtgaacctgatggcctggatggacctcttcatcacccagggcgccaccatcaagagatttgtggtgctgatcagcaccctgggcacctacaacagcctgctgatcatctcctggctgcctgtgctgggcttcctgcagctgccctacctggacagcttctatgagtacagcctgaagctgctgcgctacagcaacaccaccaccctggcctcctgggtgcgggctgactggatgttctacagcagccacccagccctcttcctgagcacctacctgggccacggcctgctgattgactactttgagaagaagagaagaagaaacaacaacaatgatgaggtgaatgccaacaacctggagtggctgagcagcctgtgggactggtacaccagctacctgttccaccccatcgccagcttccagaacttccctgtggagagtgactgggatgaggaccctgacctcttcctggagcggctggccttcccagacctgtggctgcaccccctcatccccacagactacatcaagaacctgcccatgtggaggttcaagtgcctgggcgtgcagagcgaggaggagatgtctgagggcagccaggacacagaaaatgattctgagagcgagaacacagacaccctgagcagcgagaaggaggtgtttgaggacaagcagagcgtgctgcacaacagccctggaacagccagccactgtgatgctgaggcctgcagctgtgccaacaagtactgccagaccagcccctgtgagaggaagggccgctcctatggcagctacaacaccaatgaagacatggagccagactggctgacctggccagctgacatgctgcactgcacagaatgtgtggtgtgcctggagaactttgaaaatggctgcctgctgatgggcctgccctgtggccacgtgttccaccagaactgcatcgtgatgtggctggccggcggccgccactgctgccctgtgtgccgctggcccagctacaagaagaagcagccctatgcccagcaccagcccctgagcaatgatgtgcccagctag

SEQ ID NO: 37618 - DNA, 984 bp, Artificial Sequence
  Description of Artificial Sequence: Synthetic coding sequence
atggctgctgtggtggaggtggaggtgggcggcggggccgccggggagcgggagctggatgaggtggacatgtctgacctgagccctgaggagcagtggagggtggagcacgccaggatgcacgccaagcaccggggccacgaggccatgcacgccgagatggtgctgatcctgattgccaccctggtggtggcccagctgctgctggtgcagtggaagcagaggcaccccaggagctacaacatggtgaccctcttccagatgtgggtggtgcccctgtacttcaccgtgaagctgcactggtggaggttcctggtgatctggatcctcttctctgctgtgacagcctttgtgaccttccgggccaccaggaagcccctggtgcagaccaccccccggctggtgtacaagtggttcctgctgatctacaagatctcctatgccactggaattgtgggctacatggctgtgatgttcaccctgtttggcctgaacctgctcttcaagatcaagccagaagatgccatggactttggcatcagcctgctcttctacggcctgtactatggagtgctggagcgggactttgctgagatgtgtgccgactacatggccagcaccatcggcttctacagcgagagcggcatgcccaccaagcacctgagtgacagcgtgtgtgctgtgtgtggccagcagatctttgtggatgtgtctgaggagggcatcatcgagaacacctaccgcctgagctgcaaccacgtgttccacgagttctgcatccggggctggtgcatcgtgggcaagaagcagacctgcccctactgcaaggagaaggtggacctgaagaggatgttcagcaacccctgggagcggccccacgtgatgtatggccagctgctggactggctgcgctacctggtggcctggcagcctgtgatcatcggcgtggtgcagggcatcaactacatcctgggcctggagtag

SEQ ID NO: 37619 - DNA, 741 bp, Artificial Sequence
  Description of Artificial Sequence: Synthetic coding sequence
atggtgaccctcttccagatgtgggtggtgcccctgtacttcaccgtgaagctgcactggtggaggttcctggtgatctggatcctcttctctgctgtgacagcctttgtgaccttccgggccaccaggaagcccctggtgcagaccaccccccggctggtgtacaagtggttcctgctgatctacaagatctcctatgccaccggcatcgtgggctacatggctgtgatgttcaccctgtttggcctgaacctgctcttcaagatcaagccagaagatgccatggactttggcatcagcctgctcttctacggcctgtactacggcgtgctggagcgggactttgctgagatgtgtgccgactacatggccagcaccatcggcttctacagcgagagcggcatgcccaccaagcacctgagtgacagcgtgtgtgctgtgtgtggccagcagatctttgtggatgtgtctgaggagggcatcatcgagaacacctaccgcctgagctgcaaccacgtgttccacgagttctgcatccggggctggtgcatcgtgggcaagaagcagacctgcccctactgcaaggagaaggtggacctgaagaggatgttcagcaacccctgggagcggccccacgtgatgtatggccagctgctggactggctgcgctacctggtggcctggcagcccgtcatcattggagtggtgcagggcatcaactacatcctgggcctggagtag

SEQ ID NO: 37620 - DNA, 468 bp, Artificial Sequence
  Description of Artificial Sequence: Synthetic coding sequence
atgcaccccttccagtggtgcaatggctgcttctgtggcctgggcctggtgtccaccaacaagagctgcagcatgccacccatctccttccaggacctgcccctgaacatctacatggtgatcttcggcaccggcatctttgtgttcatgctgagcctcatcttctgctgctacttcatcagcaagctgaggaaccaggcccagagcgagagatatggctacaaggaggtggtgctgaagggagatgccaagaagctgcagctgtatggccagacctgtgctgtgtgcctggaggacttcaagggcaaggatgagctgggcgtgctgccctgccagcacgccttccacaggaagtgcctggtgaagtggctggaggtgcgctgtgtgtgccccatgtgcaacaagcccatcgccagccccagcgaggccacccagaacatcggcatcctgctggatgagctggtgtag

SEQ ID NO: 37621 - DNA, 1146 bp, Artificial Sequence
  Description of Artificial Sequence: Synthetic coding sequence
atgctgctgagcatcggcatgctgatgctgagcgccacccaggtgtacaccatcctgactgtgcagctgtttgccttcctgaacctgctgcctgtggaggccgacatcctggcctacaactttgaaaatgccagccagacctttgatgacctgcctgccaggtttggctaccgcctgcctgctgagggcctgaagggcttcctgatcaacagcaagccagaaaatgcctgtgagcccatcgtgcccccacctgtgaaggacaacagcagcggcaccttcatcgtgctgatccggcggctggactgcaactttgacatcaaggtgctgaatgcccagagagctggctacaaggccgccatcgtgcacaacgtggacagtgatgacctgatctccatgggcagcaatgacatcgaggtgctgaagaagattgacatccccagcgtcttcatcggggagagcagcgccaacagcctgaaggatgagttcacctatgagaagggcggccacctgatcctggtgcctgagttcagcctgcccctggagtactacctgatccccttcctgatcatcgtgggcatctgcctgatcctgattgtcatcttcatgatcaccaagtttgtgcaggacagacaccgggcccggaggaaccggctgaggaaggaccagctgaagaagctgcctgtgcacaagttcaagaagggagatgaatatgatgtgtgtgccatctgcctggatgaatatgaagatggagacaagctgcgcatcctgccctgcagccacgcctaccactgcaagtgtgtggacccctggctgaccaagaccaagaagacctgccctgtgtgcaagcagaaggtggtgcccagccagggcgacagcgacagcgacacagacagcagccaggaggagaatgaggtgacagagcacacccccctgctgcggcccctggcctctgtgtctgcccagagctttggagccctgtctgagagccgcagccaccagaacatgacagagagcagtgactatgaagaagatgacaatgaagacacagacagcagtgatgctgaaaatgagatcaatgaacatgatgtggtggtgcagctgcagcccaacggggagcgggactacaacatcgccaacacagtgtag

SEQ ID NO: 37622 - DNA, 1146 bp, Artificial Sequence; identical to SEQ ID NO: 37621
  Description of Artificial Sequence: Synthetic coding sequence

SEQ ID NO: 37623 - DNA, 498 bp, Artificial Sequence
  Description of Artificial Sequence: Synthetic coding sequence
atgctgctgagcatcggcatgctgatgctgagcgccacccaggtgtacaccatcctgactgtgcagctgtttgccttcctgaacctgctgcctgtggaggccgacatcctggcctacaactttgaaaatgccagccagacctttgatgacctgcctgccaggtttggctaccgcctgcctgctgagggcctgaagggcttcctgatcaacagcaagccagaaaatgcctgtgagcccatcgtgcccccacctgtgaaggacaacagcagcggcaccttcatcgtgctgatccggcggctggactgcaactttgacatcaaggtgctgaatgcccagagagctggctacaaggccgccatcgtgcacaacgtggacagtgatgacctgatctccatgggcagcaatgacatcgaggtgctgaagaagattgacatccccagcgtcttcatcggggagagcagcgccaacagcctgaaggatgagttcacctatgaatag

SEQ ID NO: 37624 - DNA, 219 bp, Artificial Sequence
  Description of Artificial Sequence: Synthetic coding sequence
atgctgctgagcatcggcatgctgatgctgagcgccacccaggtgtacaccatcctgactgtgcagctgtttgccttcctgaacctgctgcctgtggaggccgacatcctggcctacaactttgaaaatgccagccagacctttgatgacctgcctgccaggtttggctaccgcctgcctgctgagggcctgaagggcttcctgatcaacagcaagtag

SEQ ID NO: 37625 - DNA, 492 bp, Artificial Sequence
  Description of Artificial Sequence: Synthetic coding sequence
atgctgctgagcatcggcatgctgatgctgagcgccacccaggtgtacaccatcctgactgtgcagctgtttgccttcctgaacctgctgcctgtggaggccgacatcctggcctacaactttgaaaatgccagccagacctttgatgacctgcctgccaggtttggctaccgcctgcctgctgagggcctgaagggcttcctgatcaacagcaagccagaaaatgcctgtgagcccatcgtgcccccacctgtgaaggacaacagcagcggcaccttcatcgtgctgatccggcggctggactgcaactttgacatcaaggtgctgaatgcccagagagctggctacaaggccgccatcgtgcacaacgtggacagtgatgacctgatctccatgggcagcaatgacatcgaggtgctgaagaagattgacatccccagcgtcttcatcggggagagcagcgccaacagcctgaaggatgagttcacctag

SEQ ID NO: 37626 - DNA, 348 bp, Artificial Sequence
  Description of Artificial Sequence: Synthetic coding sequence
atgctgctgagcatcggcatgctgatgctgagcgccacccaggtgtacaccatcctgactgtgcagctgtttgccttcctgaacctgctgcctgtggaggccgacatcctggcctacaactttgaaaatgccagccagacctttgatgacctgcctgccaggtttggctaccgcctgcctgctgagggcctgaagggcttcctgatcaacagcaagccagaaaatgcctgtgagcccatcgtgcccccacctgtgaaggacaacagcagcggcaccttcatcgtgctgatccggcggctggactgcaactttgacatcaaggtgctgaatgcccagagagctggatag

SEQ ID NO: 37627 - DNA, 243 bp, Artificial Sequence
  Description of Artificial Sequence: Synthetic coding sequence
atgctgctgagcatcggcatgctgatgctgagcgccacccaggtgtacaccatcctgactgtgcagctgtttgccttcctgaacctgctgcctgtggaggccgacatcctggcctacaactttgaaaatgccagccagacctttgatgacctgcctgccaggtttggctaccgcctgcctgctgagggcctgaagggcttcctgatcaacagcaagccagaaaatgcctgtgagcccatctag

SEQ ID NO: 37628 - DNA, 273 bp, Artificial Sequence
  Description of Artificial Sequence: Synthetic coding sequence
atgctgctgagcatcggcatgctgatgctgagcgccacccaggtgtacaccatcctgactgtgcagctgtttgccttcctgaacctgctgcctgtggaggccgacatcctggcctacaactttgaaaatgccagccagacctttgatgacctgcctgccaggtttggctaccgcctgcctgctgagggcctgaagggcttcctgatcaacagcaagccagaaaatgcctgtgagcccatcgtgcccccacctgtgaaggacaacagcagctag

SEQ ID NO: 37629 - DNA, 876 bp, Artificial Sequence
  Description of Artificial Sequence: Synthetic coding sequence
atgctgctgagcatcggcatgctgatgctgagcgccacccaggtgtacaccatcctgactgtgcagctgtttgccttcctgaacctgctgcctgtggaggccgacatcctggcctacaactttgaaaatgccagccagacctttgatgacctgcctgccaggtttggctaccgcctgcctgctgagggcctgaagggcttcctgatcaacagcaagccagaaaatgcctgtgagcccatcgtgcccccacctgtgaaggacaacagcagcggcaccttcatcgtgctgatccggcggctggactgcaactttgacatcaaggtgctgaatgcccagagagctggctacaaggccgccatcgtgcacaacgtggacagtgatgacctgatctccatgggcagcaatgacatcgaggtgctgaagaagattgacatccccagcgtcttcatcggggagagcagcgccaacagcctgaaggatgagttcacctatgagaagggcggccacctgatcctggtgcctgagttcagcctgcccctggagtactacctgatccccttcctgatcatcgtgggcatctgcctgatcctgattgtcatcttcatgatcaccaagtttgtgcaggacagacaccgggcccggaggaaccggctgaggaaggaccagctgaagaagctgcctgtgcacaagttcaagaagggagatgaatatgatgtgtgtgccatctgcctggatgaatatgaagatggagacaagctgcgcatcctgccctgcagccacgcctaccactgcaagtgtgtggacccctggctgaccaagaccaagaagacctgccctgtgtgcaagcagaagcccaagcacaagaagaagaagtag

SEQ ID NO: 37630 - DNA, 1260 bp, Artificial Sequence
  Description of Artificial Sequence: Synthetic coding sequence
atgagctgtgccggccgggccggccctgcccggctggccgccctggccctgctgacctgcagcctgtggccagcccgggctgacaatgccagccaggagtactacacagccctgatcaacgtgacagtgcaggagcccggccgcggggcccccctgaccttcagaattgaccggggccgctatggcctggacagccccaaggccgaggtgcggggccaggtgctggcccccctgcccctgcatggagtggccgaccacctgggctgtgacccccagacccgcttctttgtgccccccaacatcaagcagtggatcgccctgctgcagaggggcaactgcaccttcaaggagaagatcagccgggccgccttccacaatgctgtggccgtggtgatctacaacaacaagagcaaggaggagcctgtgaccatgacccaccctggcactggagacatcatcgctgtgatgatcacagagctgcggggcaaggacatcctgagctacctggagaagaacatctctgtgcagatgaccatcgctgtgggcaccaggatgccacccaagaacttcagccggggcagcctggtgtttgtgtccatctccttcatcgtgctgatgatcatcagcagcgcctggctgatcttctacttcatccagaagatccgctacaccaatgcccgggacaggaaccagaggcggctgggagatgctgccaagaaggccatcagcaagctgaccaccaggacagtgaagaagggggacaaggagacagatcctgactttgaccactgtgctgtgtgcatcgagagctacaagcagaatgatgtggtgcgcatcctgccctgcaagcacgtgttccacaagagctgtgtggacccctggctgtctgagcactgcacctgccccatgtgcaagctgaacatcctgaaggccctgggcatcgtgcccaacctgccctgcacagacaacgtggcctttgacatggagcggctgaccaggacccaggccgtgaacagaagaagtgccctgggggacctggccggggacaacagcctgggcctggagcccctgcggaccagcggcatcagccccctgccccaggatggagagctgacccccaggactggagagatcaacattgctgtgaccaaggagtggttcatcatcgccagctttggcctgctgagcgccctgaccctgtgctacatgatcatccgggccacagccagcctgaatgccaatgaggtggagtggttctag

SEQ ID NO: 37631 - DNA, 1131 bp, Artificial Sequence
  Description of Artificial Sequence: Synthetic coding sequence
atgcacctgctgaaggtgggcacctggaggaacaacacagccagctcctggctgatgaagttctctgtgctgtggctggtgtcccagaactgctgccgggcctctgtggtgtggatggcctacatgaacatctccttccacgtgggcaaccacgtgctgtctgagctgggggagactggagtgtttggccgcagcagcaccctgaagagggtggccggcgtgattgtgcccccagagggcaagatccagaatgcctgcaaccccaacaccatcttcagccgcagcaagtacagcgagacctggctggccctgattgagcggggcggctgcaccttcacccagaagatcaaggtggccacagagaagggggccagcggggtcatcatctacaacgtgcccggcactggaaaccaggtgttccccatgttccaccaggcctttgaagatgtggtggtggtgatgattggcaacctgaagggcacagagatcttccacctgatcaagaagggcgtgctgatcacagctgtggtggaggtgggcaggaagcacatcatctggatgaaccactacctggtgtcctttgtgattgtgaccacagccaccctggcctacttcatcttctaccacatccaccggctgtgcctggcccgcatccagaacagacgctggcagaggctgaccacagacctgcagaacaccttcggccagctgcagctgcgggtggtgaaggagggagatgaggagatcaaccccaacggggacagctgtgtgatctgctttgagcgctacaagcccaatgacatcgtgcgcatcctgacctgcaagcacttcttccacaagaactgcatcgacccctggatcctgccccacggcacctgccccatctgcaagtgtgacatcctgaaggtgctgggcatccaggtggtggtggagaatggaacagagcccctgcaggtgctgatgagcaatgagctgcctgagaccctgagccccagcgaggaggagaccaacaatgaggtgtccccagctggcaccagtgacaaggtgattcatgtggaggagaaccccaccagccagaacaatgacatccagccccacagcgtggtggaggatgtgcaccccagcccctag

SEQ ID NO: 37632 - DNA, 879 bp, Artificial Sequence
  Description of Artificial Sequence: Synthetic coding sequence
atgaccaccacccgctaccggcccacctgggacctggccctggaccccctggtgtcctgcaagctgtgcctgggggagtaccctgtggagcagatgaccaccatcgcccagtgccagtgcatcttctgcaccctgtgcctgaagcagtatgtggagctgctgatcaaggagggcctggagacagccatcagctgcccagatgctgcctgccccaagcagggccacctgcaggagaatgaaattgagtgcatggtggccgctgagatcatgcagcgctacaagaagctgcagtttgagcgggaggtgctgtttgacccctgcaggacctggtgcccagccagcacctgccaggccgtgtgccagctgcaggatgtgggcctgcagaccccccagcctgtgcagtgcaaggcctgcaggatggagttctgcagcacctgcaaggcctcctggcaccctggccagggctgcccagagaccatgcccatcaccttcctgcccggggagaccagcgctgccttcaagatggaggaggatgatgcccccatcaagcgctgccccaagtgcaaggtgtacatcgagagagatgagggctgtgcccagatgatgtgcaagaactgcaagcacgccttctgctggtactgcctggagagcctggatgatgacttcctgctgatccactatgacaagggcccctgcaggaacaagctgggccacagccgggccagcgtcatctggcacaggacccaggtggtgggcatctttgctggcttcggcctgctgctgctggtggccagccccttcctgctgctggccaccccatttgtgctgtgctgcaagtgcaagtgcagcaaaggagatgatgaccccctgcccacctag

SEQ ID NO: 37633 - DNA, 168 bp, Artificial Sequence
  Description of Artificial Sequence: Synthetic coding sequence
atgaccaccacccgctaccggcccacctgggacctggccctggaccccctggtgtcctgcaagctgtgcctgggggagtaccctgtggagcagatgaccaccatcgcccagtgccagtgcatcttctgcaccctgtgcctgaagcagtatgtggagctgctgatctag

SEQ ID NO: 37634 - DNA, 597 bp, Artificial Sequence
  Description of Artificial Sequence: Synthetic coding sequence
atgaccaccacccgctaccggcccacctgggacctggccctggaccccctggtgtcctgcaagctgtgcctgggggagtaccctgtggagcagatgaccaccatcgcccagtgccagtgcatcttctgcaccctgtgcctgaagcagtatgtggagctgctgatcaaggagggcctggagacagccatcagctgcccagatgctgcctgccccaagcagggccacctgcaggagaatgaaattgagtgcatggtggccgctgagatcatgcagcgctacaagaagctgcagtttgagcgggaggtgctgtttgacccctgcaggacctggtgcccagccagcacctgccaggccgtgtgccagctgcaggatgtgggcctgcagaccccccagcctgtgcagtgcaaggcctgcaggatggagttctgcagcacctgcaaggcctcctggcaccctggccagggctgcccagagaccatgcccatcaccttcctgcccggggagaccagcgctgccttcaagatggaggaggatgatgcccccatcaagcgctgccccaagtgcagcaaaggagatgatgaccccctgcccacctag

SEQ ID NO: 37635 - DNA, 168 bp, Artificial Sequence; identical to SEQ ID NO: 37633
  Description of Artificial Sequence: Synthetic coding sequence

SEQ ID NO: 37636 - DNA, 912 bp, Artificial Sequence
  Description of Artificial Sequence: Synthetic coding sequence
atgggcagcgctggccgcctgcactacctggccatgacagctgagaaccccacccctggggacctggccccagcccccctcatcacctgcaagctgtgcctgtgtgagcagagcctggacaagatgaccaccctgcaggagtgccagtgcatcttctgcacagcctgcctgaagcagtacatgcagctggccatccgggagggctgcggcagccccatcacctgcccagacatggtgtgcctgaaccacggcaccctgcaggaggccgagatcgcctgcctggtgcctgtggaccagttccagctgtaccagaggctgaagtttgagcgggaggtgcacctggacccctaccgcacctggtgccctgtggccgactgccagacagtgtgccctgtggccagcagtgaccccggccagcctgtgctggtggagtgccccagctgccacctgaagttctgcagctgctgcaaggatgcctggcacgccgaggtgtcctgccgggacagccagcccatcgtgctgcccacagagcaccgggccctgtttggaacagatgctgaggcccccatcaagcagtgccctgtgtgccgggtgtacatcgagagaaatgaaggctgtgcccagatgatgtgcaagaactgcaagcacaccttctgctggtactgcctgcagaacctggacaatgacatcttcctgcggcactatgacaagggcccctgcaggaacaagctgggccacagccgggcctctgtgatgtggaacagaacccaggtggtgggcatcctggtgggcctgggcatcatcgccctggtgaccagccccctgctgctgctggccagcccctgcatcatctgctgcgtgtgcaagagctgccggggcaagaagaagaagcatgaccccagcaccacctag

SEQ ID NO: 37637 - DNA, 645 bp, Artificial Sequence
  Description of Artificial Sequence: Synthetic coding sequence
atgctgtggatcaccatgccccacccagcccacctgggcctcttcatcgctgtgaccctgtctgaggtgcacctggacccctaccgcacctggtgccctgtggccgactgccagacagtgtgccctgtggccagcagtgaccccggccagcctgtgctggtggagtgccccagctgccacctgaagttctgcagctgctgcaaggatgcctggcatgctgaggtgtcctgccgggacagccagcccatcgtgctgcccacagagcaccgggccctgtttggaacagatgctgaggcccccatcaagcagtgccctgtgtgccgggtgtacattgaaagaaatgaaggctgtgcccagatgatgtgcaagaactgcaagcacaccttctgctggtactgcctgcagaacctggacaatgacatcttcctgcggcactatgacaagggcccctgcaggaacaagctgggccacagccgggcctctgtgatgtggaacagaacccaggtggtgggcatcctggtgggcctgggcatcatcgccctggtgaccagccccctgctgctgctggccagcccctgcatcatctgctgcgtgtgcaagagctgccggggcaagaagaagaagcatgaccccagcaccacctag

SEQ ID NO: 37638 - DNA, 2076 bp, Artificial Sequence
  Description of Artificial Sequence: Synthetic coding sequence
atgatgaggaaccacagaattgccagcagcctgtgtggggaccaggtgttcagcaagaagaagaagaagaagaagaagaacaacatggccgccaaggagaagctggaggccgtgctgaatgtggccctgcgggtgcccagcatcatgctgctggatgtgctgtaccgctgggatgtgtcctccttcttccagcagatccagaggagcagcctgagcaacaaccccctcttccagtacaagtacctggccctgaacatgcactacgtgggctacatcctgtctgtggtgctgctgaccctgccccggcagcacctggtgcagctgtacctgtacttcctgacagccctgctgctgtatgccggccaccagatcagccgggactatgtgcgctctgagctggagtttgcctatgagggccccatgtacctggagcccctgtccatgaaccgcttcaccacagccctgattggccagctggtggtgtgcaccctgtgcagctgtgtgatgaagaccaagcagatctggctgttcagcgcccacatgctgcccctgctggcccggctgtgcctggtgcccctggagaccatcgtcatcatcaacaagtttgccatgatcttcaccggcctggaggtgctgtacttcctgggcagcaacctgctggtgccctacaacctggccaagagcgcctaccgggagctggtgcaggtggtggaggtgtatggcctgctggccctgggcatgagcctgtggaaccagctggtggtgcctgtgctcttcatggtgttctggctggtgctgtttgccctgcagatctacagctacttcagcacccgggaccagcctgccagccgggagcggctgctcttcctgttcctgaccagcattgctgagtgctgcagcaccccctacagcctgctgggcctggtgttcaccgtgtcctttgtggccctgggcgtgctgaccctgtgcaagttctacctgcagggctaccgggccttcatgaatgaccctgccatgaacagaggcatgacagagggcgtgaccctgctgatcctggccgtgcagacaggcctgattgagctgcaggtggtgcaccgggccttcctgctgagcatcatcctcttcatcgtggtggccagcatcctgcagagcatgctggagattgctgaccccatcgtgctggccctgggcgccagccgggacaagagcctgtggaagcacttccgggctgtgtccctgtgcctcttcctgctggtgtttcctgcctacatggcctacatgatctgccagttcttccacatggacttctggctgctgatcatcatcagcagcagcatcctgaccagcctgcaggtgctgggcaccctcttcatctacgtgctcttcatggtggaggagttcaggaaggagcctgtggagaacatggatgatgtgatctactacgtgaatggcacctaccgcctgctggagttcctggtggccctgtgtgtggtggcctacggcgtgtctgagaccatctttggagagtggacagtgatgggctccatgatcatcttcatccacagctactacaacgtgtggctgcgggcccagctgggctggaagagcttcctgctgcggagagatgctgtgaacaagatcaagagcctgcccatcgccaccaaggagcagctggagaagcacaatgacatctgtgccatctgctaccaggacatgaagtctgctgtgatcaccccctgcagccacttcttccacgccggctgcctgaagaagtggctgtatgtgcaggagacctgccccctgtgccactgccacctgaagaacagcagccagctgcccggcctgggcacagagcctgtgctgcagccccatgctggagctgagcagaatgtgatgttccaggagggcacagagcccccaggccaggagcacaccccaggcacccgcatccaggagggcagccgggacaacaatgagtacatcgcccggcggccagacaaccaggagggcgcctttgaccccaaggagtacccccacagcgccaaggatgaggcccaccctgtggagagcgcctag

SEQ ID NO: 37639 - DNA, 2043 bp, Artificial Sequence
  Description of Artificial Sequence: Synthetic coding sequence
atggccgaggtggtgttcagcaagaagaagaagaagaagaagaagaacaacatggccgccaaggagaagctggaggccgtgctgaatgtggccctgcgggtgcccagcatcatgctgctggatgtgctgtaccgctgggatgtgagcagcttcttccagcagatccagaggagcagcctgagcaacaaccccctcttccagtacaagtacctggccctgaacatgcactacgtgggctacatcctgtctgtggtgctgctgaccctgccccggcagcacctggtgcagctgtacctgtacttcctgacagccctgctgctgtatgccggccaccagatcagccgggactatgtgcgctctgagctggagtttgcctatgagggccccatgtacctggagcccctgtccatgaaccgcttcaccacagccctgattggccagctggtggtgtgcaccctgtgcagctgtgtgatgaagaccaagcagatctggctgttcagcgcccacatgctgcccctgctggcccggctgtgcctggtgcccctggagaccatcgtcatcatcaacaagtttgccatgatcttcaccggcctggaggtgctgtacttcctgggcagcaacctgctggtgccctacaacctggccaagagcgcctaccgggagctggtgcaggtggtggaggtgtatggcctgctggccctgggcatgagcctgtggaaccagctggtggtgcctgtgctcttcatggtgttctggctggtgctgtttgccctgcagatctacagctacttcagcacccgggaccagcctgccagccgggagcggctgctcttcctgttcctgaccagcattgctgagtgctgcagcaccccctacagcctgctgggcctggtgttcaccgtgtcctttgtggccctgggcgtgctgaccctgtgcaagttctacctgcagggctaccgggccttcatgaatgaccctgccatgaacagaggcatgacagaaggagtgaccctgctgatcctggccgtgcagacaggcctcatcgagctgcaggtggtgcaccgggccttcctgctgagcatcatcctcttcatcgtggtggccagcatcctgcagagcatgctggagattgctgaccccatcgtgctggccctgggcgccagccgggacaagagcctgtggaagcacttccgggctgtgtccctgtgcctcttcctgctggtgtttcctgcctacatggcctacatgatctgccagttcttccacatggacttctggctgctgatcatcatcagcagcagcatcctgaccagcctgcaggtgctgggcaccctcttcatctacgtgctcttcatggtggaggagttcaggaaggagcctgtggagaacatggatgatgtgatctactacgtgaatggcacctaccgcctgctggagttcctggtggccctgtgtgtggtggcctatggagtgtctgagaccatctttggagagtggacagtgatgggctccatgatcatcttcatccacagctactacaacgtgtggctgcgggcccagctgggctggaagagcttcctgctgcggagagatgctgtgaacaagatcaagagcctgcccatcgccaccaaggagcagctggagaagcacaatgacatctgtgccatctgctaccaggacatgaagtctgctgtgatcaccccctgcagccacttcttccacgccggctgcctgaagaagtggctgtatgtgcaggagacctgccccctgtgccactgccacctgaagaacagcagccagctgcccggcctgggcacagagcctgtgctgcagccccacgccggggctgagcagaatgtgatgttccaggagggcacagagcccccaggccaggagcacaccccaggcacccgcatccaggagggcagccgggacaacaatgagtacatcgcccggcggccagacaaccaggagggcgcctttgaccccaaggagtacccccacagcgccaaggatgaggcccaccctgtggagagcgcctag

SEQ ID NO: 37640 - DNA, 1992 bp, Artificial Sequence
  Description of Artificial Sequence: Synthetic coding sequence
atggccgccaaggagaagctggaggccgtgctgaatgtggccctgcgggtgcccagcatcatgctgctggatgtgctgtaccgctgggatgtgtcctccttcttccagcagatccagaggagcagcctgagcaacaaccccctcttccagtacaagtacctggccctgaacatgcactacgtgggctacatcctgtctgtggtgctgctgaccctgccccggcagcacctggtgcagctgtacctgtacttcctgacagccctgctgctgtatgccggccaccagatcagccgggactatgtgcgctctgagctggagtttgcctatgagggccccatgtacctggagcccctgtccatgaaccgcttcaccacagccctgattggccagctggtggtgtgcaccctgtgcagctgtgtgatgaagaccaagcagatctggctgttcagcgcccacatgctgcccctgctggcccggctgtgcctggtgcccctggagaccatcgtcatcatcaacaagtttgccatgatcttcaccggcctggaggtgctgtacttcctgggcagcaacctgctggtgccctacaacctggccaagagcgcctaccgggagctggtgcaggtggtggaggtgtatggcctgctggccctgggcatgagcctgtggaaccagctggtggtgcctgtgctcttcatggtgttctggctggtgctgtttgccctgcagatctacagctacttcagcacccgggaccagcctgccagccgggagcggctgctcttcctgttcctgaccagcattgctgagtgctgcagcaccccctacagcctgctgggcctggtgttcaccgtgtcctttgtggccctgggcgtgctgaccctgtgcaagttctacctgcagggctaccgggccttcatgaatgaccctgccatgaacagaggcatgacagagggcgtgaccctgctgatcctggccgtgcagacaggcctgattgagctgcaggtggtgcaccgggccttcctgctgagcatcatcctcttcatcgtggtggccagcatcctgcagagcatgctggagattgctgaccccatcgtgctggccctgggcgccagccgggacaagagcctgtggaagcacttccgggctgtgtccctgtgcctcttcctgctggtgtttcctgcctacatggcctacatgatctgccagttcttccacatggacttctggctgctgatcatcatcagcagcagcatcctgaccagcctgcaggtgctgggcaccctcttcatctacgtgctcttcatggtggaggagttcaggaaggagcctgtggagaacatggatgatgtgatctactacgtgaatggcacctaccgcctgctggagttcctggtggccctgtgtgtggtggcctacggcgtgtctgagaccatctttggagagtggacagtgatgggctccatgatcatcttcatccacagctactacaacgtgtggctgcgggcccagctgggctggaagagcttcctgctgcggagagatgctgtgaacaagatcaagagcctgcccatcgccaccaaggagcagctggagaagcacaatgacatctgtgccatctgctaccaggacatgaagtctgctgtgatcaccccctgcagccacttcttccacgccggctgcctgaagaagtggctgtatgtgcaggagacctgccccctgtgccactgccacctgaagaacagcagccagctgcccggcctgggcacagagcctgtgctgcagccccatgctggagctgagcagaatgtgatgttccaggagggcacagagcccccaggccaggagcacaccccaggcacccgcatccaggagggcagccgggacaacaatgagtacatcgcccggcggccagacaaccaggagggcgcctttgaccccaaggagtacccccacagcgccaaggatgaggcccaccctgtggagagcgcctag

SEQ ID NO: 37641 - DNA, 2082 bp, Artificial Sequence
  Description of Artificial Sequence: Synthetic coding sequence
atgcaccgggaccgcatcagccccagcaacagccccacctggagcctgcaggtgttcagcaagaagaagaagaagaagaagaagaacaacatggccgccaaggagaagctggaggccgtgctgaatgtggccctgcgggtgcccagcatcatgctgctggatgtgctgtaccgctgggatgtgtcctccttcttccagcagatccagaggagcagcctgagcaacaaccccctcttccagtacaagtacctggccctgaacatgcactacgtgggctacatcctgtctgtggtgctgctgaccctgccccggcagcacctggtgcagctgtacctgtacttcctgacagccctgctgctgtatgccggccaccagatcagccgggactatgtgcgctctgagctggagtttgcctatgagggccccatgtacctggagcccctgtccatgaaccgcttcaccacagccctgattggccagctggtggtgtgcaccctgtgcagctgtgtgatgaagaccaagcagatctggctgttcagcgcccacatgctgcccctgctggcccggctgtgcctggtgcccctggagaccatcgtcatcatcaacaagtttgccatgatcttcaccggcctggaggtgctgtacttcctgggcagcaacctgctggtgccctacaacctggccaagagcgcctaccgggagctggtgcaggtggtggaggtgtatggcctgctggccctgggcatgagcctgtggaaccagctggtggtgcctgtgctcttcatggtgttctggctggtgctgtttgccctgcagatctacagctacttcagcacccgggaccagcctgccagccgggagcggctgctcttcctgttcctgaccagcattgctgagtgctgcagcaccccctacagcctgctgggcctggtgttcaccgtgtcctttgtggccctgggcgtgctgaccctgtgcaagttctacctgcagggctaccgggccttcatgaatgaccctgccatgaacagaggcatgacagagggcgtgaccctgctgatcctggccgtgcagacaggcctgattgagctgcaggtggtgcaccgggccttcctgctgagcatcatcctcttcatcgtggtggccagcatcctgcagagcatgctggagattgctgaccccatcgtgctggccctgggcgccagccgggacaagagcctgtggaagcacttccgggctgtgtccctgtgcctcttcctgctggtgtttcctgcctacatggcctacatgatctgccagttcttccacatggacttctggctgctgatcatcatcagcagcagcatcctgaccagcctgcaggtgctgggcaccctcttcatctacgtgctcttcatggtggaggagttcaggaaggagcctgtggagaacatggatgatgtgatctactacgtgaatggcacctaccgcctgctggagttcctggtggccctgtgtgtggtggcctacggcgtgtctgagaccatctttggagagtggacagtgatgggctccatgatcatcttcatccacagctactacaacgtgtggctgcgggcccagctgggctggaagagcttcctgctgcggagagatgctgtgaacaagatcaagagcctgcccatcgccaccaaggagcagctggagaagcacaatgacatctgtgccatctgctaccaggacatgaagtctgctgtgatcaccccctgcagccacttcttccacgccggctgcctgaagaagtggctgtatgtgcaggagacctgccccctgtgccactgccacctgaagaacagcagccagctgcccggcctgggcacagagcctgtgctgcagccccatgctggagctgagcagaatgtgatgttccaggagggcacagagcccccaggccaggagcacaccccaggcacccgcatccaggagggcagccgggacaacaatgagtacatcgcccggcggccagacaaccaggagggcgcctttgaccccaaggagtacccccacagcgccaaggatgaggcccaccctgtggagagcgcctag

SEQ ID NO: 37642 - DNA, 1992 bp, Artificial Sequence; identical to SEQ ID NO: 37640
  Description of Artificial Sequence: Synthetic coding sequence

SEQ ID NO: 37643 - DNA, 2034 bp, Artificial Sequence
  Description of Artificial Sequence: Synthetic coding sequence
atggtgttcagcaagaagaagaagaagaagaagaagaacaacatggccgccaaggagaagctggaggccgtgctgaatgtggccctgcgggtgcccagcatcatgctgctggatgtgctgtaccgctgggatgtgtcctccttcttccagcagatccagaggagcagcctgagcaacaaccccctcttccagtacaagtacctggccctgaacatgcactacgtgggctacatcctgtctgtggtgctgctgaccctgccccggcagcacctggtgcagctgtacctgtacttcctgacagccctgctgctgtatgccggccaccagatcagccgggactatgtgcgctctgagctggagtttgcctatgagggccccatgtacctggagcccctgtccatgaaccgcttcaccacagccctgattggccagctggtggtgtgcaccctgtgcagctgtgtgatgaagaccaagcagatctggctgttcagcgcccacatgctgcccctgctggcccggctgtgcctggtgcccctggagaccatcgtcatcatcaacaagtttgccatgatcttcaccggcctggaggtgctgtacttcctgggcagcaacctgctggtgccctacaacctggccaagagcgcctaccgggagctggtgcaggtggtggaggtgtatggcctgctggccctgggcatgagcctgtggaaccagctggtggtgcctgtgctcttcatggtgttctggctggtgctgtttgccctgcagatctacagctacttcagcacccgggaccagcctgccagccgggagcggctgctcttcctgttcctgaccagcattgctgagtgctgcagcaccccctacagcctgctgggcctggtgttcaccgtgtcctttgtggccctgggcgtgctgaccctgtgcaagttctacctgcagggctaccgggccttcatgaatgaccctgccatgaacagaggcatgacagagggcgtgaccctgctgatcctggccgtgcagacaggcctgattgagctgcaggtggtgcaccgggccttcctgctgagcatcatcctcttcatcgtggtggccagcatcctgcagagcatgctggagattgctgaccccatcgtgctggccctgggcgccagccgggacaagagcctgtggaagcacttccgggctgtgtccctgtgcctcttcctgctggtgtttcctgcctacatggcctacatgatctgccagttcttccacatggacttctggctgctgatcatcatcagcagcagcatcctgaccagcctgcaggtgctgggcaccctcttcatctacgtgctcttcatggtggaggagttcaggaaggagcctgtggagaacatggatgatgtgatctactacgtgaatggcacctaccgcctgctggagttcctggtggccctgtgtgtggtggcctacggcgtgtctgagaccatctttggagagtggacagtgatgggctccatgatcatcttcatccacagctactacaacgtgtggctgcgggcccagctgggctggaagagcttcctgctgcggagagatgctgtgaacaagatcaagagcctgcccatcgccaccaaggagcagctggagaagcacaatgacatctgtgccatctgctaccaggacatgaagtctgctgtgatcaccccctgcagccacttcttccacgccggctgcctgaagaagtggctgtatgtgcaggagacctgccccctgtgccactgccacctgaagaacagcagccagctgcccggcctgggcacagagcctgtgctgcagccccatgctggagctgagcagaatgtgatgttccaggagggcacagagcccccaggccaggagcacaccccaggcacccgcatccaggagggcagccgggacaacaatgagtacatcgcccggcggccagacaaccaggagggcgcctttgaccccaaggagtacccccacagcgccaaggatgaggcccaccctgtggagagcgcctag

SEQ ID NO: 37644 - DNA, 2040 bp, Artificial Sequence
  Description of Artificial Sequence: Synthetic coding sequence
atggccgaggtgttcagcaagaagaagaagaagaagaagaagaacaacatggccgccaaggagaagctggaggccgtgctgaatgtggccctgcgggtgcccagcatcatgctgctggatgtgctgtaccgctgggatgtgtcctccttcttccagcagatccagaggagcagcctgagcaacaaccccctcttccagtacaagtacctggccctgaacatgcactacgtgggctacatcctgtctgtggtgctgctgaccctgccccggcagcacctggtgcagctgtacctgtacttcctgacagccctgctgctgtatgccggccaccagatcagccgggactatgtgcgctctgagctggagtttgcctatgagggccccatgtacctggagcccctgtccatgaaccgcttcaccacagccctgattggccagctggtggtgtgcaccctgtgcagctgtgtgatgaagaccaagcagatctggctgttcagcgcccacatgctgcccctgctggcccggctgtgcctggtgcccctggagaccatcgtcatcatcaacaagtttgccatgatcttcaccggcctggaggtgctgtacttcctgggcagcaacctgctggtgccctacaacctggccaagagcgcctaccgggagctggtgcaggtggtggaggtgtatggcctgctggccctgggcatgagcctgtggaaccagctggtggtgcctgtgctcttcatggtgttctggctggtgctgtttgccctgcagatctacagctacttcagcacccgggaccagcctgccagccgggagcggctgctcttcctgttcctgaccagcattgctgagtgctgcagcaccccctacagcctgctgggcctggtgttcaccgtgtcctttgtggccctgggcgtgctgaccctgtgcaagttctacctgcagggctaccgggccttcatgaatgaccctgccatgaacagaggcatgacagagggcgtgaccctgctgatcctggccgtgcagacaggcctgattgagctgcaggtggtgcaccgggccttcctgctgagcatcatcctcttcatcgtggtggccagcatcctgcagagcatgctggagattgctgaccccatcgtgctggccctgggcgccagccgggacaagagcctgtggaagcacttccgggctgtgtccctgtgcctcttcctgctggtgtttcctgcctacatggcctacatgatctgccagttcttccacatggacttctggctgctgatcatcatcagcagcagcatcctgaccagcctgcaggtgctgggcaccctcttcatctacgtgctcttcatggtggaggagttcaggaaggagcctgtggagaacatggatgatgtgatctactacgtgaatggcacctaccgcctgctggagttcctggtggccctgtgtgtggtggcctacggcgtgtctgagaccatctttggagagtggacagtgatgggctccatgatcatcttcatccacagctactacaacgtgtggctgcgggcccagctgggctggaagagcttcctgctgcggagagatgctgtgaacaagatcaagagcctgcccatcgccaccaaggagcagctggagaagcacaatgacatctgtgccatctgctaccaggacatgaagtctgctgtgatcaccccctgcagccacttcttccacgccggctgcctgaagaagtggctgtatgtgcaggagacctgccccctgtgccactgccacctgaagaacagcagccagctgcccggcctgggcacagagcctgtgctgcagccccatgctggagctgagcagaatgtgatgttccaggagggcacagagcccccaggccaggagcacaccccaggcacccgcatccaggagggcagccgggacaacaatgagtacatcgcccggcggccagacaaccaggagggcgcctttgaccccaaggagtacccccacagcgccaaggatgaggcccaccctgtggagagcgcctag

SEQ ID NO: 37645 - DNA, 1992 bp, Artificial Sequence; identical to SEQ ID NO: 37640
  Description of Artificial Sequence: Synthetic coding sequence

SEQ ID NO: 37646 - DNA, 918 bp, Artificial Sequence
  Description of Artificial Sequence: Synthetic coding sequence
atgtccttcctgcgcatcacccccagcacccacagctctgtgagcagcggcctgctgcggctgagcatcttcctgctgctgtccttcccagacagcaatggcaaggccatctggacagcccacctgaacatcaccttccaggtgggcaatgagatcaccagcgagctgggggagagcggcgtgtttggaaaccacagccccctggagcgggtgtctggagtggtggccctgcctgagggctggaaccagaatgcctgccaccccctgaccaacttcagccggcccaagcaggccgacagctggctggccctgattgagcggggcggctgcaccttcacccacaagatcaacgtggccgctgagaagggggccaatggagtcatcatctacaactaccagggcaccggcagcaaggtgttccccatgagccaccagggcacagagaacatcgtggccgtgatgatcagcaacctgaagggcatggagatcctgcacagcatccagaagggcgtgtatgtgaccgtcatcatcgaggtgggccgcatgcacatgcagtgggtgagccactacatcatgtacctgttcaccttcctggccgccaccatcgcctacttctacctggactgtgtgtggaggctgaccccccgggtgcccaacagcttcacccggcggcgcagccagatcaagacagatgtgaagaaggccatcgaccagctgcagctgcgggtgctgaaggagggagatgaggagctggacctgaatgaagacaactgtgtggtgtgctttgacacctacaagccccaggatgtggtgcgcatcctgacctgcaagcacttcttccacaaggcctgcatcgacccctggctgctggcccacaggacctgccccatgtgcaagtgtgacatcctgaagacctag

SEQ ID NO: 37647 - DNA, 1203 bp, Artificial Sequence
  Description of Artificial Sequence: Synthetic coding sequence
atggcctggaggagaagagaggcctctgtgggcgcccggggcgtgctggccctggccctgctggccctggccctgtgtgtgcctggggcccggggccgggccctggagtggttctctgctgtggtgaacatcgagtatgtggacccccagaccaacctgactgtgtggagcgtgtctgagagcggccgctttggagacagcagccccaaggagggcgcccacggcctggtgggcgtgccctgggcccctggaggagacctggagggctgtgccccagacacccgcttctttgtgcctgagcccggcggccgcggggccgccccctgggtggccctggtggcccggggcggctgcaccttcaaggacaaggtgctggtggccgccaggagaaatgccagcgctgtggtgctgtacaatgaggagagatatggcaacatcaccctgcccatgagccatgctggcactggaaacatcgtggtgatcatgatctcctaccccaagggccgggagatcctggagctggtgcagaagggcatccctgtgaccatgaccatcggcgtgggcaccaggcatgtgcaggagttcatcagcggccagagcgtggtgtttgtggccatcgccttcatcaccatgatgatcatcagcctggcctggctgatcttctactacatccagcgcttcctgtacacaggcagccagatcggcagccagagccacaggaaggagaccaagaaggtgattggccagctgctgctgcacacagtgaagcatggagagaagggcattgatgtggatgctgagaactgtgctgtgtgcatcgagaacttcaaggtgaaggacatcatccgcatcctgccctgcaagcacatcttccaccgcatctgcatcgacccctggctgctggaccacaggacctgccccatgtgcaagctggatgtgatcaaggccctgggctactggggcgagcctggagatgtgcaggagatgcctgcccctgagagccccccaggccgggaccctgctgccaacctgagcctggccctgcctgatgatgatggcagtgatgacagcagccccccatctgccagccctgctgagagcgagccccagtgtgaccccagcttcaagggagatgctggagaaaatacagccctgctggaggccggccgcagtgacagcagacatggaggccccatctcctag

SEQ ID NO: 37648 - DNA, 1191 bp, Artificial Sequence
  Description of Artificial Sequence: Synthetic coding sequence
atggccatgagcctcatccaggcctgctgcagcctggccctgagcacctggctgctgtccttctgctttgtgcacctgctgtgcctggacttcaccgtggccgagaaggaggagtggtacacagcctttgtgaacatcacctatgcagagcccgccccagaccctggagctggagctgctgggggcggcggcgctgagctgcacacagagaagacagaatgtggccgctatggagagcacagccccaagcaggatgcccggggggaggtggtgatggccagcagcgcccatgaccggctggcctgtgaccccaacaccaagtttgctgcccccacccggggcaagaactggatcgccctgatccccaagggcaactgcacctacagagacaagatcagaaatgccttcctgcagaatgccagcgctgtggtgatcttcaacgtgggcagcaacaccaatgagaccatcaccatgcctcatgctggggtggaggacatcgtggccatcatgatccctgagcccaagggcaaggagatcgtgtccctgctggagaggaacatcaccgtgaccatgtacatcaccatcggcaccaggaacctgcagaagtaccgccgcctgggagatgctgccaagaaggccatcagcaagctgcagatccgcaccatcaagaagggggacaaggagacagaaagtgactttgacaactgtgctgtgtgcatcgagggctacaagcccaatgatgtggtgcgcatcctgccctgccgccacctgttccacaagagctgtgtggacccctggctgctggaccacaggacctgccccatgtgcaagatgaacatcctgaaggccctgggcatccccccaaatgctgactgcatggatgacctgcccacagactttgagggcagcctgggcggcccccccaccaaccagatcactggagccagtgacaccaccgtgaatgaatcttctgtgaccctggaccctgctgtgaggacagtgggcgccctgcaggtggtgcaggacacagaccccatcccccaggagggagatgtgatcttcaccaccaacagcgagcaggagcctgctgtgtccagtgacagcgacatcagcctcatcatggccatggaggtgggcctgagtgatgtggagctgagcacagaccaggactgtgaggaggtgaagagctag

SEQ ID NO: 37649 - DNA, 894 bp, Artificial Sequence
  Description of Artificial Sequence: Synthetic coding sequence
atgagcagccacgcccagcccctgaagctgatcagcccctgcccctacagcctgagcagcggcgtggaggacatcgtggccatcatgatccctgagcccaagggcaaggagatcgtgtccctgctggagaggaacatcaccgtgaccatgtacatcaccatcggcaccaggaacctgcagaagtatgtgtccaggacctctgtggtgtttgtgtccatctccttcatcgtgctgatgatcatcagcctggcctggctggtgttctactacatccagcgcttccgctatgccaatgcccgggacaggaaccagaggcggctgggagatgctgccaagaaggccatcagcaagctgcagatccgcaccatcaagaagggggacaaggagacagaaagtgactttgacaactgtgctgtgtgcatcgagggctacaagcccaatgatgtggtgcgcatcctgccctgccgccacctgttccacaagagctgtgtggacccctggctgctggaccacaggacctgccccatgtgcaagatgaacatcctgaaggccctgggcatccccccaaatgctgactgcatggatgacctgcccacagactttgagggcagcctgggcggcccccccaccaaccagatcaccggggccagtgacaccaccgtgaatgaatcttctgtgaccctggaccctgctgtgaggacagtgggcgccctgcaggtggtgcaggacacagaccccatcccccaggagggagatgtgatcttcaccaccaacagcgagcaggagcctgctgtgtccagtgacagcgacatcagcctcatcatggccatggaggtgggcctgagtgatgtggagctgagcacagaccaggactgtgaggaggtgaagagctag

SEQ ID NO: 37650 - DNA, 894 bp, Artificial Sequence; identical to SEQ ID NO: 37649
  Description of Artificial Sequence: Synthetic coding sequence

SEQ ID NO: 37651 - DNA, 1218 bp, Artificial Sequence
  Description of Artificial Sequence: Synthetic coding sequence
atggccatgagcctcatccaggcctgctgcagcctggccctgagcacctggctgctgtccttctgctttgtgcacctgctgtgcctggacttcaccgtggccgagaaggaggagtggtacacagcctttgtgaacatcacctatgcagagcccgccccagaccctggagctggagctgctgggggcggcggcgctgagctgcacacagagaagacagaatgtggccgctatggagagcacagccccaagcaggatgcccggggggaggtggtgatggccagcagcgcccatgaccggctggcctgtgaccccaacaccaagtttgctgcccccacccggggcaagaactggatcgccctgatccccaagggcaactgcacctacagagacaagatcagaaatgccttcctgcagaatgccagcgctgtggtgatcttcaacgtgggcagcaacaccaatgagaccatcaccatgcctcatgctggggtggaggacatcgtggccatcatgatccctgagcccaagggcaaggagatcgtgtccctgctggagaggaacatcaccgtgaccatgtacatcaccatcggcaccaggaacctgcagaagtatgtgtccaggacctctgtggtgtttgtgtccatctccttcatcgtgctgatgatcatcagcctggcctggctggtgttctactacatccagcgcttccgctatgccaatgcccgggacaggaaccagaggcggctgggagatgctgccaagaaggccatcagcaagctgcagatccgcaccatcaagaagggggacaaggagacagaaagtgactttgacaactgtgctgtgtgcatcgagggctacaagcccaatgatgtggtgcgcatcctgccctgccgccacctgttccacaagagctgtgtggacccctggctgctggaccacaggacctgccccatgtgcaagatgaacatcctgaaggccctgggcatccccccaaatgctgactgcatggatgacctgcccacagactttgagggcagcctgggcggcccccccaccaaccagatcactggagccagtgacaccaccgtgaatgaatcttctgtgaccctggaccctgctgtgaggacagtgggcgccctgcaggtggtgcaggacacagaccccatcccccaggagggagatgtgatcttcaccaccaacagcgagttctgccacacctag

SEQ ID NO: 37652 - DNA, 1317 bp, Artificial Sequence
  Description of Artificial Sequence: Synthetic coding sequence
atggccatgagcctcatccaggcctgctgcagcctggccctgagcacctggctgctgtccttctgctttgtgcacctgctgtgcctggacttcaccgtggccgagaaggaggagtggtacacagcctttgtgaacatcacctatgcagagcccgccccagaccctggagctggagctgctgggggcggcggcgctgagctgcacacagagaagacagaatgtggccgctatggagagcacagccccaagcaggatgcccggggggaggtggtgatggccagcagcgcccatgaccggctggcctgtgaccccaacaccaagtttgctgcccccacccggggcaagaactggatcgccctgatccccaagggcaactgcacctacagagacaagatcagaaatgccttcctgcagaatgccagcgctgtggtgatcttcaacgtgggcagcaacaccaatgagaccatcaccatgcctcatgctggggtggaggacatcgtggccatcatgatccctgagcccaagggcaaggagatcgtgtccctgctggagaggaacatcaccgtgaccatgtacatcaccatcggcaccaggaacctgcagaagtatgtgtccaggacctctgtggtgtttgtgtccatctccttcatcgtgctgatgatcatcagcctggcctggctggtgttctactacatccagcgcttccgctatgccaatgcccgggacaggaaccagaggcggctgggagatgctgccaagaaggccatcagcaagctgcagatccgcaccatcaagaagggggacaaggagacagaaagtgactttgacaactgtgctgtgtgcatcgagggctacaagcccaatgatgtggtgcgcatcctgccctgccgccacctgttccacaagagctgtgtggacccctggctgctggaccacaggacctgccccatgtgcaagatgaacatcctgaaggccctgggcatccccccaaatgctgactgcatggatgacctgcccacagactttgagggcagcctgggcggcccccccaccaaccagatcactggagccagtgacaccaccgtgaatgaatcttctgtgaccctggaccctgctgtgaggacagtgggcgccctgcaggtggtgcaggacacagaccccatcccccaggagggagatgtgatcttcaccaccaacagcgagcaggagcctgctgtgtccagtgacagcgacatcagcctcatcatggccatggaggtgggcctgagtgatgtggagctgagcacagaccaggactgtgaggaggtgaagagctag

SEQ ID NO: 37653 - DNA, 612 bp, Artificial Sequence
  Description of Artificial Sequence: Synthetic coding sequence
atggagaccctgagccaggacagcctgctggagtgccagatctgcttcaactactacagccccaggagaagacccaagctgctggactgcaagcacacctgctgcagcgtgtgcctgcagcagatgaggaccagccagaaggatgtgcgctgcccctggtgccggggcgtgaccaagctgcccccaggcttctctgtgtcccagctgcctgatgatcctgaggtgctggccgtgattgccatcccccacaccagcgagcacacccctgtgttcatcaagctgcccagcaatggctgctacatgctgcccctgcccatcagcaaggagcgggccctgctgcccggggacatgggctgccgcctgctgcccggcagccagcagaagtctgtgacagtggtgaccatcccagctgagcagcagcccctgcagggcggggccccccaggaggccgtggaggaggagcaggacagaagaggagtggtgaagagcagcacctggagcggcgtgtgcaccgtcatcctggtggcctgtgtgctggtgttcctgctgggcatcgtgctgcacaacatgagctgcatcagcaagcgcttcaccgtcatcagctgtggctag

SEQ ID NO: 37654 - DNA, 1053 bp, Artificial Sequence
  Description of Artificial Sequence: Synthetic coding sequence
atgcaccctgctgccttccccctgcctgtggtggtggccgctgtgctgtggggcgccgcccccacccggggcctcatccgggccaccagtgaccacaatgcctccatggactttgctgacctgcctgccctgtttggagccaccctgagccaggagggcctgcagggcttcctggtggaggcccacccagacaatgcctgcagccccatcgcccctcctcctccagcccctgtgaatggatctgtgttcatcgccctgctgcggagatttgactgcaactttgacctgaaggtgctgaatgcccagaaggccggctacggggctgctgtggtgcacaacgtgaacagcaatgagctgctgaacatggtgtggaacagcgaggagatccagcagcagatctggatccccagcgtcttcatcggggagaggagcagcgagtacctgcgggccctgtttgtgtatgagaagggggcccgggtgctgctggtgcctgacaacaccttccccctgggctactacctgatccccttcaccggcatcgtgggcctgctggtgctggccatgggcgctgtgatgattgcccgctgcatccagcacaggaagaggctgcagaggaaccggctgaccaaggagcagctgaagcagatccccacccatgactaccagaagggggaccagtatgatgtgtgtgccatctgcctggatgaatatgaagatggagacaagctgcgggtgctgccctgtgcccacgcctaccacagccgctgtgtggacccctggctgacccagaccaggaagacctgccccatctgcaagcagcctgtgcaccggggccctggagatgaggaccaggaggaggagacccagggccaggaggagggagatgaaggagagccccgggaccacccagccagcgagaggacccccctgctgggcagcagccccaccctgcccaccagctttggcagcctggccccagcccccctggtgtttcctggccccagcacagacccccccctgagcccccccagcagccctgtgatcctggtgtag

SEQ ID NO: 37655 - DNA, 489 bp, Artificial Sequence
  Description of Artificial Sequence: Synthetic coding sequence
atgcacctgctgcccctggacagcagcagcaccctgacctgcaccgtgcccagcgcctgcaccaagccacccagccgctggaggcccaccgtggacatcttctttgtggtgaccctgctgctgactgtgtttggagaagatgaccagagccaggatgtgctgcggctgcaccaggacatcaatgactacaacagacgcttcagcggccagcccaggagcatcatggagcgcatcatggacctgcccaccctgctgcggcatgccttccgggagatgttttctgtgggcggcctcttctggatgttccgcatccgcatcatcctgtgcctgatgggcgccttcttctacctgatcagccccctggactttgtgcctgaggccctgtttggcatcctgggcttcctggatgacttctttgtgatcttcctgctgctgatctacatcagcatcatgtaccgggaggtgatcacccagaggctgaccaggtag

SEQ ID NO: 37656 - DNA, 603 bp, Artificial Sequence
  Description of Artificial Sequence: Synthetic coding sequence
atggccaagtaccagggcgaggtgcagagcctgaagctggatgatgattctgtgattgaaggagtgtctgaccaggtgctggtggccgtggtggtgtcctttgccctgattgccaccctggtgtatgccctcttcagaaatgtgcaccagaacatccaccctgagaaccaggagctggtgcgggtgctgcgggagcagctgcagacagagcaggatgccccagctgccacccggcagcagttctacacagacatgtactgccccatctgcctgcaccaggccagcttccctgtggagaccaactgtggccacctgttctgtggggcctgcatcatcgcctactggaggtatggctcctggctgggcgccatcagctgccccatctgccggcagacaggcagcagcgagaagagcagccgggccagcgagcagacccaccaggaggccgtggcctgcctggacacccagaacagccctgcctgcaccgtgggctgccgcagcggcccccagcacatcccccatgacaggatgctgcccagcgccagcccccggctgtgcttcaccctgctggactgtgtgtccatcctgtggttctctggatag

SEQ ID NO: 37657 - DNA, 138 bp, Artificial Sequence
  Description of Artificial Sequence: Synthetic coding sequence
atggccaagtaccagggcgaggtgcagagcctgaagctggatgatgattctgtgattgaaggagtgtctgaccaggtgctggtggccgtggtggtgtcctttgccctgattgccaccctggtgtatgccctcttctag

SEQ ID NO: 37658 - DNA, 777 bp, Artificial Sequence
  Description of Artificial Sequence: Synthetic coding sequence
atggccaagtaccagggcgaggtgcagagcctgaagctggatgatgattctgtgattgaaggagtgtctgaccaggtgctggtggccgtggtggtgtcctttgccctgattgccaccctggtgtatgccctcttcagaaatgtgcaccagaacatccaccctgagaaccaggagctggtgcgggtgctgcgggagcagctgcagacagagcaggatgccccagctgccacccggcagcagttctacacagacatgtactgccccatctgcctgcaccaggccagcttccctgtggagaccaactgtggccacctgttctgtggggcctgcatcatcgcctactggaggtatggctcctggctgggcgccatcagctgccccatctgccggcagacagtgaccctgctgctgactgtgtttggagaagatgaccagagccaggatgtgctgcggctgcaccaggacatcaatgactacaacagacgcttcagcggccagcccaggagcatcatggagcgcatcatggacctgcccaccctgctgcggcatgccttccgggagatgttttctgtgggcggcctcttctggatgttccgcatccgcatcatcctgtgcctgatgggcgccttcttctacctgatcagccccctggactttgtgcctgaggccctgtttggcatcctgggcttcctggatgacttctttgtgatcttcctgctgctgatctacatcagcatcatgtaccgggaggtgatcacccagaggctgaccaggtag

SEQ ID NO: 37659 - DNA, 348 bp, Artificial Sequence
  Description of Artificial Sequence: Synthetic coding sequence
atggccaagtaccagggcgaggtgcagagcctgaagctggatgatgattctgtgattgaaggagtgtctgaccaggtgctggtggccgtggtggtgtcctttgccctgattgccaccctggtgtatgccctcttcagaaatgtgcaccagaacatccaccctgagaaccaggagctggtgcgggtgctgcgggagcagctgcagacagagcaggatgccccagctgccacccggcagcagttctacacagacatgtactgccccatctgcctgcaccaggccagcttccctgtggagaccaactgtggccacctgttctgtggggcctgcatcatcgcctactggtag

SEQ ID NO: 37660 - DNA, 777 bp, Artificial Sequence; identical to SEQ ID NO: 37658
  Description of Artificial Sequence: Synthetic coding sequence

SEQ ID NO: 37661 - DNA, 525 bp, Artificial Sequence
  Description of Artificial Sequence: Synthetic coding sequence
atgtactgccccatctgcctgcaccaggccagcttccctgtggagaccaactgtggccacctgttctgtggggcctgcatcatcgcctactggaggtatggctcctggctgggcgccatcagctgccccatctgccggcagacagtgaccctgctgctgactgtgtttggagaagatgaccagagccaggatgtgctgcggctgcaccaggacatcaatgactacaacagacgcttcagcggccagcccaggagcatcatggagcgcatcatggacctgcccaccctgctgcggcatgccttccgggagatgttttctgtgggcggcctcttctggatgttccgcatccgcatcatcctgtgcctgatgggcgccttcttctacctgatcagccccctggactttgtgcctgaggccctgtttggcatcctgggcttcctggatgacttctttgtgatcttcctgctgctgatctacatcagcatcatgtaccgggaggtgatcacccagaggctgaccaggtag

SEQ ID NO: 37662 - DNA, 546 bp, Artificial Sequence
  Description of Artificial Sequence: Synthetic coding sequence
atggctgaccccaccatcctggtgtacaagtggttcctgctgatctacaagctgtcctatgccttcggcgtggtgggctacctggccatcatgttcaccatgtgtggcttcaacctcttcttcaagatcaaggcccgggacagcatggactttggaattgtgtccctcttctacggcctgtactacggcgtgatgggccgggactttgctgagatctgcagcgactacatggccagcaccatcggcttctacagcgtgtcccggctgcccaccaggagcctgagtgacaacatctgtgctgtgtgtggccagaagatcatcgtggagctggatgaggagggcctgattgagaacacctaccagctgagctgcaaccacgtgtaccccttccagaggaagctgtttggcctgcaccaggccagcttcttcccccccagccccccacctcctcctgtgcccatcagcagcatcctgctgaccttccacgcccagacccctgtgctgtaccccccagcccagagcagcctgcctgtgtgcccctgctag

SEQ ID NO: 37663 - DNA, 987 bp, Artificial Sequence
  Description of Artificial Sequence: Synthetic coding sequence
atggctgctggaacagctgccaggaaggccgcccctgtgctggaggccccaccccagcaggagcagctgagccacaccaagctgtctgctgaggacacctggaacctgcagcaggagaggatgtacaagatgcaccggggccatgacagcatgcacgtggagatgatcctgatcttcctgtgtgtgctggtgattgcccagatcgtgctggtgcagtggaggcagagacatggccgcagctacaacctggtgaccctgctgcagatgtgggtggtgcccctgtacttcaccatcaagctgtactggtggaggttcctgtccatgtggggcatgttttctgtcatcaccagctacatcctcttccgggccaccaggaagcccctgagcggccgcaccccccggctggtgtacaagtggttcctgctgatctacaagctgtcctatgccttcggcgtggtgggctacctggccatcatgttcaccatgtgtggcttcaacctcttcttcaagatcaaggcccgggacagcatggactttggaattgtgtccctcttctacggcctgtactacggcgtgatgggccgggactttgctgagatctgcagcgactacatggccagcaccatcggcttctacagcgtgtcccggctgcccaccaggagcctgagtgacaacatctgtgctgtgtgtggccagaagatcatcgtggagctggatgaggagggcctgattgagaacacctaccagctgagctgcaaccacgtgttccacgagttctgcatccggggctggtgcatcgtgggcaagaagcagacctgcccctactgcaaggagaaggtggacctgaagaggatgatcagcaacccctgggagaggacccacttcctgtatggccagatcctggactggctgcgctacctggtggcctggcagcctgtggtgattggaattgtgcagggcatcatctacagcctgggcctggagtag

SEQ ID NO: 37664 - DNA, 1251 bp, Artificial Sequence
  Description of Artificial Sequence: Synthetic coding sequence
atgaagaggagcaaggagctgatcaccaagaaccacagccaggaggagaccagcatcctgcgctgctggaagtgcaggaaatgtattgccagcagcggctgcttcatggagtacctggagaaccaggtgatcaaggacaaggatgacagcgtggatgcccagaacatctgccacgtgtggcacatgaatgtggaggccctgcctgagtggatcagctgcctgatccagaaggcccagtggacagtgggcaagctgaactgccccttctgtggggcccggctgggcggcttcaactttgtgtccacccccaagtgcagctgtggccagctggccgctgtgcacctgagcaagagcaggacagactaccagcccacccaggccggccgcctgatgaggcccagcgtgaagtacctgagccacccccgggtgcagagcggctgtgacaaggaggccctgctgaccggcggcggctctgaaaatagaaaccaccggctgctgaacatggccaggaacaacaatgaccccggccgcctgacagaggccctgtgcctggaggtgcggcccacctactttgagatgaagaatgagaagctgctgagcaaggccagcgagcccaagtaccagctgtttgtgccccagctggtgacaggccgctgtgccacccgggccttccacaggaagagccacagcctggacctgaacatcagcgagaagctgaccctgctgcccaccctgtatgagatccacagcaagaccacagcctacagccggctgaatgagacccagcccatcgacctgagcggcctgcccctgcagagcagcaagaacagctacagcttccagaaccccagcagctttgaccccagcatgctgctgcagcgcttctctgtggcccctcatgagacccagacccagagaggaggagagttccagtgtggcctggaggccgcctctgtgtacagcgaccacaccaacaccaacaacctgaccttcctgatggacctgcccagcgctggccgctccatgcctgaggccagtgaccaggaggagcacctgagccccctggacttcctgcacagcgccaacttcagcctgggcagcatcaaccagaggctgaacaagcgggagaggagcaagctgaagaacctgcggaggaagcagaggagaagagagcgctggctgcagaagcagggcaagtacagcggcgtgggcctgctggaccacatggtgtccatctacctgctgatctag

SEQ ID NO: 37665 - DNA, 291 bp, Artificial Sequence
  Description of Artificial Sequence: Synthetic coding sequence
atgaagaggagcaaggagctgatcaccaagaaccacagccaggaggagaccagcatcctgcgctgctggaagtgcaggaaatgtattgccagcagcggctgcttcatggagtacctggagaaccaggtgatcaaggacaaggatgacagcgtggatgcccagaacatctgccacgtgtggcacatgaatgtggaggccctgcctgagtggatcagctgcctgatccagaagggcaagtacagcggcgtgggcctgctggaccacatggtgtccatctacctgctgatctag

SEQ ID NO: 37666 - DNA, 1779 bp, Artificial Sequence
  Description of Artificial Sequence: Synthetic coding sequence
atgaagaggagcaaggagctgatcaccaagaaccacagccaggaggagaccagcatcctgcgctgctggaagtgcaggaaatgtattgccagcagcggctgcttcatggagtacctggagaaccaggtgatcaaggacaaggatgacagcgtggatgcccagaacatctgccacgtgtggcacatgaatgtggaggccctgcctgagtggatcagctgcctgatccagaaggcccagtggacagtgggcaagctgaactgccccttctgtggggcccggctgggcggcttcaactttgtgtccacccccaagtgcagctgtggccagctggccgctgtgcacctgagcaagagcaggacagactaccagcccacccaggccggccgcctgatgaggcccagcgtgaagtacctgagccacccccgggtgcagagcggctgtgacaaggaggccctgctgaccggcggcggctctgaaaatagaaaccaccggctgctgaacatggccaggaacaacaatgaccccggccgcctgacagaggccctgtgcctggaggtgcggcccacctactttgagatgaagaatgagaagctgctgagcaaggccagcgagcccaagtaccagctgtttgtgccccagctggtgacaggccgctgtgccacccgggccttccacaggaagagccacagcctggacctgaacatcagcgagaagctgaccctgctgcccaccctgtatgagatccacagcaagaccacagcctacagccggctgaatgagacccagcccatcgacctgagcggcctgcccctgcagagcagcaagaacagctacagcttccagaaccccagcagctttgaccccagcatgctgctgcagcgcttctctgtggcccctcatgagacccagacccagagaggaggagagttccagtgtggcctggaggccgcctctgtgtacagcgaccacaccaacaccaacaacctgaccttcctgatggacctgcccagcgctggccgctccatgcctgaggccagtgaccaggaggagcacctgagccccctggacttcctgcacagcgccaacttcagcctgggcagcatcaaccagaggctgaacaagcgggagaggagcaagctgaagaacctgcggaggaagcagaggagaagagagcgctggctgcagaagcagggcaagtacagcggcgtgggcctgctggaccacatgaccctgaacaatgagatgagcacagatgaagataatgaatatgcagaggagaaggacagctacatctgtgctgtgtgcctggatgtgtacttcaacccctacatgtgctacccctgccaccacatcttctgtgagccctgcctgcggaccctggccaaggacaaccccagcagcaccccctgccccctgtgcaggaccatcatcagcagggtcttcttccagacagagctgaacaatgccaccaagaccttcttcaccaaggagtacctgaagatcaagcagagcttccagaagagcaacagcgccaagtggcccctgcccagctgcaggaaggccttccacctgtttggaggcttcagaagacatgctgcccctgtgacccggcggcagttcccccacggggcccacaggatggactacctgcactttgaagatgacagccggggctggtggtttgacatggacatggtgatcatctacatctacagcgtgaactgggtgattggcttcatcgtgttctgcttcctgtgctacttcttcttccccttctag

SEQ ID NO: 37667 - DNA, 324 bp, Artificial Sequence
  Description of Artificial Sequence: Synthetic coding sequence
atgaagaggagcaaggagctgatcaccaagaaccacagccaggaggagaccagcatcctgcgctgctggaagtgcaggaaatgtattgccagcagcggctgcttcatggagtacctggagaaccaggtgatcaaggacaaggatgacagcgtggatgcccagaacatctgccacgtgtggcacatgaatgtggaggccctgcctgagtggatcagctgcctgatccagaaggcccagtggacagtgggcaagctgaactgccccttctgtggggcccggctgggcggcttcaactttgtgtccacccccaagtgcagctgctag

SEQ ID NO: 37668 - DNA, 489 bp, Artificial Sequence
  Description of Artificial Sequence: Synthetic coding sequence
atggccagccagcccccagaggacacagctgagagccaggccagtgatgagctggagtgcaagatctgctacaaccgctacaacctgaagcagaggaagcccaaggtgctggagtgctgccaccgggtgtgtgccaagtgcctgtacaagatcatcgactttggagacagcccccagggcgtcatcgtgtgccccttctgccgctttgagacctgcctgcctgatgatgaggtgagcagcctgcctgatgacaacaacatcctggtgaacctgacctgtggcggcaagggcaagaagtgcctgcctgagaaccccacagagctgctgctgacccccaagaggctggccagcctggtgagccccagccacaccagcagcaactgcctggtgatcaccatcatggaggtgcagcgggagagcagccccagcctgagcagcacccctgtggtggagttctacagacctgccagctttgacagcgtgacctag

SEQ ID NO: 37669 - DNA, 249 bp, Artificial Sequence
  Description of Artificial Sequence: Synthetic coding sequence
atggccagccagcccccagaggacacagctgagagccaggccagtgatgagctggagtgcaagatctgctacaaccgctacaacctgaagcagaggaagcccaaggtgctggagtgctgccaccgggtgtgtgccaagtgcctgtacaagatcatcgactttggagacagcccccagggcgtcatcgtgtgccccttctgccgctttgagacctgcctgcctgatgatgaggtgagcagcctgccctag

SEQ ID NO: 37670 - DNA, 42 bp, Artificial Sequence
  Description of Artificial Sequence: Synthetic coding sequence
atggccagccagcccccagaggacacagctgagagccagtag

SEQ ID NO: 37671 - DNA, 744 bp, Artificial Sequence
  Description of Artificial Sequence: Synthetic coding sequence
atggccagccagcccccagaggacacagctgagagccaggccagtgatgagctggagtgcaagatctgctacaaccgctacaacctgaagcagaggaagcccaaggtgctggagtgctgccaccgggtgtgtgccaagtgcctgtacaagatcatcgactttggagacagcccccagggcgtcatcgtgtgccccttctgccgctttgagacctgcctgcctgatgatgaggtgagcagcctgcctgatgacaacaacatcctggtgaacctgacctgtggcggcaagggcaagaagtgcctgcctgagaaccccacagagctgctgctgacccccaagaggctggccagcctggtgagccccagccacaccagcagcaactgcctggtgatcaccatcatggaggtgcagcgggagagcagccccagcctgagcagcacccctgtggtggagttctacagacctgccagctttgacagcgtgaccaccgtgagccacaactggacagtgtggaactgcaccagcctgctcttccagaccagcatccgggtgctggtgtggctgctgggcctgctgtacttcagcagcctgcccctgggcatctacctgctggtgtccaagaaggtgaccctgggcgtggtgtttgtgtccctggtgcccagcagcctggtgatcctgatggtgtatggcttctgccagtgtgtgtgccacgagttcctggactgcatggccccacccagctag

SEQ ID NO: 37672 - DNA, 156 bp, Artificial Sequence
  Description of Artificial Sequence: Synthetic coding sequence
atggccagccagcccccagaggacacagctgagagccaggccagtgatgagctggagtgcaagatctgctacaaccgctacaacctgaagcagaggaagcccaaggtgctggagtgctgccaccgggtgtgtgccaagtgcctgtacaagatctag

SEQ ID NO: 37673 - DNA, 744 bp, Artificial Sequence; identical to SEQ ID NO: 37671
  Description of Artificial Sequence: Synthetic coding sequence

SEQ ID NO: 37674 - DNA, 744 bp, Artificial Sequence; identical to SEQ ID NO: 37671
  Description of Artificial Sequence: Synthetic coding sequence

SEQ ID NO: 37675 - DNA, 744 bp, Artificial Sequence; identical to SEQ ID NO: 37671
  Description of Artificial Sequence: Synthetic coding sequence

SEQ ID NO: 37676 - DNA, 579 bp, Artificial Sequence
  Description of Artificial Sequence: Synthetic coding sequence
atggccagcaagggccccagcgccagcgccagccctgagaacagcagcgctgggggccccagcggcagcagcaatggagctggggagagcggcggccaggacagcacctttgagtgcaacatctgcctggacacagccaaggatgctgtgatcagcctgtgtggccacctgttctgctggccctgcctgcaccagtggctggagacccggcccaaccggcaggtgtgccctgtgtgcaaggccggcatcagccgggacaaggtgatccccctgtatggccggggcagcacaggccagcaggacccccgggagaagaccccaccccggccccagggccagaggcctgagcctgagaacagaggaggcttccagggcttcggctttggagatggcggcttccagatgagctttggaattggagccttccccttcggcatctttgccacagccttcaacatcaatgatggccggcccccacctgctgtgcccggcaccccccagtatgtggatgagcagttcctgagccgcctcttcctgtttgtggccctggtgatcatgttctggctgctgattgcctag

SEQ ID NO: 37677 - DNA, 393 bp, Artificial Sequence
  Description of Artificial Sequence: Synthetic coding sequence
atggccctggcccgggcagagggccgcacagccctgagcagcgccaccagcgcctggacccagcccaggatgcccagcagcgcctgtgtggccaccagctctgtgggccgggtgtacatccgggagaagaccccaccccggccccagggccagaggcctgagcctgagaacagaggaggcttccagggcttcggctttggagatggcggcttccagatgagctttggaattggagccttccccttcggcatctttgccacagccttcaacatcaatgatggccggcccccacctgctgtgcccggcaccccccagtatgtggatgagcagttcctgagccgcctcttcctgtttgtggccctggtgatcatgttctggctgctgattgcctag

SEQ ID NO: 37678 - DNA, 474 bp, Artificial Sequence
  Description of Artificial Sequence: Synthetic coding sequence
atggccagcaagggccccagcgccagcgccagccctgagaacagcagcgctgggggccccagcggcagcagcaatggagctggggagagcggcggccaggacagcacctttgagtgcaacatctgcctggacacagccaaggatgctgtgatcagcctgtgtggccacctgttctgctggccctgcctgcaccagtggctggagacccggcccaaccggcaggtgtgccctgtgtgcaaggccggcatcagccgggacaaggtgatccccctgtatggccggggcagcacaggccagcaggacccccgggagaagaccccaccccggccccagggccagaggcctgagcctgagaacagaggagtgaggaacatcctgggggaggccagcaccaatgagctgatggccctggaggtgtccttcctggccctgcagttcttcagcctcatcatcaaggtgaaggagaacctgtag

SEQ ID NO: 37679 - DNA, 579 bp, Artificial Sequence; identical to SEQ ID NO: 37676
  Description of Artificial Sequence: Synthetic coding sequence

SEQ ID NO: 37680 - DNA, 411 bp, Artificial Sequence
  Description of Artificial Sequence: Synthetic coding sequence
atggccagcaagggccccagcgccagcgccagccctgagaacagcagcgctgggggccccagcggcagcagcaatggagctggggagagcggcggccaggacagcacctttgagtgcaacatctgcctggacacagccaaggatgctgtgatcagcctgtgtggccacctgttctgctggccctgcctgcaccagggcttccagggcttcggctttggagatggcggcttccagatgagctttggaattggagccttccccttcggcatctttgccacagccttcaacatcaatgatggccggcccccacctgctgtgcccggcaccccccagtatgtggatgagcagttcctgagccgcctcttcctgtttgtggccctggtgatcatgttctggctgctgattgcctag

SEQ ID NO: 37681 - DNA, 2517 bp, Artificial Sequence
  Description of Artificial Sequence: Synthetic coding sequence
atgcaggagcaggagatcggcttcatcagcaagtacaatgaaggcctgtgtgtgaacacagatcctgtgtccatcctgaccagcatcctggacatgagcctgcaccggcagatgggcagtgaccgggacctgcagagcagcgccagctctgtgtccctgcccagcgtgaagaaggcccccaagaagaggcgcatcagcatcggcagcctcttccggaggaagaaggacaacaagaggaagagccgggagctgaatggaggagtggatggcatcgccagcattgagagcatccacagcgagatgtgcacagacaagaacagcatcttcagcaccaacaccagcagtgacaatggcctgaccagcatcagcaagcagatcggggacttcattgaatgtcccctgtgcctgctgcggcacagcaaggaccgcttcccagacatcatgacctgccaccacaggagctgtgtggactgcctgcggcagtacctgagaattgagatcagcgagagccgggtgaacatcagctgcccagagtgcacagagcgcttcaacccccatgacatccgcctcatcctgagtgatgatgtgctgatggagaagtatgaggagttcatgctgcggcgctggctggtggccgaccctgactgccgctggtgcccagccccagactgtggctatgctgtgattgccttcggctgtgccagctgccccaagctgacctgtggccgggagggctgcggcacagagttctgctaccactgcaagcagatctggcaccccaaccagacctgtgatgctgcccggcaggagcgggcccagagcctgcggctgcggaccatccgcagcagcagcatctcctacagccaggagagcggggctgctgctgatgacatcaagccctgcccccgctgtgccgcctacatcatcaagatgaatgatggcagctgcaaccacatgacctgtgctgtgtgtggctgtgagttctgctggctgtgcatgaaggagatcagtgacctgcactacctgagccccagcggctgcaccttctggggcaagaagccctggagcaggaagaagaagatcctgtggcagctgggcaccctggtgggcgcccctgtgggcatcgccctgattgctggcatcgccatcccagccatgatcatcggcatccctgtgtatgtgggcaggaagatccacaacagatatgagggcaaggatgtgtccaagcacaagaggaacctggccatcgccggcggcgtgaccctgtctgtgattgtgtcccctgtggtggccgctgtgacagtgggcattggagtgcccatcatgctggcctacgtgtatggagtggtgcccatcagcctgtgccgcagcggcggctgcggcgtgtctgctggaaatggcaagggcgtgcgcatcgagtttgatgatgaaaatgacatcaacgtgggcggcaccaacacagctgtggacaccacctctgtggccgaggcccggcacaaccccagcattggagagggctctgtgggcggcctgaccggcagcctgagcgccagcggcagccacatggacagaattggagccatccgggacaacctgtctgaaacagccagcaccatggccctggccggggccagcatcaccggcagcctgagcggcagcgccatggtgaactgcttcaaccggctggaggtgcaggctgatgtgcagaaggagcgctacagcctgagcggggagagcggcaccgtgtccctgggcaccgtgtctgacaatgccagcaccaaggccatggccggcagcatcctgaacagctacatccccctggacaaggagggcaacagcatggaggtgcaggtggacatcgagagcaagcccagcaagttccgccacaacagcggcagcagctctgtggatgatggcagcgccaccaggagccacgccggcggcagcagcagcggcctgcctgagggcaagagcagcgccaccaagtggagcaaggaggccacagctgggaagaagagcaagagcggcaagctgaggaagaagggcaacatgaagatcaatgagacccgggaggacatggatgcccagctgctggagcagcagagcaccaacagcagcgagtttgaggcccccagcctgagtgacagcatgcccagcgtggccgacagccacagcagccacttcagcgagttcagctgcagcgacctggagagcatgaagaccagctgcagccacggcagcagtgactaccacaccaggtttgccaccgtgaacatcctgcctgaggtggagaatgaccggctggagaacagcccccaccagtgcagcatctctgtggtgacccagacagccagctgcagcgaggtgtcccagctgaaccacatcgccgaggagcacggcaacaacggcatcaagcccaacgtggacctgtactttggagatgccctgaaggagaccaacaacaaccacagccaccagaccatggagctgaaggtggccatccagacagagatctag

SEQ ID NO: 37682 - DNA, 270 bp, Artificial Sequence
  Description of Artificial Sequence: Synthetic coding sequence
atgcaggagcaggagatcggcttcatcagcaagtacaatgaaggcctgtgtgtgaacacagatcctgtgtccatcctgaccagcatcctggacatgagcctgcaccggcagatgggcagtgaccgggacctgcagagcagcgccagctctgtgtccctgcccagcgtgaagaaggcccccaagaagaggcgcatcagcatcggcagcctcttccggaggaagaaggacaacaagaggaagagccgggagctgaatggaggagtggactag

SEQ ID NO: 37683 - DNA, 2517 bp, Artificial Sequence; identical to SEQ ID NO: 37681
  Description of Artificial Sequence: Synthetic coding sequence

SEQ ID NO: 37684 - DNA, 498 bp, Artificial Sequence
  Description of Artificial Sequence: Synthetic coding sequence
atgcaggagcaggagatcggcttcatcagcaagtacaatgaaggcctgtgtgtgaacacagatcctgtgtccatcctgaccagcatcctggacatgagcctgcaccggcagatgggcagtgaccgggacctgcagagcagcgccagctctgtgtccctgcccagcgtgaagaaggcccccaagaagaggcgcatcagcatcggcagcctcttccggaggaagaaggacaacaagaggaagagccgggagctgaatggaggagtggatggcatcgccagcattgagagcatccacagcgagatgtgcacagacaagaacagcatcttcagcaccaacaccagcagtgacaatggcctgaccagcatcagcaagcagatcggggacttcattgaatgtcccctgtgcctgctgcggcacagcaaggaccgcttcccagacatcatgacctgccaccacaggagctgtgtggactgcctgcggcagtacctgcgcatctag

SEQ ID NO: 37685 - DNA, 342 bp, Artificial Sequence
  Description of Artificial Sequence: Synthetic coding sequence
atgcaggagcaggagatcggcttcatcagcaagtacaatgaaggcctgtgtgtgaacacagatcctgtgtccatcctgaccagcatcctggacatgagcctgcaccggcagatgggcagtgaccgggacctgcagagcagcgccagctctgtgtccctgcccagcgtgaagaaggcccccaagaagaggcgcatcagcatcggcagcctcttccggaggaagaaggacaacaagaggaagagccgggagctgaatggaggagtggatggcatcgccagcattgagagcatccacagcgagatgtgcacagacaagaacagcatcttcagcaccaacacctag

SEQ ID NO: 37686 - DNA, 471 bp, Artificial Sequence
  Description of Artificial Sequence: Synthetic coding sequence
atgcaggagcaggagatcggcttcatcagcaagtacaatgaaggcctgtgtgtgaacacagatcctgtgtccatcctgaccagcatcctggacatgagcctgcaccggcagatgggcagtgaccgggacctgcagagcagcgccagctctgtgtccctgcccagcgtgaagaaggcccccaagaagaggcgcatcagcatcggcagcctcttccggaggaagaaggacaacaagaggaagagccgggagctgaatggaggagtggatggcatcgccagcattgagagcatccacagcgagatgtgcacagacaagaacagcatcttcagcaccaacaccagcagtgacaatggcctgaccagcatcagcaagcagatcggggacttcattgaatgtcccctgtgcctgctgcggcacagcaaggaccgcttcccagacatcatgacctgccaccacaggagctgtgtgtag

SEQ ID NO: 37687 - DNA, 48 bp, Artificial Sequence
  Description of Artificial Sequence: Synthetic coding sequence
atgcaggagcaggagatcggcttcatcagcaagtacaatgaaggatag

SEQ ID NO: 37688 - DNA, 1029 bp, Artificial Sequence
  Description of Artificial Sequence: Synthetic coding sequence
atgaggaaggagaccccaccacccctggtgcccccagctgcccgggagtggaacctgcccccaaatgccccagcctgcatggagcggcagctggaggccgcccgctacagaagtgatggagccctgctgctgggcgccagcagcctgagcggccgctgctgggccggcagcctgtggctgttcaaggacccctgtgccgccccaaatgaaggcttctgcagcgctggggtgcagacagaagctggggtggccgacctgacctgggtgggggagcggggcatcctggtggccagtgacagcggggctgtggagctgtgggagctggatgaaaatgagaccctgattgtgtccaagttctgcaagtatgaacatgatgacatcgtgtccacagtgtctgtgctgagcagcggcacccaggccgtgtctggcagcaaggacatctgcatcaaggtgtgggacctggcccagcaggtggtgctgagcagctaccgggcccatgctgcccaggtgacctgtgtggccgccagcccccacaaggacagcgtcttcctgagctgcagcgaggacaaccgcatcctgctgtgggacacccgctgccccaagccagccagccagatcggctgcagcgcccctggctacctgcccaccagcctggcctggcacccccagcagagcgaggtgtttgtgtttggagatgaaaatggcaccgtgtccctggtggacaccaagagcaccagctgtgtgctgagcagcgctgtgcacagccagtgtgtgacaggcctggtgttcagcccccacagcgtgcccttcctggccagcctgtctgaggactgcagcctggccgtgctggacagcagcctgtctgagctgttccgcagccaggcccaccgggactttgtgagagatgccacctggagccccctgaaccacagcctgctgaccaccgtgggctgggaccaccaggtggtgcaccacgtggtgcccacagagcccctgcctgcccctggccctgcctctgtgacagaatag

SEQ ID NO: 37689 - DNA, 1764 bp, Artificial Sequence
  Description of Artificial Sequence: Synthetic coding sequence
atgggcagcgagaaggacagcgagagccccaggagcaccagcctgcatgctgctgccccagaccccaagtgccgcagcggcggcagaagaagaaggctgaccctgcacagcgtcttcagcgccagcgcccggggccggcgggcccgggccaagccccaggccgagcccccacctcctgctgcccagcccccaccagccccagccccagctgctgcccagggccccccacctgaggccctgcctgctgagcctgctgctgaggccgaggccgaggccgctgctgctgctgctgagcccggctttgatgatgaggaggccgctgagggcggcggccctggagctgaggaggtggagtgccccctgtgcctggtgcggctgcccccagagcgggccccccggctgctgagctgcccccacaggagctgccgggactgcctgcggcactacctgcggctggagatcagcgagagccgggtgcccatcagctgcccagaatgttctgagcggctgaacccccatgacatccggctgctgctggccgacccccccctgatgcacaagtatgaggagttcatgctgcggcgctacctggccagtgaccctgactgccgctggtgcccagccccagactgtggctacgccgtcatcgcctacggctgtgccagctgccccaagctgacctgtgagcgggagggctgccagacagagttctgctaccactgcaagcagatctggcaccccaaccagacctgtgacatggcccggcagcagagggcccagaccctgcgggtgaggaccaagcacaccagcggcctgtcctatggccaggagagcggcccagatgacatcaagccctgcccccgctgcagcgcctacatcatcaagatgaatgatggcagctgcaaccacatgacctgtgctgtgtgtggctgtgagttctgctggctgtgcatgaaggagatcagtgacctgcactacctgagccccagcggctgcaccttctggggcaagaagccctggagcaggaagaagaagatcctgtggcagctgggcaccctcatcggggcccctgtgggcatcagcctgattgctggcatcgccatcccagccatggtgattggcatccctgtgtatgtgggcaggaagatccacagccgctatgagggcaggaagaccagcaagcacaagaggaacctggccatcaccggcggcgtgaccctgagcgtcatcgccagccctgtgattgctgctgtgtctgtgggcatcggcgtgcccatcatgctggcctacgtgtatggagtggtgcccatcagcctgtgccggggcggcggctgcggcgtgtccacagccaatggaaaaggagtgaagattgaatttgatgaagatgatggccccatcaccgtggctgatgcctggagggccctgaagaaccccagcatcggggagagcagcattgagggcctgacctctgtgctgagcaccagcggcagccccacagatggcctgtctgtgatgcagggcccctacagcgagacagccagctttgctgccctgagcggcggcaccctgagcggcggcatcctgagcagcggcaagggcaagtacagccggctggaggtgcaggctgatgtgcagaaggagatcttccccaaggacacagccagcctgggcgccatcagtgacaatgccagcacccgggccatggccggcagcatcatcagcagctacaacccccaggaccgcttctccatgatccacgcctag

SEQ ID NO: 37690 - DNA, 2199 bp, Artificial Sequence
  Description of Artificial Sequence: Synthetic coding sequence
atgggcagcgagaaggacagcgagagccccaggagcaccagcctgcatgctgctgccccagaccccaagtgccgcagcggcggcagaagaagaaggctgaccctgcacagcgtcttcagcgccagcgcccggggccggcgggcccgggccaagccccaggccgagcccccacctcctgctgcccagcccccaccagccccagccccagctgctgcccagggccccccacctgaggccctgcctgctgagcctgctgctgaggccgaggccgaggccgctgctgctgctgctgagcccggctttgatgatgaggaggccgctgagggcggcggccctggagctgaggaggtggagtgccccctgtgcctggtgcggctgcccccagagcgggccccccggctgctgagctgcccccacaggagctgccgggactgcctgcggcactacctgcggctggagatcagcgagagccgggtgcccatcagctgcccagaatgttctgagcggctgaacccccatgacatccggctgctgctggccgacccccccctgatgcacaagtatgaggagttcatgctgcggcgctacctggccagtgaccctgactgccgctggtgcccagccccagactgtggctacgccgtcatcgcctacggctgtgccagctgccccaagctgacctgtgagcgggagggctgccagacagagttctgctaccactgcaagcagatctggcaccccaaccagacctgtgacatggcccggcagcagagggcccagaccctgcgggtgaggaccaagcacaccagcggcctgtcctatggccaggagagcggccctgcagatgacatcaagccctgcccccgctgcagcgcctacatcatcaagatgaatgatggcagctgcaaccacatgacctgtgctgtgtgtggctgtgagttctgctggctgtgcatgaaggagatcagtgacctgcactacctgagccccagcggctgcaccttctggggcaagaagccctggagcaggaagaagaagatcctgtggcagctgggcaccctgattggagcccctgtgggcatcagcctgattgctggcatcgccatcccagccatggtgattggcatccctgtgtatgtgggcaggaagatccacagccgctatgagggcaggaagaccagcaagcacaagaggaacctggccatcactggaggagtgaccctgtctgtgattgccagccctgtgattgctgctgtgtctgtgggcattggagtgcccatcatgctggcctacgtgtatggagtggtgcccatcagcctgtgccggggcggcggctgcggcgtgtccacagccaacgggaagggcgtgaagattgaatttgatgaagatgatggccccatcaccgtggctgatgcctggagggccctgaagaaccccagcattggagagagcagcattgagggcctgacctctgtgctgagcaccagcggcagccccacagatggcctgtctgtgatgcagggcccctacagcgagacagccagctttgctgccctgagcggcggcaccctgagcggcggcatcctgagcagcggcaagggcaagtacagccggctggaggtgcaggctgatgtgcagaaggagatcttccccaaggacacagccagcctgggcgccatcagtgacaatgccagcacccgggccatggccggcagcatcatcagcagctacaacccccaggaccgggagtgcaacaacatggagatccaggtggacatcgaggccaagcccagccactaccagctggtgtctggcagcagcacagaggacagcctgcacgtgcacgcccagatggccgagaatgaggaggagggcagcggcggcggcggctctgaagaagatcctccctgccgccaccagagctgtgagcagaaggactgcctggccagcaagccctgggacatcagcctggcccagcctgagagcatccgcagtgacctggagagcagtgatgcccagagtgatgatgtgcctgacatcaccagtgatgaatgtggcagccccaggagccacacagctgcctgccccagcaccccccgggcccagggcgcccccagccccagcgcccacatgaacctgagcgccctggccgagggccagacagtgctgaagccagagggcggggaggcccgggtgtag

SEQ ID NO: 37691 - DNA, 1461 bp, Artificial Sequence
  Description of Artificial Sequence: Synthetic coding sequence
atgggcagcgagaaggacagcgagagccccaggagcaccagcctgcatgctgctgccccagaccccaagtgccgcagcggcggcagaagaagaaggctgctgagctgcccccacaggagctgccgggactgcctgcggcactacctgcggctggagatcagcgagagccgggtgcccatcagctgcccagagtgcagcgagcggctgaacccccatgacatccggctgctgctggccgacccccccctgatgcacaagtatgaggagttcatgctgcggcgctacctggccagtgaccctgactgccgctggtgcccagccccagactgtggctatgctgtgattgcctacggctgtgccagctgccccaagctgacctgtgagcgggagggctgccagacagagttctgctaccactgcaagcagatctggcaccccaaccagacctgtgacatggcccggcagcagagggcccagaccctgcgggtgaggaccaagcacaccagcggcctgtcctatggccaggagagcggcccagatgacatcaagccctgcccccgctgcagcgcctacatcatcaagatgaatgatggcagctgcaaccacatgacctgtgctgtgtgtggctgtgagttctgctggctgtgcatgaaggagatcagtgacctgcactacctgagccccagcggctgcaccttctggggcaagaagccctggagcaggaagaagaagatcctgtggcagctgggcaccctgattggagcccctgtgggcatcagcctgattgctggcatcgccatcccagccatggtgattggcatccctgtgtatgtgggcaggaagatccacagccgctatgagggcaggaagaccagcaagcacaagaggaacctggccatcactggaggagtgaccctgtctgtgattgccagccctgtgattgctgctgtgtctgtgggcattggagtgcccatcatgctggcctacgtgtatggagtggtgcccatcagcctgtgccggggcggcggctgcggcgtgtccacagccaacgggaagggcgtgaagattgaatttgatgaagatgatggccccatcaccgtggctgatgcctggagggccctgaagaaccccagcattggagagagcagcattgagggcctgacctctgtgctgagcaccagcggcagccccacagatggcctgtctgtgatgcagggcccctacagcgagacagccagctttgctgccctgagcggcggcaccctgagcggcggcatcctgagcagcggcaagggcaagtacagccggctggaggtgcaggctgatgtgcagaaggagatcttccccaaggacacagccagcctgggcgccatcagtgacaatgccagcacccgggccatggccggcagcatcatcagcagctacaacccccaggacaggagctccatgcctcatgtgtag

SEQ ID NO: 37692 - DNA, 1134 bp, Artificial Sequence
  Description of Artificial Sequence: Synthetic coding sequence
atgggccctgctgcccggcctgccctgcggagccccccacctcctcctcctcctccacccagccccctgctgctgctgctgcccctgctgcccctgtggctgggcctggccggccctggagctgctgctgatggcagcgagcctgctgctggggccggccggggcggggcccgggctgtgcgggtggatgtgcggctgccccggcaggatgccctggtgctggagggcgtgagaattggcagcgaggccgaccctgcccccctgctgggcggccgcctgctgctgatggacatcgtggatgctgagcaggaggcccctgtggagggctggattgctgtggcctacgtgggcaaggagcaggccgcccagttccaccaggagaacaagggcagcggcccccaggcctaccccaaggccctggtgcagcagatgagaagagccctcttcctgggcgccagcgccctgctgctgctgatcctgaaccacaacgtggtgcgggagctggacatcagccagctgctgctgcggcctgtgattgtgctgcactacagcagcaatgtgaccaagctgctggatgccctgctgcagaggacccaggccacagctgagatcaccagcggggagagcctgagcgccaacatcgagtggaagctgaccctgtggaccacctgtggcctgagcaaggatggctatggaggctggcaggacctggtgtgcctgggcggcagccgggcccaggagcagaagcccctgcagcagctgtggaatgccatcctgctggtggccatgctgctgtgcaccggcctggtggtgcaggcccagaggcaggccagccggcagagccagcgggagctgggcggccaggtggacctcttcaagagaagagtggtgcggcggctggccagcctgaagacccggcgctgccgcctgagcagagctgcccagggcctgcctgaccccggggctgagacctgtgctgtgtgcctggactacttctgcaacaagcagtggctgcgggtgctgccctgcaagcatgagttccaccgggactgtgtggacccctggctgatgctgcagcagacctgccccctgtgcaagttcaacgtgctgggcaaccgctacagtgatgactag

SEQ ID NO: 37693 - DNA, 561 bp, Artificial Sequence
  Description of Artificial Sequence: Synthetic coding sequence
atggccccctgcacagagaccaagatctttgtgctgtgtgatgagcagatccagtgccccacctgccagtttgtgtggtgcttcaagtgccacagcccctggcatgaaggagtgaactgcaaggagtacaagaagggggacaagctgctgcggcactgggccagcgagattgaacatggccagagaaatgcccagaagtgccccaagtgcaagatccacatccagaggacagagggctgtgaccacatgacctgcagccagtgcaacaccaacttctgctaccgctgtggggagcgctaccggcagctgcgcttcttcggggaccacaccagcaacctgagcatcttcggctgcaagtaccgctacctgcctgagcggccccacctgcggcggctggtgcggggctctgtgtgtgccggcaagctgttcatcgcccccctcatcatggtgctgggcctggccctgggcgccatcgctgtggtgattggcctgtttgtgttccccatctactgcctgtgcaagaagcagaggaagaggagcaggacaggcatgcactggtag

SEQ ID NO: 37694 - DNA, 828 bp, Artificial Sequence
  Description of Artificial Sequence: Synthetic coding sequence
atgaaggtgcagctgggccaggtggagatcaagtgccccatcacagagtgctttgagttcctggaggagaccaccgtggtgtacaacctgacccatgaagattccatcaagtacaagtacttcctggagctgggcagaattgacagcagcaccaagccctgcccccagtgcaagcacttcaccaccttcaagaagaagggccacatccccacccccagccgctctgagagcaagtacaagatccagtgccccacctgccagtttgtgtggtgcttcaagtgccacagcccctggcatgaaggagtgaactgcaaggagtacaagaagggggacaagctgctgcggcactgggccagcgagattgaacatggccagagaaatgcccagaagtgccccaagtgcaagatccacatccagaggacagagggctgtgaccacatgacctgcagccagtgcaacaccaacttctgctaccgctgtggggagcgctaccggcagctgcgcttcttcggggaccacaccagcaacctgagcatcttcggctgcaagtaccgctacctgcctgagcggccccacctgcggcggctggtgcggggctctgtgtgtgccggcaagctgttcatcgcccccctcatcatggtgctgggcctggccctgggcgccatcgctgtggtgattgtggaggagatcaagacctactggaacctgatcagcggccgcaccaggaaccagacccagcacctggccccccagcctgtgctgctgagtgacatgctgtactgcctgaagcaggtgttcatctgcatctcctacctgctgcccctgtag

SEQ ID NO: 37695 - DNA, 9 bp, Artificial Sequence
  Description of Artificial Sequence: Synthetic coding sequence
atgaagtag

SEQ ID NO: 37696 - DNA, 924 bp, Artificial Sequence
  Description of Artificial Sequence: Synthetic coding sequence
atgcccagcctgctgggcgccccaccctacagcggcctgggcggcgtgggggacccctacgtgcccctgatggtgctgatgtgccgggtgtgcctggaggacaagcccatcaagcccctgccctgctgcaagaaggctgtgtgtgaggagtgcctgaaggtgtacctgagcgcccaggtgcagctgggccaggtggagatcaagtgccccatcacagaatgttttgagttcctggaggagaccaccgtggtgtacaacctgacccatgaggacagcatcaagtacaagtacttcctggagctgggcagaattgacagcagcaccaagccctgcccccagtgcaagcacttcaccaccttcaagaagaagggccacatccccacccccagccgctctgagagcaagtacaagatccagtgccccacctgccagtttgtgtggtgcttcaagtgccacagcccctggcatgagggcgtgaactgcaaggagtacaagaagggggacaagctgctgcggcactgggccagcgagattgagcacggccagagaaatgcccagaagtgccccaagtgcaagatccacatccagaggacagagggctgtgaccacatgacctgcagccagtgcaacaccaacttctgctaccgctgtggggagcgctaccggcagctgcgcttctttggagaccacaccagcaacctgagcatcttcggctgcaagtaccgctacctgcctgagcggccccacctgcggcggctggtgcggggctctgtgtgtgccggcaagctgttcatcgcccccctcatcatggtgctgggcctggccctgggcgccatcgctgtggtgattggcctgtttgtgttccccatctactgcctgtgcaagaagcagaggaagaggagcaggacaggcatgcactggtag

SEQ ID NO: 37697 - DNA, 750 bp, Artificial Sequence
  Description of Artificial Sequence: Synthetic coding sequence
atgagcagcggccagcaggtgtggcacacagctgtgcccccaccccggcgcagcagcagcatcgcctccatgcccaggagccccagcagcgctggcagccccaggagccctggcaccccaggcagcgagcgggtggccagccccctggagtgcagcatctgcttcagcggctatgacaacatcttcaagacccccaaggagctgagctgcacccacgtgttctgcctggagtgcctggcccggctggccgccgcccagcctgtgggccggcctggaggagaggccgtgccctgccccttctgccggcagcccacagctgtgcccccagctggggccccagccctgtgcaccagccggcagctgcaggccaggatgcctgcccacctgcggcgggaggagcctgtgtggctggagggcaccaagctgtgctgccagcccctgcccaccaccccaggccgggagcccggctttgtgtgtgtggatgtgggcctgagcaagccagctgagcccccagccccagcccgggaccctgccccccggcggggccgcctggcccgctgctgggcccgctgccgggactggaggaggatggccctggtgtctgccctgctgctgatgctgttctgtgtggccctgtggcctgtgcagtgtgccctgaagacaggcaacctgcgctgcctgcccctgcccccccggcccccagccaccagcacagctgccagccccctgggccccctgacagacaactag

SEQ ID NO: 37698 - DNA, 3006 bp, Artificial Sequence
  Description of Artificial Sequence: Synthetic coding sequence
atgagcggccctggcaacaagagagctgctggagatggcggcagcggccccccagagaagaagctgagccgggaggagaagaccaccaccaccctgattgagcccatccggctgggcggcatcagcagcacagaggagatggacctgaaggtgctgcagttcaagaacaagaagctggccgagcggctggagcagaggcaggcctgtgaagatgagctgcgggagagaattgagaagctggagaagaggcaggccacagatgatgccaccctgctgattgtgaaccgctactgggcccagctggatgagaccgtggaggccctgctgcgctgccacgagagccagggcgagctgagcagcgcccctgaggcccctggcacccaggagggccccacctgtgatggcacccccctgcctgagcccggcaccagcgagctgcgggaccccctgctgatgcagctgcggccccccctgtctgagcccgccctggcctttgtggtggccctgggcgccagcagcagcgaggaggtggagctggagctgcagggccgcatggagttcagcaaggctgctgtgtcccgggtggtggaggccagtgaccggctgcagaggagagtggaggagctgtgccagagggtgtacagcagaggagacagcgagcccctgtctgaggccgcccaggcccacacccgggagctgggccgggagaacagaaggctgcaggacctggccacccagctgcaggagaagcaccaccgcatcagcctggagtacagcgagctgcaggacaaggtgaccagcgctgagaccaaggtgctggagatggagaccaccgtggaggacctgcagtgggacatcgagaagctgaggaagcgggagcagaagctgaacaagcacctggccgaggccctggagcagctgaacagcggctactacgtgtctggcagcagcagcggcttccagggcggccagatcaccctgtccatgcagaagtttgagatgctgaatgctgagctggaggagaaccaggagctggccaacagcaggatggccgagctggagaagctgcaggccgagctgcagggcgctgtgaggaccaatgaaaggctgaaggtggccctgcggagcctgcctgaggaggtggtgcgggagactggagagtacaggatgctgcaggcccagttcagcctgctgtacaatgaaagcctgcaggtgaagacccagctggatgaggcccggggcctgctgctggccaccaagaacagccacctgcggcacatcgagcacatggagagtgatgagctgggcctgcagaagaagctgaggacagaggtgatccagctggaggacaccctggcccaggtgaggaaggagtatgagatgctgcgcatcgagtttgagcagaacctggccgccaatgagcaggccggccccatcaaccgggagatgaggcacctgatcagcagcctgcagaaccacaaccaccagctgaagggagatgcccagcgctacaagaggaagctgcgggaggtgcaggccgagatcggcaagctgcgggcccaggccagcggcagcgcccacagcacccccaacctgggccaccctgaggacagcggcgtgtctgccccagcccctgggaaggaggagggcggccctggccctgtgtccaccccagacaacaggaaggagatggcccctgtgcccggcaccaccaccaccaccacctctgtgaagaaggaggagctggtgcccagcgaggaggacttccagggcatcacccctggggcccagggccccagcagccggggccgggagcctgaggcccggcccaagcgggagctgcaggagcgggagggccccagcctgggccccccacctgtggccagcgccctgagcagagctgaccgggagaaggccaaggtggaggagaccaagaggaaggagagcgagctgctgaagggcctgcgggcagagctgaagaaggcccaggagagccagaaggagatgaagctgctgctggacatgtacaagagcgcccccaaggagcagagggacaaggtgcagctgatggctgctgagaggaaggccaaggccgaggtggatgagctgcggagccgcatccgggagctggaggagcgggacagaagagagagcaagaagattgctgatgaagatgccctgcggcgcatccggcaggccgaggagcagatcgagcacctgcagaggaagctgggcgccaccaagcaggaggaggaggccctgctgtctgagatggatgtgacaggccaggcctttgaggacatgcaggagcagaatggccgcctgctgcagcagctgcgggagaaggatgatgccaacttcaagctgatgtctgagcgcatcaaggccaaccagatccacaagctgctgcgggaggagaaggatgagctgggggagcaggtgctgggcctgaagagccaggtggatgcccagctgctgactgtgcagaagctggaggagaaggagcgggccctgcagggcagcctgggcggcgtggagaaggagctgaccctgcggagccaggccctggagctgaacaagaggaaggctgtggaggccgcccagctggccgaggacctgaaggtgcagctggagcacgtgcagacccggctgcgggagatccagccctgcctggccgagagccgggccgcccgggagaaggagagcttcaacctgaagagggcccaggaggacatcagccggctgcggaggaagctggagaagcagaggaaggtggaggtgtatgcagatgctgatgagatcctgcaggaggagatcaaggagtacaaggcccggctgacctgcccctgctgcaacaccaggaagaaggatgctgtgctgaccaagtgcttccacgtgttctgctttgaatgtgtgcggggccgctatgaggcccggcagaggaagtgccccaagtgcaatgctgccttcggggcccatgacttccaccgcatctacatctcctag

SEQ ID NO: 37699 - DNA, 2706 bp, Artificial Sequence
  Description of Artificial Sequence: Synthetic coding sequence
atgagcggccctggcaacaagagagctgctggagatggcggcagcggccccccagagaagaagctgagccgggaggagaagaccaccaccaccctgattgagcccatccggctgggcggcatcagcagcacagaggagatggacctgaaggtgctgcagttcaagaacaagaagctggccgagcggctggagcagaggcaggcctgtgaagatgagctgcgggagagaattgagaagctggagaagaggcaggccacagatgatgccaccctgctgattgtgaaccgctactgggcccagctggatgagaccgtggaggccctgctgcgctgccacgagagccagggcgagctgagcagcgcccctgaggcccctggcacccaggagggccccacctgtgatggcacccccctgcctgagcccggcaccagcgagctgcgggaccccctgctgatgcagctgcggccccccctgtctgagcccgccctggcctttgtggtggccctgggcgccagcagcagcgaggaggtggagctggagctgcagggccgcatggagttcagcaaggctgctgtgtcccgggtggtggaggccagtgaccggctgcagaggagagtggaggagctgtgccagagggtgtacagcagaggagacagcgagcccctgtctgaggccgcccaggcccacacccgggagctgggccgggagaacagaaggctgcaggacctggccacccagctgcaggagaagcaccaccgcatcagcctggagtacagcgagctgcaggacaaggtgaccagcgctgagaccaaggtgctggagatggagaccaccgtggaggacctgcagtgggacatcgagaagctgaggaagcgggagcagaagctgaacaagcacctggccgaggccctggagcagctgaacagcggctactacgtgtctggcagcagcagcggcttccagggcggccagatcaccctgtccatgcagaagagtgatgagctgggcctgcagaagaagctgaggacagaggtgatccagctggaggacaccctggcccaggtgaggaaggagtatgagatgctgcgcatcgagtttgagcagaacctggccgccaatgagcaggccggccccatcaaccgggagatgaggcacctgatcagcagcctgcagaaccacaaccaccagctgaagggagatgcccagcgctacaagaggaagctgcgggaggtgcaggccgagatcggcaagctgcgggcccaggccagcggcagcgcccacagcacccccaacctgggccaccctgaggacagcggcgtgtctgccccagcccctgggaaggaggagggcggccctggccctgtgtccaccccagacaacaggaaggagatggcccctgtgcccggcaccaccaccaccaccacctctgtgaagaaggaggagctggtgcccagcgaggaggacttccagggcatcacccctggggcccagggccccagcagccggggccgggagcctgaggcccggcccaagcgggagctgcaggagcgggagggccccagcctgggccccccacctgtggccagcgccctgagcagagctgaccgggagaaggccaaggtggaggagaccaagaggaaggagagcgagctgctgaagggcctgcgggcagagctgaagaaggcccaggagagccagaaggagatgaagctgctgctggacatgtacaagagcgcccccaaggagcagagggacaaggtgcagctgatggctgctgagaggaaggccaaggccgaggtggatgagctgcggagccgcatccgggagctggaggagcgggacagaagagagagcaagaagattgctgatgaagatgccctgcggcgcatccggcaggccgaggagcagatcgagcacctgcagaggaagctgggcgccaccaagcaggaggaggaggccctgctgtctgagatggatgtgacaggccaggcctttgaggacatgcaggagcagaatggccgcctgctgcagcagctgcgggagaaggatgatgccaacttcaagctgatgtctgagcgcatcaaggccaaccagatccacaagctgctgcgggaggagaaggatgagctgggggagcaggtgctgggcctgaagagccaggtggatgcccagctgctgactgtgcagaagctggaggagaaggagcgggccctgcagggcagcctgggcggcgtggagaaggagctgaccctgcggagccaggccctggagctgaacaagaggaaggctgtggaggccgcccagctggccgaggacctgaaggtgcagctggagcacgtgcagacccggctgcgggagatccagccctgcctggccgagagccgggccgcccgggagaaggagagcttcaacctgaagagggcccaggaggacatcagccggctgcggaggaagctggagaagcagaggaaggtggaggtgtatgcagatgctgatgagatcctgcaggaggagatcaaggagtacaaggcccggctgacctgcccctgctgcaacaccaggaagaaggatgctgtgctgaccaagtgcttccacgtgttctgctttgaatgtgtgcggggccgctatgaggcccggcagaggaagtgccccaagtgcaatgctgccttcggggcccatgacttccaccgcatctacatctcctag

SEQ ID NO: 37700 - DNA, 2082 bp, Artificial Sequence
  Description of Artificial Sequence: Synthetic coding sequence
atgagcggccctggcaacaagagagctgctggagatggcggcagcggccccccagagaagaagctgagccgggaggagaagaccaccaccaccctgattgagcccatccggctgggcggcatcagcagcacagaggagatggacctgaaggtgctgcagttcaagaacaagaagctggccgagcggctggagcagaggcaggcctgtgaagatgagctgcgggagagaattgagaagctggagaagaggcaggcccagttcagcctgctgtacaatgaaagcctgcaggtgaagacccagctggatgaggcccggggcctgctgctggccaccaagaacagccacctgcggcacatcgagcacatggagagtgatgagctgggcctgcagaagaagctgaggacagaggtgatccagctggaggacaccctggcccaggtgaggaaggagtatgagatgctgcgcatcgagtttgagcagaacctggccgccaatgagcaggccggccccatcaaccgggagatgaggcacctgatcagcagcctgcagaaccacaaccaccagctgaagggagatgcccagcgctacaagaggaagctgcgggaggtgcaggccgagatcggcaagctgcgggcccaggccagcggcagcgcccacagcacccccaacctgggccaccctgaggacagcggcgtgtctgccccagcccctgggaaggaggagggcggccctggccctgtgtccaccccagacaacaggaaggagatggcccctgtgcccggcaccaccaccaccaccacctctgtgaagaaggaggagctggtgcccagcgaggaggacttccagggcatcacccctggggcccagggccccagcagccggggccgggagcctgaggcccggcccaagcgggagctgcaggagcgggagggccccagcctgggccccccacctgtggccagcgccctgagcagagctgaccgggagaaggccaaggtggaggagaccaagaggaaggagagcgagctgctgaagggcctgcgggcagagctgaagaaggcccaggagagccagaaggagatgaagctgctgctggacatgtacaagagcgcccccaaggagcagagggacaaggtgcagctgatggctgctgagaggaaggccaaggccgaggtggatgagctgcggagccgcatccgggagctggaggagcgggacagaagagagagcaagaagattgctgatgaagatgccctgcggcgcatccggcaggccgaggagcagatcgagcacctgcagaggaagctgggcgccaccaagcaggaggaggaggccctgctgtctgagatggatgtgacaggccaggcctttgaggacatgcaggagcagaatggccgcctgctgcagcagctgcgggagaaggatgatgccaacttcaagctgatgtctgagcgcatcaaggccaaccagatccacaagctgctgcgggaggagaaggatgagctgggggagcaggtgctgggcctgaagagccaggtggatgcccagctgctgactgtgcagaagctggaggagaaggagcgggccctgcagggcagcctgggcggcgtggagaaggagctgaccctgcggagccaggccctggagctgaacaagaggaaggctgtggaggccgcccagctggccgaggacctgaaggtgcagctggagcacgtgcagacccggctgcgggagatccagccctgcctggccgagagccgggccgcccgggagaaggagagcttcaacctgaagagggcccaggaggacatcagccggctgcggaggaagctggagaagcagaggaaggtggaggtgtatgcagatgctgatgagatcctgcaggaggagatcaaggagtacaaggcccggctgacctgcccctgctgcaacaccaggaagaaggatgctgtgctgaccaagtgcttccacgtgttctgctttgaatgtgtgcggggccgctatgaggcccggcagaggaagtgccccaagtgcaatgctgccttcggggcccatgacttccaccgcatctacatctcctag

SEQ ID NO: 37701 - DNA, 693 bp, Artificial Sequence
  Description of Artificial Sequence: Synthetic coding sequence
atgcagctgcggccccccctgtctgagcccgccctggcctttgtggtggccctgggcgccagcagcagcgaggaggtggagctggagctgcagggccgcatggagttcagcaaggctgctgtgtcccgggtggtggaggccagtgaccggctgcagaggagagtggaggagctgtgccagagggtgtacagcagaggagacagcgagcccctgtctgaggccgcccaggcccacacccgggagctgggcagagaaaatagaaggctgcaggacctggccacccagctgcaggagaagcaccaccgcatcagcctggagtacagcgagctgcaggacaaggtgaccagcgctgagaccaaggtgctggagatggagaccaccgtggaggacctgcagtgggacatcgagaagctgaggaagcgggagcagaagctgaacaagcacctggccgaggccctggagcagctgaacagcggctactacgtgtctggcagcagcagcggcttccagggcggccagatcaccctgtccatgcagaagtttgagatgctgaatgctgagctggaggagaaccaggagctggccaacagcaggatggccgagctggagaagctgcaggccgagctgcagggcgctgtgaggaccaacttccagagcttccagctggaggagctgcccccagacaccctgtag

SEQ ID NO: 37702 - DNA, 924 bp, Artificial Sequence
  Description of Artificial Sequence: Synthetic coding sequence
atgaagctgctgctggacatgtacaagagcgcccccaaggagcagagggacaaggtgcagctgatggctgctgagaggaaggccaaggccgaggtggatgagctgcggagccgcatccgggagctggaggagcgggacagaagagagagcaagaagattgctgatgaagatgccctgcggcgcatccggcaggccgaggagcagatcgagcacctgcagaggaagctgggcgccaccaagcaggaggaggaggccctgctgtctgagatggatgtgacaggccaggcctttgaggacatgcaggagcagaatggccgcctgctgcagcagctgcgggagaaggatgatgccaacttcaagctgatgtctgagcgcatcaaggccaaccagatccacaagctgctgcgggaggagaaggatgagctgggggagcaggtgctgggcctgaagagccaggtggatgcccagctgctgactgtgcagaagctggaggagaaggagcgggccctgcagggcagcctgggcggcgtggagaaggagctgaccctgcggagccaggccctggagctgaacaagaggaaggctgtggaggccgcccagctggccgaggacctgaaggtgcagctggagcacgtgcagacccggctgcgggagatccagccctgcctggccgagagccgggccgcccgggagaaggagagcttcaacctgaagagggcccaggaggacatcagccggctgcggaggaagctggagaagcagaggaaggtggaggtgtatgcagatgctgatgagatcctgcaggaggagatcaaggagtacaaggtgggcctgtgggccaagctgtgccccatccacctgagaattgtggatgctggcctgctgcggctggtggagagcctgggcaccctggaggtgatgtag

SEQ ID NO: 37703 - DNA, 1308 bp, Artificial Sequence
  Description of Artificial Sequence: Synthetic coding sequence
atgcccctcttcctgctgagcctgcccaccccaccttctgccagcggccatgaaagacggcagaggcctgaggccaagaccagcggcagcgagaagaagtacctgcgggccatgcaggccaacagaagccagctgcacagccccccaggcaccggcagcagtgaagatgccagcaccccccagtgtgtgcacacccggctgaccggggagggcagctgcccccacagcggagatgtgcacatccagatcaacagcatccccaaggaatgtgccgagaatgccagcagcaggaacatccgctctggagtgcacagctgtgcccacggctgtgtgcacagccggctgcggggccacagccacagcgaggcccggctgacagatgacacagctgctgagagcggggaccacggcagcagcagcttcagcgagttccgctacctgttcaagtggctgcagaagagcctgccctacatcctgatcctgtctgtgaagctggtgatgcagcacatcaccggcatcagcctgggcatcggcctgctgaccaccttcatgtatgccaacaagagcatcgtgaaccaggtgttcctgcgggagaggagcagcaagatccagtgtgcctggctgctggtgttcctggccggcagctctgtgctgctgtactacaccttccacagccagagcctgtactacagcctcatcttcctgaaccccaccctggaccacctgtccttctgggaggtgttctggatcgtgggcatcacagacttcatcctgaagttcttcttcatgggcctgaagtgcctgatcctgctggtgcccagcttcatcatgcccttcaagagcaagggctactggtacatgctgctggaggagctgtgccagtactaccgcacctttgtgcccatccctgtgtggttccgctacctgatctcctatggagaatttggaaatgtgacccgctggagcctgggcatcctgctggccctgctgtacctgatcctgaagctgctggagttcttcggccacctgcggaccttccggcaggtgctgcgcatcttcttcacccagcccagctatggagtggccgccagcaagaggcagtgcagtgatgtggatgacatctgcagcatctgccaggccgagttccagaagcccatcctgctgatctgccagcacatcttctgtgaggagtgcatgaccctgtggttcaaccgggagaagacctgccccctgtgcaggacagtcatcagtgaccacatcaacaagtggaaggatggagccaccagcagccacctgcagatctactag

SEQ ID NO: 37704 - DNA, 408 bp, Artificial Sequence
  Description of Artificial Sequence: Synthetic coding sequence
atgcaggccaacagaagccagctgcacagccccccaggcaccggcagcagtgaagatgccagcaccccccagtgtgtgcacacccggctgactggagagggcagctgcccccacagcggagatgtgcacatccagatcaacagcatccccaaggaatgtgctgaaaatgccagcagcaggaacatccgcagcggcgtgcacagctgtgcccacggctgtgtgcacagccggctgcggggccacagccacagcgaggcccggctgacagatgacacagctgctgagagcggggaccacggcagcagcagcttcagcgagttccgctacctgttcaagtggctgcagaagagcctgccctacatcctgatcctgtctgtgaagctggtgatgcagcacatcacagcctag

SEQ ID NO: 37705 - DNA, 1335 bp, Artificial Sequence
  Description of Artificial Sequence: Synthetic coding sequence
atgtggctgttcaccgtgaaccaggtgctgaggaagatgcagaggaggcacagcagcaacacagacaacatccccccagagaggaacagaagccaggccctgagcagcgaggcctctgtggatgaaggaggagtgtttgagagcctgaaggccgaggccgccagccccccagccctcttcagcggcctgagcggcagcctgcccaccagcagcttccccagcagcctggtgctgggcagcagcgctggaggaggagatgtgttcatccagatgcctgccagccgggaggagggcggcggccgcggggagggcggggcctaccaccaccggcagccccaccaccacttccaccacggcggccacagaggaggcagcctgctgcagcacgtgggcggggaccaccggggccacagcgaggagggcggagatgagcagcccggcaccccagccccagccctgtctgagctgaaggccgtcatctgctggctgcagaagggcctgcccttcatcctgatcctgctggccaagctgtgcttccagcacaagctgggcattgctgtgtgcatcggcatggccagcacctttgcctatgccaacagcaccctgcgggagcaggtgtccctgaaggagaagaggtctgtgctggtgatcctgtggatcctggccttcctggccggcaacaccctgtatgtgctgtacaccttcagcagccagcagctgtacaacagcctcatcttcctgaagcccaacctggagatgctggacttctttgacctgctgtggatcgtgggcattgctgactttgtgctgaagtacatcaccatcgccctgaagtgcctgattgtggccctgcccaagatcatcctggccgtgaagagcaagggcaagttctacctggtgattgaggagctgagccagctgttccgcagcctggtgcccatccagctgtggtacaagtacatcatgggagatgacagcagcaacagctacttcctgggcggcgtgctgattgtgctgtacagcctgtgcaagagctttgacatctgtggccgggtgggcggcgtgaggaaggccctgaagctgctgtgcaccagccagaactacggcgtgcgggccaccggccagcagtgcacagaggccggggacatctgtgccatctgccaggccgagttccgggagcccctcatcctgctgtgccagcacgtgttctgtgaggagtgcctgtgcctgtggctggaccgggagaggacctgccccctgtgccgctctgtggccgtggacaccctgcgctgctggaaggatggagccaccagcgcccacttccaggtgtactag

SEQ ID NO: 37706 - DNA, 1335 bp, Artificial Sequence; identical to SEQ ID NO: 37705
  Description of Artificial Sequence: Synthetic coding sequence

SEQ ID NO: 37707 - DNA, 1263 bp, Artificial Sequence
  Description of Artificial Sequence: Synthetic coding sequence
atgtggctgttcaccgtgaaccaggtgctgaggaagatgcagaggaggcacagcagcaacacagacaacatccccccagagaggaacagaagccaggccctgagcagcgaggcctctgtggatgaaggaggagtgtttgagagcctgaaggccgaggccgccagccccccagccctcttcagcggcctgagcggcagcctgcccaccagcagcttccccagcagcctggtgctgggcagcagcgctggaggaggagatgtgttcatccagatgcctgccagccgggaggagggcggcggccgcggggagggcggggcctaccaccaccggcagccccaccaccacttccaccacggcggccacagaggaggcagcctgctgcagcacgtgggcggggaccaccggggccacagcgaggagggcggagatgagcagcccggcaccccagccccagccctgtctgagctgaaggccgtcatctgctggctgcagaagggcctgcccttcatcctgatcctgctggccaagctgtgcttccagcacaagctgggcattgctgtgtgcatcggcatggccagcacctttgcctatgccaacagcaccctgcgggagcaggtgtccctgaaggagaagaggtctgtgctggtgatcctgtggatcctggccttcctggccggcaacaccctgtatgtgctgtacaccttcagcagccagcagctgtacaacagcctcatcttcctgaagcccaacctggagatgctggacttctttgacctgctgtggatcgtgggcattgctgactttgtgctgaagtacatcaccatcgccctgaagtgcctgattgtggccctgcccaagatcatcctggccgtgaagagcaagggcaagttctacctggtgattgaggagctgagccagctgttccgcagcctggtgcccatccagctgtggtacaagtacatcatgggagatgacagcagcaacagctacttcctgggcggcgtgctgattgtgctgtacagcctgtgcaagagctttgacatctgtggccgggtgggcggcgtgaggaaggccctgaagctgctgtgcaccagccagaactacggcgtgcgggccaccggccagcagtgcacagaggccggggacatctgtgccatctgccaggccgagttccgggagcccctcatcctgctgtgccagatgctgctgaagggccacaagaagctggagctggagaagattgatgaatctgctggggtgtag

SEQ ID NO: 37708 - DNA, 1212 bp, Artificial Sequence
  Description of Artificial Sequence: Synthetic coding sequence
atggccgccttcctgaagatgtctgtgtctgtgaacttcttccggcccttcacccgcttcctggtgcccttcaccctgcacaggaagaggaacaacctgaccatcctgcagcgctacatgagcagcaagatcccagctgtgacctaccccaagaatgaaagcaccccacccagcgaggagctggagctggacaagtggaagaccaccatgaagagctctgtgcaggaggagtgtgtgtccaccatcagcagcagcaaggatgaggaccccctggccgccacccgggagttcatcgagatgtggaggctgctgggccgggaggtgcctgagcacatcacagaggaggagctgaagaccctgatggagtgtgtgagcaacacagccaagaagaagtacctgaagtacctgtacaccaaggagaaggtgaagaaggcccggcagatcaagaaggagatgaaggctgctgcccgggaggaggccaagaacatcaagctgctggagaccacagaggaggacaagcagaagaacttcctgttcctgcggctgtgggacaggaacatggacatcgccatgggctggaagggggcccaggccatgcagtttggccagcccctggtgtttgacatggcctatgagaactacatgaagaggaaggagctgcagaacacagtgtcccagctgctggagagcgagggctggaacagaagaaatgtggaccccttccacatctacttctgcaacctgaagattgatggagccctgcaccgggagctggtgaagcgctaccaggagaagtgggacaagctgctgctgaccagcacagagaagagccacgtggacctcttccccaaggacagcatcatctacctgacagctgacagccccaacgtgatgaccaccttcagacatgacaaggtgtatgtgattggcagctttgtggacaagtccatgcagcccggcaccagcctggccaaggccaagaggctgaacctggccacagagtgcctgcccctggacaagtacctgcagtgggagatcggcaacaagaacctgaccctggaccagatgatccgcatcctgctgtgcctgaagaacaacggcaactggcaggaggccctgcagtttgtgcccaagaggaagcacacaggcttcctggagatcagccagcacagccaggagttcatcaaccggctgaagaaggccaagacctag

SEQ ID NO: 37709 - DNA, 939 bp, Artificial Sequence
  Description of Artificial Sequence: Synthetic coding sequence
atggccgccttcctgaagatgtctgtgtctgtgaacttcttccggcccttcacccgcttcctggtgcccttcaccctgcacaggaagaggaacaacctgaccatcctgcagcgctacatgagcagcaagatcccagctgtgacctaccccaagaatgaaagcaccccacccagcgaggagctggagctggacaagtggaagaccaccatgaagagctctgtgcaggaggagtgtgtgtccaccatcagcagcagcaaggatgaggaccccctggccgccacccgggagttcatcgagatgtggaggctgctgggccgggaggtgcctgagcacatcacagaggaggagctgaagaccctgatggagtgtgtgagcaacacagccaagaagaagtacctgaagtacctgtacaccaaggagaaggtgaagaaggcccggcagatcaagaaggagatgaaggctgctgcccgggaggaggccaagaacatcaagctgctggagaccacagaggaggacaagcagaagaacttcctgttcctgcggctgtgggacaggaacatggacatcgccatgggctggaagggggcccaggccatgcagtttggccagcccctggtgtttgacatggcctatgagaactacatgaagaggaaggagctgcagaacacagtgtcccagctgctggagagcgagggctggaacagaagaaatgtggaccccttccacatctacttctgcaacctgaagattgatggagccctgcaccgggagctggtgaagcgctaccaggagaagtgggacaagctgctgctgaccagcacagagaagagccacgtggacctcttccccaaggacagcatcatctacctgacagctgacagccccaacgtgatgaccaccttcagacatgacaaggtgtatgtgattggcagcttctag

SEQ ID NO: 37710 - DNA, 1134 bp, Artificial Sequence
  Description of Artificial Sequence: Synthetic coding sequence
atggccgccccccgctggagcgccagcggcccctggatcagaggaaatggccagggctgcggcagcctcttcaccctggtgtccaagcccttctgtgccgctgctgctgccagcacagccatcaatgcccagaggctggccgagaagctgcgggcccagaagcgggagcaggacaccaagaaggagcctgtgtccaccaatgctgtgcagaggagagtgcaggagatcgtgcgcttcacccggcagctgcagagggtgcaccccaacgtgctggccaaggccctgacccggggcatcctgcaccaggacaagaacctggtggtgatcaacaagccctacggcctgcctgtgcacggcggccctggggtgcagctgtgcatcacagatgtgctgcccatcctggccaagatgctgcacggccacaaggccgagcccctgcacctgtgccaccggctggacaaggagaccactggagtgatggtgctggcctgggacaaggacatggcccaccaggtgcaggagctgttccgcacccggcaggtggtgaagaagtactgggccatcaccgtgcacgtgcccatgcccagcgctggggtggtggacatccccatcgtggagaaggaggcccagggccagcagcagcaccacaagatgaccctgagccccagctacaggatggatgatggcaagatggtgaaggtgagaagaagcagaaatgcccaggtggccgtgacccagtaccaggtgctgagcagcaccctgagcagcgccctggtggagctgcagcccatcaccggcatcaagcaccagctgcgggtgcacctgagctttggcctggactgccccatcctgggggaccacaagtacagcgactggaaccggctggccccccagaagctgtctgtgggcaccctgaagaagctgggcctggagcagagcaaggcccgctacatccccctgcacctgcacgcccggcagctgatcctgcctgccctgggcagcggcaaggaggagctgaacctggtgtgcaagctgccccgcttctttgtgcacagcctgcaccggctgcggctggagatgcccaatgaagaccagaatgaaaataatgaggccaagtgcctgggcgcccagtag

SEQ ID NO: 37711 - DNA, 1041 bp, Artificial Sequence
  Description of Artificial Sequence: Synthetic coding sequence
atggccgccccccgctggagcgccagcggcccctggatcagaggaaatggccagggctgcggcagcctcttcaccctggtgtccaagcccttctgtgccgctgctgctgccagcacagccatcaatgcccagaggctggccgagaagctgcgggcccagaagcgggagcaggacaccaagaaggagcctgtgtccaccaatgctgtgcagaggagagtgcaggagatcgtgcgcttcacccggcagctgcagagggtgcaccccaacgtgctggccaaggccctgacccggggcatcctgcaccaggacaagaacctggtggtgatcaacaagccctacggcctgcctgtgcacggcggccctggggtgcagctgtgcatcacagatgtgctgcccatcctggccaagatgctgcacggccacaaggccgagcccctgcacctgtgccaccggctggacaaggagaccactggagtgatggtgctggcctgggacaaggacatggcccaccaggtgcaggagctgttccgcacccggcaggtggtgaagaagtactgggccatcaccgtgcacgtgcccatgcccagcgctggggtggtggacatccccatcgtggagaaggaggcccaggtggccgtgacccagtaccaggtgctgagcagcaccctgagcagcgccctggtggagctgcagcccatcaccggcatcaagcaccagctgcgggtgcacctgagctttggcctggactgccccatcctgggggaccacaagtacagcgactggaaccggctggccccccagaagctgtctgtgggcaccctgaagaagctgggcctggagcagagcaaggcccgctacatccccctgcacctgcacgcccggcagctgatcctgcctgccctgggcagcggcaaggaggagctgaacctggtgtgcaagctgccccgcttctttgtgcacagcctgcaccggctgcggctggagatgcccaatgaagaccagaatgaaaataatgaggccaagtgcctgggcgcccagtag

SEQ ID NO: 37712 - DNA, 1098 bp, Artificial Sequence
  Description of Artificial Sequence: Synthetic coding sequence
atggagggccagagcgtggaggagctgctggccaaggccgagcaggatgaggccgagaagctgcagaggatcaccgtgcacaaggagctggagctgcagtttgacctgggcaacctgctggccagtgacaggaacccccccaccggcctgcgctgtgccggccccaccccagaggccgagctgcaggccctggcccgggacaacacccagctgctgatcaaccagctgtggcagctgcccacagagcgggtggaggaggccatcgtggcccggctgcctgagcccaccacccggctgccccgggagaagcccctgccccggccccggcccctgacccgctggcagcagtttgcccggctgaagggcatccggcccaagaagaagaccaacctggtgtgggatgaggtgtctggccagtggaggcggcgctggggctaccagagggccagagatgacaccaaggagtggctgattgaggtgcctggaaatgctgaccccctggaggaccagtttgccaagaggatccaggccaagaaggagcgggtggccaagaatgagctgaaccggctgaggaacctggcccgggcccacaagatgcagctgcccagcgctgctggcctgcaccccaccggccaccagagcaaggaggagctgggccgggccatgcaggtggccaaggtgtccacagcctctgtgggccgcttccaggagcggctgcccaaggagaaggtgccccggggcagcggcaagaagaggaagttccagcccctgtttggagactttgctgctgagaagaagaaccagctggagctgctgcgggtgatgaacagcaagaagccccagctggatgtgacccgggccaccaacaagcagatgagggaggaggaccaggaggaggccgccaagaggaggaagatgagccagaagggcaagaggaaaggaggccggcagggccctgggggcaagaggaagggcggcccccccagccagggcggcaagaggaaaggaggcctgggcggcaagatgaacagcggccccccaggcctgggcggcaagaggaagggcggccagaggcctgggggcaagaggaggaagtag

SEQ ID NO: 37713 - DNA, 2127 bp, Artificial Sequence
  Description of Artificial Sequence: Synthetic coding sequence
atggctgaccgggagggcggctgtgccgccggccggggccgggagctggagcctgagctggagcccggccctggccctggcagcgccctggagcccggggaggagtttgagatcgtggacaggagccagctgcccggccctggggacctgcggagcgccacccggcccagggctgctgagggctggagcgcccccatcctgaccctggcccggcgggccaccggcaacctgagcgccagctgtggcagcgccctgcgggctgctgctggcctgggcggcggggacagcggagatggaacagcccgggccgccagcaagtgccagatgatggaggagcgggccaacctgatgcacatgatgaagctgagcatcaaggtgctgctgcagagcgccctgagcctgggccgcagcctggatgctgaccacgcccccctgcagcagttctttgtggtgatggagcactgcctgaagcacggcctgaaggtgaagaagagcttcatcggccagaacaagagcttcttcggccccctggagctggtggagaagctgtgcccagaggccagtgacatcgccacctctgtgaggaacctgcctgagctgaagacagctgtgggccggggccgggcctggctgtacctggccctgatgcagaagaagctggccgactacctgaaggtgctgattgacaacaagcacctgctgtctgagttctatgagcctgaggccctgatgatggaggaggagggcatggtgattgtgggcctgctggtgggcctgaatgtgctggatgccaacctgtgcctgaagggggaggacctggacagccaggtgggcgtcatcgacttcagcctgtacctgaaggatgtgcaggacctggatggcggcaaggagcacgagcgcatcacagatgtgctggaccagaagaactacgtggaggagctgaacagacacctgagctgcaccgtgggggacctgcagaccaagattgatggcctggagaagaccaacagcaagctgcaggaggagctgtctgctgccacagaccgcatctgcagcctgcaggaggagcagcagcagctgcgggagcagaatgagctgatccgggagaggtctgagaagtctgtggagatcaccaagcaggacaccaaggtggagctggagacctacaagcagacccggcagggcctggatgagatgtacagtgatgtgtggaagcagctgaaggaggagaagaaggtgcggctggagctggagaaggagctggagctgcagatcggcatgaagacagagatggagatcgccatgaagctgctggagaaggacacccatgagaagcaggacaccctggtggccctgcggcagcagctggaggaggtgaaggccatcaacctgcagatgttccacaaggcccagaatgctgagagcagcctgcagcagaagaatgaggccatcaccagctttgagggcaagaccaaccaggtgatgagctccatgaagcagatggaggagcggctgcagcacagcgagcgggcccggcagggcgctgaggagaggagccacaagctgcagcaggagctgggcggccgcatcggggccctgcagctgcagctgagccagctgcacgagcagtgcagcagcctggagaaggagctgaagtctgagaaggagcagaggcaggccctgcagcgggagctgcagcacgagaaggacaccagcagcctgctgaggatggagctgcagcaggtggagggcctgaagaaggagctgcgggagctgcaggatgagaaggccgagctgcagaagatctgtgaggagcaggagcaggccctgcaggagatgggcctgcacctgagccagagcaagctgaagatggaggacatcaaggaggtgaaccaggccctgaagggccacgcctggctgaaggatgatgaggccacccactgccggcagtgtgagaaggagttcagcatcagcaggaggaagcaccactgcaggaactgtggccacatcttctgcaacacctgcagcagcaatgagctggccctgcccagctaccccaagcctgtgcgggtgtgtgacagctgccacaccctgctgctgcagcgctgcagcagcacagccagctag

SEQ ID NO: 37714 - DNA, 933 bp, Artificial Sequence
  Description of Artificial Sequence: Synthetic coding sequence
atgtacagtgatgtgtggaagcagctgaaggaggagaagaaggtgcggctggagctggagaaggagctggagctgcagatcggcatgaagacagagatggagatcgccatgaagctgctggagaaggacacccatgagaagcaggacaccctggtggccctgcggcagcagctggaggaggtgaaggccatcaacctgcagatgttccacaaggcccagaatgctgagagcagcctgcagcagaagaatgaggccatcaccagctttgagggcaagaccaaccaggtgatgagctccatgaagcagatggaggagcggctgcagcacagcgagcgggcccggcagggcgctgaggagaggagccacaagctgcagcaggagctgggcggccgcatcggggccctgcagctgcagctgagccagctgcacgagcagtgcagcagcctggagaaggagctgaagtctgagaaggagcagaggcaggccctgcagcgggagctgcagcacgagaaggacaccagcagcctgctgaggatggagctgcagcaggtggagggcctgaagaaggagctgcgggagctgcaggatgagaaggccgagctgcagaagatctgtgaggagcaggagcaggccctgcaggagatgggcctgcacctgagccagagcaagctgaagatggaggacatcaaggaggtgaaccaggccctgaagggccacgcctggctgaaggatgatgaggccacccactgccggcagtgtgagaaggagttcagcatcagcaggaggaagcaccactgcaggaactgtggccacatcttctgcaacacctgcagcagcaatgagctggccctgcccagctaccccaagcctgtgcgggtgtgtgacagctgccacaccctgctgctgcagcgctgcagcagcacagccagctag

SEQ ID NO: 37715 - DNA, 1239 bp, Artificial Sequence
  Description of Artificial Sequence: Synthetic coding sequence
atggctgaccgggagggcggctgtgccgccggccggggccgggagctggagcctgagctggagcccggccctggccctggcagcgccctggagcccggggaggagtttgagatcgtggacaggagccagctgcccggccctggggacctgcggagcgccacccggcccagggctgctgagggctggagcgcccccatcctgaccctggcccggcgggccaccggcaacctgagcgccagctgtggcagcgccctgcgggctgctgctggcctgggcggcggggacagcggagatggaacagcccgggccgccagcaagtgccagatgatggaggagcgggccaacctgatgcacatgatgaagctgagcatcaaggtgctgctgcagagcgccctgagcctgggccgcagcctggatgctgaccacgcccccctgcagcagttctttgtggtgatggagcactgcctgaagcacggcctgaaggtgaagaagagcttcatcggccagaacaagagcttcttcggccccctggagctggtggagaagctgtgcccagaggccagtgacatcgccacctctgtgaggaacctgcctgagctgaagacagctgtgggccggggccgggcctggctgtacctggccctgatgcagaagaagctggccgactacctgaaggtgctgattgacaacaagcacctgctgtctgagttctatgagcctgaggccctgatgatggaggaggagggcatggtgattgtgggcctgctggtgggcctgaatgtgctggatgccaacctgtgcctgaagggggaggacctggacagccaggtgggcgtcatcgacttcagcctgtacctgaaggatgtgcaggacctggatggcggcaaggagcacgagcgcatcacagatgtgctggaccagaagaactacgtggaggagctgaacagacacctgagctgcaccgtgggggacctgcagaccaagattgatggcctggagaagaccaacagcaagctgcaggaggaggaggagaggatgaagggccaggacaagggcggcctgagccggggccgggagctggccgccagctgcccagctgtgtccctgctggacaccagctgcctgctgctggccggcggcggctgcagcgccctgctgcggctgagcacagccttcagctgcaaccggcccaacctgctgaccagcagaagaacagctgctgtgaagaggaccaagtag

SEQ ID NO: 37716 - DNA, 1803 bp, Artificial Sequence
  Description of Artificial Sequence: Synthetic coding sequence
atgatggaggagcgggccaacctgatgcacatgatgaagctgagcatcaaggtgctgctgcagagcgccctgagcctgggccgcagcctggatgctgaccacgcccccctgcagcagttctttgtggtgatggagcactgcctgaagcacggcctgaaggtgaagaagagcttcatcggccagaacaagagcttcttcggccccctggagctggtggagaagctgtgcccagaggccagtgacatcgccacctctgtgaggaacctgcctgagctgaagacagctgtgggccggggccgggcctggctgtacctggccctgatgcagaagaagctggccgactacctgaaggtgctgattgacaacaagcacctgctgtctgagttctatgagcctgaggccctgatgatggaggaggagggcatggtgattgtgggcctgctggtgggcctgaatgtgctggatgccaacctgtgcctgaagggggaggacctggacagccaggtgggcgtcatcgacttcagcctgtacctgaaggatgtgcaggacctggatggcggcaaggagcacgagcgcatcacagatgtgctggaccagaagaactacgtggaggagctgaacagacacctgagctgcaccgtgggggacctgcagaccaagattgatggcctggagaagaccaacagcaagctgcaggaggagctgtctgctgccacagaccgcatctgcagcctgcaggaggagcagcagcagctgcgggagcagaatgagctgatccgggagaggtctgagaagtctgtggagatcaccaagcaggacaccaaggtggagctggagacctacaagcagacccggcagggcctggatgagatgtacagtgatgtgtggaagcagctgaaggaggagaagaaggtgcggctggagctggagaaggagctggagctgcagatcggcatgaagacagagatggagatcgccatgaagctgctggagaaggacacccatgagaagcaggacaccctggtggccctgcggcagcagctggaggaggtgaaggccatcaacctgcagatgttccacaaggcccagaatgctgagagcagcctgcagcagaagaatgaggccatcaccagctttgagggcaagaccaaccaggtgatgagctccatgaagcagatggaggagcggctgcagcacagcgagcgggcccggcagggcgctgaggagaggagccacaagctgcagcaggagctgggcggccgcatcggggccctgcagctgcagctgagccagctgcacgagcagtgcagcagcctggagaaggagctgaagtctgagaaggagcagaggcaggccctgcagcgggagctgcagcacgagaaggacaccagcagcctgctgaggatggagctgcagcaggtggagggcctgaagaaggagctgcgggagctgcaggatgagaaggccgagctgcagaagatctgtgaggagcaggagcaggccctgcaggagatgggcctgcacctgagccagagcaagctgaagatggaggacatcaaggaggtgaaccaggccctgaagggccacgcctggctgaaggatgatgaggccacccactgccggcagtgtgagaaggagttcagcatcagcaggaggaagcaccactgcaggaactgtggccacatcttctgcaacacctgcagcagcaatgagctggccctgcccagctaccccaagcctgtgcgggtgtgtgacagctgccacaccctgctgctgcagcgctgcagcagcacagccagctag

SEQ ID NO: 37717 - DNA, 1803 bp, Artificial Sequence; identical to SEQ ID NO: 37716
  Description of Artificial Sequence: Synthetic coding sequence

SEQ ID NO: 37718 - DNA, 1827 bp, Artificial Sequence
  Description of Artificial Sequence: Synthetic coding sequence
gcctgggccgcccggctgggccggcccggccgcagctgcctgcccggggcccggggccgggcccctcctcctccacccctgctgctgctgctggccctgctgcccctgctgcctgcccctggagctgctgctgccccagccccccggcccccagagctgcagagcgccagcgctggccccagcgtgtccctgtacctgtctgaagatgaggtgcggcggctgattggcctggatgctgagctgtactacgtgagaaatgacctgatcagccactacgccctgtccttcagcctgctggtgcccagcgagaccaacttcctgcacttcacctggcacgccaagagcaaggtggagtacaagctgggcttccaggtggacaacgtgctggccatggacatgccccaggtgaacatctctgtgcagggcgaggtgcccaggaccctgtctgtgttccgggtggagctgagctgcaccgggaaggtggacagcgaggtgatgatcctgatgcagctgaacctgactgtgaacagcagcaagaacttcaccgtgctgaacttcaagaggaggaagatgtgctacaagaagctggaggaggtgaagaccagcgccctggacaagaacaccagcaggaccatctatgaccctgtgcacgccgcccccaccaccagcaccagggtcttctacatctctgtgggcgtgtgctgtgccgtcatcttcctggtggccatcatcctggccgtgctgcacctgcacagcatgaagagaattgagctggatgacagcatcagcgccagcagcagcagccagggcctgagccagcccagcacccagaccacccagtacctgcgggctgacacccccaacaatgccacccccatcaccagcagcctgggctaccccaccctgcgcatcgagaagaatgacctgcggtctgtgaccctgctggaggccaagggcaaggtgaaggacatcgccatcagccgggagcgcatcaccctgaaggatgtgctgcaggagggcaccttcggccgcatcttccacggcatcctgattgatgagaaggaccccaacaaggagaagcaggcctttgtgaagacagtgaaggaccaggccagcgagatccaggtgaccatgatgctgacagagagctgcaagctgcggggcctgcaccacaggaacctgctgcccatcacccacgtgtgcatcgaggagggggagaagcccatggtgatcctgccctacatgaactggggcaacctgaagctgttcctgcggcagtgcaagctggtggaggccaacaacccccaggccatcagccagcaggacctggtgcacatggccatccagatcgcctgtggcatgagctacctggcccggcgggaggtgatccacaaggacctggccgccaggaactgtgtgattgatgacaccctgcaggtgaagatcacagacaatgccctgagccgggacctcttccccatggactaccactgcctgggggacaatgaaaatagacctgtgcgctggatggccctggagagcctggtgaacaatgagttcagcagcgccagtgatgtgtgggcctttggagtgaccctgtgggagctgatgaccctgggccagaccccctacgtggacatcgacccctttgagatggccgcctacctgaaggatggctaccgcatcgcccagcccatcaactgcccagatgagctgtttgctgtgatggcctgctgctgggccctggaccctgaggagcggcccaagttccagcagctggtgcagtgcctgacagagttccacgccgccctgggcgcctacgtgtag

SEQ ID NO: 37719 - DNA, 1257 bp, Artificial Sequence
  Description of Artificial Sequence: Synthetic coding sequence
atgtgctacaagaagctggaggaggtgaagaccagcgccctggacaagaacaccagcaggaccatctatgaccctgtgcacgccgcccccaccaccagcaccagggtcttctacatctctgtgggcgtgtgctgtgccgtcatcttcctggtggccatcatcctggccgtgctgcacctgcacagcatgaagagaattgagctggatgacagcatcagcgccagcagcagcagccagggcctgagccagcccagcacccagaccacccagtacctgcgggctgacacccccaacaatgccacccccatcaccagcagcctgggctaccccaccctgcgcatcgagaagaatgacctgcggtctgtgaccctgctggaggccaagggcaaggtgaaggacatcgccatcagccgggagcgcatcaccctgaaggatgtgctgcaggagggcaccttcggccgcatcttccacggcatcctgattgatgagaaggaccccaacaaggagaagcaggcctttgtgaagacagtgaaggaccaggccagcgagatccaggtgaccatgatgctgacagagagctgcaagctgcggggcctgcaccacaggaacctgctgcccatcacccacgtgtgcatcgaggagggggagaagcccatggtgatcctgccctacatgaactggggcaacctgaagctgttcctgcggcagtgcaagctggtggaggccaacaacccccaggccatcagccagcaggacctggtgcacatggccatccagatcgcctgtggcatgagctacctggcccggcgggaggtgatccacaaggacctggccgccaggaactgtgtgattgatgacaccctgcaggtgaagatcacagacaatgccctgagccgggacctcttccccatggactaccactgcctgggggacaatgaaaatagacctgtgcgctggatggccctggagagcctggtgaacaatgagttcagcagcgccagtgatgtgtgggcctttggagtgaccctgtgggagctgatgaccctgggccagaccccctacgtggacatcgacccctttgagatggccgcctacctgaaggatggctaccgcatcgcccagcccatcaactgcccagatgagctgtttgctgtgatggcctgctgctgggccctggaccctgaggagcggcccaagttccagcagctggtgcagtgcctgacagagttccacgccgccctgggcgcctacgtgtag

SEQ ID NO: 37720 - DNA, 1764 bp, Artificial Sequence
  Description of Artificial Sequence: Synthetic coding sequence
tgaagagcccctcctcctccacccctgctgctgctgctggccctgctgcccctgctgcctgcccctggagctgctgctgccccagccccccggcccccagagctgcagagcgccagcgctggccccagcgtgtccctgtacctgtctgaagatgaggtgcggcggctgattggcctggatgctgagctgtactacgtgagaaatgacctgatcagccactacgccctgtccttcagcctgctggtgcccagcgagaccaacttcctgcacttcacctggcacgccaagagcaaggtggagtacaagctgggcttccaggtggacaacgtgctggccatggacatgccccaggtgaacatctctgtgcagggcgaggtgcccaggaccctgtctgtgttccgggtggagctgagctgcaccgggaaggtggacagcgaggtgatgatcctgatgcagctgaacctgactgtgaacagcagcaagaacttcaccgtgctgaacttcaagaggaggaagatgtgctacaagaagctggaggaggtgaagaccagcgccctggacaagaacaccagcaggaccatctatgaccctgtgcacgccgcccccaccaccagcaccagggtcttctacatctctgtgggcgtgtgctgtgccgtcatcttcctggtggccatcatcctggccgtgctgcacctgcacagcatgaagagaattgagctggatgacagcatcagcgccagcagcagcagccagggcctgagccagcccagcacccagaccacccagtacctgcgggctgacacccccaacaatgccacccccatcaccagctaccccaccctgagaattgagaagaatgacctgcggtctgtgaccctgctggaggccaagggcaaggtgaaggacatcgccatcagccgggagcgcatcaccctgaaggatgtgctgcaggagggcaccttcggccgcatcttccacggcatcctgattgatgagaaggaccccaacaaggagaagcaggcctttgtgaagacagtgaaggaccaggccagcgagatccaggtgaccatgatgctgacagagagctgcaagctgcggggcctgcaccacaggaacctgctgcccatcacccacgtgtgcatcgaggagggggagaagcccatggtgatcctgccctacatgaactggggcaacctgaagctgttcctgcggcagtgcaagctggtggaggccaacaacccccaggccatcagccagcaggacctggtgcacatggccatccagatcgcctgtggcatgagctacctggcccggcgggaggtgatccacaaggacctggccgccaggaactgtgtgattgatgacaccctgcaggtgaagatcacagacaatgccctgagccgggacctcttccccatggactaccactgcctgggggacaatgaaaatagacctgtgcgctggatggccctggagagcctggtgaacaatgagttcagcagcgccagtgatgtgtgggccttcggcgtgaccctgtgggagctgatgaccctgggccagaccccctacgtggacatcgacccctttgagatggccgcctacctgaaggatggctacagaattgcccagcccatcaactgcccagatgagctgtttgctgtgatggcctgctgctgggccctggaccctgaggagcggcccaagttccagcagctggtgcagtgcctgacagagttccacgccgccctgggcgcctacgtgtag

SEQ ID NO: 37721 - DNA, 240 bp, Artificial Sequence
  Description of Artificial Sequence: Synthetic coding sequence
atgagcaccaagaagagccctgaggagctgaagaggatctttgagaagtatgctgccaaggagggggaccctgaccagctgagcaaggatgagctgaagctgctgatccaggccgagttccccagcctgctgaagggccccaacaccctggatgacctcttccaggagctggacaagaatggagatggagaggtgtcctttgaggagttccaggtgctggtgaagaagatcagccagtag

SEQ ID NO: 37722 - DNA, 726 bp, Artificial Sequence
  Description of Artificial Sequence: Synthetic coding sequence
atgaatggcaccctgacagctgtggagagcttcctgaccatccacagcggccctgagggcctgagcatccatgatggcacctggaagagcgccatctacggctttggagaccagagcaacctgaggaagctgagaaatgtgagcaacctgaagcctgtgcccctcatcggccccaagctgaagaggcgctggcccatctcctactgccgggagctgaagggctacagcatccccttcatgggcagtgatgtgtctgtggtgcggaggacccagcgctacctgtatgagaacctggaggagagccctgtgcagtatgctgcctacgtgacagtgggcggcatcaccagcgtcatcaagctgatgtttgctggcctcttcttcctgttctttgtgcgctttggaattggccggcagctgctgatcaagattgatgctgccagcttcaccctgaccttcttcggccagggctacagccagggcactggaacagacaagaacaagcccaacatcaagatctgcacccaggtgaagggccctgaggccggctacgtggccacccccatcgccatggtgcaggccgccatgaccctgctgagtgatgccagccacctgcccaaggccggcggcgtcttcaccccaggagctgccttcagcaagaccaagctgattgaccggctgaacaagcatggaattgagttcagcgtcatcagcagcagcgaggtgtag

SEQ ID NO: 37723 - DNA, 1290 bp, Artificial Sequence
  Description of Artificial Sequence: Synthetic coding sequence
atggccacagagcagaggcccttccacctggtggtgtttggagccagcggcttcaccggccagtttgtgacagaggaggtggcccgggagcaggtggaccctgagaggagcagccggctgccctgggccgtggccggccgcagccgggagaagctgcagagggtgctggagaaggccgccctgaagctgggccggcccaccctgagcagcgaggtgggcatcatcatctgtgacatcgccaacccagccagcctggatgagatggccaagcaggccaccgtggtgctgaactgtgtgggcccctaccgcttctatggagagcccgtcatcaaggcctgcattgaaaatggagccagctgcatcgacatcagcggggagccccagttcctggagctgatgcagctgaagtaccacgagaaggctgctgacaagggcgtgtacatcatcggcagcagcggctttgacagcatcccagctgacctgggcgtcatctacaccaggaacaagatgaatggcaccctgacagctgtggagagcttcctgaccatccacagcggccctgagggcctgagcatccatgatggcacctggaagagcgccatctacggctttggagaccagagcaacctgaggaagctgagaaatgtgagcaacctgaagcctgtgcccctgattggccccaagctgaagaggcgctggcccatctcctactgccgggagctgaagggctacagcatccccttcatgggcagtgatgtgtctgtggtgcggaggacccagcgctacctgtatgagaacctggaggagagccctgtgcagtatgctgcctacgtgacagtgggcggcatcaccagcgtcatcaagctgatgtttgctggcctcttcttcctgttctttgtgcgcttcggcatcggccggcagctgctgatcaagttcccctggttcttctcctttggctacttcagcaagcagggccccacccagaagcagattgatgctgccagcttcaccctgaccttcttcggccagggctacagccagggcactggaacagacaagaacaagcccaacatcaagatctgcacccaggtgaagggccctgaggccggctacgtggccacccccatcgccatggtgcaggccgccatgaccctgctgagtgatgccagccacctgcccaaggccggcggcgtcttcaccccaggagctgccttcagcaagaccaagctgattgaccggctgaacaagcatggaattgagttcagcgtcatcagcagcagcgaggtgtag

SEQ ID NO: 37724 - DNA, 1074 bp, Artificial Sequence
  Description of Artificial Sequence: Synthetic coding sequence
atgtctgggaagaccaaggcccggcgggccgccatgttcttccgccgctgcagtgaagatgccagcggcagcgccagcggaaatgccctgctgtctgaagatgaaaatccagatgccaacggggtgaccaggtcctggaagatcatcctgagcaccatgctgaccctgaccttcctgctggtgggcctgctgaaccaccagtggctgaaggagacagatgtgccccagaagagccggcagctgtatgccatcatcgccgagtatggcagccggctgtacaagtaccaggcccggctgaggatgcccaaggagcagctggagctgctgaagaaggagagccagaacctggagaacaacttccggcagatcctcttcctgattgagcagattgatgtgctgaaggccctgctgcgggacatgaaggatggcatggacaacaaccacaactggaacacccatggagaccctgtggaggaccctgaccacacagaggaggtgagcaacctggtgaactacgtgctgaagaagctgcgggaggaccaggtggagatggctgactatgccctgaagtctgctggggccagcatcattgaagctggcaccagcgagagctacaagaacaacaaggccaagctgtactggcatggaattggcttcctgaaccacgagatgcccccagacatcatcctgcagccagatgtgtacccaggcaagtgctgggccttccctggcagccagggccacaccctcatcaagctggccaccaagatcatccccacagctgtgaccatggagcacatcagcgagaaggtgagccccagcggcaacatcagcagcgcccccaaggagttctctgtgtatggcatcaccaagaagtgtgagggggaggagatcttcctgggccagttcatctacaacaagacaggcaccaccgtgcagacctttgagctgcagcacgctgtgtctgagtacctgctgtgtgtgaagctgaacatcttcagcaactggggccaccccaagtacacctgcctgtaccgcttccgggtgcacggcaccccaggcaagcacatctag

SEQ ID NO: 37725 - DNA, 1074 bp, Artificial Sequence; identical to SEQ ID NO: 37724
  Description of Artificial Sequence: Synthetic coding sequence

SEQ ID NO: 37726 - DNA, 810 bp, Artificial Sequence
  Description of Artificial Sequence: Synthetic coding sequence
atgcccaaggagcagctggagctgctgaagaaggagagccagaacctggagaacaacttccggcagatcctcttcctgattgagcagattgatgtgctgaaggccctgctgcgggacatgaaggatggcatggacaacaaccacaactggaacacccatggagaccctgtggaggaccctgaccacacagaggaggtgagcaacctggtgaactacgtgctgaagaagctgcgggaggaccaggtggagatggctgactatgccctgaagtctgctggggccagcatcattgaagctggcaccagcgagagctacaagaacaacaaggccaagctgtactggcatggaattggcttcctgaaccacgagatgcccccagacatcatcctgcagccagatgtgtacccaggcaagtgctgggccttccctggcagccagggccacaccctcatcaagctggccaccaagatcatccccacagctgtgaccatggagcacatcagcgagaaggtgagccccagcggcaacatcagcagcgcccccaaggagttctctgtgtatgtgcagcgctacatgtgccgctttgtgatccaggccggcatcaccaagaagtgtgagggggaggagatcttcctgggccagttcatctacaacaagacaggcaccaccgtgcagacctttgagctgcagcacgctgtgtctgagtacctgctgtgtgtgaagctgaacatcttcagcaactggggccaccccaagtacacctgcctgtaccgcttccgggtgcacggcaccccaggcaagcacatctag

SEQ ID NO: 37727 - DNA, 810 bp, Artificial Sequence; identical to SEQ ID NO: 37726
  Description of Artificial Sequence: Synthetic coding sequence

SEQ ID NO: 37728 - DNA, 846 bp, Artificial Sequence
  Description of Artificial Sequence: Synthetic coding sequence
tgatatgccatcatcgccgagtatggcagccggctgtacaagtaccaggcccggctgaggatgcccaaggagcagctggagctgctgaagaaggagagccagaacctggagaacaacttccggcagatcctcttcctgattgagcagattgatgtgctgaaggccctgctgcgggacatgaaggatggcatggacaacaaccacaactggaacacccatggagaccctgtggaggaccctgaccacacagaggtgctggatgaggaggtgagcaacctggtgaactacgtgctgaagaagctgcgggaggaccaggtggagatggctgactatgccctgaagtctgctggggccagcatcattgaagctggcaccagcgagagctacaagaacaacaaggccaagctgtactggcatggaattggcttcctgaaccacgagatgcccccagacatcatcctgcagccagatgtgtacccaggcaagtgctgggccttccctggcagccagggccacaccctcatcaagctggccaccaagatcatccccacagctgtgaccatggagcacatcagcgagaaggtgagccccagcggcaacatcagcagcgcccccaaggagttctctgtgtatggcatcaccaagaagtgtgagggggaggagatcttcctgggccagttcatctacaacaagacaggcaccaccgtgcagacctttgagctgcagcacgctgtgtctgagtacctgctgtgtgtgaagctgaacatcttcagcaactggggccaccccaagtacacctgcctgtaccgcttccgggtgcacggcaccccaggcaagcacatctag

SEQ ID NO: 37729 - DNA, 1038 bp, Artificial Sequence
  Description of Artificial Sequence: Synthetic coding sequence
atggaggactacagcaagtacaatgcctacacagacttcagcagctgccgcctggagtgcagcggggccatcctggcccactgcaacctgcacctgctgggcagcagcatcagccctgccagcgccagccgggtggccggcaccaccggcctgctgaaccaccagtggctgaaggagacagatgtgccccagaagagccggcagctgtatgccatcatcgccgagtatggcagccggctgtacaagtaccaggcccggctgaggatgcccaaggagcagctggagctgctgaagaaggagagccagaacctggagaacaacttccggcagatcctcttcctgattgagcagattgatgtgctgaaggccctgctgcgggacatgaaggatggcatggacaacaaccacaactggaacacccatggagaccctgtggaggaccctgaccacacagaggaggtgagcaacctggtgaactacgtgctgaagaagctgcgggaggaccaggtggagatggctgactatgccctgaagtctgctggggccagcatcattgaagctggcaccagcgagagctacaagaacaacaaggccaagctgtactggcatggaattggcttcctgaaccacgagatgcccccagacatcatcctgcagccagatgtgtacccaggcaagtgctgggccttccctggcagccagggccacaccctcatcaagctggccaccaagatcatccccacagctgtgaccatggagcacatcagcgagaaggtgagccccagcggcaacatcagcagcgcccccaaggagttctctgtgtatggcatcaccaagaagtgtgagggggaggagatcttcctgggccagttcatctacaacaagacaggcaccaccgtgcagacctttgagctgcagcacgctgtgtctgagtacctgctgtgtgtgaagctgaacatcttcagcaactggggccaccccaagtacacctgcctgtaccgcttccgggtgcacggcaccccaggcaagcacatctag

SEQ ID NO: 37730 - DNA, 939 bp, Artificial Sequence
  Description of Artificial Sequence: Synthetic coding sequence
atggacaggagcaccaacctggacatcgaggagctgaagatgacccgggagcagtacatcctggccacccagcagaacaacctgcccaggacagaaaatgcccagctgtaccctgtgggcatctacggctggaggaagcgctgcctgtacttctttgtgctgctgctgctggtgaccatgattgtgaacctggccatgaccatctggatcctgaaggtgatgaacttcaccgtggatggcatgggcaacctgcgggtgaccaagaagggcatccggctggagggcatcagcgagttcctgctgcccctgtatgtgaaggagatccacagcaggaaggacagccccctggtgctgcagagcgacagaaatgtgacagtgaatgccaggaaccacatgggccagctgaccggccagctgaccatcggggctgatgctgtggaggcccagtgcaagagatttgaggtgcgggcctctgaagatggccgggtgctcttcagcgcagatgaagatgagatcaccatcggggctgagaagctgaaggtgactggaacagagggcgctgtgtttggccacagcgtggagaccccccacatccgggcagagcccagccaggacctgcggctggagagccccaccaggagcctcatcatggaggccccccggggcgtgcaggtgtctgctgctgctggggacttcaaggccacctgcaggaaggagctgcacctgcagagcacagaaggagagatcttcctgaatgctgagaccatcaagctgggcaacctgcccaccggcagcttcagcagcagcagccccagcagcagcagcagccggcagacagtgtatgagctgtgtgtgtgccccaacgggaagctgtacctgagccctgctggggtgggcagcacctgccagagcagcagcaacatctgcctgtggagctag

SEQ ID NO: 37731 - DNA, 798 bp, Artificial Sequence
  Description of Artificial Sequence: Synthetic coding sequence
atgacccgggagcagtacatcctggccacccagcagaacaacctgcccaggacagaaaatgcccagctgtaccctgtgggcatctacggctggaggaagcgctgcctgtacttctttgtgctgctgctgctggtgaccatgattgtgaacctggccatgaccatctggatcctgaaggtgatgaacttcaccgtggacagccccctggtgctgcagagcgacagaaatgtgacagtgaatgccaggaaccacatgggccagctgaccggccagctgaccatcggggctgatgctgtggaggcccagtgcaagagatttgaggtgcgggcctctgaagatggccgggtgctcttcagcgcagatgaagatgagatcaccatcggggctgagaagctgaaggtgactggaacagaaggagctgtgtttggccacagcgtggagaccccccacatccgggcagagcccagccaggacctgcggctggagagccccaccaggagcctcatcatggaggccccccggggcgtgcaggtgtctgctgctgctggggacttcaaggccacctgcaggaaggagctgcacctgcagagcacagaaggagagatcttcctgaatgctgagaccatcaagctgggcaacctgcccaccggcagcttcagcagcagcagccccagcagcagcagcagccggcagacagtgtatgagctgtgtgtgtgccccaacgggaagctgtacctgagccctgctggggtgggcagcacctgccagagcagcagcaacatctgcctgtggagctag

SEQ ID NO: 37732 - DNA, 2436 bp, Artificial Sequence
  Description of Artificial Sequence: Synthetic coding sequence
atgcccagcgccctggccatcttcacctgccggcccaacagccaccccttccaggagagacatgtgtacctggatgagcccatcaagattggccgctctgtggcccgctgcaggcctgcccagaacaatgccacctttgactgcaaggtgctgagcagaaatcatgccctggtgtggtttgaccacaagacaggcaagttctacctgcaggacaccaagagcagcaatggcaccttcatcaacagccagaggctgagccggggcagcgaggagagccccccctgtgagatcctgagcggggacatcatccagtttggagtggatgtgacagagaacaccaggaaggtgacccacggctgcatcgtgtccaccatcaagctgttcctgcctgatggcatggaggcccggctgcggagtgatgtgattcatgcccccctgcccagccctgtggacaaggtggccgccaacacccccagcatgtacagccaggagctgttccagctgagccagtacctgcaggaggccctgcaccgggagcagatgctggagcagaagctggccaccctgcagaggctgctggccatcacccaggaggccagtgacacctcctggcaggccctgattgatgaggaccggctgctgagccggctggaggtgatgggcaaccagctgcaggcctgcagcaagaaccagacagaggacagcctgaggaaggagctgattgccctgcaggaggacaagcacaactatgagaccacagccaaggagagcctgcggcgggtgctgcaggagaagattgaggtggtgaggaagctgtctgaggtggagaggagcctgagcaacacagaagatgaatgtacccacctgaaggagatgaatgaaagaacccaggaggagctgcgggagctggccaacaagtacaacggggctgtgaatgagatcaaggacctgagtgacaagctgaaggtggccgagggcaagcaggaggagatccagcagaagggccaggccgagaagaaggagctgcagcacaagattgatgagatggaggagaaggagcaggagctgcaggccaagattgaggccctgcaggccgacaatgacttcaccaatgaaaggctgacagccctgcaggagcacctgctgagcaagtctggaggagactgcaccttcatccaccagttcatcgagtgccagaagaagctgattgtggagggccacctgaccaaggctgtggaggagaccaagctgagcaaggagaaccagacccgggccaaggagagtgacttcagtgacaccctgagccccagcaaggagaagagcagtgatgacaccacagatgcccagatggatgagcaggacctgaatgagcccctggccaaggtgtccctgctgaaggatgacctgcagggcgcccagagcgagattgaggccaagcaggagatccagcacctgaggaaggagctgattgaggcccaggagctggcccggaccagcaagcagaagtgctttgagctgcaggccctgctggaggaggagaggaaggcctacagaaaccaggtggaggagagcaccaagcagatccaggtgctgcaggcccagctgcagaggctgcacatcgacacagagaacctgcgggaggagaaggacagcgagatcaccagcaccagagatgagctgctgagcgccagagatgagatcctgctgctgcaccaggccgccgccaaggtggccagcgagcgggacacagacatcgccagcctgcaggaggagctgaagaaggtgcgggcagagctggagcgctggaggaaggccgcctctgaatatgagaaggagatcaccagcctgcagaacagcttccagctgcgctgccagcagtgtgaggaccagcagcgggaggaggccacccggctgcagggcgagctggagaagctgaggaaggagtggaatgccctggagacagagtgccacagcctgaagcgggagaatgtgctgctgagcagcgagctgcagaggcaggagaaggagctgcacaacagccagaagcagagcctggagctgaccagtgacctgagcatcctgcagatgagcaggaaggagctggagaaccaggtgggcagcctgaaggagcagcacctgcgggacagcgctgacctgaagaccctgctgagcaaggccgagaaccaggccaaggatgtgcagaaggagtatgagaagacccagacagtgctgtctgagctgaagctgaagtttgagatgacagagcaggagaagcagagcatcacagatgagctgaagcagtgcaagaacaacctgaagctgctgcgggagaagggcaacaacaagccctggccctggatgcccatgctggccgccctggtggccgtgacagccatcgtgctgtatgtgcccggcctggcccgggccagcccctag

SEQ ID NO: 37733 - DNA, 2436 bp, Artificial Sequence; identical to SEQ ID NO: 37732
  Description of Artificial Sequence: Synthetic coding sequence

SEQ ID NO: 37734 - DNA, 1521 bp, Artificial Sequence
  Description of Artificial Sequence: Synthetic coding sequence
atgcccagcgccctggccatcttcacctgccggcccaacagccaccccttccaggagagacatgtgtacctggatgagcccatcaagattggccgctctgtggcccgctgcaggcctgcccagaacaatgccacctttgactgcaaggtgctgagcagaaatcatgccctggtgtggtttgaccacaagacaggcaagttctacctgcaggacaccaagagcagcaatggcaccttcatcaacagccagaggctgagccggggcagcgaggagagccccccctgtgagatcctgagcggggacatcatccagtttggagtggatgtgacagagaacaccaggaaggtgacccacggctgcatcgtgtccaccatcaagctgttcctgcctgatggcatggaggcccggctgcggagtgatgtgattcatgcccccctgcccagccctgtggacaaggtggccgccaacacccccagcatgtacagccaggagctgttccagctgagccagtacctgcaggaggccctgcaccgggagcagatgctggagcagaagctggccaccctgcagaggctgctggccatcacccaggaggccagtgacacctcctggcaggccctgattgatgaggaccggctgctgagccggctggaggtgatgggcaaccagctgcaggcctgcagcaagaaccagacagaggacagcctgaggaaggagctgattgccctgcaggaggacaagcacaactatgagaccacagccaaggagagcctgcggcgggtgctgcaggagaagattgaggtggtgaggaagctgtctgaggtggagaggagcctgagcaacacagaagatgaatgtacccacctgaaggagatgaatgaaagaacccaggaggagctgcgggagctggccaacaagtacaacggggctgtgaatgagatcaaggacctgagtgacaagctgaaggtggccgagggcaagcaggaggagatccagcagaagggccaggccgagaagaaggagctgcagcacaagattgatgagatggaggagaaggagcaggagctgcaggccaagattgaggccctgcaggccgacaatgacttcaccaatgaaaggctgacagccctgcaggtgcggctggagcacctgcaggagaagaccctgaaggaatgtagcagcctgggcatccaggtggatgacttcctgcccaagatcaatggcagcacagagaaggagaagctgattgtggagggccacctgaccaaggctgtggaggagaccaagctgagcaaagaaaaccagacccgggccaaggagagtgacttcagtgacaccctgagccccagcaaggagaagagcagtgatgacaccacagatgcccagatggatgagcaggacctgaatgagcccctggccaaggtgtccctgctgaagggcaccctgacctgcttctatgacatcgtgaaccagggcatcaagagcccctttgccatcaagtctgtgctggacatcatgtag

SEQ ID NO: 37735 - DNA, 816 bp, Artificial Sequence
  Description of Artificial Sequence: Synthetic coding sequence
atggatgagcaggacctgaatgagcccctggccaaggtgtccctgctgaaggccctgctggaggaggagaggaaggcctacagaaaccaggtggaggagagcaccaagcagatccaggtgctgcaggcccagctgcagaggctgcacatcgacacagagaacctgcgggaggagaaggacagcgagatcaccagcaccagagatgagctgctgagcgccagagatgagatcctgctgctgcaccaggccgccgccaaggtggccagcgagcgggacacagacatcgccagcctgcaggaggagctgaagaaggtgcgggcagagctggagcgctggaggaaggccgcctctgaatatgagaaggagatcaccagcctgcagaacagcttccagctgcgctgccagcagtgtgaggaccagcagcgggaggaggccacccggctgcagggcgagctggagaagctgaggaaggagtggaatgccctggagacagagtgccacagcctgaagcgggagaatgtgctgctgagcagcgagctgcagaggcaggagaaggagctgcacaacagccagaagcagagcctggagctgaccagtgacctgagcatcctgcagatgagcaggaaggagctggagaaccaggtgggcagcctgaaggagcagcacctgcgggacagcgctgacctgaagaccctgctgagcaaggccgagaaccaggccaaggatgtgcagaaggaggtgaagaggaaggacatcatgagccccatcatggtgggcctgaaggccaagagcaagagtgacatccacgccagctag

SEQ ID NO: 37736 - DNA, 1230 bp, Artificial Sequence
  Description of Artificial Sequence: Synthetic coding sequence
tgaaaactcatcgtggagggccacctgaccaaggctgtggaggagaccaagctgagcaaagaaaaccagacccgggccaaggagagtgacttcagtgacaccctgagccccagcaaggagaagagcagtgatgacaccacagatgcccagatggatgagcaggacctgaatgagcccctggccaaggtgtccctgctgaaggatgacctgcagggcgcccagagcgagattgaggccaagcaggagatccagcacctgaggaaggagctgattgaggcccaggagctggcccggaccagcaagcagaagtgctttgagctgcaggccctgctggaggaggagaggaaggcctacagaaaccaggtggaggagagcaccaagcagatccaggtgctgcaggcccagctgcagaggctgcacatcgacacagagaacctgcgggaggagaaggacagcgagatcaccagcaccagagatgagctgctgagcgccagagatgagatcctgctgctgcaccaggccgccgccaaggtggccagcgagcgggacacagacatcgccagcctgcaggaggagctgaagaaggtgcgggcagagctggagcgctggaggaaggccgcctctgaatatgagaaggagatcaccagcctgcagaacagcttccagctgcgctgccagcagtgtgaggaccagcagcgggaggaggccacccggctgcagggcgagctggagaagctgaggaaggagtggaatgccctggagacagagtgccacagcctgaagagagaaaatgtgctgctgagcagcgagctgcagaggcaggagaaggagctgcacaacagccagaagcagagcctggagctgaccagtgacctgagcatcctgcagatgagcaggaaggagctggagaaccaggtgggcagcctgaaggagcagcacctgcgggacagcgctgacctgaagaccctgctgagcaaggccgagaaccaggccaaggatgtgcagaaggagtatgagaagacccagacagtgctgtctgagctgaagctgaagtttgagatgacagagcaggagaagcagagcatcacagatgagctgaagcagtgcaagaacaacctgaagctgctgcgggagaagggcaacaaccccagcatcctgcagcctgtgcctgctgtgttcatcggcctcttcctggccttcctgttctggtgcttcggccccctgtggtag

SEQ ID NO: 37737 - DNA, 2487 bp, Artificial Sequence
  Description of Artificial Sequence: Synthetic coding sequence
atgcccagcgccctggccatcttcacctgccggcccaacagccaccccttccaggagagacatgtgtacctggatgagcccatcaagattggccgctctgtggcccgctgcaggcctgcccagaacaatgccacctttgactgcaaggtgctgagcagaaatcatgccctggtgtggtttgaccacaagacaggcaagttctacctgcaggacaccaagagcagcaatggcaccttcatcaacagccagaggctgagccggggcagcgaggagagccccccctgtgagatcctgagcggggacatcatccagtttggagtggatgtgacagagaacaccaggaaggtgacccacggctgcatcgtgtccaccatcaagctgttcctgcctgatggcatggaggcccggctgcggagtgatgtgattcatgcccccctgcccagccctgtggacaaggtggccgccaacacccccagcatgtacagccaggagctgttccagctgagccagtacctgcaggaggccctgcaccgggagcagatgctggagcagaagctggccaccctgcagaggctgctggccatcacccaggaggccagtgacacctcctggcaggccctgattgatgaggaccggctgctgagccggctggaggtgatgggcaaccagctgcaggcctgcagcaagaaccagacagaggacagcctgaggaaggagctgattgccctgcaggaggacaagcacaactatgagaccacagccaaggagagcctgcggcgggtgctgcaggagaagattgaggtggtgaggaagctgtctgaggtggagaggagcctgagcaacacagaagatgaatgtacccacctgaaggagatgaatgaaagaacccaggaggagctgcgggagctggccaacaagtacaacggggctgtgaatgagatcaaggacctgagtgacaagctgaaggtggccgagggcaagcaggaggagatccagcagaagggccaggccgagaagaaggagctgcagcacaagattgatgagatggaggagaaggagcaggagctgcaggccaagattgaggccctgcaggccgacaatgacttcaccaatgaaaggctgacagccctgcaggtgcggctggagcacctgcaggagaagaccctgaaggaatgtagcagcctggagcacctgctgagcaagagcggcggggactgcaccttcatccaccagttcatcgagtgccagaagaagctgattgtggagggccacctgaccaaggctgtggaggagaccaagctgagcaaagaaaaccagacccgggccaaggagagtgacttcagtgacaccctgagccccagcaaggagaagagcagtgatgacaccacagatgcccagatggatgagcaggacctgaatgagcccctggccaaggtgtccctgctgaaggatgacctgcagggcgcccagagcgagattgaggccaagcaggagatccagcacctgaggaaggagctgattgaggcccaggagctggcccggaccagcaagcagaagtgctttgagctgcaggccctgctggaggaggagaggaaggcctacagaaaccaggtggaggagagcaccaagcagatccaggtgctgcaggcccagctgcagaggctgcacatcgacacagagaacctgcgggaggagaaggacagcgagatcaccagcaccagagatgagctgctgagcgccagagatgagatcctgctgctgcaccaggccgccgccaaggtggccagcgagcgggacacagacatcgccagcctgcaggaggagctgaagaaggtgcgggcagagctggagcgctggaggaaggccgcctctgaatatgagaaggagatcaccagcctgcagaacagcttccagctgcgctgccagcagtgtgaggaccagcagcgggaggaggccacccggctgcagggcgagctggagaagctgaggaaggagtggaatgccctggagacagagtgccacagcctgaagagagaaaatgtgctgctgagcagcgagctgcagaggcaggagaaggagctgcacaacagccagaagcagagcctggagctgaccagtgacctgagcatcctgcagatgagcaggaaggagctggagaaccaggtgggcagcctgaaggagcagcacctgcgggacagcgctgacctgaagaccctgctgagcaaggccgagaaccaggccaaggatgtgcagaaggagtatgagaagacccagacagtgctgtctgagctgaagctgaagtttgagatgacagagcaggagaagcagagcatcacagatgagctgaagcagtgcaagaacaacctgaagctgctgcgggagaagggcaacaacaagccctggccctggatgcccatgctggccgccctggtggccgtgacagccatcgtgctgtatgtgcccggcctggcccgggccagcccctag

SEQ ID NO: 37738 - DNA, 951 bp, Artificial Sequence
  Description of Artificial Sequence: Synthetic coding sequence
tgaggccacctgaccaaggctgtggaggagaccaagctgagcaaggagaaccagacccgggccaaggagagtgacttcagtgacaccctgagccccagcaaggagaagagcagtgatgacaccacagatgcccagatggatgagcaggacctgaatgagcccctggccaaggtgtccctgctgaaggccctgctggaggaggagaggaaggcctacagaaaccaggtggaggagagcaccaagcagatccaggtgctgcaggcccagctgcagaggctgcacatcgacacagagaacctgcgggaggagaaggacagcgagatcaccagcaccagagatgagctgctgagcgccagagatgagatcctgctgctgcaccaggccgccgccaaggtggccagcgagcgggacacagacatcgccagcctgcaggaggagctgaagaaggtgcgggcagagctggagcgctggaggaaggccgcctctgaatatgagaaggagatcaccagcctgcagaacagcttccagctgcgctgccagcagtgtgaggaccagcagcgggaggaggccacccggctgcagggcgagctggagaagctgaggaaggagtggaatgccctggagacagagtgccacagcctgaagagagaaaatgtgctgctgagcagcgagctgcagaggcaggagaaggagctgcacaacagccagaagcagagcctggagctgaccagtgacctgagcatcctgcagatgagcaggaaggagctggagaaccaggtgggcagcctgaaggagcagcacctgcgggacagcgctgacctgaagaccctgctgagcaaggccgagaaccaggccaaggatgtgcagaaggaggtgaagaggaaggacatcatgagccccatcatggtgggcctgaaggccaagagcaagagtgacatccacgccagctag

SEQ ID NO: 37739 - DNA, 891 bp, Artificial Sequence
  Description of Artificial Sequence: Synthetic coding sequence
atggatgagcaggacctgaatgagcccctggccaaggtgtccctgctgaaggcccagctgcagaggctgcacatcgacacagagaacctgcgggaggagaaggacagcgagatcaccagcaccagagatgagctgctgagcgccagagatgagatcctgctgctgcaccaggccgccgccaaggtggccagcgagcgggacacagacatcgccagcctgcaggaggagctgaagaaggtgcgggcagagctggagcgctggaggaaggccgcctctgaatatgagaaggagatcaccagcctgcagaacagcttccagctgcgctgccagcagtgtgaggaccagcagcgggaggaggccacccggctgcagggcgagctggagaagctgaggaaggagtggaatgccctggagacagagtgccacagcctgaagagagaaaatgtgctgctgagcagcgagctgcagaggcaggagaaggagctgcacaacagccagaagcagagcctggagctgaccagtgacctgagcatcctgcagatgagcaggaaggagctggagaaccaggtgggcagcctgaaggagcagcacctgcgggacagcgctgacctgaagaccctgctgagcaaggccgagaaccaggccaaggatgtgcagaaggagtatgagaagacccagacagtgctgtctgagctgaagctgaagtttgagatgacagagcaggagaagcagagcatcacagatgagctgaagcagtgcaagaacaacctgaagctgctgcgggagaagggcaacaacaagccctggccctggatgcccatgctggccgccctggtggccgtgacagccatcgtgctgtatgtgcccggcctggcccgggccagcccctag

SEQ ID NO: 37740 - DNA, 2373 bp, Artificial Sequence
  Description of Artificial Sequence: Synthetic coding sequence
atgcccagcgccctggccatcttcacctgccggcccaacagccaccccttccaggagagacatgtgtacctggatgagcccatcaagattggccgctctgtggcccgctgcaggcctgcccagaacaatgccacctttgactgcaaggtgctgagcagaaatcatgccctggtgtggtttgaccacaagacaggcaagttctacctgcaggacaccaagagcagcaatggcaccttcatcaacagccagaggctgagccggggcagcgaggagagccccccctgtgagatcctgagcggggacatcatccagtttggagtggatgtgacagagaacaccaggaaggtgacccacggctgcatcgtgtccaccatcaagctgttcctgcctgatggcatggaggcccggctgcggagtgatgtgattcatgcccccctgcccagccctgtggacaaggtggccgccaacacccccagcatgtacagccaggagctgttccagctgagccagtacctgcaggaggccctgcaccgggagcagatgctggagcagaagctggccaccctgcagaggctgctggccatcacccaggaggccagtgacacctcctggcaggccctgattgatgaggaccggctgctgagccggctggaggtgatgggcaaccagctgcaggcctgcagcaagaaccagacagaggacagcctgaggaaggagctgattgccctgcaggaggacaagcacaactatgagaccacagccaaggagagcctgcggcgggtgctgcaggagaagattgaggtggtgaggaagctgtctgaggtggagaggagcctgagcaacacagaagatgaatgtacccacctgaaggagatgaatgaaagaacccaggaggagctgcgggagctggccaacaagtacaacggggctgtgaatgagatcaaggacctgagtgacaagctgaaggtggccgagggcaagcaggaggagatccagcagaagggccaggccgagaagaaggagctgcagcacaagattgatgagatggaggagaaggagcaggagctgcaggccaagattgaggccctgcaggccgacaatgacttcaccaatgaaaggctgacagccctgcaggagaagctgattgtggagggccacctgaccaaggctgtggaggagaccaagctgagcaaagaaaaccagacccgggccaaggagagtgacttcagtgacaccctgagccccagcaaggagaagagcagtgatgacaccacagatgcccagatggatgagcaggacctgaatgagcccctggccaaggtgtccctgctgaaggatgacctgcagggcgcccagagcgagattgaggccaagcaggagatccagcacctgaggaaggagctgattgaggcccaggagctggcccggaccagcaagcagaagtgctttgagctgcaggccctgctggaggaggagaggaaggcctacagaaaccaggtggaggagagcaccaagcagatccaggtgctgcaggcccagctgcagaggctgcacatcgacacagagaacctgcgggaggagaaggacagcgagatcaccagcaccagagatgagctgctgagcgccagagatgagatcctgctgctgcaccaggccgccgccaaggtggccagcgagcgggacacagacatcgccagcctgcaggaggagctgaagaaggtgcgggcagagctggagcgctggaggaaggccgcctctgaatatgagaaggagatcaccagcctgcagaacagcttccagctgcgctgccagcagtgtgaggaccagcagcgggaggaggccacccggctgcagggcgagctggagaagctgaggaaggagtggaatgccctggagacagagtgccacagcctgaagagagaaaatgtgctgctgagcagcgagctgcagaggcaggagaaggagctgcacaacagccagaagcagagcctggagctgaccagtgacctgagcatcctgcagatgagcaggaaggagctggagaaccaggtgggcagcctgaaggagcagcacctgcgggacagcgctgacctgaagaccctgctgagcaaggccgagaaccaggccaaggatgtgcagaaggagtatgagaagacccagacagtgctgtctgagctgaagctgaagtttgagatgacagagcaggagaagcagagcatcacagatgagctgaagcagtgcaagaacaacctgaagctgctgcgggagaagggcaacaacaagccctggccctggatgcccatgctggccgccctggtggccgtgacagccatcgtgctgtatgtgcccggcctggcccgggccagcccctag

SEQ ID NO: 37741 - DNA, 957 bp, Artificial Sequence
  Description of Artificial Sequence: Synthetic coding sequence
atggatgagcaggacctgaatgagcccctggccaaggtgtccctgctgaaggccctgctggaggaggagaggaaggcctacagaaaccaggtggaggagagcaccaagcagatccaggtgctgcaggcccagctgcagaggctgcacatcgacacagagaacctgcgggaggagaaggacagcgagatcaccagcaccagagatgagctgctgagcgccagagatgagatcctgctgctgcaccaggccgccgccaaggtggccagcgagcgggacacagacatcgccagcctgcaggaggagctgaagaaggtgcgggcagagctggagcgctggaggaaggccgcctctgaatatgagaaggagatcaccagcctgcagaacagcttccagctgcgctgccagcagtgtgaggaccagcagcgggaggaggccacccggctgcagggcgagctggagaagctgaggaaggagtggaatgccctggagacagagtgccacagcctgaagcgggagaatgtgctgctgagcagcgagctgcagaggcaggagaaggagctgcacaacagccagaagcagagcctggagctgaccagtgacctgagcatcctgcagatgagcaggaaggagctggagaaccaggtgggcagcctgaaggagcagcacctgcgggacagcgctgacctgaagaccctgctgagcaaggccgagaaccaggccaaggatgtgcagaaggagtatgagaagacccagacagtgctgtctgagctgaagctgaagtttgagatgacagagcaggagaagcagagcatcacagatgagctgaagcagtgcaagaacaacctgaagctgctgcgggagaagggcaacaaccccagcatcctgcagcctgtgcctgctgtgttcatcggcctcttcctggccttcctgttctggtgcttcggccccctgtggtag

SEQ ID NO: 37742 - DNA, 1089 bp, Artificial Sequence
  Description of Artificial Sequence: Synthetic coding sequence
atggatgagcaggacctgaatgagcccctggccaaggtgtccctgctgaaggatgacctgcagggcgcccagagcgagattgaggccaagcaggagatccagcacctgaggaaggagctgattgaggcccaggagctggcccggaccagcaagcagaagtgctttgagctgcaggccctgctggaggaggagaggaaggcctacagaaaccaggtggaggagagcaccaagcagatccaggtgctgcaggcccagctgcagaggctgcacatcgacacagagaacctgcgggaggagaaggacagcgagatcaccagcaccagagatgagctgctgagcgccagagatgagatcctgctgctgcaccaggccgccgccaaggtggccagcgagcgggacacagacatcgccagcctgcaggaggagctgaagaaggtgcgggcagagctggagcgctggaggaaggccgcctctgaatatgagaaggagatcaccagcctgcagaacagcttccagctgcgctgccagcagtgtgaggaccagcagcgggaggaggccacccggctgcagggcgagctggagaagctgaggaaggagtggaatgccctggagacagagtgccacagcctgaagagagaaaatgtgctgctgagcagcgagctgcagaggcaggagaaggagctgcacaacagccagaagcagagcctggagctgaccagtgacctgagcatcctgcagatgagcaggaaggagctggagaaccaggtgggcagcctgaaggagcagcacctgcgggacagcgctgacctgaagaccctgctgagcaaggccgagaaccaggccaaggatgtgcagaaggagtatgagaagacccagacagtgctgtctgagctgaagctgaagtttgagatgacagagcaggagaagcagagcatcacagatgagctgaagcagtgcaagaacaacctgaagctgctgcgggagaagggcaacaacaagccctggccctggatgcccatgctggccgccctggtggccgtgacagccatcgtgctgtatgtgcccggcctggcccgggccagcccctag

SEQ ID NO: 37743 - DNA, 1356 bp, Artificial Sequence
  Description of Artificial Sequence: Synthetic coding sequence
atggaggagaaggagcaggagctgcaggccaagattgaggccctgcaggccgacaatgacttcaccaatgaaaggctgacagccctgcaggagaaccagacccgggccaaggagagtgacttcagtgacaccctgagccccagcaaggagaagagcagtgatgacaccacagatgcccagatggatgagcaggacctgaatgagcccctggccaaggtgtccctgctgaaggatgacctgcagggcgcccagagcgagattgaggccaagcaggagatccagcacctgaggaaggagctgattgaggcccaggagctggcccggaccagcaagcagaagtgctttgagctgcaggccctgctggaggaggagaggaaggcctacagaaaccaggtggaggagagcaccaagcagatccaggtgctgcaggcccagctgcagaggctgcacatcgacacagagaacctgcgggaggagaaggacagcgagatcaccagcaccagagatgagctgctgagcgccagagatgagatcctgctgctgcaccaggccgccgccaaggtggccagcgagcgggacacagacatcgccagcctgcaggaggagctgaagaaggtgcgggcagagctggagcgctggaggaaggccgcctctgaatatgagaaggagatcaccagcctgcagaacagcttccagctgcgctgccagcagtgtgaggaccagcagcgggaggaggccacccggctgcagggcgagctggagaagctgaggaaggagtggaatgccctggagacagagtgccacagcctgaagagagaaaatgtgctgctgagcagcgagctgcagaggcaggagaaggagctgcacaacagccagaagcagagcctggagctgaccagtgacctgagcatcctgcagatgagcaggaaggagctggagaaccaggtgggcagcctgaaggagcagcacctgcgggacagcgctgacctgaagaccctgctgagcaaggccgagaaccaggccaaggatgtgcagaaggagtatgagaagacccagacagtgctgtctgagctgaagctgaagtttgagatgacagagcaggagaagcagagcatcacagatgagctgaagcagtgcaagaacaacctgaagctgctgcgggagaagggcaacaaccccagcatcctgcagcctgtgccccgcatccaccggcccatccctggcttccctgtgctggtgttccgcagcatcgtggtggagcagaagccctggccctggatgcccatgctggccgccctggtggccgtgacagccatcgtgctgtatgtgcccggcctggcccgggccagcccctag

SEQ ID NO: 37744 - DNA, 2427 bp, Artificial Sequence
  Description of Artificial Sequence: Synthetic coding sequence
atggccggcaccgtggtgctggatgatgtggagctgcgggaggcccagagggactacctggacttcctggatgatgaggaggaccagggcatctaccagagcaaggtgcgggagctgatcagtgacaaccagtaccgcctcatcgtgaatgtgaatgacctgcggaggaagaatgagaagagggccaaccggctgctgaacaatgcctttgaggagctggtggccttccagagggccctgaaggactttgtggccagcattgatgccacctacgccaagcagtatgaggagttctacgtgggcctggagggcagctttggcagcaagcacgtgagccccaggaccctgaccagctgcttcctgagctgtgtggtgtgtgtggagggcatcgtgaccaagtgcagcctggtgcggcccaaggtggtgcgctctgtgcactactgcccagccaccaagaagaccattgaaagacgctacagcgacctgaccaccctggtggccttccccagcagctctgtgtaccccaccaaggatgaggagaacaaccccctggagacagaatatggcctgtctgtgtacaaggaccaccagaccatcaccatccaggagatgcctgagaaggccccagctggccagctgcccaggtctgtggatgtgatcctggatgatgacctggtggacaaggccaagccaggggacagagtgcaggtggtgggcacctaccgctgcctgcccgggaagaagggcggctacaccagcggcaccttcagaacagtgctgattgcctgcaatgtgaagcagatgagcaaggatgcccagcccagcttcagcgcagaagatattgccaagatcaagaagttcagcaagaccaggagcaaggacatctttgaccagctggccaagagcctggcccccagcatccacggccatgactatgtgaagaaggccatcctgtgcctgctgctgggcggcgtggagcgggacctggagaatggcagccacatccggggggacatcaacatcctgctgattggagaccccagcgtggccaagagccagctgctgcgctacgtgctgtgcacagccccccgggccatccccaccaccggccggggcagcagcggcgtgggcctgacagctgctgtgaccacagaccaggagaccggggagcggcggctggaggccggggccatggtgctggccgaccggggcgtggtgtgcattgatgaatttgacaagatgtctgacatggacagaacagccatccacgaggtgatggagcagggccgggtgaccatcgccaaggccggcatccacgcccggctgaatgcccgctgcagcgtgctggccgccgccaaccctgtgtatggccgctatgaccagtacaagacccccatggagaacatcggcctgcaggacagcctgctgagcagatttgacctgctcttcatcatgctggaccagatggaccctgagcaggaccgggagatcagtgaccacgtgctgaggatgcaccgctaccgggcccctggagagcaggatggagatgccatgcccctgggcagcgctgtggacatcctggccacagatgaccccaacttcagccaggaggaccagcaggacacccagatctatgagaagcatgacaacctgctgcacggcaccaagaagaagaaggagaagatggtgtctgctgccttcatgaagaagtacatccacgtggccaagatcatcaagcctgtgctgacccaggagagcgccacctacatcgccgaggagtacagccggctgcggagccaggacagcatgagcagtgacacagcccggaccagccctgtgacagcccggaccctggagaccctcatccggctggccacagcccacgccaaggccaggatgagcaagacagtggacctgcaggatgctgaggaggccgtggagctggtgcagtatgcctacttcaagaaggtgctggagaaggagaagaagaggaagaagagaagtgaagatgagagcgagacagaagatgaggaggagaagagccaggaggaccaggagcagaagaggaagaggaggaagacccggcagccagatgccaaggatggagacagctatgacccctatgacttcagtgacacagaggaggagatgccccaggtgcacacccccaagacagctgacagccaggagaccaaggagagccagaaggtggagctgtctgagagccggctgaaggccttcaaggtggccctgctggatgtgttccgggaggcccacgcccagagcatcggcatgaaccggctgacagagagcatcaacagagacagcgaggagcccttcagctctgtggagatccaggccgccctgagcaagatgcaggatgacaaccaggtgatggtgtctgagggcatcatcttcctgatctag

SEQ ID NO: 37745 - DNA, 351 bp, Artificial Sequence
  Description of Artificial Sequence: Synthetic coding sequence
atgctggaggccgcccagccccagggcagcaccagcgagaccccctggaacacagccatccccctgcccagctgctgggaccagagcttcctgaccaacatcaccttcctgaaggtgctgctgtggctggtgctgctgggcctgtttgtggagctggagtttggcctggcctactttgtgctgagcctcttctactggatgtatgtgggcacccggggccctgaggagaagaaggagggggagaagagcgcctacagcgtcttcaaccctggctgtgaggccatccagggcaccctgacagctgagcagctggagcgggagctgcagctgcggcccctggccggccgctag

SEQ ID NO: 37746 - DNA, 1074 bp, Artificial Sequence
  Description of Artificial Sequence: Synthetic coding sequence
atggagaacaaggccatgtacctgcacacagtgtctgactgtgacaccagcagcatctgtgaagattcttttgatggccgcagcctgagcaagctgaacctgtgtgaagatgtgtcccggcccaggagcagcccagatgacctgaaggccctgaccagaaatgtgaaccggctgaatgaaagcttccgggacctgcagctgcggctgctgcaggcccccctgcaggccgacctgacagagcaggtgtggaaggtgcaggatgccctgcagaaccagagcgacagcctgctggccctggccggggctgtgcagaggctggagggcgccctgtggggcctgcaggcccaggccgtgcagacagagcaggccgtggccctgctgcgggacagaacaggccagcagagcgacacagcccagctggagctgtaccagctgcaggtggagagcaacagcagccagctgctgctgcggagacatgctggcctgctggatggcctggcccggcgggtgggcatcctgggggaggagctggctgatgtgggcggcgtgctgcggggcctgaaccacagcctgtcctatgatgtggccctgcacaggacccggctgcaggacctgcgggtgctggtgtccaatgccagcgaggacacccggcggctgcggctggcccacgtgggcatggagctgcagctgaagcaggagctggccatgctgaatgctgtgacagaggacctgcggctgaaggactgggagcacagcatcgccctgaggaacatcagcctggccaagggccccccaggccccaagggggaccagggagatgagggcaaggagggccggcccggcatccctggcctgcccggcctgcggggcctgcccggggagcggggcaccccaggcctgcccggccccaagggagatgatggcaagctgggcgccaccggccccatgggcatgaggggcttcaagggggaccggggccccaagggggagaagggggagaagggggacagagctggagatgccagcaaggacatcctgctgggcccctgggacatggtgctggcccagggctag

SEQ ID NO: 37747 - DNA, 1488 bp, Artificial Sequence
  Description of Artificial Sequence: Synthetic coding sequence
atggagaacaaggccatgtacctgcacacagtgtctgactgtgacaccagcagcatctgtgaagattcttttgatggccgcagcctgagcaagctgaacctgtgtgaagatggcccctgccacaagagaagagccagcatctgctgcacccagctgggcagcctgagcgccctgaagcatgctgtgctgggcctgtacctgctggtgttcctgatcctggtgggcatcttcatcctggccgtgtcccggcccaggagcagcccagatgacctgaaggccctgaccagaaatgtgaaccggctgaatgaaagcttccgggacctgcagctgcggctgctgcaggcccccctgcaggccgacctgacagagcaggtgtggaaggtgcaggatgccctgcagaaccagagcgacagcctgctggccctggccggggctgtgcagaggctggagggcgccctgtggggcctgcaggcccaggccgtgcagacagagcaggccgtggccctgctgcgggacagaacaggccagcagagcgacacagcccagctggagctgtaccagctgcaggtggagagcaacagcagccagctgctgctgcggagacatgctggcctgctggatggcctggccaggagagtgggcatcctgggggaggagctggctgatgtgggcggcgtgctgcggggcctgaaccacagcctgtcctatgatgtggccctgcacaggacccggctgcaggacctgcgggtgctggtgtccaatgccagcgaggacacccggcggctgcggctggcccacgtgggcatggagctgcagctgaagcaggagctggccatgctgaatgctgtgacagaggacctgcggctgaaggactgggagcacagcatcgccctgaggaacatcagcctggccaagggccccccaggccccaagggggaccagggagatgagggcaaggagggccggcccggcatccctggcctgcccggcctgcggggcctgcctggagagcggggcaccccaggcctgcccggccccaagggagatgatggcaagctgggcgccaccggccccatgggcatgaggggcttcaagggggaccggggccccaagggggagaagggggagaagggggacagagctggagatgccagcggcgtggaggcccccatgatgatccggctggtgaatggaagtggcccccatgagggccgggtggaggtgtaccatgaccggcgctggggcaccgtgtgtgatgatggctgggacaagaaggatggagatgtggtgtgcaggatgctgggcttccggggcgtggaggaggtgtacagaacagcccgcttcggccagggcaccggccgcatctggatggatgatgtggcctgcaagggcacagaggagaccatcttccgctgcagcttcagcaagtggggcgtgaccaactgtggccatgctgaagatgcctctgtgacctgcaacagacactag

SEQ ID NO: 37748 - DNA, 813 bp, Artificial Sequence
  Description of Artificial Sequence: Synthetic coding sequence
atggagaacaaggccatgtacctgcacacagtgtctgactgtgacaccagcagcatctgtgaagattcttttgatggccgcagcctgagcaagctgaacctgtgtgaagatggcccctgccacaagagaagagccagcatctgctgcacccagctgggcagcctgagcgccctgaagcatgctgtgctgggcctgtacctgctggtgttcctgatcctggtgggcatcttcatcctggccggccccccaggccccaagggggaccagggagatgagggcaaggagggccggcccggcatccctggcctgcccggcctgcggggcctgcccggggagcggggcaccccaggcctgcccggccccaagggagatgatggcaagctgggcgccaccggccccatgggcatgaggggcttcaagggggaccggggccccaagggggagaagggggagaagggggacagagctggagatgccagcggcgtggaggcccccatgatgatccggctggtgaatggcagcggcccccatgagggccgggtggaggtgtaccatgaccggcgctggggcaccgtgtgtgatgatggctgggacaagaaggatggagatgtggtgtgcaggatgctgggcttccggggcgtggaggaggtgtacagaacagccaggtttggccagggcaccggccgcatctggatggatgatgtggcctgcaagggcacagaggagaccatcttccgctgcagcttcagcaagtggggcgtgaccaactgtggccacgcagaagatgcctctgtgacctgcaacagacactag

SEQ ID NO: 37749 - DNA, 1074 bp, Artificial Sequence; identical to SEQ ID NO: 37746
  Description of Artificial Sequence: Synthetic coding sequence

SEQ ID NO: 37750 - DNA, 1203 bp, Artificial Sequence
  Description of Artificial Sequence: Synthetic coding sequence
atggagaacaaggccatgtacctgcacacagtgtctgactgtgacaccagcagcatctgtgaagattcttttgatggccgcagcctgagcaagctgaacctgtgtgaagatggcccctgccacaagagaagagccagcatctgctgcacccagctgggcagcctgagcgccctgaagcatgctgtgctgggcctgtacctgctggtgttcctgatcctggtgggcatcttcatcctggccgtgtcccggcccaggagcagcccagatgacctgaaggccctgaccagaaatgtgaaccggctgaatgaaagcttccgggacctgcagctgcggctgctgcaggcccccctgcaggccgacctgacagagcaggtgtggaaggtgcaggatgccctgcagaaccagagcgacagcctgctggccctggccggggctgtgcagaggctggagggcgccctgtggggcctgcaggcccaggccgtgcagacagagcaggccgtggccctgctgcgggacagaacaggccagcagagcgacacagcccagctggagctgtaccagctgcaggtggagagcaacagcagccagctgctgctgcggagacatgctggcctgctggatggcctggccaggagagtgggcatcctgggggaggagctggctgatgtgggcggcgtgctgcggggcctgaaccacagcctgtcctatgatgtggccctgcacaggacccggctgcaggacctgcgggtgctggtgtccaatgccagcgaggacacccggcggctgcggctggcccacgtgggcatggagctgcagctgaagcaggagctggccatgctgaatgctgtgacagaggacctgcggctgaaggactgggagcacagcatcgccctgaggaacatcagcctggccaagggccccccaggccccaagggggaccagggagatgagggcaaggagggccggcccggcatccctggcctgcccggcctgcggggcctgcctggagagcggggcaccccaggcctgcccggccccaagggagatgatggcaagctgggcgccaccggccccatgggcatgaggggcttcaagggggaccggggccccaagggggagaagggggagaagggggacagagctggagatgccagcaaggacatcctgctgggcccctgggacatggtgctggcccagggctag

SEQ ID NO: 37751 - DNA, 1002 bp, Artificial Sequence
  Description of Artificial Sequence: Synthetic coding sequence
atggtgcacggcaacatcaccccagagaacatcatcctgaacaagagcggggcctggaagatcatgggctttgacttctgtgtgagcagcaccaaccccagcgagcaggagcccaagttcccctgcaaggagtgggaccccaacctgcccagcctgtgcctgcccaaccctgagtacctggcccctgagtacatcctgtctgtgtcctgtgaaacagccagtgacatgtacagcctgggcaccgtgatgtatgctgtgttcaacaagggcaagcccatctttgaggtgaacaagcaggacatctacaagagcttcagccggcagctggaccagctgagccggctgggcagcagcagcctgaccaacatccctgaggaggtgcgggagcacgtgaagctgctgctgaatgtgacccccaccgtgcggccagatgctgaccagatgaccaagatccccttctttgatgatgtgggcgctgtgaccctgcagtactttgacaccctcttccagagggacaacctgcagaagagccagttcttcaagggcctgcccaaggtgctgcccaagctgcccaagagggtgattgtgcagaggatcctgccctgcctgaccagcgagtttgtgaacccagacatggtgccctttgtgctgcccaacgtgctgctgattgctgaggagtgcaccaaggaggagtatgtgaagctgatcctgcctgagctgggccctgtgttcaagcagcaggagcccatccagatcctgctgatcttcctgcagaagatggacctgctgctgaccaagaccccaccagatgagatcaagaacagcgtgctgcccatggtgtaccgggccctggaggcccccagcatccagatccaggagctgtgcctgaacatcatccccacctttgccaacctgattgactaccccagcatgaagaatgccctgatcccccgcatcaagaatgcctgctacaagcacctgcccctgcgcttccagcagtag

SEQ ID NO: 37752 - DNA, 2790 bp, Artificial Sequence
  Description of Artificial Sequence: Synthetic coding sequence
atggagagcatgctgaacaagctgaagagcacagtgaccaaggtgacagcagatgtgaccagcgctgtgatgggcaaccctgtgacccgggagtttgatgtgggccgccacatcgccagcggcggcaatggcctggcctggaagatcttcaacggcaccaagaagagcaccaagcaggaggtggccgtgtttgtgtttgacaagaagctgattgacaagtaccagaagtttgagaaggaccagatcatcgacagcctgaagaggggcgtgcagcagctgacccggctgcggcacccccggctgctgactgtgcagcaccccctggaggagagccgggactgcctggccttctgcacagagcctgtgtttgccagcctggccaacgtgctgggcaactgggagaacctgcccagccccatcagcccagacatcaaggactacaagctgtatgatgtggagaccaagtatggcctgctgcaggtgtctgagggcctgtccttcctgcacagctctgtgaagatggtgcacggcaacatcaccccagagaacatcatcctgaacaagagcggggcctggaagatcatgggctttgacttctgtgtgagcagcaccaaccccagcgagcaggagcccaagttcccctgcaaggagtgggaccccaacctgcccagcctgtgcctgcccaaccctgagtacctggcccctgagtacatcctgtctgtgtcctgtgaaacagccagtgacatgtacagcctgggcaccgtgatgtatgctgtgttcaacaagggcaagcccatctttgaggtgaacaagcaggacatctacaagagcttcagccggcagctggaccagctgagccggctgggcagcagcagcctgaccaacatccctgaggaggtgcgggagcacgtgaagctgctgctgaatgtgacccccaccgtgcggccagatgctgaccagatgaccaagatccccttctttgatgatgtgggcgctgtgaccctgcagtactttgacaccctcttccagagggacaacctgcagaagagccagttcttcaagggcctgcccaaggtgctgcccaagctgcccaagagggtcatcgtgcagaggatcctgccctgcctgaccagcgagtttgtgaacccagacatggtgccctttgtgctgcccaacgtgctgctgattgctgaagaatgtaccaaggaggagtatgtgaagctgatcctgcctgagctgggccctgtgttcaagcagcaggagcccatccagatcctgctgatcttcctgcagaagatggacctgctgctgaccaagaccccaccagatgagatcaagaacagcgtgctgcccatggtgtaccgggccctggaggcccccagcatccagatccaggagctgtgcctgaacatcatccccacctttgccaacctgattgactaccccagcatgaagaatgccctgatcccccgcatcaagaatgcctgcctgcagaccagcagcctggccgtgcgggtgaacagcctggtgtgcctgggcaagatcctggagtacctggacaagtggtttgtgctggatgacatcctgcccttcctgcagcagatccccagcaaggagcctgctgtgctgatgggcatcctgggcatctacaagtgcaccttcacccacaagaagctgggcatcaccaaggagcagctggccggcaaggtgctgccccacctgatccccctgagcattgagaacaacctgaacctgaaccagttcaacagcttcatcagcgtcatcaaggagatgctgaaccggctggagagcgagcacaagaccaagctggagcagctgcacatcatgcaggagcagcagaagagcctggacatcggcaaccagatgaatgtgtctgaggagatgaaggtgaccaacatcggcaaccagcagattgacaaggtgttcaacaacatcggggctgacctgctgaccggcagcgagagcgagaacaaggaggatggcctgcagaacaagcacaagagggccagcctgaccctggaggagaagcagaagctggccaaggagcaggagcaggcccagaagctgaagagccagcagcccctgaagccccaggtgcacacccctgtggccaccgtgaagcagaccaaggacctgacagacaccctgatggacaacatgagcagcctgaccagcctgtctgtgtccacccccaagagcagcgccagcagcaccttcacctctgtgcccagcatgggcatcggcatgatgttcagcacccccacagacaacaccaagaggaacctgaccaacggcctgaatgccaacatgggcttccagaccagcggcttcaacatgcctgtgaacaccaaccagaacttctacagcagccccagcacagtgggcgtgaccaagatgaccctgggcaccccacccaccctgcccaacttcaatgccctgtctgtgcccccagctggggccaagcagacccagcagaggcccacagacatgtctgccctgaacaacctgtttggcccccagaagcccaaggtgtccatgaaccagctgagccagcagaagcccaaccagtggctgaaccagtttgtgcccccccagggcagccccaccatgggcagctctgtgatgggcacccagatgaatgtgattggccagagcgccttcggcatgcagggcaaccccttcttcaacccccagaactttgcccagccccccaccaccatgaccaacagcagcagcgccagcaatgacctgaaggacctgtttggatag

SEQ ID NO: 37753 - DNA, 2046 bp, Artificial Sequence
  Description of Artificial Sequence: Synthetic coding sequence
atggagagcatgctgaacaagctgaagagcacagtgaccaaggtgacagcagatgtgaccagcgctgtgatgggcaaccctgtgacccgggagtttgatgtgggccgccacatcgccagcggcggcaatggcctggcctggaagatcttcaacggcaccaagaagagcaccaagcaggaggtggccgtgtttgtgtttgacaagaagctgattgacaagtaccagaagtttgagaaggaccagatcatcgacagcctgaagaggggcgtgcagcagctgacccggctgcggcacccccggctgctgactgtgcagcaccccctggaggagagccgggactgcctggccttctgcacagagcctgtgtttgccagcctggccaacgtgctgggcaactgggagaacctgcccagccccatcagcccagacatcaaggactacaagctgtatgatgtggagaccaagtatggcctgctgcaggtgtctgagggcctgtccttcctgcacagctctgtgaagatggtgcacggcaacatcaccccagagaacatcatcctgaacaagagcggggcctggaagatcatgggctttgacttctgtgtgagcagcaccaaccccagcgagcaggagcccaagttcccctgcaaggagtgggaccccaacctgcccagcctgtgcctgcccaaccctgagtacctggcccctgagtacatcctgtctgtgtcctgtgaaacagccagtgacatgtacagcctgggcaccgtgatgtatgctgtgttcaacaagggcaagcccatctttgaggtgaacaagcaggacatctacaagagcttcagccggcagctggaccagctgagccggctgggcagcagcagcctgaccaacatccctgaggaggtgcgggagcacgtgaagctgctgctgaatgtgacccccaccgtgcggccagatgctgaccagatgaccaagatccccttctttgatgatgtgggcgctgtgaccctgcagtactttgacaccctcttccagagggacaacctgcagaagagccagttcttcaagggcctgcccaaggtgctgcccaagctgcccaagagggtcatcgtgcagaggatcctgccctgcctgaccagcgagtttgtgaacccagacatggtgccctttgtgctgcccaacgtgctgctgattgctgaagaatgtaccaaggaggagtatgtgaagctgatcctgcctgagctgggccctgtgttcaagcagcaggagcccatccagatcctgctgatcttcctgcagaagatggacctgctgctgaccaagaccccaccagatgagatcaagaacagcgtgctgcccatggtgtaccgggccctggaggcccccagcatccagatccaggagctgtgcctgaacatcatccccacctttgccaacctgattgactaccccagcatgaagaatgccctgatcccccgcatcaagaatgcctgcctgcagaccagcagcctggccgtgcgggtgaacagcctggtgtgcctgggcaagatcctggagtacctggacaagtggtttgtgctggatgacatcctgcccttcctgcagcagatccccagcaaggagcctgctgtgctgatgggcatcctgggcatctacaagtgcaccttcacccacaagaagctgggcatcaccaaggagcagctggccggcaaggtgctgccccacctgatccccctgagcattgagaacaacctgaacctgaaccagttcaacagcttcatcagcgtcatcaaggagatgctgaaccggctggagagcgagcacaagaccaagctggagcagctgcacatcatgcaggagcagcagaagagcctggacatcggcaaccagatgaatgtgtctgaggagatgaaggtgaccaacatcggcaaccagcagattgacaaggtgttcaacaacatcggggctgacctgctgaccggcagcgagagcgagaacaaggaggatggcctgcagaacaagcacaagagggccagcctgaccctggagtag

SEQ ID NO: 37754 - DNA, 1653 bp, Artificial Sequence
  Description of Artificial Sequence: Synthetic coding sequence
atgcccacagaagaaaatattgacaggatgtgccaggacctgaggaaccagctgtatgagagctactacctgaacttcatcagcgccatcagccgcagcaagctggaggacatcgccaatgctgccctggccgccagcgctgtgacccaggtggccaaggtgtttgaccagtacctgaacttcatcaccctggaggatgacatgtttgtgctgtgcaaccagaacaaggagctggtgtcctaccgggccatcaacagaccagacatcacagacacagagatggagaccgtgatggacaccatcgtggacagcctcttctgcttctttgtgaccctgggcgctgtgcccatcatccgctgcagccggggcacagctgctgagatggtggccgtgaagctggacaagaagctgcgggagaacctgagagatgccaggaacagcctcttcaccggggacaccctgggcgccggccagttctccttccagaggcccctgctggtgctggtggacagaaatattgacctggccacccccctgcaccacacctggacctaccaggccctggtgcatgatgtgctggacttccacctgaacagagtgaacctggaggagagcagcggcgtggagaacagccctgctggggcccggcccaagaggaagaacaagaagagctatgacctgacccctgtggacaagttctggcagaagcacaagggcagccccttccctgaggtggccgagagcgtgcagcaggagctggagagctaccgggcccaggaggatgaggtgaagaggctgaagagcatcatgggcctggagggagaagatgagggcgccatctccatgctgagtgacaacacagccaagctgaccagcgctgtgagcagcctgcctgagctgctggagaagaagaggctgattgacctgcacaccaacgtggccacagctgtgctggagcacatcaaggccaggaagctggatgtgtactttgaatatgaggagaagatcatgagcaagaccaccctggacaagagcctgctggacatcatcagtgaccctgatgctggcaccccagaggacaagatgaggctcttcctgatctactacatcagcacccagcaggcccccagcgaggccgacctggagcagtacaagaaggccctgacagatgctggctgcaacctgaaccccctgcagtacatcaagcagtggaaggccttcaccaagatggccagcgccccagccagctatggcagcaccaccaccaagcccatgggcctgctgagccgggtgatgaacacaggcagccagtttgtgatggagggcgtgaagaacctggtgctgaagcagcagaacctgcctgtgacccgcatcctggacaacctgatggagatgaagagcaaccctgagacagatgactaccgctactttgaccccaagatgctgcggggaaatgacagctctgtgcccaggaacaagaaccccttccaggaggccatcgtgtttgtggtgggcggcggcaactacatcgagtaccagaacctggtggactacatcaagggcaagcagggcaagcacatcctgtatggctgcagcgagctgttcaatgccacccagttcatcaagcagctgagccagctgggccagaagtag

SEQ ID NO: 37755 - DNA, 1752 bp, Artificial Sequence
  Description of Artificial Sequence: Synthetic coding sequence
atgtgcctgatcctgaagacagcccaggagaaccagtatggccgcctgctgcacagcgaccgggaccccatcccagatgtgcctgctgtgtactttgtgatgcccacagaggagaacatcgacaggatgtgccaggacctgaggaaccagctgtatgagagctactacctgaacttcatcagcgccatcagccgcagcaagctggaggacatcgccaatgctgccctggccgccagcgctgtgacccaggtggccaaggtgtttgaccagtacctgaacttcatcaccctggaggatgacatgtttgtgctgtgcaaccagaacaaggagctggtgtcctaccgggccatcaacagaccagacatcacagacacagagatggagaccgtgatggacaccatcgtggacagcctcttctgcttctttgtgaccctgggcgctgtgcccatcatccgctgcagccggggcacagctgctgagatggtggccgtgaagctggacaagaagctgcgggagaacctgagagatgccaggaacagcctcttcaccggggacaccctgggcgccggccagttctccttccagaggcccctgctggtgctggtggacaggaacatcgacctggccacccccctgcaccacacctggacctaccaggccctggtgcatgatgtgctggacttccacctgaacagagtgaacctggaggagagcagtggagtggagaacagccctgctggggcccggcccaagaggaagaacaagaagagctatgacctgacccctgtggacaagttctggcagaagcacaagggcagccccttccctgaggtggccgagagcgtgcagcaggagctggagagctaccgggcccaggaggatgaggtgaagaggctgaagagcatcatgggcctggagggggaggatgaaggagccatctccatgctgagtgacaacacagccaagctgaccagcgctgtgagcagcctgcctgagctgctggagaagaagaggctgattgacctgcacaccaacgtggccacagctgtgctggagcacatcaaggccaggaagctggatgtgtactttgaatatgaggagaagatcatgagcaagaccaccctggacaagagcctgctggacatcatcagtgaccctgatgctggcaccccagaggacaagatgaggctcttcctgatctactacatcagcacccagcaggcccccagcgaggccgacctggagcagtacaagaaggccctgacagatgctggctgcaacctgaaccccctgcagtacatcaagcagtggaaggccttcaccaagatggccagcgccccagccagctatggcagcaccaccaccaagcccatgggcctgctgagccgggtgatgaacacaggcagccagtttgtgatggagggcgtgaagaacctggtgctgaagcagcagaacctgcctgtgacccgcatcctggacaacctgatggagatgaagagcaaccctgagacagatgactaccgctactttgaccccaagatgctgcggggaaatgacagctctgtgcccaggaacaagaaccccttccaggaggccatcgtgtttgtggtgggcggcggcaactacatcgagtaccagaacctggtggactacatcaagggcaagcagggcaagcacatcctgtatggctgcagcgagctgttcaatgccacccagttcatcaagcagctgagccagctgggccagaagtag

SEQ ID NO: 37756 - DNA, 1929 bp, Artificial Sequence
  Description of Artificial Sequence: Synthetic coding sequence
atggctgctgctgctgctgccacagctgctgctgctgccagcatccgggagcggcagacagtggccctgaagaggatgctgaacttcaacgtgccccacatcaagaacagcactggagagcctgtgtggaaggtgctgatctatgacagatttggccaggacatcatcagccccctgctgtctgtgaaggagctgcgggacatgggcatcaccctgcacctgctgctgcacagcgaccgggaccccatcccagatgtgcctgctgtgtactttgtgatgcccacagaagaaaatattgacaggatgtgccaggacctgaggaaccagctgtatgagagctactacctgaacttcatcagcgccatcagccgcagcaagctggaggacatcgccaatgctgccctggccgccagcgctgtgacccaggtggccaaggtgtttgaccagtacctgaacttcatcaccctggaggatgacatgtttgtgctgtgcaaccagaacaaggagctggtgtcctaccgggccatcaacagaccagacatcacagacacagagatggagaccgtgatggacaccatcgtggacagcctcttctgcttctttgtgaccctgggcgctgtgcccatcatccgctgcagccggggcacagctgctgagatggtggccgtgaagctggacaagaagctgcgggagaacctgagagatgccaggaacagcctcttcaccggggacaccctgggcgccggccagttctccttccagaggcccctgctggtgctggtggacagaaatattgacctggccacccccctgcaccacacctggacctaccaggccctggtgcatgatgtgctggacttccacctgaacagagtgaacctggaggagagcagcggcgtggagaacagccctgctggggcccggcccaagaggaagaacaagaagagctatgacctgacccctgtggacaagttctggcagaagcacaagggcagccccttccctgaggtggccgagagcgtgcagcaggagctggagagctaccgggcccaggaggatgaggtgaagaggctgaagagcatcatgggcctggagggagaagatgagggcgccatctccatgctgagtgacaacacagccaagctgaccagcgctgtgagcagcctgcctgagctgctggagaagaagaggctgattgacctgcacaccaacgtggccacagctgtgctggagcacatcaaggccaggaagctggatgtgtactttgaatatgaggagaagatcatgagcaagaccaccctggacaagagcctgctggacatcatcagtgaccctgatgctggcaccccagaggacaagatgaggctcttcctgatctactacatcagcacccagcaggcccccagcgaggccgacctggagcagtacaagaaggccctgacagatgctggctgcaacctgaaccccctgcagtacatcaagcagtggaaggccttcaccaagatggccagcgccccagccagctatggcagcaccaccaccaagcccatgggcctgctgagccgggtgatgaacacaggcagccagtttgtgatggagggcgtgaagaacctggtgctgaagcagcagaacctgcctgtgacccgcatcctggacaacctgatggagatgaagagcaaccctgagacagatgactaccgctactttgaccccaagatgctgcggggaaatgacagctctgtgcccaggaacaagaaccccttccaggaggccatcgtgtttgtggtgggcggcggcaactacatcgagtaccagaacctggtggactacatcaagggcaagcagggcaagcacatcctgtatggctgcagcgagctgttcaatgccacccagttcatcaagcagctgagccagctgggccagaagtag

SEQ ID NO: 37757 - DNA, 1374 bp, Artificial Sequence
  Description of Artificial Sequence: Synthetic coding sequence
atggagaccgtgatggacaccatcgtggacagcctcttctgcttctttgtgaccctgggcgctgtgcccatcatccgctgcagccggggcacagctgctgagatggtggccgtgaagctggacaagaagctgcgggagaacctgagagatgccaggaacagcctcttcaccggggacaccctgggcgccggccagttctccttccagaggcccctgctggtgctggtggacaggaacatcgacctggccacccccctgcaccacacctggacctaccaggccctggtgcatgatgtgctggacttccacctgaacagagtgaacctggaggagagcagtggagtggagaacagccctgctggggcccggcccaagaggaagaacaagaagagctatgacctgacccctgtggacaagttctggcagaagcacaagggcagccccttccctgaggtggccgagagcgtgcagcaggagctggagagctaccgggcccaggaggatgaggtgaagaggctgaagagcatcatgggcctggagggggaggatgaaggagccatctccatgctgagtgacaacacagccaagctgaccagcgctgtgagcagcctgcctgagctgctggagaagaagaggctgattgacctgcacaccaacgtggccacagctgtgctggagcacatcaaggccaggaagctggatgtgtactttgaatatgaggagaagatcatgagcaagaccaccctggacaagagcctgctggacatcatcagtgaccctgatgctggcaccccagaggacaagatgaggctcttcctgatctactacatcagcacccagcaggcccccagcgaggccgacctggagcagtacaagaaggccctgacagatgctggctgcaacctgaaccccctgcagtacatcaagcagtggaaggccttcaccaagatggccagcgccccagccagctatggcagcaccaccaccaagcccatgggcctgctgagccgggtgatgaacacaggcagccagtttgtgatggagggcgtgaagaacctggtgctgaagcagcagaacctgcctgtgacccgcatcctggacaacctgatggagatgaagagcaaccctgagacagatgactaccgctactttgaccccaagatgctgcggggaaatgacagctctgtgcccaggaacaagaaccccttccaggaggccatcgtgtttgtggtgggcggcggcaactacatcgagtaccagaacctggtggactacatcaagggcaagcagggcaagcacatcctgtatggctgcagcgagctgttcaatgccacccagttcatcaagcagctgagccagctgggccagaagtag

SEQ ID NO: 37758 - DNA, 1728 bp, Artificial Sequence
  Description of Artificial Sequence: Synthetic coding sequence
atgggcatcaccctgcacctgctgctgcacagcgaccgggaccccatcccagatgtgcctgctgtgtactttgtgatgcccacagaggagaacatcgacaggatgtgccaggacctgaggaaccagctgtatgagagctactacctgaacttcatcagcgccatcagccgcagcaagctggaggacatcgccaatgctgccctggccgccagcgctgtgacccaggtggccaaggtgtttgaccagtacctgaacttcatcaccctggaggatgacatgtttgtgctgtgcaaccagaacaaggagctggtgtcctaccgggccatcaacagaccagacatcacagacacagagatggagaccgtgatggacaccatcgtggacagcctcttctgcttctttgtgaccctgggcgctgtgcccatcatccgctgcagccggggcacagctgctgagatggtggccgtgaagctggacaagaagctgcgggagaacctgagagatgccaggaacagcctcttcaccggggacaccctgggcgccggccagttctccttccagaggcccctgctggtgctggtggacaggaacatcgacctggccacccccctgcaccacacctggacctaccaggccctggtgcatgatgtgctggacttccacctgaacagagtgaacctggaggagagcagtggagtggagaacagccctgctggggcccggcccaagaggaagaacaagaagagctatgacctgacccctgtggacaagttctggcagaagcacaagggcagccccttccctgaggtggccgagagcgtgcagcaggagctggagagctaccgggcccaggaggatgaggtgaagaggctgaagagcatcatgggcctggagggggaggatgaaggagccatctccatgctgagtgacaacacagccaagctgaccagcgctgtgagcagcctgcctgagctgctggagaagaagaggctgattgacctgcacaccaacgtggccacagctgtgctggagcacatcaaggccaggaagctggatgtgtactttgaatatgaggagaagatcatgagcaagaccaccctggacaagagcctgctggacatcatcagtgaccctgatgctggcaccccagaggacaagatgaggctcttcctgatctactacatcagcacccagcaggcccccagcgaggccgacctggagcagtacaagaaggccctgacagatgctggctgcaacctgaaccccctgcagtacatcaagcagtggaaggccttcaccaagatggccagcgccccagccagctatggcagcaccaccaccaagcccatgggcctgctgagccgggtgatgaacacaggcagccagtttgtgatggagggcgtgaagaacctggtgctgaagcagcagaacctgcctgtgacccgcatcctggacaacctgatggagatgaagagcaaccctgagacagatgactaccgctactttgaccccaagatgctgcggggaaatgacagctctgtgcccaggaacaagaaccccttccaggaggccatcgtgtttgtggtgggcggcggcaactacatcgagtaccagaacctggtggactacatcaagggcaagcagggcaagcacatcctgtatggctgcagcgagctgttcaatgccacccagttcatcaagcagctgagccagctgggccagaagtag

SEQ ID NO: 37759 - DNA, 540 bp, Artificial Sequence
  Description of Artificial Sequence: Synthetic coding sequence
atgctgagcctggacttcctggatgatgtgcggaggatgaacaagaggcagctgtactaccaggtgctgaactttggcatgattgtgtcctctgccctgatgatctggaagggcctgatggtgatcactggaagtgagagccccatcgtggtggtgctgagcggctccatggagcccgccttccacagaggagacctgctcttcctgaccaacagagtggaggaccccatccgggtgggggagatcgtggtgttcagaattgagggccgggagatccccatcgtgcaccgggtgctgaagatccacgagaagcagaatggccacatcaagttcctgaccaagggggacaacaatgctgtggatgaccggggcctgtacaagcagggccagcactggctggagaagaaggatgtggtgggccgggcccggggctttgtgccctacatcggcatcgtgaccatcctgatgaatgactaccccaagttcaagtatgctgtgctcttcctgctgggcctgtttgtgctggtgcaccgggagtag

SEQ ID NO: 37760 - DNA, 462 bp, Artificial Sequence
  Description of Artificial Sequence: Synthetic coding sequence
atgattgtgtcctctgccctgatgatctggaagggcctgatggtgatcactggaagtgagagccccatcgtggtggtgctgagcggctccatggagcccgccttccacagaggagacctgctcttcctgaccaacagagtggaggaccccatccgggtgggggagatcgtggtgttcagaattgagggccgggagatccccatcgtgcaccgggtgctgaagatccacgagaagcagaatggccacatcaagttcctgaccaagggggacaacaatgctgtggatgaccggggcctgtacaagcagggccagcactggctggagaagaaggatgtggtgggccgggcccggggctttgtgccctacatcggcatcgtgaccatcctgatgaatgactaccccaagttcaagtatgctgtgctcttcctgctgggcctgtttgtgctggtgcaccgggagtag

SEQ ID NO: 37761 - DNA, 579 bp, Artificial Sequence
  Description of Artificial Sequence: Synthetic coding sequence
atggtgcgggccggggctgtgggcgcccacctgcctgccagcggcctggacatctttggagacctgaagaagatgaacaagaggcagctgtactaccaggtgctgaactttgccatgattgtgtcctctgccctgatgatctggaagggcctcatcgtgctgactggaagtgagagccccatcgtggtggtgctgagcggctccatggagcccgccttccacagaggagacctgctcttcctgaccaacttccgggaggaccccatccgggccggggagatcgtggtgttcaaggtggagggccgggacatccccatcgtgcacagggtcatcaaggtgcatgagaaggacaacggggacatcaagttcctgaccaagggggacaacaatgaggtggatgaccggggcctgtacaaggagggccagaactggctggagaagaaggatgtggtgggccgggcccggggcttcctgccctacgtgggcatggtgaccatcatcatgaatgactaccccaagttcaagtatgccctgctggccgtgatgggcgcctacgtgctgctgaagcgggagagctag

SEQ ID NO: 37762 - DNA, 471 bp, Artificial Sequence
  Description of Artificial Sequence: Synthetic coding sequence
atggtgcgggccggggctgtgggcgcccacctgcctgccagcggcctggacatctttggagacctgaagaagatgaacaagaggcagctgtactaccaggtgctgaactttgccatgattgtgtcctctgccctgatgatctggaagggcctcatcgtgctgactggaagtgagagccccatcgtggtggtgctgagcggctccatggagcccgccttccacagaggagacctgctcttcctgaccaacttccgggaggaccccatccgggccggggagatcgtggtgttcaaggtggagggccgggacatccccatcgtgcacagggtcatcaaggtgcatgagaaggacaacggggacatcaagttcctgaccaagggggacaacaatgaggtggatgaccggggcctgtacaaggagggccagaactggctggagaagaaggatgtggtgggccgggcccggggctag

SEQ ID NO: 37763 - DNA, 579 bp, Artificial Sequence; identical to SEQ ID NO: 37761
  Description of Artificial Sequence: Synthetic coding sequence

SEQ ID NO: 37764 - DNA, 2091 bp, Artificial Sequence
  Description of Artificial Sequence: Synthetic coding sequence
atggaggccagcgtcatcctgcccatcctgaagaagaagctggccttcctgagcggcggcaaggacagaagaagtggcctcatcctgaccatccccctgtgcctggagcagaccaacatggatgagctgtctgtgaccctggactacctgctgagcatccccagcgagaagtgcaaggcccggggcttcaccgtcatcgtggatggcaggaagagccagtggaatgtggtgaagacagtggtggtgatgctgcagaatgtggtgcctgctgaggtgtccctggtgtgtgtggtgaagccagatgagttctgggacaagaaggtgacccacttctgcttctggaaggagaaggaccggctgggctttgaggtgatcctggtgtctgccaacaagctgacccgctacatcgagccctgccagctgacagaagattttggaggcagcctgacctatgaccacatggactggctgaacaagaggctggtgtttgagaagttcaccaaggagagcaccagcctgctggatgagctggccctgatcaacaacggcagtgacaagggcaaccagcaggagaaggagaggtctgtggacctgaacttcctgcccagcgtggaccctgagaccgtgctgcagacaggccacgagctgctgtctgagctgcagcagaggcgcttcaacggcagtgatggaggagtgtcctggagccccatggatgatgagctgctggcccagccccaggtgatgaagctgctggacagcctgcgggagcagtacacccgctaccaggaggtgtgccggcagaggagcaagaggacccagctggaggagatccagcagaaggtgatgcaggtggtgaactggctggagggccctggcagcgagcagctgcgggcccagtggggcatcggggacagcatccgggccagccaggccctgcagcagaagcatgaggagattgagagccagcacagcgagtggtttgctgtgtatgtggagctgaaccagcagattgctgccctgctgaatgctggagatgaggaggacctggtggagctgaagagcctgcagcagcagctgagtgatgtgtgctaccggcaggccagccagctggagttccggcagaacctgctgcaggccgccctggagttccacggcgtggcccaggacctgagccagcagctggatggcctgctgggcatgctgtgtgtggatgtggccccagcagatggagccagcatccagcagaccctgaagctgctggaggagaagctgaagtctgtggatgtgggcctgcagggcctgcgggagaagggccagggcctgctggaccagatcagcaaccaggcctcctgggcctacggcaaggatgtgaccatcgagaacaaggaaaatgtggaccacatccagggcgtgatggaggacatgcagctgaggaagcagagatgtgaggacatggtggatgtgcggcggctgaagatgctgcagatggtgcagctgttcaagtgtgaggaggatgctgcccaggccgtggagtggctgtctgagctgctggatgccctgctgaagacccacatccggctgggagatgatgcccaggagaccaaggtgctgctggagaagcacaggaagtttgtggatgtggcccagagcacctatgactatggccggcagctgctgcaggccaccgtggtgctgtgccagagcctgcgctgcaccagccgcagcagcggggacaccctgccccggctgaacagagtgtggaagcagttcaccatcgccagcgaggagcgggtgcaccggctggagatggccatcgccttccacagcaatgctgagaagatcctgcaggactgcccagaggagcctgaggccatcaatgatgaggagcagtttgatgaaattgaggccgtgggcaagagcctgctggaccggctgactgtgcctgtggtgtacccagatggaacagagcagtacttcggcagccccagcgacatggccagcacagctgagaacatccgggacaggatgaagctggtgaacctgaagaggcagcagctgcggcaccctgagatggtgaccacagagagctag

SEQ ID NO: 37765 - DNA, 432 bp, Artificial Sequence
  Description of Artificial Sequence: Synthetic coding sequence
atggaggccagcgtcatcctgcccatcctgaagaagaagctggccttcctgagcggcggcaaggacagaagaagtggcctcatcctgaccatccccctgtgcctggagcagaccaacatggatgagctgtctgtgaccctggactacctgctgagcatccccagcgagaagtgcaaggcccggggcttcaccgtcatcgtggatggcaggaagagccagtggaatgtggtgaagacagtggtggtgatgctgcagaatgtggtgcctgctgaggtgtccctggtgtgtgtggtgaagccagatgagttctgggacaagaaggtgacccacttctgcttctggaaggagaaggaccggctgggctttgaggtgatcctggtgtctgccaacaagctgacccgctacatcgagccctgccagctgacagaatag

SEQ ID NO: 37766 - DNA, 441 bp, Artificial Sequence
  Description of Artificial Sequence: Synthetic coding sequence
atggaggccagcgtcatcctgcccatcctgaagaagaagctggccttcctgagcggcggcaaggacagaagaagtggcctcatcctgaccatccccctgtgcctggagcagaccaacatggatgagctgtctgtgaccctggactacctgctgagcatccccagcgagaagtgcaaggcccggggcttcaccgtcatcgtggatggcaggaagagccagtggaatgtggtgaagacagtggtggtgatgctgcagaatgtggtgcctgctgaggtgtccctggtgtgtgtggtgaagccagatgagttctgggacaagaaggtgacccacttctgcttctggaaggagaaggaccggctgggctttgaggtgatcctggtgtctgccaacaagctgacccgctacatcgagccctgccagctgacagaagattttggatag

SEQ ID NO: 37767 - DNA, 2160 bp, Artificial Sequence
  Description of Artificial Sequence: Synthetic coding sequence
atggtgcagaagtaccagagccctgtgcgggtgtacaagtacccctttgagctgatcatggccgcctatgaaagacgcttccccacctgccccctcatccccatgtttgtgggcagtgacacagtgaatgagttcaagtcagaagatggagccatccacgtgattgaaagacgctgcaagctggatgtggatgccccccggctgctgaagaagattgctggggtggactatgtgtactttgtgcagaagaacagcctgaacagccgggagaggaccctgcacatcgaggcctacaatgagaccttcagcaacagagtcatcatcaatgagcactgctgctacacagtgcacccagaaaatgaagactggacctgctttgagcagagcgccagcctggacatcaagagcttcttcggctttgagagcacagtggagaagatcgccatgaagcagtacaccagcaacatcaagaagggcaaggagatcatcgagtactacctgcggcagctggaggaggagggcatcacctttgtgccccgctggagccccccatccatcaccaccagcagcgagaccagcagcagcagcagcaagaagcaggccgcctccatggctgtggtgattcctgaggccgccctgaaggagggcctgtctggagatgccctgagcagccccagcgcccctgagcctgtggtgggcaccccagatgacaagctggatgctgactacatcaagcgctacctgggggacctgacccccctgcaggagagctgcctgatccggctgcggcagtggctgcaggagacccacaagggcaagatccccaaggatgagcacatcctgcgcttcctgcgggcccgggacttcaacatcgacaaggcccgggagatcatgtgccagagcctgacctggaggaagcagcaccaggtggactacatcctggagacctggaccccaccccaggtgctgcaggactactatgctgggggctggcaccaccacgacaaggatggccggcccctgtatgtgctgcggctgggccagatggacaccaagggcctggtgcgggccctgggggaggaggccctgctgcgctacgtgctgagcatcaatgaggagggcctgcggcgctgtgaggagaacaccaaggtgtttggccggcccatcagctcctggacctgcctggtggacctggagggcctgaacatgaggcacctgtggaggcctggggtgaaggccctgctgcgcatcatcgaggtggtggaggccaactacccagagaccctgggccgcctgctgatcctgcgggcccccagggtcttccctgtgctgtggaccctggtgagccccttcattgatgacaacaccaggaggaagttcctgatctatgctggaaatgactaccagggccctgggggcctgctggactacatcgacaaggagatcatcccagacttcctgagcggggagtgcatgtgtgaggtgcctgagggcggcctggtgcccaagagcctgtacagaacagctgaggagctggagaatgaagacctgaagctgtggacagagaccatctaccagagcgcctctgtgttcaagggggcccctcatgagatcctgatccagatcgtggatgccagcagcgtcatcacctgggactttgatgtgtgcaagggggacatcgtgttcaacatctaccacagcaagaggagcccccagccccccaagaaggacagcctgggcgcccacagcatcaccagccctgggggcaacaacgtgcagctgattgacaaggtgtggcagctgggccgggactacagcatggtggagagccccctcatctgcaaggagggggagagcgtgcagggcagccacgtgacccgctggccaggcttctacatcctgcagtggaagttccacagcatgcctgcctgtgccgccagcagcctgccccgggtggatgatgtgctggccagcctgcaggtgagcagccacaagtgcaaggtgatgtactacacagaggtgattggcagcgaggacttccggggctccatgaccagcctggagagcagccacagcggcttcagccagctgtctgctgccaccaccagcagcagccagagccacagcagctccatgatcagccgctggaggttctgctag

SEQ ID NO: 37768 - DNA, 2148 bp, Artificial Sequence
  Description of Artificial Sequence: Synthetic coding sequence
atggtgcagaagtaccagagccctgtgcgggtgtacaagtacccctttgagctgatcatggccgcctatgaaagacgcttccccacctgccccctcatccccatgtttgtgggcagtgacacagtgaatgagttcaagtcagaagatggagccatccacgtgattgaaagacgctgcaagctggatgtggatgccccccggctgctgaagaagattgctggggtggactatgtgtactttgtgcagaagaacagcctgaacagccgggagaggaccctgcacatcgaggcctacaatgagaccttcagcaacagagtcatcatcaatgagcactgctgctacacagtgcacccagaaaatgaagactggacctgctttgagcagagcgccagcctggacatcaagagcttcttcggctttgagagcacagtggagaagatcgccatgaagcagtacaccagcaacatcaagaagggcaaggagatcatcgagtactacctgcggcagctggaggaggagggcatcacctttgtgccccgctggagccccccatccatcaccaccagcagcgagaccagcagcagcagcagcaagaagcaggccgcctccatggctgtggtgattcctgaggccgccctgaaggagggcctgtctggagatgccctgagcagccccagcgcccctgagcctgtggtgggcaccccagatgacaagctggatgctgactacatcaagcgctacctgggggacctgacccccctgcaggagagctgcctgatccggctgcggcagtggctgcaggagacccacaagggcaagatccccaaggatgagcacatcctgcgcttcctgcgggcccgggacttcaacatcgacaaggcccgggagatcatgtgccagagcctgacctggaggaagcagcaccaggtggactacatcctggagacctggaccccaccccaggtgctgcaggactactatgctgggggctggcaccaccacgacaaggatggccggcccctgtatgtgctgcggctgggccagatggacaccaagggcctggtgcgggccctgggggaggaggccctgctgcgctacgtgctgagcatcaatgaggagggcctgcggcgctgtgaggagaacaccaaggtgtttggccggcccatcagctcctggacctgcctggtggacctggagggcctgaacatgaggcacctgtggaggcctggggtgaaggccctgctgcgcatcatcgaggtggtggaggccaactacccagagaccctgggccgcctgctgatcctgcgggcccccagggtcttccctgtgctgtggaccctggtgagccccttcattgatgacaacaccaggaggaagttcctgatctatgctggaaatgactaccagggccctgggggcctgctggactacatcgacaaggagatcatcccagacttcctgagcggggagtgcatgtgtgaggtgcctgagggcggcctggtgcccaagagcctgtacagaacagctgaggagctggagaatgaagacctgaagctgtggacagagaccatctaccagagcgcctctgtgttcaagggggcccctcatgagatcctgatccagatcgtggatgccagcagcgtcatcacctgggactttgatgtgtgcaagggggacatcgtgttcaacatctaccacagcaagaggagcccccagccccccaagaaggacagcctgggcgcccacagcatcaccagccctgggggcaacaacgtgcagctgattgacaaggtgtggcagctgggccgggactacagcatggtggagagccccctcatctgcaaggagggggagagcgtgcagggcagccacgtgacccgctggccaggcttctacatcctgcagtggaagttccacagcatgcctgcctgtgccgccagcagcctgccccgggtggatgatgtgctggccagcctgcaggtgagcagccacaagtgcaaggtgatgtactacacagaggtgattggcagcgaggacttccggggctccatgaccagcctggagagcagccacagcggcttcagccagctgtctgctgccaccaccagcagcagccagagccacagcagctccatgatcagcaggtag

SEQ ID NO: 37769 - DNA, 2148 bp, Artificial Sequence; identical to SEQ ID NO: 37768
  Description of Artificial Sequence: Synthetic coding sequence

SEQ ID NO: 37770 - DNA, 2046 bp, Artificial Sequence
  Description of Artificial Sequence: Synthetic coding sequence
atgtttgtgggcagtgacacagtgaatgagttcaagtcagaagatggagccatccacgtgattgaaagacgctgcaagctggatgtggatgccccccggctgctgaagaagattgctggggtggactatgtgtactttgtgcagaagaacagcctgaacagccgggagaggaccctgcacatcgaggcctacaatgagaccttcagcaacagagtcatcatcaatgagcactgctgctacacagtgcacccagaaaatgaagactggacctgctttgagcagagcgccagcctggacatcaagagcttcttcggctttgagagcacagtggagaagatcgccatgaagcagtacaccagcaacatcaagaagggcaaggagatcatcgagtactacctgcggcagctggaggaggagggcatcacctttgtgccccgctggagccccccatccatcaccaccagcagcgagaccagcagcagcagcagcaagaagcaggccgcctccatggctgtggtgattcctgaggccgccctgaaggagggcctgtctggagatgccctgagcagccccagcgcccctgagcctgtggtgggcaccccagatgacaagctggatgctgactacatcaagcgctacctgggggacctgacccccctgcaggagagctgcctgatccggctgcggcagtggctgcaggagacccacaagggcaagatccccaaggatgagcacatcctgcgcttcctgcgggcccgggacttcaacatcgacaaggcccgggagatcatgtgccagagcctgacctggaggaagcagcaccaggtggactacatcctggagacctggaccccaccccaggtgctgcaggactactatgctgggggctggcaccaccacgacaaggatggccggcccctgtatgtgctgcggctgggccagatggacaccaagggcctggtgcgggccctgggggaggaggccctgctgcgctacgtgctgagcatcaatgaggagggcctgcggcgctgtgaggagaacaccaaggtgtttggccggcccatcagctcctggacctgcctggtggacctggagggcctgaacatgaggcacctgtggaggcctggggtgaaggccctgctgcgcatcatcgaggtggtggaggccaactacccagagaccctgggccgcctgctgatcctgcgggcccccagggtcttccctgtgctgtggaccctggtgagccccttcattgatgacaacaccaggaggaagttcctgatctatgctggaaatgactaccagggccctgggggcctgctggactacatcgacaaggagatcatcccagacttcctgagcggggagtgcatgtgtgaggtgcctgagggcggcctggtgcccaagagcctgtacagaacagctgaggagctggagaatgaagacctgaagctgtggacagagaccatctaccagagcgcctctgtgttcaagggggcccctcatgagatcctgatccagatcgtggatgccagcagcgtcatcacctgggactttgatgtgtgcaagggggacatcgtgttcaacatctaccacagcaagaggagcccccagccccccaagaaggacagcctgggcgcccacagcatcaccagccctgggggcaacaacgtgcagctgattgacaaggtgtggcagctgggccgggactacagcatggtggagagccccctcatctgcaaggagggggagagcgtgcagggcagccacgtgacccgctggccaggcttctacatcctgcagtggaagttccacagcatgcctgcctgtgccgccagcagcctgccccgggtggatgatgtgctggccagcctgcaggtgagcagccacaagtgcaaggtgatgtactacacagaggtgattggcagcgaggacttccggggctccatgaccagcctggagagcagccacagcggcttcagccagctgtctgctgccaccaccagcagcagccagagccacagcagctccatgatcagcaggtag

SEQ ID NO: 37771 - DNA, 2148 bp, Artificial Sequence; identical to SEQ ID NO: 37768
  Description of Artificial Sequence: Synthetic coding sequence

SEQ ID NO: 37772 - DNA, 2160 bp, Artificial Sequence; identical to SEQ ID NO: 37767
  Description of Artificial Sequence: Synthetic coding sequence

SEQ ID NO: 37773 - DNA, 2091 bp, Artificial Sequence
  Description of Artificial Sequence: Synthetic coding sequence
atggtgcagcgctaccagagccctgtgcgggtgtacaagtacccctttgagctggtgatggccgcctatgagaagcgcttccccacctgcccccagatccctgtgttcctgggcagcgaggtgctgcgggagagccgcagcccagatggagctgtgcacgtggtggagaggagctgccgcctgcgggtggatgccccccggctgctgaggaagattgctggggtggagcacgtggtgtttgtgcagaccaacatcctgaactggaaggagaggaccctgctgattgaggcccacaatgagacctttgccaacagagtggtggtgaatgagcactgcagctacacagtgcacccagaaaatgaagactggacctgctttgagcagagcgccagcctggacatccgctccttcttcggctttgaaaatgccctggagaagatcgccatgaagcagtacacagccaacgtgaagaggggcaaggaggtgattgagcactacctgaatgagctgatcagccagggcaccagccacatcccccgctggaccccagcccctgtgcgggaggaggatgccaggaaccaggccggcccccgggaccccagcagcctggaggcccacggccccaggagcaccctgggccctgccctggaggccgtgtccatggatggagacaagctggatgctgactacatcgagcgctgcctgggccacctgacccccatgcaggagagctgcctgatccagctgcggcactggctgcaggagacccacaagggcaagatccccaaggatgagcacatcctgcgcttcctgcgggcccatgacttccacctggacaaggcccgggagatgctgcggcagagcctgtcctggaggaagcagcaccaggtggacctgctgctgcagacctggcagcccccagccctgctggaggagttctacgccggcggctggcactaccaggacattgatggccggcccctgtacatcctgcggctgggccagatggacaccaagggcctgatgaaggctgtgggggaggaggccctgctgcggcacgtgctgtctgtgaatgaggagggccagaagagatgtgagggcagcacccggcagctgggccggcccatcagctcctggacctgcctgctggacctggagggcctgaacatgaggcacctgtggaggcctggggtgaaggccctgctgaggatgattgaggtggtggaggacaactacccagagaccctgggccgcctgctgattgtgcgggcccccagggtcttccctgtgctgtggaccctcatcagccccttcatcaatgaaaacaccaggaggaagttcctgatctacagcggcagcaactaccagggccctgggggcctggtggactacctggaccgggaggtgatcccagacttcctgggcggggagagcgtgtgcaatgtgcctgagggcggcctggtgcccaagagcctgtacatgacagaggaggagcaggagcacacagaccagctgtggcagtggagcgagacctaccacagcgcctctgtgctgcggggggcccctcatgaggtggccgtggagatcctggagggggagagcgtcatcacctgggactttgacatcctgcggggagatgtggtgttcagcctgtaccacaccaagcaggccccccggctgggcgcccgggagcccggcacccgggccagcggccagctgattgacaagggctgggtgctgggccgggactacagccgggtggaggcccccctggtgtgccgggagggggagagcatccagggcagccacgtgacccgctggccaggagtgtacctgctgcagtggcagatgcacagcccccccagctctgtggcctgcagcctgcccggggtggatgatgtgctgacagccctgcacagccctggccccaagtgcaagctgctgtactactgtgaggtgctggccagcgaggacttccggggctccatgagcagcctggagagctgcaccagcggcttcagccagctgtctgctgccaccagcagcagcagcagcggccagagccacagcagcagcctggtgtccaggtag

SEQ ID NO: 37774 - DNA, 912 bp, Artificial Sequence
  Description of Artificial Sequence: Synthetic coding sequence
atgtctgtcatcttctttgcctgtgtggtgcgggtgagagatggcctgcccctgagcgccagcacagacttctaccacacccaggacttcctggagtggaggcggcggctgaagagcctggccctgcggctggcccagtacccaggccggggcagcgctgagggctgtgacttcagcatccacttcagcagctttggagatgtggcctgcatggccatctgcagctgccagtgcccagctgccatggccttctgcttcctggagaccctgtggtgggagttcaccgccagctatgacaccacctgcatcggcctggccagccggccctatgccttcctggagtttgacagcatcatccagaaggtgaagtggcacttcaactacgtgagcagcagccagatggagtgcagcctggagaagatccaggaggagctgaagctgcagcccccagctgtgctgaccctggaggacacagatgtggccaacggggtgatgaatggccacacccccatgcacctggagcccgcccccaacttcaggatggagcctgtgacagccctgggcatcctgagcctcatcctgaacatcatgtgtgccgccctgaacctgatccggggcgtgcacctggccgagcacagcctgcaggtggcccacgaggagatcggcaacatcctggccttcctggtgccctttgtggcctgcatcttccagtgctacctgtacctgttctacagccctgcccggaccatgaaggtggtgctgatgctgctcttcatctgcctgggcaacatgtacctgcacggcctgaggaacctgtggcagatcctcttccacatcggcgtggccttcctgagcagctaccagatcctgacccggcagctgcaggagaagcagagcgactgtggggtgtag

SEQ ID NO: 37775 - DNA, 753 bp, Artificial Sequence
  Description of Artificial Sequence: Synthetic coding sequence
atgtctgtcatcttctttgcctgtgtggtgcgggtgagagatggcctgcccctgagcgccagcacagacttctaccacacccaggacttcctggagtggaggcggcggctgaagagcctggccctgcggctggcccagtacccaggccggggcagcgctgagggctgtgacttcagcatccacttcagcagctttggagatgtggcctgcatggccatctgcagctgccagtgcccagctgccatggccttctgcttcctggagaccctgtggtgggagttcaccgccagctatgacaccacctgcatcggcctggccagccggccctatgccttcctggagtttgacagcatcatccagaaggtgaagtggcacttcaactacgtgagcagcagccagatggagtgcagcctggagaagatccaggaggagctgaagctgcagcccccagctgtgctgaccctggaggacacagatgtggccaacggggtgatgaatggccacacccccatgcacctggagcccgcccccaacttcaggatggagcctgtgacagccctgggcatcctgagcctcatcctgaacatcatgtgtgccgccctgaacctgatccggggcgtgcacctggccgagcacagcctgcaggtggcccacgaggagatcggcaacatcctggccttcctggtgccctttgtggcctgcatcttccaggaccccaggtcctggttctgctggctggaccagaccagctag

SEQ ID NO: 37776 - DNA, 753 bp, Artificial Sequence; identical to SEQ ID NO: 37775
  Description of Artificial Sequence: Synthetic coding sequence

SEQ ID NO: 37777 - DNA, 687 bp, Artificial Sequence
  Description of Artificial Sequence: Synthetic coding sequence
atgtctgtcatcttctttgcctgtgtggtgcgggtgagagatggcctgcccctgagcgccagcacagacttctaccacacccaggacttcctggagtggaggcggcggctgaagagcctggccctgcggctggcccagtacccaggccggggcagcgctgagggctgtgacttcagcatccacttcagcagctttggagatgtggcctgcatggccatctgcagctgccagtgcccagctgccatggccttctgcttcctggagaccctgtggtgggagttcaccgccagctatgacaccacctgcatcggcctggccagccggccctatgccttcctggagtttgacagcatcatccagaaggtgaagtggcacttcaactacgtgagcagcagccagatggagtgcagcctggagaagatccaggaggagctgaagctgcagcccccagctgtgctgaccctggaggacacagatgtggccaacggggtgatgaatggccacacccccatgcacctggagcccgcccccaacttcaggatggagcctgtgacagccctgggcatcctgagcctcatcctgaacatcatgtgtgccgccctgaacctgatccggggcgtgcacctggccgagcacagcctgcaggaccccaggtcctggttctgctggctggaccagaccagctag

SEQ ID NO: 37778 - DNA, 543 bp, Artificial Sequence
  Description of Artificial Sequence: Synthetic coding sequence
atggccatctgcagctgccagtgcccagctgccatggccttctgcttcctggagaccctgtggtgggagttcaccgccagctatgacaccacctgcatcggcctggccagccggccctatgccttcctggagtttgacagcatcatccagaaggtgaagtggcacttcaactacgtgagcagcagccagatggagtgcagcctggagaagatccaggaggagctgaagctgcagcccccagctgtgctgaccctggaggacacagatgtggccaacggggtgatgaatggccacacccccatgcacctggagcccgcccccaacttcaggatggagcctgtgacagccctgggcatcctgagcctcatcctgaacatcatgtgtgccgccctgaacctgatccggggcgtgcacctggccgagcacagcctgcaggtggcccacgaggagatcggcaacatcctggccttcctggtgccctttgtggcctgcatcttccaggaccccaggtcctggttctgctggctggaccagaccagctag

SEQ ID NO: 37779 - DNA, 1842 bp, Artificial Sequence
  Description of Artificial Sequence: Synthetic coding sequence
atgagccagcccggcatcccagccagcggcggggccccagccagcctgcaggcccagaatggagctgccctggccagcggcagcccctacaccaacggccctgtgcagaatgccctgctgagcagccaggagagcgtgtcccagggctacaacttccagctgcccggcagctacccccaccccatcccagccaagaccctgaaccctgtgtctggccagagcaactacggcggcagccagggcagcggccagaccctgaacagacctcctgtggccagcaaccctgtgacccccagcctgcacagcggccctgcccccaggatgcccctgcctgccagccagaacccagccaccacccccatgcccagcagcagcttcctgcctgaggccaacctgcccccacccctgaactggcagtacaactaccccagcacagccagccagaccaaccactgcccccgggccagcagccagcccaccgtgtctggcaacaccagcctgaccaccaaccaccagtatgtgagcagcggctaccccagcctgcagaacagcttcatcaagagcggccccagcgtgccccccctggtgaacccccccctgcccaccaccttccagcccggggccccccacggccccccacctgctgggggccccccacctgtgcgggccctgacccccctgaccagcagctacagagatgtgccccagcccctcttcaacagcgctgtgaaccaggagggcatcaccagcaacaccaacaacggctccatggtggtgcacagcagctatgatgaaattgagggcggcggcctgctggccaccccccagctgaccaacaagaaccccaagatgagccgctctgtgggctacagctaccccagcctgcccccaggctaccagaacaccaccccacctggggccaccggggtgccccccagcagcctgaactaccccagcggcccccaggccttcacccagacccccctgggcgccaaccacctgaccacctccatgagcggcctgagcctgcagcctgagggcctgcgggtggtgaacctgctgcaggagaggaacatgctgcccagcacccccctgaagccccctgtgcccaacctgcacgaggacatccagaagctgaactgcaaccctgagctgttccgctgcaccctgaccagcatcccccagacccaggccctgctgaacaaggccaagctgcccctgggcctgctgctgcaccccttcaaggacctggtgcagctgcctgtggtgaccagcagcaccatcgtgcgctgccgcagctgcaggacctacatcaacccctttgtgtccttcctggaccagaggcgctggaagtgcaacctgtgctacagagtgaatgatgtgcctgaggagttcctgtacaaccccctgaccagggtgtatggagagccccacagaagacctgaggtgcagaatgccaccatcgagttcatggcccccagcgagtacatgctgcggcccccccagccccctgtgtacctgtttgtgtttgatgtgagccacaatgctgtggagaccggctacctgaacagcgtgtgccagagcctgctggacaacctggacctgctgcccggcaacaccaggaccaagattggcttcatcacctttgacagcaccatccacttctacggcctgcaggagagcctgagccagccccagatgctgattgtgtctgacattgaagatgtgttcatccccatgcctgagaacctgctggtgaacctgaatgaaagcaaggagagcgtcatcggcgtgagcagcgaggagaccctcatcacctgcctggagatcgccatgaggtag

SEQ ID NO: 37780 - DNA, 3282 bp, Artificial Sequence
  Description of Artificial Sequence: Synthetic coding sequence
atgagccagcccggcatcccagccagcggcggggccccagccagcctgcaggcccagaatggagctgccctggccagcggcagcccctacaccaacggccctgtgcagaatgccctgctgagcagccaggagagcgtgtcccagggctacaacttccagctgcccggcagctacccccaccccatcccagccaagaccctgaaccctgtgtctggccagagcaactacggcggcagccagggcagcggccagaccctgaacagacctcctgtggccagcaaccctgtgacccccagcctgcacagcggccctgcccccaggatgcccctgcctgccagccagaacccagccaccacccccatgcccagcagcagcttcctgcctgaggccaacctgcccccacccctgaactggcagtacaactaccccagcacagccagccagaccaaccactgcccccgggccagcagccagcccaccgtgtctggcaacaccagcctgaccaccaaccaccagtatgtgagcagcggctaccccagcctgcagaacagcttcatcaagagcggccccagcgtgccccccctggtgaacccccccctgcccaccaccttccagcccggggccccccacggccccccacctgctgggggccccccacctgtgcgggccctgacccccctgaccagcagctacagagatgtgccccagcccctcttcaacagcgctgtgaaccaggagggcatcaccagcaacaccaacaacggctccatggtggtgcacagcagctatgatgaaattgagggcggcggcctgctggccaccccccagctgaccaacaagaaccccaagatgagccgctctgtgggctacagctaccccagcctgcccccaggctaccagaacaccaccccacctggggccaccggggtgccccccagcagcctgaactaccccagcggcccccaggccttcacccagacccccctgggcgccaaccacctgaccacctccatgagcggcctgagcctgcagcctgagggcctgcgggtggtgaacctgctgcaggagaggaacatgctgcccagcacccccctgaagccccctgtgcccaacctgcacgaggacatccagaagctgaactgcaaccctgagctgttccgctgcaccctgaccagcatcccccagacccaggccctgctgaacaaggccaagctgcccctgggcctgctgctgcaccccttcaaggacctggtgcagctgcctgtggtgaccagcagcaccatcgtgcgctgccgcagctgcaggacctacatcaacccctttgtgtccttcctggaccagaggcgctggaagtgcaacctgtgctacagagtgaatgatgtgcctgaggagttcctgtacaaccccctgaccagggtgtatggagagccccacagaagacctgaggtgcagaatgccaccatcgagttcatggcccccagcgagtacatgctgcggcccccccagccccctgtgtacctgtttgtgtttgatgtgagccacaatgctgtggagaccggctacctgaacagcgtgtgccagagcctgctggacaacctggacctgctgcccggcaacaccaggaccaagattggcttcatcacctttgacagcaccatccacttctacggcctgcaggagagcctgagccagccccagatgctgattgtgtctgacattgaagatgtgttcatccccatgcctgagaacctgctggtgaacctgaatgaaagcaaggagctggtgcaggacctgctgaagaccctgccccagatgttcaccaagaccctggagacccagagcgccctgggccctgccctgcaggccgccttcaagctgatgagccccaccggcggccgcatgtctgtgttccagacccagctgcccaccctgggcgtgggcgccctgaagccccgggaggagcccaaccacaggagcagcgccaaggacatccacatgacccccagcacagacttctacaagaagctggccctggactgcagcggccagcaggtggccgtggacctcttcctgctgagcggccagtacagcgacctggccagcctgggctgcatcagccgctacagcgctggctctgtgtactactaccccagctaccaccaccagcacaaccctgtgcaggtgcagaagctgcagaaggagctgcagcgctacctgaccaggaagattggatttgaagctgtgatgaggatccgctgcaccaagggcctgagcatccacaccttccacggcaacttctttgtgcgcagcacagacctgctgagcctgcccaacgtgaacccagatgctggctatgctgtgcagatgtctgtggaggagagcctgacagacacccagctggtgtccttccagagcgccctgctgtacaccagcagcaaaggagagcggcgcatccgggtgcacaccctgtgcctgcctgtggtgtccaccctgaatgatgtgttcctgggcgcagatgtgcaggccatcagcggcctgctggccaacatggctgtggaccgctccatgacagccagcctgagtgatgccagagatgccctggtgaatgctgtgattgacagcctgagcgcctaccgcagctctgtgctgagcaaccagcagcccggcctgatggtgcccttcagcctgcggctcttccccctgtttgtgctggccctgctgaagcagaagagcttccagacaggcaccaatgcccggctggatgagcgcatctttgccatgtgccaggtgaagaaccagcccctggtgtacctgatgctgaccacccaccccagcctgtacagagtggacaacctgagtgatgagggcgccctgaacatcagtgacaggaccatcccccagccccccatcctgcagctgtctgtggagaagctgagcagagatggagccttcctgatggatgctggctctgtgctgatgctgtgggtgggcaagaactgcacccagaacttcctgagccaggtgctgggcgtgcagaactatgccagcatcccccagcccatgacagacctgcctgagctggacaccccagagagcgcccgcatcatcgccttcatctcctggctgcgggagcagaggcccttcttccccatcctgtatgtgatcagagatgagagccccatgaaggccaacttcctgcagaacatgattgaggacagaacagagagcgccctgagctactatgagttcctgctgcacatccagcagcaggtgaacaagtag

SEQ ID NO: 37781 - DNA, 3807 bp, Artificial Sequence
  Description of Artificial Sequence: Synthetic coding sequence
atgtctgccccagctggcagcagccaccctgctgccagcgcccgcatcccccccaagtttggaggagctgctgtgtctggagctgctgccccagctggccctggggccggccctgccccccaccagcagaatggacctgcccagaaccagatgcaggtgcccagcggctacggcctgcaccaccagaactacatcgcccccagcggccactacagccagggccctgggaagatgaccagcctgcccctggacacccagtgtggggactactacagcgccctgtacacagtgcccacccagaatgtgacccccaacacagtgaaccagcagcccggggcccagcagctgtacagccggggccccccagccccccacatcgtgggcagcaccctgggcagcttccagggcgccgccagcagcgccagccacctgcacaccagcgccagccagccctacagcagctttgtgaaccactacaacagccctgccatgtacagcgccagcagctctgtggccagccagggcttccccagcacctgtggccactacgccatgagcacagtgtccaatgctgcctaccccagcgtgtcctaccccagcctgcctgctggggacacctacggccagatgttcaccagccagaatgcccccaccgtgcggcctgtgaaggacaacagcttcagcggccagaacacagccatcagccaccccagccccctgccccccctgcccagccagcagcaccaccagcagcagagcctgagcggctacagcaccctgacctggagcagccctggcctgcccagcacccaggacaacctgatccggaaccacacaggcagcctggccgtggccaacaacaaccccaccatcaccgtggccgacagcctgagctgccctgtgatgcagaatgtgcagccccccaagagcagccctgtggtgtccacagtgctgagcggcagcagcggcagcagcagcaccaggaccccacccacagccaaccaccctgtggagcctgtgacctctgtgacccagcccagcgagctgctgcagcagaagggcgtgcagtatggagaatatgtgaacaaccaggccagcagcgcccccacccccctgagcagcaccagtgatgatgaggaggaggaggaggaggatgaggaggccggcgtggacagcagcagcaccaccagcagcgccagccccatgcccaacagctatgatgccctggagggcggcagctacccagacatgctgagcagcagcgccagcagccctgccccagaccctgcccctgagccagaccctgccagcgccccagccccagccagcgccccagcccctgtggtgccccagcccagcaagatggccaagcccttcggctacggctaccccaccctgcagcccggctaccagaatgccacagcccccctcatctctggagtgcagcccagcaaccctgtgtacagcggcttccagcagtacccccagcagtacccaggagtgaaccagctgagcagcagcatcggcggcctgagcctgcagagcagcccccagcctgagagcctgcggcctgtgaacctgacccaggagaggaacatcctgcccatgacccctgtgtgggcccctgtgcccaacctgaatgctgacctgaagaagctgaactgcagcccagacagcttccgctgcaccctgaccaacatcccccagacccaggccctgctgaacaaggccaagctgcccctgggcctgctgctgcaccccttccgggacctgacccagctgcctgtgatcaccagcaacaccatcgtgcgctgccgcagctgcaggacctacatcaacccctttgtgtccttcatcgaccagaggcgctggaagtgcaacctgtgctacagagtgaatgatgtgcctgaggagttcatgtacaaccccctgaccaggagctatggagagccccacaagaggcctgaggtgcagaacagcacagtggagttcatcgccagcagtgactacatgctgcggcccccccagcctgctgtgtacctgtttgtgctggatgtgagccacaatgctgtggaggccggctacctgaccatcctgtgccagagcctgctggagaacctggacaagctgcccggggacagcaggacccgcatcggcttcatgacctttgacagcaccatccacttctacaacctgcaggagggcctgagccagccccagatgctgattgtgtctgacattgatgatgtgttcctgcccaccccagacagcctgctggtgaacctgtatgagagcaaggagctgatcaaggacctgctgaatgccctgcccaacatgttcaccaacacccgggagacccacagcgccctgggccctgccctgcaggccgccttcaagctgatgagccccaccggcggccgggtgtctgtgttccagacccagctgcccagcctgggcgccggcctgctgcagagccgggaggaccccaaccagaggagcagcaccaaggtggtgcagcacctgggccctgccacagacttctacaagaagctggccctggactgcagcggccagcagacagctgtggacctcttcctgctgagcagccagtacagcgacctggccagcctggcctgcatgagcaagtacagcgctggctgcatctactactaccccagcttccactacacccacaaccccagccaggccgagaagctgcagaaggacctgaagcgctacctgaccaggaagattggatttgaggccgtgatgaggatccgctgcaccaagggcctgtccatgcacaccttccacggcaacttctttgtgcgcagcacagacctgctgagcctggccaacatcaacccagatgctggctttgctgtgcagctgagcattgaggagagcctgacagacaccagcctggtgtgcttccagacagccctgctgtacaccagcagcaagggggagcggcgcatccgggtgcacaccctgtgcctgcctgtggtgagcagcctggctgatgtgtatgccggcgtggatgtgcaggccgccatctgcctgctggccaacatggctgtggacagatctgtgagcagcagcctgagtgatgccagagatgccctggtgaatgctgtggtggacagcctgagcgcctacggcagcacagtgagcaacctgcagcacagcgccctgatggcccccagcagcctgaagctgttccccctgtatgtgctggccctgctgaagcagaaggccttcagaacaggcaccagcacccggctggatgacagagtgtatgccatgtgccagatcaagagccagcccctggtgcacctgatgaagatgatccaccccaacctgtacagaattgaccggctgacagatgaaggagctgtgcacgtgaatgacagaattgtgccccagccccccctgcagaagctgtctgctgagaagctgacccgggagggcgccttcctgatggactgtggctctgtgttctacatctgggtgggcaagggctgtgacaacaacttcattgaagatgtgctgggctacaccaactttgccagcatcccccagaagatgacccacctgcctgagctggacaccctgagcagcgagcgggcccggagcttcatcacctggctgcgggacagccggcccctgagccccatcctgcacatcgtgaaggatgagagccctgccaaggccgagttcttccagcacctgattgaggacagaacagaagctgccttctcctactatgagttcctgctgcacgtgcagcagcagatctgcaagtag

SEQ ID NO: 37782 - DNA, 3702 bp, Artificial Sequence
  Description of Artificial Sequence: Synthetic coding sequence
atgtctgccccagctggcagcagccaccctgctgccagcgcccgcatcccccccaagtttggaggagctgctgtgtctggagctgctgccccagctggccctggggccggccctgccccccaccagcagaatggacctgcccagaaccagatgcaggtgcccagcggctacggcctgcaccaccagaactacatcgcccccagcggccactacagccagggccctgggaagatgaccagcctgcccctggacacccagtgtggggactactacagcgccctgtacacagtgcccacccagaatgtgacccccaacacagtgaaccagcagcccggggcccagcagctgtacagccggggccccccagccccccacatcgtgggcagcaccctgggcagcttccagggcgccgccagcagcgccagccacctgcacaccagcgccagccagccctacagcagctttgtgaaccactacaacagccctgccatgtacagcgccagcagctctgtggccagccagggcttccccagcacctgtggccactacgccatgagcacagtgtccaatgctgcctaccccagcgtgtcctaccccagcctgcctgctggggacacctacggccagatgttcaccagccagaatgcccccaccgtgcggcctgtgaaggacaacagcttcagcggccagaacacagccatcagccaccccagccccctgccccccctgcccagccagcagcaccaccagcagcagagcctgagcggctacagcaccctgacctggagcagccctggcctgcccagcacccaggacaacctgatccggaaccacacaggcagcctggccgtggccaacaacaaccccaccatcaccgtggccgacagcctgagctgccctgtgatgcagaatgtgcagccccccaagagcagccctgtggtgtccacagtgctgagcggcagcagcggcagcagcagcaccaggaccccacccacagccaaccaccctgtggagcctgtgacctctgtgacccagcccagcgagctgctgcagcagaagggcgtggacagcagcagcaccaccagcagcgccagccccatgcccaacagctatgatgccctggagggcggcagctacccagacatgctgagcagcagcgccagcagccctgccccagaccctgcccctgagccagaccctgccagcgccccagccccagccagcgccccagcccctgtggtgccccagcccagcaagatggccaagcccttcggctacggctaccccaccctgcagcccggctaccagaatgccacagcccccctcatcagcggcgtgcagcccagcaaccctgtgtacagcggcttccagcagtacccccagcagtacccaggagtgaaccagctgagcagcagcattggaggcctgagcctgcagagcagcccccagcctgagagcctgcggcctgtgaacctgacccaggagaggaacatcctgcccatgacccctgtgtgggcccctgtgcccaacctgaatgctgacctgaagaagctgaactgcagcccagacagcttccgctgcaccctgaccaacatcccccagacccaggccctgctgaacaaggccaagctgcccctgggcctgctgctgcaccccttccgggacctgacccagctgcccgtcatcaccagcaacaccatcgtgcgctgccgcagctgcaggacctacatcaacccctttgtgtccttcatcgaccagaggcgctggaagtgcaacctgtgctacagagtgaatgatgtgcctgaggagttcatgtacaaccccctgaccaggagctatggagagccccacaagaggcctgaggtgcagaacagcacagtggagttcatcgccagcagtgactacatgctgcggcccccccagcctgctgtgtacctgtttgtgctggatgtgagccacaatgctgtggaggccggctacctgaccatcctgtgccagagcctgctggagaacctggacaagctgcccggggacagcaggaccagaattggcttcatgacctttgacagcaccatccacttctacaacctgcaggagggcctgagccagccccagatgctgattgtgtctgacattgatgatgtgttcctgcccaccccagacagcctgctggtgaacctgtatgagagcaaggagctgatcaaggacctgctgaatgccctgcccaacatgttcaccaacacccgggagacccacagcgccctgggccctgccctgcaggccgccttcaagctgatgagccccactggaggccgggtgtctgtgttccagacccagctgcccagcctgggcgccggcctgctgcagagccgggaggaccccaaccagaggagcagcaccaaggtggtgcagcacctgggccctgccacagacttctacaagaagctggccctggactgcagcggccagcagacagctgtggacctcttcctgctgagcagccagtacagcgacctggccagcctggcctgcatgagcaagtacagcgctggctgcatctactactaccccagcttccactacacccacaaccccagccaggccgagaagctgcagaaggacctgaagcgctacctgaccaggaagattggatttgaagctgtgatgaggatccgctgcaccaagggcctgtccatgcacaccttccacggcaacttctttgtgcgcagcacagacctgctgagcctggccaacatcaacccagatgctggctttgctgtgcagctgagcattgaggagagcctgacagacaccagcctggtgtgcttccagacagccctgctgtacaccagcagcaaaggagagcggcgcatccgggtgcacaccctgtgcctgcctgtggtgagcagcctggctgatgtgtatgctggggtggatgtgcaggccgccatctgcctgctggccaacatggctgtggacagatctgtgagcagcagcctgagtgatgccagagatgccctggtgaatgctgtggtggacagcctgagcgcctacggcagcacagtgagcaacctgcagcacagcgccctgatggcccccagcagcctgaagctgttccccctgtatgtgctggccctgctgaagcagaaggccttcagaacaggcaccagcacccggctggatgacagagtgtatgccatgtgccagatcaagagccagcccctggtgcacctgatgaagatgatccaccccaacctgtacagaattgaccggctgacagatgagggcgctgtgcacgtgaatgaccgcatcgtgccccagccccccctgcagaagctgtctgctgagaagctgacccgggagggcgccttcctgatggactgtggcagcgtcttctacatctgggtgggcaagggctgtgacaacaacttcattgaagatgtgctgggctacaccaactttgccagcatcccccagaagatgacccacctgcctgagctggacaccctgagcagcgagcgggcccgctccttcatcacctggctgcgggacagccggcccctgagccccatcctgcacatcgtgaaggatgagagccctgccaaggccgagttcttccagcacctgattgaggacagaacagaggccgccttctcctactatgagttcctgctgcacgtgcagcagcagatctgcaagtag

SEQ ID NO: 37783 - DNA, 3897 bp, Artificial Sequence
  Description of Artificial Sequence: Synthetic coding sequence
atgtctgccccagctggcagcagccaccctgctgccagcgcccgcatcccccccaagtttggaggagctgctgtgtctggagctgctgccccagctggccctggggccggccctgccccccaccagcagaatgagaccggcttccaccacgtggcccaggccagcctggagctgctggaccccagcaacctgcctgccagcgccagccagattgctggcagcactggacctgcccagaaccagatgcaggtgcccagcggctacggcctgcaccaccagaactacatcgcccccagcggccactacagccagggccctgggaagatgaccagcctgcccctggacacccagtgtggggactactacagcgccctgtacacagtgcccacccagaatgtgacccccaacacagtgaaccagcagcccggggcccagcagctgtacagccggggccccccagccccccacatcgtgggcagcaccctgggcagcttccagggcgccgccagcagcgccagccacctgcacaccagcgccagccagccctacagcagctttgtgaaccactacaacagccctgccatgtacagcgccagcagctctgtggccagccagggcttccccagcacctgtggccactacgccatgagcacagtgtccaatgctgcctaccccagcgtgtcctaccccagcctgcctgctggggacacctacggccagatgttcaccagccagaatgcccccaccgtgcggcctgtgaaggacaacagcttcagcggccagaacacagccatcagccaccccagccccctgccccccctgcccagccagcagcaccaccagcagcagagcctgagcggctacagcaccctgacctggagcagccctggcctgcccagcacccaggacaacctgatccggaaccacacaggcagcctggccgtggccaacaacaaccccaccatcaccgtggccgacagcctgagctgccctgtgatgcagaatgtgcagccccccaagagcagccctgtggtgtccacagtgctgagcggcagcagcggcagcagcagcaccaggaccccacccacagccaaccaccctgtggagcctgtgacctctgtgacccagcccagcgagctgctgcagcagaagggcgtgcagtacggggagtatgtgaacaaccaggccagcagcgcccccacccccctgagcagcaccagtgatgatgaggaggaggaggaggaggatgaggaggccggcgtggacagcagcagcaccaccagcagcgccagccccatgcccaacagctatgatgccctggagggcggcagctacccagacatgctgagcagcagcgccagcagccctgccccagaccctgcccctgagccagaccctgccagcgccccagccccagccagcgccccagcccctgtggtgccccagcccagcaagatggccaagcccttcggctacggctaccccaccctgcagcccggctaccagaatgccacagcccccctcatcagcggcgtgcagcccagcaaccctgtgtacagcggcttccagcagtacccccagtacccaggagtgaaccagctgagcagcagcatcggcggcctgagcctgcagagcagcccccagcctgagagcctgcggcctgtgaacctgacccaggagaggaacatcctgcccatgacccctgtgtgggcccctgtgcccaacctgaatgctgacctgaagaagctgaactgcagcccagacagcttccgctgcaccctgaccaacatcccccagacccaggccctgctgaacaaggccaagctgcccctgggcctgctgctgcaccccttccgggacctgacccagctgcctgtgatcaccagcaacaccatcgtgcgctgccgcagctgcaggacctacatcaacccctttgtgtccttcatcgaccagaggcgctggaagtgcaacctgtgctacagagtgaatgatgtgcctgaggagttcatgtacaaccccctgaccaggagctatggagagccccacaagaggcctgaggtgcagaacagcacagtggagttcatcgccagcagtgactacatgctgcggcccccccagcctgctgtgtacctgtttgtgctggatgtgagccacaatgctgtggaggccggctacctgaccatcctgtgccagagcctgctggagaacctggacaagctgcccggggacagcaggacccgcatcggcttcatgacctttgacagcaccatccacttctacaacctgcaggagggcctgagccagccccagatgctgattgtgtctgacattgatgatgtgttcctgcccaccccagacagcctgctggtgaacctgtatgagagcaaggagctgatcaaggacctgctgaatgccctgcccaacatgttcaccaacacccgggagacccacagcgccctgggccctgccctgcaggccgccttcaagctgatgagccccaccggcggccgggtgtctgtgttccagacccagctgcccagcctgggcgccggcctgctgcagagccgggaggaccccaaccagaggagcagcaccaaggtggtgcagcacctgggccctgccacagacttctacaagaagctggccctggactgcagcggccagcagacagctgtggacctcttcctgctgagcagccagtacagcgacctggccagcctggcctgcatgagcaagtacagcgctggctgcatctactactaccccagcttccactacacccacaaccccagccaggccgagaagctgcagaaggacctgaagcgctacctgaccaggaagattggatttgaggccgtgatgaggatccgctgcaccaagggcctgtccatgcacaccttccacggcaacttctttgtgcgcagcacagacctgctgagcctggccaacatcaacccagatgctggctttgctgtgcagctgagcattgaggagagcctgacagacaccagcctggtgtgcttccagacagccctgctgtacaccagcagcaagggggagcggcgcatccgggtgcacaccctgtgcctgcctgtggtgagcagcctggctgatgtgtatgccggcgtggatgtgcaggccgccatctgcctgctggccaacatggctgtggacagatctgtgagcagcagcctgagtgatgccagagatgccctggtgaatgctgtggtggacagcctgagcgcctacggcagcacagtgagcaacctgcagcacagcgccctgatggcccccagcagcctgaagctgttccccctgtatgtgctggccctgctgaagcagaaggccttcagaacaggcaccagcacccggctggatgacagagtgtatgccatgtgccagatcaagagccagcccctggtgcacctgatgaagatgatccaccccaacctgtacagaattgaccggctgacagatgaaggagctgtgcacgtgaatgacagaattgtgccccagccccccctgcagaagctgtctgctgagaagctgacccgggagggcgccttcctgatggactgtggctctgtgttctacatctgggtgggcaagggctgtgacaacaacttcattgaagatgtgctgggctacaccaactttgccagcatcccccagaagatgacccacctgcctgagctggacaccctgagcagcgagcgggcccggagcttcatcacctggctgcgggacagccggcccctgagccccatcctgcacatcgtgaaggatgagagccctgccaaggccgagttcttccagcacctgattgaggacagaacagaagctgccttctcctactatgagttcctgctgcacgtgcagcagcagatctgcaagtag

SEQ ID NO: 37784 - DNA, 3285 bp, Artificial Sequence
  Description of Artificial Sequence: Synthetic coding sequence
atgaatgtgaaccagagcgtgccccctgtgcccccatttggccagccccagcccatctacccaggctaccaccagagcagctatggaggccagagcggcagcacagccccagccatcccctatggagcctacaatggacctgtgcccggctaccagcagaccccaccccagggcatgagccgggccccacccagcagcggggcccccccagccagcacagcccaggccccctgtggccaggccgcctacggccagtttggccagggagatgtgcagaatggccccagcagcacagtgcagatgcagaggctgcccggcagccagcccttcggcagccccctggcccctgtgggcaaccagccccctgtgctgcagccctacggccccccacccaccagcgcccaggtggccacccagctgagcggcatgcagatcagcggggctgtggccccagccccacccagcagcggcctgggcttcggcccccccaccagcctggccagcgccagcggcagcttccccaacagcggcctgtatggcagctacccccagggccaggccccacccctgagccaggcccagggccaccctggcatccagaccccccagaggtctgcccccagccaggccagcagcttcaccccaccagccagcggcggcccccggctgcccagcatgacaggccccctgctgcccggccagagctttggaggccccagcgtgtcccagcccaaccacgtgagcagccccccccaggccctgcccccaggcacccagatgacaggccccctgggccccctgccccccatgcacagcccccagcagcccggctaccagccccagcagaatggcagctttggacctgcccggggcccccagagcaactacggcggcccctacccagctgcccccaccttcggcagccagcccggccccccccagcccctgccccccaagaggctggaccctgatgccatccccagccccatccaggtgattgaagatgacaggaacaacagaggaacagagccctttgtgactggagtgcggggccaggtgccccccctggtgaccaccaacttcctggtgaaggaccagggcaatgccagcccccgctacatccgctgcaccagctacaacatcccctgcaccagtgacatggccaagcaggcccaggtgcccctggccgctgtgatcaagcccctggcccggctgcccccagaggaggccagcccctacgtggtggaccatggagagagcggccccctgcgctgcaaccgctgcaaggcctacatgtgccccttcatgcagttcattgaaggaggaagacgcttccagtgctgcttctgcagctgcatcaatgatgtgcccccccagtacttccagcacctggaccacacaggcaagagggtggatgcctatgacaggcctgagctgagcctgggcagctatgagttcctggccaccgtggactactgcaagaacaacaagttccccagccccccagccttcatcttcatgattgatgtgtcctacaatgccatcagaacaggcctggtgcggctgctgtgtgaggagctgaagagcctgctggacttcctgccccgggagggcggcgctgaggagagcgccatccgggtgggctttgtgacctacaacaaggtgctgcacttctacaacgtgaagagcagcctggcccagccccagatgatggtggtgtctgatgtggccgacatgtttgtgcccctgctggatggcttcctggtgaatgtgaatgaaagccgggccgtcatcaccagcctgctggaccagatccctgagatgtttgctgacacccgggagacagaaacagtgtttgtgcctgtgatccaggccggcatggaggccctgaaggctgctgaatgtgccggcaagctgttcctgttccacaccagcctgcccatcgccgaggcccctgggaagctgaagaacagagatgacaggaagctgatcaacacagacaaggagaagaccctcttccagccccagacaggagcctaccagaccctggccaaggaatgtgtggcccagggctgctgcgtggacctcttcctgttccccaaccagtatgtggatgtggccaccctgtctgtggtgccccagctgaccggcggctctgtgtacaagtatgccagcttccaggtggagaatgaccaggagcgcttcctgagtgacctgcggagagatgtgcagaaggtggtgggctttgatgctgtgatgagggtgaggaccagcacaggcatccgggctgtggacttctttggagccttctacatgagcaacaccacagatgtggagctggccggcctggatggagacaagacagtgacagtggagttcaagcatgatgaccggctgaatgaggagagcggggccctgctgcagtgtgccctgctgtacaccagctgtgccggccagaggcggctgcgcatccacaacctggccctgaactgctgcacccagctggccgacctgtacagaaactgtgaaacagacaccctcatcaactacatggccaagtttgcctaccggggcgtgctgaacagccctgtgaaggctgtgcgggacaccctcatcacccagtgtgcccagatcctggcctgctacaggaagaactgtgccagccccagcagcgctggccagctgatcctgcctgagtgcatgaagctgctgcctgtgtacctgaactgtgtgctgaagagtgatgtgctgcagcctggagctgaggtgaccacagatgaccgggcctacgtgcggcagctggtgacctccatggatgtgacagagaccaacgtgttcttctacccccggctgctgcccctgaccaagagccctgtggagagcaccacagagcccccagctgtgcgggccagcgaggagcggctgagcaatggagacatctacctgctggagaatggcctgaacctcttcctgtgggtgggcgcctctgtgcagcagggcgtggtgcagagcctcttctctgtgagcagcttcagccagatcaccagcggcctgtctgtgctgcctgtgctggacaaccccctgagcaagaaggtgcggggcctgattgacagcctgcgggcccagaggagccgctacatgaagctgactgtggtgaagcaggaggacaagatggagatgctgttcaagcacttcctggtggaggacaagagcctgtctggaggagccagctatgtggacttcctgtgccacatgcacaaggagatccggcagctgctgtcctag

SEQ ID NO: 37785 - DNA, 3285 bp, Artificial Sequence; identical to SEQ ID NO: 37784
  Description of Artificial Sequence: Synthetic coding sequence

SEQ ID NO: 37786 - DNA, 2928 bp, Artificial Sequence
  Description of Artificial Sequence: Synthetic coding sequence
atgcagatcagcggggctgtggccccagccccacccagcagcggcctgggcttcggcccccccaccagcctggccagcgccagcggcagcttccccaacagcggcctgtatggcagctacccccagggccaggccccacccctgagccaggcccagggccaccctggcatccagaccccccagaggtctgcccccagccaggccagcagcttcaccccaccagccagcggcggcccccggctgcccagcatgacaggccccctgctgcccggccagagctttggaggccccagcgtgtcccagcccaaccacgtgagcagccccccccaggccctgcccccaggcacccagatgacaggccccctgggccccctgccccccatgcacagcccccagcagcccggctaccagccccagcagaatggcagctttggacctgcccggggcccccagagcaactacggcggcccctacccagctgcccccaccttcggcagccagcccggccccccccagcccctgccccccaagaggctggaccctgatgccatccccagcccccagctgtctgagctgcccccccagcagaagaccaggcacagaattgatcctgatgccatccccagccccatccaggtgattgaagatgacaggaacaacagaggaacagagccctttgtgactggagtgcggggccaggtgccccccctggtgaccaccaacttcctggtgaaggaccagggcaatgccagcccccgctacatccgctgcaccagctacaacatcccctgcaccagtgacatggccaagcaggcccaggtgcccctggccgccgtcatcaagcccctggcccggctgcccccagaggaggccagcccctacgtggtggaccacggggagagcggccccctgcgctgcaaccgctgcaaggcctacatgtgccccttcatgcagttcatcgagggcggccgccgcttccagtgctgcttctgcagctgcatcaatgatgtgcccccccagtacttccagcacctggaccacacaggcaagagggtggatgcctatgacaggcctgagctgagcctgggcagctatgagttcctggccaccgtggactactgcaagaacaacaagttccccagccccccagccttcatcttcatgattgatgtgtcctacaatgccatcagaacaggcctggtgcggctgctgtgtgaggagctgaagagcctgctggacttcctgccccgggagggcggcgctgaggagagcgccatccgggtgggctttgtgacctacaacaaggtgctgcacttctacaacgtgaagagcagcctggcccagccccagatgatggtggtgtctgatgtggccgacatgtttgtgcccctgctggatggcttcctggtgaatgtgaatgaaagcagagctgtgatcaccagcctgctggaccagatccctgagatgtttgctgacacccgggagacagagaccgtgtttgtgcctgtgatccaggccggcatggaggccctgaaggccgcagaatgtgccggcaagctgttcctgttccacaccagcctgcccatcgccgaggcccctgggaagctgaagaacagagatgacaggaagctgatcaacacagacaaggagaagaccctcttccagccccagacaggagcctaccagaccctggccaaggaatgtgtggcccagggctgctgcgtggacctcttcctgttccccaaccagtatgtggatgtggccaccctgtctgtggtgccccagctgactggaggctctgtgtacaagtatgccagcttccaggtggagaatgaccaggagcgcttcctgagtgacctgcggagagatgtgcagaaggtggtgggctttgatgctgtgatgagggtgaggaccagcacaggcatccgggctgtggacttcttcggggccttctacatgagcaacaccacagatgtggagctggccggcctggatggagacaagacagtgacagtggagttcaagcatgatgaccggctgaatgaggagagcggggccctgctgcagtgtgccctgctgtacaccagctgtgccggccagaggcggctgcgcatccacaacctggccctgaactgctgcacccagctggccgacctgtacagaaactgtgaaacagacaccctcatcaactacatggccaagtttgcctacagaggagtgctgaacagccctgtgaaggctgtgcgggacaccctcatcacccagtgtgcccagatcctggcctgctacaggaagaactgtgccagccccagcagcgctggccagctgatcctgcctgagtgcatgaagctgctgcctgtgtacctgaactgtgtgctgaagagtgatgtgctgcagcccggggctgaggtgaccacagatgaccgggcctacgtgcggcagctggtgacctccatggatgtgacagagaccaacgtgttcttctacccccggctgctgcccctgaccaagagccctgtggagagcaccacagagcccccagctgtgcgggccagcgaggagcggctgagcaatggagacatctacctgctggagaatggcctgaacctcttcctgtgggtgggcgcctctgtgcagcagggcgtggtgcagagcctcttctctgtgtcctccttcagccagatcaccagcggcctgtctgtgctgcctgtgctggacaaccccctgagcaagaaggtgcggggcctgattgacagcctgcgggcccagaggagccgctacatgaagctgactgtggtgaagcaggaggacaagatggagatgctgttcaagcacttcctggtggaggacaagagcctgagcggcggggccagctatgtggacttcctgtgccacatgcacaaggagatccggcagctgctgtcctag

SEQ ID NO: 37787 - DNA, 1029 bp, Artificial Sequence
  Description of Artificial Sequence: Synthetic coding sequence
atgagggtgaggaccagcacaggcatccgggctgtggacttctttggagccttctacatgagcaacaccacagatgtggagctggccggcctggatggagacaagacagtgacagtggagttcaagcatgatgaccggctgaatgaggagagcggggccctgctgcagtgtgccctgctgtacaccagctgtgccggccagaggcggctgcgcatccacaacctggccctgaactgctgcacccagctggccgacctgtacagaaactgtgaaacagacaccctcatcaactacatggccaagtttgcctaccggggcgtgctgaacagccctgtgaaggctgtgcgggacaccctcatcacccagtgtgcccagatcctggcctgctacaggaagaactgtgccagccccagcagcgctggccagctgatcctgcctgagtgcatgaagctgctgcctgtgtacctgaactgtgtgctgaagagtgatgtgctgcagcctggagctgaggtgaccacagatgaccgggcctacgtgcggcagctggtgacctccatggatgtgacagagaccaacgtgttcttctacccccggctgctgcccctgaccaagagccctgtggagagcaccacagagcccccagctgtgcgggccagcgaggagcggctgagcaatggagacatctacctgctggagaatggcctgaacctcttcctgtgggtgggcgcctctgtgcagcagggcgtggtgcagagcctcttctctgtgagcagcttcagccagatcaccagcggcctgtctgtgctgcctgtgctggacaaccccctgagcaagaaggtgcggggcctgattgacagcctgcgggcccagaggagccgctacatgaagctgactgtggtgaagcaggaggacaagatggagatgctgttcaagcacttcctggtggaggacaagagcctgtctggaggagccagctatgtggacttcctgtgccacatgcacaaggagatccggcagctgctgtcctag

SEQ ID NO: 37788 - DNA, 1029 bp, Artificial Sequence; identical to SEQ ID NO: 37787
  Description of Artificial Sequence: Synthetic coding sequence

SEQ ID NO: 37789 - DNA, 3099 bp, Artificial Sequence
  Description of Artificial Sequence: Synthetic coding sequence
atgagccagcagggctacgtggccaccccaccctacagccagccccagcccggcatcggcctgagccccccccactacggccactatggagaccccagccacacagccagccccaccggcatgatgaagccagctggccccctgggcgccacagccacccggggcatgctgcccccaggccccccacctcctggcccccaccagtttggccagaatggagcccacgccaccggccaccccccccagcgcttccctggccccccacctgtgaacaacgtggccagcagccacgccccctaccagcccagcgcccagagcagctacccaggccccatcagcaccagctctgtgacccagctgggcagccagctgagcgccatgcagatcaacagctatggcagcggcatggccccacccagccagggccccccaggccccctgagcgccaccagcctgcagaccccaccccggcccccccagcccagcatcctgcagcccggcagccaggtgctgcccccaccacccaccaccctgaatggacctggggccagccccctgcccctgcccatgtacagaccagatggcctgagcggccccccacctccaaatgcccagtaccagcccccacccctgcccggccagaccctgggcgccggctacccaccccagcaggccaacagcggcccccagatggccggggcccagctgagctacccaggcggcttccctgggggccctgcccagatggccggccccccccagccccagaagaagctggaccctgacagcatccccagccccatccaggtgattgaaaatgaccgggccagcagaggaggccaggtgtatgccaccaacacccggggccagatcccccccctggtgaccacagactgcatgatccaggaccagggcaatgccagcccccgcttcatccgctgcaccacctactgcttcccctgcaccagtgacatggccaagcaggcccagatccccctggccgctgtgatcaagccctttgccaccatccccagcaatgaaagccccctgtacctggtgaaccacggggagagcggccctgtgcgctgcaaccgctgcaaggcctacatgtgccccttcatgcagttcattgaaggaggaagacgctaccagtgtggcttctgcaactgtgtgaatgatgtgccccccttctacttccagcacctggaccacatcggccgccgcctggaccactatgagaagccagagctgagcctgggcagctatgaatatgtggccaccctggactactgcaggaagagcaagccacccaaccccccagccttcatcttcatgattgatgtgtcctacagcaacatcaagaatggcctggtgaagctgatctgtgaggagctgaagaccatgctggagaagatccccaaggaggagcaggaggagaccagcgccatccgggtgggcttcatcacctacaacaaggtgctgcacttcttcaacgtgaagagcaacctggcccagccccagatgatggtggtgacagatgtgggggaggtgtttgtgcccctgctggatggcttcctggtgaactaccaggagagccagagcgtcatccacaacctgctggaccagatcccagacatgtttgctgacagcaatgaaaatgaaacagtgtttgcccctgtgatccaggccggcatggaggccctgaaggctgctgactgccctgggaagctgttcatcttccacagcagcctgcccacagctgaggcccctgggaagctgaagaacagagatgacaagaagctggtgaacacagacaaggagaagatcctcttccagccccagaccaacgtgtatgacagcctggccaaggactgtgtggcccacggctgcagcgtgaccctcttcctgttccccagccagtatgtggatgtggccagcctgggcctggtgccccagctgaccggcggcaccctgtacaagtacaacaacttccagatgcacctggaccggcagcagttcctgaatgacctgagaaatgacatcgagaagaagattggatttgatgccatcatgagggtgaggaccagcacaggcttccgggccacagacttctttggaggcatcctgatgaacaacaccacagatgtggagatggccgccatcgactgtgacaaggctgtgacagtggagttcaagcatgatgacaagctgtctgaagattctggggccctgatccagtgtgctgtgctgtacaccaccatcagcggccagaggcggctgcgcatccacaacctgggcctgaactgcagcagccagctggccgacctgtacaagagctgtgaaacagatgccctgatcaacttctttgccaagagcgccttcaaggctgtgctgcaccagcccctgaaggtgatccgggagatcctggtgaaccagacagcccacatgctggcctgctacaggaagaactgtgccagccccagcgctgccagccagctgatcctgcctgacagcatgaaggtgctgcctgtgtacatgaactgcctgctgaagaactgtgtgctgctgagcaggcctgagatcagcacagatgagcgggcctaccagaggcagctggtgatgaccatgggcgtggccgacagccagctgttcttctacccccagctgctgcccatccacaccctggatgtgaagagcaccatgctgcctgctgctgtgcgctgcagcgagagccggctgtctgaggagggcatcttcctgctggccaacggcctgcacatgttcctgtggctgggcgtgagcagccccccagagctgatccagggcatcttcaacgtgcccagctttgcccacatcaacacagacatgaccctgctgcctgaggtgggcaacccctacagccagcagctgaggatgatcatgggcatcatccagcagaagaggccctacagcatgaagctgaccatcgtgaagcagcgggagcagcctgagatggtgttccggcagttcctggtggaggacaagggcctgtatggaggcagcagctatgtggacttcctgtgctgcgtgcacaaggagatctgccagctgctgaactag

SEQ ID NO: 37790 - DNA, 3102 bp, Artificial Sequence
  Description of Artificial Sequence: Synthetic coding sequence
atgagccagcagggctacgtggccaccccaccctacagccagccccagcccggcatcggcctgagccccccccactacggccactatggagaccccagccacacagccagccccaccggcatgatgaagccagctggccccctgggcgccacagccacccggggcatgctgcccccaggccccccacctcctggcccccaccagtttggccagaatggagcccacgccaccggccaccccccccagcgcttccctggccccccacctgtgaacaacgtggccagcagccacgccccctaccagcccagcgcccagagcagctacccaggccccatcagcaccagctctgtgacccagctgggcagccagctgagcgccatgcagatcaacagctatggcagcggcatggccccacccagccagggccccccaggccccctgagcgccaccagcctgcagaccccaccccggcccccccagcccagcatcctgcagcccggcagccaggtgctgcccccaccacccaccaccctgaatggacctggggccagccccctgcccctgcccatgtacagaccagatggcctgagcggccccccacctccaaatgcccagtaccagcccccacccctgcccggccagaccctgggcgccggctacccaccccagcaggccgccaacagcggcccccagatggccggggcccagctgagctacccaggcggcttccctgggggccctgcccagatggccggccccccccagccccagaagaagctggaccctgacagcatccccagccccatccaggtgattgaaaatgaccgggccagccggggcggccaggtgtatgccaccaacacccggggccagatcccccccctggtgaccacagactgcatgatccaggaccagggcaatgccagcccccgcttcatccgctgcaccacctactgcttcccctgcaccagtgacatggccaagcaggcccagatccccctggccgccgtcatcaagccctttgccaccatccccagcaatgaaagccccctgtacctggtgaaccacggggagagcggccctgtgcgctgcaaccgctgcaaggcctacatgtgccccttcatgcagttcatcgagggcggccgccgctaccagtgtggcttctgcaactgtgtgaatgatgtgccccccttctacttccagcacctggaccacatcggccggcggctggaccactatgagaagccagagctgagcctgggcagctatgaatatgtggccaccctggactactgcaggaagagcaagccacccaaccccccagccttcatcttcatgattgatgtgtcctacagcaacatcaagaatggcctggtgaagctgatctgtgaggagctgaagaccatgctggagaagatccccaaggaggagcaggaggagaccagcgccatccgggtgggcttcatcacctacaacaaggtgctgcacttcttcaacgtgaagagcaacctggcccagccccagatgatggtggtgacagatgtgggggaggtgtttgtgcccctgctggatggcttcctggtgaactaccaggagagccagagcgtcatccacaacctgctggaccagatcccagacatgtttgctgacagcaatgaaaatgagaccgtgtttgcccctgtgatccaggccggcatggaggccctgaaggctgctgactgccctgggaagctgttcatcttccacagcagcctgcccacagctgaggcccctgggaagctgaagaacagagatgacaagaagctggtgaacacagacaaggagaagatcctcttccagccccagaccaacgtgtatgacagcctggccaaggactgtgtggcccacggctgcagcgtgaccctcttcctgttccccagccagtatgtggatgtggccagcctgggcctggtgccccagctgactggaggcaccctgtacaagtacaacaacttccagatgcacctggaccggcagcagttcctgaatgacctgagaaatgacatcgagaagaagattggatttgatgccatcatgagggtgaggaccagcacaggcttccgggccacagacttcttcggcggcatcctgatgaacaacaccacagatgtggagatggccgccatcgactgtgacaaggctgtgacagtggagttcaagcatgatgacaagctgtctgaggacagcggggccctgatccagtgtgctgtgctgtacaccaccatcagcggccagaggcggctgcgcatccacaacctgggcctgaactgcagcagccagctggccgacctgtacaagagctgtgaaacagatgccctgatcaacttctttgccaagagcgccttcaaggctgtgctgcaccagcccctgaaggtgatccgggagatcctggtgaaccagacagcccacatgctggcctgctacaggaagaactgtgccagccccagcgctgccagccagctgatcctgcctgacagcatgaaggtgctgcctgtgtacatgaactgcctgctgaagaactgtgtgctgctgagcaggcctgagatcagcacagatgagcgggcctaccagaggcagctggtgatgaccatgggcgtggccgacagccagctgttcttctacccccagctgctgcccatccacaccctggatgtgaagagcaccatgctgcctgctgctgtgcgctgcagcgagagccggctgtctgaggagggcatcttcctgctggccaacggcctgcacatgttcctgtggctgggcgtgagcagccccccagagctgatccagggcatcttcaacgtgcccagctttgcccacatcaacacagacatgaccctgctgcctgaggtgggcaacccctacagccagcagctgaggatgatcatgggcatcatccagcagaagaggccctacagcatgaagctgaccatcgtgaagcagcgggagcagcctgagatggtgttccggcagttcctggtggaggacaagggcctgtatggaggcagcagctatgtggacttcctgtgctgcgtgcacaaggagatctgccagctgctgaactag

SEQ ID NO: 37791 - DNA, 1182 bp, Artificial Sequence
  Description of Artificial Sequence: Synthetic coding sequence
atgattgatgtgtcctacagcaacatcaagaatggcctggtgaagctgatctgtgaggagctgaagaccatgctggagaagatccccaaggaggagcaggaggagaccagcgccatccgggtgggcttcatcacctacaacaaggtgctgcacttcttcaacgtgaagagcaacctggcccagccccagatgatggtggtgacagatgtgggggaggtgtttgtgcccctgctggatggcttcctggtgaactaccaggagagccagagcgtcatccacaacctgctggaccagatcccagacatgtttgctgacagcaatgaaaatgaaacagtgtttgcccctgtgatccaggccggcatggaggccctgaaggctgctgactgccctgggaagctgttcatcttccacagcagcctgcccacagctgaggcccctgggaagctgaagaacagagatgacaagaagctggtgaacacagacaaggagaagatcctcttccagccccagaccaacgtgtatgacagcctggccaaggactgtgtggcccacggctgcagcgtgaccctcttcctgttccccagccagtatgtggatgtggccagcctgggcctggtgccccagctgaccggcggcaccctgtacaagtacaacaacttccagatgcacctggaccggcagcagttcctgaatgacctgagaaatgacatcgagaagaagattggatttgatgccatcatgagggtgaggaccagcacaggcttccgggccacagacttctttggaggcatcctgatgaacaacaccacagatgtggagatggccgccatcgactgtgacaaggctgtgacagtggagttcaagcatgatgacaagctgtctgaagattctggggccctgatccagtgtgctgtgctgtacaccaccatcagcggccagaggcggctgcgcatccacaacctgggcctgaactgcagcagccagctggccgacctgtacaagagctgtgaaacagatgccctgatcaacttctttgccaagagcgccttcaaggctgtgctgcaccagcccctgaaggtgatccgggagatcctggtgaaccagacagcccacatgctggcctgctacaggaagaactgtgccagccccagcgctgccagccagttcacctgtgagaagtag

SEQ ID NO: 37792 - DNA, 1182 bp, Artificial Sequence; identical to SEQ ID NO: 37791
  Description of Artificial Sequence: Synthetic coding sequence

SEQ ID NO: 37793 - DNA, 2910 bp, Artificial Sequence
  Description of Artificial Sequence: Synthetic coding sequence
atggtgaagctggtgctgctgagcatcgtgctgctgaaggtgacagtgcccaagctgagcaatgacctgctgcagctggacttcatgcccatccaccggggcatcctggccatcgcctggagcatggctgaccctgagctgctgctgagctgtgggaaggatgccaagatcctgtgcagcaaccccaacacaggagaggtgctgtatgagctgcccaccaacacccagtggtgctttgacatccagtggtgccccaggaacccagctgtgctgtctgctgccagctttgatggccgcatctctgtgtacagcatcatgggcggcagcacagatggcctgcggcagaagcaggtggacaagctgagcagcagctttggaaacctggacccctttggaacaggccagcccctgccccccctgcagatcccccagcagacagcccagcacagcatcgtgctgcccctgaagaagccacccaagtggatcagaagacctgtgggcgccagcttctcctttggaggcaagctggtgacctttgaaaatgtgaggatgcccagccaccagggcgctgagcagcagcagcagcagcaccacgtgttcatcagccaggtggtgacagagaaggagttcctgagcagaagtgaccagctgcagcaggccgtgcagagccagggcttcatcaactactgccagaagaagattgatgccagccagacagaatttgagaagaatgtgtggagcttcctgaaggtgaactttgaagatgacagccggggcaagtacctggagctgctgggctacaggaaggaggacctgggcaagaagcacatcaaggaggagaaggaggagagcgagttcctgcccagcagcggcggcaccttcaacatctctgtgtctggggacattgatggcctcatcacccaggccctgctgaccggcaactttgaatctgctgtggacctgtgcctgcatgacaacaggatggctgatgccatcatcctggccatcgccggcggccaggagctgctggcccggacccagaagaagtactttgccaagagccagagcaagatcaccaggctcatcacagctgtggtgatgaagaactggaaggagatcgtggagagctgtgacctgaagaactggagggaggccctggccgctgtgctgacctacgccaagccagatgagttcagcgccctgtgtgacctgctgggcacccggctggagaatgaaggagacagcctgctgcagacccaggcctgcctgtgctacatctgtgctggaaatgtggagaagctggtggcctgctggaccaaggcccaggacggcagccaccccctgagcctgcaggacctgattgagaaggtggtgatcctgaggaaggctgtgcagctgacccaggccatggacaccagcacagtgggcgtgctgctggccgccaagatgagccagtatgccaacctgctggccgcccagggcagcattgctgctgccctggccttcctgcctgacaacaccaaccagcccaacatcatgcagctgcgggaccggctgtgccgggcccagggcgagcctgtggccggccacgagagccccaagatcccctatgagaagcagcagctgcccaagggccggcccggccctgtggccggccaccaccagatgccccgggtgcagacccagcagtactacccccacgtgcgcatcgcccccaccgtgaccacctggagcaacaagacccccacagccctgcccagccaccccccagctgccagccccagcgacacccagggcgagaaccccccacctcctggcttcatcatgcacggcaatgtgaaccccaatgctgctggccagctgcccaccagccctggccacatgcacacccaggtgcccccctacccccagccccagccctaccagcctgcccagccctacccctttggaactggaggcagcgccatgtaccggccccagcagcctgtggccccacccaccagcaatgcctaccccaacaccccctacatcagcagcgccagcagctacacaggccagagccagctgtatgctgcccagcaccaggccagcagccccaccagcagccctgccaccagcttccccccaccacccagcagcggggccagcttccagcacggcggccctggggccccacccagcagcagcgcctatgccctgcccccaggcaccaccggcccccagaatggctggaatgaccccccagccctgaacagagtgcccaagaagaagaagatgcctgagaacttcatgcctcctgtgcccatcaccagccccatcatgaaccccctgggggacccccagagccagatgctgcagcagcagcccagcgcccctgtgcccctgagcagccagagcagcttcccccagccccacctgcccggcggccagcccttccatggagtgcagcagcccctgggccagacaggcatgcctccttccttcagcaagcccaacattgaaggagcccctggggcccccatcggcaacaccttccagcacgtgcagagcctgcccaccaagaagatcaccaagaagcccatcccagatgagcacctgatcctgaagaccacctttgaagatctcatccagcgctgcctgagcagcgccacagacccccagaccaagaggaagctggatgatgccagcaagaggctggagttcctgtatgacaagctgcgggagcagaccctgagccccaccatcaccagcggcctgcacaacatcgcccggagcattgagaccaggaactacagcgagggcctgaccatgcacacccacatcgtgtccaccagcaacttcagcgagaccagcgccttcatgcctgtgctgaaggtggtgctgacccaggccaacaagctgggcgtgtag

SEQ ID NO: 37794 - DNA, 3321 bp, Artificial Sequence
  Description of Artificial Sequence: Synthetic coding sequence
atgaagctgaaggaggtggacagaacagccatgcaggcctggagccctgcccagaaccaccccatctacctggccaccggcaccagcgcccagcagctggatgccaccttcagcaccaatgccagcctggagatctttgagctggacctgagtgaccccagcctggacatgaagagctgtgccaccttcagcagcagccaccgctaccacaagctgatctggggcccctacaagatggacagcaaaggagatgtgtctggagtgctgattgctggaggagaaaatggaaacatcatcctgtatgaccccagcaagatcatcgccggggacaaggaggtggtgattgcccagaatgacaagcacacaggccctgtgcgggccctggatgtgaacatcttccagaccaacctggtggccagcggggccaatgaaagtgagatctacatctgggacctgaacaactttgccacccccatgacccctggggccaagacccagcccccagaggacatcagctgcatcgcctggaaccggcaggtgcagcacatcctggccagcgccagccccagcggccgggccaccgtgtgggacctgaggaagaatgagcccatcatcaaggtgtctgaccacagcaacaggatgcactgcagcggcctggcctggcacccagatgtggccacccagatggtgctggcctctgaagatgaccggctgcctgtgatccagatgtgggacctgcgctttgccagcagccccctgcgggtgctggagaaccacgcccggggcatcctggccatcgcctggagcatggctgaccctgagctgctgctgagctgtgggaaggatgccaagatcctgtgcagcaaccccaacacaggagaggtgctgtatgagctgcccaccaacacccagtggtgctttgacatccagtggtgccccaggaacccagctgtgctgtctgctgccagctttgatggccgcatctctgtgtacagcatcatgggcggcagcacagatggcctgcggcagaagcaggtggacaagctgagcagcagctttggaaacctggacccctttggaacaggccagcccctgccccccctgcagatcccccagcagacagcccagcacagcatcgtgctgcccctgaagaagccacccaagtggatcagaagacctgtgggcgccagcttctcctttggaggcaagctggtgacctttgaaaatgtgaggatgcccagccaccagggcgctgagcagcagcagcagcagcaccacgtgttcatcagccaggtggtgacagagaaggagttcctgagcagaagtgaccagctgcagcaggccgtgcagagccagggcttcatcaactactgccagaagaagattgatgccagccagacagaatttgagaagaatgtgtggagcttcctgaaggtgaactttgaagatgacagccggggcaagtacctggagctgctgggctacaggaaggaggacctgggcaagaagatcgccctggccctgaacaaggtggatggagccaacgtggccctgaaggacagcgaccaggtggcccagagtgatggagaggagagccctgctgctgaggagcagctgctgggggagcacatcaaggaggagaaggaggagagcgagttcctgcccagcagcggcggcaccttcaacatctctgtgtctggggacattgatggcctcatcacccaggccctgctgactggaaactttgagagcgctgtggacctgtgcctgcatgacaacaggatggctgatgccatcatcctggccatcgccggcggccaggagctgctggcccggacccagaagaagtactttgccaagagccagagcaagatcaccaggctcatcacagctgtggtgatgaagaactggaaggagatcgtggagagctgtgacctgaagaactggagggaggccctggccgctgtgctgacctacgccaagccagatgagttcagcgccctgtgtgacctgctgggcacccggctggagaatgaaggagacagcctgctgcagacccaggcctgcctgtgctacatctgtgctggaaatgtggagaagctggtggcctgctggaccaaggcccaggacggcagccaccccctgagcctgcaggacctgattgagaaggtggtgatcctgaggaaggctgtgcagctgacccaggccatggacaccagcacagtgggcgtgctgctggccgccaagatgagccagtatgccaacctgctggccgcccagggcagcattgctgctgccctggccttcctgcctgacaacaccaaccagcccaacatcatgcagctgcgggaccggctgtgccgggcccagggcgagcctgtggccggccacgagagccccaagatcccctatgagaagcagcagctgcccaagggccggcccggccctgtggccggccaccaccagatgccccgggtgcagacccagcagtactacccccacggggagaaccccccacctcctggcttcatcatgcacggcaatgtgaaccccaatgctgctggccagctgcccaccagccctggccacatgcacacccaggtgcccccctacccccagccccagaggccccagaatggctggaatgaccccccagccctgaacagagtgcccaagaagaagaagatgcctgagaacttcatgcctcctgtgcccatcaccagccccatcatgaaccccctgggggacccccagagccagatgctgcagcagcagcccagcgcccctgtgcccctgagcagccagagcagcttcccccagccccacctgcccggcggccagcccttccacggcgtgcagcagcccctgggccagacaggcatgccacccagcttcagcaagcccaacatcgagggcgcccctggggcccccatcggcaacaccttccagcacgtgcagagcctgcccaccaagaagatcaccaagaagcccatcccagatgagcacctgatcctgaagaccacctttgaggacctgatccagcgctgcctgagcagcgccacagacccccagaccaagaggaagctggatgatgccagcaagaggctggagttcctgtatgacaagctgcgggagcagaccctgagccccaccatcaccagcggcctgcacaacatcgcccggagcattgagaccaggaactacagcgagggcctgaccatgcacacccacatcgtgtccaccagcaacttcagcgagaccagcgccttcatgcctgtgctgaaggtggtgctgacccaggccaacaagctgggcgtgtag

SEQ ID NO: 37795 - DNA, 3546 bp, Artificial Sequence
  Description of Artificial Sequence: Synthetic coding sequence
atgaagctgaaggaggtggacagaacagccatgcaggcctggagccctgcccagaaccaccccatctacctggccaccggcaccagcgcccagcagctggatgccaccttcagcaccaatgccagcctggagatctttgagctggacctgagtgaccccagcctggacatgaagagctgtgccaccttcagcagcagccaccgctaccacaagctgatctggggcccctacaagatggacagcaaaggagatgtgtctggagtgctgattgctggaggagaaaatggaaacatcatcctgtatgaccccagcaagatcatcgccggggacaaggaggtggtgattgcccagaatgacaagcacacaggccctgtgcgggccctggatgtgaacatcttccagaccaacctggtggccagcggggccaatgaaagtgagatctacatctgggacctgaacaactttgccacccccatgacccctggggccaagacccagcccccagaggacatcagctgcatcgcctggaaccggcaggtgcagcacatcctggccagcgccagccccagcggccgggccaccgtgtgggacctgaggaagaatgagcccatcatcaaggtgtctgaccacagcaacaggatgcactgcagcggcctggcctggcacccagatgtggccacccagatggtgctggcctctgaagatgaccggctgcctgtgatccagatgtgggacctgcgctttgccagcagccccctgcgggtgctggagaaccacgcccggggcatcctggccatcgcctggagcatggctgaccctgagctgctgctgagctgtgggaaggatgccaagatcctgtgcagcaaccccaacacaggagaggtgctgtatgagctgcccaccaacacccagtggtgctttgacatccagtggtgccccaggaacccagctgtgctgtctgctgccagctttgatggccgcatctctgtgtacagcatcatgggcggcagcacagatggcctgcggcagaagcaggtggacaagctgagcagcagctttggaaacctggacccctttggaacaggccagcccctgccccccctgcagatcccccagcagacagcccagcacagcatcgtgctgcccctgaagaagccacccaagtggatcagaagacctgtgggcgccagcttctcctttggaggcaagctggtgacctttgaaaatgtgaggatgcccagccaccagggcgctgagcagcagcagcagcagcaccacgtgttcatcagccaggtggtgacagagaaggagttcctgagcagaagtgaccagctgcagcaggccgtgcagagccagggcttcatcaactactgccagaagaagattgatgccagccagacagaatttgagaagaatgtgtggagcttcctgaaggtgaactttgaagatgacagccggggcaagtacctggagctgctgggctacaggaaggaggacctgggcaagaagcacatcaaggaggagaaggaggagagcgagttcctgcccagcagcggcggcaccttcaacatctctgtgtctggggacattgatggcctcatcacccaggccctgctgaccggcaactttgaatctgctgtggacctgtgcctgcatgacaacaggatggctgatgccatcatcctggccatcgccggcggccaggagctgctggcccggacccagaagaagtactttgccaagagccagagcaagatcaccaggctcatcacagctgtggtgatgaagaactggaaggagatcgtggagagctgtgacctgaagaactggagggaggccctggccgctgtgctgacctacgccaagccagatgagttcagcgccctgtgtgacctgctgggcacccggctggagaatgaaggagacagcctgctgcagacccaggcctgcctgtgctacatctgtgctggaaatgtggagaagctggtggcctgctggaccaaggcccaggacggcagccaccccctgagcctgcaggacctgattgagaaggtggtgatcctgaggaaggctgtgcagctgacccaggccatggacaccagcacagtgggcgtgctgctggccgccaagatgagccagtatgccaacctgctggccgcccagggcagcattgctgctgccctggccttcctgcctgacaacaccaaccagcccaacatcatgcagctgcgggaccggctgtgccgggcccagggcgagcctgtggccggccacgagagccccaagatcccctatgagaagcagcagctgcccaagggccggcccggccctgtggccggccaccaccagatgccccgggtgcagacccagcagtactacccccatggagaaaatcctcctcctcctggcttcatcatgcatggaaatgtgaaccccaatgctgctggccagctgcccaccagccctggccacatgcacacccaggtgcccccctacccccagccccagccctaccagcctgcccagccctaccccttcggcaccggcggcagcgccatgtaccggccccagcagcctgtggccccacccaccagcaatgcctaccccaacaccccctacatcagcagcgccagcagctacacaggccagagccagctgtatgctgcccagcaccaggccagcagccccaccagcagccctgccaccagcttccccccaccacccagcagcggggccagcttccagcacggcggccctggggccccacccagcagcagcgcctatgccctgcccccaggcaccaccggcaccctgcctgctgccagcgagctgcctgccagccagaggacaggcccccagaatggctggaatgaccccccagccctgaacagagtgcccaagaagaagaagatgcctgagaacttcatgcctcctgtgcccatcaccagccccatcatgaaccccctgggggacccccagagccagatgctgcagcagcagcccagcgcccctgtgcccctgagcagccagagcagcttcccccagccccacctgcccggcggccagcccttccatggagtgcagcagcccctgggccagacaggcatgcctccttccttcagcaagcccaacattgaaggagcccctggggcccccatcggcaacaccttccagcacgtgcagagcctgcccaccaagaagatcaccaagaagcccatcccagatgagcacctgatcctgaagaccacctttgaagatctcatccagcgctgcctgagcagcgccacagacccccagaccaagaggaagctggatgatgccagcaagaggctggagttcctgtatgacaagctgcgggagcagaccctgagccccaccatcaccagcggcctgcacaacatcgcccggagcattgagaccaggaactacagcgagggcctgaccatgcacacccacatcgtgtccaccagcaacttcagcgagaccagcgccttcatgcctgtgctgaaggtggtgctgacccaggccaacaagctgggcgtgtag

SEQ ID NO: 37796 - DNA, 3546 bp, Artificial Sequence; identical to SEQ ID NO: 37795
  Description of Artificial Sequence: Synthetic coding sequence

SEQ ID NO: 37797 - DNA, 3663 bp, Artificial Sequence
  Description of Artificial Sequence: Synthetic coding sequence
atgaagctgaaggaggtggacagaacagccatgcaggcctggagccctgcccagaaccaccccatctacctggccaccggcaccagcgcccagcagctggatgccaccttcagcaccaatgccagcctggagatctttgagctggacctgagtgaccccagcctggacatgaagagctgtgccaccttcagcagcagccaccgctaccacaagctgatctggggcccctacaagatggacagcaaaggagatgtgtctggagtgctgattgctggaggagaaaatggaaacatcatcctgtatgaccccagcaagatcatcgccggggacaaggaggtggtgattgcccagaatgacaagcacacaggccctgtgcgggccctggatgtgaacatcttccagaccaacctggtggccagcggggccaatgaaagtgagatctacatctgggacctgaacaactttgccacccccatgacccctggggccaagacccagcccccagaggacatcagctgcatcgcctggaaccggcaggtgcagcacatcctggccagcgccagccccagcggccgggccaccgtgtgggacctgaggaagaatgagcccatcatcaaggtgtctgaccacagcaacaggatgcactgcagcggcctggcctggcacccagatgtggccacccagatggtgctggcctctgaagatgaccggctgcctgtgatccagatgtgggacctgcgctttgccagcagccccctgcgggtgctggagaaccacgcccggggcatcctggccatcgcctggagcatggctgaccctgagctgctgctgagctgtgggaaggatgccaagatcctgtgcagcaaccccaacacaggagaggtgctgtatgagctgcccaccaacacccagtggtgctttgacatccagtggtgccccaggaacccagctgtgctgtctgctgccagctttgatggccgcatctctgtgtacagcatcatgggcggcagcacagatggcctgcggcagaagcaggtggacaagctgagcagcagctttggaaacctggacccctttggaacaggccagcccctgccccccctgcagatcccccagcagacagcccagcacagcatcgtgctgcccctgaagaagccacccaagtggatcagaagacctgtgggcgccagcttctcctttggaggcaagctggtgacctttgaaaatgtgaggatgcccagccaccagggcgctgagcagcagcagcagcagcaccacgtgttcatcagccaggtggtgacagagaaggagttcctgagcagaagtgaccagctgcagcaggccgtgcagagccagggcttcatcaactactgccagaagaagattgatgccagccagacagaatttgagaagaatgtgtggagcttcctgaaggtgaactttgaagatgacagccggggcaagtacctggagctgctgggctacaggaaggaggacctgggcaagaagatcgccctggccctgaacaaggtggatggagccaacgtggccctgaaggacagcgaccaggtggcccagagtgatggagaggagagccctgctgctgaggagcagctgctgggggagcacatcaaggaggagaaggaggagagcgagttcctgcccagcagcggcggcaccttcaacatctctgtgtctggggacattgatggcctcatcacccaggccctgctgactggaaactttgagagcgctgtggacctgtgcctgcatgacaacaggatggctgatgccatcatcctggccatcgccggcggccaggagctgctggcccggacccagaagaagtactttgccaagagccagagcaagatcaccaggctcatcacagctgtggtgatgaagaactggaaggagatcgtggagagctgtgacctgaagaactggagggaggccctggccgctgtgctgacctacgccaagccagatgagttcagcgccctgtgtgacctgctgggcacccggctggagaatgaaggagacagcctgctgcagacccaggcctgcctgtgctacatctgtgctggaaatgtggagaagctggtggcctgctggaccaaggcccaggacggcagccaccccctgagcctgcaggacctgattgagaaggtggtgatcctgaggaaggctgtgcagctgacccaggccatggacaccagcacagtgggcgtgctgctggccgccaagatgagccagtatgccaacctgctggccgcccagggcagcattgctgctgccctggccttcctgcctgacaacaccaaccagcccaacatcatgcagctgcgggaccggctgtgccgggcccagggcgagcctgtggccggccacgagagccccaagatcccctatgagaagcagcagctgcccaagggccggcccggccctgtggccggccaccaccagatgccccgggtgcagacccagcagtactacccccacggggagaaccccccacctcctggcttcatcatgcacggcaatgtgaaccccaatgctgctggccagctgcccaccagccctggccacatgcacacccaggtgcccccctacccccagccccagccctaccagcctgcccagccctacccctttggaactggaggcagcgccatgtaccggccccagcagcctgtggccccacccaccagcaatgcctaccccaacaccccctacatcagcagcgccagcagctacacaggccagagccagctgtatgctgcccagcaccaggccagcagccccaccagcagccctgccaccagcttccccccaccacccagcagcggggccagcttccagcacggcggccctggggccccacccagcagcagcgcctatgccctgcccccaggcaccaccggcaccctgcctgctgccagcgagctgcctgccagccagaggacaggcccccagaatggctggaatgaccccccagccctgaacagagtgcccaagaagaagaagatgcctgagaacttcatgcctcctgtgcccatcaccagccccatcatgaaccccctgggggacccccagagccagatgctgcagcagcagcccagcgcccctgtgcccctgagcagccagagcagcttcccccagccccacctgcccggcggccagcccttccacggcgtgcagcagcccctgggccagacaggcatgccacccagcttcagcaagcccaacatcgagggcgcccctggggcccccatcggcaacaccttccagcacgtgcagagcctgcccaccaagaagatcaccaagaagcccatcccagatgagcacctgatcctgaagaccacctttgaggacctgatccagcgctgcctgagcagcgccacagacccccagaccaagaggaagctggatgatgccagcaagaggctggagttcctgtatgacaagctgcgggagcagaccctgagccccaccatcaccagcggcctgcacaacatcgcccggagcattgagaccaggaactacagcgagggcctgaccatgcacacccacatcgtgtccaccagcaacttcagcgagaccagcgccttcatgcctgtgctgaaggtggtgctgacccaggccaacaagctgggcgtgtag

SEQ ID NO: 37798 - DNA, 3663 bp, Artificial Sequence; identical to SEQ ID NO: 37797
  Description of Artificial Sequence: Synthetic coding sequence

SEQ ID NO: 37799 - DNA, 3702 bp, Artificial Sequence
  Description of Artificial Sequence: Synthetic coding sequence
atgaagctgaaggaggtggacagaacagccatgcaggcctggagccctgcccagaaccaccccatctacctggccaccggcaccagcgcccagcagctggatgccaccttcagcaccaatgccagcctggagatctttgagctggacctgagtgaccccagcctggacatgaagagctgtgccaccttcagcagcagccaccgctaccacaagctgatctggggcccctacaagatggacagcaaaggagatgtgtctggagtgctgattgctggaggagaaaatggaaacatcatcctgtatgaccccagcaagatcatcgccggggacaaggaggtggtgattgcccagaatgacaagcacacaggccctgtgcgggccctggatgtgaacatcttccagaccaacctggtggccagcggggccaatgaaagtgagatctacatctgggacctgaacaactttgccacccccatgacccctggggccaagacccagcccccagaggacatcagctgcatcgcctggaaccggcaggtgcagcacatcctggccagcgccagccccagcggccgggccaccgtgtgggacctgaggaagaatgagcccatcatcaaggtgtctgaccacagcaacaggatgcactgcagcggcctggcctggcacccagatgtggccacccagatggtgctggcctctgaagatgaccggctgcctgtgatccagatgtgggacctgcgctttgccagcagccccctgcgggtgctggagaaccacgcccggggcatcctggccatcgcctggagcatggctgaccctgagctgctgctgagctgtgggaaggatgccaagatcctgtgcagcaaccccaacacaggagaggtgctgtatgagctgcccaccaacacccagtggtgctttgacatccagtggtgccccaggaacccagctgtgctgtctgctgccagctttgatggccgcatctctgtgtacagcatcatgggcggcagcacagatggcctgcggcagaagcaggtggacaagctgagcagcagctttggaaacctggacccctttggaacaggccagcccctgccccccctgcagatcccccagcagacagcccagcacagcatcgtgctgcccctgaagaagccacccaagtggatcagaagacctgtgggcgccagcttctcctttggaggcaagctggtgacctttgaaaatgtgaggatgcccagccaccagggcgctgagcagcagcagcagcagcaccacgtgttcatcagccaggtggtgacagagaaggagttcctgagcagaagtgaccagctgcagcaggccgtgcagagccagggcttcatcaactactgccagaagaagattgatgccagccagacagaatttgagaagaatgtgtggagcttcctgaaggtgaactttgaagatgacagccggggcaagtacctggagctgctgggctacaggaaggaggacctgggcaagaagatcgccctggccctgaacaaggtggatggagccaacgtggccctgaaggacagcgaccaggtggcccagagtgatggagaggagagccctgctgctgaggagcagctgctgggggagcacatcaaggaggagaaggaggagagcgagttcctgcccagcagcggcggcaccttcaacatctctgtgtctggggacattgatggcctcatcacccaggccctgctgactggaaactttgagagcgctgtggacctgtgcctgcatgacaacaggatggctgatgccatcatcctggccatcgccggcggccaggagctgctggcccggacccagaagaagtactttgccaagagccagagcaagatcaccaggctcatcacagctgtggtgatgaagaactggaaggagatcgtggagagctgtgacctgaagaactggagggaggccctggccgctgtgctgacctacgccaagccagatgagttcagcgccctgtgtgacctgctgggcacccggctggagaatgaaggagacagcctgctgcagacccaggcctgcctgtgctacatctgtgctggaaatgtggagaagctggtggcctgctggaccaaggcccaggacggcagccaccccctgagcctgcaggacctgattgagaaggtggtgatcctgaggaaggctgtgcagctgacccaggccatggacaccagcacagtgggcgtgctgctggccgccaagatgagccagtatgccaacctgctggccgcccagggcagcattgctgctgccctggccttcctgcctgacaacaccaaccagcccaacatcatgcagctgcgggaccggctgtgccgggcccagggcgagcctgtggccggccacgagagccccaagatcccctatgagaagcagcagctgcccaagggccggcccggccctgtggccggccaccaccagatgccccgggtgcagacccagcagtactacccccacggggagaaccccccacctcctggcttcatcatgcacggcaatgtgaaccccaatgctgctggccagctgcccaccagccctggccacatgcacacccaggtgcccccctacccccagccccagccctaccagcctgcccagccctacccctttggaactggaggcagcgccatgtaccggccccagcagcctgtggccccacccaccagcaatgcctaccccaacaccccctacatcagcagcgccagcagctacacaggccagagccagctgtatgctgcccagcaccaggccagcagccccaccagcagccctgccaccagcttccccccaccacccagcagcggggccagcttccagcacggcggccctggggccccacccagcagcagcgcctatgccctgcccccaggcaccaccggcaccctgcctgctgccagcgagctgcctgccagccagaggacagagaaccagagcatccaggaccaggcccccatgctggagggcccccagaatggctggaatgaccccccagccctgaacagagtgcccaagaagaagaagatgcctgagaacttcatgcctcctgtgcccatcaccagccccatcatgaaccccctgggggacccccagagccagatgctgcagcagcagcccagcgcccctgtgcccctgagcagccagagcagcttcccccagccccacctgcccggcggccagcccttccatggagtgcagcagcccctgggccagacaggcatgcctccttccttcagcaagcccaacattgaaggagcccctggggcccccatcggcaacaccttccagcacgtgcagagcctgcccaccaagaagatcaccaagaagcccatcccagatgagcacctgatcctgaagaccacctttgaagatctcatccagcgctgcctgagcagcgccacagacccccagaccaagaggaagctggatgatgccagcaagaggctggagttcctgtatgacaagctgcgggagcagaccctgagccccaccatcaccagcggcctgcacaacatcgcccggagcattgagaccaggaactacagcgagggcctgaccatgcacacccacatcgtgtccaccagcaacttcagcgagaccagcgccttcatgcctgtgctgaaggtggtgctgacccaggccaacaagctgggcgtgtag

SEQ ID NO: 37800 - DNA, 3663 bp, Artificial Sequence; identical to SEQ ID NO: 37797
  Description of Artificial Sequence: Synthetic coding sequence

SEQ ID NO: 37801 - DNA, 3204 bp, Artificial Sequence
  Description of Artificial Sequence: Synthetic coding sequence
atgaagctgaaggaggtggacagaacagccatgcaggcctggagccctgcccagaaccaccccatctacctggccaccggcaccagcgcccagcagctggatgccaccttcagcaccaatgccagcctggagatctttgagctggacctgagtgaccccagcctggacatgaagagctgtgccaccttcagcagcagccaccgctaccacaagctgatctggggcccctacaagatggacagcaaaggagatgtgtctggagtgctgattgctggaggagaaaatggaaacatcatcctgtatgaccccagcaagatcatcgccggggacaaggaggtggtgattgcccagaatgacaagcacacaggccctgtgcgggccctggatgtgaacatcttccagaccaacctggtggccagcggggccaatgaaagtgagatctacatctgggacctgaacaactttgccacccccatgacccctggggccaagacccagcccccagaggacatcagctgcatcgcctggaaccggcaggtgcagcacatcctggccagcgccagccccagcggccgggccaccgtgtgggacctgaggaagaatgagcccatcatcaaggtgtctgaccacagcaacaggatgcactgcagcggcctggcctggcacccagatgtggccacccagatggtgctggcctctgaagatgaccggctgcctgtgatccagatgtgggacctgcgctttgccagcagccccctgcgggtgctggagaaccacgcccggggcatcctggccatcgcctggagcatggctgaccctgagctgctgctgagctgtgggaaggatgccaagatcctgtgcagcaaccccaacacaggagaggtgctgtatgagctgcccaccaacacccagtggtgctttgacatccagtggtgccccaggaacccagctgtgctgtctgctgccagctttgatggccgcatctctgtgtacagcatcatgggcggcagcacagatggcctgcggcagaagcaggtggacaagctgagcagcagctttggaaacctggacccctttggaacaggccagcccctgccccccctgcagatcccccagcagacagcccagcacagcatcgtgctgcccctgaagaagccacccaagtggatcagaagacctgtgggcgccagcttctcctttggaggcaagctggtgacctttgaaaatgtgaggatgcccagccaccagggcgctgagcagcagcagcagcagcaccacgtgttcatcagccaggtggtgacagagaaggagttcctgagcagaagtgaccagctgcagcaggccgtgcagagccagggcttcatcaactactgccagaagaagattgatgccagccagacagaatttgagaagaatgtgtggagcttcctgaaggtgaactttgaagatgacagccggggcaagtacctggagctgctgggctacaggaaggaggacctgggcaagaagcacatcaaggaggagaaggaggagagcgagttcctgcccagcagcggcggcaccttcaacatctctgtgtctggggacattgatggcctcatcacccaggccctgctgaccggcaactttgaatctgctgtggacctgtgcctgcatgacaacaggatggctgatgccatcatcctggccatcgccggcggccaggagctgctggcccggacccagaagaagtactttgccaagagccagagcaagatcaccaggctcatcacagctgtggtgatgaagaactggaaggagatcgtggagagctgtgacctgaagaactggagggaggccctggccgctgtgctgacctacgccaagccagatgagttcagcgccctgtgtgacctgctgggcacccggctggagaatgaaggagacagcctgctgcagacccaggcctgcctgtgctacatctgtgctggaaatgtggagaagctggtggcctgctggaccaaggcccaggacggcagccaccccctgagcctgcaggacctgattgagaaggtggtgatcctgaggaaggctgtgcagctgacccaggccatggacaccagcacagtgggcgtgctgctggccgccaagatgagccagtatgccaacctgctggccgcccagggcagcattgctgctgccctggccttcctgcctgacaacaccaaccagcccaacatcatgcagctgcgggaccggctgtgccgggcccagggcgagcctgtggccggccacgagagccccaagatcccctatgagaagcagcagctgcccaagggccggcccggccctgtggccggccaccaccagatgccccgggtgcagacccagcagtactacccccatggagaaaatcctcctcctcctggcttcatcatgcatggaaatgtgaaccccaatgctgctggccagctgcccaccagccctggccacatgcacacccaggtgcccccctacccccagccccagaggccccagaatggctggaatgaccccccagccctgaacagagtgcccaagaagaagaagatgcctgagaacttcatgcctcctgtgcccatcaccagccccatcatgaaccccctgggggacccccagagccagatgctgcagcagcagcccagcgcccctgtgcccctgagcagccagagcagcttcccccagccccacctgcccggcggccagcccttccatggagtgcagcagcccctgggccagacaggcatgcctccttccttcagcaagcccaacattgaaggagcccctggggcccccatcggcaacaccttccagcacgtgcagagcctgcccaccaagaagatcaccaagaagcccatcccagatgagcacctgatcctgaagaccacctttgaagatctcatccagcgctgcctgagcagcgccacagacccccagaccaagaggaagctggatgatgccagcaagaggctggagttcctgtatgacaagctgcgggagcagaccctgagccccaccatcaccagcggcctgcacaacatcgcccggagcattgagaccaggaactacagcgagggcctgaccatgcacacccacatcgtgtccaccagcaacttcagcgagaccagcgccttcatgcctgtgctgaaggtggtgctgacccaggccaacaagctgggcgtgtag

SEQ ID NO: 37802 - DNA, 246 bp, Artificial Sequence
  Description of Artificial Sequence: Synthetic coding sequence
atgaagctgaaggaggtggacagaacagccatgcaggcctggagccctgcccagaaccaccccatctacctggccaccggcaccagcgcccagcagctggatgccaccttcagcaccaatgccagcctggagatctttgagctggacctgagtgaccccagcctggacatgaagagctgtgccaccttcagcagcagccaccgctaccacaagctgatctggggcccctacaagatggacagctag

SEQ ID NO: 37803 - DNA, 201 bp, Artificial Sequence
  Description of Artificial Sequence: Synthetic coding sequence
atgaagctgaaggaggtggacagaacagccatgcaggcctggagccctgcccagaaccaccccatctacctggccaccggcaccagcgcccagcagctggatgccaccttcagcaccaatgccagcctggagatctttgagctggacctgagtgaccccagcctggacatgaagagctgtgccaccttcagcagcagctag

SEQ ID NO: 37804 - DNA, 3501 bp, Artificial Sequence
  Description of Artificial Sequence: Synthetic coding sequence
atgaagctgaaggaggtggacagaacagccatgcaggcctggagccctgcccagaaccaccccatctacctggccaccggcaccagcgcccagcagctggatgccaccttcagcaccaatgccagcctggagatctttgagctggacctgagtgaccccagcctggacatgaagagctgtgccaccttcagcagcagccaccgctaccacaagctgatctggggcccctacaagatggacagcaaaggagatgtgtctggagtgctgattgctggaggagaaaatggaaacatcatcctgtatgaccccagcaagatcatcgccggggacaaggaggtggtgattgcccagaatgacaagcacacaggccctgtgcgggccctggatgtgaacatcttccagaccaacctggtggccagcggggccaatgaaagtgagatctacatctgggacctgaacaactttgccacccccatgacccctggggccaagacccagcccccagaggacatcagctgcatcgcctggaaccggcaggtgcagcacatcctggccagcgccagccccagcggccgggccaccgtgtgggacctgaggaagaatgagcccatcatcaaggtgtctgaccacagcaacaggatgcactgcagcggcctggcctggcacccagatgtggccacccagatggtgctggcctctgaagatgaccggctgcctgtgatccagatgtgggacctgcgctttgccagcagccccctgcgggtgctggagaaccacgcccggggcatcctggccatcgcctggagcatggctgaccctgagctgctgctgagctgtgggaaggatgccaagatcctgtgcagcaaccccaacacaggagaggtgctgtatgagctgcccaccaacacccagtggtgctttgacatccagtggtgccccaggaacccagctgtgctgtctgctgccagctttgatggccgcatctctgtgtacagcatcatgggcggcagcacagatggcctgcggcagaagcaggtggacaagctgagcagcagctttggaaacctggacccctttggaacaggccagcccctgccccccctgcagatcccccagcagacagcccagcacagcatcgtgctgcccctgaagaagccacccaagtggatcagaagacctgtgggcgccagcttctcctttggaggcaagctggtgacctttgaaaatgtgaggatgcccagccaccagggcgctgagcagcagcagcagcagcaccacgtgttcatcagccaggtggtgacagagaaggagttcctgagcagaagtgaccagctgcagcaggccgtgcagagccagggcttcatcaactactgccagaagaagattgatgccagccagacagaatttgagaagaatgtgtggagcttcctgaaggtgaactttgaagatgacagccggggcaagtacctggagctgctgggctacaggaaggaggacctgggcaagaagcacatcaaggaggagaaggaggagagcgagttcctgcccagcagcggcggcaccttcaacatctctgtgtctggggacattgatggcctcatcacccaggccctgctgaccggcaactttgaatctgctgtggacctgtgcctgcatgacaacaggatggctgatgccatcatcctggccatcgccggcggccaggagctgctggcccggacccagaagaagtactttgccaagagccagagcaagatcaccaggctcatcacagctgtggtgatgaagaactggaaggagatcgtggagagctgtgacctgaagaactggagggaggccctggccgctgtgctgacctacgccaagccagatgagttcagcgccctgtgtgacctgctgggcacccggctggagaatgaaggagacagcctgctgcagacccaggcctgcctgtgctacatctgtgctggaaatgtggagaagctggtggcctgctggaccaaggcccaggacggcagccaccccctgagcctgcaggacctgattgagaaggtggtgatcctgaggaaggctgtgcagctgacccaggccatggacaccagcacagtgggcgtgctgctggccgccaagatgagccagtatgccaacctgctggccgcccagggcagcattgctgctgccctggccttcctgcctgacaacaccaaccagcccaacatcatgcagctgcgggaccggctgtgccgggcccagggcgagcctgtggccggccacgagagccccaagatcccctatgagaagcagcagctgcccaagggccggcccggccctgtggccggccaccaccagatgccccgggtgcagacccagcagtactacccccatggagaaaatcctcctcctcctggcttcatcatgcatggaaatgtgaaccccaatgctgctggccagctgcccaccagccctggccacatgcacacccaggtgcccccctacccccagccccagccctaccagcctgcccagccctaccccttcggcaccggcggcagcgccatgtaccggccccagcagcctgtggccccacccaccagcaatgcctaccccaacaccccctacatcagcagcgccagcagctacacaggccagagccagctgtatgctgcccagcaccaggccagcagccccaccagcagccctgccaccagcttccccccaccacccagcagcggggccagcttccagcacggcggccctggggccccacccagcagcagcgcctatgccctgcccccaggcaccaccggcccccagaatggctggaatgaccccccagccctgaacagagtgcccaagaagaagaagatgcctgagaacttcatgcctcctgtgcccatcaccagccccatcatgaaccccctgggggacccccagagccagatgctgcagcagcagcccagcgcccctgtgcccctgagcagccagagcagcttcccccagccccacctgcccggcggccagcccttccacggcgtgcagcagcccctgggccagacaggcatgccacccagcttcagcaagcccaacatcgagggcgcccctggggcccccatcggcaacaccttccagcacgtgcagagcctgcccaccaagaagatcaccaagaagcccatcccagatgagcacctgatcctgaagaccacctttgaggacctgatccagcgctgcctgagcagcgccacagacccccagaccaagaggaagctggatgatgccagcaagaggctggagttcctgtatgacaagctgcgggagcagaccctgagccccaccatcaccagcggcctgcacaacatcgcccggagcattgagaccaggaactacagcgagggcctgaccatgcacacccacatcgtgtccaccagcaacttcagcgagaccagcgccttcatgcctgtgctgaaggtggtgctgacccaggccaacaagctgggcgtgtag

SEQ ID NO: 37805 - DNA, 84 bp, Artificial Sequence
  Description of Artificial Sequence: Synthetic coding sequence
atgaagctgaaggaggtggacagaacagccatgcaggcctggagccctgcccagaaccaccccatctacctggccaccggctag

SEQ ID NO: 37806 - DNA, 3618 bp, Artificial Sequence
  Description of Artificial Sequence: Synthetic coding sequence
atgaagctgaaggaggtggacagaacagccatgcaggcctggagccctgcccagaaccaccccatctacctggccaccggcaccagcgcccagcagctggatgccaccttcagcaccaatgccagcctggagatctttgagctggacctgagtgaccccagcctggacatgaagagctgtgccaccttcagcagcagccaccgctaccacaagctgatctggggcccctacaagatggacagcaaaggagatgtgtctggagtgctgattgctggaggagaaaatggaaacatcatcctgtatgaccccagcaagatcatcgccggggacaaggaggtggtgattgcccagaatgacaagcacacaggccctgtgcgggccctggatgtgaacatcttccagaccaacctggtggccagcggggccaatgaaagtgagatctacatctgggacctgaacaactttgccacccccatgacccctggggccaagacccagcccccagaggacatcagctgcatcgcctggaaccggcaggtgcagcacatcctggccagcgccagccccagcggccgggccaccgtgtgggacctgaggaagaatgagcccatcatcaaggtgtctgaccacagcaacaggatgcactgcagcggcctggcctggcacccagatgtggccacccagatggtgctggcctctgaagatgaccggctgcctgtgatccagatgtgggacctgcgctttgccagcagccccctgcgggtgctggagaaccacgcccggggcatcctggccatcgcctggagcatggctgaccctgagctgctgctgagctgtgggaaggatgccaagatcctgtgcagcaaccccaacacaggagaggtgctgtatgagctgcccaccaacacccagtggtgctttgacatccagtggtgccccaggaacccagctgtgctgtctgctgccagctttgatggccgcatctctgtgtacagcatcatgggcggcagcacagatggcctgcggcagaagcaggtggacaagctgagcagcagctttggaaacctggacccctttggaacaggccagcccctgccccccctgcagatcccccagcagacagcccagcacagcatcgtgctgcccctgaagaagccacccaagtggatcagaagacctgtgggcgccagcttctcctttggaggcaagctggtgacctttgaaaatgtgaggatgcccagccaccagggcgctgagcagcagcagcagcagcaccacgtgttcatcagccaggtggtgacagagaaggagttcctgagcagaagtgaccagctgcagcaggccgtgcagagccagggcttcatcaactactgccagaagaagattgatgccagccagacagaatttgagaagaatgtgtggagcttcctgaaggtgaactttgaagatgacagccggggcaagtacctggagctgctgggctacaggaaggaggacctgggcaagaagatcgccctggccctgaacaaggtggatggagccaacgtggccctgaaggacagcgaccaggtggcccagagtgatggagaggagagccctgctgctgaggagcagctgctgggggagcacatcaaggaggagaaggaggagagcgagttcctgcccagcagcggcggcaccttcaacatctctgtgtctggggacattgatggcctcatcacccaggccctgctgactggaaactttgagagcgctgtggacctgtgcctgcatgacaacaggatggctgatgccatcatcctggccatcgccggcggccaggagctgctggcccggacccagaagaagtactttgccaagagccagagcaagatcaccaggctcatcacagctgtggtgatgaagaactggaaggagatcgtggagagctgtgacctgaagaactggagggaggccctggccgctgtgctgacctacgccaagccagatgagttcagcgccctgtgtgacctgctgggcacccggctggagaatgaaggagacagcctgctgcagacccaggcctgcctgtgctacatctgtgctggaaatgtggagaagctggtggcctgctggaccaaggcccaggacggcagccaccccctgagcctgcaggacctgattgagaaggtggtgatcctgaggaaggctgtgcagctgacccaggccatggacaccagcacagtgggcgtgctgctggccgccaagatgagccagtatgccaacctgctggccgcccagggcagcattgctgctgccctggccttcctgcctgacaacaccaaccagcccaacatcatgcagctgcgggaccggctgtgccgggcccagggcgagcctgtggccggccacgagagccccaagatcccctatgagaagcagcagctgcccaagggccggcccggccctgtggccggccaccaccagatgccccgggtgcagacccagcagtactacccccacggggagaaccccccacctcctggcttcatcatgcacggcaatgtgaaccccaatgctgctggccagctgcccaccagccctggccacatgcacacccaggtgcccccctacccccagccccagccctaccagcctgcccagccctacccctttggaactggaggcagcgccatgtaccggccccagcagcctgtggccccacccaccagcaatgcctaccccaacaccccctacatcagcagcgccagcagctacacaggccagagccagctgtatgctgcccagcaccaggccagcagccccaccagcagccctgccaccagcttccccccaccacccagcagcggggccagcttccagcacggcggccctggggccccacccagcagcagcgcctatgccctgcccccaggcaccaccggcccccagaatggctggaatgaccccccagccctgaacagagtgcccaagaagaagaagatgcctgagaacttcatgcctcctgtgcccatcaccagccccatcatgaaccccctgggggacccccagagccagatgctgcagcagcagcccagcgcccctgtgcccctgagcagccagagcagcttcccccagccccacctgcccggcggccagcccttccatggagtgcagcagcccctgggccagacaggcatgcctccttccttcagcaagcccaacattgaaggagcccctggggcccccatcggcaacaccttccagcacgtgcagagcctgcccaccaagaagatcaccaagaagcccatcccagatgagcacctgatcctgaagaccacctttgaagatctcatccagcgctgcctgagcagcgccacagacccccagaccaagaggaagctggatgatgccagcaagaggctggagttcctgtatgacaagctgcgggagcagaccctgagccccaccatcaccagcggcctgcacaacatcgcccggagcattgagaccaggaactacagcgagggcctgaccatgcacacccacatcgtgtccaccagcaacttcagcgagaccagcgccttcatgcctgtgctgaaggtggtgctgacccaggccaacaagctgggcgtgtag

SEQ ID NO: 37807 - DNA, 3321 bp, Artificial Sequence; identical to SEQ ID NO: 37794
  Description of Artificial Sequence: Synthetic coding sequence

SEQ ID NO: 37808 - DNA, 498 bp, Artificial Sequence
  Description of Artificial Sequence: Synthetic coding sequence
atgaagctgaaggaggtggacagaacagccatgcaggcctggagccctgcccagaaccaccccatctacctggccaccggcaccagcgcccagcagctggatgccaccttcagcaccaatgccagcctggagatctttgagctggacctgagtgaccccagcctggacatgaagagctgtgccaccttcagcagcagccaccgctaccacaagctgatctggggcccctacaagatggacagcaaaggagatgtgtctggagtgctgattgctggaggagaaaatggaaacatcatcctgtatgaccccagcaagatcatcgccggggacaaggaggtggtgattgcccagaatgacaagcacacaggccctgtgcgggccctggatgtgaacatcttccagaccaacctggtggccagcggggccaatgaaagtgagatctacatctgggacctgaacaactttgccacccccatgacccctggggccaagacctag

SEQ ID NO: 37809 - DNA, 501 bp, Artificial Sequence
  Description of Artificial Sequence: Synthetic coding sequence
atgaagctgaaggaggtggacagaacagccatgcaggcctggagccctgcccagaaccaccccatctacctggccaccggcaccagcgcccagcagctggatgccaccttcagcaccaatgccagcctggagatctttgagctggacctgagtgaccccagcctggacatgaagagctgtgccaccttcagcagcagccaccgctaccacaagctgatctggggcccctacaagatggacagcaaaggagatgtgtctggagtgctgattgctggaggagaaaatggaaacatcatcctgtatgaccccagcaagatcatcgccggggacaaggaggtggtgattgcccagaatgacaagcacacaggccctgtgcgggccctggatgtgaacatcttccagaccaacctggtggccagcggggccaatgaaagtgagatctacatctgggacctgaacaactttgccacccccatgacccctggggccaagacccagtag

SEQ ID NO: 37810 - DNA, 3603 bp, Artificial Sequence
  Description of Artificial Sequence: Synthetic coding sequence
atgctgggggagagtgatgagcgctgcaccaatgccggcagcggctgcagaagaagcagccctggcaccagcgcccagcagctggatgccaccttcagcaccaatgccagcctggagatctttgagctggacctgagtgaccccagcctggacatgaagagctgtgccaccttcagcagcagccaccgctaccacaagctgatctggggcccctacaagatggacagcaaaggagatgtgtctggagtgctgattgctggaggagaaaatggaaacatcatcctgtatgaccccagcaagatcatcgccggggacaaggaggtggtgattgcccagaatgacaagcacactggacctgtgcgggccctggatgtgaacatcttccagaccaacctggtggccagcggggccaatgaaagtgagatctacatctgggacctgaacaactttgccacccccatgacccctggggccaagacccagcccccagaggacatcagctgcatcgcctggaaccggcaggtgcagcacatcctggccagcgccagccccagcggccgggccaccgtgtgggacctgaggaagaatgagcccatcatcaaggtgtctgaccacagcaacaggatgcactgcagcggcctggcctggcacccagatgtggccacccagatggtgctggcctctgaagatgaccggctgcccgtcatccagatgtgggacctgcgctttgccagcagccccctgcgggtgctggagaaccacgcccggggcatcctggccatcgcctggagcatggctgaccctgagctgctgctgagctgtgggaaggatgccaagatcctgtgcagcaaccccaacacaggagaggtgctgtatgagctgcccaccaacacccagtggtgctttgacatccagtggtgccccagaaatcctgctgtgctgtctgctgccagctttgatggccgcatctctgtgtacagcatcatgggcggcagcacagatggcctgcggcagaagcaggtggacaagctgagcagcagctttggaaacctggaccccttcggcaccggccagcccctgccccccctgcagatcccccagcagacagcccagcacagcatcgtgctgcccctgaagaagccacccaagtggatccggcggcctgtgggcgccagcttctcctttggaggcaagctggtgacctttgaaaatgtgaggatgcccagccaccagggcgctgagcagcagcagcagcagcaccacgtgttcatcagccaggtggtgacagagaaggagttcctgagcagaagtgaccagctgcagcaggccgtgcagagccagggcttcatcaactactgccagaagaagattgatgccagccagacagaatttgagaagaatgtgtggagcttcctgaaggtgaactttgaagatgacagccggggcaagtacctggagctgctgggctacagaaaagaagacctgggcaagaagatcgccctggccctgaacaaggtggatggagccaacgtggccctgaaggacagcgaccaggtggcccagagtgatggagaggagagccctgctgctgaggagcagctgctgggggagcacatcaaggaggagaaggaggagagcgagttcctgcccagcagcggcggcaccttcaacatctctgtgtctggggacattgatggcctcatcacccaggccctgctgaccggcaactttgaatctgctgtggacctgtgcctgcatgacaacaggatggctgatgccatcatcctggccatcgccggcggccaggagctgctggcccggacccagaagaagtactttgccaagagccagagcaagatcaccaggctcatcacagctgtggtgatgaagaactggaaggagatcgtggagagctgtgacctgaagaactggagggaggccctggccgctgtgctgacctacgccaagccagatgagttcagcgccctgtgtgacctgctgggcacccggctggagaatgaaggagacagcctgctgcagacccaggcctgcctgtgctacatctgtgctggaaatgtggagaagctggtggcctgctggaccaaggcccaggacggcagccaccccctgagcctgcaggacctgattgagaaggtggtgatcctgaggaaggctgtgcagctgacccaggccatggacaccagcacagtgggcgtgctgctggccgccaagatgagccagtatgccaacctgctggccgcccagggcagcattgctgctgccctggccttcctgcctgacaacaccaaccagcccaacatcatgcagctgcgggaccggctgtgccgggcccagggcgagcctgtggccggccacgagagccccaagatcccctatgagaagcagcagctgcccaagggccggcccggccctgtggccggccaccaccagatgccccgggtgcagacccagcagtactacccccatggagaaaatcctcctcctcctggcttcatcatgcatggaaatgtgaaccccaatgctgctggccagctgcccaccagccctggccacatgcacacccaggtgcccccctacccccagccccagccctaccagcctgcccagccctaccccttcggcaccggcggcagcgccatgtaccggccccagcagcctgtggccccacccaccagcaatgcctaccccaacaccccctacatcagcagcgccagcagctacacaggccagagccagctgtatgctgcccagcaccaggccagcagccccaccagcagccctgccaccagcttccccccaccacccagcagcggggccagcttccagcacggcggccctggggccccacccagcagcagcgcctatgccctgcccccaggcaccaccggcccccagaatggctggaatgaccccccagccctgaacagagtgcccaagaagaagaagatgcctgagaacttcatgcctcctgtgcccatcaccagccccatcatgaaccccctgggggacccccagagccagatgctgcagcagcagcccagcgcccctgtgcccctgagcagccagagcagcttcccccagccccacctgcccggcggccagcccttccacggcgtgcagcagcccctgggccagacaggcatgccacccagcttcagcaagcccaacatcgagggcgcccctggggcccccatcggcaacaccttccagcacgtgcagagcctgcccaccaagaagatcaccaagaagcccatcccagatgagcacctgatcctgaagaccacctttgaggacctgatccagcgctgcctgagcagcgccacagacccccagaccaagaggaagctggatgatgccagcaagaggctggagttcctgtatgacaagctgcgggagcagaccctgagccccaccatcaccagcggcctgcacaacatcgcccggagcattgagaccaggaactacagcgagggcctgaccatgcacacccacatcgtgtccaccagcaacttcagcgagaccagcgccttcatgcctgtgctgaaggtggtgctgacccaggccaacaagctgggcgtgtag

SEQ ID NO: 37811 - DNA, 1431 bp, Artificial Sequence
  Description of Artificial Sequence: Synthetic coding sequence
atggccatcaagttcctggaggtgatcaagcccttctgtgtgatcctgcctgagatccagaagccagagaggaagatccagttcaaggagaaggtgctgtggacagccatcaccctcttcatcttcctggtgtgctgccagatccccctgtttggcatcatgagcagtgacagcgctgaccccttctactggatgagggtcatcctggccagcaacagaggcaccctgatggagctgggcatcagccccatcgtgaccagcggcctcatcatgcagctgctggccggggccaagatcatcgaggtgggggacacccccaaggaccgggccctcttcaatggagcccagaagctgtttggcatgatcatcaccatcggccagagcatcgtgtatgtgatgacaggcatgtatggagaccccagcgagatgggcgccggcatctgcctgctgatcaccatccagctgtttgtggccggcctgattgtgctgctgctggatgagctgctgcagaagggctacggcctgggcagcggcatcagcctcttcatcgccaccaacatctgtgagaccatcgtgtggaaggccttcagccccaccaccgtgaacacaggccggggcatggagtttgaaggagccatcatcgccctcttccacctgctggccaccaggacagacaaggtgcgggccctgcgggaggccttctaccggcagaacctgcccaacctgatgaacctgattgccaccatctttgtgtttgctgtggtgatctacttccagggcttccgggtggacctgcccatcaagagcgcccgctaccggggccagtacaacacctaccccatcaagctgttctacaccagcaacatccccatcatcctgcagagcgccctggtgagcaacctgtatgtgatcagccagatgctgagcgcccgcttcagcggcaacctgctggtgtccctgctgggcacctggagcgacaccagcagcggcggccctgcccgggcctaccctgtgggcggcctgtgctactacctgagccccccagagagctttggatctgtgctggaggaccctgtgcatgctgtggtgtacatcgtgttcatgctgggcagctgtgccttcttcagcaagacctggattgaggtgtctggcagcagcgccaaggatgtggccaagcagctgaaggagcagcagatggtgatgaggggccaccgggagacctccatggtgcatgagctgaaccgctacatccccacagctgctgcctttggaggcctgtgcatcggggccctgtctgtgctggccgacttcctgggcgccatcggcagcggcaccggcatcctgctggccgtgaccatcatctaccagtactttgagatctttgtgaaggagcagagcgaggtgggctccatgggcgccctgctcttctag

SEQ ID NO: 37812 - DNA, 1071 bp, Artificial Sequence
  Description of Artificial Sequence: Synthetic coding sequence
atgatcatcaccatcggccagagcatcgtgtatgtgatgacaggcatgtatggagaccccagcgagatgggcgccggcatctgcctgctgatcaccatccagctgtttgtggccggcctgattgtgctgctgctggatgagctgctgcagaagggctacggcctgggcagcggcatcagcctcttcatcgccaccaacatctgtgagaccatcgtgtggaaggccttcagccccaccaccgtgaacacaggccggggcatggagtttgaaggagccatcatcgccctcttccacctgctggccaccaggacagacaaggtgcgggccctgcgggaggccttctaccggcagaacctgcccaacctgatgaacctgattgccaccatctttgtgtttgctgtggtgatctacttccagggcttccgggtggacctgcccatcaagagcgcccgctaccggggccagtacaacacctaccccatcaagctgttctacaccagcaacatccccatcatcctgcagagcgccctggtgagcaacctgtatgtgatcagccagatgctgagcgcccgcttcagcggcaacctgctggtgtccctgctgggcacctggagcgacaccagcagcggcggccctgcccgggcctaccctgtgggcggcctgtgctactacctgagccccccagagagctttggatctgtgctggaggaccctgtgcatgctgtggtgtacatcgtgttcatgctgggcagctgtgccttcttcagcaagacctggattgaggtgtctggcagcagcgccaaggatgtggccaagcagctgaaggagcagcagatggtgatgaggggccaccgggagacctccatggtgcatgagctgaaccgctacatccccacagctgctgcctttggaggcctgtgcatcggggccctgtctgtgctggccgacttcctgggcgccatcggcagcggcaccggcatcctgctggccgtgaccatcatctaccagtactttgagatctttgtgaaggagcagagcgaggtgggctccatgggcgccctgctcttctag

SEQ ID NO: 37813 - DNA, 1449 bp, Artificial Sequence
  Description of Artificial Sequence: Synthetic coding sequence
atgacccagacagcccgggtgctggtgaagttcctggaggtgatcaagcccttctgtgtgatcctgcctgagatccagaagccagagaggaagatccagttcaaggagaaggtgctgtggacagccatcaccctcttcatcttcctggtgtgctgccagatccccctgtttggcatcatgagcagtgacagcgctgaccccttctactggatgagggtcatcctggccagcaacagaggcaccctgatggagctgggcatcagccccatcgtgaccagcggcctcatcatgcagctgctggccggggccaagatcatcgaggtgggggacacccccaaggaccgggccctcttcaatggagcccagaagctgtttggcatgatcatcaccatcggccagagcatcgtgtatgtgatgacaggcatgtatggagaccccagcgagatgggcgccggcatctgcctgctgatcaccatccagctgtttgtggccggcctgattgtgctgctgctggatgagctgctgcagaagggctacggcctgggcagcggcatcagcctcttcatcgccaccaacatctgtgagaccatcgtgtggaaggccttcagccccaccaccgtgaacacaggccggggcatggagtttgaaggagccatcatcgccctcttccacctgctggccaccaggacagacaaggtgcgggccctgcgggaggccttctaccggcagaacctgcccaacctgatgaacctgattgccaccatctttgtgtttgctgtggtgatctacttccagggcttccgggtggacctgcccatcaagagcgcccgctaccggggccagtacaacacctaccccatcaagctgttctacaccagcaacatccccatcatcctgcagagcgccctggtgagcaacctgtatgtgatcagccagatgctgagcgcccgcttcagcggcaacctgctggtgtccctgctgggcacctggagcgacaccagcagcggcggccctgcccgggcctaccctgtgggcggcctgtgctactacctgagccccccagagagctttggatctgtgctggaggaccctgtgcatgctgtggtgtacatcgtgttcatgctgggcagctgtgccttcttcagcaagacctggattgaggtgtctggcagcagcgccaaggatgtggccaagcagctgaaggagcagcagatggtgatgaggggccaccgggagacctccatggtgcatgagctgaaccgctacatccccacagctgctgcctttggaggcctgtgcatcggggccctgtctgtgctggccgacttcctgggcgccatcggcagcggcaccggcatcctgctggccgtgaccatcatctaccagtactttgagatctttgtgaaggagcagagcgaggtgggctccatgggcgccctgctcttctag

SEQ ID NO: 37814 - DNA, 1431 bp, Artificial Sequence
  Description of Artificial Sequence: Synthetic coding sequence
atgggcatcaagttcctggaggtgatcaagcccttctgtgctgtgctgcctgagatccagaagccagagaggaagatccagttccgggagaaggtgctgtggacagccatcaccctcttcatcttcctggtgtgctgccagatccccctgtttggcatcatgagcagtgacagcgctgaccccttctactggatgagggtcatcctggccagcaacagaggcaccctgatggagctgggcatcagccccatcgtgaccagcggcctcatcatgcagctgctggccggggccaagatcatcgaggtgggggacacccccaaggaccgggccctcttcaatggagcccagaagctgtttggcatgatcatcaccatcggccaggccatcgtgtatgtgatgacaggcatgtatggagaccctgctgagatgggcgccggcatctgcctgctgatcatcatccagctgtttgtggccggcctgattgtgctgctgctggatgagctgctgcagaagggctacggcctgggcagcggcatcagcctcttcatcgccaccaacatctgtgagaccatcgtgtggaaggccttcagccccaccaccatcaacacaggccggggcacagaatttgaaggagctgtgattgccctcttccacctgctggccaccaggacagacaaggtgcgggccctgcgggaggccttctaccggcagaacctgcccaacctgatgaacctgattgccaccgtgtttgtgtttgctgtggtgatctacttccagggcttccgggtggacctgcccatcaagagcgcccgctaccggggccagtacagcagctaccccatcaagctgttctacaccagcaacatccccatcatcctgcagagcgccctggtgagcaacctgtatgtgatcagccagatgctgtctgtgcgcttcagcggcaacttcctggtgaacctgctgggccagtgggcagatgtgtctgggggcggccctgcccggagctaccctgtgggcggcctgtgctactacctgagccccccagagagcatgggcgccatctttgaggaccctgtgcacgtggtggtgtacatcatcttcatgctgggcagctgtgccttcttcagcaagacctggattgaggtgtctggcagcagcgccaaggatgtggccaagcagctgaaggagcagcagatggtgatgaggggccaccgggacacctccatggtgcatgagctgaaccgctacatccccacagctgctgcctttggaggcctgtgcatcggggccctgtctgtgctggccgacttcctgggcgccatcggcagcggcaccggcatcctgctggccgtgaccatcatctaccagtactttgagatctttgtgaaggagcaggccgaggtgggcggcatgggcgccctcttcttctag

SEQ ID NO: 37815 - DNA, 1314 bp, Artificial Sequence
  Description of Artificial Sequence: Synthetic coding sequence
atgggcatcaagttcctggaggtgatcaagcccttctgtgctgtgctgcctgagatccagaagccagagaggaagatccagttccgggagaaggtgctgtggacagccatcaccctcttcatcttcctggtgtgctgccagatccccctgtttggcatcatgagcagtgacagcgctgaccccttctactggatgagggtcatcctggccagcaacagaggcaccctgatggagctgggcatcagccccatcgtgaccagcggcctcatcatgcagctgctggccggggccaagatcatcgaggtgggggacacccccaaggaccgggccctcttcaatggagcccagaagctgtttggcatgatcatcaccatcggccaggccatcgtgtatgtgatgacaggcatgtatggagaccctgctgagatgggcgccggcatctgcctgctgatcatcatccagctgtttgtggccggcctgattgtgctgctgctggatgagctgctgcagaagggctacggcctgggcagcggcatcagcctcttcatcgccaccaacatctgtgagaccatcgtgtggaaggccttcagccccaccaccatcaacacaggccggggcacagaatttgaaggagctgtgattgccctcttccacctgctggccaccaggacagacaaggtgcgggccctgcgggaggccttctaccggcagaacctgcccaacctgatgaacctgattgccaccgtgtttgtgtttgctgtggtgatctacttccagggcttccgggtggacctgcccatcaagagcgcccgctaccggggccagtacagcagctaccccatcaagctgttctacaccagcaacatccccatcatcctgcagagcgccctggtgagcaacctgtatgtgatcagccagatgctgtctgtgcgcttcagcggcaacttcctggtgaacctgctgggccagtgggcagatgtgtctgggggcggccctgcccggagctaccctgtgggcggcctgtgctactacctgagccccccagagagcatgggcgccatctttgaggaccctgtgcacgtggtggtgtacatcatcttcatgctgggcagctgtgccttcttcagcaagacctggattgaggtgtctggcagcagcgccaaggatgtggccaagcagctgaaggagcagcagatggtgatgaggggccaccgggacacctccatggtgcatgagctgaaccggcccaaggtgaagctgcggcgctggaagggggagggccgccacttcaccaagaggatcctcttctactag

SEQ ID NO: 37816 - DNA, 507 bp, Artificial Sequence
  Description of Artificial Sequence: Synthetic coding sequence
atgggcatcaagttcctggaggtgatcaagcccttctgtgctgtgctgcctgagatccagaagccagagaggaagatccagttccgggagaaggtgctgtggacagccatcaccctcttcatcttcctggtgtgctgccagatccccctgtttggcatcatgagcagtgacagcgctgaccccttctactggatgagggtcatcctggccagcaacagaggcaccctgatggagctgggcatcagccccatcgtgaccagcggcctcatcatgcagctgctggccggggccaagatcatcgaggtgggggacacccccaaggaccgggccctcttcaatggagcccagaagctgtttggcatgatcatcaccatcggccaggccatcgtgtatgtgatgacaggcatgtatggagaccctgctgagatgggcgccggcatctgcctgctgatcatcatccaggccctgctgaccctgaagatctgtggctacacagaggagctgtag

SEQ ID NO: 37817 - DNA, 1233 bp, Artificial Sequence
  Description of Artificial Sequence: Synthetic coding sequence
atgggcatcaagttcctggaggtgatcaagcccttctgtgctgtgctgcctgagatccagaagccagagaggaagatccagttccgggagaaggtgctgtggacagccatcaccctcttcatcttcctggtgtgctgccagatccccctgtttggcatcatgagcagtgacagcgctgaccccttctactggatgagggtcatcctggccagcaacagaggcaccctgatggagctgggcatcagccccatcgtgaccagcggcctcatcatgcagctgctggccggggccaagatcatcgaggtgggggacacccccaaggaccgggccctcttcaatggagcccagaagctgtttggcatgatcatcaccatcggccaggccatcgtgtatgtgatgacaggcatgtatggagaccctgctgagatgggcgccggcatctgcctgctgatcatcatccagctgtttgtggccggcctgattgtgctgctgctggatgagctgctgcagaagggctacggcctgggcagcggcatcagcctcttcatcgccaccaacatctgtgagaccatcgtgtggaaggccttcagccccaccaccatcaacacaggccggggcacagaatttgaaggagctgtgattgccctcttccacctgctggccaccaggacagacaaggtgcgggccctgcgggaggccttctaccggcagaacctgcccaacctgatgaacctgattgccaccgtgtttgtgtttgctgtggtgatctacttccaggatgtgtctgggggcggccctgcccggagctaccctgtgggcggcctgtgctactacctgagccccccagagagcatgggcgccatctttgaggaccctgtgcacgtggtggtgtacatcatcttcatgctgggcagctgtgccttcttcagcaagacctggattgaggtgtctggcagcagcgccaaggatgtggccaagcagctgaaggagcagcagatggtgatgaggggccaccgggacacctccatggtgcatgagctgaaccgctacatccccacagctgctgcctttggaggcctgtgcatcggggccctgtctgtgctggccgacttcctgggcgccatcggcagcggcaccggcatcctgctggccgtgaccatcatctaccagtactttgagatctttgtgaaggagcaggccgaggtgggcggcatgggcgccctcttcttctag

SEQ ID NO: 37818 - DNA, 1365 bp, Artificial Sequence
  Description of Artificial Sequence: Synthetic coding sequence
atgggcatcaagttcctggaggtgatcaagcccttctgtgctgtgctgcctgagatccagaagccagagaggaagatccccctgtttggcatcatgagcagtgacagcgctgaccccttctactggatgagggtcatcctggccagcaacagaggcaccctgatggagctgggcatcagccccatcgtgaccagcggcctcatcatgcagctgctggccggggccaagatcatcgaggtgggggacacccccaaggaccgggccctcttcaatggagcccagaagctgtttggcatgatcatcaccatcggccaggccatcgtgtatgtgatgacaggcatgtatggagaccctgctgagatgggcgccggcatctgcctgctgatcatcatccagctgtttgtggccggcctgattgtgctgctgctggatgagctgctgcagaagggctacggcctgggcagcggcatcagcctcttcatcgccaccaacatctgtgagaccatcgtgtggaaggccttcagccccaccaccatcaacacaggccggggcacagaatttgaaggagctgtgattgccctcttccacctgctggccaccaggacagacaaggtgcgggccctgcgggaggccttctaccggcagaacctgcccaacctgatgaacctgattgccaccgtgtttgtgtttgctgtggtgatctacttccagggcttccgggtggacctgcccatcaagagcgcccgctaccggggccagtacagcagctaccccatcaagctgttctacaccagcaacatccccatcatcctgcagagcgccctggtgagcaacctgtatgtgatcagccagatgctgtctgtgcgcttcagcggcaacttcctggtgaacctgctgggccagtgggcagatgtgtctgggggcggccctgcccggagctaccctgtgggcggcctgtgctactacctgagccccccagagagcatgggcgccatctttgaggaccctgtgcacgtggtggtgtacatcatcttcatgctgggcagctgtgccttcttcagcaagacctggattgaggtgtctggcagcagcgccaaggatgtggccaagcagctgaaggagcagcagatggtgatgaggggccaccgggacacctccatggtgcatgagctgaaccgctacatccccacagctgctgcctttggaggcctgtgcatcggggccctgtctgtgctggccgacttcctgggcgccatcggcagcggcaccggcatcctgctggccgtgaccatcatctaccagtactttgagatctttgtgaaggagcaggccgaggtgggcggcatgggcgccctcttcttctag

SEQ ID NO: 37819 - DNA, 480 bp, Artificial Sequence
  Description of Artificial Sequence: Synthetic coding sequence
atgggcatcaagttcctggaggtgatcaagcccttctgtgctgtgctgcctgagatccagaagccagagaggaagatccagttccgggagaaggtgctgtggacagccatcaccctcttcatcttcctggtgtgctgccagatccccctgtttggcatcatgagcagtgacagcgctgaccccttctactggatgagggtcatcctggccagcaacagaggcaccctgatggagctgggcatcagccccatcgtgaccagcggcctcatcatgcagctgctggccggggccaagatcatcgaggtgggggacacccccaaggaccgggccctcttcaatggagcccagaagctgtttggcatgatcatcaccatcggccaggccatcgtgtatgtgatgacaggcatgtatggagaccctgctgagatgggcgccggcatctgcctgctgatcatcatccaggaccagcacagcccctag

SEQ ID NO: 37820 - DNA, 438 bp, Artificial Sequence
  Description of Artificial Sequence: Synthetic coding sequence
tgaagtgacagcgctgaccccttctactggatgagggtcatcctggccagcaacagaggcaccctgatggagctgggcatcagccccatcgtgaccagcggcctcatcatgcagctgctggccggggccaagatcatcgaggtgggggacacccccaaggaccgggccctcttcaatggagcccagaagctgtttggcatgatcatcaccatcggccaggccatcgtgtatgtgatgacaggcatgtatggagaccctgctgagatgggcgccggcatctgcctgctgatcatcatccagggcttccgggtggacctgcccatcaagagcgcccgctaccggggccagtacagcagctaccccatcaagctgttctacaccagcaacatccccatcatcctgcagagcgccctggtgagcaacctgtatgtgatctag

SEQ ID NO: 37821 - DNA, 687 bp, Artificial Sequence
  Description of Artificial Sequence: Synthetic coding sequence
tgaggcatgatcatcaccatcggccaggccatcgtgtatgtgatgacaggcatgtatggagaccctgctgagatgggcgccggcatctgcctgctgatcatcatccagctgtttgtggccggcctgattgtgctgctgctggatgagctgctgcagaagggctacggcctgggcagcggcatcagcctcttcatcgccaccaacatctgtgagaccatcgtgtggaaggccttcagccccaccaccatcaacacaggccggggcacagaatttgaaggagctgtgattgccctcttccacctgctggccaccaggacagacaaggtgcgggccctgcgggaggccttctaccggcagaacctgcccaacctgatgaacctgattgccaccgtgtttgtgtttgctgtggtgatctacttccaggtggccaagcagctgaaggagcagcagatggtgatgaggggccaccgggacacctccatggtgcatgagctgaaccgctacatccccacagctgctgcctttggaggcctgtgcatcggggccctgtctgtgctggccgacttcctgggcgccatcggcagcggcaccggcatcctgctggccgtgaccatcatctaccagtactttgagatctttgtgaaggagcaggccgaggtgggcggcatgggcgccctcttcttctag

SEQ ID NO: 37822 - DNA, 633 bp, Artificial Sequence
  Description of Artificial Sequence: Synthetic coding sequence
aagtacaacctcttcaccaagggcttccgggtggacctgcccatcaagagcgcccgctaccggggccagtacagcagctaccccatcaagctgttctacaccagcaacatccccatcatcctgcagagcgccctggtgagcaacctgtatgtgatcagccagatgctgtctgtgcgcttcagcggcaacttcctggtgaacctgctgggccagtgggcagatgtgtctgggggcggccctgcccggagctaccctgtgggcggcctgtgctactacctgagccccccagagagcatgggcgccatctttgaggaccctgtgcacgtggtggtgtacatcatcttcatgctgggcagctgtgccttcttcagcaagacctggattgaggtgtctggcagcagcgccaaggatgtggccaagcagctgaaggagcagcagatggtgatgaggggccaccgggacacctccatggtgcatgagctgaaccgctacatccccacagctgctgcctttggaggcctgtgcatcggggccctgtctgtgctggccgacttcctgggcgccatcggcagcggcaccggcatcctgctggccgtgaccatcatctaccagtactttgagatctttgtgtag

SEQ ID NO: 37823 - DNA, 570 bp, Artificial Sequence
  Description of Artificial Sequence: Synthetic coding sequence
atgggcatcaagttcctggaggtgatcaagcccttctgtgctgtgctgcctgagatccagaagccagagaggaagatccagttccgggagaaggtgctgtggacagccatcaccctcttcatcttcctggtgtgctgccagatccccctgtttggcatcatgagcagtgacagcgctgaccccttctactggatgagggtcatcctggccagcaacagaggcaccctgatggagctgggcatcagccccatcgtgaccagcggcctcatcatgcagctgctggccggggccaagatcatcgaggtgggggacacccccaaggaccgggccctcttcaatggagcccagaagaggacagaatttgaaggagctgtgattgccctcttccacctgctggccaccaggacagacaaggtgcgggccctgcgggaggccttctaccggcagaacctgcccaacctgatgaacctgattgccaccgtgtttgtgtttgctgtggtgatctacttccagggcttccgggtggacctgcccatcaagagcgcccgctaccggggccagtacagctag

SEQ ID NO: 37824 - DNA, 285 bp, Artificial Sequence
  Description of Artificial Sequence: Synthetic coding sequence
tgattccgggagaaggtgctgtggacagccatcaccctcttcatcttcctggtgtgctgccagatccccctgtttggcatcatgagcagtgacagcgctgaccccttctactggatgagggtcatcctggccagcaacagaggcaccctgatggagctgggcatcagccccatcgtgaccagcggcctcatcatgcagctgctggccggggccaagatcatcgaggtgggggacacccccaaggaccgggccctcttcaatggagcccagaagcgggagcactag

SEQ ID NO: 37825 - DNA, 1257 bp, Artificial Sequence
  Description of Artificial Sequence: Synthetic coding sequence
atgggcatcaagttcctggaggtgatcaagcccttctgtgctgtgctgcctgagatccagaagccagagaggaagatccagttccgggagaaggtgctgtggacagccatcaccctcttcatcttcctggtgtgctgccagatccccctgtttggcatcatgagcagtgacagcgctgaccccttctactggatgagggtcatcctggccagcaacagaggcaccctgatggagctgggcatcagccccatcgtgaccagcggcctcatcatgcagctgctggccggggccaagatcatcgaggtgggggacacccccaaggaccgggccctcttcaatggagcccagaagctgtttggcatgatcatcaccatcggccaggccatcgtgtatgtgatgacaggcatgtatggagaccctgctgagatgggcgccggcatctgcctgctgatcatcatccagctgtttgtggccggcctgattgtgctgctgctggatgagctgctgcagaagggctacggcctgggcagcggcatcagcctcttcatcgccaccaacatctgtgagaccatcgtgtggaaggccttcagccccaccaccatcaacacaggccggggcacagaatttgaaggagctgtgattgccctcttccacctgctggccaccaggacagacaaggtgcgggccctgcgggaggccttctaccggcagaacctgcccaacctgatgaacctgattgccaccgtgtttgtgtttgctgtggtgatctacttccagggcttccgggtggacctgcccatcaagagcgcccgctaccggggccagtacagcagctaccccatcaagctgttctacaccagcaacatccccatcatcctgcagagcgccctggtgagcaacctgtatgtgatcagccagatgctgtctgtgcgcttcagcggcaacttcctggtgaacctgctgggccagtgggcagatgtgtctgggggcggccctgcccggagctaccctgtgggcggcctgtgctactacctgagccccccagagagcatgggcgccatctttgaggaccctgtgcacgtggtggtgtacatcatcttcatgctgggcagctgtgccttcttcagcaagacctggattgaggtgtctggcagcagcgccaaggatgtggccaagcagctgaaggagcagcagatggtgatgaggggccaccgggacacctccatggtgcatgagctgaacagcgcccgggcctag

SEQ ID NO: 37826 - DNA, 975 bp, Artificial Sequence
  Description of Artificial Sequence: Synthetic coding sequence
atgctgaagagctgcagccgggccagcttcagccccagcgtgaggaagcccccactcatcctgcggcggctgctgtctgaagatgtgggcatggacatcccctttgaggagggcgtgctgagccccagcgctgctgacatgaggcctgagccccccaacagcctggacctgaatgacacccacccccggcgcatcaagctgacagcccccaacatcaacctgagcctggaccagagcgagggcagcatcctgagtgatgacaacctggacagcccagatgaaattgacatcaacgtggatgagctggacaccccagatgaggccgacagctttgagtacacaggccacgaggaccccacagccaacaaggacagcggccaggagagcgagagcatccctgagtacacagctgaggaggagcgggaggacaaccggctgtggaggacagtggtgattggagagcaggagcagagaattgacatgaaggtgattgagccctaccgccgggtcatcagccatggaggctactatggagatggcctgaatgccatcatcgtgtttgctgcctgcttcctgcctgacagcagcagagctgactaccactacgtgatggagaacctcttcctgtatgtgatcagcaccctggagctgatggtggccgaggactacatgattgtgtacctgaatggagccacccccaggaggaggatgcctggcctgggctggatgaagaagtgctaccagatgattgaccggcggctgaggaagaacctgaagagcttcatcatcgtgcaccccagctggttcatccgcaccatcctggccgtgacccggcccttcatcagcagcaagttcagcagcaagatcaagtatgtgaacagcctgtctgagctgagcggcctcatccccatggactgcatccacatccctgagagcatcatcaacatcgacctgaagctgaaggagaagccctag

SEQ ID NO: 37827 - DNA, 207 bp, Artificial Sequence
  Description of Artificial Sequence: Synthetic coding sequence
atggaccaggtgatgcagtttgtggagcccagccggcagtttgtgaaggacagcatccggctggtgaagcgctgcaccaagccagacaggaaggagttccagaagatcgccatggccacagccatcggctttgccatcatgggcttcatcggcttctttgtgaagctgatccacatccccatcaacaacatcatcgtgggcggctag

SEQ ID NO: 37828 - DNA, 207 bp, Artificial Sequence; identical to SEQ ID NO: 37827
  Description of Artificial Sequence: Synthetic coding sequence

SEQ ID NO: 37829 - DNA, 207 bp, Artificial Sequence; identical to SEQ ID NO: 37827
  Description of Artificial Sequence: Synthetic coding sequence

SEQ ID NO: 37830 - DNA, 207 bp, Artificial Sequence; identical to SEQ ID NO: 37827
  Description of Artificial Sequence: Synthetic coding sequence

SEQ ID NO: 37831 - DNA, 2610 bp, Artificial Sequence
  Description of Artificial Sequence: Synthetic coding sequence
atggctgctgtgcccacccagccccagagcaaggagggcccctggagccctgagagcgagagccccatgctgcgcatcacagcccccctgcccccaggccccagcatggctgtgcccaccctgggccctggagagatcgccagcaccaccccacccagccgggcctggacccccacccaggagggccctggggacatgggccggccctgggtggccgaggtggtgtcccagggcgccggcatcggcatccagggcaccatcaccagcagcacagccagcggagatgatgaggagaccaccaccaccaccaccatcatcaccaccaccatcaccaccgtgcagaccccaggcccctgctcctggaacttcagcggccctgagggcagcctggacagccccacagacctgagcagccccacagatgtgggcctggactgcttcttctacatctctgtgtacccaggctacggcgtggagatcaaggtgcagaacatcagcctgcgggagggggagaccgtgacagtggagggcctgggcggccctgaccccctgcccctggccaaccagagcttcctgctgcggggccaggtgatccgcagccccacccaccaggccgccctgcgcttccagagcctgcccccacctgctggccctggcaccttccacttccactaccaggcctacctgctgagctgccacttcccccggcggcctgcctatggagatgtgacagtgaccagcctgcaccctgggggcagcgcccgcttccactgtgccaccggctaccagctgaagggggcccggcacctgacctgcctgaatgccacccagcccttctgggacagcaaggagcctgtgtgcatcgccgcctgtggcggcgtcatcagaaatgccaccaccggcagaattgtgtccccaggcttccctggcaactacagcaacaacctgacctgccactggctgctggaggcccctgagggccagaggctgcacctgcactttgagaaggtgtccctggctgaagatgatgacaggctcatcatcagaaatggagacaacgtggaggcccctcctgtgtatgacagctatgaggtggagtacctgcccatcgagggcctgctgagcagcggcaagcacttctttgtggagctgagcacagacagcagtggagctgctgctggcatggccctgcgctatgaggccttccagcagggccactgctatgagccctttgtgaagtatggcaacttcagcagcagcacccccacctaccctgtgggcaccaccgtggagttcagctgtgaccccggctacaccctggagcagggcagcatcatcattgaatgtgtggacccccatgacccccagtggaatgaaacagagcccgcctgcagagctgtgtgcagcggggagatcacagattctgctggggtggtgctgagccccaactggccagagccctacggccggggccaggactgcatctggggcgtgcacgtggaggaggacaagaggatcatgctggacatccgggtgctgagaattggccctggagatgtgctgaccttctatgatggagatgacctgacagcccgggtgctgggccagtacagcggccccaggagccacttcaagctgttcacctccatggctgatgtgaccatccagttccagagcgaccccggcacctctgtgctgggctaccagcagggcttcgtcatccacttctttgaggtgcccagaaatgacacctgcccagagctgcctgagatccccaacggctggaagagccccagccagcctgagctggtgcatggaacagtggtgacctaccagtgctacccaggctaccaggtggtgggcagctctgtgctgatgtgccagtgggacctgacctggagcgaggacctgcccagctgccagagggtgaccagctgccacgaccctggagatgtggagcacagccggcggctcatcagcagccccaagtttcctgtgggcgccaccgtgcagtacatctgtgaccagggctttgtgctgatgggcagcagcatcctgacctgccacgaccggcaggccggcagccccaagtggagcgaccgggcccccaagtgcctgctggagcagctgaagccctgccacggcctgagcgccccagaaaatggagcccggagccctgagaagcagctgcaccctgctggggccaccatccacttcagctgtgcccctggctacgtgctgaagggccaggccagcatcaagtgtgtgcccggccaccccagccactggagcgaccccccacccatctgccgggccgccagcctggatggcttctacaacagccgcagcctggatgtggccaaggccccagctgccagcagcaccctggatgctgcccacatcgctgctgccatcttcctgcccctggtggccatggtgctgctggtgggcggcgtgtacttctacttcagccggctgcagggcaagagcagcctgcagctgccccggccccggccccggccctacaaccgcatcaccattgaaagtgcctttgacaaccccacctatgagaccggcagcctgagctttgctggagatgagcgcatctag

SEQ ID NO: 37832 - DNA, 1527 bp, Artificial Sequence
  Description of Artificial Sequence: Synthetic coding sequence
atgaggcctgtggccctgctgctgctgcccagcctgctggccctgctggcccacggcctgagcctggaggcccccaccgtgggcaagggccaggcccctggcatcgaggagacagatggagagctgacagctgcccccaccccagagcagcctgagcggggcgtgcactttgtgaccacagcccccaccctgaagctgctgaaccaccaccccctgctggaggagttcctgcaggagggcctggagaagggagatgaggagctgcggcctgccctgcccttccagcctgaccccccagcccccttcacccccagccccctgccccggctggccaaccaggacagcaggcctgtgttcaccagccccaccccagccatggctgctgtgcccacccagccccagagcaaggagggcccctggagccctgagagcgagagccccatgctgcgcatcacagcccccctgcccccaggccccagcatggctgtgcccaccctgggccctggagaaattgccagcaccaccccacccagccgggcctggacccccacccaggagggccctggggacatgggccggccctgggtggccgaggtggtgtcccagggcgccggcatcggcatccagggcaccatcaccagcagcacagccagcggagatgatgaggagaccaccaccaccaccaccatcatcaccaccaccatcaccaccgtgcagaccccaggcccctgctcctggaacttcagcggccctgagggcagcctggacagccccacagacctgagcagccccacagatgtgggcctggactgcttcttctacatctctgtgtacccaggctatggagtggagatcaaggtgcagaacatcagcctgcgggagggggagaccgtgacagtggagggcctgggcggccctgaccccctgcccctggccaaccagagcttcctgctgcggggccaggtgatccgcagccccacccaccaggccgccctgcgcttccagagcctgcccccacctgctggccctggcaccttccacttccactaccaggcctacctgctgagctgccacttccccaggaggcctgcctatggagatgtgacagtgaccagcctgcaccctgggggcagcgcccgcttccactgtgccaccggctaccagctgaagggggcccggcacctgacctgcctgaatgccacccagcccttctgggacagcaaggagcctgtgtgcatcgccgcctgtggcggcgtcatcagaaatgccaccaccggccgcatcgtgtccccaggcttccctggcaactacagcaacaacctgacctgccactggctgctggaggcccctgagggccagaggctgcacctgcactttgagaaggtgtccctggccgaggatgatgacaggctcatcatcagaaatggagacaacgtggaggcccctcctgtgtatgacagctatgaggtgacagcccctcctcctcctccacccctgcagccccactaccaccgggtgtctgtgtag

SEQ ID NO: 37833 - DNA, 2985 bp, Artificial Sequence
  Description of Artificial Sequence: Synthetic coding sequence
atgaggcctgtggccctgctgctgctgcccagcctgctggccctgctggcccacggcctgagcctggaggcccccaccgtgggcaagggccaggcccctggcatcgaggagacagatggagagctgacagctgcccccaccccagagcagcctgagcggggcgtgcactttgtgaccacagcccccaccctgaagctgctgaaccaccaccccctgctggaggagttcctgcaggagggcctggagaagggagatgaggagctgcggcctgccctgcccttccagcctgaccccccagcccccttcacccccagccccctgccccggctggccaaccaggacagcaggcctgtgttcaccagccccaccccagccatggctgctgtgcccacccagccccagagcaaggagggcccctggagccctgagagcgagagccccatgctgcgcatcacagcccccctgcccccaggccccagcatggctgtgcccaccctgggccctggagaaattgccagcaccaccccacccagccgggcctggacccccacccaggagggccctggggacatgggccggccctgggtggccgaggtggtgtcccagggcgccggcatcggcatccagggcaccatcaccagcagcacagccagcggagatgatgaggagaccaccaccaccaccaccatcatcaccaccaccatcaccaccgtgcagaccccaggcccctgctcctggaacttcagcggccctgagggcagcctggacagccccacagacctgagcagccccacagatgtgggcctggactgcttcttctacatctctgtgtacccaggctatggagtggagatcaaggtgcagaacatcagcctgcgggagggggagaccgtgacagtggagggcctgggcggccctgaccccctgcccctggccaaccagagcttcctgctgcggggccaggtgatccgcagccccacccaccaggccgccctgcgcttccagagcctgcccccacctgctggccctggcaccttccacttccactaccaggcctacctgctgagctgccacttccccaggaggcctgcctatggagatgtgacagtgaccagcctgcaccctgggggcagcgcccgcttccactgtgccaccggctaccagctgaagggggcccggcacctgacctgcctgaatgccacccagcccttctgggacagcaaggagcctgtgtgcatcgccgcctgtggcggcgtcatcagaaatgccaccaccggccgcatcgtgtccccaggcttccctggcaactacagcaacaacctgacctgccactggctgctggaggcccctgagggccagaggctgcacctgcactttgagaaggtgtccctggccgaggatgatgacaggctcatcatcagaaatggagacaacgtggaggcccctcctgtgtatgacagctatgaggtggagtacctgcccatcgagggcctgctgagcagcggcaagcacttctttgtggagctgagcacagacagcagcggggctgctgctggcatggccctgcgctatgaggccttccagcagggccactgctatgagccctttgtgaagtatggcaacttcagcagcagcacccccacctaccctgtgggcaccaccgtggagttcagctgtgaccccggctacaccctggagcagggcagcatcatcattgaatgtgtggacccccatgacccccagtggaatgaaacagagcccgcctgcagagctgtgtgcagcggggagatcacagacagcgctggggtggtgctgagccccaactggccagagccctacggccggggccaggactgcatctggggcgtgcacgtggaggaggacaagaggatcatgctggacatccgggtgctgcgcatcggccctggagatgtgctgaccttctatgatggagatgacctgacagcccgggtgctgggccagtacagcggccccaggagccacttcaagctgttcacctccatggctgatgtgaccatccagttccagagcgaccccggcacctctgtgctgggctaccagcagggctttgtgatccacttctttgaggtgcccagaaatgacacctgcccagagctgcctgagatccccaacggctggaagagccccagccagcctgagctggtgcacggcaccgtggtgacctaccagtgctacccaggctaccaggtggtgggcagctctgtgctgatgtgccagtgggacctgacctggagcgaggacctgcccagctgccagagggtgaccagctgccacgaccctggagatgtggagcacagcagaagactcatcagcagccccaagtttcctgtgggcgccaccgtgcagtacatctgtgaccagggctttgtgctgatgggcagcagcatcctgacctgccacgaccggcaggccggcagccccaagtggagcgaccgggcccccaagtgcctgctggagcagctgaagccctgccacggcctgagcgccccagaaaatggagcccggagccctgagaagcagctgcaccctgctggggccaccatccacttcagctgtgcccctggctacgtgctgaagggccaggccagcatcaagtgtgtgcccggccaccccagccactggagcgaccccccacccatctgcagagctgccagcctggatggcttctacaacagccgcagcctggatgtggccaaggccccagctgccagcagcaccctggatgctgcccacatcgccgccgccatcttcctgcccctggtggccatggtgctgctggtgggcggcgtgtacttctacttcagccggctgcagggcaagagcagcctgcagctgccccggccccggccccggccctacaaccgcatcaccatcgagagcgcctttgacaaccccacctatgaaacaggcagcctgagctttgctggagatgagcgcatctag

SEQ ID NO: 37834 - DNA, 2982 bp, Artificial Sequence
  Description of Artificial Sequence: Synthetic coding sequence
atgaggcctgtggccctgctgctgctgcccagcctgctggccctgctggcccacggcctgagcctggaggcccccaccgtgggcaagggccaggcccctggcatcgaggagacagatggagagctgacagctgcccccaccccagagcagcctgagcggggcgtgcactttgtgaccacagcccccaccctgaagctgctgaaccaccaccccctgctggaggagttcctgcaggagggcctggagaagggagatgaggagctgcggcctgccctgcccttccagcctgaccccccagcccccttcacccccagccccctgccccggctggccaaccaggacagcaggcctgtgttcaccagccccaccccagccatggctgctgtgcccacccagccccagagcaaggagggcccctggagccctgagagcgagagccccatgctgcgcatcacagcccccctgcccccaggccccagcatggctgtgcccaccctgggccctggagaaattgccagcaccaccccacccagccgggcctggacccccacccaggagggccctggggacatgggccggccctgggtggccgaggtggtgtcccagggcgccggcatcggcatccagggcaccatcaccagcagcacagccagcggagatgatgaggagaccaccaccaccaccaccatcatcaccaccaccatcaccaccgtgcagaccccaggcccctgctcctggaacttcagcggccctgagggcagcctggacagccccacagacctgagcagccccacagatgtgggcctggactgcttcttctacatctctgtgtacccaggctatggagtggagatcaaggtgcagaacatcagcctgcgggagggggagaccgtgacagtggagggcctgggcggccctgaccccctgcccctggccaaccagagcttcctgctgcggggccaggtgatccgcagccccacccaccaggccgccctgcgcttccagagcctgcccccacctgctggccctggcaccttccacttccactaccaggcctacctgctgagctgccacttccccaggaggcctgcctatggagatgtgacagtgaccagcctgcaccctgggggcagcgcccgcttccactgtgccaccggctaccagctgaagggggcccggcacctgacctgcctgaatgccacccagcccttctgggacagcaaggagcctgtgtgcatcgccgcctgtggcggcgtcatcagaaatgccaccaccggccgcatcgtgtccccaggcttccctggcaactacagcaacaacctgacctgccactggctgctggaggcccctgagggccagaggctgcacctgcactttgagaaggtgtccctggccgaggatgatgacaggctcatcatcagaaatggagacaacgtggaggcccctcctgtgtatgacagctatgaggtggagtacctgcccatcgagggcctgctgagcagcggcaagcacttctttgtggagctgagcacagacagcagcggggctgctgctggcatggccctgcgctatgaggccttccagcagggccactgctatgagccctttgtgaagtatggcaacttcagcagcagcacccccacctaccctgtgggcaccaccgtggagttcagctgtgaccccggctacaccctggagcagggcagcatcatcattgaatgtgtggacccccatgacccccagtggaatgaaacagagcccgcctgcagagctgtgtgcagcggggagatcacagacagcgctggggtggtgctgagccccaactggccagagccctacggccggggccaggactgcatctggggcgtgcacgtggaggaggacaagaggatcatgctggacatccgggtgctgcgcatcggccctggagatgtgctgaccttctatgatggagatgacctgacagcccgggtgctgggccagtacagcggccccaggagccacttcaagctgttcacctccatggctgatgtgaccatccagttccagagcgaccccggcacctctgtgctgggctaccagcagggctttgtgatccacttctttgaggtgcccagaaatgacacctgcccagagctgcctgagatccccaacggctggaagagccccagccagcctgagctggtgcacggcaccgtggtgacctaccagtgctacccaggctaccaggtggtgggcagctctgtgctgatgtgccagtgggacctgacctggagcgaggacctgcccagctgccagagggtgaccagctgccacgaccctggagatgtggagcacagcagaagactcatcagcagccccaagtttcctgtgggcgccaccgtgcagtacatctgtgaccagggctttgtgctgatgggcagcagcatcctgacctgccacgaccggcaggccggcagccccaagtggagcgaccgggcccccaagtgcctgctggagcagctgaagccctgccacggcctgagcgccccagaaaatggagcccggagccctgagaagcagctgcaccctgctggggccaccatccacttcagctgtgcccctggctacgtgctgaagggccaggccagcatcaagtgtgtgcccggccaccccagccactggagcgaccccccacccatctgcagagctgccagcctggatggcttctacaacagccgcagcctggatgtggccaaggccccagctgccagcagcaccctggatgctgcccacatcgccgccgccatcttcctgcccctggtggccatggtgctgctggtgggcggcgtgtacttctacttcagccggctgcagggcaagagcagcctgcagctgccccggccccggccccggccctacaaccgcatcaccatcgagagcgcctttgacaaccccacctatgaaacaggagagacccgggagtatgaggtgtccatctag

SEQ ID NO: 37835 - DNA, 2733 bp, Artificial Sequence
  Description of Artificial Sequence: Synthetic coding sequence
atgggcaccccccgggcccagcaccccccaccaccccagctgctcttcctgatcctgctgagctgcccctggatccagggcctgcccctgaaggaggaggagatcctgcctgagcccggcagcgagacccccaccgtggccagcgaggccctggccgagctgctgcacggggccctgctgcggcggggccctgagatgggctacctgcccggcagtgaccgggaccccaccctggccaccccacctgctggccagaccctggccgtgcccagcctgccccgggccacagagcccggcaccggccccctgaccacagctgtgacccccaacggggtgagaggagctggccccacagcccctgagctgctgaccccacctcctggcaccacagcccctcctccacccagccctgccagccctggcccccccctgggccctgagggcggggaggaggagaccaccaccaccatcatcaccaccaccaccgtgaccaccaccgtgaccagccctgtgctgtgcaacaacaacatcagcgagggggagggctacgtggagagcccagacctgggcagccctgtgtccaggaccctgggcctgctggactgcacctacagcatccacgtgtacccaggctacggcatcgagatccaggtgcagaccctgaacctgagccaggaggaggagctgctggtgctggccggcggcggcagccctggcctggccccccggctgctggccaacagctccatgctgggggagggccaggtgctgcggagccccaccaaccggctgctgctgcacttccagagcccccgggtgccccggggcggcggcttccgcatccactaccaggcctacctgctgagctgtggcttcccccccaggcctgcccatggagatgtgtctgtgacagacctgcaccctgggggcacagccaccttccactgtgacagcggctaccagctgcagggcgaggagaccctcatctgcctgaatggcacccggcccagctggaatggagagacccccagctgcatggccagctgtggcggcaccatccacaatgccaccctgggcagaattgtgtccccagagcccggcggcgctgtgggccccaacctgacctgccgctgggtgattgaggccgctgagggccggcggctgcacctgcactttgagcgggtgtccctggatgaagataatgaccggctgatggtgcgcagcggcggcagccccctgagccctgtgatctatgacagcgacatggatgatgtgcctgagcggggcctcatcagtgatgcccagagcctgtatgtggagctgctgtctgagaccccagccaaccccctgctgctgagcctgcgctttgaggcctttgaagaagatcgctgctttgcccccttcctggcccatggaaatgtgaccaccacagatcctgagtacagacctggggccctggccaccttcagctgcctgcccggctacgccctggagcccccaggccccccaaatgccattgaatgtgtggaccccacagagccccactggaatgacacagagcccgcctgcaaggccatgtgtggcggggagctgtctgagcctgctggggtggtgctgagcccagactggccccagagctacagccctggccaggactgtgtgtggggcgtgcacgtgcaggaggagaagaggatcctgctgcaggtggagatcctgaatgtgcgggagggggacatgctgaccctgtttgatggagatggccccagcgcccgggtgctggcccagctgcggggcccccagccccggcggcggctgctgagcagcggccctgacctgaccctgcagttccaggcccctcctggcccccccaaccctggcctgggccagggctttgtgctgcacttcaaggaggtgcccagaaatgacacctgcccagagctgcccccacctgagtggggctggaggacagccagccatggagacctgatccggggcaccgtgctgacctaccagtgtgagcccggctatgagctgctgggcagtgacatcctgacctgccagtgggacctgtcctggagcgctgcccccccagcctgccagaagatcatgacctgtgccgaccccggggagatcgccaacggccacaggacagccagtgatgctggcttccctgtgggcagccacgtgcagtaccgctgcctgcccggctacagcctggagggcgccgccatgctgacctgctacagccgggacaccggcacccccaagtggagcgacagagtgcccaagtgtgccctgaagtatgagccctgcctgaaccctggggtgcctgaaaatggctaccagaccctgtacaagcaccactaccaggccggggagagcctgcgcttcttctgctatgagggctttgagctgattggagaggtgaccatcacctgtgtgcccggccaccccagccagtggaccagccagccccccctgtgcaaggtgacccagaccacagaccccagccggcagctggagggcggcaacctggccctggccatcctgctgcccctgggcctggtgattgtgctgggcagcggcgtgtacatctactacaccaagctgcagggcaagagcctgtttggcttcagcggcagccacagctacagccccatcaccgtggagagtgacttcagcaaccccctgtatgaggccggggacacccgggagtatgaggtgtccatctag

SEQ ID NO: 37836 - DNA, 2430 bp, Artificial Sequence
  Description of Artificial Sequence: Synthetic coding sequence
atgggcaccccccgggcccagcaccccccaccaccccagctgctcttcctgatcctgctgagctgcccctggatccagggcctgcccctgaaggaggaggagatcctgcctgagcccggcagcgagacccccaccgtggccagcgaggccctggccgagctgctgcacggggccctgctgcggcggggccctgagatgggctacctgcccggcagtgaccgggaccccaccctggccaccccacctgctggccagaccctggccgtgcccagcctgccccgggccacagagcccggcaccggccccctgaccacagctgtgacccccaacggggtgagaggagctggccccacagcccctgagctgctgaccccacctcctggcaccacagcccctcctccacccagccctgccagccctggcccccccctgggccctgagggcggggaggaggagaccaccaccaccatcatcaccaccaccaccgtgaccaccaccgtgaccagccctgcctacctgctgagctgtggcttcccccccaggcctgcccatggagatgtgtctgtgacagacctgcaccctgggggcacagccaccttccactgtgacagcggctaccagctgcagggcgaggagaccctcatctgcctgaatggcacccggcccagctggaatggagagacccccagctgcatggccagctgtggcggcaccatccacaatgccaccctgggcagaattgtgtccccagagcccggcggcgctgtgggccccaacctgacctgccgctgggtgattgaggccgctgagggccggcggctgcacctgcactttgagcgggtgtccctggatgaagataatgaccggctgatggtgcgcagcggcggcagccccctgagccctgtgatctatgacagcgacatggatgatgtgcctgagcggggcctcatcagtgatgcccagagcctgtatgtggagctgctgtctgagaccccagccaaccccctgctgctgagcctgcgctttgaggcctttgaagaagatcgctgctttgcccccttcctggcccatggaaatgtgaccaccacagatcctgagtacagacctggggccctggccaccttcagctgcctgcccggctacgccctggagcccccaggccccccaaatgccattgaatgtgtggaccccacagagccccactggaatgacacagagcccgcctgcaaggccatgtgtggcggggagctgtctgagcctgctggggtggtgctgagcccagactggccccagagctacagccctggccaggactgtgtgtggggcgtgcacgtgcaggaggagaagaggatcctgctgcaggtggagatcctgaatgtgcgggagggggacatgctgaccctgtttgatggagatggccccagcgcccgggtgctggcccagctgcggggcccccagccccggcggcggctgctgagcagcggccctgacctgaccctgcagttccaggcccctcctggcccccccaaccctggcctgggccagggctttgtgctgcacttcaaggaggtgcccagaaatgacacctgcccagagctgcccccacctgagtggggctggaggacagccagccatggagacctgatccggggcaccgtgctgacctaccagtgtgagcccggctatgagctgctgggcagtgacatcctgacctgccagtgggacctgtcctggagcgctgcccccccagcctgccagaagatcatgacctgtgccgaccccggggagatcgccaacggccacaggacagccagtgatgctggcttccctgtgggcagccacgtgcagtaccgctgcctgcccggctacagcctggagggcgccgccatgctgacctgctacagccgggacaccggcacccccaagtggagcgacagagtgcccaagtgtgccctgaagtatgagccctgcctgaaccctggggtgcctgaaaatggctaccagaccctgtacaagcaccactaccaggccggggagagcctgcgcttcttctgctatgagggctttgagctgattggagaggtgaccatcacctgtgtgcccggccaccccagccagtggaccagccagccccccctgtgcaaggtggcctatgaggagctgctggacaacaggaagctggaggtgacccagaccacagaccccagccggcagctggagggcggcaacctggccctggccatcctgctgcccctgggcctggtgattgtgctgggcagcggcgtgtacatctactacaccaagctgcagggcaagagcctgtttggcttcagcggcagccacagctacagccccatcaccgtggagagtgacttcagcaaccccctgtatgaagctggggacacccgggagtatgaggtgtccatctag

SEQ ID NO: 37837 - DNA, 2562 bp, Artificial Sequence
  Description of Artificial Sequence: Synthetic coding sequence
atgggcaccccccgggcccagcaccccccaccaccccagctgctcttcctgatcctgctgagctgcccctggatccagggcctgcccctgaaggaggaggagatcctgcctgagcccggcagcgagacccccaccgtggccagcgaggccctggccgagctgctgcacggggccctgctgcggcggggccctgagatgggctacctgcccggcccccccctgggccctgagggcggggaggaggagaccaccaccaccatcatcaccaccaccaccgtgaccaccaccgtgaccagccctgtgctgtgcaacaacaacatcagcgagggggagggctacgtggagagcccagacctgggcagccctgtgtccaggaccctgggcctgctggactgcacctacagcatccacgtgtacccaggctacggcatcgagatccaggtgcagaccctgaacctgagccaggaggaggagctgctggtgctggccggcggcggcagccctggcctggccccccggctgctggccaacagctccatgctgggggagggccaggtgctgcggagccccaccaaccggctgctgctgcacttccagagcccccgggtgccccggggcggcggcttccgcatccactaccaggcctacctgctgagctgtggcttcccccccaggcctgcccatggagatgtgtctgtgacagacctgcaccctgggggcacagccaccttccactgtgacagcggctaccagctgcagggcgaggagaccctcatctgcctgaatggcacccggcccagctggaatggagagacccccagctgcatggccagctgtggcggcaccatccacaatgccaccctgggcagaattgtgtccccagagcccggcggcgctgtgggccccaacctgacctgccgctgggtgattgaggccgctgagggccggcggctgcacctgcactttgagcgggtgtccctggatgaagataatgaccggctgatggtgcgcagcggcggcagccccctgagccctgtgatctatgacagcgacatggatgatgtgcctgagcggggcctcatcagtgatgcccagagcctgtatgtggagctgctgtctgagaccccagccaaccccctgctgctgagcctgcgctttgaggcctttgaagaagatcgctgctttgcccccttcctggcccatggaaatgtgaccaccacagatcctgagtacagacctggggccctggccaccttcagctgcctgcccggctacgccctggagcccccaggccccccaaatgccattgaatgtgtggaccccacagagccccactggaatgacacagagcccgcctgcaaggccatgtgtggcggggagctgtctgagcctgctggggtggtgctgagcccagactggccccagagctacagccctggccaggactgtgtgtggggcgtgcacgtgcaggaggagaagaggatcctgctgcaggtggagatcctgaatgtgcgggagggggacatgctgaccctgtttgatggagatggccccagcgcccgggtgctggcccagctgcggggcccccagccccggcggcggctgctgagcagcggccctgacctgaccctgcagttccaggcccctcctggcccccccaaccctggcctgggccagggctttgtgctgcacttcaaggaggtgcccagaaatgacacctgcccagagctgcccccacctgagtggggctggaggacagccagccatggagacctgatccggggcaccgtgctgacctaccagtgtgagcccggctatgagctgctgggcagtgacatcctgacctgccagtgggacctgtcctggagcgctgcccccccagcctgccagaagatcatgacctgtgccgaccccggggagatcgccaacggccacaggacagccagtgatgctggcttccctgtgggcagccacgtgcagtaccgctgcctgcccggctacagcctggagggcgccgccatgctgacctgctacagccgggacaccggcacccccaagtggagcgacagagtgcccaagtgtgccctgaagtatgagccctgcctgaaccctggggtgcctgaaaatggctaccagaccctgtacaagcaccactaccaggccggggagagcctgcgcttcttctgctatgagggctttgagctgattggagaggtgaccatcacctgtgtgcccggccaccccagccagtggaccagccagccccccctgtgcaaggtggcctatgaggagctgctggacaacaggaagctggaggtgacccagaccacagaccccagccggcagctggagggcggcaacctggccctggccatcctgctgcccctgggcctggtgattgtgctgggcagcggcgtgtacatctactacaccaagctgcagggcaagagcctgtttggcttcagcggcagccacagctacagccccatcaccgtggagagtgacttcagcaaccccctgtatgaagctggggacacccgggagtatgaggtgtccatctag

SEQ ID NO: 37838 - DNA, 2640 bp, Artificial Sequence
  Description of Artificial Sequence: Synthetic coding sequence
atgggcaccccccgggcccagcaccccccaccaccccagctgctcttcctgatcctgctgagctgcccctggatccagggcagtgaccgggaccccaccctggccaccccacctgctggccagaccctggccgtgcccagcctgccccgggccacagagcccggcaccggccccctgaccacagctgtgacccccaacggggtgagaggagctggccccacagcccctgagctgctgaccccacctcctggcaccacagcccctcctccacccagccctgccagccctggcccccccctgggccctgagggcggggaggaggagaccaccaccaccatcatcaccaccaccaccgtgaccaccaccgtgaccagccctgtgctgtgcaacaacaacatcagcgagggggagggctacgtggagagcccagacctgggcagccctgtgtccaggaccctgggcctgctggactgcacctacagcatccacgtgtacccaggctacggcatcgagatccaggtgcagaccctgaacctgagccaggaggaggagctgctggtgctggccggcggcggcagccctggcctggccccccggctgctggccaacagctccatgctgggggagggccaggtgctgcggagccccaccaaccggctgctgctgcacttccagagcccccgggtgccccggggcggcggcttccgcatccactaccaggcctacctgctgagctgtggcttcccccccaggcctgcccatggagatgtgtctgtgacagacctgcaccctgggggcacagccaccttccactgtgacagcggctaccagctgcagggcgaggagaccctcatctgcctgaatggcacccggcccagctggaatggagagacccccagctgcatggccagctgtggcggcaccatccacaatgccaccctgggcagaattgtgtccccagagcccggcggcgctgtgggccccaacctgacctgccgctgggtgattgaggccgctgagggccggcggctgcacctgcactttgagcgggtgtccctggatgaagataatgaccggctgatggtgcgcagcggcggcagccccctgagccctgtgatctatgacagcgacatggatgatgtgcctgagcggggcctcatcagtgatgcccagagcctgtatgtggagctgctgtctgagaccccagccaaccccctgctgctgagcctgcgctttgaggcctttgaagaagatcgctgctttgcccccttcctggcccatggaaatgtgaccaccacagatcctgagtacagacctggggccctggccaccttcagctgcctgcccggctacgccctggagcccccaggccccccaaatgccattgaatgtgtggaccccacagagccccactggaatgacacagagcccgcctgcaaggccatgtgtggcggggagctgtctgagcctgctggggtggtgctgagcccagactggccccagagctacagccctggccaggactgtgtgtggggcgtgcacgtgcaggaggagaagaggatcctgctgcaggtggagatcctgaatgtgcgggagggggacatgctgaccctgtttgatggagatggccccagcgcccgggtgctggcccagctgcggggcccccagccccggcggcggctgctgagcagcggccctgacctgaccctgcagttccaggcccctcctggcccccccaaccctggcctgggccagggctttgtgctgcacttcaaggaggtgcccagaaatgacacctgcccagagctgcccccacctgagtggggctggaggacagccagccatggagacctgatccggggcaccgtgctgacctaccagtgtgagcccggctatgagctgctgggcagtgacatcctgacctgccagtgggacctgtcctggagcgctgcccccccagcctgccagaagatcatgacctgtgccgaccccggggagatcgccaacggccacaggacagccagtgatgctggcttccctgtgggcagccacgtgcagtaccgctgcctgcccggctacagcctggagggcgccgccatgctgacctgctacagccgggacaccggcacccccaagtggagcgacagagtgcccaagtgtgccctgaagtatgagccctgcctgaaccctggggtgcctgaaaatggctaccagaccctgtacaagcaccactaccaggccggggagagcctgcgcttcttctgctatgagggctttgagctgattggagaggtgaccatcacctgtgtgcccggccaccccagccagtggaccagccagccccccctgtgcaaggtggcctatgaggagctgctggacaacaggaagctggaggtgacccagaccacagaccccagccggcagctggagggcggcaacctggccctggccatcctgctgcccctgggcctggtgattgtgctgggcagcggcgtgtacatctactacaccaagctgcagggcaagagcctgtttggcttcagcggcagccacagctacagccccatcaccgtggagagtgacttcagcaaccccctgtatgaagctggggacacccgggagtatgaggtgtccatctag

SEQ ID NO: 37839 - DNA, 3294 bp, Artificial Sequence
  Description of Artificial Sequence: Synthetic coding sequence
atggccccccggcccaagaagcagcctgacaagaaccccctgcacggccgggagctgaatgtggtgcccagcctgggccggcagaccagcctgaccaccagcgtcatccccaaggccgagcagagcgtggcctacaaggacttcatctacttcaccgtgtttgagggcaatgtgagaaatgtgtctgaggtgtctgtggagtacctgtgcagccagccctgtgtggtgaacctggaggccgtggtgagcagcgagttccgcagcagcatccctgtgtacaagaagcgctggaagaatgagaagcacctgcacaccagcaggacccagatcgtgcacgtgaagttccccagcatcatggtgtacagagatgactacttcatccgccacagcatctctgtgtctgctgtgattgtgcgggcctggatcacccacaagtacagcggccgggactggaatgtgaagtgggaggagaacctgctgcatgctgtggccaagaactacaccctgctgcagaccatccccccatttgagcggcccttcaaggaccaccaggtgtgcctggagtggaacatgggctacatctggaacctgcgggccaaccgcatcccccagtgccccctggagaatgatgtggtggccctgctgggcttcccctatgccagcagcggggagaacacaggcatcgtgaagaagttcccccgcttcaggaaccgggagctggaggccacccggcggcagaggatggactaccctgtgttcaccgtgtccctgtggctgtacctgctgcactactgcaaggccaacctgtgtggcatcctgtactttgtggacagcaatgagatgtatggcacccccagcgtcttcctgacagaggagggctacctgcacatccagatgcacctggtgaagggggaggacctggccgtgaagaccaagttcatcatccccctgaaggagtggttccggctggacatctccttcaacggcggccagatcgtggtgaccaccagcatcggccaggacctgaagagctaccacaaccagaccatctccttccgggaggacttccactacaatgacacagctggctacttcatcattggaggcagccgctacgtggccggcatcgagggcttcttcggccccctgaagtactaccgcctgcggagcctgcacccagcccagatcttcaaccccctgctggagaagcagctggccgagcagatcaagctgtactatgagcgctgtgccgaggtgcaggagatcgtgtctgtgtatgccagcgctgccaagcacggcggggagcggcaggaggcctgccacctgcacaacagctacctggacctgcagaggagatatggccggcccagcatgtgccgggccttcccctgggagaaggagctgaaggacaagcaccccagcctcttccaggccctgctggagatggacctgctgactgtgcccaggaaccagaatgaatctgtgtctgagatcggcggcaagatctttgagaaggctgtgaagaggctgagcagcattgatggcctgcaccagatcagcagcatcgtgcccttcctgacagacagcagctgctgcggctaccacaaggccagctactacctggccgtgttctatgaaacaggcctgaatgtgccccgggaccagctgcagggcatgctgtacagcctggtgggcggccagggcagcgagcggctgagctccatgaacctgggctacaagcactaccagggcatcgacaactaccccctggactgggagctgtcctatgcctactacagcaacatcgccaccaagacccccctggaccagcacaccctgcagggcgaccaggcctacgtggagaccatccggctgaaggatgatgagatcctgaaggtgcagaccaaggaggatggagatgtgttcatgtggctgaagcatgaggccaccagaggaaatgctgctgcccagcagaggctggcccagatgctgttctggggccagcagggcgtggccaagaaccctgaggccgccatcgagtggtacgccaagggggccctggagacagaggaccctgccctgatctatgactatgccatcgtgctcttcaagggccagggcgtgaagaagaacagaaggctggccctggagctgatgaagaaggccgccagcaagggcctgcaccaggccgtgaatggcctgggctggtactaccacaagttcaagaagaactatgccaaggccgccaagtactggctgaaggccgaggagatgggcaacccagatgccagctacaacctgggcgtgctgcacctggatggcatcttccctggggtgcccggcaggaaccagaccctggccggggagtacttccacaaggccgcccagggcggccacatggagggcaccctgtggtgcagcctgtactacatcaccggcaacctggagaccttcccccgggaccctgagaaggctgtggtgtgggccaagcacgtggccgagaagaatggctacctgggccacgtgatcaggaagggcctgaatgcctacctggagggctcctggcatgaggccctgctgtactacgtgctggccgctgagaccggcatcgaggtgtcccagaccaacctggcccacatctgtgaggagaggccagacctggcccggcgctacctgggcgtgaactgtgtgtggagatactacaacttcagcgtcttccagattgatgcccccagctttgcctacctgaagatgggagacctgtactactacggccaccagaaccagagccaggacctggagctgtctgtgcagatgtatgcccaggccgccctggatggagacagccagggcttcttcaacctggccctgctgattgaggagggcaccatcatcccccaccacatcctggacttcctggagattgacagcaccctgcacagcaacaacatcagcatcctgcaggagctgtatgagcgctgctggagccacagcaatgaggagagcttcagcccctgcagcctggcctggctgtacctgcacctgcggctgctgtggggcgccatcctgcacagcgccctgatctacttcctgggcaccttcctgctgagcatcctgattgcctggacagtgcagtacttccagagcgtgtctgccagtgaccccccaccccggcccagccaggccagcccagacacagccaccagcacagccagccctgctgtgaccccagctgctgatgccagtgaccaggaccagcccaccgtgaccaacaaccctgagccccggggctag

SEQ ID NO: 37840 - DNA, 3399 bp, Artificial Sequence
  Description of Artificial Sequence: Synthetic coding sequence
atgcagaggagaggagctggcctgggctggccccggcagcagcagcagcagcccccacccctggccgtgggccccagggctgctgccatggtgcccagcggaggagtgccccagggcctgggcggccgcagcgcctgtgccctgctgctgctgtgctacctgaatgtggtgcccagcctgggccggcagaccagcctgaccaccagcgtcatccccaaggccgagcagagcgtggcctacaaggacttcatctacttcaccgtgtttgagggcaatgtgagaaatgtgtctgaggtgtctgtggagtacctgtgcagccagccctgtgtggtgaacctggaggccgtggtgtcctctgagttccgcagcagcatccctgtgtacaagaagcgctggaagaatgagaagcacctgcacaccagcaggacccagatcgtgcacgtgaagttccccagcatcatggtgtacagagatgactacttcatccgccacagcatctctgtgtctgctgtgattgtgcgggcctggatcacccacaagtacagcggccgggactggaatgtgaagtgggaggagaacctgctgcatgctgtggccaagaactacaccctgctgcagaccatccccccatttgagcggcccttcaaggaccaccaggtgtgcctggagtggaacatgggctacatctggaacctgcgggccaaccgcatcccccagtgccccctggagaatgatgtggtggccctgctgggcttcccctatgccagcagtggagaaaatactggaattgtgaagaagttcccccgcttcaggaaccgggagctggaggccacccggcggcagaggatggactaccctgtgttcaccgtgtccctgtggctgtacctgctgcactactgcaaggccaacctgtgtggcatcctgtactttgtggacagcaatgagatgtatggcaccccatctgtgttcctgacagaggagggctacctgcacatccagatgcacctggtgaagggggaggacctggccgtgaagaccaagttcatcatccccctgaaggagtggttccggctggacatctccttcaatggaggccagatcgtggtgaccaccagcatcggccaggacctgaagagctaccacaaccagaccatctccttccgggaggacttccactacaatgacacagctggctacttcatcatcggcggcagccgctacgtggccggcatcgagggcttcttcggccccctgaagtactaccgcctgcggagcctgcacccagcccagatcttcaaccccctgctggagaagcagctggccgagcagatcaagctgtactatgaaagatgtgccgaggtgcaggagatcgtgtctgtgtatgccagcgctgccaagcatggaggagagcggcaggaggcctgccacctgcacaacagctacctggacctgcagaggagatatggccggcccagcatgtgccgggccttcccctgggagaaggagctgaaggacaagcaccccagcctcttccaggccctgctggagatggacctgctgactgtgcccaggaaccagaatgaatctgtgtctgaaattggaggcaagatctttgagaaggctgtgaagaggctgagcagcattgatggcctgcaccagatcagcagcatcgtgcccttcctgacagacagcagctgctgcggctaccacaaggccagctactacctggccgtgttctatgagaccggcctgaatgtgccccgggaccagctgcagggcatgctgtacagcctggtgggcggccagggcagcgagcggctgagctccatgaacctgggctacaagcactaccagggcatcgacaactaccccctggactgggagctgtcctatgcctactacagcaacatcgccaccaagacccccctggaccagcacaccctgcagggcgaccaggcctacgtggagaccatccggctgaaggatgatgagatcctgaaggtgcagaccaaggaggatggagatgtgttcatgtggctgaagcatgaggccaccagaggaaatgctgctgcccagcagaggctggcccagatgctgttctggggccagcagggcgtggccaagaaccctgaggccgccatcgagtggtacgccaagggggccctggagacagaagatcctgccctgatctatgactatgccatcgtgctcttcaagggccagggcgtgaagaagaacagaaggctggccctggagctgatgaagaaggccgccagcaagggcctgcaccaggccgtgaatggcctgggctggtactaccacaagttcaagaagaactatgccaaggccgccaagtactggctgaaggccgaggagatgggcaacccagatgccagctacaacctgggcgtgctgcacctggatggcatcttccctggggtgcctggaagaaaccagaccctggccggggagtacttccacaaggccgcccagggcggccacatggagggcaccctgtggtgcagcctgtactacatcactggaaacctggagaccttcccccgggaccctgagaaggctgtggtgtgggccaagcacgtggccgagaagaatggctacctgggccacgtgatcaggaagggcctgaatgcctacctggagggctcctggcatgaggccctgctgtactacgtgctggccgctgagactggaattgaggtgtcccagaccaacctggcccacatctgtgaggagaggccagacctggcccggcgctacctgggcgtgaactgtgtgtggagatactacaacttctctgtgttccagattgatgcccccagctttgcctacctgaagatgggagacctgtactactacggccaccagaaccagagccaggacctggagctgtctgtgcagatgtatgcccaggccgccctggatggagacagccagggcttcttcaacctggccctgctgattgaggagggcaccatcatcccccaccacatcctggacttcctggagattgacagcaccctgcacagcaacaacatcagcatcctgcaggagctgtatgagcgctgctggagccacagcaatgaggagagcttcagcccctgcagcctggcctggctgtacctgcacctgcggctgctgtggggcgccatcctgcacagcgccctgatctacttcctgggcaccttcctgctgagcatcctgattgcctggacagtgcagtacttccagagcgtgtctgccagtgaccccccaccccggcccagccaggccagcccagacacagccaccagcacagccagccctgctgtgaccccagctgctgatgccagtgaccaggaccagcccaccgtgaccaacaaccctgagccccggggctag

SEQ ID NO: 37841 - DNA, 2940 bp, Artificial Sequence
  Description of Artificial Sequence: Synthetic coding sequence
atggtgtacagagatgactacttcatccgccacagcatctctgtgtctgctgtgattgtgcgggcctggatcacccacaagtacagcggccgggactggaatgtgaagtgggaggagaacctgctgcatgctgtggccaagaactacaccctgctgcagaccatccccccatttgagcggcccttcaaggaccaccaggtgtgcctggagtggaacatgggctacatctggaacctgcgggccaaccgcatcccccagtgccccctggagaatgatgtggtggccctgctgggcttcccctatgccagcagcggggagaacacaggcatcgtgaagaagttcccccgcttcaggaaccgggagctggaggccacccggcggcagaggatggactaccctgtgttcaccgtgtccctgtggctgtacctgctgcactactgcaaggccaacctgtgtggcatcctgtactttgtggacagcaatgagatgtatggcacccccagcgtcttcctgacagaggagggctacctgcacatccagatgcacctggtgaagggggaggacctggccgtgaagaccaagttcatcatccccctgaaggagtggttccggctggacatctccttcaacggcggccagatcgtggtgaccaccagcatcggccaggacctgaagagctaccacaaccagaccatctccttccgggaggacttccactacaatgacacagctggctacttcatcattggaggcagccgctacgtggccggcatcgagggcttcttcggccccctgaagtactaccgcctgcggagcctgcacccagcccagatcttcaaccccctgctggagaagcagctggccgagcagatcaagctgtactatgagcgctgtgccgaggtgcaggagatcgtgtctgtgtatgccagcgctgccaagcacggcggggagcggcaggaggcctgccacctgcacaacagctacctggacctgcagaggagatatggccggcccagcatgtgccgggccttcccctgggagaaggagctgaaggacaagcaccccagcctcttccaggccctgctggagatggacctgctgactgtgcccaggaaccagaatgaatctgtgtctgagatcggcggcaagatctttgagaaggctgtgaagaggctgagcagcattgatggcctgcaccagatcagcagcatcgtgcccttcctgacagacagcagctgctgcggctaccacaaggccagctactacctggccgtgttctatgaaacaggcctgaatgtgccccgggaccagctgcagggcatgctgtacagcctggtgggcggccagggcagcgagcggctgagctccatgaacctgggctacaagcactaccagggcatcgacaactaccccctggactgggagctgtcctatgcctactacagcaacatcgccaccaagacccccctggaccagcacaccctgcagggcgaccaggcctacgtggagaccatccggctgaaggatgatgagatcctgaaggtgcagaccaaggaggatggagatgtgttcatgtggctgaagcatgaggccaccagaggaaatgctgctgcccagcagaggctggcccagatgctgttctggggccagcagggcgtggccaagaaccctgaggccgccatcgagtggtacgccaagggggccctggagacagaggaccctgccctgatctatgactatgccatcgtgctcttcaagggccagggcgtgaagaagaacagaaggctggccctggagctgatgaagaaggccgccagcaagggcctgcaccaggccgtgaatggcctgggctggtactaccacaagttcaagaagaactatgccaaggccgccaagtactggctgaaggccgaggagatgggcaacccagatgccagctacaacctgggcgtgctgcacctggatggcatcttccctggggtgcccggcaggaaccagaccctggccggggagtacttccacaaggccgcccagggcggccacatggagggcaccctgtggtgcagcctgtactacatcaccggcaacctggagaccttcccccgggaccctgagaaggctgtggtgtgggccaagcacgtggccgagaagaatggctacctgggccacgtgatcaggaagggcctgaatgcctacctggagggctcctggcatgaggccctgctgtactacgtgctggccgctgagaccggcatcgaggtgtcccagaccaacctggcccacatctgtgaggagaggccagacctggcccggcgctacctgggcgtgaactgtgtgtggagatactacaacttcagcgtcttccagattgatgcccccagctttgcctacctgaagatgggagacctgtactactacggccaccagaaccagagccaggacctggagctgtctgtgcagatgtatgcccaggccgccctggatggagacagccagggcttcttcaacctggccctgctgattgaggagggcaccatcatcccccaccacatcctggacttcctggagattgacagcaccctgcacagcaacaacatcagcatcctgcaggagctgtatgagcgctgctggagccacagcaatgaggagagcttcagcccctgcagcctggcctggctgtacctgcacctgcggctgctgtggggcgccatcctgcacagcgccctgatctacttcctgggcaccttcctgctgagcatcctgattgcctggacagtgcagtacttccagagcgtgtctgccagtgaccccccaccccggcccagccaggccagcccagacacagccaccagcacagccagccctgctgtgaccccagctgctgatgccagtgaccaggaccagcccaccgtgaccaacaaccctgagccccggggctag

SEQ ID NO: 37842 - DNA, 228 bp, Artificial Sequence
  Description of Artificial Sequence: Synthetic coding sequence
atggtgtacagagatgactacttcatccgccacagcatctctgtgtctgctgtgattgtgcgggcctggatcacccacaagtacagcggccgggactggaatgtgaagtgggaggagaacctgctgcatgctgtggccaagaactacaccctgctgcagaccatccccccatttgagcggcccttcaaggaccaccaggtgtgcctggagtggaacatgggctactag

SEQ ID NO: 37843 - DNA, 189 bp, Artificial Sequence
  Description of Artificial Sequence: Synthetic coding sequence
atggtgtacagagatgactacttcatccgccacagcatctctgtgtctgctgtgattgtgcgggcctggatcacccacaagtacagcggccgggactggaatgtgaagtgggaggagaacctgctgcatgctgtggccaagaactacaccctgctgcagaccatccccccatttgagcggcccttctag

SEQ ID NO: 37844 - DNA, 108 bp, Artificial Sequence
  Description of Artificial Sequence: Synthetic coding sequence
atggtgtacagagatgactacttcatccgccacagcatctctgtgtctgctgtgattgtgcgggcctggatcacccacaagtacagcggccgggactggaatgtgtag

SEQ ID NO: 37845 - DNA, 564 bp, Artificial Sequence
  Description of Artificial Sequence: Synthetic coding sequence
atggagcggcaggaggagagcctgagcgcccggcctgccctggagacagagggcctgcgcttcctgcacaccaccgtgggcagcctgctggccacctacggctggtacatcgtgttcagctgcatcctgctgtatgtggtgttccagaagctgagcgcccggctgcgggccctgcggcagaggcagctggacagagctgctgctgctgtggagccagatgtggtggtgaagaggcaggaggccctggccgccgcccggctgaagatgcaggaggagctgaatgcccaggtggagaagcacaaggagaagctgaagcagctggaggaggagaagaggcggcagaagattgagatgtgggacagcatgcaggagggcaagagctacaagggaaatgccaagaagccccaggaggaggacagccctggccccagcaccagctctgtgctgaagaggaagagtgacaggaagcccctgcggggcggcggctacaaccccctgtctggagagggcggcggggcctgctcctggaggcctggccggcggggccccagcagcggcggctag

SEQ ID NO: 37846 - DNA, 564 bp, Artificial Sequence; identical to SEQ ID NO: 37845
  Description of Artificial Sequence: Synthetic coding sequence

SEQ ID NO: 37847 - DNA, 564 bp, Artificial Sequence; identical to SEQ ID NO: 37845
  Description of Artificial Sequence: Synthetic coding sequence

SEQ ID NO: 37848 - DNA, 2667 bp, Artificial Sequence
  Description of Artificial Sequence: Synthetic coding sequence
atgcagaccccccgggccagcccccccaggcctgccctgctgctgctgctgctgctgctgggcggggcccacggcctcttccctgaggagcccccacccctgtctgtggccccccgggactacctgaaccactaccctgtgtttgtgggcagcggccctggccgcctgaccccagctgagggcgcagatgacctgaacatccagagggtgctgcgggtgaacagaaccctcttcatcggggaccgggacaacctgtacagagtggagctggagccccccaccagcacagagctgcgctaccagaggaagctgacctggaggagcaaccccagcgacatcaacgtgtgcaggatgaagggcaagcaggagggagaatgtagaaactttgtgaaggtgctgctgctgagagatgagagcaccctgtttgtgtgtggcagcaatgccttcaaccctgtgtgtgccaactacagcattgacaccctgcagcctgtgggggacaacatcagcggcatggcccgctgcccctatgaccccaagcacgccaacgtggccctcttcagtgatggcatgctgttcaccgccaccgtgacagacttcctggccattgatgctgtgatctaccgcagcctgggggaccggcccaccctgaggacagtgaagcatgacagcaagtggttcaaggagccctactttgtgcatgctgtggagtggggcagccacgtgtacttcttcttccgggagatcgccatggagttcaactacctggagaaggtggtggtgtcccgggtggcccgggtgtgcaagaatgatgtgggcggcagcccccgggtgctggagaagcagtggaccagcttcctgaaggcccggctgaactgcagcgtgcctggggacagccacttctacttcaacgtgctgcaggccgtgactggagtggtgtccctgggcggccggcctgtggtgctggccgtgttcagcacccccagcaacagcatccctggcagcgctgtgtgtgcctttgacctgacccaggtggccgctgtgtttgagggccgcttccgggagcagaagagccctgagagcatctggacccctgtgcctgaggaccaggtgccccggcccaggcctggctgctgtgccgcccctggcatgcagtacaatgccagcagcgccctgcctgatgacatcctgaactttgtgaagacccaccccctgatggatgaggccgtgcccagcctgggccacgccccctggatcctgcggaccctgatgaggcaccagctgaccagggtggccgtggatgtgggcgccggcccctggggcaaccagacagtggtgttcctgggcagcgaggccggcaccgtgctgaagttcctggtgcggcccaatgccagcaccagcggcaccagcggcctgagcgtcttcctggaggagtttgagacctacagaccagacagatgtggccggcctgggggcggggagaccggccagaggctgctgagcctggagctggatgctgccagcggcggcctgctggccgccttcccccgctgtgtggtgcgggtgcctgtggcccgctgccagcagtacagcggctgcatgaagaactgcatcggcagccaggacccctactgcggctgggccccagatggcagctgcatcttcctgagccctggcaccagggctgcctttgagcaggatgtgtctggggccagcaccagcggcctgggggactgcaccggcctgctgcgggccagcctgtctgaggacagagctggcctggtgtctgtgaacctgctggtgaccagctctgtggccgcctttgtggtgggcgctgtggtgtctggcttctctgtgggctggtttgtgggcctgcgggagcggcgggagctggcccggaggaaggacaaggaggccatcctggcccacggggccggggaggccgtgctgtctgtgtcccggctgggggagcggcgggcccagggccctgggggccggggcggcggcggcggcggcggggccggcgtgcccccagaggccctgctggcccccctgatgcagaatggctgggccaaggccaccctgctgcagggcggcccccatgacctggacagcggcctgctgcccaccccagagcagacccccctgccccagaagaggctgcccaccccccacccccacccccacgccctgggcccccgggcctgggaccacggccaccccctgctgcctgccagcgccagcagcagcctgctgctgctggccccagcccgggcccctgagcagcccccagcccctggagagcccaccccagatggccgcctgtatgctgcccggcccggccgggccagccacggggacttccccctgaccccccacgccagcccagacagaagaagagtggtgtctgcccccaccggccccctggaccctgccagcgctgctgatggcctgccccggccctggagccccccacccaccggcagcctgcggcggcccctgggcccccacgcccccccagctgccaccctgcggaggacccacaccttcaacagcggggaggcccggcctggggacagacaccggggctgccacgcccggcctggaacagacctggcccacctgctgccctatggaggagctgacagaacagcccctcctgtgccctag

SEQ ID NO: 37849 - DNA, 2358 bp, Artificial Sequence
  Description of Artificial Sequence: Synthetic coding sequence
atgctggtggccggcctgctgctgtgggccagcctgctgaccggggcctggcccagcttccccacccaggaccacctgcctgccaccccccgggtgcggctgtccttcaaggagctgaaggccaccggcacagcccacttcttcaacttcctgctgaacaccacagactaccgcatcctgctgaaggatgaggaccatgacaggatgtatgtgggcagcaaggactatgtgctgagcctggacctgcatgacatcaaccgggagcccctcatcatccactgggccgccagcccccagagaattgaagaatgtgtgctgagcggcaaggatgtgaatggagaatgtggcaactttgtgcggctcatccagccctggaacagaacccacctgtatgtgtgtggcactggagcctacaaccccatgtgcacctacgtgaacagaggaagaagagcccaggccaccccctggacccagacccaggccgtgcggggccggggcagccgggccacagatggagccctgcggcccatgcccacagccccccggcaggactacatcttctacctggagcctgagcggctggagagcggcaagggcaagtgcccctatgaccccaagctggacacagccagcgccctgatcaatgaggagctgtatgctggggtgtacatcgacttcatgggcacagatgctgccatcttccgcaccctgggcaagcagacagccatgaggacagaccagtacaacagccgctggctgaatgaccccagcttcatccatgctgagctgatcccagattctgctgagagaaatgatgacaagctgtacttcttcttccgggagaggtctgctgaggccccccagagccctgctgtgtatgcccgcatcggccgcatctgcctgaatgatgatggcggccactgctgcctggtgaacaagtggagcaccttcctgaaggcccggctggtgtgcagcgtgcctggagaagatggcatcgagacccactttgatgagctgcaggatgtgtttgtgcagcagacccaggatgtgagaaatcctgtgatctatgctgtgttcaccagcagcggcagcgtcttccggggcagcgctgtgtgtgtgtacagcatggctgacatccgcatggtgttcaacggcccctttgcccacaaggagggccccaactaccagtggatgcccttcagcggcaagatgccctaccccaggcctggcacctgccctgggggcaccttcacccccagcatgaagagcaccaaggactacccagatgaagtcatcaacttcatgaggagccaccccctgatgtaccaggccgtgtaccccctgcagaggcggcccctggtggtgaggactggagccccctaccgcctgaccaccatcgctgtggaccaggtggatgctgctgatggccgctatgaggtgctcttcctgggcacagaccggggcaccgtgcagaaggtgattgtgctgcccaaggatgaccaggagctggaggagctgatgctggaggaggtggaggtgttcaaggaccctgcccctgtgaagaccatgaccatcagcagcaagaggcagcagctgtatgtggccagcgctgtgggcgtgacccacctgagcctgcaccgctgccaggcctatggagctgcctgtgccgactgctgcctggcccgggacccctactgtgcctgggatggccaggcctgcagccgctacacagccagcagcaagaggaggagccggcggcaggatgtgagacatggcaaccccatccggcagtgccggggcttcaacagcaatgccaacaagaatgctgtggagagcgtgcagtatggagtggccggcagcgctgccttcctggagtgccagcccaggagcccccaggccaccgtgaagtggctgttccagagggaccccggggacagaagaagagagatccgggcagaagatcgcttcctgaggacagagcagggcctgctgctgcgggccctgcagctgagtgaccggggcctgtacagctgcacagccacagagaacaacttcaagcacgtggtgaccagggtgcagctgcacgtgctgggcagagatgctgtgcacgccgccctcttcccccccctgtccatgtctgcccctcctcctcctggggccggcccccccaccccaccctaccaggagctggcccagctgctggcccagcctgaggtgggcctcatccaccagtactgccagggctactggaggcatgtgccccccagcccccgggaggcccctggggcccccaggagccctgagccccaggaccagaagaagcccaggaacagaagacaccaccccccagacacctag

SEQ ID NO: 37850 - DNA, 795 bp, Artificial Sequence
  Description of Artificial Sequence: Synthetic coding sequence
atgctggtggccggcctgctgctgtgggccagcctgctgaccggggcctggcccagcttccccacccaggaccacctgcctgccaccccccgggtgcggctgtccttcaaggagctgaaggccaccggcacagcccacttcttcaacttcctgctgaacaccacagactaccgcatcctgctgaaggatgaggaccatgacaggatgtatgtgggcagcaaggactatgtgctgagcctggacctgcatgacatcaaccgggagcccctcatcatccactgggccgccagcccccagagaattgaagaatgtgtgctgagcggcaaggatgtgaatggagaatgtggcaactttgtgcggctcatccagccctggaacagaacccacctgtatgtgtgtggcactggagcctacaaccccatgtgcacctacgtgaacagaggaagaagagcccaggactacatcttctacctggagcctgagcggctggagagcgggaaaggaaaatgtccctatgaccccaagctggacacagccagcgccctgatcaatgaggagctgtatgccggcgtgtacatcgacttcatgggcacagatgctgccatcttccgcaccctgggcaagcagacagccatgaggacagaccagtacaacagccgctggctgaatgaccccagcttcatccacgccgagctgatcccagacagcgctgagagaaatgatgacaagctgtacttcttcttccgggagaggtctgctgaggccccccagagccctgctgtgtatgccaggtag

SEQ ID NO: 37851 - DNA, 279 bp, Artificial Sequence
  Description of Artificial Sequence: Synthetic coding sequence
atgctggtggccggcctgctgctgtgggccagcctgctgaccggggcctggcccagcttccccacccaggaccacctgcctgccaccccccgggtgcggctgtccttcaaggagctgaaggccaccggcacagcccacttcttcaacttcctgctgaacaccacagactaccgcatcctgctgaaggatgaggaccatgacaggatgtatgtgggcagcaaggactatgtgctgagcctggacctgcatgacatcaaccgggagcccctgattgtgtag

SEQ ID NO: 37852 - DNA, 2265 bp, Artificial Sequence
  Description of Artificial Sequence: Synthetic coding sequence
atgctggtggccggcctgctgctgtgggccagcctgctgaccggggcctggcccagcttccccacccaggaccacctgcctgccaccccccgggtgcggctgtccttcaaggagctgaaggccaccggcacagcccacttcttcaacttcctgctgaacaccacagactaccgcatcctgctgaaggatgaggaccatgacaggatgtatgtgggcagcaaggactatgtgctgagcctggacctgcatgacatcaaccgggagcccctcatcatccactgggccgccagcccccagagaattgaagaatgtgtgctgagcggcaaggatgtgaatggagaatgtggcaactttgtgcggctcatccagccctggaacagaacccacctgtatgtgtgtggcactggagcctacaaccccatgtgcacctacgtgaacagaggaagaagagcccaggactacatcttctacctggagcctgagcggctggagagcgggaaaggaaaatgtccctatgaccccaagctggacacagccagcgccctgatcaatgaggagctgtatgccggcgtgtacatcgacttcatgggcacagatgctgccatcttccgcaccctgggcaagcagacagccatgaggacagaccagtacaacagccgctggctgaatgaccccagcttcatccacgccgagctgatcccagacagcgctgagagaaatgatgacaagctgtacttcttcttccgggagaggtctgctgaggccccccagagccctgctgtgtatgccagaattggccgcatctgcctgaatgatgatggcggccactgctgcctggtgaacaagtggagcaccttcctgaaggcccggctggtgtgcagcgtgcctggagaagatggcatcgagacccactttgatgagctgcaggatgtgtttgtgcagcagacccaggatgtgaggaaccctgtgatctatgctgtgttcaccagcagcggctctgtgttccggggcagcgctgtgtgtgtgtacagcatggctgacatccgcatggtgttcaacggcccctttgcccacaaggagggccccaactaccagtggatgcccttcagcggcaagatgccctacccccggcccggcacctgccctgggggcaccttcacccccagcatgaagagcaccaaggactacccagatgaggtgatcaacttcatgaggagccaccccctgatgtaccaggccgtgtaccccctgcagaggcggcccctggtggtgaggactggagccccctaccgcctgaccaccatcgctgtggaccaggtggatgctgctgatggccgctatgaggtgctcttcctgggcacagaccggggcaccgtgcagaaggtgattgtgctgcccaaggatgaccaggagctggaggagctgatgctggaggaggtggaggtgttcaaggaccctgcccctgtgaagaccatgaccatcagcagcaagaggcagcagctgtatgtggccagcgctgtgggcgtgacccacctgagcctgcaccgctgccaggcctacggggccgcctgtgccgactgctgcctggcccgggacccctactgtgcctgggatggccaggcctgcagccgctacacagccagcagcaagagaagaagccggcggcaggatgtgcgccacggcaaccccatccggcagtgccggggcttcaacagcaatgccaacaagaatgctgtggagagcgtgcagtatggagtggccggcagcgctgccttcctggagtgccagcccaggagcccccaggccaccgtgaagtggctgttccagagggaccccggggacagaagaagagagatccgggcagaggaccgcttcctgaggacagagcagggcctgctgctgcgggccctgcagctgagtgaccggggcctgtacagctgcacagccacagagaacaacttcaagcacgtggtgaccagggtgcagctgcacgtgctgggcagagatgctgtgcatgctgccctcttcccccccctgtccatgtctgcccctcctcctcctggagctggcccccccaccccaccctaccaggagctggcccagctgctggcccagcctgaggtgggcctcatccaccagtactgccagggctactggaggcatgtgccccccagcccccgggaggcccctggggcccccaggagccctgagccccaggaccagaagaagcccaggaacagaagacaccaccccccagacacctag

SEQ ID NO: 37853 - DNA, 1143 bp, Artificial Sequence
  Description of Artificial Sequence: Synthetic coding sequence
atgctggtggccggcctgctgctgtgggccagcctgctgaccggggcctggcccagcttccccacccaggaccacctgcctgccaccccccgggtgcggctgtccttcaaggagctgaaggccaccggcacagcccacttcttcaacttcctgctgaacaccacagactaccgcatcctgctgaaggatgaggaccatgacaggatgtatgtgggcagcaaggactatgtgctgagcctggacctgcatgacatcaaccgggagcccctcatcatccactgggccgccagcccccagagaattgaagaatgtgtgctgagcggcaaggatgtgaatggagaatgtggcaactttgtgcggctcatccagccctggaacagaacccacctgtatgtgtgtggcactggagcctacaaccccatgtgcacctacgtgaacagaggaagaagagcccaggactacatcttctacctggagcctgagcggctggagagcgggaaaggaaaatgtccctatgaccccaagctggacacagccagcgccctgatcaatgaggagctgtatgccggcgtgtacatcgacttcatgggcacagatgctgccatcttccgcaccctgggcaagcagacagccatgaggacagaccagtacaacagccgctggctgaatgaccccagcttcatccacgccgagctgatcccagacagcgctgagagaaatgatgacaagctgtacttcttcttccgggagaggtctgctgaggccccccagagccctgctgtgtatgccagaattggccgcatctgcctgaatgatgatggcggccactgctgcctggtgaacaagtggagcaccttcctgaaggcccggctggtgtgcagcgtgcctggagaagatggcatcgagacccactttgatgagctgcaggatgtgtttgtgcagcagacccaggatgtgaggaaccctgtgatctatgctgtgttcaccagcagcggctctgtgttccggggcagcgctgtgtgtgtgtacagcatggctgacatccgcatggtgttcaacggcccctttgcccacaaggagggccccaactaccagtggatgcccttcagcggcaagatgccctacccccggcccggcacctag

SEQ ID NO: 37854 - DNA, 2514 bp, Artificial Sequence
  Description of Artificial Sequence: Synthetic coding sequence
atgctgaggacagccatgggcctgcgctcctggctggccgccccctggggcgccctgccccccaggcctcccctgctgctgctgctgctgctgctgctgctgctgcagcccccaccacccacctgggccctgagcccccgcatcagcctgcccctgggcagcgaggagcggcccttcctgcgctttgaggccgagcacatcagcaactacacagccctgctgctgagcagagatggccgcaccctgtatgtgggcgcccgggaggccctgtttgccctgagcagcaacctgtccttcctgcctggaggagagtaccaggagctgctgtggggcgcagatgctgagaagaagcagcagtgcagcttcaagggcaaggacccccagagggactgccagaactacatcaagatcctgctgcccctgagcggcagccacctgttcacctgtggcacagctgccttcagccccatgtgcacctacatcaacatggagaacttcaccctggccagagatgagaagggaaatgtgctgctggaggatggcaagggccgctgcccctttgaccccaacttcaagagcacagccctggtggtggatggagagctgtacacaggcaccgtgtcctccttccagggcaatgaccctgccatcagccgcagccagagcctgcggcccaccaagacagagagcagcctgaactggctgcaggaccctgcctttgtggccagcgcctacatccctgagagcctgggcagcctgcagggagatgatgacaagatctacttcttcttcagcgagaccggccaggagtttgagttctttgagaacaccatcgtgagccgcatcgcccgcatctgcaagggagatgaaggaggagagcgggtgctgcagcagcgctggaccagcttcctgaaggcccagctgctgtgcagcaggccagatgatggcttccccttcaacgtgctgcaggatgtgttcaccctgagccccagcccccaggactggagggacaccctcttctatggagtcttcaccagccagtggcaccggggcaccacagagggcagcgctgtgtgtgtgttcaccatgaaggatgtgcagagggtcttcagcggcctgtacaaggaggtgaaccgggagacccagcagtggtacacagtgacccaccctgtgcccacccccaggcctggggcctgcatcaccaacagcgcccgggagaggaagatcaacagcagcctgcagctgcctgacagagtgctgaacttcctgaaggaccacttcctgatggatggccaggtgcgcagcaggatgctgctgctgcagccccaggcccgctaccagagggtggccgtgcaccgggtgcccggcctgcaccacacctatgatgtgctcttcctgggcactggagatggccgcctgcacaaggctgtgtctgtgggcccccgggtgcacatcatcgaggagctgcagatcttcagcagcggccagcctgtgcagaacctgctgctggacacccaccggggcctgctgtatgctgccagccacagcggcgtggtgcaggtgcccatggccaactgcagcctgtaccgcagctgtggggactgcctgctggcccgggacccctactgtgcctggagcggcagcagctgcaagcacgtgtccctgtaccagccccagctggccacccggccctggatccaggacattgaaggagccagcgccaaggacctgtgcagcgccagctctgtggtgagccccagctttgtgcccactggagagaagccctgtgagcaggtgcagttccagcccaacacagtgaacaccctggcctgccccctgctgagcaacctggccacccggctgtggctgagaaatggagcccctgtgaatgccagcgccagctgccacgtgctgcccaccggggacctgctgctggtgggcacccagcagctgggggagttccagtgctggagcctggaggagggcttccagcagctggtggccagctactgcccagaggtggtggaggatggagtggccgaccagacagatgagggcggctctgtgcctgtgatcatcagcaccagccgggtgtctgccccagctgggggcaaggcctcctggggcgctgacaggagctactggaaggagttcctggtgatgtgcaccctgtttgtgctggccgtgctgctgcctgtgctcttcctgctgtaccgccacagaaattccatgaaggtgttcctgaagcagggagaatgtgcctctgtgcaccccaagacctgccctgtggtgctgcccccagagacccggcccctgaatggcctgggcccccccagcacccccctggaccaccggggctaccagagcctgagtgacagccccccaggcagcagggtcttcacagaaagtgagaagaggcccctgagcatccaggacagctttgtggaggtgtcccctgtgtgcccccggccccgggtgcggctgggcagcgagatccgggacagcgtggtgtag

SEQ ID NO: 37855 - DNA, 2214 bp, Artificial Sequence
  Description of Artificial Sequence: Synthetic coding sequence
atgggcctgcgctcctggctggccgccccctggggcgccctgcccccccggccccccctgctgctgctgctgctgctgctgctgctgctgcagcccccaccacccacctgggccctgagcccccgcatcagcctgcccctgggcagcgaggagcggcccttcctgcgctttgaagctgagcacatcagcaactacacagccctgctgctgagcagagatggccgcaccctgtatgtgggcgcccgggaggccctgtttgccctgagcagcaacctgtccttcctgcccggcggggagtaccaggagctgctgtggggcgcagatgctgagaagaagcagcagtgcagcttcaagggcaaggacccccagagggactgccagaactacatcaagatcctgctgcccctgagcggcagccacctgttcacctgtggcacagctgccttcagccccatgtgcacctacatcaacatggagaacttcaccctggccagagatgagaagggaaatgtgctgctggaggatggcaagggccgctgcccctttgaccccaacttcaagagcacagccctggtggtggatggagagctgtacacaggaacagtgagcagcttccagggcaatgaccctgccatcagccgcagccagagcctgcggcccaccaagacagagagcagcctgaactggctgcaggaccctgcctttgtggccagcgcctacatccctgagagcctgggcagcctgcagggagatgatgacaagatctacttcttcttcagcgagaccggccaggagtttgagttctttgagaacaccatcgtgtccagaattgcccgcatctgcaagggagatgagggcggggagcgggtgctgcagcagcgctggaccagcttcctgaaggcccagctgctgtgcagcaggccagatgatggcttccccttcaacgtgctgcaggatgtgttcaccctgagccccagcccccaggactggagggacaccctcttctacggcgtcttcaccagccagtggcaccggggcaccacagagggcagcgctgtgtgtgtgttcaccatgaaggatgtgcagagggtcttcagcggcctgtacaaggaggtgaaccgggagacccagcagtggtacacagtgacccaccctgtgcccacccccaggcctggggcctgcatcaccaacagcgcccgggagaggaagatcaacagcagcctgcagctgcctgacagagtgctgaacttcctgaaggaccacttcctgatggatggccaggtgcgcagcaggatgctgctgctgcagccccaggcccgctaccagagggtggccgtgcaccgggtgcccggcctgcaccacacctatgatgtgctcttcctgggcactggagatggccgcctgcacaaggctgtgtctgtgggcccccgggtgcacatcatcgaggagctgcagatcttcagcagcggccagcctgtgcagaacctgctgctggacacccaccggggcctgctgtatgctgccagccacagcggcgtggtgcaggtgcccatggccaactgcagcctgtaccgcagctgtggggactgcctgctggcccgggacccctactgtgcctggagcggcagcagctgcaagcacgtgtccctgtaccagccccagctggccacccggccctggatccaggacatcgagggcgccagcgccaaggacctgtgcagcgccagctctgtggtgagccccagctttgtgcccaccggggagaagccctgtgagcaggtgcagttccagcccaacacagtgaacaccctggcctgccccctgctgagcaacctggccacccggctgtggctgagaaatggagcccctgtgaatgccagcgccagctgccacgtgctgcccactggagacctgctgctggtgggcacccagcagctgggggagttccagtgctggagcctggaggagggcttccagcagctggtggccagctactgcccagaggtggtggaggatggagtggccgaccagacagatgaaggaggctctgtgcctgtgatcatcagcaccagccgggtgtctgccccagctgggggcaaggcctcctggggcgctgaccgctcctgggcccggacccagctgctggacctgagcagcctgtaccaggccgtggccacccgggaggacagcgccagcagtggagagatctcctag

SEQ ID NO: 37856 - DNA, 2514 bp, Artificial Sequence; identical to SEQ ID NO: 37854
  Description of Artificial Sequence: Synthetic coding sequence

SEQ ID NO: 37857 - DNA, 276 bp, Artificial Sequence
  Description of Artificial Sequence: Synthetic coding sequence
atgctgaggacagccatgggcctgcgctcctggctggccgccccctggggcgccctgccccccaggcctcccctgctgctgctgctgctgctgctgctgctgctgcagcccccaccacccacctgggccctgagcccccgcatcagcctgcccctgggcagcgaggagcggcccttcctgcgctttgaggccgagcacatcagcaactacacagccctgctgctgagcagagatggccgcaccctgtatgtgggcgcccgggaggccctcttctag

SEQ ID NO: 37858 - DNA, 345 bp, Artificial Sequence
  Description of Artificial Sequence: Synthetic coding sequence
atgctgaggacagccatgggcctgcgctcctggctggccgccccctggggcgccctgccccccaggcctcccctgctgctgctgctgctgctgctgctgctgctgcagcccccaccacccacctgggccctgagcccccgcatcagcctgcccctgggcagcgaggagcggcccttcctgcgctttgaggccgagcacatcagcaactacacagccctgctgctgagcagagatggccgcaccctgtatgtgggcgcccgggaggccctgtttgccctgagcagcaacctgtccttcctgcctggaggagagtaccaggagctgctgtggggcgcagatgcctag

SEQ ID NO: 37859 - DNA, 366 bp, Artificial Sequence
  Description of Artificial Sequence: Synthetic coding sequence
atgctgaggacagccatgggcctgcgctcctggctggccgccccctggggcgccctgccccccaggcctcccctgctgctgctgctgctgctgctgctgctgctgcagcccccaccacccacctgggccctgagcccccgcatcagcctgcccctgggcagcgaggagcggcccttcctgcgctttgaggccgagcacatcagcaactacacagccctgctgctgagcagagatggccgcaccctgtatgtgggcgcccgggaggccctgtttgccctgagcagcaacctgtccttcctgcctggaggagagtaccaggagctgctgtggggcgcagatgctgagaagaagcagcagtgcagctag

SEQ ID NO: 37860 - DNA, 2502 bp, Artificial Sequence
  Description of Artificial Sequence: Synthetic coding sequence
atggccccccactgggccgtgtggctgctggccgcccggctgtggggcctgggcattggagctgaggtgtggtggaacctggtgcccaggaagacagtgtcctctggagagctggccaccgtggtgcggcgcttcagccagacaggcatccaggacttcctgaccctgaccctgacagagcccaccggcctgctgtatgtgggcgcccgggaggccctgtttgccttctccatggaggccctggagctgcagggcgccatctcctgggaggcccctgtggagaagaagacagagtgcatccagaagggcaagaacaaccagacagagtgcttcaacttcatccgcttcctgcagccctacaatgccagccacctgtatgtgtgtggcacctacgccttccagcccaagtgcacctacgtgaacatgctgaccttcaccctggagcacggggagtttgaagatggcaagggcaagtgcccctatgaccctgccaagggccacgccggcctgctggtggatggagagctgtacagcgccaccctgaacaacttcctgggcacagagcccatcatcctgaggaacatgggcccccaccacagcatgaagacagagtacctggccttctggctgaatgagccccactttgtgggcagcgcctacgtgcctgagagcgtgggcagcttcaccggagatgatgacaaggtgtacttcttcttccgggagagagctgtggagagtgactgctacgccgagcaggtggtggcccgggtggcccgggtgtgcaagggggacatgggcggggcccggaccctgcagaggaagtggaccaccttcctgaaggcccggctggcctgcagcgcccccaactggcagctgtacttcaaccagctgcaggccatgcacaccctgcaggacacctcctggcacaacaccaccttcttcggggtcttccaggcccagtggggagacatgtacctgagcgccatctgtgagtaccagctggaggagatccagagggtgtttgagggcccctacaaggagtaccacgaggaggcccagaagtgggaccgctacacagatcctgtgcccagccccaggcctggcagctgcatcaacaactggcaccggcggcacggctacaccagcagcctggagctgcctgacaacatcctgaactttgtgaagaagcaccccctgatggaggagcaggtgggcccccgctggagccggcccctgctggtgaagaagggcaccaacttcacccacctggtggccgacagagtgacaggcctggatggagccacctacacagtgctcttcatcggcactggagatggctggctgctgaaggctgtgtccctgggcccctgggtgcacctgattgaggagctgcagctgtttgaccaggagcccatgaggagcctggtgctgagccagagcaagaagctgctgtttgctggcagccgcagccagctggtgcagctgcctgtggccgactgcatgaagtaccgcagctgtgccgactgtgtgctggcccgggacccctactgtgcctggagcgtgaacaccagccgctgtgtggccgtgggcggccacagcggcagcctgctgatccagcacgtgatgaccagtgacaccagcggcatctgcaacctgcggggcagcaagaaggtgcggcccacccccaagaacatcaccgtggtggccggcacagacctggtgctgccctgccacctgagcagcaacctggcccacgcccgctggaccttcggcggccgggacctgcctgctgagcagcccggcagcttcctgtatgatgcccggctgcaggccctggtggtgatggccgcccagcccaggcatgctggggcctaccactgcttcagcgaggagcagggcgcccggctggccgctgagggctacctggtggccgtggtggccggccccagcgtgaccctggaggcccgggcccccctggagaacctgggcctggtgtggctggccgtggtggccctgggcgctgtgtgcctggtgctgctgctgctggtgctgagcctgcggcggcggctgcgggaggagctggagaagggggccaaggccacagagaggaccctggtgtaccccctggagctgcccaaggagcccaccagcccccccttccggccctgcccagagccagatgagaagctgtgggaccctgtgggctactactacagtgatggcagcctgaagatcgtgcccggccacgcccgctgccagcccggcggcggcccccccagccccccacctggcatccctggccagcccctgcccagccccacccggctgcacctgggcggcggcaggaacagcaatgccaacggctacgtgcggctgcagctgggcggagaagatcggggcggcctgggccaccccctgcctgagctggctgatgagctgcggaggaagctgcagcagaggcagcccctgcctgacagcaaccctgaggagagctctgtgtag

SEQ ID NO: 37861 - DNA, 606 bp, Artificial Sequence
  Description of Artificial Sequence: Synthetic coding sequence
atggccccccactgggccgtgtggctgctggccgcccggctgtggggcctgggcattggagctgaggtgtggtggaacctggtgcccaggaagacagtgtcctctggagagctggccaccgtggtgcggcgcttcagccagacaggcatccaggacttcctgaccctgaccctgacagagcccaccggcctgctgtatgtgggcgcccgggaggccctgtttgccttctccatggaggccctggagctgcagggcgccatctcctgggaggcccctgtggagaagaagacagagtgcatccagaagggcaagaacaaccagacagagtgcttcaacttcatccgcttcctgcagccctacaatgccagccacctgtatgtgtgtggcacctacgccttccagcccaagtgcacctacgtgaacatgctgaccttcaccctggagcacggggagtttgaagatggcaagggcaagtgcccctatgaccctgccaagggccacgccggcctgctggtggatggagagctgtacagcgccaccctgaacaacttcctgggcacagagcccatcatcctgaggaacatgggcccccaccacagcatgtag

SEQ ID NO: 37862 - DNA, 423 bp, Artificial Sequence
  Description of Artificial Sequence: Synthetic coding sequence
atggccccccactgggccgtgtggctgctggccgcccggctgtggggcctgggcattggagctgaggtgtggtggaacctggtgcccaggaagacagtgtcctctggagagctggccaccgtggtgcggcgcttcagccagacaggcatccaggacttcctgaccctgaccctgacagagcccaccggcctgctgtatgtgggcgcccgggaggccctgtttgccttctccatggaggccctggagctgcagggcgccatctcctgggaggcccctgtggagaagaagacagagtgcatccagaagggcaagaacaaccagacagagtgcttcaacttcatccgcttcctgcagccctacaatgccagccacctgtatgtgtgtggcacctacgccttccagcccaagtgcacctacgtgtag

SEQ ID NO: 37863 - DNA, 2217 bp, Artificial Sequence
  Description of Artificial Sequence: Synthetic coding sequence
atgaggatgtgcacccccatccggggcctgctgatggccctggccgtgatgtttggaacagccatggcctttgcccccatcccccgcatcacctgggagcaccgggaggtgcacctggtgcagttccacgagccagacatctacaactacagcgccctgctgctgtctgaggacaaggacaccctgtacatcggggcccgggaggccgtgtttgctgtgaatgccctgaacatcagcgagaagcagcacgaggtgtactggaaggtgtctgaggacaagaaggccaagtgtgccgagaagggcaagagcaagcagacagaatgtctgaactacatccgggtgctgcagcccctgagcgccaccagcctgtatgtgtgtggcaccaatgccttccagcctgcctgtgaccacctgaacctgaccagcttcaagttcctgggcaagaatgaagatggcaagggccgctgcccctttgatcctgcccacagctacacctctgtgatggtggatggagagctgtacagcggcaccagctacaacttcctgggcagcgagcccatcatcagcaggaacagcagccacagccccctgaggacagaatatgccatcccctggctgaatgagcccagctttgtgtttgctgatgtgatcaggaagagcccagacagcccagatggagaagatgacagagtgtacttcttcttcacagaggtgtctgtggagtatgaatttgtgttccgggtgctgatccccagaattgcccgggtgtgcaagggggaccagggcggcctgcggaccctgcagaagaagtggaccagcttcctgaaggcccggctcatctgcagcaggccagacagcggcctggtgttcaacgtgctgagagatgtgtttgtgctgcggagccctggcctgaaggtgcctgtgttctacgccctcttcaccccccagctgaacaacgtgggcctgtctgctgtgtgtgcctacaacctgagcacagctgaggaggtgttcagccacggcaagtacatgcagagcaccaccgtggagcagagccacaccaagtgggtgcgctacaatggacctgtgcccaagcccaggcctggggcctgcattgattctgaggcccgggccgccaactacaccagcagcctgaacctgcctgacaagaccctgcagtttgtgaaggaccaccccctgatggatgattctgtgacccccatcgacaaccggcccaggctcatcaagaaggatgtgaactacacccagatcgtggtggacaggacccaggccctggatggcaccgtgtatgatgtgatgtttgtgtccacagacagaggagccctgcacaaggccatcagcctggagcacgctgtgcacatcatcgaggagacccagctgttccaggactttgagcctgtgcagaccctgctgctgagcagcaagaagggcaacagatttgtgtatgccggcagcaacagcggcgtggtgcaggcccccctggccttctgtgggaagcacggcacctgtgaggactgtgtgctggcccgggacccctactgtgcctggagccccccaacagccacctgtgtggccctgcaccagacagagagccccagccggggcctcatccaggagatgtctggagatgcctctgtgtgcccagccagcagccccaagcccctgcccccacctggcagcagcagcctgagctgcctgggccacgtgggggaccggcggctgagcagcccctggaccccctggccagccagcggggccggccctgacagcagcagccgggtgtccctgctgccccccttcctgagtgaccaggcccagcacgtgcacgccctgggcaacttctacctgttctgccaggccactggacctgctgacatccgctttgtgtgggagaagaatggccgggccctggagacctgtgtgcctgtgcagacccacgccctgcctgatggccgggcccacgccctgtcctggctgcaggatgccatccgggagagcgctgagtaccgctgcagcgtgctgagcagcgctggcaacaagaccagcaaggtgcaggtggccgtgatgaggcctgaggtgacccaccaggagcgctggacccgggagctgagcgcctggagggctgtggccggggagcatgacaggatgatgcagagctggaggaaggcctgggagagctgcagcaaggacaccctgtag

SEQ ID NO: 37864 - DNA, 2589 bp, Artificial Sequence
  Description of Artificial Sequence: Synthetic coding sequence
atgaggatgtgcacccccatccggggcctgctgatggccctggccgtgatgtttggaacagccatggcctttgcccccatcccccgcatcacctgggagcaccgggaggtgcacctggtgcagttccacgagccagacatctacaactacagcgccctgctgctgtctgaggacaaggacaccctgtacatcggggcccgggaggccgtgtttgctgtgaatgccctgaacatcagcgagaagcagcacgaggtgtactggaaggtgtctgaggacaagaaggccaagtgtgccgagaagggcaagagcaagcagacagaatgtctgaactacatccgggtgctgcagcccctgagcgccaccagcctgtatgtgtgtggcaccaatgccttccagcctgcctgtgaccacctgaacctgaccagcttcaagttcctgggcaagaatgaagatggcaagggccgctgcccctttgatcctgcccacagctacacctctgtgatggtggatggagagctgtacagcggcaccagctacaacttcctgggcagcgagcccatcatcagcaggaacagcagccacagccccctgaggacagaatatgccatcccctggctgaatgagcccagctttgtgtttgctgatgtgatcaggaagagcccagacagcccagatggagaagatgacagagtgtacttcttcttcacagaggtgtctgtggagtatgaatttgtgttccgggtgctgatccccagaattgcccgggtgtgcaagggggaccagggcggcctgcggaccctgcagaagaagtggaccagcttcctgaaggcccggctcatctgcagcaggccagacagcggcctggtgttcaacgtgctgagagatgtgtttgtgctgcggagccctggcctgaaggtgcctgtgttctacgccctcttcaccccccagctgaacaacgtgggcctgtctgctgtgtgtgcctacaacctgagcacagctgaggaggtgttcagccacggcaagtacatgcagagcaccaccgtggagcagagccacaccaagtgggtgcgctacaatggacctgtgcccaagcccaggcctggggcctgcattgattctgaggcccgggccgccaactacaccagcagcctgaacctgcctgacaagaccctgcagtttgtgaaggaccaccccctgatggatgattctgtgacccccatcgacaaccggcccaggctcatcaagaaggatgtgaactacacccagatcgtggtggacaggacccaggccctggatggcaccgtgtatgatgtgatgtttgtgtccacagacagaggagccctgcacaaggccatcagcctggagcacgctgtgcacatcatcgaggagacccagctgttccaggactttgagcctgtgcagaccctgctgctgagcagcaagaagggcaacagatttgtgtatgccggcagcaacagcggcgtggtgcaggcccccctggccttctgtgggaagcacggcacctgtgaggactgtgtgctggcccgggacccctactgtgcctggagccccccaacagccacctgtgtggccctgcaccagacagagagccccagccggggcctcatccaggagatgtctggagatgcctctgtgtgcccagacaagagcaagggcagctaccggcagcacttcttcaagcacggcggcacagctgagctgaagtgcagccagaagagcaacctggcccgggtcttctggaagttccagaatggagtgctgaaggccgagagccccaagtatggcctgatgggcaggaagaacctgctgatcttcaacctgtctgagggggacagcggcgtgtaccagtgcctgtctgaggagcgggtgaagaacaagacagtgttccaggtggtggccaagcacgtgctggaggtgaaggtggtgcccaagcctgtggtggcccccaccctgtctgtggtgcagacagagggcagccgcatcgccaccaaggtgctggtggccagcacccagggcagcagcccccccaccccagctgtgcaggccaccagcagcggggccatcaccctgccccccaagccagcccccaccggcaccagctgtgagcccaagatcgtcatcaacacagtgccccagctgcacagcgagaagaccatgtacctgaagagcagtgacaaccggctgctgatgagcctcttcctgttcttctttgtgctcttcctgtgcctcttcttctacaactgctacaagggctacctgccccggcagtgcctgaagttccgcagcgccctgctgattggcaagaagaagcccaagagtgacttctgtgaccgggagcagagcctgaaggagaccctggtggagcccggcagcttcagccagcagaatggagagcaccccaagccagccctggacaccggctatgaaacagagcaggacaccatcaccagcaaggtgcccacagaccgggaggacagccagagaattgatgacctgagcgcccgggacaagccctttgatgtgaagtgtgagctgaagtttgctgacagtgatgctgatggagactag

SEQ ID NO: 37865 - DNA, 180 bp, Artificial Sequence
  Description of Artificial Sequence: Synthetic coding sequence
atgaggatgtgcacccccatccggggcctgctgatggccctggccgtgatgtttggaacagccatggcctttgcccccatcccccgcatcacctgggagcaccgggaggtgcacctggtgcagttccacgagccagacatctacaactacagcgccctgctgctgtctgaggacaagtag

SEQ ID NO: 37866 - DNA, 372 bp, Artificial Sequence
  Description of Artificial Sequence: Synthetic coding sequence
atgtggacccagcgctggaagaggtctgtgtccccaggccctgctgacatccgctttgtgtgggagaagaatggccgggccctggagacctgtgtgcctgtgcagacccacgccctgcctgatggccgggcccacgccctgtcctggctgcaggatgccatccgggagagcgctgagtaccgctgcagcgtgctgagcagcgctggcaacaagaccagcaaggtgcaggtggccgtgatgaggcctgaggtgacccaccaggagcgctggacccgggagctgagcgcctggagggctgtggccggggagcatgacaggatgatgcagagctggaggaaggcctgggagagctgcagcaaggacaccctgtag

SEQ ID NO: 37867 - DNA, 6 bp, Artificial Sequence
  Description of Artificial Sequence: Synthetic coding sequence
atgtag

SEQ ID NO: 37868 - DNA, 441 bp, Artificial Sequence
  Description of Artificial Sequence: Synthetic coding sequence
atgaggatgtgcacccccatccggggcctgctgatggccctggccgtgatgtttggaacagccatggcctttgcccccatcccccgcatcacctgggagcaccgggaggtgcacctggtgcagttccacgagccagacatctacaactacagcgccctgctgctgtctgaggacaaggacaccctgtacatcggggcccgggaggccgtgtttgctgtgaatgccctgaacatcagcgagaagcagcacgaggtgtactggaaggtgtctgaggacaagaaggccaagtgtgccgagaagggcaagagcaagcagacagaatgtctgaactacatccgggtgctgcagcccctgagcgccaccagcctgtatgtgtgtggcaccaatgccttccagcctgcctgtgaccacctgaacctgaccagcttcaagttcctgtag

SEQ ID NO: 37869 - DNA, 2217 bp, Artificial Sequence; identical to SEQ ID NO: 37863
  Description of Artificial Sequence: Synthetic coding sequence

SEQ ID NO: 37870 - DNA, 2589 bp, Artificial Sequence; identical to SEQ ID NO: 37864
  Description of Artificial Sequence: Synthetic coding sequence

SEQ ID NO: 37871 - DNA, 231 bp, Artificial Sequence
  Description of Artificial Sequence: Synthetic coding sequence
atgaggatgtgcacccccatccggggcctgctgatggccctggccgtgatgtttggaacagccatggcctttgcccccatcccccgcatcacctgggagcaccgggaggtgcacctggtgcagttccacgagccagacatctacaactacagcgccctgctgctgtctgaggacaaggacaccctgtacatcggggcccgggaggccgtgtttgctgtgaatgccctgtag

SEQ ID NO: 37872 - DNA, 2589 bp, Artificial Sequence; identical to SEQ ID NO: 37864
  Description of Artificial Sequence: Synthetic coding sequence

SEQ ID NO: 37873 - DNA, 2589 bp, Artificial Sequence; identical to SEQ ID NO: 37864
  Description of Artificial Sequence: Synthetic coding sequence

SEQ ID NO: 37874 - DNA, 201 bp, Artificial Sequence
  Description of Artificial Sequence: Synthetic coding sequence
atgaggatgtgcacccccatccggggcctgctgatggccctggccgtgatgtttggaacagccatggcctttgcccccatcccccgcatcacctgggagcaccgggaggtgcacctggtgcagttccacgagccagacatctacaactacagcgccctgctgctgtctgaggacaaggacaccctgtacatcggggcctag

SEQ ID NO: 37875 - DNA, 2313 bp, Artificial Sequence
  Description of Artificial Sequence: Synthetic coding sequence
atgcctgccagcgctgcccggccccggcccggccctggccagcccacagccagccccttccccctgctgctgctggccgtgctgagcggccctgtgtctggccgggtgcccaggtctgtgcccaggaccagcctgcccatcagcgaggccgacagctgcctgaccaggtttgctgtgccccacacctacaactacagcgtgctgctggtggaccctgccagccacaccctgtatgtgggcgcccgggacaccatctttgccctgagcctgcccttctctggagagcggcccaggagaattgactggatggtgcctgaggcccaccggcagaactgcaggaagaagggcaagaaggaggatgagtgccacaactttgtgcagatcctggccatcgccaatgccagccacctgctgacctgtggcacctttgcctttgaccccaagtgtggggtgattgatgtgagccgcttccagcaggtggagcggctggagagcggccggggcaaatgtccctttgagcccgcccagaggtctgctgctgtgatggccggcggcgtgctgtatgctgccaccgtgaagaactacctgggcacagagcccatcatcaccagggctgtgggccgggcagaggactggatcagaacagacaccctgcccagctggctgaatgccccagcctttgtggccgctgtggccctgagccctgctgagtggggagatgaagatggagatgatgagatctacttcttcttcacagagaccagccgggcctttgacagctatgagcgcatcaaggtgccccgggtggcccgggtgtgtgccggggacctgggcggcaggaagaccctgcagcagcgctggaccaccttcctgaaggctgacctgctgtgccccggccctgagcacggccgggccagctctgtgctgcaggatgtggccgtgctgcggcctgagctgggcgccggcacccccatcttctacggcatcttcagcagccagtgggagggcgccaccatctctgctgtgtgtgccttccggccccaggacatcagaacagtgctgaatggccccttccgggagctgaagcatgactgcaacagaggcctgcctgtggtggacaatgatgtgccccagcccaggcctggagagtgcatcaccaacaacatgaagctgcggcacttcggcagcagcctgagcctgcctgacagagtgctgaccttcatccgggaccaccccctgatggacaggcctgtgtttcctgcagatggccaccccctgctggtgaccacagacacagcctacctgcgggtggtggcccaccgggtgaccagcctgagcggcaaggagtatgatgtgctgtacctgggcacagaagatggccacctgcacagagctgtgcgcatcggggcccagctgtctgtgctggaggacctggccctcttccctgagccccagcctgtggagaacatgaagctgtaccacagctggctgctggtgggcagcaggacagaggtgacccaggtgaacaccaccaactgtggccgcctgcagagctgcagcgagtgcatcctggcccaggaccctgtgtgtgcctggagcttccggctggatgaatgtgtggcccatgctggggagcaccggggcctggtgcaggacattgaatctgcagatgtgagcagcctgtgccccaaggagcccggggagaggcctgtggtgtttgaggtgcctgtggccacagctgcccacgtggtgctgccctgcagccccagcagcgcctgggccagctgtgtgtggcaccagcccagcggcgtgacagccctgacccccaggagagatggcctggaggtggtggtgacccctggggccatgggcgcctatgcctgtgagtgccaggagggcggggccgcccacgtggtggccgcctacagcctggtgtggggcagccagagagatgcccccagccgggcccacacagtgggcgccggcctggccggcttcttcctgggcatcctggccgccagcctgaccctcatcctgattggccggcggcagcagaggcggcggcagcgggagctgctggcccgggacaaggtgggcctggacctgggcgcccctccttctggcaccaccagctacagccaggacccccccagccccagcccagaagatgagcggctgcccctggccctggccaagaggggcagcggctttggaggcttcagcccccccttcctgctggacccctgccccagccctgcccacatccggctgaccggggcccccctggccacctgtgatgagaccagcatctag

SEQ ID NO: 37876 - DNA, 384 bp, Artificial Sequence
  Description of Artificial Sequence: Synthetic coding sequence
atgcctgccagcgctgcccggccccggcccggccctggccagcccacagccagccccttccccctgctgctgctggccgtgctgagcggccctgtgtctggccgggtgcccaggtctgtgcccaggaccagcctgcccatcagcgaggccgacagctgcctgaccaggtttgctgtgccccacacctacaactacagcgtgctgctggtggaccctgccagccacaccctgtatgtgggcgcccgggacaccatctttgccctgagcctgcccttctctggagagcggcccaggagaattgactggatggtgcctgaggcccaccggcagaactgcaggaagaagggcaagaaggagggcggcagctccatgctgcccctgtag

SEQ ID NO: 37877 - DNA, 1080 bp, Artificial Sequence
  Description of Artificial Sequence: Synthetic coding sequence
atgcccctggagctggagctgtgccccggccgctgggtgggcggccagcacccctgcttcatcatcgccgagatcggccagaaccaccagggcgacctggatgtggccaagaggatgatccgcatggccaaggaatgtggggctgactgtgccaagttccagaagtctgagctggagttcaagttcaacaggaaggccctggagcggccctacaccagcaagcacagctggggcaagacctatggagagcacaagaggcacctggagttcagccatgaccagtaccgggagctgcagagatatgcagaggaggtgggcatcttcttcaccgccagcggcatggatgagatggctgtggagttcctgcacgagctgaatgtgcccttcttcaaggtgggcagcggggacaccaacaacttcccctacctggagaagacagccaagaagggccggcccatggtgatcagcagcggcatgcagagcatggacaccatgaagcaggtgtaccagatcgtgaagcccctgaaccccaacttctgcttcctgcagtgcaccagcgcctaccccctgcagccagaagatgtgaacctgcgggtcatcagcgagtaccagaagctgttcccagacatccccatcggctacagcggccatgaaacaggaattgccatctctgtggccgctgtggccctgggcgccaaggtgctggagcggcacatcaccctggacaagacctggaagggcagtgaccacagcgccagcctggagcccggggagctggccgagctggtgcgctctgtgcggctggtggagcgggccctgggcagccccaccaagcagctgctgccctgtgagatggcctgcaatgagaagctgggcaagtctgtggtggccaaggtgaagatccctgagggcaccatcctgaccatggacatgctgactgtgaaggtgggggagcccaagggctaccccccagaggacatcttcaacctggtgggcaagaaggtgctggtgacagtggaggaggatgacaccatcatggaggagctggtggacaaccacggcaagaagatcaagagctag

SEQ ID NO: 37878 - DNA, 2517 bp, Artificial Sequence
  Description of Artificial Sequence: Synthetic coding sequence
atgtggggccgcctgtggcccctgctgctgagcatcctgacagccacagctgtgcccggccccagcctgcggcggcccagccgggagctggatgccacccccaggatgaccatcccctatgaggagctgagcggcaccaggcacttcaagggccaggcccagaactacagcaccctgctgctggaggaggccagcgcccggctgctggtgggcgcccggggggccctcttcagcctgagcgccaatgacattggagatggagcccacaaggagatccactgggaggccagccctgagatgcagagcaagtgccaccagaagggcaagaacaaccagacagagtgcttcaaccacgtgcgcttcctgcagaggctgaacagcacccacctgtatgcctgtggcacccacgccttccagcccctgtgtgccgccattgatgctgaggccttcaccctgcccaccagctttgaggagggcaaggagaagtgcccctatgaccctgcccggggcttcaccggcctcatcattgatggcggcctgtacacagccaccaggtatgagttccgcagcatcccagacatcagaagaagccgccacccccacagcctgaggacagaggagacccccatgcactggctgaatgatgctgagtttgtgttttctgtgctggtgcgggagagcaaggccagcgctgtgggagatgatgacaaggtgtactacttcttcacagagcgggccacagaggagggcagcggcagcttcacccagagccgcagcagccaccgggtggcccgggtggcccgggtgtgcaagggggacctgggcggcaagaagatcctgcagaagaagtggaccagcttcctgaaggcccggctcatctgccacatccccctgtatgagaccctgcggggcgtgtgcagcctggatgctgagaccagcagcaggacccacttctacgccgccttcaccctgagcacccagtggaagaccctggaggccagcgccatctgccgctatgacctggccgagatccaggccgtgtttgctggcccctacatggagtaccaggacggcagccgccgctggggccgctatgaaggaggagtgcctgagccccggcccggcagctgcatcacagacagcctgcggagccagggctacaacagcagccaggacctgcccagcctggtgctggactttgtgaagctgcaccccctgatggcccggcctgtggtgcccacccggggccggcccctgctgctgaagaggaacatccgctacacccacctgaccggcacccctgtgaccaccccagctggccccacctatgacctgctcttcctgggcacagcagatggctggatccacaaggctgtggtgctgggcagcggcatgcacatcatcgaggagacccaggtgttccgggagagccagagcgtggagaacctggtgatcagcctgctgcagcacagcctgtatgtgggcgcccccagcggggtcatccagctgcccctgagcagctgcagccgctaccgcagctgctatgactgcatcctggcccgggacccctactgcggctgggaccccggcacccacgcctgtgccgccgccaccaccatcgccaacagaacagccctgatccaggacatcgagcggggcaacagaggctgtgagagcagccgggacaccggccccccaccacccctgaagaccaggtctgtgctgcggggagatgatgtgctgctgccctgtgaccagcccagcaacctggcccgggccctgtggctgctgaatggctccatgggcctgagtgatggccagggcggctacagagtgggcgtggatggcctgctggtgacagatgcccagcctgagcacagcggcaactacggctgctacgccgaggagaatggcctgcggaccctgctggccagctacagcctgactgtgcggcctgccaccccagccccagcccccaaggccccagccacccctggggcccagctggccccagatgtgcggctgctgtatgtgctggccatcgccgccctgggcggcctgtgcctgatcctggccagcagcctgctgtatgtggcctgcctgcgggagggcagaagaggaagaagaaggaagtacagcctgggccgggccagccgggccggcggcagcgctgtgcagctgcagacagtgtctggccagtgccctggagaggaggatgaaggagatgatgaaggagctgggggcctggagggcagctgcctgcagatcatccctggagagggcgccccagcccctcctcctcctcctcctcctcctcctcctgctgagctgaccaacggcctggtggccctgcccagccggctgcggaggatgaatggaaacagctatgtgctgctgcggcagagcaacaacggggtgcctgctggcccctgcagctttgctgaggagctgagccgcatcctggagaagaggaagcacacccagctggtggagcagctggatgagagctctgtgtag

SEQ ID NO: 37879 - DNA, 1659 bp, Artificial Sequence
  Description of Artificial Sequence: Synthetic coding sequence
atgtggggccgcctgtggcccctgctgctgagcatcctgacagccacagctgtgcccggccccagcctgcggcggcccagccgggagctggatgccacccccaggatgaccatcccctatgaggagctgagcggcaccaggcacttcaagggccaggcccagaactacagcaccctgctgctggaggaggccagcgcccggctgctggtgggcgcccggggggccctcttcagcctgagcgccaatgacattggagatggagcccacaaggagatccactgggaggccagccctgagatgcagagcaagtgccaccagaagggcaagaacaaccagacagagtgcttcaaccacgtgcgcttcctgcagaggctgaacagcacccacctgtatgcctgtggcacccacgccttccagcccctgtgtgccgccattgatgctgaggccttcaccctgcccaccagctttgaggagggcaaggagaagtgcccctatgaccctgcccggggcttcaccggcctcatcattgatggcggcctgtacacagccaccaggtatgagttccgcagcatcccagacatcagaagaagccgccacccccacagcctgaggacagaggagacccccatgcactggctgaatgatgctgagtttgtgttttctgtgctggtgcgggagagcaaggccagcgctgtgggagatgatgacaaggtgtactacttcttcacagagcgggccacagaggagggcagcggcagcttcacccagagccgcagcagccaccgggtggcccgggtggcccgggtgtgcaagggggacctgggcggcaagaagatcctgcagaagaagtggaccagcttcctgaaggcccggctcatctgccacatccccctgtatgagaccctgcggggcgtgtgcagcctggatgctgagaccagcagcaggacccacttctacgccgccttcaccctgagcacccagtggaagaccctggaggccagcgccatctgccgctatgacctggccgagatccaggccgtgtttgctggcccctacatggagtaccaggacggcagccgccgctggggccgctatgaaggaggagtgcctgagccccggcccggcagctgcatcacagacagcctgcggagccagggctacaacagcagccaggacctgcccagcctggtgctggactttgtgaagctgcaccccctgatggcccggcctgtggtgcccacccggggccggcccctgctgctgaagaggaacatccgctacacccacctgaccggcacccctgtgaccaccccagctggccccacctatgacctgctcttcctgggcacagcagatggctggatccacaaggctgtggtgctgggcagcggcatgcacatcatcgaggagacccaggtgttccgggagagccagagcgtggagaacctggtgatcagcctgctgcagcacagcctgtatgtgggcgcccccagcggggtcatccagctgcccctgagcagctgcagccgctaccgcagctgctatgactgcatcctggcccgggacccctactgccacatcctgagcggccccctgccccagccccacgtggtgaccagcctgagccgggcctgggagcgggccagcctgggccgctag

SEQ ID NO: 37880 - DNA, 2109 bp, Artificial Sequence
  Description of Artificial Sequence: Synthetic coding sequence
atgtggggccgcctgtggcccctgctgctgagcatcctgacagccacagctgtgcccggccccagcctgcggcggcccagccgggagctggatgccacccccaggatgaccatcccctatgaggagctgagcggcaccaggcacttcaagggccaggcccagaactacagcaccctgctgctggaggaggccagcgcccggctgctggtgggcgcccggggggccctcttcagcctgagcgccaatgacattggagatggagcccacaaggagatccactgggaggccagccctgagatgcagagcaagtgccaccagaagggcaagaacaaccagacagagtgcttcaaccacgtgcgcttcctgcagaggctgaacagcacccacctgtatgcctgtggcacccacgccttccagcccctgtgtgccgccattgatgctgaggccttcaccctgcccaccagctttgaggagggcaaggagaagtgcccctatgaccctgcccggggcttcaccggcctcatcattgatggcggcctgtacacagccaccaggtatgagttccgcagcatcccagacatcagaagaagccgccacccccacagcctgaggacagaggagacccccatgcactggctgaatgatgctgagtttgtgttttctgtgctggtgcgggagagcaaggccagcgctgtgggagatgatgacaaggtgtactacttcttcacagagcgggccacagaggagggcagcggcagcttcacccagagccgcagcagccaccgggtggcccgggtggcccgggtgtgcaagggggacctgggcggcaagaagatcctgcagaagaagtggaccagcttcctgaaggcccggctcatctgccacatccccctgtatgagaccctgcggggcgtgtgcagcctggatgctgagaccagcagcaggacccacttctacgccgccttcaccctgagcacccagtggaagaccctggaggccagcgccatctgccgctatgacctggccgagatccaggccgtgtttgctggcccctacatggagtaccaggacggcagccgccgctggggccgctatgaaggaggagtgcctgagccccggcccggcagctgcatcacagacagcctgcggagccagggctacaacagcagccaggacctgcccagcctggtgctggactttgtgaagctgcaccccctgatggcccggcctgtggtgcccacccggggccggcccctgctgctgaagaggaacatccgctacacccacctgaccggcacccctgtgaccaccccagctggccccacctatgacctgctcttcctgggcacagcagatggctggatccacaaggctgtggtgctgggcagcggcatgcacatcatcgaggagacccaggtgttccgggagagccagagcgtggagaacctggtgatcagcctgctgcagcacagcctgtatgtgggcgcccccagcggggtcatccagctgcccctgagcagctgcagccgctaccgcagctgctatgactgcatcctggcccgggacccctactgcggctgggaccccggcacccacgcctgtgccgccgccaccaccatcgccaacagaagccagggcagcaggacagccctgatccaggacatcgagcggggcaacagaggctgtgagagcagccgggacaccggccgggccctgcaggtgcacatgggctccatgagccccccatctgcctggccctgtgtgctggatggccctgagacccggcaggacctgtgccagccccccaagccctgtgtgcacagccacgcccacatggaggagtgcctgtctgctggcctgcagtgcccccacccccacctgctgctggtgcacagctgcttcatcccagccagcggcctgggcgtgcccagccagctgccccaccccatctggagcagcagccctgccccctgtggggacctgtttgtgaagagcctgggcaccggccagcctggagaggtgcggctgcaccacagcccccccctgcccagctgtgtggccctggtgaaccagcccccccacagcccctggagcttcagccgggtgtag

SEQ ID NO: 37881 - DNA, 513 bp, Artificial Sequence
  Description of Artificial Sequence: Synthetic coding sequence
atgtggggccgcctgtggcccctgctgctgagcatcctgacagccacagctgtgcccggccccagcctgcggcggcccagccgggagctggatgccacccccaggatgaccatcccctatgaggagctgagcggcaccaggcacttcaagggccaggcccagaactacagcaccctgctgctggaggaggccagcgcccggctgctggtgggcgcccggggggccctcttcagcctgagcgccaatgacattggagatggagcccacaaggagatccactgggaggccagccctgagatgcagagcaagtgccaccagaagggcaagaacaaccagacagagtgcttcaaccacgtgcgcttcctgcagaggctgaacagcacccacctgtatgcctgtggcacccacgccttccagcccctgtgtgccgccattgatgctgaggccttcaccctgcccaccagctttgaggagggcaaggagaagtgcccctatgaccctgcccggggctag

SEQ ID NO: 37882 - DNA, 1569 bp, Artificial Sequence
  Description of Artificial Sequence: Synthetic coding sequence
atgtggggccgcctgtggcccctgctgctgagcatcctgacagccacagctgtgcccggccccagcctgcggcggcccagccgggagctggatgccacccccaggatgaccatcccctatgaggagctgagcggcaccaggcacttcaagggccaggcccagaactacagcaccctgctgctggaggaggccagcgcccggctgctggtgggcgcccggggggccctcttcagcctgagcgccaatgacattggagatggagcccacaaggagatccactgggaggccagccctgagatgcagagcaagtgccaccagaagggcaagaacaaccagacagagtgcttcaaccacgtgcgcttcctgcagaggctgaacagcacccacctgtatgcctgtggcacccacgccttccagcccctgtgtgccgccattgatgctgaggccttcaccctgcccaccagctttgaggagggcaaggagaagtgcccctatgaccctgcccggggcttcaccggcctcatcattgatggcggcctgtacacagccaccaggtatgagttccgcagcatcccagacatcagaagaagccgccacccccacagcctgaggacagaggagacccccatgcactggctgaatgatgctgagtttgtgttttctgtgctggtgcgggagagcaaggccagcgctgtgggagatgatgacaaggtgtactacttcttcacagagcgggccacagaggagggcagcggcagcttcacccagagccgcagcagccaccgggtggcccgggtggcccgggtgtgcaagggggacctgggcggcaagaagatcctgcagaagaagtggaccagcttcctgaaggcccggctcatctgccacatccccctgtatgagaccctgcggggcgtgtgcagcctggatgctgagaccagcagcaggacccacttctacgccgccttcaccctgagcacccagtggaagaccctggaggccagcgccatctgccgctatgacctggccgagatccaggccgtgtttgctggcccctacatggagtaccaggacggcagccgccgctggggccgctatgaaggaggagtgcctgagccccggcccggcagctgcatcacagacagcctgcggagccagggctacaacagcagccaggacctgcccagcctggtgctggactttgtgaagctgcaccccctgatggcccggcctgtggtgcccacccggggccggcccctgctgctgaagaggaacatccgctacacccacctgaccggcacccctgtgaccaccccagctggccccacctatgacctgctcttcctgggcacagcagatggctggatccacaaggctgtggtgctgggcagcggcatgcacatcatcgaggagacccaggtgttccgggagagccagagcgtggagaacctggtgatcagcctgctgcagcacagcctgtatgtgggcgcccccagcggggtcatccagctgcccctgagcagctgcagccgctaccgcagctgctatgactgcatcctggcccgggactag

SEQ ID NO: 37883 - DNA, 2517 bp, Artificial Sequence; identical to SEQ ID NO: 37878
  Description of Artificial Sequence: Synthetic coding sequence

SEQ ID NO: 37884 - DNA, 3279 bp, Artificial Sequence
  Description of Artificial Sequence: Synthetic coding sequence
atgccctgtggcttcagccccagccctgtggcccaccacctggtgcccggccccccagacaccccagcccagcagctgcgctgtggctggacagtgggcggctggctgctgagcctggtgcggggcctgctgccctgcctgcccccaggggccaggacagctgagggccccatcatggtgctggccggccccctggccgtgtccctgctgctgcccagcctgaccctgctggtgagccacctgagcagcagccaggatgtgtcctctgagcccagcagcgagcagcagctgtgtgccctgagcaagcaccccaccgtggcctttgaggacctgcagccctgggtgagcaacttcacctacccaggggcccgggacttcagccagctggccctggaccccagcggcaaccagctgattgtgggcgccaggaactacctgttccggctgagcctggccaacgtgtccctgctgcaggccacagagtgggccagcagcgaggacaccaggaggagctgccagagcaagggcaagacagaggaggagtgccagaactacgtgcgggtgctgattgtggccggcaggaaggtgttcatgtgtggcaccaatgccttcagccccatgtgcaccagccggcaggtgggcaacctgagcaggaccatcgagaagatcaacggggtggcccgctgcccctatgaccccaggcacaacagcacagctgtgatcagcagccagggcgagctgtatgctgccaccgtgattgacttcagcggccgggaccctgccatctaccgcagcctgggcagcggcccccccctgaggacagcccagtacaacagcaagtggctgaatgagcccaactttgtggccgcctatgacatcggcctgtttgcctacttcttcctgagagaaaatgctgtggagcatgactgtggccgcacagtgtacagccgggtggcccgggtgtgcaagaatgatgtgggcggccgcttcctgctggaggacacctggaccaccttcatgaaggcccggctgaactgcagcaggcctggagaggtgcccttctactacaatgagctgcagagcgccttccacctgcctgagcaggacctgatctacggcgtcttcaccaccaacgtgaacagcattgctgccagcgctgtgtgtgccttcaacctgagcgccatcagccaggccttcaacggccccttccgctaccaggagaaccccagggctgcctggctgcccatcgccaaccccatccccaacttccagtgtggcaccctgcctgagaccggccccaatgaaaacctgacagagaggagcctgcaggatgcccagaggctcttcctgatgtctgaggccgtgcagcctgtgaccccagagccctgtgtgacccaggacagcgtgcgcttcagccacctggtggtggacctggtgcaggccaaggacaccctgtaccacgtgctgtacatcggcacagaaagtggcaccatcctgaaggccctgagcacagccagccgcagcctgcacggctgctacctggaggagctgcacgtgctgcccccaggccggcgggagcccctgcggagcctgcgcatcctgcacagcgcccgggccctgtttgtgggcctgagagatggagtgctgcgggtgcccctggagcgctgtgccgcctaccgcagccagggcgcctgcctgggcgcccgggacccctactgcggctgggatggcaagcagcagcgctgcagcaccctggaggacagcagcaacatgagcctgtggacccagaacatcacagcctgccctgtgagaaatgtgaccagagatggcggcttcggcccctggagcccctggcagccctgtgagcacctggatggagacaacagcggcagctgcctgtgccgggcccggagctgtgacagcccccggccccgctgtggcggcctggactgcctgggccctgccatccacatcgccaactgcagcagaaatggagcctggaccccctggagctcctgggccctgtgcagcaccagctgtggcatcggcttccaggtgcggcagaggagctgcagcaacccagcccccaggcatggaggccgcatctgtgtgggcaagagccgggaggagcgcttctgcaatgaaaacaccccctgccctgtgcccatcttctgggcctcctggggctcctggagcaagtgcagcagcaactgtggcggcggcatgcagagcagaagaagagcctgtgaaaatggaaacagctgcctgggctgtggggagttcaagacctgcaaccctgagggctgcccagaggtgagaagaaacaccccctggaccccctggctgcctgtgaatgtgacccagggcggggcccggcaggagcagcgcttccgcttcacctgccgggcccccctggccgacccccacggcctgcagtttggaagaagaagaacagagaccaggacctgcccagcagatggcagcggcagctgtgacacagatgccctggtggaggtgctgctgcggagcggcagcaccagcccccacacagtgtctgggggctgggccgcctggggcccctggagcagctgcagccgggactgtgagctgggcttccgggtgaggaagaggacctgcaccaaccctgagcccagaaatggaggcctgccctgtgtgggagatgctgctgagtaccaggactgcaacccccaggcctgccctgtgcggggggcctggagctgctggacctcctggagcccctgcagcgccagctgtggcggcggccactaccagaggaccaggagctgcaccagccctgcccccagccctggagaggacatctgcctgggcctgcacacagaggaggccctgtgtgccacccaggcctgccccggctggagcccctggagcgagtggagcaagtgcacagatgatggagcccagagccgcagccgccactgtgaggagctgctgcccggcagcagcgcctgtgccggcaacagcagccagagccggccctgcccctacagcgagatccctgtgatcctgcctgccagctccatggaggaggccacagactgtgccggcaagaggaacagaacctacctgatgctgcggagcagccagcccagcggcacccccctgcagagcctggacagcttccacatcctgctgcagacagccaagctgtgctggggcccccactgctttgagatgggcagcatcagcagcacctggtggccccgggccagccctgcctcctgggccctgggcagctag

SEQ ID NO: 37885 - DNA, 3456 bp, Artificial Sequence
  Description of Artificial Sequence: Synthetic coding sequence
atgccctgtggcttcagccccagccctgtggcccaccacctggtgcccggccccccagacaccccagcccagcagctgcgctgtggctggacagtgggcggctggctgctgagcctggtgcggggcctgctgccctgcctgcccccaggggccaggacagctgagggccccatcatggtgctggccggccccctggccgtgtccctgctgctgcccagcctgaccctgctggtgagccacctgagcagcagccaggatgtgtcctctgagcccagcagcgagcagcagctgtgtgccctgagcaagcaccccaccgtggcctttgaggacctgcagccctgggtgagcaacttcacctacccaggggcccgggacttcagccagctggccctggaccccagcggcaaccagctgattgtgggcgccaggaactacctgttccggctgagcctggccaacgtgtccctgctgcaggccacagagtgggccagcagcgaggacaccaggaggagctgccagagcaagggcaagacagaggaggagtgccagaactacgtgcgggtgctgattgtggccggcaggaaggtgttcatgtgtggcaccaatgccttcagccccatgtgcaccagccggcaggtgggcaacctgagcaggaccatcgagaagatcaacggggtggcccgctgcccctatgaccccaggcacaacagcacagctgtgatcagcagccagggcgagctgtatgctgccaccgtgattgacttcagcggccgggaccctgccatctaccgcagcctgggcagcggcccccccctgaggacagcccagtacaacagcaagtggctgaatgagcccaactttgtggccgcctatgacatcggcctgtttgcctacttcttcctgagagaaaatgctgtggagcatgactgtggccgcacagtgtacagccgggtggcccgggtgtgcaagaatgatgtgggcggccgcttcctgctggaggacacctggaccaccttcatgaaggcccggctgaactgcagcaggcctggagaggtgcccttctactacaatgagctgcagagcgccttccacctgcctgagcaggacctgatctacggcgtcttcaccaccaacgtgaacagcattgctgccagcgctgtgtgtgccttcaacctgagcgccatcagccaggccttcaacggccccttccgctaccaggagaaccccagggctgcctggctgcccatcgccaaccccatccccaacttccagtgtggcaccctgcctgagaccggccccaatgaaaacctgacagagaggagcctgcaggatgcccagaggctcttcctgatgtctgaggccgtgcagcctgtgaccccagagccctgtgtgacccaggacagcgtgcgcttcagccacctggtggtggacctggtgcaggccaaggacaccctgtaccacgtgctgtacatcggcacagaaagtggcaccatcctgaaggccctgagcacagccagccgcagcctgcacggctgctacctggaggagctgcacgtgctgcccccaggccggcgggagcccctgcggagcctgcgcatcctgcacagcgcccgggccctgtttgtgggcctgagagatggagtgctgcgggtgcccctggagcgctgtgccgcctaccgcagccagggcgcctgcctgggcgcccgggacccctactgcggctgggatggcaagcagcagcgctgcagcaccctggaggacagcagcaacatgagcctgtggacccagaacatcacagcctgccctgtgagaaatgtgaccagagatggcggcttcggcccctggagcccctggcagccctgtgagcacctggatggagacaacagcggcagctgcctgtgccgggcccggagctgtgacagcccccggccccgctgtggcggcctggactgcctgggccctgccatccacatcgccaactgcagcagaaatggagcctggaccccctggagctcctgggccctgtgcagcaccagctgtggcatcggcttccaggtgcggcagaggagctgcagcaacccagcccccaggcatggaggccgcatctgtgtgggcaagagccgggaggagcgcttctgcaatgaaaacaccccctgccctgtgcccatcttctgggcctcctggggctcctggagcaagtgcagcagcaactgtggcggcggcatgcagagcagaagaagagcctgtgaaaatggaaacagctgcctgggctgcggcgtggagttcaagacctgcaaccctgagggctgcccagaggtgagaagaaacaccccctggaccccctggctgcctgtgaatgtgacccagggcggggcccggcaggagcagcgcttccgcttcacctgccgggcccccctggccgacccccacggcctgcagtttggaagaagaagaacagagaccaggacctgcccagcagatggcagcggcagctgtgacacagatgccctggtggaggtgctgctgcggagcggcagcaccagcccccacacagtgtctgggggctgggccgcctggggcccctggagcagctgcagccgggactgtgagctgggcttccgggtgaggaagaggacctgcaccaaccctgagcccagaaatggaggcctgccctgtgtgggagatgctgctgagtaccaggactgcaacccccaggcctgccctgtgcggggggcctggagctgctggacctcctggagcccctgcagcgccagctgtggcggcggccactaccagaggaccaggagctgcaccagccctgcccccagccctggagaggacatctgcctgggcctgcacacagaggaggccctgtgtgccacccaggcctgcccagagggctggagcccctggagcgagtggagcaagtgcacagatgatggagcccagagccgcagccgccactgtgaggagctgctgcccggcagcagcgcctgtgccggcaacagcagccagagccggccctgcccctacagcgagatccctgtgatcctgcctgccagctccatggaggaggccacagactgtgccggcttcaacctgatccacctggtggccaccggcatcagctgcttcctgggcagcggcctgctgaccctggccgtgtacctgagctgccagcactgccagaggcagagccaggagagcaccctggtgcacccagccacccccaaccacctgcactacaagggcggcggcacccccaagaatgagaagtacacccccatggagttcaagaccctgaacaagaacaacctgatcccagatgaccgggccaacttctaccccctgcagcagaccaacgtgtacaccaccacctactaccccagccccctgaacaagcacagcttccggcctgaggccagccctggccagcgctgcttccccaacagctag

SEQ ID NO: 37886 - DNA, 3267 bp, Artificial Sequence
  Description of Artificial Sequence: Synthetic coding sequence
atgccctgtggcttcagccccagccctgtggcccaccacctggtgcccggccccccagacaccccagcccagcagctgcgctgtggctggacagtgggcggctggctgctgagcctggtgcggggcctgctgccctgcctgcccccaggggccaggacagctgagggccccatcatggtgctggccggccccctggccgtgtccctgctgctgcccagcctgaccctgctggtgagccacctgagcagcagccaggatgtgtcctctgagcccagcagcgagcagcagctgtgtgccctgagcaagcaccccaccgtggcctttgaggacctgcagccctgggtgagcaacttcacctacccaggggcccgggacttcagccagctggccctggaccccagcggcaaccagctgattgtgggcgccaggaactacctgttccggctgagcctggccaacgtgtccctgctgcaggccacagagtgggccagcagcgaggacaccaggaggagctgccagagcaagggcaagacagaggaggagtgccagaactacgtgcgggtgctgattgtggccggcaggaaggtgttcatgtgtggcaccaatgccttcagccccatgtgcaccagccggcaggtgggcaacctgagcaggaccatcgagaagatcaacggggtggcccgctgcccctatgaccccaggcacaacagcacagctgtgatcagcagccagggcgagctgtatgctgccaccgtgattgacttcagcggccgggaccctgccatctaccgcagcctgggcagcggcccccccctgaggacagcccagtacaacagcaagtggctgaatgagcccaactttgtggccgcctatgacatcggcctgtttgcctacttcttcctgagagaaaatgctgtggagcatgactgtggccgcacagtgtacagccgggtggcccgggtgtgcaagaatgatgtgggcggccgcttcctgctggaggacacctggaccaccttcatgaaggcccggctgaactgcagcaggcctggagaggtgcccttctactacaatgagctgcagagcgccttccacctgcctgagcaggacctgatctacggcgtcttcaccaccaacgtgaacagcattgctgccagcgctgtgtgtgccttcaacctgagcgccatcagccaggccttcaacggccccttccgctaccaggagaaccccagggctgcctggctgcccatcgccaaccccatccccaacttccagtgtggcaccctgcctgagaccggccccaatgaaaacctgacagagaggagcctgcaggatgcccagaggctcttcctgatgtctgaggccgtgcagcctgtgaccccagagccctgtgtgacccaggacagcgtgcgcttcagccacctggtggtggacctggtgcaggccaaggacaccctgtaccacgtgctgtacatcggcacagaaagtggcaccatcctgaaggccctgagcacagccagccgcagcctgcacggctgctacctggaggagctgcacgtgctgcccccaggccggcgggagcccctgcggagcctgcgcatcctgcacagcgcccgggccctgtttgtgggcctgagagatggagtgctgcgggtgcccctggagcgctgtgccgcctaccgcagccagggcgcctgcctgggcgcccgggacccctactgcggctgggatggcaagcagcagcgctgcagcaccctggaggacagcagcaacatgagcctgtggacccagaacatcacagcctgccctgtgagaaatgtgaccagagatggcggcttcggcccctggagcccctggcagccctgtgagcacctggatggagacaacagcggcagctgcctgtgccgggcccggagctgtgacagcccccggccccgctgtggcggcctggactgcctgggccctgccatccacatcgccaactgcagcagaaatggagcctggaccccctggagctcctgggccctgtgcagcaccagctgtggcatcggcttccaggtgcggcagaggagctgcagcaacccagcccccaggcatggaggccgcatctgtgtgggcaagagccgggaggagcgcttctgcaatgaaaacaccccctgccctgtgcccatcttctgggcctcctggggctcctggagcaagtgcagcagcaactgtggcggcggcatgcagagcagaagaagagcctgtgaaaatggaaacagctgcctgggctgcggcgtggagttcaagacctgcaaccctgagggctgcccagaggtgagaagaaacaccccctggaccccctggctgcctgtgaatgtgacccagggcggggcccggcaggagcagcgcttccgcttcacctgccgggcccccctggccgacccccacggcctgcagtttggaagaagaagaacagagaccaggacctgcccagcagatggcagcggcagctgtgacacagatgccctggtggaggtgctgctgcggagcggcagcaccagcccccacacagtgtctgggggctgggccgcctggggcccctggagcagctgcagccgggactgtgagctgggcttccgggtgaggaagaggacctgcaccaaccctgagcccagaaatggaggcctgccctgtgtgggagatgctgctgagtaccaggactgcaacccccaggcctgccctgtgcggggggcctggagctgctggacctcctggagcccctgcagcgccagctgtggcggcggccactaccagaggaccaggagctgcaccagccctgcccccagccctggagaggacatctgcctgggcctgcacacagaggaggccctgtgtgccacccaggcctgcccagagggctggagcccctggagcgagtggagcaagtgcacagatgatggagcccagagccgcagccgccactgtgaggagctgctgcccggcagcagcgcctgtgccggcaacagcagccagagccggccctgcccctacagcgagatccctgtgatcctgcctgccagctccatggaggaggccacagactgtgccggcttcaacctgatccacctggtggccaccggcatcagctgcttcctgggcagcggcctgctgaccctggccgtgtacctgagctgccagcactgccagaggcagagccaggagagcaccctggtgcacccagccacccccaaccacctgcactacaagggcggcggcaccccctag

SEQ ID NO: 37887 - DNA, 3174 bp, Artificial Sequence
  Description of Artificial Sequence: Synthetic coding sequence
atggtgctggccggccccctggccgtgtccctgctgctgcccagcctgaccctgctggtgagccacctgagcagcagccaggatgtgtcctctgagcccagcagcgagcagcagctgtgtgccctgagcaagcaccccaccgtggcctttgaggacctgcagccctgggtgagcaacttcacctacccaggggcccgggacttcagccagctggccctggaccccagcggcaaccagctgattgtgggcgccaggaactacctgttccggctgagcctggccaacgtgtccctgctgcaggccacagagtgggccagcagcgaggacaccaggaggagctgccagagcaagggcaagacagaggaggagtgccagaactacgtgcgggtgctgattgtggccggcaggaaggtgttcatgtgtggcaccaatgccttcagccccatgtgcaccagccggcaggtgggcaacctgagcaggaccatcgagaagatcaacggggtggcccgctgcccctatgaccccaggcacaacagcacagctgtgatcagcagccagggcgagctgtatgctgccaccgtgattgacttcagcggccgggaccctgccatctaccgcagcctgggcagcggcccccccctgaggacagcccagtacaacagcaagtggctgaatgagcccaactttgtggccgcctatgacatcggcctgtttgcctacttcttcctgagagaaaatgctgtggagcatgactgtggccgcacagtgtacagccgggtggcccgggtgtgcaagaatgatgtgggcggccgcttcctgctggaggacacctggaccaccttcatgaaggcccggctgaactgcagcaggcctggagaggtgcccttctactacaatgagctgcagagcgccttccacctgcctgagcaggacctgatctacggcgtcttcaccaccaacgtgaacagcattgctgccagcgctgtgtgtgccttcaacctgagcgccatcagccaggccttcaacggccccttccgctaccaggagaaccccagggctgcctggctgcccatcgccaaccccatccccaacttccagtgtggcaccctgcctgagaccggccccaatgaaaacctgacagagaggagcctgcaggatgcccagaggctcttcctgatgtctgaggccgtgcagcctgtgaccccagagccctgtgtgacccaggacagcgtgcgcttcagccacctggtggtggacctggtgcaggccaaggacaccctgtaccacgtgctgtacatcggcacagaaagtggcaccatcctgaaggccctgagcacagccagccgcagcctgcacggctgctacctggaggagctgcacgtgctgcccccaggccggcgggagcccctgcggagcctgcgcatcctgcacagcgcccgggccctgtttgtgggcctgagagatggagtgctgcgggtgcccctggagcgctgtgccgcctaccgcagccagggcgcctgcctgggcgcccgggacccctactgcggctgggatggcaagcagcagcgctgcagcaccctggaggacagcagcaacatgagcctgtggacccagaacatcacagcctgccctgtgagaaatgtgaccagagatggcggcttcggcccctggagcccctggcagccctgtgagcacctggatggagacaacagcggcagctgcctgtgccgggcccggagctgtgacagcccccggccccgctgtggcggcctggactgcctgggccctgccatccacatcgccaactgcagcagaaatggagcctggaccccctggagctcctgggccctgtgcagcaccagctgtggcatcggcttccaggtgcggcagaggagctgcagcaacccagcccccaggcatggaggccgcatctgtgtgggcaagagccgggaggagcgcttctgcaatgaaaacaccccctgccctgtgcccatcttctgggcctcctggggctcctggagcaagtgcagcagcaactgtggcggcggcatgcagagcagaagaagagcctgtgaaaatggaaacagctgcctgggctgcggcgtggagttcaagacctgcaaccctgagggctgcccagaggtgagaagaaacaccccctggaccccctggctgcctgtgaatgtgacccagggcggggcccggcaggagcagcgcttccgcttcacctgccgggcccccctggccgacccccacggcctgcagtttggaagaagaagaacagagaccaggacctgcccagcagatggcagcggcagctgtgacacagatgccctggtggaggtgctgctgcggagcggcagcaccagcccccacacagtgtctgggggctgggccgcctggggcccctggagcagctgcagccgggactgtgagctgggcttccgggtgaggaagaggacctgcaccaaccctgagcccagaaatggaggcctgccctgtgtgggagatgctgctgagtaccaggactgcaacccccaggcctgccctggagaggacatctgcctgggcctgcacacagaggaggccctgtgtgccacccaggcctgcccagagggctggagcccctggagcgagtggagcaagtgcacagatgatggagcccagagccgcagccgccactgtgaggagctgctgcccggcagcagcgcctgtgccggcaacagcagccagagccggccctgcccctacagcgagatccctgtgatcctgcctgccagctccatggaggaggccacagactgtgccggcttcaacctgatccacctggtggccaccggcatcagctgcttcctgggcagcggcctgctgaccctggccgtgtacctgagctgccagcactgccagaggcagagccaggagagcaccctggtgcacccagccacccccaaccacctgcactacaagggcggcggcacccccaagaatgagaagtacacccccatggagttcaagaccctgaacaagaacaacctgatcccagatgaccgggccaacttctaccccctgcagcagaccaacgtgtacaccaccacctactaccccagccccctgaacaagcacagcttccggcctgaggccagccctggccagcgctgcttccccaacagctag

SEQ ID NO: 37888 - DNA, 429 bp, Artificial Sequence
  Description of Artificial Sequence: Synthetic coding sequence
atgccctgtggcttcagccccagccctgtggcccaccacctggtgcccggccccccagacaccccagcccagcagctgcgctgtggctggacagtgggcggctggctgctgagcctggtgcggggcctgctgccctgcctgcccccaggggccaggacagctgagggccccatcatggtgctggccggccccctggccgtgtccctgctgctgcccagcctgaccctgctggtgagccacctgagcagcagccaggatgtgtcctctgagcccagcagcgagcagcagctgtgtgccctgagcaagcaccccaccgtggcctttgaggacctgcagccctgggtgagcaacttcacctacccaggggcccgggacttcagccagctggccctggaccccagcggcaaccagctgattgtgggcgcctag

SEQ ID NO: 37889 - DNA, 255 bp, Artificial Sequence
  Description of Artificial Sequence: Synthetic coding sequence
atgccctgtggcttcagccccagccctgtggcccaccacctggtgcccggccccccagacaccccagcccagcagctgcgctgtggctggacagtgggcggctggctgctgagcctggtgcggggcctgctgccctgcctgcccccaggggccaggacagctgagggccccatcatggtgctggccggccccctggccgtgtccctgctgctgcccagcctgaccctgctggtgagccacctgagcagcagctag

SEQ ID NO: 37890 - DNA, 3618 bp, Artificial Sequence
  Description of Artificial Sequence: Synthetic coding sequence
atgctgcacctgtctgctgaggaggccatcggctgtgtgcgggtgcggcgctccttcattgatgagctggccttcggccggggccacagcactggaacaggcaagcagaagaggcgggacagagtgtctggcagctcctggtgcctggcctgtgtgtcctggatgccctgtggcttcagccccagccctgtggcccaccacctggtgcccggccccccagacaccccagcccagcagctgcgctgtggctggacagtgggcggctggctgctgagcctggtgcggggcctgctgccctgcctgcccccaggggccaggacagctgagggccccatcatggtgctggccggccccctggccgtgtccctgctgctgcccagcctgaccctgctggtgagccacctgagcagcagccaggatgtgtcctctgagcccagcagcgagcagcagctgtgtgccctgagcaagcaccccaccgtggcctttgaggacctgcagccctgggtgagcaacttcacctacccaggggcccgggacttcagccagctggccctggaccccagcggcaaccagctgattgtgggcgccaggaactacctgttccggctgagcctggccaacgtgtccctgctgcaggccacagagtgggccagcagcgaggacaccaggaggagctgccagagcaagggcaagacagaggaggagtgccagaactacgtgcgggtgctgattgtggccggcaggaaggtgttcatgtgtggcaccaatgccttcagccccatgtgcaccagccggcaggtgggcaacctgagcaggaccatcgagaagatcaacggggtggcccgctgcccctatgaccccaggcacaacagcacagctgtgatcagcagccagggcgagctgtatgctgccaccgtgattgacttcagcggccgggaccctgccatctaccgcagcctgggcagcggcccccccctgaggacagcccagtacaacagcaagtggctgaatgagcccaactttgtggccgcctatgacatcggcctgtttgcctacttcttcctgagagaaaatgctgtggagcatgactgtggccgcacagtgtacagccgggtggcccgggtgtgcaagaatgatgtgggcggccgcttcctgctggaggacacctggaccaccttcatgaaggcccggctgaactgcagcaggcctggagaggtgcccttctactacaatgagctgcagagcgccttccacctgcctgagcaggacctgatctacggcgtcttcaccaccaacgtgaacagcattgctgccagcgctgtgtgtgccttcaacctgagcgccatcagccaggccttcaacggccccttccgctaccaggagaaccccagggctgcctggctgcccatcgccaaccccatccccaacttccagtgtggcaccctgcctgagaccggccccaatgaaaacctgacagagaggagcctgcaggatgcccagaggctcttcctgatgtctgaggccgtgcagcctgtgaccccagagccctgtgtgacccaggacagcgtgcgcttcagccacctggtggtggacctggtgcaggccaaggacaccctgtaccacgtgctgtacatcggcacagaaagtggcaccatcctgaaggccctgagcacagccagccgcagcctgcacggctgctacctggaggagctgcacgtgctgcccccaggccggcgggagcccctgcggagcctgcgcatcctgcacagcgcccgggccctgtttgtgggcctgagagatggagtgctgcgggtgcccctggagcgctgtgccgcctaccgcagccagggcgcctgcctgggcgcccgggacccctactgcggctgggatggcaagcagcagcgctgcagcaccctggaggacagcagcaacatgagcctgtggacccagaacatcacagcctgccctgtgagaaatgtgaccagagatggcggcttcggcccctggagcccctggcagccctgtgagcacctggatggagacaacagcggcagctgcctgtgccgggcccggagctgtgacagcccccggccccgctgtggcggcctggactgcctgggccctgccatccacatcgccaactgcagcagaaatggagcctggaccccctggagctcctgggccctgtgcagcaccagctgtggcatcggcttccaggtgcggcagaggagctgcagcaacccagcccccaggcatggaggccgcatctgtgtgggcaagagccgggaggagcgcttctgcaatgaaaacaccccctgccctgtgcccatcttctgggcctcctggggctcctggagcaagtgcagcagcaactgtggcggcggcatgcagagcagaagaagagcctgtgaaaatggaaacagctgcctgggctgcggcgtggagttcaagacctgcaaccctgagggctgcccagaggtgagaagaaacaccccctggaccccctggctgcctgtgaatgtgacccagggcggggcccggcaggagcagcgcttccgcttcacctgccgggcccccctggccgacccccacggcctgcagtttggaagaagaagaacagagaccaggacctgcccagcagatggcagcggcagctgtgacacagatgccctggtggaggtgctgctgcggagcggcagcaccagcccccacacagtgtctgggggctgggccgcctggggcccctggagcagctgcagccgggactgtgagctgggcttccgggtgaggaagaggacctgcaccaaccctgagcccagaaatggaggcctgccctgtgtgggagatgctgctgagtaccaggactgcaacccccaggcctgccctgtgcggggggcctggagctgctggacctcctggagcccctgcagcgccagctgtggcggcggccactaccagaggaccaggagctgcaccagccctgcccccagccctggagaggacatctgcctgggcctgcacacagaggaggccctgtgtgccacccaggcctgcccagagggctggagcccctggagcgagtggagcaagtgcacagatgatggagcccagagccgcagccgccactgtgaggagctgctgcccggcagcagcgcctgtgccggcaacagcagccagagccggccctgcccctacagcgagatccctgtgatcctgcctgccagctccatggaggaggccacagactgtgccggcttcaacctgatccacctggtggccaccggcatcagctgcttcctgggcagcggcctgctgaccctggccgtgtacctgagctgccagcactgccagaggcagagccaggagagcaccctggtgcacccagccacccccaaccacctgcactacaagggcggcggcacccccaagaatgagaagtacacccccatggagttcaagaccctgaacaagaacaacctgatcccagatgaccgggccaacttctaccccctgcagcagaccaacgtgtacaccaccacctactaccccagccccctgaacaagcacagcttccggcctgaggccagccctggccagcgctgcttccccaacagctag

SEQ ID NO: 37891 - DNA, 3144 bp, Artificial Sequence
  Description of Artificial Sequence: Synthetic coding sequence
atgaggtctgaggccctgctgctgtacttcaccctgctgcactttgctggggccggcttccctgaggacagcgagcccatcagcatcagccacggcaactacaccaagcagtaccctgtgtttgtgggccacaagccaggcaggaacaccacccagaggcaccggctggacatccagatgatcatgatcatgaatggcaccctgtacatcgccgcccgggaccacatctacacagtggacatcgacaccagccacacagaggagatctactgcagcaagaagctgacctggaagagccggcaggctgatgtggacacctgcaggatgaagggcaagcacaaggatgagtgccacaacttcatcaaggtgctgctgaagaagaatgatgatgccctgtttgtgtgtggcaccaatgccttcaaccccagctgcaggaactacaagatggacaccctggagccctttggagatgagttcagcggcatggcccgctgcccctatgatgccaagcacgccaacgtggccctgtttgctgatggcaagctgtacagcgccaccgtgacagacttcctggccattgatgctgtgatctaccgcagcctgggggagagccccaccctgaggacagtgaagcatgacagcaagtggctgaaggagccctactttgtgcaggccgtggactatggagactacatctacttcttcttccgggagattgctgtggagtacaacaccatgggcaaggtggtgttcccccgggtggcccaggtgtgcaagaatgacatgggcggcagccagagggtgctggagaagcagtggaccagcttcctgaaggcccggctgaactgcagcgtgcctggggacagccacttctacttcaacatcctgcaggccgtgacagatgtgatccgcatcaatggaagagatgtggtgctggccaccttcagcaccccctacaacagcatccctggcagcgctgtgtgtgcctatgacatgctggacatcgcctctgtgttcaccggccgcttcaaggagcagaagagcccagacagcacctggacccctgtgcctgatgagcgggtgcccaagccccggcccggctgctgtgccggcagcagcagcctggagagatatgccaccagcaatgagttcccagatgacaccctgaacttcatcaagacccaccccctgatggatgaagctgtgcccagcatcttcaaccggccctggttcctgcggaccatggtgcgctaccgcctgaccaagattgctgtggacacagctgctggcccctaccagaaccacacagtggtgttcctgggcagcgagaagggcatcatcctgaagttcctggcccgcatcggcaacagcggcttcctgaatgacagcctcttcctggaggagatgtctgtgtacaacagcgagaagtgcagctatgatggagtggaggacaagaggatcatgggcatgcagctggaccgggccagcagcagcctgtatgtggccttcagcacctgtgtgatcaaggtgcccctgggccgctgtgaaagatatggcaagtgcaagaagacctgcatcgccagccgggacccctactgcggctggatcaaggagggcggggcctgcagccacctgagccccaacagccggctgacctttgagcaggacatcgagcggggcaacacagatggcctgggggactgccacaacagctttgtggccctgaatgacatcagcacccccctgcctgacaatgagatgagctacaacacagtgtatggccacagcagcagcctgctgcccagcaccaccaccagtgacagcacagcccaggagggctatgagagccggggcggcatgctggactggaagcacctgctggacagcccagacagcacagaccccctgggcgctgtgagcagccacaaccaccaggacaagaagggcgtcatccgggagagctacctgaagggccatgaccagctggtgcctgtgaccctgctggccatcgctgtgatcctggcctttgtgatgggcgctgtgttttctggcatcaccgtgtactgtgtgtgtgaccacaggaggaaggatgtggccgtggtgcagaggaaggagaaggagctgacccacagccggcggggctccatgagctctgtgaccaagctgagcggcctgtttggagacacccagagcaaggaccccaagccagaggccatcctgacccccctgatgcacaacgggaagctggccaccccaggcaacacagccaagatgctgatcaaggctgaccagcaccacctggacctgacagccctgcccaccccagagagcacccccaccctgcagcagaagaggaagcccagccggggcagccgggagtgggagaggaaccagaacctgatcaatgcctgcaccaaggacatgccacccatgggcagccctgtgatccccacagacctgcccctgcgggccagccccagccacatccccagcgtggtggtgctgcccatcacccagcagggctaccagcacgagtatgtggaccagcccaagatgtctgaggtggcccagatggccctggaggaccaggccgccaccctggagtacaagaccatcaaggagcacctgagcagcaagagccccaaccacggcgtgaacctggtggagaacctggacagcctgccccccaaggtgccccagcgggaggccagcctgggccccccaggggccagcctgagccagacaggcctgagcaagaggctggagatgcaccacagcagcagctatggagtggactacaagaggagctaccccaccaacagcctgaccaggagccaccaggccaccaccctgaagaggaacaacaccaacagcagcaacagcagccacctgagcaggaaccagagctttggccgcggggacaaccccccaccagccccccagagggtggacagcatccaggtgcacagcagccagcccagcggccaggccgtgacagtgtcccggcagcccagcctgaatgcctacaacagcctgaccaggagcggcctgaagaggacccccagcctgaagccagatgtgccccccaagcccagctttgcccccctgagcacctccatgaagcccaatgatgcctgcacctag

SEQ ID NO: 37892 - DNA, 1524 bp, Artificial Sequence
  Description of Artificial Sequence: Synthetic coding sequence
atgtctgtgtacaacagcgagaagtgcagctatgatggagtggaggacaagaggatcatgggcatgcagctggaccgggccagcagcagcctgtatgtggccttcagcacctgtgtgatcaaggtgcccctgggccgctgtgaaagatatggcaagtgcaagaagacctgcatcgccagccgggacccctactgcggctggatcaaggagggcggggcctgcagccacctgagccccaacagccggctgacctttgagcaggacatcgagcggggcaacacagatggcctgggggactgccacaacagctttgtggccctgaatggagtcatccgggagagctacctgaagggccatgaccagctggtgcctgtgaccctgctggccatcgctgtgatcctggcctttgtgatgggcgctgtgttttctggcatcaccgtgtactgtgtgtgtgaccacaggaggaaggatgtggccgtggtgcagaggaaggagaaggagctgacccacagccggcggggctccatgagctctgtgaccaagctgagcggcctgtttggagacacccagagcaaggaccccaagccagaggccatcctgacccccctgatgcacaacgggaagctggccaccccaggcaacacagccaagatgctgatcaaggctgaccagcaccacctggacctgacagccctgcccaccccagagagcacccccaccctgcagcagaagaggaagcccagccggggcagccgggagtgggagaggaaccagaacctgatcaatgcctgcaccaaggacatgccacccatgggcagccctgtgatccccacagacctgcccctgcgggccagccccagccacatccccagcgtggtggtgctgcccatcacccagcagggctaccagcacgagtatgtggaccagcccaagatgtctgaggtggcccagatggccctggaggaccaggccgccaccctggagtacaagaccatcaaggagcacctgagcagcaagagccccaaccacggcgtgaacctggtggagaacctggacagcctgccccccaaggtgccccagcgggaggccagcctgggccccccaggggccagcctgagccagacaggcctgagcaagaggctggagatgcaccacagcagcagctatggagtggactacaagaggagctaccccaccaacagcctgaccaggagccaccaggccaccaccctgaagaggaacaacaccaacagcagcaacagcagccacctgagcaggaaccagagctttggccgcggggacaaccccccaccagccccccagagggtggacagcatccaggtgcacagcagccagcccagcggccaggccgtgacagtgtcccggcagcccagcctgaatgcctacaacagcctgaccaggagcggcctgaagaggacccccagcctgaagccagatgtgccccccaagcccagctttgcccccctgagcacctccatgaagcccaatgatgcctgcacctag

SEQ ID NO: 37893 - DNA, 3093 bp, Artificial Sequence
  Description of Artificial Sequence: Synthetic coding sequence
atgaggtctgaggccctgctgctgtacttcaccctgctgcactttgctggggccggcttccctgaggacagcgagcccatcagcatcagccacggcaactacaccaagcagtaccctgtgtttgtgggccacaagccaggcaggaacaccacccagaggcaccggctggacatccagatgatcatgatcatgaatggcaccctgtacatcgccgcccgggaccacatctacacagtggacatcgacaccagccacacagaggagatctactgcagcaagaagctgacctggaagagccggcaggctgatgtggacacctgcaggatgaagggcaagcacaaggatgagtgccacaacttcatcaaggtgctgctgaagaagaatgatgatgccctgtttgtgtgtggcaccaatgccttcaaccccagctgcaggaactacaagatggacaccctggagccctttggagatgagttcagcggcatggcccgctgcccctatgatgccaagcacgccaacgtggccctgtttgctgatggcaagctgtacagcgccaccgtgacagacttcctggccattgatgctgtgatctaccgcagcctgggggagagccccaccctgaggacagtgaagcatgacagcaagtggctgaaggagccctactttgtgcaggccgtggactatggagactacatctacttcttcttccgggagattgctgtggagtacaacaccatgggcaaggtggtgttcccccgggtggcccaggtgtgcaagaatgacatgggcggcagccagagggtgctggagaagcagtggaccagcttcctgaaggcccggctgaactgcagcgtgcctggggacagccacttctacttcaacatcctgcaggccgtgacagatgtgatccgcatcaatggaagagatgtggtgctggccaccttcagcaccccctacaacagcatccctggcagcgctgtgtgtgcctatgacatgctggacatcgcctctgtgttcaccggccgcttcaaggagcagaagagcccagacagcacctggacccctgtgcctgatgagcgggtgcccaagccccggcccggctgctgtgccggcagcagcagcctggagagatatgccaccagcaatgagttcccagatgacaccctgaacttcatcaagacccaccccctgatggatgaagctgtgcccagcatcttcaaccggccctggttcctgcggaccatggtgcgctaccgcctgaccaagattgctgtggacacagctgctggcccctaccagaaccacacagtggtgttcctgggcagcgagaagggcatcatcctgaagttcctggcccgcatcggcaacagcggcttcctgaatgacagcctcttcctggaggagatgtctgtgtacaacagcgagaagtgcagctatgatggagtggaggacaagaggatcatgggcatgcagctggaccgggccagcagcagcctgtatgtggccttcagcacctgtgtgatcaaggtgcccctgggccgctgtgaaagatatggcaagtgcaagaagacctgcatcgccagccgggacccctactgcggctggatcaaggagggcggggcctgcagccacctgagccccaacagccggctgacctttgagcaggacatcgagcggggcaacacagatggcctgggggactgccacaacagctttgtggccctgaatggccacagcagcagcctgctgcccagcaccaccaccagtgacagcacagcccaggagggctatgagagcagaggaggcatgctggactggaagcacctgctggacagcccagacagcacagaccccctgggcgctgtgagcagccacaaccaccaggacaagaagggcgtcatccgggagagctacctgaagggccatgaccagctggtgcctgtgaccctgctggccatcgccgtcatcctggcctttgtgatgggcgctgtgttcagcggcatcaccgtgtactgtgtgtgtgaccacaggaggaaggatgtggccgtggtgcagaggaaggagaaggagctgacccacagcagaagaggctccatgagctctgtgaccaagctgagcggcctgtttggagacacccagagcaaggaccccaagccagaggccatcctgacccccctgatgcacaacgggaagctggccaccccaggcaacacagccaagatgctgatcaaggctgaccagcaccacctggacctgacagccctgcccaccccagagagcacccccaccctgcagcagaagaggaagcccagccggggcagccgggagtgggagaggaaccagaacctgatcaatgcctgcaccaaggacatgccacccatgggcagccctgtgatccccacagacctgcccctgcgggccagccccagccacatccccagcgtggtggtgctgcccatcacccagcagggctaccagcatgaatatgtggaccagcccaagatgtctgaggtggcccagatggccctggaggaccaggccgccaccctggagtacaagaccatcaaggagcacctgagcagcaagagccccaaccacggcgtgaacctggtggagaacctggacagcctgccccccaaggtgccccagcgggaggccagcctgggccccccaggggccagcctgagccagacaggcctgagcaagaggctggagatgcaccacagcagcagctatggagtggactacaagaggagctaccccaccaacagcctgaccaggagccaccaggccaccaccctgaagaggaacaacaccaacagcagcaacagcagccacctgagcaggaaccagagctttggccgcggggacaaccccccaccagccccccagagggtggacagcatccaggtgcacagcagccagcccagcggccaggccgtgacagtgtcccggcagcccagcctgaatgcctacaacagcctgaccaggagcggcctgaagaggacccccagcctgaagccagatgtgccccccaagcccagctttgcccccctgagcacctccatgaagcccaatgatgcctgcacctag

SEQ ID NO: 37894 - DNA, 1230 bp, Artificial Sequence
  Description of Artificial Sequence: Synthetic coding sequence
atgaagaatgccagccctgagacccgggagggcgtcatccgggagagctacctgaagggccatgaccagctggtgcctgtgaccctgctggccatcgctgtgatcctggcctttgtgatgggcgctgtgttttctggcatcaccgtgtactgtgtgtgtgaccacaggaggaaggatgtggccgtggtgcagaggaaggagaaggagctgacccacagccggcggggctccatgagctctgtgaccaagctgagcggcctgtttggagacacccagagcaaggaccccaagccagaggccatcctgacccccctgatgcacaacgggaagctggccaccccaggcaacacagccaagatgctgatcaaggctgaccagcaccacctggacctgacagccctgcccaccccagagagcacccccaccctgcagcagaagaggaagcccagccggggcagccgggagtgggagaggaaccagaacctgatcaatgcctgcaccaaggacatgccacccatgggcagccctgtgatccccacagacctgcccctgcgggccagccccagccacatccccagcgtggtggtgctgcccatcacccagcagggctaccagcacgagtatgtggaccagcccaagatgtctgaggtggcccagatggccctggaggaccaggccgccaccctggagtacaagaccatcaaggagcacctgagcagcaagagccccaaccacggcgtgaacctggtggagaacctggacagcctgccccccaaggtgccccagcgggaggccagcctgggccccccaggggccagcctgagccagacaggcctgagcaagaggctggagatgcaccacagcagcagctatggagtggactacaagaggagctaccccaccaacagcctgaccaggagccaccaggccaccaccctgaagaggaacaacaccaacagcagcaacagcagccacctgagcaggaaccagagctttggccgcggggacaaccccccaccagccccccagagggtggacagcatccaggtgcacagcagccagcccagcggccaggccgtgacagtgtcccggcagcccagcctgaatgcctacaacagcctgaccaggagcggcctgaagaggacccccagcctgaagccagatgtgccccccaagcccagctttgcccccctgagcacctccatgaagcccaatgatgcctgcacctag

SEQ ID NO: 37895 - DNA, 345 bp, Artificial Sequence
  Description of Artificial Sequence: Synthetic coding sequence
atgaggtctgaggccctgctgctgtacttcaccctgctgcactttgctggggccggcttccctgaggacagcgagcccatcagcatcagccacggcaactacaccaagcagtaccctgtgtttgtgggccacaagccaggcaggaacaccacccagaggcaccggctggacatccagatgatcatgatcatgaatggcaccctgtacatcgccgcccgggaccacatctacacagtggacatcgacaccagccacacagaggagatctactgcagcaagaagctgacctggaagagccggcaggctgatgtggacacctgcaggatgaagggcaagcacaagtag

SEQ ID NO: 37896 - DNA, 3093 bp, Artificial Sequence; identical to SEQ ID NO: 37893
  Description of Artificial Sequence: Synthetic coding sequence

SEQ ID NO: 37897 - DNA, 1374 bp, Artificial Sequence
  Description of Artificial Sequence: Synthetic coding sequence
atgaagacaggccacagcagcagcctgctgcccagcaccaccaccagtgacagcacagcccaggagggctatgagagccggggcggcatgctggactggaagcacctgctggacagcccagacagcacagaccccctgggcgctgtgagcagccacaaccaccaggacaagaagggcgtcatccgggagagctacctgaagggccatgaccagctggtgcctgtgaccctgctggccatcgctgtgatcctggcctttgtgatgggcgctgtgttttctggcatcaccgtgtactgtgtgtgtgaccacaggaggaaggatgtggccgtggtgcagaggaaggagaaggagctgacccacagccggcggggctccatgagctctgtgaccaagctgagcggcctgtttggagacacccagagcaaggaccccaagccagaggccatcctgacccccctgatgcacaacgggaagctggccaccccaggcaacacagccaagatgctgatcaaggctgaccagcaccacctggacctgacagccctgcccaccccagagagcacccccaccctgcagcagaagaggaagcccagccggggcagccgggagtgggagaggaaccagaacctgatcaatgcctgcaccaaggacatgccacccatgggcagccctgtgatccccacagacctgcccctgcgggccagccccagccacatccccagcgtggtggtgctgcccatcacccagcagggctaccagcacgagtatgtggaccagcccaagatgtctgaggtggcccagatggccctggaggaccaggccgccaccctggagtacaagaccatcaaggagcacctgagcagcaagagccccaaccacggcgtgaacctggtggagaacctggacagcctgccccccaaggtgccccagcgggaggccagcctgggccccccaggggccagcctgagccagacaggcctgagcaagaggctggagatgcaccacagcagcagctatggagtggactacaagaggagctaccccaccaacagcctgaccaggagccaccaggccaccaccctgaagaggaacaacaccaacagcagcaacagcagccacctgagcaggaaccagagctttggccgcggggacaaccccccaccagccccccagagggtggacagcatccaggtgcacagcagccagcccagcggccaggccgtgacagtgtcccggcagcccagcctgaatgcctacaacagcctgaccaggagcggcctgaagaggacccccagcctgaagccagatgtgccccccaagcccagctttgcccccctgagcacctccatgaagcccaatgatgcctgcacctag

SEQ ID NO: 37898 - DNA, 480 bp, Artificial Sequence
  Description of Artificial Sequence: Synthetic coding sequence
atgaggtctgaggccctgctgctgtacttcaccctgctgcactttgctggggccggcttccctgaggacagcgagcccatcagcatcagccacggcaactacaccaagcagtaccctgtgtttgtgggccacaagccaggcaggaacaccacccagaggcaccggctggacatccagatgatcatgatcatgaatggcaccctgtacatcgccgcccgggaccacatctacacagtggacatcgacaccagccacacagaggagatctactgcagcaagaagctgacctggaagagccggcaggctgatgtggacacctgcaggatgaagggcaagcacaaggatgagtgccacaacttcatcaaggtgctgctgaagaagaatgatgatgccctgtttgtgtgtggcaccaatgccttcaaccccagctgcaggaactacaagatggacaccctggagccctttggagatgagttctag

SEQ ID NO: 37899 - DNA, 2049 bp, Artificial Sequence
  Description of Artificial Sequence: Synthetic coding sequence
atgcagaccccccgggccagcccccccaggcctgccctgctgctgctgctgctgctgctgggcggggcccacggcctcttccctgaggagcccccacccctgtctgtggccccccgggactacctgaaccactaccctgtgtttgtgggcagcggccctggccgcctgaccccagctgagggcgcagatgacctgaacatccagagggtgctgcgggtgaacagaaccctcttcatcggggaccgggacaacctgtacagagtggagctggagccccccaccagcacagagctgcgctaccagaggaagctgacctggaggagcaaccccagcgacatcaacgtgtgcaggatgaagggcaagcaggagggagaatgtagaaactttgtgaaggtgctgctgctgagagatgagagcaccctgtttgtgtgtggcagcaatgccttcaaccctgtgtgtgccaactacagcattgacaccctgcagcctgtgggggacaacatcagcggcatggcccgctgcccctatgaccccaagcacgccaacgtggccctcttcagtgatggcatgctgttcaccgccaccgtgacagacttcctggccattgatgctgtgatctaccgcagcctgggggaccggcccaccctgaggacagtgaagcatgacagcaagtggttcaaggagccctactttgtgcatgctgtggagtggggcagccacgtgtacttcttcttccgggagatcgccatggagttcaactacctggagaaggtggtggtgtcccgggtggcccgggtgtgcaagaatgatgtgggcggcagcccccgggtgctggagaagcagtggaccagcttcctgaaggcccggctgaactgcagcgtgcctggggacagccacttctacttcaacgtgctgcaggccgtgactggagtggtgtccctgggcggccggcctgtggtgctggccgtgttcagcacccccagcaacagcatccctggcagcgctgtgtgtgcctttgacctgacccaggtggccgctgtgtttgagggccgcttccgggagcagaagagccctgagagcatctggacccctgtgcctgaggaccaggtgccccggcccaggcctggctgctgtgccgcccctggcatgcagtacaatgccagcagcgccctgcctgatgacatcctgaactttgtgaagacccaccccctgatggatgaggccgtgcccagcctgggccacgccccctggatcctgcggaccctgatgaggcaccagctgaccagggtggccgtggatgtgggcgccggcccctggggcaaccagacagtggtgttcctgggcagcgaggccggcaccgtgctgaagttcctggtgcggcccaatgccagcaccagcggcaccagcggcctgagcgtcttcctggaggagtttgagacctacagaccagacagatgtggccggcctgggggcggggagaccggccagaggctgctgagcctggagctggatgctgccagcggcggcctgctggccgccttcccccgctgtgtggtgcgggtgcctgtggcccgctgccagcagtacagcggctgcatgaagaactgcatcggcagccaggacccctactgcggctgggccccagatggcagctgcatcttcctgagccctggcaccagggctgcctttgagcaggatgtgtctggggccagcaccagcggcctgggggactgcaccggcctgctgcgggccagcctgtctgaggacagagctggcctggtgtctgtgaacctgctggtgaccagctctgtggccgcctttgtggtgggcgctgtggtgtctggcttctctgtgggctggtttgtgggcctgcgggagcggcgggagctggcccggaggaaggacaaggaggccatcctggcccacggggccggggaggccgtgctgtctgtgtcccggctgggggagcggcgggcccagggccctggcagccgccgctggggcttccagaaggcccggggcagcccccgctgccgcctgggcgtgtag

SEQ ID NO: 37900 - DNA, 2667 bp, Artificial Sequence; identical to SEQ ID NO: 37848
  Description of Artificial Sequence: Synthetic coding sequence

SEQ ID NO: 37901 - DNA, 2793 bp, Artificial Sequence
  Description of Artificial Sequence: Synthetic coding sequence
atgccccgggccccccacttcatgcccctgctgctgctgctgctgctgctgagcctgccccacacccaggccgccttcccccaggaccccctgcccctgctgatcagtgacctgcagggcaccagccccctgtcctggttccggggcctggaggatgatgctgtggccgctgagctgggcctggacttccagcgcttcctgaccctgaacagaaccctgctggtggccgcccgggaccacgtgttctcctttgacctgcaggccgaggaggagggggagggcctggtgcccaacaagtacctgacctggaggagccaggatgtggagaactgtgctgtgcggggcaagctgacagatgagtgctacaactacatccgggtgctggtgccctgggacagccagaccctgctggcctgtggcaccaacagcttcagccctgtgtgccgctcctatggcatcaccagcctgcagcaggagggggaggagctgagcggccaggcccgctgcccctttgatgccacccagagcaatgtggccatctttgctgagggcagcctgtacagcgccacagctgctgacttccaggccagtgatgctgtggtgtaccgcagcctgggcccccagccccccctgcggagcgccaagtatgacagcaagtggctgcgggagccccactttgtgcaggccctggagcacggggaccacgtgtacttcttcttccgggaggtgtctgtggaggatgcccggctgggccgggtgcagttcagccgggtggcccgggtgtgcaagagggacatgggcggcagcccccgggccctggacagacactggaccagcttcctgaagctgcggctgaactgcagcgtgcctggggacagcaccttctactttgatgtgctgcaggccctgaccggccctgtgaacctgcacggccgcagcgccctgtttggagtcttcaccacccagaccaacagcatccctggcagcgctgtgtgtgccttctacctggatgaaattgagcggggctttgagggcaagttcaaggagcagaggagcctggatggagcctggacccctgtgtctgaggacagagtgcccagcccccggcccggcagctgtgccggcgtgggcggggccgccctcttcagcagcagccgggacctgcctgatgatgtgctgaccttcatcaaggcccaccccctgctggaccctgctgtgccccctgtgacccaccagcccctgctgaccctgaccagccgggccctgctgacccaggtggccgtggatggcatggccggcccccacagcaacatcaccgtgatgttcctgggcagcaatgatggcaccgtgctgaaggtgctgacccctgggggccgcagcggcggccctgagcccatcctgctggaggagattgatgcctacagccctgcccgctgcagcggcaagaggacagcccagacagcccggcgcatcatcggcctggagctggacacagagggccaccggctgtttgtggccttcagcggctgcatcgtgtacctgcccctgagccgctgtgcccggcacggggcctgccagaggagctgcctggccagccaggacccctactgcggctggcacagcagccggggctgtgtggacatccggggcagcggcggcacagatgtggaccaggccggcaaccaggagagcatggagcacggggactgccaggatggagccaccggcagccagagcggccctggggacagcgcctacggcgtgagaagagacctgcccccagccagcgccagccgctctgtgcccatccccctgctgctggcctctgtggccgccgcctttgccctgggcgcctctgtgtctggcctgctggtgtcctgtgcctgccggcgggcccacagaagaagaggcaaggacatcgagaccccaggcctgccccggcccctgagcctgcggagcctggcccggctgcacggcggcggccctgagcccccaccacccagcaaggatggagatgctgtgcagaccccccagctgtacaccaccttcctgcccccacctgagggcgtgcccccacctgagctggcctgcctgcccaccccagagagcaccccagagctgcctgtgaagcacctgcgggctgctggggacccctgggagtggaaccagaacagaaataatgccaaggagggccctggccgcagcagaggaggccacgccgccggcggccctgccccccgggtgctggtgcggcccccacctcctggctgccccggccaggccgtggaggtgaccaccctggaggagctgctgcgctacctgcacggcccccagccccccaggaaaggagctgagcccccagcccccctgaccagccgggccctgcccccagagcccgccccagccctgctgggcggccccagcccccggccccatgaatgtgccagccccctgcggctggatgtgcccccagagggccgctgtgccagcgccccagcccggcctgccctgagcgccccagccccccggctgggcgtgggcggcggccggcggctgcccttcagcggccaccgggcccccccagccctgctgaccagggtgcccagcggcggccccagccgctacagcggcggccctgggaagcacctgctgtacctgggccggcctgagggctaccggggccgggccctgaagagggtggatgtggagaagccccagctgagcctgaagccacccctggtgggccccagcagccggcaggccgtgcccaacggcggccgcttcaacttctag

SEQ ID NO: 37902 - DNA, 2769 bp, Artificial Sequence
  Description of Artificial Sequence: Synthetic coding sequence
atgccccgggccccccacttcatgcccctgctgctgctgctgctgctgctgagcctgccccacacccaggccgccttcccccaggaccccctgcccctgctgatcagtgacctgcagggcaccagccccctgtcctggttccggggcctggaggatgatgctgtggccgctgagctgggcctggacttccagcgcttcctgaccctgaacagaaccctgctggtggccgcccgggaccacgtgttctcctttgacctgcaggccgaggaggagggggagggcctggtgcccaacaagtacctgacctggaggagccaggatgtggagaactgtgctgtgcggggcaagctgacagatgagtgctacaactacatccgggtgctggtgccctgggacagccagaccctgctggcctgtggcaccaacagcttcagccctgtgtgccgctcctatggcatcaccagcctgcagcaggagggggaggagctgagcggccaggcccgctgcccctttgatgccacccagagcaatgtggccatctttgctgagccccactttgtgcaggccctggagcacggggaccacgtgtacttcttcttccgggaggtgtctgtggaggatgcccggctgggccgggtgcagttcagccgggtggcccgggtgtgcaagagggacatgggcggcagcccccgggccctggacagacactggaccagcttcctgaagctgcggctgaactgcagcgtgcctggggacagcaccttctactttgatgtgctgcaggccctgaccggccctgtgaacctgcacggccgcagcgccctgtttggagtcttcaccacccagaccaacagcatccctggcagcgctgtgtgtgccttctacctggatgaaattgagcggggctttgagggcaagttcaaggagcagaggagcctggatggagcctggacccctgtgtctgaggacagagtgcccagcccccggcccggcagctgtgccggcgtgggcggggccgccctcttcagcagcagccgggacctgcctgatgatgtgctgaccttcatcaaggcccaccccctgctggaccctgctgtgccccctgtgacccaccagcccctgctgaccctgaccagccgggccctgctgacccaggtggccgtggatggcatggccggcccccacagcaacatcaccgtgatgttcctgggcagcaatgatggcaccgtgctgaaggtgctgacccctgggggccgcagcggcggccctgagcccatcctgctggaggagattgatgcctacagccctgcccgctgcagcggcaagaggacagcccagacagcccggcgcatcatcggcctggagctggacacagagggccaccggctgtttgtggccttcagcggctgcatcgtgtacctgcccctgagccgctgtgcccggcacggggcctgccagaggagctgcctggccagccaggacccctactgcggctggcacagcagccggggctgtgtggacatccggggcagcggcggcacagatgtggaccaggccggcaaccaggagagcatggagcacggggactgccaggatggagccaccggcagccagagcggccctggggacagcgcctacgtgctgcccggccctggccccagccctggcacccccagccccccatctgatgcccacccccggccccagagcagcaccctgggcgtgcacacccggggcgtgagaagagacctgcccccagccagcgccagccgctctgtgcccatccccctgctgctggcctctgtggccgccgcctttgccctgggcgcctctgtgtctggcctgctggtgtcctgtgcctgccggcgggcccacagaagaagaggcaaggacatcgagaccccaggcctgccccggcccctgagcctgcggagcctggcccggctgcacggcggcggccctgagcccccaccacccagcaaggatggagatgctgtgcagaccccccagctgtacaccaccttcctgcccccacctgagggcgtgcccccacctgagctggcctgcctgcccaccccagagagcaccccagagctgcctgtgaagcacctgcgggctgctggggacccctgggagtggaaccagaacagaaataatgccaaggagggccctggccgcagcagaggaggccacgccgccggcggccctgccccccgggtgctggtgcggcccccacctcctggctgccccggccaggccgtggaggtgaccaccctggaggagctgctgcgctacctgcacggcccccagccccccaggaaaggagctgagcccccagcccccctgaccagccgggccctgcccccagagcccgccccagccctgctgggcggccccagcccccggccccatgaatgtgccagccccctgcggctggatgtgcccccagagggccgctgtgccagcgccccagcccggcctgccctgagcgccccagccccccggctgggcgtgggcggcggccggcggctgcccttcagcggccaccgggcccccccagccctgctgaccagggtgcccagcggcggccccagccgctacagcggcggccctgggaagcacctgctgtacctgggccggcctgagggctaccggggccgggccctgaagagggtggatgtggagaagccccagctgagcctgaagccacccctggtgggccccagcagccggcaggccgtgcccaacggcggccgcttcaacttctag

SEQ ID NO: 37903 - DNA, 2889 bp, Artificial Sequence
  Description of Artificial Sequence: Synthetic coding sequence
atgccccgggccccccacttcatgcccctgctgctgctgctgctgctgctgagcctgccccacacccaggccgccttcccccaggaccccctgcccctgctgatcagtgacctgcagggcaccagccccctgtcctggttccggggcctggaggatgatgctgtggccgctgagctgggcctggacttccagcgcttcctgaccctgaacagaaccctgctggtggccgcccgggaccacgtgttctcctttgacctgcaggccgaggaggagggggagggcctggtgcccaacaagtacctgacctggaggagccaggatgtggagaactgtgctgtgcggggcaagctgacagatgagtgctacaactacatccgggtgctggtgccctgggacagccagaccctgctggcctgtggcaccaacagcttcagccctgtgtgccgctcctatggcatcaccagcctgcagcaggagggggaggagctgagcggccaggcccgctgcccctttgatgccacccagagcaatgtggccatctttgctgagggcagcctgtacagcgccacagctgctgacttccaggccagtgatgctgtggtgtaccgcagcctgggcccccagccccccctgcggagcgccaagtatgacagcaagtggctgcgggagccccactttgtgcaggccctggagcacggggaccacgtgtacttcttcttccgggaggtgtctgtggaggatgcccggctgggccgggtgcagttcagccgggtggcccgggtgtgcaagagggacatgggcggcagcccccgggccctggacagacactggaccagcttcctgaagctgcggctgaactgcagcgtgcctggggacagcaccttctactttgatgtgctgcaggccctgaccggccctgtgaacctgcacggccgcagcgccctgtttggagtcttcaccacccagaccaacagcatccctggcagcgctgtgtgtgccttctacctggatgaaattgagcggggctttgagggcaagttcaaggagcagaggagcctggatggagcctggacccctgtgtctgaggacagagtgcccagcccccggcccggcagctgtgccggcgtgggcggggccgccctcttcagcagcagccgggacctgcctgatgatgtgctgaccttcatcaaggcccaccccctgctggaccctgctgtgccccctgtgacccaccagcccctgctgaccctgaccagccgggccctgctgacccaggtggccgtggatggcatggccggcccccacagcaacatcaccgtgatgttcctgggcagcaatgatggcaccgtgctgaaggtgctgacccctgggggccgcagcggcggccctgagcccatcctgctggaggagattgatgcctacagccctgcccgctgcagcggcaagaggacagcccagacagcccggcgcatcatcggcctggagctggacacagagggccaccggctgtttgtggccttcagcggctgcatcgtgtacctgcccctgagccgctgtgcccggcacggggcctgccagaggagctgcctggccagccaggacccctactgcggctggcacagcagccggggctgtgtggacatccggggcagcggcggcacagatgtggaccaggccggcaaccaggagagcatggagcacggggactgccaggatggagccaccggcagccagagcggccctggggacagcgcctacgtgctgcccggccctggccccagccctggcacccccagccccccatctgatgcccacccccggccccagagcagcaccctgggcgtgcacacccggggcgtgagaagagacctgcccccagccagcgccagccgctctgtgcccatccccctgctgctggcctctgtggccgccgcctttgccctgggcgcctctgtgtctggcctgctggtgtcctgtgcctgccggcgggcccacagaagaagaggcaaggacatcgagaccccaggcctgccccggcccctgagcctgcggagcctggcccggctgcacggcggcggccctgagcccccaccacccagcaaggatggagatgctgtgcagaccccccagctgtacaccaccttcctgcccccacctgagggcgtgcccccacctgagctggcctgcctgcccaccccagagagcaccccagagctgcctgtgaagcacctgcgggctgctggggacccctgggagtggaaccagaacagaaataatgccaaggagggccctggccgcagcagaggaggccacgccgccggcggccctgccccccgggtgctggtgcggcccccacctcctggctgccccggccaggccgtggaggtgaccaccctggaggagctgctgcgctacctgcacggcccccagccccccaggaaaggagctgagcccccagcccccctgaccagccgggccctgcccccagagcccgccccagccctgctgggcggccccagcccccggccccatgaatgtgccagccccctgcggctggatgtgcccccagagggccgctgtgccagcgccccagcccggcctgccctgagcgccccagccccccggctgggcgtgggcggcggccggcggctgcccttcagcggccaccgggcccccccagccctgctgaccagggtgcccagcggcggccccagccgctacagcggcggccctgggaagcacctgctgtacctgggccggcctgagggctaccggggccgggccctgaagagggtggatgtggagaagccccagctgagcctgaagccacccctggtgggccccagcagccggcaggccgtgcccaacggcggccgcttcaacttctag

SEQ ID NO: 37904 - DNA, 2793 bp, Artificial Sequence; identical to SEQ ID NO: 37901
  Description of Artificial Sequence: Synthetic coding sequence

SEQ ID NO: 37905 - DNA, 1614 bp, Artificial Sequence
  Description of Artificial Sequence: Synthetic coding sequence
atgccccgggccccccacttcatgcccctgctgctgctgctgctgctgctgagcctgccccacacccaggccgccttcccccaggaccccctgcccctgctgatcagtgacctgcagggcaccagccccctgtcctggttccggggcctggaggatgatgctgtggccgctgagctgggcctggacttccagcgcttcctgaccctgaacagaaccctgctggtggccgcccgggaccacgtgttctcctttgacctgcaggccgaggaggagggggagggcctggtgcccaacaagtacctgacctggaggagccaggatgtggagaactgtgctgtgcggggcaagctgacagatgagtgctacaactacatccgggtgctggtgccctgggacagccagaccctgctggcctgtggcaccaacagcttcagccctgtgtgccgctcctatggcatcaccagcctgcagcaggagggggaggagctgagcggccaggcccgctgcccctttgatgccacccagagcaatgtggccatctttgctgagggcagcctgtacagcgccacagctgctgacttccaggccagtgatgctgtggtgtaccgcagcctgggcccccagccccccctgcggagcgccaagtatgacagcaagtggctgcgggagccccactttgtgcaggccctggagcacggggaccacgtgtacttcttcttccgggaggtgtctgtggaggatgcccggctgggccgggtgcagttcagccgggtggcccgggtgtgcaagagggacatgggcggcagcccccgggccctggacagacactggaccagcttcctgaagctgcggctgaactgcagcgtgcctggggacagcaccttctactttgatgtgctgcaggccctgaccggccctgtgaacctgcacggccgcagcgccctgtttggagtcttcaccacccagaccaacagcatccctggcagcgctgtgtgtgccttctacctggatgaaattgagcggggctttgagggcaagttcaaggagcagaggagcctggatggagcctggacccctgtgtctgaggacagagtgcccagcccccggcccggcagctgcccagcccacagcagccccctgggccgcagcctgcaggtgctgcggggcagccgggaggcccctcctgtgcccggccctgcccggggcctgcccggccccaggcctgagaagggcggcagaagagaggcccctgtggtgcctgaggccagcccccggcgggccctgctgcccccaggccggcctgagcggcggcccttccagctgctgaagggagctgcccacggcctgcagagaggagagcggcccagccccctgggccacgagctggatgccctgcaggatgtgagccccccacccaggcctgcccccccagccttccccacccggcgggtgtcccggggccccttcagcccccgggtgtacctgctgactgtgttcccccctgtgctggacagaagagtgggcggggagaagcctgtgtcctctgtgtcccagcacttccggggctcctggaggacccccacccccaggagcctgcctgccaagctgccctag

SEQ ID NO: 37906 - DNA, 3222 bp, Artificial Sequence
  Description of Artificial Sequence: Synthetic coding sequence
atgagggtcttcctgctgtgtgcctacatcctgctgctgatggtgtcccagctgcgggctgtgtccttcccagaagatgatgagcccctgaacacagtggactaccactacagccggcagtaccctgtgttccggggccggcccagcggaaatgaaagccagcaccggctggacttccagctgatgctgaagatccgggacaccctgtacatcgccggccgggaccaggtgtacacagtgaacctgaatgagatgcccaagacagaggtgatccccaacaagaagctgacctggaggagccggcagcaggaccgggagaactgtgccatgaagggcaagcacaaggatgagtgccacaacttcatcaaggtgtttgtgcccagaaatgatgagatggtgtttgtgtgtggcaccaatgccttcaaccccatgtgccgctactaccgcctgagcaccctggagtatgatggagaggagatcagcggcctggcccgctgcccctttgatgcccggcagaccaacgtggccctgtttgctgatggcaagctgtacagcgccaccgtggccgacttcctggccagtgatgctgtgatctaccgctccatgggagatggcagcgccctgcggaccatcaagtatgacagcaagtggatcaaggagccccacttcctgcacgccattgaatatggcaactacgtgtacttcttcttccgggagattgctgtggagcacaacaacctgggcaaggctgtgtacagccgggtggcccgcatctgcaagaatgacatgggcggcagccagagggtgctggagaagcactggaccagcttcctgaaggcccggctgaactgcagcgtgcctggggacagcttcttctactttgatgtgctgcagagcatcacagacatcatccagatcaatggcatccccaccgtggtgggcgtcttcaccacccagctgaacagcatccctggcagcgctgtgtgtgccttctccatggatgacatcgagaaggtgttcaagggccgcttcaaggagcagaagaccccagacagcgtgtggacagctgtgcctgaggacaaggtgcccaagcccaggcctggctgctgtgccaagcacggcctggccgaggcctacaagaccagcattgacttcccagatgagaccctgtccttcatcaagagccaccccctgatggattctgctgtgccccccatcgcagatgagccctggttcaccaagaccagggtgcgctaccgcctgacagccatctctgtggaccacagcgctggcccctaccagaactacaccgtcatctttgtgggcagcgaggccggcatggtgctgaaggtgctggccaagaccagccccttcagcctgaatgattctgtgctgctggaggagattgaggcctacaaccacgccaagtgcagcgcagaaaatgaggaggacaagaaggtgatcagcctgcagctggacaaggaccaccacgccctgtatgtggccttcagcagctgcatcatccgcatccccctgagccgctgtgaaagatatggcagctgcaagaagagctgcatcgccagccgggacccctactgcggctggctgagccagggcagctgtggccgggtgaccccaggcatgctggccgagggctatgagcaggacacagaatttggaaacacagcccacctgggggactgccacgagatcctgcccaccagcaccaccccagactacaagatctttggaggccccaccagtgacatggaggtgagcagcagctctgtgaccaccatggccagcatccctgagatcacccccaaggtgattgacacctggaggcccaagctgaccagcagcaggaagtttgtggtgcaggatgaccccaacaccagtgacttcacagaccccctgagcggcatccccaagggcgtgcgctgggaggtgcagagcggggagagcaaccagatggtgcacatgaatgtgctgatcacctgtgtgtttgctgcctttgtgctgggcgccttcatcgccggcgtggccgtgtactgctacagagacatgtttgtgaggaagaacaggaagatccacaaggatgctgagagcgcccagagctgcacagacagcagcggcagctttgccaagctgaatggcctgtttgacagccctgtgaaggagtaccagcagaacatcgacagccccaagctgtacagcaacctgctgaccagcaggaaggagctgcccccaaatggagacaccaagtccatggtgatggaccaccggggccagcccccagagctggccgccctgcccaccccagagagcacccctgtgctgcaccagaagaccctgcaggccatgaagagccacagcgagaaggcccacggccacggggccagcaggaaggagaccccccagttcttccccagcagccccccaccccacagccccctgagccacggccacatccccagcgccatcgtgctgcccaatgccacccatgactacaacaccagcttcagcaacagcaatgcccacaaggccgagaagaagctgcagaacatcgaccaccccctgaccaagagcagcagcaagagggaccaccggcgctctgtggacagcaggaacaccctgaatgacctgctgaagcacctgaatgaccccaacagcaaccccaaggccatcatgggagacatccagatggcccaccagaacctgatgctggaccccatgggctccatgtctgaggtgccccccaaggtgcccaaccgggaggccagcctgtacagcccccccagcaccctgcccaggaacagccccaccaagagggtggatgtgcccaccaccccaggagtgcccatgaccagcctggagcggcagaggggctaccacaagaacagcagccagaggcacagcatcagcgccatgcccaagaacctgaacagccccaatggagtgctgctgagccggcagcccagcatgaacagaggaggctacatgcccacccccactggagccaaggtggactacatccagggcacccctgtgtctgtgcacctgcagcccagcctgagccggcagagcagctacaccagcaatggcaccctgcccaggacaggcctgaagaggacccccagcctgaagccagatgtgccccccaagcccagctttgtgccccagacccccagcgtgcggcccctgaacaagtacacctactag

SEQ ID NO: 37907 - DNA, 3054 bp, Artificial Sequence
  Description of Artificial Sequence: Synthetic coding sequence
atgagggtcttcctgctgtgtgcctacatcctgctgctgatggtgtcccagctgcgggctgtgtccttcccagaagatgatgagcccctgaacacagtggactaccactacagccggcagtaccctgtgttccggggccggcccagcggaaatgaaagccagcaccggctggacttccagctgatgctgaagatccgggacaccctgtacatcgccggccgggaccaggtgtacacagtgaacctgaatgagatgcccaagacagaggtgatccccaacaagaagctgacctggaggagccggcagcaggaccgggagaactgtgccatgaagggcaagcacaaggatgagtgccacaacttcatcaaggtgtttgtgcccagaaatgatgagatggtgtttgtgtgtggcaccaatgccttcaaccccatgtgccgctactaccgcctgagcaccctggagtatgatggagaggagatcagcggcctggcccgctgcccctttgatgcccggcagaccaacgtggccctgtttgctgatggcaagctgtacagcgccaccgtggccgacttcctggccagtgatgctgtgatctaccgctccatgggagatggcagcgccctgcggaccatcaagtatgacagcaagtggatcaaggagccccacttcctgcacgccattgaatatggcaactacgtgtacttcttcttccgggagattgctgtggagcacaacaacctgggcaaggctgtgtacagccgggtggcccgcatctgcaagaatgacatgggcggcagccagagggtgctggagaagcactggaccagcttcctgaaggcccggctgaactgcagcgtgcctggggacagcttcttctactttgatgtgctgcagagcatcacagacatcatccagatcaatggcatccccaccgtggtgggcgtcttcaccacccagctgaacagcatccctggcagcgctgtgtgtgccttctccatggatgacatcgagaaggtgttcaagggccgcttcaaggagcagaagaccccagacagcgtgtggacagctgtgcctgaggacaaggtgcccaagcccaggcctggctgctgtgccaagcacggcctggccgaggcctacaagaccagcattgacttcccagatgagaccctgtccttcatcaagagccaccccctgatggattctgctgtgccccccatcgcagatgagccctggttcaccaagaccagggtgcgctaccgcctgacagccatctctgtggaccacagcgctggcccctaccagaactacaccgtcatctttgtgggcagcgaggccggcatggtgctgaaggtgctggccaagaccagccccttcagcctgaatgattctgtgctgctggaggagattgaggcctacaaccacgccaagtgcagcgcagaaaatgaggaggacaagaaggtgatcagcctgcagctggacaaggaccaccacgccctgtatgtggccttcagcagctgcatcatccgcatccccctgagccgctgtgaaagatatggcagctgcaagaagagctgcatcgccagccgggacccctactgcggctggctgagccagggcagctgtggccgggtgaccccaggcatgctggccgagggctatgagcaggacacagaatttggaaacacagcccacctgggggactgccacgagatcctgcccaccagcaccaccccagactacaagatctttggaggccccaccagcggcgtgcgctgggaggtgcagagcggggagagcaaccagatggtgcacatgaatgtgctgatcacctgtgtgtttgctgcctttgtgctgggcgccttcatcgccggcgtggccgtgtactgctacagagacatgtttgtgaggaagaacaggaagatccacaaggatgctgagagcgcccagagctgcacagacagcagcggcagctttgccaagctgaatggcctgtttgacagccctgtgaaggagtaccagcagaacatcgacagccccaagctgtacagcaacctgctgaccagcaggaaggagctgcccccaaatggagacaccaagtccatggtgatggaccaccggggccagcccccagagctggccgccctgcccaccccagagagcacccctgtgctgcaccagaagaccctgcaggccatgaagagccacagcgagaaggcccacggccacggggccagcaggaaggagaccccccagttcttccccagcagccccccaccccacagccccctgagccacggccacatccccagcgccatcgtgctgcccaatgccacccatgactacaacaccagcttcagcaacagcaatgcccacaaggccgagaagaagctgcagaacatcgaccaccccctgaccaagagcagcagcaagagggaccaccggcgctctgtggacagcaggaacaccctgaatgacctgctgaagcacctgaatgaccccaacagcaaccccaaggccatcatgggagacatccagatggcccaccagaacctgatgctggaccccatgggctccatgtctgaggtgccccccaaggtgcccaaccgggaggccagcctgtacagcccccccagcaccctgcccaggaacagccccaccaagagggtggatgtgcccaccaccccaggagtgcccatgaccagcctggagcggcagaggggctaccacaagaacagcagccagaggcacagcatcagcgccatgcccaagaacctgaacagccccaatggagtgctgctgagccggcagcccagcatgaacagaggaggctacatgcccacccccactggagccaaggtggactacatccagggcacccctgtgtctgtgcacctgcagcccagcctgagccggcagagcagctacaccagcaatggcaccctgcccaggacaggcctgaagaggacccccagcctgaagccagatgtgccccccaagcccagctttgtgccccagacccccagcgtgcggcccctgaacaagtacacctactag

SEQ ID NO: 37908 - DNA, 1794 bp, Artificial Sequence
  Description of Artificial Sequence: Synthetic coding sequence
atgagggtcttcctgctgtgtgcctacatcctgctgctgatggtgtcccagctgcgggctgtgtccttcccagaagatgatgagcccctgaacacagtggactaccactacagccggcagtaccctgtgttccggggccggcccagcggaaatgaaagccagcaccggctggacttccagctgatgctgaagatccgggacaccctgtacatcgccggccgggaccaggtgtacacagtgaacctgaatgagatgcccaagacagaggtgatccccaacaagaagctgacctggaggagccggcagcaggaccgggagaactgtgccatgaagggcaagcacaaggatgagtgccacaacttcatcaaggtgtttgtgcccagaaatgatgagatggtgtttgtgtgtggcaccaatgccttcaaccccatgtgccgctactaccgcctgagcaccctggagtatgatggagaggagatcagcggcctggcccgctgcccctttgatgcccggcagaccaacgtggccctgtttgctgatggcaagctgtacagcgccaccgtggccgacttcctggccagtgatgctgtgatctaccgctccatgggagatggcagcgccctgcggaccatcaagtatgacagcaagtggatcaaggagccccacttcctgcacgccattgaatatggcaactacgtgtacttcttcttccgggagattgctgtggagcacaacaacctgggcaaggctgtgtacagccgggtggcccgcatctgcaagaatgacatgggcggcagccagagggtgctggagaagcactggaccagcttcctgaaggcccggctgaactgcagcgtgcctggggacagcttcttctactttgatgtgctgcagagcatcacagacatcatccagatcaatggcatccccaccgtggtgggcgtcttcaccacccagctgaacagcatccctggcagcgctgtgtgtgccttctccatggatgacatcgagaaggtgttcaagggccgcttcaaggagcagaagaccccagacagcgtgtggacagctgtgcctgaggacaaggtgcccaagcccaggcctggctgctgtgccaagcacggcctggccgaggcctacaagaccagcattgacttcccagatgagaccctgtccttcatcaagagccaccccctgatggattctgctgtgccccccatcgcagatgagccctggttcaccaagaccagggtgcgctaccgcctgacagccatctctgtggaccacagcgctggcccctaccagaactacaccgtcatctttgtgggcagcgaggccggcatggtgctgaaggtgctggccaagaccagccccttcagcctgaatgattctgtgctgctggaggagattgaggcctacaaccacgccaagtgcagcgcagaaaatgaggaggacaagaaggtgatcagcctgcagctggacaaggaccaccacgccctgtatgtggccttcagcagctgcatcatccgcatccccctgagccgctgtgaaagatatggcagctgcaagaagagctgcatcgccagccgggacccctactgcggctggctgagccagggcagctgtggccgggtgaccccaggcatgctggccgagggctatgagcaggacacagaatttggaaacacagcccacctgggggactgccacgacatggaggtgagcagcagctctgtgaccaccatggtgtatgatggcaagagcagcctggagagccccacccgctggagcacctag

SEQ ID NO: 37909 - DNA, 3036 bp, Artificial Sequence
  Description of Artificial Sequence: Synthetic coding sequence
atgagggtcttcctgctgtgtgcctacatcctgctgctgatggtgtcccagctgcgggctgtgtccttcccagaagatgatgagcccctgaacacagtggactaccactacagccggcagtaccctgtgttccggggccggcccagcggaaatgaaagccagcaccggctggacttccagctgatgctgaagatccgggacaccctgtacatcgccggccgggaccaggtgtacacagtgaacctgaatgagatgcccaagacagaggtgatccccaacaagaagctgacctggaggagccggcagcaggaccgggagaactgtgccatgaagggcaagcacaaggatgagtgccacaacttcatcaaggtgtttgtgcccagaaatgatgagatggtgtttgtgtgtggcaccaatgccttcaaccccatgtgccgctactaccgcctgagcaccctggagtatgatggagaggagatcagcggcctggcccgctgcccctttgatgcccggcagaccaacgtggccctgtttgctgatggcaagctgtacagcgccaccgtggccgacttcctggccagtgatgctgtgatctaccgctccatgggagatggcagcgccctgcggaccatcaagtatgacagcaagtggatcaaggagccccacttcctgcacgccattgaatatggcaactacgtgtacttcttcttccgggagattgctgtggagcacaacaacctgggcaaggctgtgtacagccgggtggcccgcatctgcaagaatgacatgggcggcagccagagggtgctggagaagcactggaccagcttcctgaaggcccggctgaactgcagcgtgcctggggacagcttcttctactttgatgtgctgcagagcatcacagacatcatccagatcaatggcatccccaccgtggtgggcgtcttcaccacccagctgaacagcatccctggcagcgctgtgtgtgccttctccatggatgacatcgagaaggtgttcaagggccgcttcaaggagcagaagaccccagacagcgtgtggacagctgtgcctgaggacaaggtgcccaagcccaggcctggctgctgtgccaagcacggcctggccgaggcctacaagaccagcattgacttcccagatgagaccctgtccttcatcaagagccaccccctgatggattctgctgtgccccccatcgcagatgagccctggttcaccaagaccagggtgcgctaccgcctgacagccatctctgtggaccacagcgctggcccctaccagaactacaccgtcatctttgtgggcagcgaggccggcatggtgctgaaggtgctggccaagaccagccccttcagcctgaatgattctgtgctgctggaggagattgaggcctacaaccacgccaagtgcagcgcagaaaatgaggaggacaagaaggtgatcagcctgcagctggacaaggaccaccacgccctgtatgtggccttcagcagctgcatcatccgcatccccctgagccgctgtgaaagatatggcagctgcaagaagagctgcatcgccagccgggacccctactgcggctggctgagccagggcagctgtggccgggtgaccccaggcatgctgctgctgacagaggacttctttgccttccacaaccacagcgctgagggctatgagcaggacacagaatttggaaacacagcccacctgggggactgccacggcgtgcgctgggaggtgcagagcggggagagcaaccagatggtgcacatgaatgtgctgatcacctgtgtgtttgctgcctttgtgctgggcgccttcatcgccggcgtggccgtgtactgctacagagacatgtttgtgaggaagaacaggaagatccacaaggatgctgagagcgcccagagctgcacagacagcagcggcagctttgccaagctgaatggcctgtttgacagccctgtgaaggagtaccagcagaacatcgacagccccaagctgtacagcaacctgctgaccagcaggaaggagctgcccccaaatggagacaccaagtccatggtgatggaccaccggggccagcccccagagctggccgccctgcccaccccagagagcacccctgtgctgcaccagaagaccctgcaggccatgaagagccacagcgagaaggcccacggccacggggccagcaggaaggagaccccccagttcttccccagcagccccccaccccacagccccctgagccacggccacatccccagcgccatcgtgctgcccaatgccacccatgactacaacaccagcttcagcaacagcaatgcccacaaggccgagaagaagctgcagaacatcgaccaccccctgaccaagagcagcagcaagagggaccaccggcgctctgtggacagcaggaacaccctgaatgacctgctgaagcacctgaatgaccccaacagcaaccccaaggccatcatgggagacatccagatggcccaccagaacctgatgctggaccccatgggctccatgtctgaggtgccccccaaggtgcccaaccgggaggccagcctgtacagcccccccagcaccctgcccaggaacagccccaccaagagggtggatgtgcccaccaccccaggagtgcccatgaccagcctggagcggcagaggggctaccacaagaacagcagccagaggcacagcatcagcgccatgcccaagaacctgaacagccccaatggagtgctgctgagccggcagcccagcatgaacagaggaggctacatgcccacccccactggagccaaggtggactacatccagggcacccctgtgtctgtgcacctgcagcccagcctgagccggcagagcagctacaccagcaatggcaccctgcccaggacaggcctgaagaggacccccagcctgaagccagatgtgccccccaagcccagctttgtgccccagacccccagcgtgcggcccctgaacaagtacacctactag

SEQ ID NO: 37910 - DNA, 1431 bp, Artificial Sequence
  Description of Artificial Sequence: Synthetic coding sequence
atgagggtcttcctgctgtgtgcctacatcctgctgctgatggtgtcccagctgcgggctgtgtccttcccagaagatgatgagcccctgaacacagtggactaccactacagccggcagtaccctgtgttccggggccggcccagcggaaatgaaagccagcaccggctggacttccagctgatgctgaagatccgggacaccctgtacatcgccggccgggaccaggtgtacacagtgaacctgaatgagatgcccaagacagaggtgatccccaacaagaagctgacctggaggagccggcagcaggaccgggagaactgtgccatgaagggcaagcacaaggatgagtgccacaacttcatcaaggtgtttgtgcccagaaatgatgagatggtgtttgtgtgtggcaccaatgccttcaaccccatgtgccgctactaccgcctgagcaccctggagtatgatggagaggagatcagcggcctggcccgctgcccctttgatgcccggcagaccaacgtggccctgtttgctgatggcaagctgtacagcgccaccgtggccgacttcctggccagtgatgctgtgatctaccgctccatgggagatggcagcgccctgcggaccatcaagtatgacagcaagtggatcaaggagccccacttcctgcacgccattgaatatggcaactacgtgtacttcttcttccgggagattgctgtggagcacaacaacctgggcaaggctgtgtacagccgggtggcccgcatctgcaagaatgacatgggcggcagccagagggtgctggagaagcactggaccagcttcctgaaggcccggctgaactgcagcgtgcctggggacagcttcttctactttgatgtgctgcagagcatcacagacatcatccagatcaatggcatccccaccgtggtgggcgtcttcaccacccagctgaacagcatccctggcagcgctgtgtgtgccttctccatggatgacatcgagaaggtgttcaagggccgcttcaaggagcagaagaccccagacagcgtgtggacagctgtgcctgaggacaaggtgcccaagcccaggcctggctgctgtgccaagcacggcctggccgaggcctacaagaccagcattgacttcccagatgagaccctgtccttcatcaagagccaccccctgatggattctgctgtgccccccatcgcagatgagccctggttcaccaagaccagggtgcgctaccgcctgacagccatctctgtggaccacagcgctggcccctaccagaactacaccgtcatctttgtgggcagcgaggccggcatggtgctgaaggtgctggccaagaccagccccttcagcctgaatgattctgtgctgctggaggagattgaggcctacaaccacgccaagtag

SEQ ID NO: 37911 - DNA, 2997 bp, Artificial Sequence
  Description of Artificial Sequence: Synthetic coding sequence
atgagggtcttcctgctgtgtgcctacatcctgctgctgatggtgtcccagctgcgggctgtgtccttcccagaagatgatgagcccctgaacacagtggactaccactacagccggcagtaccctgtgttccggggccggcccagcggaaatgaaagccagcaccggctggacttccagctgatgctgaagatccgggacaccctgtacatcgccggccgggaccaggtgtacacagtgaacctgaatgagatgcccaagacagaggtgatccccaacaagaagctgacctggaggagccggcagcaggaccgggagaactgtgccatgaagggcaagcacaaggatgagtgccacaacttcatcaaggtgtttgtgcccagaaatgatgagatggtgtttgtgtgtggcaccaatgccttcaaccccatgtgccgctactaccgcctgagcaccctggagtatgatggagaggagatcagcggcctggcccgctgcccctttgatgcccggcagaccaacgtggccctgtttgctgatggcaagctgtacagcgccaccgtggccgacttcctggccagtgatgctgtgatctaccgctccatgggagatggcagcgccctgcggaccatcaagtatgacagcaagtggatcaaggagccccacttcctgcacgccattgaatatggcaactacgtgtacttcttcttccgggagattgctgtggagcacaacaacctgggcaaggctgtgtacagccgggtggcccgcatctgcaagaatgacatgggcggcagccagagggtgctggagaagcactggaccagcttcctgaaggcccggctgaactgcagcgtgcctggggacagcttcttctactttgatgtgctgcagagcatcacagacatcatccagatcaatggcatccccaccgtggtgggcgtcttcaccacccagctgaacagcatccctggcagcgctgtgtgtgccttctccatggatgacatcgagaaggtgttcaagggccgcttcaaggagcagaagaccccagacagcgtgtggacagctgtgcctgaggacaaggtgcccaagcccaggcctggctgctgtgccaagcacggcctggccgaggcctacaagaccagcattgacttcccagatgagaccctgtccttcatcaagagccaccccctgatggattctgctgtgccccccatcgcagatgagccctggttcaccaagaccagggtgcgctaccgcctgacagccatctctgtggaccacagcgctggcccctaccagaactacaccgtcatctttgtgggcagcgaggccggcatggtgctgaaggtgctggccaagaccagccccttcagcctgaatgattctgtgctgctggaggagattgaggcctacaaccacgccaagtgcagcgcagaaaatgaggaggacaagaaggtgatcagcctgcagctggacaaggaccaccacgccctgtatgtggccttcagcagctgcatcatccgcatccccctgagccgctgtgaaagatatggcagctgcaagaagagctgcatcgccagccgggacccctactgcggctggctgagccagggcagctgtggccgggtgaccccaggcatgctggccgagggctatgagcaggacacagaatttggaaacacagcccacctgggggactgccacggcgtgcgctgggaggtgcagagcggggagagcaaccagatggtgcacatgaatgtgctgatcacctgtgtgtttgctgcctttgtgctgggcgccttcatcgccggcgtggccgtgtactgctacagagacatgtttgtgaggaagaacaggaagatccacaaggatgctgagagcgcccagagctgcacagacagcagcggcagctttgccaagctgaatggcctgtttgacagccctgtgaaggagtaccagcagaacatcgacagccccaagctgtacagcaacctgctgaccagcaggaaggagctgccccccaacggggacaccaagtccatggtgatggaccaccggggccagcccccagagctggccgccctgcccaccccagagagcacccctgtgctgcaccagaagaccctgcaggccatgaagagccacagcgagaaggcccacggccatggagccagcaggaaggagaccccccagttcttccccagcagccccccaccccacagccccctgagccacggccacatccccagcgccatcgtgctgcccaatgccacccatgactacaacaccagcttcagcaacagcaatgcccacaaggccgagaagaagctgcagaacatcgaccaccccctgaccaagagcagcagcaagagggaccacagaagatctgtggacagcaggaacaccctgaatgacctgctgaagcacctgaatgaccccaacagcaaccccaaggccatcatgggagacatccagatggcccaccagaacctgatgctggaccccatgggctccatgtctgaggtgccccccaaggtgcccaaccgggaggccagcctgtacagcccccccagcaccctgcccaggaacagccccaccaagagggtggatgtgcccaccaccccaggagtgcccatgaccagcctggagcggcagaggggctaccacaagaacagcagccagaggcacagcatcagcgccatgcccaagaacctgaacagccccaacggggtgctgctgagccggcagcccagcatgaacagaggaggctacatgcccacccccaccggggccaaggtggactacatccagggcacccctgtgtctgtgcacctgcagcccagcctgagccggcagagcagctacaccagcaatggcaccctgcccaggacaggcctgaagaggacccccagcctgaagccagatgtgccccccaagcccagctttgtgccccagaccccatctgtgcggcccctgaacaagtacacctactag

SEQ ID NO: 37912 - DNA, 3093 bp, Artificial Sequence
  Description of Artificial Sequence: Synthetic coding sequence
atgagggtcttcctgctgtgtgcctacatcctgctgctgatggtgtcccagctgcgggctgtgtccttcccagaagatgatgagcccctgaacacagtggactaccactacagccggcagtaccctgtgttccggggccggcccagcggaaatgaaagccagcaccggctggacttccagctgatgctgaagatccgggacaccctgtacatcgccggccgggaccaggtgtacacagtgaacctgaatgagatgcccaagacagaggtgatccccaacaagaagctgacctggaggagccggcagcaggaccgggagaactgtgccatgaagggcaagcacaaggatgagtgccacaacttcatcaaggtgtttgtgcccagaaatgatgagatggtgtttgtgtgtggcaccaatgccttcaaccccatgtgccgctactaccgcctgagcaccctggagtatgatggagaggagatcagcggcctggcccgctgcccctttgatgcccggcagaccaacgtggccctgtttgctgatggcaagctgtacagcgccaccgtggccgacttcctggccagtgatgctgtgatctaccgctccatgggagatggcagcgccctgcggaccatcaagtatgacagcaagtggatcaaggagccccacttcctgcacgccattgaatatggcaactacgtgtacttcttcttccgggagattgctgtggagcacaacaacctgggcaaggctgtgtacagccgggtggcccgcatctgcaagaatgacatgggcggcagccagagggtgctggagaagcactggaccagcttcctgaaggcccggctgaactgcagcgtgcctggggacagcttcttctactttgatgtgctgcagagcatcacagacatcatccagatcaatggcatccccaccgtggtgggcgtcttcaccacccagctgaacagcatccctggcagcgctgtgtgtgccttctccatggatgacatcgagaaggtgttcaagggccgcttcaaggagcagaagaccccagacagcgtgtggacagctgtgcctgaggacaaggtgcccaagcccaggcctggctgctgtgccaagcacggcctggccgaggcctacaagaccagcattgacttcccagatgagaccctgtccttcatcaagagccaccccctgatggattctgctgtgccccccatcgcagatgagccctggttcaccaagaccagggtgcgctaccgcctgacagccatctctgtggaccacagcgctggcccctaccagaactacaccgtcatctttgtgggcagcgaggccggcatggtgctgaaggtgctggccaagaccagccccttcagcctgaatgattctgtgctgctggaggagattgaggcctacaaccacgccaagtgcagcgcagaaaatgaggaggacaagaaggtgatcagcctgcagctggacaaggaccaccacgccctgtatgtggccttcagcagctgcatcatccgcatccccctgagccgctgtgaaagatatggcagctgcaagaagagctgcatcgccagccgggacccctactgcggctggctgagccagggcagctgtggccgggtgaccccaggcatgctgctgctgacagaggacttctttgccttccacaaccacagcgctgagggctatgagcaggacacagaatttggaaacacagcccacctgggggactgccacgagatcctgcccaccagcaccaccccagactacaagatctttggaggccccaccagcggcgtgcgctgggaggtgcagagcggggagagcaaccagatggtgcacatgaatgtgctgatcacctgtgtgtttgctgcctttgtgctgggcgccttcatcgccggcgtggccgtgtactgctacagagacatgtttgtgaggaagaacaggaagatccacaaggatgctgagagcgcccagagctgcacagacagcagcggcagctttgccaagctgaatggcctgtttgacagccctgtgaaggagtaccagcagaacatcgacagccccaagctgtacagcaacctgctgaccagcaggaaggagctgccccccaacggggacaccaagtccatggtgatggaccaccggggccagcccccagagctggccgccctgcccaccccagagagcacccctgtgctgcaccagaagaccctgcaggccatgaagagccacagcgagaaggcccacggccatggagccagcaggaaggagaccccccagttcttccccagcagccccccaccccacagccccctgagccacggccacatccccagcgccatcgtgctgcccaatgccacccatgactacaacaccagcttcagcaacagcaatgcccacaaggccgagaagaagctgcagaacatcgaccaccccctgaccaagagcagcagcaagagggaccacagaagatctgtggacagcaggaacaccctgaatgacctgctgaagcacctgaatgaccccaacagcaaccccaaggccatcatgggagacatccagatggcccaccagaacctgatgctggaccccatgggctccatgtctgaggtgccccccaaggtgcccaaccgggaggccagcctgtacagcccccccagcaccctgcccaggaacagccccaccaagagggtggatgtgcccaccaccccaggagtgcccatgaccagcctggagcggcagaggggctaccacaagaacagcagccagaggcacagcatcagcgccatgcccaagaacctgaacagccccaacggggtgctgctgagccggcagcccagcatgaacagaggaggctacatgcccacccccaccggggccaaggtggactacatccagggcacccctgtgtctgtgcacctgcagcccagcctgagccggcagagcagctacaccagcaatggcaccctgcccaggacaggcctgaagaggacccccagcctgaagccagatgtgccccccaagcccagctttgtgccccagaccccatctgtgcggcccctgaacaagtacacctactag

SEQ ID NO: 37913 - DNA, 3165 bp, Artificial Sequence
  Description of Artificial Sequence: Synthetic coding sequence
atgagggtcttcctgctgtgtgcctacatcctgctgctgatggtgtcccagctgcgggctgtgtccttcccagaagatgatgagcccctgaacacagtggactaccactacagccggcagtaccctgtgttccggggccggcccagcggaaatgaaagccagcaccggctggacttccagctgatgctgaagatccgggacaccctgtacatcgccggccgggaccaggtgtacacagtgaacctgaatgagatgcccaagacagaggtgatccccaacaagaagctgacctggaggagccggcagcaggaccgggagaactgtgccatgaagggcaagcacaaggatgagtgccacaacttcatcaaggtgtttgtgcccagaaatgatgagatggtgtttgtgtgtggcaccaatgccttcaaccccatgtgccgctactaccgcctgagcaccctggagtatgatggagaggagatcagcggcctggcccgctgcccctttgatgcccggcagaccaacgtggccctgtttgctgatggcaagctgtacagcgccaccgtggccgacttcctggccagtgatgctgtgatctaccgctccatgggagatggcagcgccctgcggaccatcaagtatgacagcaagtggatcaaggagccccacttcctgcacgccattgaatatggcaactacgtgtacttcttcttccgggagattgctgtggagcacaacaacctgggcaaggctgtgtacagccgggtggcccgcatctgcaagaatgacatgggcggcagccagagggtgctggagaagcactggaccagcttcctgaaggcccggctgaactgcagcgtgcctggggacagcttcttctactttgatgtgctgcagagcatcacagacatcatccagatcaatggcatccccaccgtggtgggcgtcttcaccacccagctgaacagcatccctggcagcgctgtgtgtgccttctccatggatgacatcgagaaggtgttcaagggccgcttcaaggagcagaagaccccagacagcgtgtggacagctgtgcctgaggacaaggtgcccaagcccaggcctggctgctgtgccaagcacggcctggccgaggcctacaagaccagcattgacttcccagatgagaccctgtccttcatcaagagccaccccctgatggattctgctgtgccccccatcgcagatgagccctggttcaccaagaccagggtgcgctaccgcctgacagccatctctgtggaccacagcgctggcccctaccagaactacaccgtcatctttgtgggcagcgaggccggcatggtgctgaaggtgctggccaagaccagccccttcagcctgaatgattctgtgctgctggaggagattgaggcctacaaccacgccaagtgcagcgcagaaaatgaggaggacaagaaggtgatcagcctgcagctggacaaggaccaccacgccctgtatgtggccttcagcagctgcatcatccgcatccccctgagccgctgtgaaagatatggcagctgcaagaagagctgcatcgccagccgggacccctactgcggctggctgagccagggcagctgtggccgggtgaccccaggcatgctggccgagggctatgagcaggacacagaatttggaaacacagcccacctgggggactgccacgacatggaggtgagcagcagctctgtgaccaccatggccagcatccctgagatcacccccaaggtgattgacacctggaggcccaagctgaccagcagcaggaagtttgtggtgcaggatgaccccaacaccagtgacttcacagaccccctgagcggcatccccaagggcgtgcgctgggaggtgcagagcggggagagcaaccagatggtgcacatgaatgtgctgatcacctgtgtgtttgctgcctttgtgctgggcgccttcatcgccggcgtggccgtgtactgctacagagacatgtttgtgaggaagaacaggaagatccacaaggatgctgagagcgcccagagctgcacagacagcagcggcagctttgccaagctgaatggcctgtttgacagccctgtgaaggagtaccagcagaacatcgacagccccaagctgtacagcaacctgctgaccagcaggaaggagctgccccccaacggggacaccaagtccatggtgatggaccaccggggccagcccccagagctggccgccctgcccaccccagagagcacccctgtgctgcaccagaagaccctgcaggccatgaagagccacagcgagaaggcccacggccatggagccagcaggaaggagaccccccagttcttccccagcagccccccaccccacagccccctgagccacggccacatccccagcgccatcgtgctgcccaatgccacccatgactacaacaccagcttcagcaacagcaatgcccacaaggccgagaagaagctgcagaacatcgaccaccccctgaccaagagcagcagcaagagggaccacagaagatctgtggacagcaggaacaccctgaatgacctgctgaagcacctgaatgaccccaacagcaaccccaaggccatcatgggagacatccagatggcccaccagaacctgatgctggaccccatgggctccatgtctgaggtgccccccaaggtgcccaaccgggaggccagcctgtacagcccccccagcaccctgcccaggaacagccccaccaagagggtggatgtgcccaccaccccaggagtgcccatgaccagcctggagcggcagaggggctaccacaagaacagcagccagaggcacagcatcagcgccatgcccaagaacctgaacagccccaacggggtgctgctgagccggcagcccagcatgaacagaggaggctacatgcccacccccaccggggccaaggtggactacatccagggcacccctgtgtctgtgcacctgcagcccagcctgagccggcagagcagctacaccagcaatggcaccctgcccaggacaggcctgaagaggacccccagcctgaagccagatgtgccccccaagcccagctttgtgccccagaccccatctgtgcggcccctgaacaagtacacctactag

SEQ ID NO: 37914 - DNA, 3222 bp, Artificial Sequence; identical to SEQ ID NO: 37906
  Description of Artificial Sequence: Synthetic coding sequence

SEQ ID NO: 37915 - DNA, 3036 bp, Artificial Sequence; identical to SEQ ID NO: 37909
  Description of Artificial Sequence: Synthetic coding sequence

SEQ ID NO: 37916 - DNA, 3036 bp, Artificial Sequence; identical to SEQ ID NO: 37909
  Description of Artificial Sequence: Synthetic coding sequence

SEQ ID NO: 37917 - DNA, 1794 bp, Artificial Sequence; identical to SEQ ID NO: 37908
  Description of Artificial Sequence: Synthetic coding sequence

SEQ ID NO: 37918 - DNA, 69 bp, Artificial Sequence
  Description of Artificial Sequence: Synthetic coding sequence
atgagggtcttcctgctgtgtgcctacatcctgctgctgatggtgtcccagctgcgggctgtgtcctag

SEQ ID NO: 37919 - DNA, 660 bp, Artificial Sequence
  Description of Artificial Sequence: Synthetic coding sequence
atgagggtcttcctgctgtgtgcctacatcctgctgctgatggtgtcccagctgcgggctgtgtccttcccagaagatgatgagcccctgaacacagtggactaccactacagccggcagtaccctgtgttccggggccggcccagcggaaatgaaagccagcaccggctggacttccagctgatgctgaagatccgggacaccctgtacatcgccggccgggaccaggtgtacacagtgaacctgaatgagatgcccaagacagaggtgatccccaacaagaagctgacctggaggagccggcagcaggaccgggagaactgtgccatgaagggcaagcacaaggatgagtgccacaacttcatcaaggtgtttgtgcccagaaatgatgagatggtgtttgtgtgtggcaccaatgccttcaaccccatgtgccgctactaccgcctgagcaccctggagtatgatggagaggagatcagcggcctggcccgctgcccctttgatgcccggcagaccaacgtggccctgtttgctgatggcaagctgtacagcgccaccgtggccgacttcctggccagtgatgctgtgatctaccgctccatgggagatggcagcgccctgcggaccatcaagtatgacagcaagtggatcaagtag

SEQ ID NO: 37920 - DNA, 6 bp, Artificial Sequence
  Description of Artificial Sequence: Synthetic coding sequence
atgtag

SEQ ID NO: 37921 - DNA, 447 bp, Artificial Sequence
  Description of Artificial Sequence: Synthetic coding sequence
atgagggtcttcctgctgtgtgcctacatcctgctgctgatggtgtcccagctgcgggctgtgtccttcccagaagatgatgagcccctgaacacagtggactaccactacagccggcagtaccctgtgttccggggccggcccagcggaaatgaaagccagcaccggctggacttccagctgatgctgaagatccgggacaccctgtacatcgccggccgggaccaggtgtacacagtgaacctgaatgagatgcccaagacagaggtgatccccaacaagaagctgacctggaggagccggcagcaggaccgggagaactgtgccatgaagggcaagcacaaggatgagtgccacaacttcatcaaggtgtttgtgcccagaaatgatgagatggtgtttgtgtgtggcaccaatgccttcaaccccatgtgccgctactactag

SEQ ID NO: 37922 - DNA, 990 bp, Artificial Sequence
  Description of Artificial Sequence: Synthetic coding sequence
atggatggccctgtggccgagcacgccaagcaggagcccttccacgtggtgacccccctgctggagagctgggccctgagccaggtggccggcatgcctgtgttcctgaagtgtgaaaatgtgcagcccagcggcagcttcaagatccggggcatcggccacttctgccaggagatggccaagaagggctgccgccacctggtgtgcagcagcggcggcaatgccggcattgctgctgcctatgctgccaggaagctgggcatcccagccaccatcgtgctgcctgagagcaccagcctgcaggtggtgcagaggctgcagggcgagggcgctgaggtgcagctgaccgggaaggtgtgggatgaggccaacctgcgggcccaggagctggccaagagagatggctgggagaatgtgcccccatttgaccaccccctcatctggaagggccacgccagcctggtgcaggagctgaaggctgtgctgcggaccccacctggggccctggtgctggccgtgggcggcggcggcctgctggccggcgtggtggccggcctgctggaggtgggctggcagcacgtgcccatcatcgccatggagacccacggggcccactgcttcaatgctgccatcacagctgggaagctggtgaccctgcctgacatcacctctgtggccaagagcctgggcgccaagacagtggccgcccgggccctggagtgcatgcaggtgtgcaagatccacagcgaggtggtggaggacacagaagctgtgtctgctgtgcagcagctgctggatgatgagaggatgctggtggagcccgcctgtggggccgccctggccgccatctacagcggcctgctgcggcggctgcaggccgagggctgcctgccccccagcctgacctctgtggtggtgattgtgtgtggcggcaacaacatcaacagccgggagctgcaggccctgaagacccacctgggccaggtgtag

SEQ ID NO: 37923 - DNA, 990 bp, Artificial Sequence; identical to SEQ ID NO: 37922
  Description of Artificial Sequence: Synthetic coding sequence

SEQ ID NO: 37924 - DNA, 90 bp, Artificial Sequence
  Description of Artificial Sequence: Synthetic coding sequence
atggatggccctgtggccgagcacgccaagcaggagcccttccacgtggtgacccccctgctggagagctgggccctgagccaggtgtag

SEQ ID NO: 37925 - DNA, 1362 bp, Artificial Sequence
  Description of Artificial Sequence: Synthetic coding sequence
atgggctctgtgctgggcctgtgcagcatggcctcctggatcccctgcctgtgtggcagcgccccctgcctgctgtgccgctgctgccccagcggcaacaacagcacagtgaccaggctcatctatgccctcttcctgctggtgggcgtgtgtgtggcctgtgtgatgctgatccctggcatggaggagcagctgaacaagatccctggcttctgtgaaaatgagaagggcgtggtgccctgcaacatcctggtgggctacaaggctgtgtaccgcctgtgcttcggcctggccatgttctacctgctgctgagcctgctgatgatcaaggtgaagagcagcagtgaccccagggctgctgtgcacaacggcttctggttcttcaagtttgctgctgccatcgccatcatcatcggggccttcttcatccctgagggcaccttcaccaccgtgtggttctacgtgggcatggccggggccttctgcttcatcctgatccagctggtgctgctgattgactttgcccacagctggaatgaatcctgggtggagaagatggaggagggcaacagccgctgctggtacgccgccctgctgagcgccacagccctgaactacctgctgagcctggtggccatcgtgctcttctttgtgtactacacccacccagccagctgcagcgagaacaaggccttcatctctgtgaacatgctgctgtgtgtgggcgcctctgtgatgagcatcctgcccaagatccaggagagccagcccaggagcggcctgctgcagagcagcgtcatcaccgtgtacaccatgtacctgacctggagcgccatgaccaatgaacctgagaccaactgcaaccccagcctgctgagcatcatcggctacaacaccaccagcacagtgcccaaggagggccagagcgtgcagtggtggcacgcccagggcatcatcggcctcatcctcttcctgctgtgtgtgttctacagcagcatccgcaccagcaacaacagccaggtgaacaagctgaccctgaccagtgatgagagcaccctgattgaagatggaggagcccggagtgatggcagcctggaggatggagatgatgtgcacagagctgtggacaatgaaagagatggagtgacctacagctacagcttcttccacttcatgctgttcctggccagcctgtacatcatgatgaccctgaccaactggtaccgctatgagcccagccgggagatgaagagccagtggacagctgtgtgggtgaagatcagcagctcctggattggcatcgtgctgtatgtgtggaccctggtggcccccctggtgctgaccaacagagactttgattag

SEQ ID NO: 37926 - DNA, 1362 bp, Artificial Sequence; identical to SEQ ID NO: 37925
  Description of Artificial Sequence: Synthetic coding sequence

SEQ ID NO: 37927 - DNA, 1368 bp, Artificial Sequence
  Description of Artificial Sequence: Synthetic coding sequence
atgggcgcctgcctgggcgcctgcagcctgctgagctgtgccagctgcctgtgtggcagcgccccctgcatcctgtgcagctgctgcccagccagcaggaacagcacagtgtcccggctcatcttcaccttcttcctgttcctgggcgtgctggtgtccatcatcatgctgagccctggggtggagagccagctgtacaagctgccctgggtgtgtgaggagggcgccggcatccccaccgtgctgcagggccacatcgactgtggcagcctgctgggctacagagctgtgtacaggatgtgctttgccacagctgccttcttcttcttcttcaccctgctgatgctgtgtgtgagcagcagccgggacccccgggccgccatccagaatggcttctggttcttcaagttcctgatcctggtgggcctgactgtgggcgccttctacatcccagatggcagcttcaccaacatctggttctactttggagtggtgggcagcttcctgttcatcctgatccagctggtgctgctgattgactttgcccacagctggaaccagcgctggctgggcaaggccgaggagtgtgacagccgggcctggtacgccggcctcttcttcttcaccctgctcttctacctgctgagcattgctgctgtggccctgatgttcatgtactacacagagcccagcggctgccacgagggcaaggtgttcatcagcctgaacctgaccttctgtgtgtgtgtgtccattgctgctgtgctgcccaaggtgcaggatgcccagcccaacagcggcctgctgcaggccagcgtcatcaccctgtacaccatgtttgtgacctggagcgccctgagcagcatccctgagcagaagtgcaacccccacctgcccacccagctgggcaatgagaccgtggtggccggccctgagggctatgagacccagtggtgggatgcccccagcatcgtgggcctcatcatcttcctgctgtgcaccctcttcatcagcctgcggagcagtgaccaccggcaggtgaacagcctgatgcagacagaagaatgtcctcccatgctggatgccacccagcagcagcagcaggtggccgcctgtgagggccgggcctttgacaatgagcaggatggagtgacctacagctacagcttcttccacttctgcctggtgctggccagcctgcacgtgatgatgaccctgaccaactggtacaagccaggagagaccaggaagatgatcagcacctggacagctgtgtgggtgaagatctgtgcctcctgggccggcctgctgctgtacctgtggaccctggtggcccccctgctgctgaggaacagagacttctcctag

SEQ ID NO: 37928 - DNA, 1395 bp, Artificial Sequence
  Description of Artificial Sequence: Synthetic coding sequence
atggatggccgcatgatgaggtccatgaggctgcgggaggaggagagccctggccccagccacacagccagctgcctgtgtggcagcgccccctgcatcctgtgcagctgctgcccagccagcaggaacagcacagtgagccgcctcatcttcaccttcttcctgttcctgggcgtgctggtgtccatcatcatgctgagccctggggtggagagccagctgtacaagctgccctgggtgtgtgaggagggcgccggcatccccaccgtgctgcagggccacatcgactgtggcagcctgctgggctacagagctgtgtacaggatgtgctttgccacagctgccttcttcttcttcttcaccctgctgatgctgtgtgtgagcagcagccgggaccccagggctgccatccagaatggcttctggttcttcaagttcctgatcctggtgggcctgactgtgggcgccttctacatcccagatggcagcttcaccaacatctggttctactttggagtggtgggcagcttcctgttcatcctgatccagctggtgctgctgattgactttgcccacagctggaaccagcgctggctgggcaaggccgaggagtgtgacagccgggcctggtacgccggcctcttcttcttcaccctgctcttctacctgctgagcattgctgctgtggccctgatgttcatgtactacacagagcccagcggctgccacgagggcaaggtgttcatcagcctgaacctgaccttctgtgtgtgtgtgtccattgctgctgtgctgcccaaggtgcaggatgcccagcccaacagcggcctgctgcaggccagcgtcatcaccctgtacaccatgtttgtgacctggagcgccctgagcagcatccctgagcagaagtgcaacccccacctgcccacccagctgggcaatgaaacagtggtggccggccctgagggctatgagacccagtggtgggatgcccccagcatcgtgggcctcatcatcttcctgctgtgcaccctcttcatcagcctgcggagcagtgaccaccggcaggtgaacagcctgatgcagacagaggagtgcccccccatgctggatgccacccagcagcagcagcaggtggccgcctgtgagggccgggcctttgacaatgagcaggatggagtgacctacagctacagcttcttccacttctgcctggtgctggccagcctgcacgtgatgatgaccctgaccaactggtacaagccaggagagaccaggaagatgatcagcacctggacagctgtgtgggtgaagatctgtgcctcctgggccggcctgctgctgtacctgtggaccctggtggcccccctgctgctgaggaacagagacttctcctag

SEQ ID NO: 37929 - DNA, 1380 bp, Artificial Sequence
  Description of Artificial Sequence: Synthetic coding sequence
atgggcgctgagggcgccccagacttcctgagctgcccccgggtgcggcgggccagctgcctgtgtggcagcgccccctgcatcctgtgcagctgctgcccagccagcaggaacagcacagtgtcccggctcatcttcaccttcttcctgttcctgggcgtgctggtgtccatcatcatgctgagccctggggtggagagccagctgtacaagctgccctgggtgtgtgaggagggcgccggcatccccaccgtgctgcagggccacatcgactgtggcagcctgctgggctacagagctgtgtacaggatgtgctttgccacagctgccttcttcttcttcttcaccctgctgatgctgtgtgtgagcagcagccgggacccccgggccgccatccagaatggcttctggttcttcaagttcctgatcctggtgggcctgactgtgggcgccttctacatcccagatggcagcttcaccaacatctggttctactttggagtggtgggcagcttcctgttcatcctgatccagctggtgctgctgattgactttgcccacagctggaaccagcgctggctgggcaaggccgaggagtgtgacagccgggcctggtacgccggcctcttcttcttcaccctgctcttctacctgctgagcattgctgctgtggccctgatgttcatgtactacacagagcccagcggctgccacgagggcaaggtgttcatcagcctgaacctgaccttctgtgtgtgtgtgtccattgctgctgtgctgcccaaggtgcaggatgcccagcccaacagcggcctgctgcaggccagcgtcatcaccctgtacaccatgtttgtgacctggagcgccctgagcagcatccctgagcagaagtgcaacccccacctgcccacccagctgggcaatgagaccgtggtggccggccctgagggctatgagacccagtggtgggatgcccccagcatcgtgggcctcatcatcttcctgctgtgcaccctcttcatcagcctgcggagcagtgaccaccggcaggtgaacagcctgatgcagacagaagaatgtcctcccatgctggatgccacccagcagcagcagcaggtggccgcctgtgagggccgggcctttgacaatgagcaggatggagtgacctacagctacagcttcttccacttctgcctggtgctggccagcctgcacgtgatgatgaccctgaccaactggtacaagccaggagagaccaggaagatgatcagcacctggacagctgtgtgggtgaagatctgtgcctcctgggccggcctgctgctgtacctgtggaccctggtggcccccctgctgctgaggaacagagacttctcctag

SEQ ID NO: 37930 - DNA, 1380 bp, Artificial Sequence
  Description of Artificial Sequence: Synthetic coding sequence
atgaggtccatgaggctgcgggaggaggagagccctggccccagccacacagccagctgcctgtgtggcagcgccccctgcatcctgtgcagctgctgcccagccagcaggaacagcacagtgtcccggctcatcttcaccttcttcctgttcctgggcgtgctggtgtccatcatcatgctgagccctggggtggagagccagctgtacaagctgccctgggtgtgtgaggagggcgccggcatccccaccgtgctgcagggccacatcgactgtggcagcctgctgggctacagagctgtgtacaggatgtgctttgccacagctgccttcttcttcttcttcaccctgctgatgctgtgtgtgagcagcagccgggacccccgggccgccatccagaatggcttctggttcttcaagttcctgatcctggtgggcctgactgtgggcgccttctacatcccagatggcagcttcaccaacatctggttctactttggagtggtgggcagcttcctgttcatcctgatccagctggtgctgctgattgactttgcccacagctggaaccagcgctggctgggcaaggccgaggagtgtgacagccgggcctggtacgccggcctcttcttcttcaccctgctcttctacctgctgagcattgctgctgtggccctgatgttcatgtactacacagagcccagcggctgccacgagggcaaggtgttcatcagcctgaacctgaccttctgtgtgtgtgtgtccattgctgctgtgctgcccaaggtgcaggatgcccagcccaacagcggcctgctgcaggccagcgtcatcaccctgtacaccatgtttgtgacctggagcgccctgagcagcatccctgagcagaagtgcaacccccacctgcccacccagctgggcaatgagaccgtggtggccggccctgagggctatgagacccagtggtgggatgcccccagcatcgtgggcctcatcatcttcctgctgtgcaccctcttcatcagcctgcggagcagtgaccaccggcaggtgaacagcctgatgcagacagaagaatgtcctcccatgctggatgccacccagcagcagcagcaggtggccgcctgtgagggccgggcctttgacaatgagcaggatggagtgacctacagctacagcttcttccacttctgcctggtgctggccagcctgcacgtgatgatgaccctgaccaactggtacaagccaggagagaccaggaagatgatcagcacctggacagctgtgtgggtgaagatctgtgcctcctgggccggcctgctgctgtacctgtggaccctggtggcccccctgctgctgaggaacagagacttctcctag

SEQ ID NO: 37931 - DNA, 825 bp, Artificial Sequence
  Description of Artificial Sequence: Synthetic coding sequence
atgagcatcagcagccagcacggcatcaccctggcctctgtggaggccctgcacagcagctactgctcctggtgcctgctgcagctgctgcccatccctggcaccaggacagagcagcccaggagcggcctgctgcaggccagcgtcatcagctgctacatcatgtacctgaccttcagcgccctgagcagccggcccccagagagggtcatcctgcagggccagaaccacaccctgtgcctgcccggcctgagcaagatggagccccagaccccagacatcagcctggccatgctgagcgccagcatcatgtatgcctgtgtgctgtttgcctgcaatgaggccagctacctggccgaggtgtttggccccctgtggatcgtgaaggtgtacagctatgagttccagaagcccagcctgtgcttctgctgcccagagaccgtggaggccgacaagggccagaggggcggggccgcccggcctgctgaccaggagaccccaccagcccctcctgtgcaggtgcagcacctgagctacaactacagcgccttccactttgtgttcttcctggccagcctgtatgtgatggtgaccctgaccaactggttctcctatgaaggagctgagctggagaagaccttcatcaagggctcctgggccaccttctgggtgaaggtggccagctgctgggcctgtgtgctgctgtacctgggcctgctgctggcccccctgtgctggccacccacccagaagccccagcccctcatcctgcggcggcggcggcaccgcatcatcagcccagacaacaagtacccacctgtgtag

SEQ ID NO: 37932 - DNA, 1557 bp, Artificial Sequence
  Description of Artificial Sequence: Synthetic coding sequence
atggtgggcgccaaggccggccccagccctggcaccagcctgggcctggcccagcagcacagcggcggcagctctgtgctggtgaagagccccttctgccaggtgtgctgctgcggccctgccccctgtgccagctgctgccacagccgctggcccagcctgacagccagcacctgcagccgcctcttctacatcctgctgcacgtgggcgccagcgccatctgctgcctgctgctgagcaggacagtggtggagcgggtgtggggcaagacccaccgcatccagatgcccagcggcctgtgtgcccacctgtttggcctgagtgactgccctgtgctgagcggcagcggggctgtgtacagagtgtgtgccggcacagccaccttccacctgctgcaggccgtgctgctggtgcacctgcacagccccaccagcccccgggcccagctgcacaacagcttctggctgctgaagctgctcttcctgctgggcctgtgtgccatcgccttctgcatcccagatgagcacctgtttcctgcctggcactacatcggcatctgtggcggctttgccttcatcctgctgcagctggtgctgatcacagcctttgcccacagctggaacaagaactggcagacaggagctgcccaggactgctcctggttcctggccgtgctgctggccaccctgggcttctacagcatggccggcgtgggcgctgtgctgctcttccactactacacccaccctgctggctgcctgctgaacaagatgctgctgagcctgcacctgtgcttctgtggcctcatctccttcctgagcatcgccccctgcatccggctgaagcagcccaggagcggcctgctgcaggccagcgtcatcagctgctacatcatgtacctgaccttcagcgccctgagcagccggcccccagagagggtcatcctgcagggccagaaccacaccctgtgcctgcccggcctgagcaagatggagccccagaccccagacatcagcctggccatgctgagcgccagcatcatgtatgcctgtgtgctgtttgcctgcaatgaggccagctacctggccgaggtgtttggccccctgtggatcgtgaaggtgtacagctatgagttccagaagcccagcctgtgcttctgctgcccagagaccgtggaggccgacaagggccagaggggcggggccgcccggcctgctgaccaggagaccccaccagcccctcctgtgcaggtgcagcacctgagctacaactacagcgccttccactttgtgttcttcctggccagcctgtatgtgatggtgaccctgaccaactggttctcctatgaaggagctgagctggagaagaccttcatcaagggctcctgggccaccttctgggtgaaggtggccagctgctgggcctgtgtgctgctgtacctgggcctgctgctggcccccctgtgctggccacccacccagaagccccagcccctcatcctgcggcggcggcggcaccgcatcatcagcccagacaacaagtacccacctgtgtag

SEQ ID NO: 37933 - DNA, 291 bp, Artificial Sequence
  Description of Artificial Sequence: Synthetic coding sequence
atggtgggcgccaaggccggccccagccctggcaccagcctgggcctggcccagcagcacagcggcggcagctctgtgctggtgaagagccccttctgccagcaggtgtccaccagcctgccctgcatctgcagcaccccccgctgtgccgctgtgggcctgctgctggtgcctgctgctgccaccctgggcggccccctgagcccccaccccctggccgccgcctgcagcaccagcagctccatgtggggcccccagcagagcgctgccagctgctgccagggccagtag

SEQ ID NO: 37934 - DNA, 1269 bp, Artificial Sequence
  Description of Artificial Sequence: Synthetic coding sequence
actggcagctgctgcgtggaccagctggcctgctgctgcggcagcgctggctgcagcctgtgctgtgactgctgcccccgcatccggcagagcctgagcacccgcttcatgtatgccctgtacttcatcctggtggtggtgctgtgctgcatcatgatgagcaccaccgtggcccacaagatgaaggagcacatccccttctttgaggacatgtgcaagggcatcaaggccggggacacctgtgagaagctggtgggctacagcgctgtgtacagagtgtgcttcggcatggcctgcttcttcttcatcttctgcctgctgaccctgaagatcaacaacagcaagagctgccgggcccacatccacaacggcttctggttcttcaagctgctgctgctgggcgccatgtgcagcggggccttcttcatcccagaccaggacaccttcctgaatgcctggaggtatgtgggcgctgtgggcggcttcctgttcatcggcatccagctgctgctgctggtggagtttgcccacaagtggaacaagaactggacagctggaacagccagcaacaagctgtggtacgccagcctggccctggtgaccctcatcatgtacagcatcgccactggaggcctggtgctgatggctgtgttctacacccagaaggacagctgcatggagaacaagatcctgctgggcgtgaatggaggcctgtgcctgctgatcagcctggtggccatcagcccctgggtgcagaaccggcagccccacagcggcctgctgcagagcggggtcatcagctgctacgtgacctacctgaccttcagcgccctgagcagcaagccagctgaggtggtgctggatgagcacggcaagaatgtgaccatctgtgtgcctgactttggccaggacctgtacagagatgagaacctggtgaccatcctgggcaccagcctgctgattggctgcatcctgtacagctgcctgaccagcaccaccaggagcagcagtgatgccctgcagggccgctatgctgcccctgagctggagatcgcccgctgctgcttctgcttcagccctggaggagaggacacagaggagcagcagcccgggaaggagggccccagggtcatctatgatgagaagaagggcaccgtgtacatctacagctacttccactttgtgttcttcctggccagcctgtatgtgatgatgacagtgaccaactggttcaaccacgtgcgcagcgccttccacctgctgccctag

SEQ ID NO: 37935 - DNA, 1272 bp, Artificial Sequence
  Description of Artificial Sequence: Synthetic coding sequence
atgtctgcccagtgctgtgccggccagctggcctgctgctgcggcagcgctggctgcagcctgtgctgtgactgctgcccccgcatccggcagagcctgagcacccgcttcatgtatgccctgtacttcatcctggtggtggtgctgtgctgcatcatgatgagcaccaccgtggcccacaagatgaaggagcacatccccttctttgaggacatgtgcaagggcatcaaggccggggacacctgtgagaagctggtgggctacagcgctgtgtacagagtgtgcttcggcatggcctgcttcttcttcatcttctgcctgctgaccctgaagatcaacaacagcaagagctgccgggcccacatccacaacggcttctggttcttcaagctgctgctgctgggcgccatgtgcagcggggccttcttcatcccagaccaggacaccttcctgaatgcctggaggtatgtgggcgctgtgggcggcttcctgttcatcggcatccagctgctgctgctggtggagtttgcccacaagtggaacaagaactggacagctggaacagccagcaacaagctgtggtacgccagcctggccctggtgaccctcatcatgtacagcatcgccaccggcggcctggtgctgatggctgtgttctacacccagaaggacagctgcatggagaacaagatcctgctgggcgtgaatggaggcctgtgcctgctgatcagcctggtggccatcagcccctgggtgcagaaccggcagccccacagcggcctgctgcagagcggggtcatcagctgctacgtgacctacctgaccttcagcgccctgagcagcaagccagctgaggtggtgctggatgaacatggcaagaatgtgaccatctgtgtgcctgactttggccaggacctgtacagagatgagaacctggtgaccatcctgggcaccagcctgctgattggctgcatcctgtacagctgcctgaccagcaccaccaggagcagcagtgatgccctgcagggccgctatgctgcccctgagctggagatcgcccgctgctgcttctgcttcagccctggaggagaggacacagaggagcagcagcccgggaaggagggccccagggtcatctatgatgagaagaagggcaccgtgtacatctacagctacttccactttgtgttcttcctggccagcctgtatgtgatgatgacagtgaccaactggttcaaccacgtgcgcagcgccttccacctgctgccctag

SEQ ID NO: 37936 - DNA, 1371 bp, Artificial Sequence
  Description of Artificial Sequence: Synthetic coding sequence
atgtctgcccagtgctgtgccggccagctggcctgctgctgcggcagcgctggctgcagcctgtgctgtgactgctgcccccgcatccggcagagcctgagcacccgcttcatgtatgccctgtacttcatcctggtggtggtgctgtgctgcatcatgatgagcaccaccgtggcccacaagatgaaggagcacatccccttctttgaggacatgtgcaagggcatcaaggccggggacacctgtgagaagctggtgggctacagcgctgtgtacagagtgtgcttcggcatggcctgcttcttcttcatcttctgcctgctgaccctgaagatcaacaacagcaagagctgccgggcccacatccacaacggcttctggttcttcaagctgctgctgctgggcgccatgtgcagcggggccttcttcatcccagaccaggacaccttcctgaatgcctggaggtatgtgggcgctgtgggcggcttcctgttcatcggcatccagctgctgctgctggtggagtttgcccacaagtggaacaagaactggacagctggaacagccagcaacaagctgtggtacgccagcctggccctggtgaccctcatcatgtacagcatcgccaccggcggcctggtgctgatggctgtgttctacacccagaaggacagctgcatggagaacaagatcctgctgggcgtgaatggaggcctgtgcctgctgatcagcctggtggccatcagcccctgggtgcagaaccggcagccccacagcggcctgctgcagagcggggtcatcagctgctacgtgacctacctgaccttcagcgccctgagcagcaagccagctgaggtggatgaacatggcaagaatgtgaccatctgtgtgcctgactttggccaggacctgtacagagatgagaacctggtgaccatcctgggcaccagcctgctgattggctgcatcctgtacagctgcctgaccagcaccaccaggagcagcagtgatgccctgcagggccgctatgctgcccctgagctggagatcgcccgctgctgcttctgcttcagccctggaggagaggacacagaggagcagcagcccgggaaggagggccccagggtcatctatgatgagaagaagggcaccgtgtacatctacagctacttccactttgtgttcttcctggccagcctgtatgtgatgatgacagtgaccaactggttcaagtggagccccaccctgctgccccggctggagtacagcggcatgatcctggcccactgcaacctgcacctgcctgatgtgaagcgcttcagctgcctgagcctgcccagctcctggggctacagacatgtgcccccatag

SEQ ID NO: 37937 - DNA, 1386 bp, Artificial Sequence
  Description of Artificial Sequence: Synthetic coding sequence
atgtctgcccagtgctgtgccggccagctggcctgctgctgcggcagcgctggctgcagcctgtgctgtgactgctgcccccgcatccggcagagcctgagcacccgcttcatgtatgccctgtacttcatcctggtggtggtgctgtgctgcatcatgatgagcaccaccgtggcccacaagatgaaggagcacatccccttctttgaggacatgtgcaagggcatcaaggccggggacacctgtgagaagctggtgggctacagcgctgtgtacagagtgtgcttcggcatggcctgcttcttcttcatcttctgcctgctgaccctgaagatcaacaacagcaagagctgccgggcccacatccacaacggcttctggttcttcaagctgctgctgctgggcgccatgtgcagcggggccttcttcatcccagaccaggacaccttcctgaatgcctggaggtatgtgggcgctgtgggcggcttcctgttcatcggcatccagctgctgctgctggtggagtttgcccacaagtggaacaagaactggacagctggaacagccagcaacaagctgtggtacgccagcctggccctggtgaccctcatcatgtacagcatcgccaccggcggcctggtgctgatggctgtgttctacacccagaaggacagctgcatggagaacaagatcctgctgggcgtgaatggaggcctgtgcctgctgatcagcctggtggccatcagcccctgggtgcagaaccggcagccccacagcggcctgctgcagagcggggtcatcagctgctacgtgacctacctgaccttcagcgccctgagcagcaagccagctgaggtggtgctggatgaacatggcaagaatgtgaccatctgtgtgcctgactttggccaggacctgtacagagatgagaacctggtgaccatcctgggcaccagcctgctgattggctgcatcctgtacagctgcctgaccagcaccaccaggagcagcagtgatgccctgcagggccgctatgctgcccctgagctggagatcgcccgctgctgcttctgcttcagccctggaggagaggacacagaggagcagcagcccgggaaggagggccccagggtcatctatgatgagaagaagggcaccgtgtacatctacagctacttccactttgtgttcttcctggccagcctgtatgtgatgatgacagtgaccaactggttcaactatgagagcgccaacatcgagagcttcttcagcggctcctggagcatcttctgggtgaagatggccagctgctggatctgtgtgctgctgtacctgtgcaccctggtggcccccctgtgctgccccacccgggagttctctgtgtag

SEQ ID NO: 37938 - DNA, 216 bp, Artificial Sequence
  Description of Artificial Sequence: Synthetic coding sequence
atggccggcatggccctggcccgggcctggaagcagatgtcctggttctactaccagtacctgctggtgacagccctgtacatgctggagccctgggagaggacagtgttcaacagcatgctggtgtccatcgtgggcatggccctgtacacaggctacgtgttcatgccccagcacatcatggccatcctgcactactttgaaattgtgcagtag

SEQ ID NO: 37939 - DNA, 231 bp, Artificial Sequence
  Description of Artificial Sequence: Synthetic coding sequence
atggacctgcggcgggtgaaggagtacttctcctggctgtactaccagtaccagatcatcagctgctgtgctgtgctggagccctgggagaggtccatgttcaacaccatcctgctgaccatcatcgccatggtggtgtacacagcctacgtgttcatccccatccacatccggctggcctgggagttcttcagcaagatctgtggctaccacagcaccatcagcaactag

SEQ ID NO: 37940 - DNA, 231 bp, Artificial Sequence; identical to SEQ ID NO: 37939
  Description of Artificial Sequence: Synthetic coding sequence

SEQ ID NO: 37941 - DNA, 918 bp, Artificial Sequence
  Description of Artificial Sequence: Synthetic coding sequence
atgggccacgccctgtgtgtgtgcagccggggcaccgtcatcatcgacaacaagcgctacctgttcatccagaagctgggggagggcggcttctcctatgtggacctggtggagggcctgcatgatggccacttctacgccctgaagaggatcctgtgccacgagcagcaggaccgggaggaggcccagcgggaggccgacatgcacaggctcttcaaccaccccaacatcctgcggctggtggcctactgcctgcgggagcggggggccaagcatgaggcctggctgctgctgcccttcttcaagaggggcaccctgtggaatgaaattgaaaggctgaaggacaagggcaacttcctgacagaggaccagatcctgtggctgctgctgggcatctgccggggcctggaggccatccacgccaagggctacgcccaccgggacctgaagcccaccaacatcctgctgggagatgagggccagcctgtgctgatggacctgggctccatgaaccaggcctgcatccacgtggagggcagccggcaggccctgaccctgcaggactgggccgcccagcgctgcaccatctcctaccgggcccctgagctgttctctgtgcagagccactgtgtgattgatgagaggacagatgtgtggagcctgggctgtgtgctgtatgccatgatgtttggagagggcccctatgacatggtgttccagaagggggacagcgtggccctggccgtgcagaaccagctgagcatcccccagagccccaggcacagcagcgccctgcggcagctgctgaacagcatgatgacagtggacccccaccagaggccccacatccccctgctgctgagccagctggaggccctgcagcccccagcccctggccagcacaccacccagatctag

SEQ ID NO: 37942 - DNA, 918 bp, Artificial Sequence; identical to SEQ ID NO: 37941
  Description of Artificial Sequence: Synthetic coding sequence

SEQ ID NO: 37943 - DNA, 1269 bp, Artificial Sequence
  Description of Artificial Sequence: Synthetic coding sequence
atgggcatgaccaggatgctgctggagtgcagcctgagtgacaagctgtgtgtgatccaggagaagcagtatgaggtgatcatcgtgcccaccctgctggtgaccatcttcctgatcctgctgggcgtcatcctgtggctgttcatccgggagcagaggacccagcagcagaggagcggcccccagggcatcgcccctgtgcccccaccccgggacctgtcctgggaggccggccatggaggaaatgtggccctgcccctgaaggagacctctgtggagaacttcctgggcgccaccaccccagccctggccaagctgcaggtgccccgggagcagctgtctgaggtgctggagcagatctgcagcggcagctgtggccccatcttccgggccaacatgaacacaggagaccccagcaagcccaagagcgtcatcctgaaggccctgaaggagcctgctggcctgcacgaggtgcaggacttcctgggccgcatccagttccaccagtacctgggcaagcacaagaacctggtgcagctggagggctgctgcacagagaagctgcccctgtacatggtgctggaggatgtggcccagggcgacctgctgtccttcctgtggacctgcagaagagatgtgatgaccatggatggcctgctgtatgacctgacagagaagcaggtgtaccacatcggcaagcaggtgctgctggccctggagttcctgcaggagaagcacctgttccatggagatgtggccgccaggaacatcctgatgcagagcgacctgacagccaagctgtgtggcctgggcctggcctatgaggtgtacaccaggggggccatcagcagcacccagaccatccccctgaagtggctggcccctgagcggctgctgctgcggcctgccagcatccgggcagatgtgtggagctttggcatcctgctgtatgagatggtgaccctgggcgccccaccctacccagaggtgccccccaccagcatcctggagcacctgcagaggaggaagatcatgaagaggcccagcagctgcacccacaccatgtacagcatcatgaagagctgctggcgctggagggaggccgaccggcccagcccccgggagctgcggctgcggctggaggccgccatcaagacagcagatgatgaagctgtgctgcaggtgcctgagctggtggtgcctgagctgtatgctgctgtggccggcatccgggtggagagcctcttctacaactacagcatgctgtag

SEQ ID NO: 37944 - DNA, 198 bp, Artificial Sequence
  Description of Artificial Sequence: Synthetic coding sequence
atgggcatgaccaggatgctgctggagtgcagcctgagtgacaagctgtgtgtgatccaggagaagcagtatgaggtgatcatcgtgcccaccctgctggtgaccatcttcctgatcctgctgggcgtcatcctgtggctgttcatccgggagcagaggacccagcagcagaggagcggcccccagggcaaggcctag

SEQ ID NO: 37945 - DNA, 252 bp, Artificial Sequence
  Description of Artificial Sequence: Synthetic coding sequence
atgggcatgaccaggatgctgctggagtgcagcctgagtgacaagctgtgtgtgatccaggagaagcagtatgaggtgatcatcgtgcccaccctgctggtgaccatcttcctgatcctgctgggcgtcatcctgtggctgttcatccgggagcagaggacccagcagcagaggagcggcccccagggcatcgcccctgtgcccccaccccgggacctgtcctgggaggccggccatggaggaaatgtgtag

SEQ ID NO: 37946 - DNA, 126 bp, Artificial Sequence
  Description of Artificial Sequence: Synthetic coding sequence
atgggcatgaccaggatgctgctggagtgcagcctgagtgacaagctgtgtgtgatccaggagaagcagtatgaggtgatcatcgtgcccaccctgctggtgaccatcttcctgatcctgctgtag

SEQ ID NO: 37947 - DNA, 264 bp, Artificial Sequence
  Description of Artificial Sequence: Synthetic coding sequence
atgggcatgaccaggatgctgctggagtgcagcctgagtgacaagctgtgtgtgatccaggagaagcagtatgaggtgatcatcgtgcccaccctgctggtgaccatcttcctgatcctgctgggcgtcatcctgtggctgttcatccgggagcagaggacccagcagcagaggagcggcccccagggcatcgcccctgtgcccccaccccgggacctgtcctgggaggccggccatggaggaaatgtggccctgcccctgtag

SEQ ID NO: 37948 - DNA, 324 bp, Artificial Sequence
  Description of Artificial Sequence: Synthetic coding sequence
atgtctgagccagacaccagcagcggcttcagcggctctgtggagaatggcaccttcctggagctgttccccaccagcctgagcacctctgtggaccccagcagcggccacctgagcaatgtgtacatctacgtgtccatcttcctgagcctgctggccttcctgctgctgctgctgatcatcgccctgcagaggctgaagaacatcatcagcagcagcagcagctacccagagtaccccagtgatgctggcagcagcttcaccaacctggaggtgtgcagcatcagcagccagaggagcaccttcagcaacctgagcagctag

SEQ ID NO: 37949 - DNA, 1182 bp, Artificial Sequence
  Description of Artificial Sequence: Synthetic coding sequence
atgcctggccacctgcaggagggcttcggctgtgtggtgaccaacagatttgaccagctgtttgatgatgaaagtgacccctttgaggtgctgaaggctgctgagaacaagaagaaggaggccggcggcggcggcgtgggcggccctggggccaagtctgctgcccaggccgccgcccagaccaacagcaatgctgctgggaagcagctgaggaaggagagccagaaggacaggaagaaccccctgcccccatctgtgggcgtggtggacaagaaggaggagacccagccccctgtggccctgaagaaggagggcatcagaagagtgggcagaagaccagaccagcagctgcagggcgagggcaagatcatcgaccggcggcctgagcggcggcccccccgggagaggagatttgagaagcccctggaggagaagggggagggcggggagttctctgtggaccggcccatcatcgaccggcccatccggggccggggcggcctgggccggggccggggcggccggggccggggcatgggcagaggagatggctttgacagccggggcaagcgggagtttgacagacattctggcagtgacaggagcagcttcagccactacagcggcctgaagcatgaggacaagagaggaggcagcggcagccacaactggggcaccgtgaaggatgagctgacagacctggaccagagcaatgtgacagaggagaccccagagggggaggagcaccaccctgtggccgacacagagaacaaggaaaatgaggtggaggaggtgaaggaggagggccccaaggagatgaccctggatgagtggaaggccatccagaacaaggaccgggccaaggtggagttcaacatcaggaagcccaatgaaggagcagatggccagtggaagaagggctttgtgctgcacaagagcaagtctgaggaggcccacgcagaagattctgtgatggaccaccacttcaggaagccagccaatgacatcaccagccagctggagatcaactttggagacctgggccggcccggccggggcggccggggcggccggggcggccggggccggggcggccggcccaacagaggcagcaggacagacaagagcagcgccagcgccccagatgtggatgatcctgaggccttccctgccctggcctag

SEQ ID NO: 37950 - DNA, 1209 bp, Artificial Sequence
  Description of Artificial Sequence: Synthetic coding sequence
atgcctggccacctgcaggagggcttcggctgtgtggtgaccaacagatttgaccagctgtttgatgatgaaagtgacccctttgaggtgctgaaggctgctgagaacaagaagaaggaggccggcggcggcggcgtgggcggccctggggccaagtctgctgcccaggccgccgcccagaccaacagcaatgctgctgggaagcagctgaggaaggagagccagaaggacaggaagaaccccctgcccccatctgtgggcgtggtggacaagaaggaggagacccagccccctgtggccctgaagaaggagggcatcagaagagtgggcagaagaccagaccagcagctgcagggcgagggcaagatcatcgaccggcggcctgagcggcggcccccccgggagaggagatttgagaagcccctggaggagaagggggagggcggggagttctctgtggaccggcccatcatcgaccggcccatccggggccggggcggcctgggccggggccggggcggccggggccggggcatgggcagaggagatggctttgacagccggggcaagcgggagtttgacagacattctggcagtgacaggagcggcctgaagcatgaggacaagagaggaggcagcggcagccacaactggggcaccgtgaaggatgagctgacagagagccccaagtacatccagaagcagatctcctacaactacagcgacctggaccagagcaatgtgacagaggagaccccagagggggaggagcaccaccctgtggccgacacagagaacaaggaaaatgaggtggaggaggtgaaggaggagggccccaaggagatgaccctggatgagtggaaggccatccagaacaaggaccgggccaaggtggagttcaacatcaggaagcccaatgaaggagcagatggccagtggaagaagggctttgtgctgcacaagagcaagtctgaggaggcccatgctgaggacagcgtgatggaccaccacttcaggaagccagccaatgacatcaccagccagctggagatcaactttggagacctgggccggcccggccggggcggccggggcggccggggcggccggggccggggcggccggcccaacagaggcagcaggacagacaagagcagcgccagcgccccagatgtggatgatcctgaggccttccctgccctggcctag

SEQ ID NO: 37951 - DNA, 1164 bp, Artificial Sequence
  Description of Artificial Sequence: Synthetic coding sequence
atgcctggccacctgcaggagggcttcggctgtgtggtgaccaacagatttgaccagctgtttgatgatgaaagtgacccctttgaggtgctgaaggctgctgagaacaagaagaaggaggccggcggcggcggcgtgggcggccctggggccaagtctgctgcccaggccgccgcccagaccaacagcaatgctgctgggaagcagctgaggaaggagagccagaaggacaggaagaaccccctgcccccatctgtgggcgtggtggacaagaaggaggagacccagccccctgtggccctgaagaaggagggcatcagaagagtgggcagaagaccagaccagcagctgcagggcgagggcaagatcatcgaccggcggcctgagcggcggcccccccgggagaggagatttgagaagcccctggaggagaagggggagggcggggagttctctgtggaccggcccatcatcgaccggcccatccggggccggggcggcctgggccggggccggggcggccggggccggggcatgggcagaggagatggctttgacagccggggcaagcgggagtttgacagacattctggcagtgacaggagcggcctgaagcatgaggacaagagaggaggcagcggcagccacaactggggcaccgtgaaggatgagctgacagacctggaccagagcaatgtgacagaggagaccccagagggggaggagcaccaccctgtggccgacacagagaacaaggaaaatgaggtggaggaggtgaaggaggagggccccaaggagatgaccctggatgagtggaaggccatccagaacaaggaccgggccaaggtggagttcaacatcaggaagcccaatgaaggagcagatggccagtggaagaagggctttgtgctgcacaagagcaagtctgaggaggcccacgcagaagattctgtgatggaccaccacttcaggaagccagccaatgacatcaccagccagctggagatcaactttggagacctgggccggcccggccggggcggccggggcggccggggcggccggggccggggcggccggcccaacagaggcagcaggacagacaagagcagcgccagcgccccagatgtggatgatcctgaggccttccctgccctggcctag

SEQ ID NO: 37952 - DNA, 1227 bp, Artificial Sequence
  Description of Artificial Sequence: Synthetic coding sequence
atgcctggccacctgcaggagggcttcggctgtgtggtgaccaacagatttgaccagctgtttgatgatgaaagtgacccctttgaggtgctgaaggctgctgagaacaagaagaaggaggccggcggcggcggcgtgggcggccctggggccaagtctgctgcccaggccgccgcccagaccaacagcaatgctgctgggaagcagctgaggaaggagagccagaaggacaggaagaaccccctgcccccatctgtgggcgtggtggacaagaaggaggagacccagccccctgtggccctgaagaaggagggcatcagaagagtgggcagaagaccagaccagcagctgcagggcgagggcaagatcatcgaccggcggcctgagcggcggcccccccgggagaggagatttgagaagcccctggaggagaagggggagggcggggagttctctgtggaccggcccatcatcgaccggcccatccggggccggggcggcctgggccggggccggggcggccggggccggggcatgggcagaggagatggctttgacagccggggcaagcgggagtttgacagacattctggcagtgacaggagcagcttcagccactacagcggcctgaagcatgaggacaagagaggaggcagcggcagccacaactggggcaccgtgaaggatgagctgacagagagccccaagtacatccagaagcagatctcctacaactacagcgacctggaccagagcaatgtgacagaggagaccccagagggggaggagcaccaccctgtggccgacacagagaacaaggaaaatgaggtggaggaggtgaaggaggagggccccaaggagatgaccctggatgagtggaaggccatccagaacaaggaccgggccaaggtggagttcaacatcaggaagcccaatgaaggagcagatggccagtggaagaagggctttgtgctgcacaagagcaagtctgaggaggcccatgctgaggacagcgtgatggaccaccacttcaggaagccagccaatgacatcaccagccagctggagatcaactttggagacctgggccggcccggccggggcggccggggcggccggggcggccggggccggggcggccggcccaacagaggcagcaggacagacaagagcagcgccagcgccccagatgtggatgatcctgaggccttccctgccctggcctag

SEQ ID NO: 37953 - DNA, 813 bp, Artificial Sequence
  Description of Artificial Sequence: Synthetic coding sequence
atgttcttcagcctgcaccgggagacccccaaggagggcatgtttggagccaacctgaccaccttccaccccaccctcttcatcctgctgggcatccctggcctggagcagtaccacatctggctgagcatccccttctacctgatgtacatcacagctgtgctgggcaatggagccctgatcctggtggtgctgtctgagcacaccctgcacgtgttcctgtccatgctggccggcacagacatcctgctgagcaccaccaccgtgcccaaggccctggccatcttctgggtgcacgccggggagatcgcctttgatgcctgcatcacccagatgttcttcatccacgtggcctttgtggccgagagcggcatcctgctggccatggcctttgacagctatgtggccatctgcacccccctgcgctacaccaccatcctgacctccatggtgaatggcaagatgaccctgaccatctggggccagagcatcggcaccatcttccctgtgatcttcctgctgaagaggctgccctactgccagaccaacatcatcccccacagctactgtgagcacatcggcgtggcccagctggcctgtgccgacatcaccgtgaacatctggtacggcttctctgtgcccatggcctctgtgctggtggatgtggccttcatcggcttctcctacaccctcatcctgcaggccgtgttccggctgcccagccaggagagccagcacaaggccctgaacacctgtggcagcaccctggagctgttcagcagcagcagcagccaccacttcctgctgtcctag

SEQ ID NO: 37954 - DNA, 678 bp, Artificial Sequence
  Description of Artificial Sequence: Synthetic coding sequence
atgtttgctggcatggacaccttcctgctggccgtgattgcctatgacagatttgtggccatctgccaccccctgcagtacatggtgatcatcaacccccacctgtgtggcctgctggtgctggcctcctggttcatcatcttctggttcagcctggtgcacatcctgctgatgaagaggctgaccttcagcactggaacagagatcccccacttcttctgtgagctggcccaggtgctgaaggtggcccggagtgatgccctgctgatcaacatcgtgctgtatgtggccatggccctgctgggcgtcttccctgtggccggcatcctcttctcctacagccagatcgtgagcagcctgatgaggatgagcagcacagagggcaagtacaaggccttcagcacctgtggcagccacctgtgtgtggtgtccctcttctatggaacaggcctgggcgtgtacctgagcagcgctgtgacccacagcagccagagcagctccatggcctctgtgatgtatgccatggtgacccccatgctgaaccccttcatctacagcctgaggaacaaggatgtgaagggggccctgggccgcctgctgagcagagctgccagctgcctgctgcgctacaccaccagcgagctgcggggctgctacggcagcctgaagcagatgtag

SEQ ID NO: 37955 - DNA, 480 bp, Artificial Sequence
  Description of Artificial Sequence: Synthetic coding sequence
atggagaagctgcggcgggtgctgagcggccaggatgatgaggagcagggcctgacagcccaggtgctggatgccagcagcctgtccttcaacacccggctgaagtggtttgccatctgctttgtgtgtggggtcttcttcagcatcctgggcaccggcctgctgtggctgcccggcggcatcaagctgtttgctgtgttctacaccctgggcaacctggccgccctggccagcacctgcttcctgatgggccctgtgaagcagctgaagaagatgtttgaggccacccggctgctggccaccatcgtgatgctgctgtgcttcatcttcaccctgtgtgccgccctgtggtggcacaagaagggcctggccgtgctcttctgcatcctgcagttcctgtccatgacctggtacagcctgagctacatcccctatgccagagatgctgtgatcaagtgctgcagcagcctgctgtcctag

SEQ ID NO: 37956 - DNA, 483 bp, Artificial Sequence
  Description of Artificial Sequence: Synthetic coding sequence
atggacaagctgaagaaggtgctgagcggccaggacacagaggacagaagtggcctgtctgaggtggtggaggccagcagcctgtcctggagcacccgcatcaagggcttcatcgcctgctttgccatcggcatcctgtgcagcctgctgggcaccgtgctgctgtgggtgcccaggaagggcctgcacctgtttgctgtgttctacacctttggaaacatcgccagcatcggcagcaccatcttcctgatgggccctgtgaagcagctgaagaggatgtttgagcccaccaggctcatcgccaccatcatggtgctgctgtgctttgccctgaccctgtgcagcgccttctggtggcacaacaagggcctggccctgatcttctgcatcctgcagagcctggccctgacctggtacagcctgtccttcatcccctttgccagagatgctgtgaagaagtgctttgctgtgtgcctggcctag

SEQ ID NO: 37957 - DNA, 327 bp, Artificial Sequence
  Description of Artificial Sequence: Synthetic coding sequence
atggacaagctgaagaaggtgctgagcggccaggacacagaggacagaagtggcctgtctgaggtggtggaggccagcagcctgtcctggagcacccgcatcaagggcttcatcgcctgctttgccatcggcatcctgtgcagcctgctgggcaccgtgctgctgtgggtgcccaggaagggcctgcacctgtttgctgtgttctacacctttggaaacatcgccagcatcggcagctgtgtgctgcacctgccctgtgtgctgccctttggaggcatcacccgggacctgcacctgagcagcgccttctgcagcctgtggcactag

SEQ ID NO: 37958 - DNA, 327 bp, Artificial Sequence; identical to SEQ ID NO: 37957
  Description of Artificial Sequence: Synthetic coding sequence

SEQ ID NO: 37959 - DNA, 648 bp, Artificial Sequence
  Description of Artificial Sequence: Synthetic coding sequence
atggctgacctgcaccggcagctgcaggagtacctggcccagggcaaggccggcggccctgctgctgctgagcccctgctggccgctgagaaggccgaggagcccggggacaggcctgctgaggagtggctgggccgggccggcctgcgctggacctgggcccggagccctgctgagagcgctgctgctggcctgacctgcctgcccagcgtgacccggggccagaggctggccgccggcggcggctgcctgctgctggccgccctgtgcttcggcctggccgccctgtatgcccctgtgctgctgctgcgggccaggaagtttgccctgctgtggagcctgggcagcgccctggccctggccggcagcgccctgctgcggggcggggccgcctgtggccgcctgctgcgctgtgaggaggcccccagcaggcctgccctgctgtacatggccgccctgggcgccaccctgtttgctgccctgggcctgcggagcaccctgctgactgtgctgggcgctggggcccaggtggccgccctgctggccgccctggtgggcctgctgccctggggcggcggcacagccctgcggctggccctgggccgcctgggcagaggagctggcctggccaaggtgctgcctgtgtag

SEQ ID NO: 37960 - DNA, 6486 bp, Artificial Sequence
  Description of Artificial Sequence: Synthetic coding sequence
atgacccacagccctgccaccagtgaagatgaggagcggcacagcgccagcgagtgcccagagggcggcagcgagagtgacagcagcccagatggccctggccggggcccccggggcacccggggccagggcagcggggcccctggcagcctggcctctgtgcggggcctgcagggccgctccatgtctgtgcctgatgatgcccacttctccatgatggtgttcagaattggcatcccagacctgcaccagaccaagtgcctgcgcttcaacccagatgccaccatctggacagccaagcagcaggtgctgtgtgccctgtctgagagcctgcaggatgtgctgaactacggcctcttccagcctgccaccagcggcagagatgccaacttcctggaggaggagcggctgctgcgggagtacccccagagctttgagaagggcgtgccctacctggagttccgctacaagaccagggtgtacaagcagaccaacctggatgagaagcagctggccaagctgcacaccaagacaggcctgaagaagttcctggagtatgtgcagctgggcaccagtgacaaggtggcccggctgctggacaagggcctggaccccaactaccatgacagcgacagcggggagacccccctgaccctggccgcccagacagagggctctgtggaggtgatccgcaccctgtgcctgggcggggcccacatcgacttccgggccagagatggcatgacagccctgcacaaggccgcctgtgcccggcactgcctggccctgacagccctgctggacctgggcggcagccccaactacaaggaccggcggggcctgacccccctcttccacacagccatggtgggcggggacccccgctgctgtgagctgctgctcttcaacagagcccagctgggcattgctgatgaaaatggctggcaggagatccaccaggcctgccagaggggccacagccagcacctggagcacctgctcttctacggggctgagcccggggcccagaatgccagcggcaacacagccctgcacatctgtgccctgtacaacaaggagacctgtgcccgcatcctgctgtacagaggagctgacaaggatgtgaagaacaacaacggccagacccccttccaggtggccgtgattgctggcaactttgagctgggggagctgatccggaaccaccgggagcaggatgtggtgcccttccaggagagccccaagtatgctgcccggcggcggggccccccaggcaccggcctgactgtgcccccagccctgctgcgggccaacagcgacacctccatggccctgcctgactggatggtgttcagcgcccctggggccgccagcagcggggcccctggccccaccagcggcagccagggccagagccagcccagcgcccccaccaccaagctgagcagcggcaccctgcggagcgccagcagccccaggggggcccgggcccggagccccagccggggccgccacccagaagatgccaagaggcagccccggggccggcccagcagcagcggcaccccccgggagggccctgctgggggcactggaggcagcggcggccctgggggcagcctgggcagccggggcagaagaaggaagctgtacagcgctgtgcccggccgctccttcatggctgtgaagagctaccaggcccaggccgagggggagatcagcctgagcaaaggagagaagatcaaggtgctgagcatcggggagggcggcttctgggagggccaggtgaagggccgggtgggctggttccccagcgactgcctggaggaggtggccaacagaagccaggagagcaagcaggagagcagaagtgacaaggccaagaggctcttccgccactacacagtgggcagctatgacagctttgatgcccccagcctgatggatggcatcggccctggcagtgactacatcatcaaggagaagacagtgctgctgcagaagaaggacagcgagggcttcggctttgtgctgcggggggccaaggcccagacccccatcgaggagttcacccccaccccagccttccctgccctgcagtacctggagagcgtggatgagggcggcgtggcctggagggctggcctgaggatgggagacttcctgattgaggtgaatggccagaatgtggtgaaggtgggccaccggcaggtggtgaacatgatccggcagggcggcaacaccctgatggtgaaggtggtgatggtgaccaggcacccagacatggatgaagctgtgcacaagaaggccccccagcaggccaagaggctgcccccacccaccatcagcctgcggagcaagtccatgaccagcgagctggaggagatggagtatgagcagcagcctgcccctgtgcccagcatggagaagaagaggacagtgtaccagatggccctgaacaagctggatgagatcctggccgccgcccagcagaccatcagcgccagcgagagccctggccctgggggcctggccagcctgggcaagcaccggcccaagggcttctttgccacagagagcagctttgacccccaccaccgggcccagcccagctatgaaagacccagcttcctgcccccaggccctggcctgatgctgcggcagaagagcattggagctgctgaagatgaccggccctacctggcccccccagccatgaagttcagccgcagcctgtctgtgcccggcagcgaggacatccccccaccacccaccaccagccccccagagcccccctacagcaccccacctgtgcccagcagcagcggccgcctgacccccagcccccggggcggccccttcaaccctggcagcggcggccccctgcctgccagcagccctgccagctttgatggccccagccccccagacaccagggtgggcagccgggagaagagcctgtaccacagcggccccctgcccccagcccaccaccaccccccccaccaccaccaccaccacgcccccccaccccagccccaccaccaccacgcccaccccccccaccccccagagatggagaccggcggcagcccagatgatcctccaccccggctggccctgggcccccagcccagcctgcggggctggaggggcggcggccccagccccacccctggggcccccagccccagccaccacggcagcgctgggggcggcggcggcagcagccagggccctgccctgcgctacttccagctgccccccagggctgccagcgctgccatgtatgtgcctgcccggagcggccggggcaggaagggccccctggtgaagcagaccaaggtggagggggagccccagaagggcggcggcctgcccccagcccccagccccaccagccctgccagcccccagcccccacctgctgtggccgcccccagcgagaagaacagcatccccatccccaccatcatcatcaaggcccccagcaccagcagcagcggccgcagcagccagggcagcagcacagaagctgagccccccacccagcctgagcccaccggcggcggcggcggcggcggcagcagccccagccctgccccagccatgagccctgtgccccccagccccagccctgtgcccaccccagccagccccagcggccctgccaccctggacttcaccagccagtttggagctgccctggtgggcgccgcccggcgggagggcggctggcagaatgaggcccggcggcgcagcaccctcttcctgagcacagatgctggagatgaagatggaggagatggcggcctgggcaccggggccgcccctggcccccggctgcggcacagcaagagcattgatgagggcatgttttctgctgagccctacctgcggctggagagcgctggcagcggggccggctacggcggctatggagctggcagccgggcctacggcggcggcggcggcagcagcgccttcaccagcttcctgcccccccggcccctggtgcaccccctgaccgggaaggccctggaccctgccagccccctgggcctggccctggccgcccgggagcgggccctgaaggagagcagcgagggcggcggggccccccagcccccaccccggccccccagccccaggtatgaggcccccccacccaccccccaccaccacagcccccacgcccaccacgagcctgtgctgcggctgtggggcgccagccccccagaccctgcccggcgggagctgggctaccgggccggcctgggcagccaggagaagagcctgcctgccagccccccagctgcccggcgcagcctgctgcaccggctgcccccaacagcccctggggtgggccccctgctgctgcagctgggcacagagcccccagccccccaccctggggtgtccaagccctggaggtctgctgcccctgaggagcctgagcggctgcccctgcacgtgcgcttcctggagaactgccagccccgggcccctgtgaccagcggccggggccccccatctgaagatggccctggggtgcccccacccagcccccggcgctctgtgccccccagccccaccagcccccgggcctctgaagaaaatggcctgcccctgctggtgctgcccccaccagcccccagcgtggatgtggaggatggagagttcctgtttgtggagcccctgcccccacccctggagttcagcaacagctttgagaagccagagagccccctgaccccaggccccccccaccccctgcctgacaccccagccccagccacccccctgccccctgtgcccccacctgctgtggccgccgccccacccaccctggacagcacagccagcagcctgaccagctatgattctgaggtggccaccctgacccagggcgccagcgctgcccctggggacccccaccccccaggccccccagccccagctgccccagccccagctgccccccagcccggccctgaccccccacctggaacagattctggaattgaggaggtggacagccgcagcagcagtgaccaccccctggagaccatcagcagcgccagcaccctgagcagcctgtctgctgagggcggcggcagcgctgggggcggcggcggggccggggccggcgtggccagcggccctgagctgctggacacctacgtggcctacctggatggccaggcctttggaggcagcagcaccccaggccccccctacccaccccagctgatgacccccagcaagctgcggggccgggccctgggcgccagcggcggcctgcggcccggccccagcggcggcctgcgggaccctgtgacccccaccagccccaccgtgtctgtgactggagctggaacagatggcctgctggccctgcgggcctgcagcggccccccaacagctggggtggccggcggccctgtggccgtggagcctgaggtgccccctgtgcccctgcccacagccagcagcctgcccaggaagctgctgccctgggaggagggccctggccccccacctccacccctgcccggccccctggcccagccccaggccagcgccctggccaccgtgaaggccagcatcatcagcgagctgagcagcaagctgcagcagtttggaggcagcagcgctgctggaggagccctgccctgggcccggggcggcagcggcggcggcggggacagccaccacggcggggccagctatgtgcctgagaggaccagcagcctgcagaggcagaggctgagtgatgacagccagagcagcctgctgagcaagcctgtgagcagcctcttccagaactggcccaagccacccctgccccccctgcccaccggcaccggggtgagccccacagctgctgctgcccctggggccaccagccccagcgccagcagcagcagcaccagcaccaggcacctgcagggcgtggagtttgagatgaggcctcccctgctgcggcgggcccccagccccagcctgctgcctgccagcgagcacaaggtgtccccagccccccggcccagcagcctgcccatcctgcccagcggccccctgtacccaggcctgtttgacatccggggcagccccaccggcggggccggcggcagcgctgacccctttgcccctgtgtttgtgcccccccaccctggcatcagcggcggcctgggcggggccctgagcggggccagccgcagcctgagccccacccggctgctgagcctgcccccagacaagccctttggagccaagcccctgggcttctggaccaagtttgatgtggccgactggctggagtggctgggcctggccgagcaccgggcccagttcctggaccacgagattgatggcagccacctgcctgccctgaccaaggaggactatgtggacctgggcgtgaccagggtgggccacaggatgaacatcgaccgggccctgaagttcttcctggagaggtag

SEQ ID NO: 37961 - DNA, 6459 bp, Artificial Sequence
  Description of Artificial Sequence: Synthetic coding sequence
atgacccacagccctgccaccagtgaagatgaggagcggcacagcgccagcgagtgcccagagggcggcagcgagagtgacagcagcccagatggccctggccggggcccccggggcacccggggccagggcagcggggcccctggcagcctggcctctgtgcggggcctgcagggccgctccatgtctgtgcctgatgatgcccacttctccatgatggtgttcagaattggcatcccagacctgcaccagaccaagtgcctgcgcttcaacccagatgccaccatctggacagccaagcagcaggtgctgtgtgccctgtctgagagcctgcaggatgtgctgaactacggcctcttccagcctgccaccagcggcagagatgccaacttcctggaggaggagcggctgctgcgggagtacccccagagctttgagaagggcgtgccctacctggagttccgctacaagaccagggtgtacaagcagaccaacctggatgagaagcagctggccaagctgcacaccaagacaggcctgaagaagttcctggagtatgtgcagctgggcaccagtgacaaggtggcccggctgctggacaagggcctggaccccaactaccatgacagcgacagcggggagacccccctgaccctggccgcccagacagagggctctgtggaggtgatccgcaccctgtgcctgggcggggcccacatcgacttccgggccagagatggcatgacagccctgcacaaggccgcctgtgcccggcactgcctggccctgacagccctgctggacctgggcggcagccccaactacaaggaccggcggggcctgacccccctcttccacacagccatggtgggcggggacccccgctgctgtgagctgctgctcttcaacagagcccagctgggcattgctgatgaaaatggctggcaggagatccaccaggcctgccagaggggccacagccagcacctggagcacctgctcttctacggggctgagcccggggcccagaatgccagcggcaacacagccctgcacatctgtgccctgtacaacaaggagacctgtgcccgcatcctgctgtacagaggagctgacaaggatgtgaagaacaacaacggccagacccccttccaggtggccgtgattgctggcaactttgagctgggggagctgatccggaaccaccgggagcaggatgtggtgcccttccaggagagccccaagtatgctgcccggcggcggggccccccaggcaccggcctgactgtgcccccagccctgctgcgggccaacagcgacacctccatggccctgcctgactggatggtgttcagcgcccctggggccgccagcagcggggcccctggccccaccagcggcagccagggccagagccagcccagcgcccccaccaccaagctgagcagcggcaccctgcggagcgccagcagccccaggggggcccgggcccggagccccagccggggccgccacccagaagatgccaagaggcagccccggggccggcccagcagcagcggcaccccccgggagggccctgctgggggcactggaggcagcggcggccctgggggcagcctgggcagccggggcagaagaaggaagctgtacagcgctgtgcccggccgctccttcatggctgtgaagagctaccaggcccaggccgagggggagatcagcctgagcaaaggagagaagatcaaggtgctgagcatcggggagggcggcttctgggagggccaggtgaagggccgggtgggctggttccccagcgactgcctggaggaggtggccaacagaagccaggagagcaagcaggagagcagaagtgacaaggccaagaggctcttccgccactacacagtgggcagctatgacagctttgatgcccccagcgactacatcatcaaggagaagacagtgctgctgcagaagaaggacagcgagggctttggatttgtgctgcggggggccaaggcccagacccccatcgaggagttcacccccaccccagccttccctgccctgcagtacctggagagcgtggatgaaggaggagtggcctggagggctggcctgaggatgggagacttcctgattgaggtgaatggccagaatgtggtgaaggtgggccaccggcaggtggtgaacatgatccggcagggcggcaacaccctgatggtgaaggtggtgatggtgaccaggcacccagacatggatgaggccgtgcacaagaaggccccccagcaggccaagaggctgcccccacccaccatcagcctgcggagcaagtccatgaccagcgagctggaggagatggagtatgagcagcagcctgcccctgtgcccagcatggagaagaagaggacagtgtaccagatggccctgaacaagctggatgagatcctggccgccgcccagcagaccatcagcgccagcgagagccctggccctgggggcctggccagcctgggcaagcaccggcccaagggcttctttgccacagagagcagctttgacccccaccaccgggcccagcccagctatgagcggcccagcttcctgcccccaggccctggcctgatgctgcggcagaagagcatcggggctgctgaagatgaccggccctacctggcccccccagccatgaagttcagccgcagcctgtctgtgcccggcagcgaggacatccccccaccacccaccaccagccccccagagcccccctacagcaccccacctgtgcccagcagcagcggccgcctgacccccagcccccggggcggccccttcaaccctggcagcggcggccccctgcctgccagcagccctgccagctttgatggccccagccccccagacaccagggtgggcagccgggagaagagcctgtaccacagcggccccctgcccccagcccaccaccaccccccccaccaccaccaccaccacgcccccccaccccagccccaccaccaccacgcccaccccccccaccccccagagatggagactggaggcagcccagatgaccccccaccccggctggccctgggcccccagcccagcctgcggggctggaggggcggcggccccagccccacccctggggcccccagccccagccaccacggcagcgctgggggcggcggcggcagcagccagggccctgccctgcgctacttccagctgcccccccgggccgccagcgctgccatgtatgtgcctgcccggagcggccggggcaggaagggccccctggtgaagcagaccaaggtggagggggagccccagaagggcggcggcctgcccccagcccccagccccaccagccctgccagcccccagcccccacctgctgtggccgcccccagcgagaagaacagcatccccatccccaccatcatcatcaaggcccccagcaccagcagcagcggccgcagcagccagggcagcagcacagaggccgagccccccacccagcctgagcccactggaggcggcggcggcggcggcagcagccccagccctgccccagccatgagccctgtgccccccagccccagccctgtgcccaccccagccagccccagcggccctgccaccctggacttcaccagccagtttggagctgccctggtgggcgccgcccggcgggagggcggctggcagaatgaggccaggagaagaagcaccctcttcctgagcacagatgctggagatgaagatggaggagatggcggcctgggcactggagctgcccctggcccccggctgcggcacagcaagagcattgatgagggcatgttttctgctgagccctacctgcggctggagagcgctggcagcggggccggctatggaggctacggggccggcagccgggcctatggaggcggcggcggcagcagcgccttcaccagcttcctgcccccccggcccctggtgcaccccctgaccgggaaggccctggaccctgccagccccctgggcctggccctggccgcccgggagcgggccctgaaggagagcagcgagggcggcggggccccccagcccccacccaggcctcccagccccaggtatgaggcccccccacccaccccccaccaccacagcccccacgcccaccacgagcctgtgctgcggctgtggggcgccagccccccagaccctgcccggcgggagctgggctacagagctggcctgggcagccaggagaagagcctgcctgccagccccccagctgcccggcgcagcctgctgcaccggctgcccccaacagcccctggggtgggccccctgctgctgcagctgggcacagagcccccagccccccaccctggggtgtccaagccctggaggtctgctgcccctgaggagcctgagcggctgcccctgcacgtgcgcttcctggagaactgccagccccgggcccctgtgaccagcggccggggccccccatctgaagatggccctggggtgcccccacccagccccaggagatctgtgccccccagccccaccagcccccgggccagcgaggagaatggcctgcccctgctggtgctgcccccaccagcccccagcgtggatgtggaggatggagagttcctgtttgtggagcccctgcccccacccctggagttcagcaacagctttgagaagccagagagccccctgaccccaggccccccccaccccctgcctgacaccccagccccagccacccccctgccccctgtgcccccacctgctgtggccgccgccccacccaccctggacagcacagccagcagcctgaccagctatgacagcgaggtggccaccctgacccagggcgccagcgctgcccctggggacccccaccccccaggccccccagccccagctgccccagccccagctgccccccagcccggccctgaccccccacctggaacagacagcggcatcgaggaggtggacagccgcagcagcagtgaccaccccctggagaccatcagcagcgccagcaccctgagcagcctgtctgctgagggcggcggcagcgctgggggcggcggcggggccggggccggcgtggccagcggccctgagctgctggacacctacgtggcctacctggatggccaggccttcggcggcagcagcaccccaggccccccctacccaccccagctgatgacccccagcaagctgcggggccgggccctgggcgccagcggcggcctgcggcccggccccagcggcggcctgcgggaccctgtgacccccaccagccccaccgtgtctgtgactggagctggaacagatggcctgctggccctgcgggcctgcagcggccccccaacagctggggtggccggcggccctgtggccgtggagcctgaggtgccccctgtgcccctgcccacagccagcagcctgcccaggaagctgctgccctgggaggagggccctggccccccacctccacccctgcccggccccctggcccagccccaggccagcgccctggccaccgtgaaggccagcatcatcagcgagctgagcagcaagctgcagcagtttggaggcagcagcgctgctgggggcgccctgccctgggcccggggcggcagcggcggcggcggggacagccaccacggcggggccagctatgtgcctgagaggaccagcagcctgcagaggcagaggctgagtgatgacagccagagcagcctgctgagcaagcctgtgagcagcctcttccagaactggcccaagccacccctgccccccctgcccactggaactggagtgagccccacagctgctgctgcccctggggccaccagccccagcgccagcagcagcagcaccagcaccaggcacctgcagggcgtggagtttgagatgaggcctcccctgctgcggcgggcccccagccccagcctgctgcctgccagcgagcacaaggtgtccccagccccccggcccagcagcctgcccatcctgcccagcggccccctgtacccaggcctgtttgacatccggggcagccccactggaggagctgggggcagcgctgacccctttgcccctgtgtttgtgcccccccaccctggcatcagcggcggcctgggcggggccctgagcggggccagccgcagcctgagccccacccggctgctgagcctgcccccagacaagccctttggagccaagcccctgggcttctggaccaagtttgatgtggccgactggctggagtggctgggcctggccgagcaccgggcccagttcctggaccatgaaattgatggcagccacctgcctgccctgaccaaggaggactatgtggacctgggcgtgaccagggtgggccacaggatgaacatcgaccgggccctgaagttcttcctggagaggtag

SEQ ID NO: 37962 - DNA, 4647 bp, Artificial Sequence
  Description of Artificial Sequence: Synthetic coding sequence
atgcagctgatggccctggagcagcgcttcggcagcggcctgcccggcggcggccagcccctgtgcctgatgatgagcagccccctgcccccacctccaccccacttcagctgcctgcctgccagtgactacatcatcaaggagaagacagtgctgctgcagaagaaggacagcgagggctttggatttgtgctgcggggggccaaggcccagacccccatcgaggagttcacccccaccccagccttccctgccctgcagtacctggagagcgtggatgaaggaggagtggcctggagggctggcctgaggatgggagacttcctgattgaggtgaatggccagaatgtggtgaaggtgggccaccggcaggtggtgaacatgatccggcagggcggcaacaccctgatggtgaaggtggtgatggtgaccaggcacccagacatggatgaggccgtgcacaagaaggccccccagcaggccaagaggctgcccccacccaccatcagcctgcggagcaagtccatgaccagcgagctggaggagatggagtatgagcagcagcctgcccctgtgcccagcatggagaagaagaggacagtgtaccagatggccctgaacaagctggatgagatcctggccgccgcccagcagaccatcagcgccagcgagagccctggccctgggggcctggccagcctgggcaagcaccggcccaagggcttctttgccacagagagcagctttgacccccaccaccgggcccagcccagctatgagcggcccagcttcctgcccccaggccctggcctgatgctgcggcagaagagcatcggggctgctgaagatgaccggccctacctggcccccccagccatgaagttcagccgcagcctgtctgtgcccggcagcgaggacatccccccaccacccaccaccagccccccagagcccccctacagcaccccacctgtgcccagcagcagcggccgcctgacccccagcccccggggcggccccttcaaccctggcagcggcggccccctgcctgccagcagccctgccagctttgatggccccagccccccagacaccagggtgggcagccgggagaagagcctgtaccacagcggccccctgcccccagcccaccaccaccccccccaccaccaccaccaccacgcccccccaccccagccccaccaccaccacgcccaccccccccaccccccagagatggagactggaggcagcccagatgaccccccaccccggctggccctgggcccccagcccagcctgcggggctggaggggcggcggccccagccccacccctggggcccccagccccagccaccacggcagcgctgggggcggcggcggcagcagccagggccctgccctgcgctacttccagctgcccccccgggccgccagcgctgccatgtatgtgcctgcccggagcggccggggcaggaagggccccctggtgaagcagaccaaggtggagggggagccccagaagggcggcggcctgcccccagcccccagccccaccagccctgccagcccccagcccccacctgctgtggccgcccccagcgagaagaacagcatccccatccccaccatcatcatcaaggcccccagcaccagcagcagcggccgcagcagccagggcagcagcacagaggccgagccccccacccagcctgagcccactggaggcggcggcggcggcggcagcagccccagccctgccccagccatgagccctgtgccccccagccccagccctgtgcccaccccagccagccccagcggccctgccaccctggacttcaccagccagtttggagctgccctggtgggcgccgcccggcgggagggcggctggcagaatgaggccaggagaagaagcaccctcttcctgagcacagatgctggagatgaagatggaggagatggcggcctgggcactggagctgcccctggcccccggctgcggcacagcaagagcattgatgagggcatgttttctgctgagccctacctgcggctggagagcgctggcagcggggccggctatggaggctacggggccggcagccgggcctatggaggcggcggcggcagcagcgccttcaccagcttcctgcccccccggcccctggtgcaccccctgaccgggaaggccctggaccctgccagccccctgggcctggccctggccgcccgggagcgggccctgaaggagagcagcgagggcggcggggccccccagcccccacccaggcctcccagccccaggtatgaggcccccccacccaccccccaccaccacagcccccacgcccaccacgagcctgtgctgcggctgtggggcgccagccccccagaccctgcccggcgggagctgggctacagagctggcctgggcagccaggagaagagcctgcctgccagccccccagctgcccggcgcagcctgctgcaccggctgcccccaacagcccctggggtgggccccctgctgctgcagctgggcacagagcccccagccccccaccctggggtgtccaagccctggaggtctgctgcccctgaggagcctgagcggctgcccctgcacgtgcgcttcctggagaactgccagccccgggcccctgtgaccagcggccggggccccccatctgaagatggccctggggtgcccccacccagccccaggagatctgtgccccccagccccaccagcccccgggccagcgaggagaatggcctgcccctgctggtgctgcccccaccagcccccagcgtggatgtggaggatggagagttcctgtttgtggagcccctgcccccacccctggagttcagcaacagctttgagaagccagagagccccctgaccccaggccccccccaccccctgcctgacaccccagccccagccacccccctgccccctgtgcccccacctgctgtggccgccgccccacccaccctggacagcacagccagcagcctgaccagctatgacagcgaggtggccaccctgacccagggcgccagcgctgcccctggggacccccaccccccaggccccccagccccagctgccccagccccagctgccccccagcccggccctgaccccccacctggaacagacagcggcatcgaggaggtggacagccgcagcagcagtgaccaccccctggagaccatcagcagcgccagcaccctgagcagcctgtctgctgagggcggcggcagcgctgggggcggcggcggggccggggccggcgtggccagcggccctgagctgctggacacctacgtggcctacctggatggccaggccttcggcggcagcagcaccccaggccccccctacccaccccagctgatgacccccagcaagctgcggggccgggccctgggcgccagcggcggcctgcggcccggccccagcggcggcctgcgggaccctgtgacccccaccagccccaccgtgtctgtgactggagctggaacagatggcctgctggccctgcgggcctgcagcggccccccaacagctggggtggccggcggccctgtggccgtggagcctgaggtgccccctgtgcccctgcccacagccagcagcctgcccaggaagctgctgccctgggaggagggccctggccccccacctccacccctgcccggccccctggcccagccccaggccagcgccctggccaccgtgaaggccagcatcatcagcgagctgagcagcaagctgcagcagtttggaggcagcagcgctgctgggggcgccctgccctgggcccggggcggcagcggcggcggcggggacagccaccacggcggggccagctatgtgcctgagaggaccagcagcctgcagaggcagaggctgagtgatgacagccagagcagcctgctgagcaagcctgtgagcagcctcttccagaactggcccaagccacccctgccccccctgcccactggaactggagtgagccccacagctgctgctgcccctggggccaccagccccagcgccagcagcagcagcaccagcaccaggcacctgcagggcgtggagtttgagatgaggcctcccctgctgcggcgggcccccagccccagcctgctgcctgccagcgagcacaaggtgtccccagccccccggcccagcagcctgcccatcctgcccagcggccccctgtacccaggcctgtttgacatccggggcagccccactggaggagctgggggcagcgctgacccctttgcccctgtgtttgtgcccccccaccctggcatcagcggcggcctgggcggggccctgagcggggccagccgcagcctgagccccacccggctgctgagcctgcccccagacaagccctttggagccaagcccctgggcttctggaccaagtttgatgtggccgactggctggagtggctgggcctggccgagcaccgggcccagttcctggaccatgaaattgatggcagccacctgcctgccctgaccaaggaggactatgtggacctgggcgtgaccagggtgggccacaggatgaacatcgaccgggccctgaagttcttcctggagaggtag

SEQ ID NO: 37963 - DNA, 6510 bp, Artificial Sequence
  Description of Artificial Sequence: Synthetic coding sequence
atgacccacagccctgccaccagtgaagatgaggagcggcacagcgccagcgagtgcccagagggcggcagcgagagtgacagcagcccagatggccctggccggggcccccggggcacccggggccagggcagcggggcccctggcagcctggcctctgtgcggggcctgcagggccgctccatgtctgtgcctgatgatgcccacttctccatgatggtgttcagaattggcatcccagacctgcaccagaccaagtgcctgcgcttcaacccagatgccaccatctggacagccaagcagcaggtgctgtgtgccctgtctgagagcctgcaggatgtgctgaactacggcctcttccagcctgccaccagcggcagagatgccaacttcctggaggaggagcggctgctgcgggagtacccccagagctttgagaagggcgtgccctacctggagttccgctacaagaccagggtgtacaagcagaccaacctggatgagaagcagctggccaagctgcacaccaagacaggcctgaagaagttcctggagtatgtgcagctgggcaccagtgacaaggtggcccggctgctggacaagggcctggaccccaactaccatgacagcgacagcggggagacccccctgaccctggccgcccagacagagggctctgtggaggtgatccgcaccctgtgcctgggcggggcccacatcgacttccgggccagagatggcatgacagccctgcacaaggccgcctgtgcccggcactgcctggccctgacagccctgctggacctgggcggcagccccaactacaaggaccggcggggcctgacccccctcttccacacagccatggtgggcggggacccccgctgctgtgagctgctgctcttcaacagagcccagctgggcattgctgatgaaaatggctggcaggagatccaccaggcctgccagaggggccacagccagcacctggagcacctgctcttctacggggctgagcccggggcccagaatgccagcggcaacacagccctgcacatctgtgccctgtacaacaaggagacctgtgcccgcatcctgctgtacagaggagctgacaaggatgtgaagaacaacaacggccagacccccttccaggtggccgtgattgctggcaactttgagctgggggagctgatccggaaccaccgggagcaggatgtggtgcccttccaggagagccccaagtatgctgcccggcggcggggccccccaggcaccggcctgactgtgcccccagccctgctgcgggccaacagcgacacctccatggccctgcctgactggatggtgttcagcgcccctggggccgccagcagcggggcccctggccccaccagcggcagccagggccagagccagcccagcgcccccaccaccaagctgagcagcggcaccctgcggagcgccagcagccccaggggggcccgggcccggagccccagccggggccgccacccagaagatgccaagaggcagccccggggccggcccagcagcagcggcaccccccgggagggccctgctgggggcactggaggcagcggcggccctgggggcagcctgggcagccggggcagaagaaggaagctgtacagcgctgtgcccggccgctccttcatggctgtgaagagctaccaggcccaggccgagggggagatcagcctgagcaaaggagagaagatcaaggtgctgagcatcggggagggcggcttctgggagggccaggtgaagggccgggtgggctggttccccagcgactgcctggaggaggtggccaacagaagccaggagagcaagcaggagagcagaagtgacaaggccaagaggctcttccgccactacacagtgggcagctatgacagctttgatgcccccagcctgatggatggcatcggccctggcagtgactacatcatcaaggagaagacagtgctgctgcagaagaaggacagcgagggcttcggctttgtgctgcggggggccaaggcccagacccccatcgaggagttcacccccaccccagccttccctgccctgcagtacctggagagcgtggatgagggcggcgtggcctggagggctggcctgaggatgggagacttcctgattgaggtgaatggccagaatgtggtgaaggtgggccaccggcaggtggtgaacatgatccggcagggcggcaacaccctgatggtgaaggtggtgatggtgaccaggcacccagacatggatgaagctgtgcacaagaaggccccccagcaggccaagaggctgcccccacccaccatcagcctgcggagcaagtccatgaccagcgagctggaggagatggtgagcccctggaagaagaagtcagaatatgagcagcagcctgcccctgtgcccagcatggagaagaagaggacagtgtaccagatggccctgaacaagctggatgagatcctggccgccgcccagcagaccatcagcgccagcgagagccctggccctgggggcctggccagcctgggcaagcaccggcccaagggcttctttgccacagagagcagctttgacccccaccaccgggcccagcccagctatgaaagacccagcttcctgcccccaggccctggcctgatgctgcggcagaagagcattggagctgctgaagatgaccggccctacctggcccccccagccatgaagttcagccgcagcctgtctgtgcccggcagcgaggacatccccccaccacccaccaccagccccccagagcccccctacagcaccccacctgtgcccagcagcagcggccgcctgacccccagcccccggggcggccccttcaaccctggcagcggcggccccctgcctgccagcagccctgccagctttgatggccccagccccccagacaccagggtgggcagccgggagaagagcctgtaccacagcggccccctgcccccagcccaccaccaccccccccaccaccaccaccaccacgcccccccaccccagccccaccaccaccacgcccaccccccccaccccccagagatggagaccggcggcagcccagatgatcctccaccccggctggccctgggcccccagcccagcctgcggggctggaggggcggcggccccagccccacccctggggcccccagccccagccaccacggcagcgctgggggcggcggcggcagcagccagggccctgccctgcgctacttccagctgccccccagggctgccagcgctgccatgtatgtgcctgcccggagcggccggggcaggaagggccccctggtgaagcagaccaaggtggagggggagccccagaagggcggcggcctgcccccagcccccagccccaccagccctgccagcccccagcccccacctgctgtggccgcccccagcgagaagaacagcatccccatccccaccatcatcatcaaggcccccagcaccagcagcagcggccgcagcagccagggcagcagcacagaagctgagccccccacccagcctgagcccaccggcggcggcggcggcggcggcagcagccccagccctgccccagccatgagccctgtgccccccagccccagccctgtgcccaccccagccagccccagcggccctgccaccctggacttcaccagccagtttggagctgccctggtgggcgccgcccggcgggagggcggctggcagaatgaggcccggcggcgcagcaccctcttcctgagcacagatgctggagatgaagatggaggagatggcggcctgggcaccggggccgcccctggcccccggctgcggcacagcaagagcattgatgagggcatgttttctgctgagccctacctgcggctggagagcgctggcagcggggccggctacggcggctatggagctggcagccgggcctacggcggcggcggcggcagcagcgccttcaccagcttcctgcccccccggcccctggtgcaccccctgaccgggaaggccctggaccctgccagccccctgggcctggccctggccgcccgggagcgggccctgaaggagagcagcgagggcggcggggccccccagcccccaccccggccccccagccccaggtatgaggcccccccacccaccccccaccaccacagcccccacgcccaccacgagcctgtgctgcggctgtggggcgccagccccccagaccctgcccggcgggagctgggctaccgggccggcctgggcagccaggagaagagcctgcctgccagccccccagctgcccggcgcagcctgctgcaccggctgcccccaacagcccctggggtgggccccctgctgctgcagctgggcacagagcccccagccccccaccctggggtgtccaagccctggaggtctgctgcccctgaggagcctgagcggctgcccctgcacgtgcgcttcctggagaactgccagccccgggcccctgtgaccagcggccggggccccccatctgaagatggccctggggtgcccccacccagcccccggcgctctgtgccccccagccccaccagcccccgggcctctgaagaaaatggcctgcccctgctggtgctgcccccaccagcccccagcgtggatgtggaggatggagagttcctgtttgtggagcccctgcccccacccctggagttcagcaacagctttgagaagccagagagccccctgaccccaggccccccccaccccctgcctgacaccccagccccagccacccccctgccccctgtgcccccacctgctgtggccgccgccccacccaccctggacagcacagccagcagcctgaccagctatgattctgaggtggccaccctgacccagggcgccagcgctgcccctggggacccccaccccccaggccccccagccccagctgccccagccccagctgccccccagcccggccctgaccccccacctggaacagattctggaattgaggaggtggacagccgcagcagcagtgaccaccccctggagaccatcagcagcgccagcaccctgagcagcctgtctgctgagggcggcggcagcgctgggggcggcggcggggccggggccggcgtggccagcggccctgagctgctggacacctacgtggcctacctggatggccaggcctttggaggcagcagcaccccaggccccccctacccaccccagctgatgacccccagcaagctgcggggccgggccctgggcgccagcggcggcctgcggcccggccccagcggcggcctgcgggaccctgtgacccccaccagccccaccgtgtctgtgactggagctggaacagatggcctgctggccctgcgggcctgcagcggccccccaacagctggggtggccggcggccctgtggccgtggagcctgaggtgccccctgtgcccctgcccacagccagcagcctgcccaggaagctgctgccctgggaggagggccctggccccccacctccacccctgcccggccccctggcccagccccaggccagcgccctggccaccgtgaaggccagcatcatcagcgagctgagcagcaagctgcagcagtttggaggcagcagcgctgctggaggagccctgccctgggcccggggcggcagcggcggcggcggggacagccaccacggcggggccagctatgtgcctgagaggaccagcagcctgcagaggcagaggctgagtgatgacagccagagcagcctgctgagcaagcctgtgagcagcctcttccagaactggcccaagccacccctgccccccctgcccaccggcaccggggtgagccccacagctgctgctgcccctggggccaccagccccagcgccagcagcagcagcaccagcaccaggcacctgcagggcgtggagtttgagatgaggcctcccctgctgcggcgggcccccagccccagcctgctgcctgccagcgagcacaaggtgtccccagccccccggcccagcagcctgcccatcctgcccagcggccccctgtacccaggcctgtttgacatccggggcagccccaccggcggggccggcggcagcgctgacccctttgcccctgtgtttgtgcccccccaccctggcatcagcggcggcctgggcggggccctgagcggggccagccgcagcctgagccccacccggctgctgagcctgcccccagacaagccctttggagccaagcccctgggcttctggaccaagtttgatgtggccgactggctggagtggctgggcctggccgagcaccgggcccagttcctggaccacgagattgatggcagccacctgcctgccctgaccaaggaggactatgtggacctgggcgtgaccagggtgggccacaggatgaacatcgaccgggccctgaagttcttcctggagaggtag

SEQ ID NO: 37964 - DNA, 2556 bp, Artificial Sequence
  Description of Artificial Sequence: Synthetic coding sequence
atgaccagccactacgtgattgccatctttgccctgatgagcagctgcctggccacagctggccctgagcccggggccctgtgtgagctgagccctgtgtctgccagccaccctgtgcaggccctgatggagagcttcaccgtgctgagcggctgtgccagccggggcaccaccggcctgccccaggaggtgcacgtgctgaacctgaggacagctggccagggccctggccagctgcagcgggaggtgaccctgcacctgaaccccatcagctctgtgcacatccaccacaagtctgtggtgttcctgctgaacagcccccaccccctggtgtggcacctgaagacagagcggctggccactggagtgtcccggctcttcctggtgtctgagggctctgtggtgcagttcagcagcgccaacttcagcctgacagctgagacagaggagaggaacttcccccatggaaatgagcacctgctgaactgggccaggaaggagtatggagctgtgaccagcttcacagagctgaagatcgccaggaacatctacatcaaggtgggggaggaccaggtgttcccccccaagtgcaacatcggcaagaacttcctgagcctgaactacctggccgagtacctgcagcccaaggctgctgagggctgtgtgatgagcagccagccccagaatgaggaggtgcacatcatcgagctgatcacccccaacagcaacccctacagcgccttccaggtggacatcaccatcgacatccggcccagccaggaggacctggaggtggtgaagaacctgatcctgatcctgaagtgcaagaagtctgtgaactgggtgatcaagagctttgatgtgaagggcagcctgaagatcatcgcccccaacagcatcggctttgggaaggagagcgagaggtccatgaccatgaccaagagcatcagagatgacatccccagcacccagggcaacctggtgaagtgggccctggacaatggctacagccccatcaccagctacaccatggcccctgtggccaaccgcttccacctgcggctggagaacaatgctgaggagatgggagatgaggaggtgcacaccatccccccagagctgcgcatcctgctggaccccggggccctgcctgccctgcagaacccccccatccggggcggggagggccagaatggaggcctgcccttccccttcccagacatcagccggcgggtgtggaatgaggagggggaggatggcctgccccggcccaaggaccctgtgatccccagcatccagctgtttcctggcctgcgggagcctgaggaggtgcagggctctgtggacatcgccctgtctgtgaagtgtgacaatgagaagatgattgtggccgtggagaaggacagcttccaggccagcggctacagcggcatggatgtgaccctgctggaccccacctgcaaggccaagatgaatggcacccactttgtgctggagagccccctgaatggctgcggcacccggccccgctggagcgccctggatggagtggtgtactacaacagcatcgtcatccaggtgcctgccctgggggacagcagcggctggccagatggctatgaggacctggagagcggggacaatggcttccctggggacatggatgaaggagatgccagcctcttcaccaggcctgagatcgtggtgttcaactgcagcctgcagcaggtgaggaaccccagcagcttccaggagcagccccacggcaacatcaccttcaacatggagctgtacaacacagacctcttcctggtgcccagccagggcgtcttctctgtgcctgaaaatggccacgtgtatgtggaggtgtctgtgaccaaggccgagcaggagctgggctttgccatccagacctgcttcatcagcccctacagcaacccagacaggatgagccactacaccatcatcgagaacatctgccccaaggatgaatctgtgaagttctacagccccaagagggtgcacttccccatcccccaggccgacatggacaagaagcgcttctcctttgtgttcaagcctgtgttcaacaccagcctgctcttcctgcagtgtgagctgaccctgtgcaccaagatggagaagcacccccagaagctgcccaagtgtgtgcccccagatgaggcctgcaccagcctggatgccagcatcatctgggccatgatgcagaacaagaagaccttcaccaagcccctggccgtcatccaccatgaagctgagagcaaggagaagggccccagcatgaaggagcccaaccccatcagcccccccatcttccacggcctggacaccctgactgtgatgggcatcgcctttgctgcctttgtgattggagccctgctgaccggggccctgtggtacatctacagccacactggagaaacagctggccggcagcaggtgcccaccagccccccagccagcgagaacagcagcgctgcccacagcatcggcagcacccagagcaccccctgcagcagcagcagcacagcctag

SEQ ID NO: 37965 - DNA, 1161 bp, Artificial Sequence
  Description of Artificial Sequence: Synthetic coding sequence
atgaacatcatggacttcaacgtgaagaagctggccgcagatgctggcaccttcctgagcagagctgtgcagttcacagaggagaagctgggccaggccgagaagacagagctggatgcccacctggagaacctgctgagcaaggccgagtgcaccaagatctggacagagaagatcatgaagcagacagaggtgctgctgcagcccaaccccaatgccagaattgaggagtttgtgtatgagaagctggacaggaaggcccccagccgcatcaacaaccctgagctgctgggccagtacatgattgatgctggaacagaatttggacctggaacagcctatggaaatgccctgatcaagtgtggggagacccagaagagaattggaacagctgaccgggagctgatccagaccagcgccctgaacttcctgacccccctgaggaacttcattgaaggagactacaagaccatcgccaaggagaggaagctgctgcagaacaagaggctggacctggatgctgccaagacccggctgaagaaggccaaggctgctgagaccaggaacagccagctgaacagcgcccggctggagggggacaacatcatgatctgggccgaggaggtgaccaagtctgagcaggagctgcgcatcacccagagcgagtttgaccggcaggccgagatcacccggctgctgctggagggcatcagcagcacccacgcccaccacctgcgctgcctgaatgactttgtggaggcccagatgacctactatgcccagtgctaccagtacatgctggacctgcagaagcagctgggcagcttccccagcaactacctgagcaacaacaaccagacctctgtgacccctgtgcccagcgtgctgcccaatgccatcggcagcagcgccatggccagcaccagcggcctggtgatcaccagccccagcaacctgagtgacctgaaggagtgcagcggcagcaggaaggcccgggtgctgtatgactatgatgctgccaacagcacagagctgagcctgctggctgatgaggtgatcaccgtcttctctgtggtgggcatggacagcgactggctgatgggagagcggggcaaccagaagggcaaggtgcccatcacctacctggagctgctgaactag

SEQ ID NO: 37966 - DNA, 798 bp, Artificial Sequence
  Description of Artificial Sequence: Synthetic coding sequence
atgattgatgctggaacagaatttggacctggaacagcctatggaaatgccctgatcaagtgtggggagacccagaagagaattggaacagctgaccgggagctgatccagaccagcgccctgaacttcctgacccccctgaggaacttcattgaaggagactacaagaccatcgccaaggagaggaagctgctgcagaacaagaggctggacctggatgctgccaagacccggctgaagaaggccaaggctgctgagaccaggaacagcagcgagcaggagctgcgcatcacccagagcgagtttgaccggcaggccgagatcacccggctgctgctggagggcatcagcagcacccacgcccaccacctgcgctgcctgaatgactttgtggaggcccagatgacctactatgcccagtgctaccagtacatgctggacctgcagaagcagctgggcagcttccccagcaactacctgagcaacaacaaccagacctctgtgacccctgtgcccagcgtgctgcccaatgccatcggcagcagcgccatggccagcaccagcggcctggtgatcaccagccccagcaacctgagtgacctgaaggaatgttctggcagcaggaaggcccgggtgctgtatgactatgatgctgccaacagcacagagctgagcctgctggctgatgaagtcatcaccgtcttctctgtggtgggcatggacagcgactggctgatgggagagcggggcaaccagaagggcaaggtgcccatcacctacctggagctgctgaactag

SEQ ID NO: 37967 - DNA, 2124 bp, Artificial Sequence
  Description of Artificial Sequence: Synthetic coding sequence
atggctgctgctgccacagctgctgagggcgtgcccagccggggccccccaggagaggtgatccacctgaatgtgggcggcaagcgcttcagcaccagccggcagaccctgacctggatcccagacagcttcttcagcagcctgctgagcggccgcatcagcaccctgaaggatgagaccggggccatcttcatcgaccgggaccccaccgtgtttgcccccatcctgaacttcctgcggaccaaggagctggacccccggggcgtgcacggcagcagcctgctgcacgaggcccagttctacggcctgacccccctggtgcggcggctgcagctgcgggaggagctggacaggagcagctgtggaaatgtgctcttcaacggctacctgcccccacctgtgtttcctgtgaagagaagaaacagacacagcctggtgggcccccagcagctgggcggccgcccagcccctgtgagaagaagcaacaccatgccacccaacctgggcaatgccggcctgctgggccgcatgctggatgagaagaccccacccagccccagcggccagcctgaggagcccggcatggtgcggctggtgtgtggccaccacaactggattgctgtggcctacacccagttcctggtgtgctaccgcctgaaggaggccagcggctggcagctggtgttcagcagcccccggctggactggcccatcgagcggctggccctgacagcccgggtgcacggcggggccctgggggagcatgacaagatggtggccgccgccactggaagtgagatcctgctgtgggccctgcaggccgagggcggcggcagcgagattggagtcttccacctgggcgtgcctgtggaggccctcttctttgtgggcaaccagctgattgccaccagccacactggaagaattggagtgtggaatgctgtgaccaagcactggcaggtgcaggaggtgcagcccatcaccagctatgatgctgctggcagcttcctgctgctgggctgcaacaacggcagcatctactacgtggatgtgcagaagttccccctgaggatgaaggacaatgacctgctggtgtctgagctgtacagagatcctgcagaagatggagtgacagccctgtctgtgtacctgacccccaagaccagtgacagcggcaactggattgaaattgcctacggcaccagcagtggaggagtgcgggtgattgtgcagcaccctgagaccgtgggcagcggcccccagctgttccagaccttcaccgtgcacaggagccctgtgaccaagatcatgctgtctgagaagcacctgatctctgtgtgtgccgacaacaaccacgtgaggacctggagcgtgacccgcttccggggcatgatcagcacccagcccggcagcacccccctggccagcttcaagatcctggccctggagagcgcagatggccacggcggctgcagcgctggaaatgacatcggcccctacggggagagagatgaccagcaggtgttcatccagaaggtggtgcccagcgccagccagctgtttgtgcggctgagcagcacaggccagagggtgtgcagcgtgcgctctgtggatggcagccccaccacagccttcaccgtgctggagtgtgagggcagccggcggctgggcagccggccccggcgctacctgctgaccggccaggccaacggcagcctggccatgtgggacctgaccacagccatggatggcctgggccaggccccagctgggggcctgacagagcaggagctgatggagcagctggagcactgtgagctggcccccccagcccccagcgcccccagctggggctgcctgcccagccccagcccccgcatcagcctgaccagcctgcacagcgccagcagcaacaccagcctgagcggccaccggggcagccccagccccccccaggccgaggccaggagaagaggaggcggcagctttgtggagcgctgccaggagctggtgcgcagcggccctgacctgcggcggccccccaccccagccccctggcccagcagcggcctgggcacccccctgaccccacccaagatgaagctgaatgagaccagcttctag

SEQ ID NO: 37968 - DNA, 1464 bp, Artificial Sequence
  Description of Artificial Sequence: Synthetic coding sequence
atgccacccaacctgggcaatgccggcctgctgggccgcatgctggatgagaagaccccacccagccccagcggccagcctgaggagcccggcatggtgcggctggtgtgtggccaccacaactggattgctgtggcctacacccagttcctggtgtgctaccgcctgaaggaggccagcggctggcagctggtgttcagcagcccccggctggactggcccatcgagcggctggccctgacagcccgggtgcatggaggagccctgggggagcatgacaagatggtggccgccgccaccggcagcgagatcctgctgtgggccctgcaggccgagggcggcggcagcgagattggagtcttccacctgggcgtgcctgtggaggccctcttctttgtgggcaaccagctgattgccaccagccacacaggccgcatcggcgtgtggaatgctgtgaccaagcactggcaggtgcaggaggtgcagcccatcaccagctatgatgctgctggcagcttcctgctgctgggctgcaacaacggcagcatctactacgtggatgtgcagaagttccccctgaggatgaaggacaatgacctgctggtgtctgagctgtacagagatcctgcagaagatggagtgacagccctgtctgtgtacctgacccccaagaccatctgtgccgacaacaaccacgtgaggacctggagcgtgacccgcttccggggcatgatcagcacccagcccggcagcacccccctggccagcttcaagatcctggccctggagagcgcagatggccacggcggctgcagcgctggaaatgacatcggcccctacggggagagagatgaccagcaggtgttcatccagaaggtggtgcccagcgccagccagctgtttgtgcggctgagcagcacaggccagagggtgtgcagcgtgcgctctgtggatggcagccccaccacagccttcaccgtgctggagtgtgagggcagccggcggctgggcagccggccccggcgctacctgctgaccggccaggccaacggcagcctggccatgtgggacctgaccacagccatggatggcctgggccaggccccagctgggggcctgacagagcaggagctgatggagcagctggagcactgtgagctggcccccccagcccccagcgcccccagctggggctgcctgcccagccccagcccccgcatcagcctgaccagcctgcacagcgccagcagcaacaccagcctgagcggccaccggggcagccccagccccccccaggccgaggccaggagaagaggaggcggcagctttgtggagcgctgccaggagctggtgcgcagcggccctgacctgcggcggccccccaccccagccccctggcccagcagcggcctgggcacccccctgaccccacccaagatgaagctgaatgagaccagcttctag

SEQ ID NO: 37969 - DNA, 1893 bp, Artificial Sequence
  Description of Artificial Sequence: Synthetic coding sequence
atgagggagcggggccaggacagcctggccggcctggtgctgtatgtgggcctgtttggccaccctggcatgctgcaccgggccaagtacagccgcttcagaaatgaaagcatcaccagcctggatgagggcagcagcggcggctctgtgggcaacaagggcagcccccagcccccccacccagccctggccccccacctgcccacagaagatgccaccctgcccagccaggagagccccacccccctgtgcaccctcatccccaggatggcctccatgaagctggccaacccagccaccctgctgagcctgaagaacttctgcctgggcaccaaggaggtgccccggctgaagctgcaggagagccgggaccccggcagcagcggccccagcagccctgagaccagcctgagccgcagcggcacagcccccccaccccagcaggacctggtgggccaccgggccacagccctgaccccagacagctgccccctgcccggccctggagagcccaccctgcggagccggcaggacagacacttcctgcagcacctgctgggcatgggcatgaactactgtgtgcgctacatgggctgtgtggaggtgctgcagagcatgaggagcctggactttggcatgaggacccaggtgacccgggaggccatcagccggctgtgtgaggccgtgcctggggccaatggagccatcaagaagaggaagccccctgtgaagttcctgagcacagtgctgggcaagagcaacctgcagttcagcggcatgaacatcaagctgaccatcagcacctgcagcctgaccctgatgaacctggacaaccagcagatcatcgccaaccaccacatgcagagcatcagctttgccagcggcggggaccctgacaccacagattatgtggcctacgtggccaaggaccctgtgaaccagagggcctgccacatcctggagtgccacaacggcatggcccaggatgtgatcagcaccatcggccaggcctttgagctgcgcttcaagcagtacctgaagaaccccagcctgaacaccagctgtgagagcgaggaggtgcacatcgacagccacgccgaggagcgggaggaccacgagtactacaatgagatccctgggaagcagccccctgtgggcggcgtgtctgacatgaggatcaaggtgcaggccacagagcagatggcctactgccccatccagtgtgagaagctgtgctacctgcccggcaacagcaagtgcagctctgtgtatgagaactgcctggagcagagccgggccatcggaaatgtgcacccccggggcgtgcagagccagagggacaccagcctgctgaagcacacctgccgggtggacctgtttgatgacccctgctacatcaacacccaggccctgcagagcaccccaggcagcgctggcaaccagaggtctgcccagcccctgggcagcccctggcactgcggcaaggcccctgagaccgtgcagcccggggccacagcccagcctgccagcagccacagcctgccccacatcaagcagcagctgtggagcgaggagtgctaccacggcaagctgagcaggaaggctgctgagagcctgctggtgaaggatggagacttcctggtgcgggagagcgccaccagccctggccagtatgtgctgagcggcctgcagggcggccaggccaagcacctgctgctggtggaccctgagggcaaggtgaggaccaaggaccacgtgtttgacaacgtgggccacctgatccgctaccacatggacaacagcctgcccatcatcagcagcggcagcgaggtgtccctgaagcagcctgtgaggaaggacaacaacccagccctgctgcacagcaacaagtag

SEQ ID NO: 37970 - DNA, 1164 bp, Artificial Sequence
  Description of Artificial Sequence: Synthetic coding sequence
atgctgcctgccctggagcactggatccccaagttcttctccttccgcaccaggacaggcagccccctgagcctggcctgccggcagcccatcgtgggcccctgtgaccacatcatcgccaaccaccacatgcagagcatcagctttgccagcggcggggaccctgacaccacagattatgtggcctacgtggccaaggaccctgtgaaccagagggcctgccacatcctggagtgccacaacggcatggcccaggacgtcatcagcaccatcggccaggcctttgagctgcgcttcaagcagtacctgaagaaccccagcctgaacaccagctgtgagagcgaggaggtgcacatcgacagccatgctgaggagagagaagatcatgagtactacaatgagatccctgggaagcagccccctgtgggcggcgtgtctgacatgaggatcaaggtgcaggccacagagcagatggcctactgccccatccagtgtgagaagctgtgctacctgcccggcaacagcaagtgcagctctgtgtatgagaactgcctggagcagagccgggccatcggaaatgtgcacccccggggcgtgcagagccagagggacaccagcctgctgaagcacacctgccgggtggacctgtttgatgacccctgctacatcaacacccaggccctgcagagcaccccaggcagcgctggcaaccagaggtctgcccagcccctgggcagcccctggcactgtgggaaggcccctgagaccgtgcagcccggggccacagcccagcctgccagcagccacagcctgccccacatcaagcagcagctgtggagcgaggagtgctaccacggcaagctgagcaggaaggctgctgagagcctgctggtgaaggatggagacttcctggtgcgggagagcgccaccagccctggccagtatgtgctgagcggcctgcagggcggccaggccaagcacctgctgctggtggaccctgagggcaaggtgaggaccaaggaccacgtgtttgacaacgtgggccacctgatccgctaccacatggacaacagcctgcccatcatcagcagcggcagcgaggtgtccctgaagcagcctgtgaggaaggacaacaacccagccctgctgcacagcaacaagtag

SEQ ID NO: 37971 - DNA, 888 bp, Artificial Sequence
  Description of Artificial Sequence: Synthetic coding sequence
atgtggggcgcccggcgcagctctgtgagcagctcctggaatgctgccagcctgctgcagctgctgctggccgccctgctggccgccggggcccgggccagcggggagtactgccacggctggctggatgcccagggcgtgtggagaattggcttccagtgcccagagagatttgatggaggagatgccaccatctgctgcggcagctgtgccctgcgctactgctgcagcagcgctgaggcccggctggaccagggcggctgtgacaatgaccggcagcagggcgctggggagcccggccgggctgacaaggatggcccagatggcagcgctgtgcccatctacgtgcccttcctgattgtgggctctgtgtttgtggccttcatcatcctgggcagcctggtggccgcctgctgctgccgctgcctgcggcccaagcaggacccccagcagagccgggcccctgggggcaaccggctgatggagaccatccccatgatccccagcgccagcaccagccggggcagcagcagccggcagagcagcacagctgccagcagcagcagcagcgccaacagcggggcccgggccccacccaccaggagccagaccaactgctgcctgcctgagggcaccatgaacaacgtgtatgtgaacatgcccaccaacttctctgtgctgaactgccagcaggccacccagatcgtgccccaccagggccagtacctgcaccccccctacgtgggctacacagtgcagcacgacagcgtgcccatgacagctgtgccccccttcatggatggcctgcagcccggctaccggcagatccagagccccttcccccacaccaacagcgagcagaagatgtacccagctgtgacagtgtag

SEQ ID NO: 37972 - DNA, 717 bp, Artificial Sequence
  Description of Artificial Sequence: Synthetic coding sequence
atgagggccctgctggccctgtgcctgctgctgggctggctgcgctggggccctgctggggcccagcagagcggggagtactgccacggctgggtggatgtgcagggcaactaccacgagggcttccagtgcccagaggactttgacaccctggatgccaccatctgctgcggcagctgtgccctgcgctactgctgtgccgctgctgatgcccggctggagcagggcggctgcaccaatgaccggcgggagctggagcaccctggcatcacagcccagcctgtgtatgtgcccttcctgattgtgggcagcatcttcatcgccttcatcatcctgggctctgtggtggccatctactgctgcacctgcctgcggcccaaggagcccagccagcagcccatccgcttcagcctgcggagctaccagacagagaccctgcccatgatcctgaccagcaccagcccccgggcccccagccggcagagcagcacagccaccagcagcagcagcactggaggcagcatccgccgcttctcctttgcccgggcagagcccggctgcctggtgcccagccccccaccaccctacaccaccagccacagcatccacctggcccagcccagcggcttcctggtgagcccccagtactttgcctaccccctgcagcaggagccccccctgcccgggaagagctgcccagacttcagcagcagctag

SEQ ID NO: 37973 - DNA, 594 bp, Artificial Sequence
  Description of Artificial Sequence: Synthetic coding sequence
atgcccccagctggcctgcggcgggccgcccccctgacagccatcgccctgctggtgctgggcgcccccctggtgctggccggggaggactgcctgtggtacctggacagaaatggctcctggcaccctggcttcaactgtgagttcttcaccttctgctgcggcacctgctaccaccgctactgctgccgggacctgaccctgctgatcacagagcggcagcagaagcactgcctggccttcagccccaagaccatcgccggcatcgccagcgctgtgatcctgtttgtggccgtggtggccaccaccatctgctgcttcctgtgcagctgctgctacctgtacagaagacggcagcagctgcagagcccctttgagggccaggagatccccatgacaggcatccctgtgcagcctgtgtacccctacccccaggaccccaaggccggccctgccccaccccagcccggcttcatctacccaccttctggccctgccccccagtaccccctgtacccagctggcccccctgtgtacaacccagctgcccccccaccctacatgccaccccagcccagctacccaggggcctag

SEQ ID NO: 37974 - DNA, 1503 bp, Artificial Sequence
  Description of Artificial Sequence: Synthetic coding sequence
atggccctgcggcggctgctgctgctgctgctgctgagcctggagagcctggacctgctgcccagcgtgcacggggcccggggccgggccgccaacagaaccctgtctgctggaggagctgctgtgggcggcagaagagctggaggagccctggcccggggcggccgggagctgaatggaacagcccgggcccctggcatccctgaggccggcagcagaagaggccagcctgctgctgctgtggccgccgccgccagcgctgctgtgacctatgagacctgctggggctactatgatgtgtctggccagtatgacaaggagtttgagtgcaacaacagcgagagcggctacctgtactgctgcggcacctgctactaccgcttctgctgcaagaagagacatgagaagctggaccagaggcagtgcaccaactaccagagccctgtgtgggtgcagacccccagcaccaaggtggtgtccccaggccctgagaacaagtatgaccctgagaaggacaagaccaacttcaccgtgtacatcacctgtggggtgattgcctttgtgattgtggccggcgtgtttgccaaggtgtcctatgacaaggcccacaggcctccccgggagatgaacatccaccgggccctggccgacatcctgcggcagcagggccccatccccatcgcccactgtgagcgggagaccatcagcgccatcgacaccagccccaaggagaacacccctgtgcgcagcagcagcaagaaccactacacccctgtgaggacagccaagcagaccccagagaagcccaggatgaacaacatcctgaccagcgccacagagccctatgacctgtccttcagccgctccttccagaacctggcccacctgcccccatcctatgagagcgctgtgaagaccaaccccagcaagtacagcagcctgaagaggctgacagacaaggaggctgatgagtactacatgagaagaagacacctgcctgacctggccgcccggggcaccctgcccctgaatgtcatccagatgagccagcagaagcccctgccccgggagcggccccggcggcccatccgggccatgagccaggacagagtgctgagcccagaccggggcctgcctgatgagttctccatgccctatgaccgcatcctgagtgatgagcagctgctgagcacagagcggctgcacagccaggaccccctgctgagccctgagaggacagccttccctgagcagagcctgagccgggccatcagccacacagatgtgtttgtgtccacccctgtgctggaccgctacaggatgagcaagatgcacagccaccccagcgccagcaacaacagctatgccaccctgggccagagccagacagctgccaagagacatgcctttgccagcagaagacacaacacagtggagcagctgcactacatccctggccaccacacctgctacacagccagcaagacagaggtgacagtgtag

SEQ ID NO: 37975 - DNA, 1599 bp, Artificial Sequence
  Description of Artificial Sequence: Synthetic coding sequence
atggccctgcggcggctgctgctgctgctgctgctgagcctggagagcctggacctgctgcccagcgtgcacggggcccggggccgggccgccaacagaaccctgtctgctggaggagctgctgtgggcggcagaagagctggaggagccctggcccggggcggccgggagctgaatggaacagcccgggcccctggcatccctgaggccggcagcagaagaggccagcctgctgctgctgtggccgccgccgccagcgctgctgtgacctatgagacctgctggggctactatgatgtgtctggccagtatgacaaggagtttgagtgcaacaacagcgagagcggctacctgtactgctgcggcacctgctactaccgcttctgctgcaagaagagacatgagaagctggaccagaggcagtgcaccaactaccagagccctgtgtgggtgcagacccccagcaccaaggtggtgtccccaggccctgagaacaagtatgaccctgagaaggacaagaccaacttcaccgtgtacatcacctgtggggtgattgcctttgtgattgtggccggcgtgtttgccaaggtgtcctatgacaaggcccacaggcctccccgggagatgaacatccaccgggccctggccgacatcctgcggcagcagggccccatccccatcgcccactgtgagcgggagaccatcagcgccatcgacaccagccccaaggagaacacccctgtgcgcagcagcagcaagaaccactacacccctgtgaggacagccaagcagaccccaggccactacggcaaggatgcctaccgcagcggcggccctgacctgcacaacttcatcagcagcggctttgtgaccctgggccggggccacaccaaggagaagcccaggatgaacaacatcctgaccagcgccacagagccctatgacctgtccttcagccgctccttccagaacctggcccacctgcccccatcctatgagagcgctgtgaagaccaaccccagcaagtacagcagcctgaagaggctgacagacaaggaggctgatgagtactacatgagaagaagacacctgcctgacctggccgcccggggcaccctgcccctgaatgtcatccagatgagccagcagaagcccctgccccgggagcggccccggcggcccatccgggccatgagccaggacagagtgctgagcccagaccggggcctgcctgatgagttctccatgccctatgaccgcatcctgagtgatgagcagctgctgagcacagagcggctgcacagccaggaccccctgctgagccctgagaggacagccttccctgagcagagcctgagccgggccatcagccacacagatgtgtttgtgtccacccctgtgctggaccgctacaggatgagcaagatgcacagccaccccagcgccagcaacaacagctatgccaccctgggccagagccagacagctgccaagagacatgcctttgccagcagaagacacaacacagtggagcagctgcactacatccctggccaccacacctgctacacagccagcaagacagaggtgacagtgtag

SEQ ID NO: 37976 - DNA, 1656 bp, Artificial Sequence
  Description of Artificial Sequence: Synthetic coding sequence
atggccctgcggcggctgctgctgctgctgctgctgagcctggagagcctggacctgctgcccagcgtgcacggggcccggggccgggccgccaacagaaccctgtctgctggaggagctgctgtgggcggcagaagagctggaggagccctggcccggggcggccgggagctgaatggaacagcccgggcccctggcatccctgaggccggcagcagaagaggccagcctgctgctgctgtggccgccgccgccagcgctgctgtgacctatgagacctgctggggctactatgatgtgtctggccagtatgacaaggagtttgagtgcaacaacagcgagagcggctacctgtactgctgcggcacctgctactaccgcttctgctgcaagaagagacatgagaagctggaccagaggcagtgcaccaactaccagagccctgtgtgggtgcagacccccagcaccaaggtggtgtccccaggccctgagaacaagtatgaccctgagaaggacaagaccaacttcaccgtgtacatcacctgtggggtgattgcctttgtgattgtggccggcgtgtttgccaaggtgtcctatgacaaggcccacaggcctccccgggagatgaacatccaccgggccctggccgacatcctgcggcagcagggccccatccccatcgcccactgtgagcgggagaccatcagcgccatcgacaccagccccaaggagaacacccctgtgcgcagcagcagcaagaaccactacacccctgtgaggacagccaagcagaccccaggccactacggcaaggatgcctaccgcagcggcggccctgacctgcacaacttcatcagcagcggctttgtgaccctgggccggggccacaccaagggggaccaccagtacaaccaccccatcctgagctctgtgacccagatcccccctcatgagaagcccaggatgaacaacatcctgaccagcgccacagagccctatgacctgtccttcagccgctccttccagaacctggcccacctgccccccagctatgaatctgctgtgaagaccaaccccagcaagtacagcagcctgaagaggctgacagacaaggaggctgatgagtactacatgagaagaagacacctgcctgacctggccgcccggggcaccctgcccctgaatgtcatccagatgagccagcagaagcccctgccccgggagcggccccggcggcccatccgggccatgagccaggacagagtgctgagcccagaccggggcctgcctgatgagttctccatgccctatgaccgcatcctgagtgatgagcagctgctgagcacagagcggctgcacagccaggaccccctgctgagccctgagaggacagccttccctgagcagagcctgagccgggccatcagccacacagatgtgtttgtgtccacccctgtgctggaccgctacaggatgagcaagatgcacagccaccccagcgccagcaacaacagctatgccaccctgggccagagccagacagctgccaagagacatgcctttgccagccgccgccacaacacagtggagcagctgcactacatccctggccaccacacctgctacacagccagcaagacagaggtgacagtgtag

SEQ ID NO: 37977 - DNA, 930 bp, Artificial Sequence
  Description of Artificial Sequence: Synthetic coding sequence
atgtccttcaacctgcagagcagcaagaagctgttcatcttcctgggcaagagcctcttcagcctgctggaggccatgatctttgccctgctgcccaagcccaggaagaatgtggccggggagatcgtgctgatcaccggggccggcagcggcctgggccgcctgctggccctgcagtttgcccggctgggctctgtgctggtgctgtgggacatcaacaaggagggcaatgaggagacctgcaagatggcccgggaggccggggccaccagggtgcacgcctacacctgtgactgcagccagaaggagggcgtgtacagagtggccgaccaggtgaagaaggaggtgggagatgtgtccatcctgatcaacaatgccggcatcgtgacaggcaagaagttcctggactgcccagatgagctgatggagaagagctttgatgtgaacttcaaggcccacctgtggacctacaaggccttcctgcctgccatgattgccaatgaccacggccacctggtgtgcatcagcagcagcgctggcctgagcggcgtgaatggcctggccgactactgtgccagcaagtttgctgccttcggctttgctgagagcgtgtttgtggagacctttgtgcagaagcagaagggcatcaagaccaccatcgtgtgccccttcttcatcaagacaggcatgtttgagggctgcaccaccggctgccccagcctgctgcccatcctggagcccaagtatgctgtggagaagatcgtggaggccatcctgcaggagaagatgtacctgtacatgcccaagctgctgtacttcatgatgttcctgaagagcttcctgcccctgaagacaggcctgctgattgctgactacctgggcatcctgcacgccatggatggctttgtggaccagaagaagaagctgtag

SEQ ID NO: 37978 - DNA, 798 bp, Artificial Sequence
  Description of Artificial Sequence: Synthetic coding sequence
atgtccttcaacctgcagagcagcaagaagctgttcatcttcctgggcaagagcctcttcagcctgctggaggccatgatctttgccctgctgcccaagcccaggaagaatgtggccggggagatcgtgctgatcaccggggccggcagcggcctgggccgcctgctggccctgcagtttgcccggctgggctctgtgctggtgctgtgggacatcaacaaggagggcaatgaggagacctgcaagatggcccgggaggccggggccaccagggtgcacgcctacacctgtgactgcagccagaaggagggcgtgtacagagtggccgaccagacctacaaggccttcctgcctgccatgattgccaatgaccacggccacctggtgtgcatcagcagcagcgctggcctgagcggcgtgaatggcctggccgactactgtgccagcaagtttgctgccttcggctttgctgagagcgtgtttgtggagacctttgtgcagaagcagaagggcatcaagaccaccatcgtgtgccccttcttcatcaagacaggcatgtttgagggctgcaccaccggctgccccagcctgctgcccatcctggagcccaagtatgctgtggagaagatcgtggaggccatcctgcaggagaagatgtacctgtacatgcccaagctgctgtacttcatgatgttcctgaagagcttcctgcccctgaagacaggcctgctgattgctgactacctgggcatcctgcacgccatggatggctttgtggaccagaagaagaagctgtag

SEQ ID NO: 37979 - DNA, 693 bp, Artificial Sequence
  Description of Artificial Sequence: Synthetic coding sequence
atgtccttcaacctgcagagcagcaagaagctgttcatcttcctgggcaagagcctcttcagcctgctggaggccatgatctttgccctgctgcccaagcccaggaagaatgtggccggggagatcgtgctgatcaccggggccggcagcggcctgggccgcctgctggccctgcagtttgcccggctgggctctgtgctggtgctgtgggacatcaacaaggagggcaatgaggagacctgcaagatggcccgggaggccggggccaccagggtgcacgcctacacctgtgactgcagccagaaggagggcgtgtacagagtggccgaccaggtgaagaaggaggtgggagatgtgtccatcctgatcaacaatgccggcatcgtgacaggcaagaagttcctggactgcccagatgagctgatggagaagagctttgatgtgaacttcaaggcccacctgtggacctacaaggccttcctgcctgccatgattgccaatgaccacggccacctggtgtgcatcagcagcagcgctggcctgagcggcgtgaatggcctggccgactactgtgccagcaagtttgctgccttcggctttgctgagagcgtgtttgtggagacctttgtgcagaagcagaagggcatcaagaccaccatcgtgtgccccttctacaagaactggaatgtgtag

SEQ ID NO: 37980 - DNA, 1182 bp, Artificial Sequence
  Description of Artificial Sequence: Synthetic coding sequence
atggaccccaagaggagccagaaggagagcgtgctgatcaccggcggcagcggctacttcggcttccggctgggctgtgccctgaaccagaatggagtgcacgtgatcctgtttgacatcagcagccctgcccagaccatccctgagggcatcaagttcatccagggcgacatccgccacctgagtgatgtggagaaggccttccaggatgctgatgtgacctgtgtgttccacatcgccagctatggcatgagcggccgggagcagctgaacagaaacctgatcaaggaggtgaatgtgcggggcacagacaacatcctgcaggtgtgccagaggagaagagtgccccggctggtgtacaccagcaccttcaacgtcatctttggaggccaggtgatcagaaatggagatgagagcctgccctacctgcccctgcacctgcacccagaccactacagcaggaccaagagcattgctgagcagaaggtgctggaggccaatgccacccccctggacagaggagatggagtgctgcggacctgtgccctgcggcctgctggcatctacggccctggagagcagaggcacctgccccgcatcgtgtcctacatcgagaagggcctcttcaagtttgtgtatggagaccccaggagcctggtggagtttgtgcacgtggacaacctggtgcaggcccacatcctggccagcgaggccctgcgggctgacaagggccacatcgccagcggccagccctacttcatcagtgatggccggcctgtgaacaactttgagttcttccggcccctggtggagggcctgggctacaccttccccagcacccggctgcccctgaccctggtgtactgctttgccttcctgacagagatggtgcacttcatcctgggccgcctgtacaacttccagcccttcctgaccaggacagaggtgtacaagacaggagtgacccactacttcagcctggagaaggccaagaaggagctgggctacaaggcccagccctttgacctgcaggaggccgtggagtggttcaaggcccacggccacggccgcagcagcggcagccgggacagtgaatgttttgtgtgggatggcctgctggtgttcctgctgatcatcgctgtgctgatgtggctgcccagcagcgtcatcctgagcctgtag

SEQ ID NO: 37981 - DNA, 369 bp, Artificial Sequence
  Description of Artificial Sequence: Synthetic coding sequence
atggatggcagcaggaaggaggaggaggaggacagcaccttcaccaacatcagcctggctgatgacatcgaccacagcagccgcatcctgtacccccggcccaagagcctgctgcccaagatgatgaatgctgacatggatgctgtggatgctgagaaccaggtggagctggaggagaagaccaggctcatcaaccaggtgctggagctgcagcacaccctggaggacctgagcgcccgggtggatgctgtgaaggaggagaacctgaagctgaagtctgagaaccaggtgctgggccagtacatcgagaacctgatgtctgccagcagcgtcttccagaccacagacaccaagagcaagaggaagtag

SEQ ID NO: 37982 - DNA, 480 bp, Artificial Sequence
  Description of Artificial Sequence: Synthetic coding sequence
atgagaagaagagtcttcagcagccaggactggagggccagcggctgggatggcatgggcttcttcagcaggaggaccttctgtggccgcagcggccgcagctgccggggccagctggtgcaggtgtccaggcctgaggtgtctgctggcagcctgctgctgcctgccccccaggccgaggaccacagcagccgcatcctgtacccccggcccaagagcctgctgcccaagatgatgaatgctgacatggatgctgtggatgctgagaaccaggtggagctggaggagaagaccaggctcatcaaccaggtgctggagctgcagcacaccctggaggacctgagcgcccgggtggatgctgtgaaggaggagaacctgaagctgaagtctgagaaccaggtgctgggccagtacatcgagaacctgatgtctgccagctctgtgttccagaccacagacaccaagagcaagaggaagtag

SEQ ID NO: 37983 - DNA, 369 bp, Artificial Sequence; identical to SEQ ID NO: 37981
  Description of Artificial Sequence: Synthetic coding sequence

SEQ ID NO: 37984 - DNA, 369 bp, Artificial Sequence; identical to SEQ ID NO: 37981
  Description of Artificial Sequence: Synthetic coding sequence

SEQ ID NO: 37985 - DNA, 396 bp, Artificial Sequence
  Description of Artificial Sequence: Synthetic coding sequence
atgagaagaagagtcttcagcagccaggactggagggccagcggctgggatggcatgggcttcttcagcaggaggaccttctgtggccgcagcggccgcagctgccggggccagctggtgcaggtgtccaggcctgaggtgtctgctggcagcctgctgctgcctgccccccaggccgaggaccacagcagccgcatcctgtacccccggcccaagagcctgctgcccaagatgatgaatgctgacatggatgacctgagcgcccgggtggatgctgtgaaggaggagaacctgaagctgaagtctgagaaccaggtgctgggccagtacatcgagaacctgatgtctgccagctctgtgttccagaccacagacaccaagagcaagaggaagtag

SEQ ID NO: 37986 - DNA, 1191 bp, Artificial Sequence
  Description of Artificial Sequence: Synthetic coding sequence
atgctgcccctgctgctgctgcccctgctgtggggcggcagcctgcaggagaagcctgtgtatgagctgcaggtgcagaagtctgtgacagtgcaggagggcctgtgtgtgctggtgccctgcagcttctcctacccctggaggtcctggtacagcagcccccccctgtatgtgtactggttcagagatggagagatcccctactatgcagaggtggtggccaccaacaacccagaccggcgggtgaagccagagacccagggccgcttccggctgctgggagatgtgcagaagaagaactgcagcctgagcattggagatgccaggatggaggacaccggcagctacttcttccgggtggagcggggcagagatgtgaagtacagctaccagcagaacaagctgaacctggaggtgacagccctgattgagaagccagacatccacttcctggagcccctggagagcggccggcccacccggctgagctgcagcctgcccggcagctgtgaggccggcccccccctgaccttctcctggacaggaaatgccctgagccccctggaccctgagaccaccaggagcagcgagctgaccctgacccccaggccagaagatcatggcaccaacctgacctgccaggtgaagaggcagggcgcccaggtgaccacagagaggacagtgcagctgaatgtgtcctatgccccccagaacctggccatcagcatcttcttcagaaatggaactggaacagccctgcgcatcctgagcaatggcatgtctgtgcccatccaggagggccagagcctcttcctggcctgcaccgtggacagcaaccccccagccagcctgtcctggttccgggagggcaaggccctgaaccccagccagacctccatgagcggcaccctggagctgcccaacattggagcccgggagggcggggagttcacctgccgggtgcagcaccccctgggcagccagcacctgtccttcatcctgtctgtgcagaggagcagcagcagctgcatctgtgtgacagagaagcagcagggctcctggcccctggtgctgaccctcatccggggggccctgatgggcgccggcttcctgctgacctacggcctgacctggatctactacacccgctgtggcggcccccagcagagcagagctgagaggcctggatag

SEQ ID NO: 37987 - DNA, 987 bp, Artificial Sequence
  Description of Artificial Sequence: Synthetic coding sequence
atggagaagagcatctggctgctggcctgcctggcctgggtgctgcccaccggcagctttgtgaggaccaagattgacaccacagagaacctgctgaacacagaggtgcacagcagccctgcccagcgctggagcatgcaggtgcccccagaggtgtctgctgaggccggagatgctgctgtgctgccctgcaccttcacccacccccaccgccactatgatggccccctgacagccatctggagggctggggagccctatgccggcccccaggtgttccgctgtgccgccgcccggggcagcgagctgtgccagacagccctgagcctgcacggccgcttccggctgctgggcaaccccaggagaaatgacctgagcctgcgggtggagcggctggccctggctgatgaccggcgctacttctgccgggtggagtttgctggagatgtgcatgacagatatgagagcagacatggagtgcggctgcacgtgacagctgccccccgcatcgtgaacatctctgtgctgcccagccctgcccacgccttccgggccctgtgcacagctgagggggagcccccaccagccctggcctggagcggccctgccctgggcaacagcctggccgctgtgcgcagcccccgggagggccacggccacctggtgacagctgagctgcctgccctgacccatgatggccgctacacctgcacagctgccaacagcctgggccgctctgaggcctctgtgtacctgttccgcttccacggggccagcggggccagcacagtggccctgctgctgggcgccctgggcttcaaggccctgctgctgctgggcgtgctggccgcccgggccgccaggagaagacctgagcacctggacaccccagacaccccacccaggagccaggcccaggagagcaactatgagaacctgagccagatgaaccccaggagccccccagccaccatgtgcagcccctag

SEQ ID NO: 37988 - DNA, 525 bp, Artificial Sequence
  Description of Artificial Sequence: Synthetic coding sequence
atgacagccacccgggccgccacagccagcggcagcgccccccgcatcgtgaacatctctgtgctgcccagccctgcccacgccttccgggccctgtgcacagctgagggggagcccccaccagccctggcctggagcggccctgccctgggcaacagcctggccgctgtgcgcagcccccgggagggccacggccacctggtgacagctgagctgcctgccctgacccatgatggccgctacacctgcacagctgccaacagcctgggccgctctgaggcctctgtgtacctgttccgcttccacggggccagcggggccagcacagtggccctgctgctgggcgccctgggcttcaaggccctgctgctgctgggcgtgctggccgcccgggccgccaggagaagacctgagcacctggacaccccagacaccccacccaggagccaggcccaggagagcaactatgagaacctgagccagatgaaccccaggagccccccagccaccatgtgcagcccctag

SEQ ID NO: 37989 - DNA, 1494 bp, Artificial Sequence
  Description of Artificial Sequence: Synthetic coding sequence
atgatgagcagcgctgccttcccccgctggctgcagagcatgggcgtgcccaggacccccagcaggacagtgctgtttgagcgggagaggacaggcctgacctacagagtgcccagcctgctgcctgtgcccccaggccccaccctgctggcctttgtggagcagaggctgagcccagatgacagccacgcccaccggctggtgctgcggcggggcaccctggccggcggctctgtgcgctggggcgccctgcacgtgctgggcacagctgccctggccgagcaccgctccatgaacccctgccctgtgcatgatgctggcaccggcaccgtcttcctgttcttcatcgctgtgctgggccacaccccagaggccgtgcagatcgccaccggcagaaatgctgcccggctgtgctgcgtggccagcagagatgctggcctgtcctggggcagcgcccgggacctgacagaggaggccatcggcggcgctgtgcaggactgggccacctttgctgtgggccctggccacggcgtgcagctgcccagcggccgcctgctggtgcctgcctacacctacagagtggaccggcgggagtgcttcggcaagatctgcaggaccagcccccacagctttgccttctacagtgatgaccacggccgcacctggaggtgtggcggcctggtgcccaacctgcggtctggagagtgccagctggccgctgtggatggcggccaggccggcagcttcctgtactgcaatgcccggagccccctgggcagccgggtgcaggccctgagcacagatgagggcaccagcttcctgcctgctgagcgggtggccagcctgcctgagacagcctggggctgccagggcagcatcgtgggcttccctgccccagcccccaaccggcccagagatgacagctggagcgtgggccctggcagccccctgcagccccccctgctgggccctggggtgcatgagcccccagaggaggccgctgtggacccccggggcggccaggtgcctgggggccccttcagccggctgcagcccagaggagatggcccccggcagcccggccccaggcctggggtgtctggagatgtgggctcctggaccctggccctgcccatgccctttgctgccccaccccagagccccacctggctgctgtacagccaccctgtgggcagaagagcccggctgcacatgggcatccggctgagccagagccccctggaccccaggtcctggacagagccctgggtgatctatgagggccccagcggctacagcgacctggccagcatcggccctgcccctgagggcggcctggtgtttgcctgcctgtatgagagcggggcccggaccagctatgatgagatctccttctgcaccttcagcctgcgggaggtgctggagaatgtgcctgccagccccaagccacccaacctgggggacaagccccggggctgctgctggcccagctag

SEQ ID NO: 37990 - DNA, 1455 bp, Artificial Sequence
  Description of Artificial Sequence: Synthetic coding sequence
atgggcgtgcccaggacccccagcaggacagtgctgtttgagcgggagaggacaggcctgacctacagagtgcccagcctgctgcctgtgcccccaggccccaccctgctggcctttgtggagcagaggctgagcccagatgacagccacgcccaccggctggtgctgcggcggggcaccctggccggcggctctgtgcgctggggcgccctgcacgtgctgggcacagctgccctggccgagcaccgctccatgaacccctgccctgtgcatgatgctggcactggaacagtgttcctgttcttcatcgctgtgctgggccacaccccagaggccgtgcagatcgccactggaagaaatgctgcccggctgtgctgcgtggccagcagagatgctggcctgtcctggggcagcgcccgggacctgacagaggaggccatcggcggcgctgtgcaggactgggccacctttgctgtgggccctggccatggagtgcagctgcccagcggccgcctgctggtgcctgcctacacctacagagtggacagaagagaatgttttgggaagatctgcaggaccagcccccacagctttgccttctacagtgatgaccacggccgcacctggaggtgtggcggcctggtgcccaacctgcggagcggggagtgccagctggccgctgtggatggcggccaggccggcagcttcctgtactgcaatgcccggagccccctgggcagccgggtgcaggccctgagcacagatgagggcaccagcttcctgcctgctgagcgggtggccagcctgcctgagacagcctggggctgccagggcagcatcgtgggcttccctgccccagcccccaaccggcccagagatgacagctggagcgtgggccctggcagccccctgcagccccccctgctgggccctggggtgcatgagcccccagaggaggccgctgtggacccccggggcggccaggtgcctgggggccccttcagccggctgcagcccagaggagatggcccccggcagcccggccccaggcctggggtgtctggagatgtgggctcctggaccctggccctgcccatgccctttgctgccccaccccagagccccacctggctgctgtacagccaccctgtgggccggcgggcccggctgcacatgggcatccggctgagccagagccccctggaccccaggtcctggacagagccctgggtgatctatgagggccccagcggctacagcgacctggccagcatcggccctgcccctgagggcggcctggtgtttgcctgcctgtatgaaagtggggcccggaccagctatgatgagatctccttctgcaccttcagcctgcgggaggtgctggagaatgtgcctgccagccccaagccacccaacctgggggacaagccccggggctgctgctggcccagctag

SEQ ID NO: 37991 - DNA, 1491 bp, Artificial Sequence
  Description of Artificial Sequence: Synthetic coding sequence
atgatgagcagcgctgccttcccccgctggctgtccatgggcgtgcccaggacccccagcaggacagtgctgtttgagcgggagaggacaggcctgacctacagagtgcccagcctgctgcctgtgcccccaggccccaccctgctggcctttgtggagcagaggctgagcccagatgacagccacgcccaccggctggtgctgcggcggggcaccctggccggcggctctgtgcgctggggcgccctgcacgtgctgggcacagctgccctggccgagcaccgctccatgaacccctgccctgtgcatgatgctggcactggaacagtgttcctgttcttcatcgctgtgctgggccacaccccagaggccgtgcagatcgccactggaagaaatgctgcccggctgtgctgcgtggccagcagagatgctggcctgtcctggggcagcgcccgggacctgacagaggaggccatcggcggcgctgtgcaggactgggccacctttgctgtgggccctggccatggagtgcagctgcccagcggccgcctgctggtgcctgcctacacctacagagtggacagaagagaatgttttgggaagatctgcaggaccagcccccacagctttgccttctacagtgatgaccacggccgcacctggaggtgtggcggcctggtgcccaacctgcggagcggggagtgccagctggccgctgtggatggcggccaggccggcagcttcctgtactgcaatgcccggagccccctgggcagccgggtgcaggccctgagcacagatgagggcaccagcttcctgcctgctgagcgggtggccagcctgcctgagacagcctggggctgccagggcagcatcgtgggcttccctgccccagcccccaaccggcccagagatgacagctggagcgtgggccctggcagccccctgcagccccccctgctgggccctggggtgcatgagcccccagaggaggccgctgtggacccccggggcggccaggtgcctgggggccccttcagccggctgcagcccagaggagatggcccccggcagcccggccccaggcctggggtgtctggagatgtgggctcctggaccctggccctgcccatgccctttgctgccccaccccagagccccacctggctgctgtacagccaccctgtgggccggcgggcccggctgcacatgggcatccggctgagccagagccccctggaccccaggtcctggacagagccctgggtgatctatgagggccccagcggctacagcgacctggccagcatcggccctgcccctgagggcggcctggtgtttgcctgcctgtatgaaagtggggcccggaccagctatgatgagatctccttctgcaccttcagcctgcgggaggtgctggagaatgtgcctgccagccccaagccacccaacctgggggacaagccccggggctgctgctggcccagctag

SEQ ID NO: 37992 - DNA, 1455 bp, Artificial Sequence; identical to SEQ ID NO: 37990
  Description of Artificial Sequence: Synthetic coding sequence

SEQ ID NO: 37993 - DNA, 1455 bp, Artificial Sequence; identical to SEQ ID NO: 37990
  Description of Artificial Sequence: Synthetic coding sequence

SEQ ID NO: 37994 - DNA, 783 bp, Artificial Sequence
  Description of Artificial Sequence: Synthetic coding sequence
atgggcgtgcccaggacccccagcaggacagtgctgtttgagcgggagaggacaggcctgacctacagagtgcccagcctgctgcctgtgcccccaggccccaccctgctggcctttgtggagcagaggctgagcccagatgacagccacgcccaccggctggtgctgcggcggggcaccctggccggcggctctgtgcgctggggcgccctgcacgtgctgggcacagctgccctggccgagcaccgctccatgaacccctgccctgtgcatgatgctggcactggaacagtgttcctgttcttcatcgctgtgctgggccacaccccagaggccgtgcagatcgccactggaagaaatgctgcccggctgtgctgcgtggccagcagagatgctggcctgtcctggggcagcgcccgggacctgacagaggaggccatcggcggcgctgtgcaggactgggccacctttgctgtgggccctggccatggagtgcagctgcccagcggccgcctgctggtgcctgcctacacctacagagtggacagaagagaatgttttgggaagatctgcaggaccagcccccacagctttgccttctacagtgatgaccacggccgcacctggaggtgtggcggcctggtgcccaacctgcggagcggggagtgccagctggccgctgtggatggcggccaggccggcagcttcctgtactgcaatgcccggagccccctgggcagccgggtgcaggccctgagcacagatgagggcaccagcttctag

SEQ ID NO: 37995 - DNA, 567 bp, Artificial Sequence
  Description of Artificial Sequence: Synthetic coding sequence
atgggcgtgcccaggacccccagcaggacagtgctgtttgagcgggagaggacaggcctgacctacagagtgcccagcctgctgcctgtgcccccaggccccaccctgctggcctttgtggagcagaggctgagcccagatgacagccacgcccaccggctggtgctgcggcggggcaccctggccggcggctctgtgcgctggggcgccctgcacgtgctgggcacagctgccctggccgagcaccgctccatgaacccctgccctgtgcatgatgctggcactggaacagtgttcctgttcttcatcgctgtgctgggccacaccccagaggccgtgcagatcgccactggaagaaatgctgcccggctgtgctgcgtggccagcagagatgctggcctgtcctggggcagcgcccgggacctgacagaggaggccatcggcggcgctgtgcaggactgggccacctttgctgtgggccctggccatggagtgcagctgcccagcggccgcctgctggtgcctgcctacacctacagagtggacagaagagaatgttttggatag

SEQ ID NO: 37996 - DNA, 1485 bp, Artificial Sequence
  Description of Artificial Sequence: Synthetic coding sequence
atgaagctgcaggagggccacacagtgctgctgagcctgcccctgcggctggccggcacagaaacagagcacggcggccccagctaccccttcacagacagcgccctgcgggccggggaggatggccctgacctgccccgggccctggccgccccccgggcccccccagatgacagccacgcccaccggctggtgctgcggcggggcaccctggccggcggctctgtgcgctggggcgccctgcacgtgctgggcacagctgccctggccgagcaccgctccatgaacccctgccctgtgcatgatgctggcactggaacagtgttcctgttcttcatcgctgtgctgggccacaccccagaggccgtgcagatcgccactggaagaaatgctgcccggctgtgctgcgtggccagcagagatgctggcctgtcctggggcagcgcccgggacctgacagaggaggccatcggcggcgctgtgcaggactgggccacctttgctgtgggccctggccatggagtgcagctgcccagcggccgcctgctggtgcctgcctacacctacagagtggacagaagagaatgttttgggaagatctgcaggaccagcccccacagctttgccttctacagtgatgaccacggccgcacctggaggtgtggcggcctggtgcccaacctgcggagcggggagtgccagctggccgctgtggatggcggccaggccggcagcttcctgtactgcaatgcccggagccccctgggcagccgggtgcaggccctgagcacagatgagggcaccagcttcctgcctgctgagcgggtggccagcctgcctgagacagcctggggctgccagggcagcatcgtgggcttccctgccccagcccccaaccggcccagagatgacagctggagcgtgggccctggcagccccctgcagccccccctgctgggccctggggtgcatgagcccccagaggaggccgctgtggacccccggggcggccaggtgcctgggggccccttcagccggctgcagcccagaggagatggcccccggcagcccggccccaggcctggggtgtctggagatgtgggctcctggaccctggccctgcccatgccctttgctgccccaccccagagccccacctggctgctgtacagccaccctgtgggccggcgggcccggctgcacatgggcatccggctgagccagagccccctggaccccaggtcctggacagagccctgggtgatctatgagggccccagcggctacagcgacctggccagcatcggccctgcccctgagggcggcctggtgtttgcctgcctgtatgaaagtggggcccggaccagctatgatgagatctccttctgcaccttcagcctgcgggaggtgctggagaatgtgcctgccagccccaagccacccaacctgggggacaagccccggggctgctgctggcccagctag

SEQ ID NO: 37997 - DNA, 2484 bp, Artificial Sequence
  Description of Artificial Sequence: Synthetic coding sequence
atgaggggctgcctgcggctggccctgctgtgtgccctgccctggctgctgctggccgccagccctggccacccagccaagagcccccggcagcccccagccccccggcgggacccctttgatgctgcccggggagctgactttgaccacgtgtacagcggcgtggtgaacctgagcacagagaacatctacagcttcaactacaccagccagcctgaccaggtgacagctgtgcgggtgtatgtgaacagcagcagcgagaacctgaactaccctgtgctggtggtggtgcggcagcagaaggaggtgctgtcctggcaggtgcccctgctcttccagggcctgtaccagaggagctacaactaccaggaggtgtccaggaccctgtgccccagcgaggccaccaatgagaccggccccctgcagcagctgatctttgtggatgtggcctccatggcccccctgggcgcccagtacaagctgctggtgaccaagctgaagcacttccagctgcggaccaacgtggccttccacttcaccgccagccccagccagccccagtacttcctgtacaagttccccaaggatgtggacagcgtcatcatcaaggtggtgtctgagatggcctacccctgcagcgtggtgtctgtgcagaacatcatgtgccctgtgtatgacctggaccacaacgtggagttcaacggggtgtaccagagcatgaccaagaaggccgccatcaccctgcagaagaaggacttccctggagagcagttctttgtggtgtttgtgatcaagccagaagattatgcctgtggcggcagcttcttcatccaggagaaggagaaccagacctggaacctgcagaggaagaagaacctggaggtgaccatcgtgcccagcatcaaggagagcgtgtatgtgaagagcagcctcttctctgtgttcatcttcctgtccttctacctgggctgcctgctggtgggctttgtgcactacctgcgcttccagaggaagagcattgatggcagctttggcagcaatgatggcagcggcaacatggtggccagccaccccatcgccgccagcaccccagagggcagcaactacggcaccattgatgagagcagcagcagccctggccggcagatgagcagcagtgatggcggccccccaggccagagcgacacagacagctctgtggaggagagtgactttgacaccatgccagacattgaaagtgacaagaacatcatccgcaccaagatgttcctgtacctgagtgacctgagcaggaaggaccggcgcatcgtgtccaagaagtacaagatctacttctggaacatcatcaccatcgctgtgttctacgccctgcccgtcatccagctggtgatcacctaccagacagtggtgaatgtgactggaaaccaggacatctgctactacaacttcctgtgtgcccaccccctgggcgtgctgagcgccttcaacaacatcctgagcaacctgggccacgtgctgctgggcttcctgttcctgctgattgtgctgcggcgggacatcctgcacagaagagccctggaggccaaggacatctttgctgtggagtatggcatccccaagcacttcggcctcttctacgccatgggcatcgccctgatgatggagggcgtgctgagcgcctgctaccacgtgtgccccaactacagcaacttccagtttgacaccagcttcatgtacatgattgctggcctgtgcatgctgaagctgtaccagaccaggcacccagacatcaatgccagcgcctacagcgcctatgccagctttgctgtggtgatcatggtgacagtgctgggcgtggtgtttgggaagaatgatgtgtggttctgggtgatcttcagcgccatccacgtgctggccagcctggccctgagcacccagatctactacatgggccgcttcaagattgacctgggcatcttcagaagagctgccatggtgttctacacagactgcatccagcagtgcagccggcccctgtacatggacaggatggtgctgctggtggtgggcaacctggtgaactggagctttgccctgtttggcctcatctaccggccccgggactttgccagctacatgctgggcatcttcatctgcaacctgctgctgtacctggccttctacatcatcatgaagctgcggagcagcgagaaggtgctgcctgtgcccctcttctgcatcgtggccacagctgtgatgtgggccgccgccctgtacttcttcttccagaacctgagctcctgggagggcaccccagctgagagccgggagaagaaccgggagtgcatcctgctggacttctttgatgaccatgacatctggcacttcctgagcgccacagccctcttcttctccttcctggtgctgctgaccctggatgatgacctggatgtggtgcggcgggaccagatccctgtgttctag

SEQ ID NO: 37998 - DNA, 2499 bp, Artificial Sequence
  Description of Artificial Sequence: Synthetic coding sequence
atgaggggctgcctgcggctggccctgctgtgtgccctgccctggctgctgctggccgccagccctggccacccagccaagagcccccggcagcccccagccccccggcgggacccctttgatgctgcccggggagctgactttgaccacgtgtacagcggcgtggtgaacctgagcacagagaacatctacagcttcaactacaccagccagcctgaccaggtgacagctgtgcgggtgtatgtgaacagcagcagcgagaacctgaactaccctgtgctggtggtggtgcggcagcagaaggaggtgctgtcctggcaggtgcccctgctcttccagggcctgtaccagaggagctacaactaccaggaggtgtccaggaccctgtgccccagcgaggccaccaatgagaccggccccctgcagcagctgatctttgtggatgtggcctccatggcccccctgggcgcccagtacaagctgctggtgaccaagctgaagcacttccagctgcggaccaacgtggccttccacttcaccgccagccccagccagccccagtacttcctgtacaagttccccaaggatgtggacagcgtcatcatcaaggtggtgtctgagatggcctacccctgcagcgtggtgtctgtgcagaacatcatgtgccctgtgtatgacctggaccacaacgtggagttcaacggggtgtaccagagcatgaccaagaaggccgccatcaccctgcagaagaaggacttccctggagagcagttctttgtggtgtttgtgatcaagccagaagattatgcctgtggcggcagcttcttcatccaggagaaggagaaccagacctggaacctgcagaggaagaagaacctggaggtgaccatcgtgcccagcatcaaggagagcgtgtatgtgaagagcagcctcttctctgtgttcatcttcctgtccttctacctgggctgcctgctggtgggctttgtgcactacctgcgcttccagaggaagagcattgatggcagctttggcagcaatgatggcagcggcaacatggtggccagccaccccatcgccgccagcaccccagagggcagcaactacggcaccattgatgagagcagcagcagccctggccggcagatgagcagcagtgatggcggccccccaggccagagcgacacagacagctctgtggaggagagtgactttgacaccatgccagacattgaaagtgacaagaacatcatccgcaccaagatgttcctgtacctgagtgacctgagcaggaaggaccggcgcatcgtgtccaagaagtacaagatctacttctggaacatcatcaccatcgctgtgttctacgccctgcccgtcatccagctggtgatcacctaccagacagtggtgaatgtgactggaaaccaggacatctgctactacaacttcctgtgtgcccaccccctgggcgtgctgagcgccttcaacaacatcctgagcaacctgggccacgtgctgctgggcttcctgttcctgctgattgtgctgcggcgggacatcctgcacagaagagccctggaggccaaggacatctttgctgtggagtatggcatccccaagcacttcggcctcttctacgccatgggcatcgccctgatgatggagggcgtgctgagcgcctgctaccacgtgtgccccaactacagcaacttccagtttgacaccagcttcatgtacatgattgctggcctgtgcatgctgaagctgtaccagaccaggcacccagacatcaatgccagcgcctacagcgcctatgccagctttgctgtggtgatcatggtgacagtgctgggcgtggtgtttgggaagaatgatgtgtggttctgggtgatcttcagcgccatccacgtgctggccagcctggccctgagcacccagatctactacatgggccgcttcaagatcgccatcacccccacagacctgggcatcttccggcgggccgccatggtgttctacacagactgcatccagcagtgcagccggcccctgtacatggacaggatggtgctgctggtggtgggcaacctggtgaactggagctttgccctgtttggcctcatctaccggccccgggactttgccagctacatgctgggcatcttcatctgcaacctgctgctgtacctggccttctacatcatcatgaagctgcggagcagcgagaaggtgctgcctgtgcccctcttctgcatcgtggccacagctgtgatgtgggccgccgccctgtacttcttcttccagaacctgagctcctgggagggcaccccagctgagagccgggagaagaaccgggagtgcatcctgctggacttctttgatgaccatgacatctggcacttcctgagcgccacagccctcttcttctccttcctggtgctgctgaccctggatgatgacctggatgtggtgagaagagaccagatccctgtgttctag

SEQ ID NO: 37999 - DNA, 2568 bp, Artificial Sequence
  Description of Artificial Sequence: Synthetic coding sequence
atgtttgccctgggcctgcccttcctggtgctgctggtggcctctgtggagagccacctgggcgtgctgggccccaagaatgtgtcccagaaggatgctgagtttgagaggacctacgtggatgaggtgaacagcgagctggtgaacatctacaccttcaaccacacagtgaccaggaacagaacagagggcgtgcgggtgtctgtgaatgtgctgaacaagcagaagggggcccccctgctgtttgtggtgcggcagaaggaggccgtggtgtccttccaggtgcccctcatcctgcggggcatgttccagaggaagtacctgtaccagaaggtggagaggaccctgtgccagccccccaccaagaatgaaagtgagatccagttcttctacgtggatgtgtccaccctgagccctgtgaacaccacctaccagctgcgggtgtccaggatggatgactttgtgctgaggactggagagcagttctccttcaacaccacagctgcccagccccagtacttcaagtatgagttccctgagggcgtggacagcgtcatcgtgaaggtgaccagcaacaaggccttcccctgcagcgtcatcagcatccaggatgtgctgtgccctgtgtatgacctggacaacaacgtggccttcatcggcatgtaccagaccatgaccaagaaggccgccatcaccgtgcagaggaaggacttccccagcaacagcttctacgtggtggtggtggtgaagacagaggaccaggcctgtggcggcagcctgcccttctacccctttgctgaagatgagcctgtggaccagggccaccggcagaagaccctgtctgtgctggtgtcccaggccgtgaccagcgaggcctacgtgtctggcatgctgttctgcctgggcatcttcctgtccttctacctgctgactgtgctgctggcctgctgggagaactggaggcagaagaagaagaccctgctggtggccatcgaccgggcctgcccagagagcggccacccccgggtgctggccgacagcttccctggcagcagcccctatgagggctacaactacggcagctttgaaaatgtgtctggcagcacagatggcctggtggacagcgctggcaccggggacctgtcctatggctaccagggccatgaccagttcaagaggcggctgcccagcggccagatgaggcagctgtgcatcgccatgggccgcagctttgagcctgtgggcacccggccccgggtggacagcatgagctctgtggaggaggatgattatgacaccctgacagacatcgacagcgacaagaatgtcatccgcaccaagcagtacctgtatgtggccgacctggccaggaaggacaagagggtgctgaggaagaagtaccagatctacttctggaacatcgccaccatcgctgtgttctacgccctgcctgtggtgcagctggtgatcacctaccagacagtggtgaatgtgactggaaaccaggacatctgctactacaacttcctgtgtgcccaccccctgggcaacctgagcgccttcaacaacatcctgagcaacctgggctacatcctgctgggcctgctcttcctgctgatcatcctgcagcgggagatcaaccacaacagagccctgctgagaaatgacctgtgtgccctggagtgtggcatccccaagcacttcggcctcttctacgccatgggcacagccctgatgatggagggcctgctgagcgcctgctaccacgtgtgccccaactacaccaacttccagtttgacaccagcttcatgtacatgattgctggcctgtgcatgctgaagctgtaccagaagaggcacccagacatcaatgccagcgcctacagcgcctatgcctgcctggccatcgtcatcttcttctctgtgctgggcgtggtgtttggaaaaggaaacacagccttctggatcgtgttcagcatcatccacatcatcgccaccctgctgctgagcacccagctgtactacatgggccgctggaagctggacagcggcatcttccgccgcatcctgcacgtgctgtacacagactgcatccggcagtgcagcggccccctgtatgtggacaggatggtgctgctggtgatgggaaatgtcatcaactggagcctggccgcctacggcctcatcatgaggcccaatgactttgccagctacctgctggccatcggcatctgcaacctgctgctgtactttgccttctacatcatcatgaagctgcggtctggagagcgcatcaagctgatccccctgctgtgcatcgtgtgcacctctgtggtgtggggctttgccctcttcttcttcttccagggcctgagcacctggcagaagaccccagctgagagccgggagcacaacagagactgcatcctgctggacttctttgatgaccatgacatctggcacttcctgagcagcatcgccatgtttggcagcttcctggtgtctggccccccaggccgggccggctgggtgcgggagggcagcagctgcctgctgctgtgtggctag

SEQ ID NO: 38000 - DNA, 2499 bp, Artificial Sequence
  Description of Artificial Sequence: Synthetic coding sequence
atgtttgccctgggcctgcccttcctggtgctgctggtggcctctgtggagagccacctgggcgtgctgggccccaagaatgtgtcccagaaggatgctgagtttgagaggacctacgtggatgaggtgaacagcgagctggtgaacatctacaccttcaaccacacagtgaccaggaacagaacagagggcgtgcgggtgtctgtgaatgtgctgaacaagcagaagggggcccccctgctgtttgtggtgcggcagaaggaggccgtggtgtccttccaggtgcccctcatcctgcggggcatgttccagaggaagtacctgtaccagaaggtggagaggaccctgtgccagccccccaccaagaatgaaagtgagatccagttcttctacgtggatgtgtccaccctgagccctgtgaacaccacctaccagctgcgggtgtccaggatggatgactttgtgctgaggactggagagcagttctccttcaacaccacagctgcccagccccagtacttcaagtatgagttccctgagggcgtggacagcgtcatcgtgaaggtgaccagcaacaaggccttcccctgcagcgtcatcagcatccaggatgtgctgtgccctgtgtatgacctggacaacaacgtggccttcatcggcatgtaccagaccatgaccaagaaggccgccatcaccgtgcagaggaaggacttccccagcaacagcttctacgtggtggtggtggtgaagacagaggaccaggcctgtggcggcagcctgcccttctacccctttgctgaagatgagcctgtggaccagggccaccggcagaagaccctgtctgtgctggtgtcccaggccgtgaccagcgaggcctacgtgtctggcatgctgttctgcctgggcatcttcctgtccttctacctgctgactgtgctgctggcctgctgggagaactggaggcagaagaagaagaccctgctggtggccatcgaccgggcctgcccagagagcggccacccccgggtgctggccgacagcttccctggcagcagcccctatgagggctacaactacggcagctttgaaaatgtgtctggcagcacagatggcctggtggacagcgctggcaccggggacctgtcctatggctaccagggccgcagctttgagcctgtgggcacccggccccgggtggacagcatgagctctgtggaggaggatgattatgacaccctgacagacatcgacagcgacaagaatgtcatccgcaccaagcagtacctgtatgtggccgacctggccaggaaggacaagagggtgctgaggaagaagtaccagatctacttctggaacatcgccaccatcgctgtgttctacgccctgcctgtggtgcagctggtgatcacctaccagacagtggtgaatgtgacaggcaaccaggacatctgctactacaacttcctgtgtgcccaccccctgggcaacctgagcgccttcaacaacatcctgagcaacctgggctacatcctgctgggcctgctcttcctgctgatcatcctgcagcgggagatcaaccacaacagagccctgctgagaaatgacctgtgtgccctggagtgtggcatccccaagcacttcggcctcttctacgccatgggcacagccctgatgatggagggcctgctgagcgcctgctaccacgtgtgccccaactacaccaacttccagtttgacaccagcttcatgtacatgattgctggcctgtgcatgctgaagctgtaccagaagaggcacccagacatcaatgccagcgcctacagcgcctatgcctgcctggccatcgtcatcttcttctctgtgctgggcgtggtgtttgggaagggcaacacagccttctggatcgtgttcagcatcatccacatcatcgccaccctgctgctgagcacccagctgtactacatgggccgctggaagctggacagcggcatcttccgccgcatcctgcacgtgctgtacacagactgcatccggcagtgcagcggccccctgtatgtggacaggatggtgctgctggtgatgggaaatgtcatcaactggagcctggccgcctacggcctcatcatgaggcccaatgactttgccagctacctgctggccatcggcatctgcaacctgctgctgtactttgccttctacatcatcatgaagctgcggagcggggagcgcatcaagctgatccccctgctgtgcatcgtgtgcacctctgtggtgtggggctttgccctcttcttcttcttccagggcctgagcacctggcagaagaccccagctgagagccgggagcacaacagagactgcatcctgctggacttctttgatgaccatgacatctggcacttcctgagcagcatcgccatgtttggcagcttcctggtgctgctgaccctggatgatgacctggacacagtgcagagggacaagatctacgtgttctag

SEQ ID NO: 38001 - DNA, 561 bp, Artificial Sequence
  Description of Artificial Sequence: Synthetic coding sequence
atgtttgccctgggcctgcccttcctggtgctgctggtggcctctgtggagagccacctgggcgtgctgggccccaagaatgtgtcccagaaggatgctgagtttgagaggacctacgtggacaggatggtgctgctggtgatgggaaatgtcatcaactggagcctggccgcctacggcctcatcatgaggcccaatgactttgccagctacctgctggccatcggcatctgcaacctgctgctgtactttgccttctacatcatcatgaagctgcggagcggggagcgcatcaagctgatccccctgctgtgcatcgtgtgcacctctgtggtgtggggctttgccctcttcttcttcttccagggcctgagcacctggcagaagaccccagctgagagccgggagcacaacagagactgcatcctgctggacttctttgatgaccatgacatctggcacttcctgagcagcatcgccatgtttggcagcttcctggtgctgctgaccctggatgatgacctggacacagtgcagagggacaagatctacgtgttctag

SEQ ID NO: 38002 - DNA, 2490 bp, Artificial Sequence
  Description of Artificial Sequence: Synthetic coding sequence
atgtttgccctgggcctgcccttcctggtgctgctggtggcctctgtggagagccacctgggcgtgctgggccccaagaatgtgtcccagaaggatgctgagtttgagaggacctacgtggatgaggtgaacagcgagctggtgaacatctacaccttcaaccacacagtgaccaggaacagaacagagggcgtgcgggtgtctgtgaatgtgctgaacaagcagaagggggcccccctgctgtttgtggtgcggcagaaggaggccgtggtgtccttccaggtgcccctcatcctgcggggcatgttccagaggaagtacctgtaccagaaggtggagaggaccctgtgccagccccccaccaagaatgaaagtgagatccagttcttctacgtggatgtgtccaccctgagccctgtgaacaccacctaccagctgcgggtgtccaggatggatgactttgtgctgaggactggagagcagttctccttcaacaccacagctgcccagccccagtacttcaagtatgagttccctgagggcgtggacagcgtcatcgtgaaggtgaccagcaacaaggccttcccctgcagcgtcatcagcatccaggatgtgctgtgccctgtgtatgacctggacaacaacgtggccttcatcggcatgtaccagaccatgaccaagaaggccgccatcaccgtgcagaggaaggacttccccagcaacagcttctacgtggtggtggtggtgaagacagaggaccaggcctgtggcggcagcctgcccttctacccctttgctgaagatgagcctgtggaccagggccaccggcagaagaccctgtctgtgctggtgtcccaggccgtgaccagcgaggcctacgtgtctggcatgctgttctgcctgggcatcttcctgtccttctacctgctgactgtgctgctggcctgctgggagaactggaggcagaagaagaagaccctgctggtggccatcgaccgggcctgcccagagagcgccagcctgctgggccacccccgggtgctggccgacagcttccctggcagcagcccctatgagggctacaactacggcagctttgaaaatgtgtctggcagcacagatggcctggtggacagcgctggcaccggggacctgtcctatggctaccagggcacccggccccgggtggacagcatgagctctgtggaggaggatgattatgacaccctgacagacatcgacagcgacaagaatgtcatccgcaccaagcagtacctgtatgtggccgacctggccaggaaggacaagagggtgctgaggaagaagtaccagatctacttctggaacatcgccaccatcgctgtgttctacgccctgcctgtggtgcagctggtgatcacctaccagacagtggtgaatgtgactggaaaccaggacatctgctactacaacttcctgtgtgcccaccccctgggcaacctgagcgccttcaacaacatcctgagcaacctgggctacatcctgctgggcctgctcttcctgctgatcatcctgcagcgggagatcaaccacaacagagccctgctgagaaatgacctgtgtgccctggagtgtggcatccccaagcacttcggcctcttctacgccatgggcacagccctgatgatggagggcctgctgagcgcctgctaccacgtgtgccccaactacaccaacttccagtttgacaccagcttcatgtacatgattgctggcctgtgcatgctgaagctgtaccagaagaggcacccagacatcaatgccagcgcctacagcgcctatgcctgcctggccatcgtcatcttcttctctgtgctgggcgtggtgtttggaaaaggaaacacagccttctggatcgtgttcagcatcatccacatcatcgccaccctgctgctgagcacccagctgtactacatgggccgctggaagctggacagcggcatcttccgccgcatcctgcacgtgctgtacacagactgcatccggcagtgcagcggccccctgtatgtggacaggatggtgctgctggtgatgggaaatgtcatcaactggagcctggccgcctacggcctcatcatgaggcccaatgactttgccagctacctgctggccatcggcatctgcaacctgctgctgtactttgccttctacatcatcatgaagctgcggtctggagagcgcatcaagctgatccccctgctgtgcatcgtgtgcacctctgtggtgtggggctttgccctcttcttcttcttccagggcctgagcacctggcagaagaccccagctgagagccgggagcacaacagagactgcatcctgctggacttctttgatgaccatgacatctggcacttcctgagcagcatcgccatgtttggcagcttcctggtgctgctgaccctggatgatgacctggacacagtgcagagggacaagatctacgtgttctag

SEQ ID NO: 38003 - DNA, 330 bp, Artificial Sequence
  Description of Artificial Sequence: Synthetic coding sequence
atgtttgccctgggcctgcccttcctggtgctgctggtggcctctgtggagagccacctgggcgtgctgggccccaagaatgtgtcccagaaggatgctgagtttgagaggacctacgtggatgaggtgaacagcgagctggtgaacatctacaccttcaaccacacagtgaccaggaacagaacagagggcgtgcgggtgtctgtgaatgtgctgaacaagcagaagggggcccccctgctgtttgtggtgcggcagaaggaggccgtggtgtccttccaggtgcccctcatcctgcggggcatgttccagaggaagtacctgtactag

SEQ ID NO: 38004 - DNA, 333 bp, Artificial Sequence
  Description of Artificial Sequence: Synthetic coding sequence
atgtttgccctgggcctgcccttcctggtgctgctggtggcctctgtggagagccacctgggcgtgctgggccccaagaatgtgtcccagaaggatgctgagtttgagaggacctacgtggatgaggtgaacagcgagctggtgaacatctacaccttcaaccacacagtgaccaggaacagaacagagggcgtgcgggtgtctgtgaatgtgctgaacaagcagaagggggcccccctgctgtttgtggtgcggcagaaggaggccgtggtgtccttccaggtgcccctcatcctgcggggcatgttccagaggaagtacctgtaccagtag

SEQ ID NO: 38005 - DNA, 6642 bp, Artificial Sequence
  Description of Artificial Sequence: Synthetic coding sequence
atggcccggggggcccggcccagcgctgctgggggcggcggcggcggcgctgagcccccagagagagctggccctggccggccccggggcagccccccaggccgggcccggcccagcctggccccccggcccggccctgagcccagccggcccagggctgcccctgagaccagcggcggggacacagctggagctggccgctgtggcggcagaagagctgccaagctgggccctggccggcggggctggtgggccctgctggccctgcagctgcacctgctgcgggccctggcccaggatgatgtggccccctacttcaagacagagcccggcctgccccagatccacctggagggcaaccggctggtgctgacctgcctggccgagggctcctggcccctggagttcaagtggatgagagatgattctgagctgaccacctacagcagcgagtacaagtacatcatccccagcctgcagaagctggatgctggcttctaccgctgtgtggtgaggaacaggatgggcgccctgctgcagaggaagtctgaggtgcaggtggcctacatgggcagcttcatggacacagaccagaggaagacagtgtcccagggccgggccgccatcctgaacctgctgcccatcaccagctacccccggccccaggtgacctggttccgggagggccacaagatcatccccagcaaccgcatcgccatcaccctggagaaccagctggtgatcctggccaccaccaccagtgatgctggggcctactacgtgcaggccgtgaatgagaagaatggagagaacaagaccagccccttcatccacctgagcatcgccagagatgtgggcaccccagagaccatggcccccaccatcgtggtgcccccaggcaacagatctgtggtggccggcagcagcgagaccaccctggagtgcatcgccagcgcccggcctgtggaggacctgtctgtgacctggaagagaaatggagtgcgcatcaccagcggcctgcacagctttggaagaaggctgaccatcagcaaccccaccagcgctgacaccggcccctacgtgtgtgaggccgccctgcccggcagcgcctttgagcccgcccgggccacagccttcctgttcatcatcgagcccccctacttcaccgctgagcctgagagccgcatctctgctgaggtggaggagaccgtggacatcggctgccaggccatgggcgtgcccctgcccaccctgcagtggtacaaggatgccatcagcatcagccggctgcagaacccccgctacaaggtgctggccagcggcggcctgcgcatccagaagctgcggccagaagattctggcatcttccagtgctttgccagcaatgaaggaggagagatccagacccacacctacctggatgtgaccaacatcgcccctgtgttcacccagaggcctgtggacaccaccgtgacagatggcatgacagccatcctgcgctgtgaggtgtctggggcccccaagccagccatcacctggaagcgggagaaccacatcctggccagcggctctgtgcgcatcccccgcttcatgctgctggagagcggcggcctgcagatcgcccctgtgttcatccaggatgctggcaactacacctgctatgctgccaacacagagggcagcctgaatgccagcgccaccctgactgtgtggaacagaaccagcatcgtgcaccccccagaagatcatgtggtgatcaagggcaccacagccaccctgcactgtggggccacccatgacccccgggtgtccctgcgctacgtgtggaagaaggacaacgtggccctgacccccagcagcaccagccgcatcgtggtggagaaggatggcagcctgctgatcagccagacctggagcggggacatcggggactacagctgtgaaattgtgtctgagggcggcaatgacagcaggatggcccggctggaggtgattgagctgccccacagcccccagaacctgctggtgagccccaacagcagccacagccatgctgtggtgctgtcctgggtgcggccctttgatggcaacagccccatcctgtactacatcgtggagctgtctgagaacaacagcccctggaaggtgcacctgagcaatgtgggccctgagatgactggagtgacagtgtctggcctgaccccagcccggacctaccagttccgggtgtgtgctgtgaatgaggtgggccggggccagtacagcgctgagaccagccggctgatgctgcctgaggagcccccatctgccccacccaagaacatcgtggccagcggccgcaccaaccagagcatcatggtgcagtggcagcccccacctgagacagagcacaacggggtgctgcggggctacatcctgcgctaccgcctggccggcctgcccggggagtaccagcagaggaacatcaccagccctgaggtgaactactgcctggtgacagacctgatcatctggacccagtatgagatccaggtggccgcctacaatggagctggcctgggcgtcttcagcagagctgtgacagagtacaccctgcagggcgtgcccacagccccaccccagaatgtgcagacagaggccgtgaacagcaccaccatccagttcctgtggaaccccccaccccagcagttcatcaatggcatcaaccagggctacaagctgctggcctggccagcagatgcccctgaggccgtgacagtggtgaccatcgccccagacttccacggcgtgcaccacggccacatcaccaacctgaagaagttcaccgcctacttcacctctgtgctgtgcttcaccaccccaggagatggcccccccagcaccccccagctggtgtggacccaggaggacaagccaggagctgtgggccacctgtccttcacagagatcctggacaccagcctgaaggtgtcctggcaggagcccctggagaagaatggcatcatcaccggctaccagatctcctgggaggtgtatggaagaaatgacagccggctgacccacaccctgaacagcaccacccatgagtacaagatccagggcctgagcagcctgaccacctacaccattgatgtggccgctgtgacagctgtgggcaccggcctggtgaccagcagcaccatcagcagtggagtgcccccagacctgcccggggcccccagcaacctggtgatcagcaacatcagccccaggtctgccaccctgcagttccggcccggctatgatggcaagaccagcatcagccgctggatcgtggagggccaggtgggcgccatcggagatgaggaggagtgggtgaccctgtatgaggaggagaatgaaccagatgcccagatgctggagatccccaacctgaccccctacacccactaccgcttcaggatgaagcaggtgaacatcgtgggccccagcccctacagccccagcagcagggtcatccagaccctgcaggcccccccagatgtggcccccacctctgtgacagtgaggacagccagcgagaccagcctgcggctgcgctgggtgcccctgcctgacagccagtacaatggaaatcctgagagcgtgggctaccgcatcaagtactggaggagtgacctgcagagcagcgctgtggcccaggtggtgtctgaccggctggagcgggagttcaccatcgaggagctggaggagtggatggagtatgagctgcagatgcaggccttcaatgctgtgggcgccggcccctggagcgaggtggtgcggggccgcacccgggagagcgtgcccagcgctgccccagaaaatgtgtctgctgaggccgtgagcagcacccagatcctgctgacctggacctctgtgcctgagcaggaccagaatggcctcatcctgggctacaagatcctcttccgggccaaggacctggaccctgagcccaggagccacatcgtgcggggcaaccacacccagagcgccctgctggccggcctgaggaagtttgtgctgtatgagctgcaggtgctggccttcaccagaattggaaatggagtgcccagcacccccctcatcctggagaggaccaaggatgatgcccctggcccccctgtgcggctggtgtttcctgaggtgcggctgacctctgtgcgcatcgtgtggcagcccccagaggagcccaacggcatcatcctgggctaccagatcgcctaccgcctggccagcagcagcccccacaccttcaccaccgtggaggtgggcgccaccgtgcggcagttcaccgccacagacctggcccctgagagcgcctacatcttccggctgagcgccaagacccggcagggctggggcgagcccctggaggccaccgtcatcaccacagagaagcgggagaggcctgccccaccccgggagctgctggtgccccaggccgaggtgacagcccggagcctgcggctgcagtgggtgcccggcagtgatggagccagccccatccgctacttcaccatgcaggtgcgggagctgcccagaggagagtggcagacctacagcagcagcatcagccatgaggccacagcctgtgtggtggaccggctgcggcccttcaccagctacaagctgcggctgaaggccaccaatgacattggagacagcgacttcagcagcgagacagaggccgtgaccaccctgcaggatgtgcctggagagcccccaggctctgtgtctgccaccccccacaccaccagctctgtgctgatccagtggcagcccccaagagatgagagcctgaatggcctgctgcagggctaccgcatctactaccgggagctggagtatgaagctggcagcggcacagaggccaagaccctgaagaaccccatcgccctgcacgccgagctgacagcccagagcagcttcaagacagtgaacagcagcagcaccagcaccatgtgtgagctgacccacctgaagaagtacagaagatatgaagtcatcatgacagcctacaacatcattggagagagccctgccagcgcccctgtggaggtgtttgtgggggaggccgccccagccatggccccccagaatgtgcaggtgacccccctgacagccagccagctggaggtgacctgggaccccccacctcctgagagccagaatggaaacatccagggctacaagatctactactgggaggccgacagccagaatgaaacagagaagatgaaggtgctcttcctgcctgagcctgtggtgcggctgaagaacctgaccagccacaccaagtacctggtgtccatcagcgccttcaatgctgctggagatggccccaagagtgacccccagcagggccgcacccaccaggccgcccctggggcccccagcttcctggccttcagcgagatcaccagcaccaccctgaatgtgtcctggggcgagcctgctgctgccaacggcatcctgcagggctacagagtggtgtatgagcccctggcccctgtgcagggcgtgtccaaggtggtgacagtggaggtgcggggcaactggcagcgctggctgaaggtgcgggacctgaccaagggcgtgacctacttcttccgggtgcaggcccggaccatcacctacggccctgagctgcaggccaacatcacagctggccctgctgagggcagccctggcagccccagagatgtgctggtgaccaagagcgccagcgagctgaccctgcagtggacagagggccacagcggggacacccccaccaccggctacgtgattgaggcccggcccagtgatgagggcctgtgggacatgtttgtgaaggacatccccaggtctgccaccagctacaccctgagcctggacaagctgcggcagggcgtgacctatgagttccgggtggtggccgtgaatgaggccggctacggggagcccagcaaccccagcacagctgtgtctgcccaggtggaggcccccttctatgaggagtggtggttcctgctggtgatggccctgagcagcctcatcgtcatcctgctggtggtgtttgccctggtgctgcacggccagaacaagaagtacaagaactgcagcacaggcaagggcatcagcaccatggaggagagcgtgaccctggacaatggaggctttgctgccctggagctgagcagccgccacctgaatgtgaagagcaccttcagcaagaagaatggcaccaggagccccccccggcccagccctgggggcctgcactacagtgatgaggacatctgcaacaagtacaacggggctgtgctgacagaatctgtgtccctgaaggagaagtctgcagatgccagcgagagcgaggccacagacagcgactatgaagatgccctgcccaagcacagctttgtgaaccactacatgtctgaccccacctactacaacagctggaagaggcgggcccagggccgggccccagccccccacagatatgaggccgtggccggcagcgaggccggggcccagctgcaccctgtgatcaccacccagagcgctggaggagtgtacaccccagctggccctggggcccggacccccctgaccggcttcagcagctttgtgtag

SEQ ID NO: 38006 - DNA, 1386 bp, Artificial Sequence
  Description of Artificial Sequence: Synthetic coding sequence
atgaaggtgctcttcctgcctgagcctgtggtgcggctgaagaacctgaccagccacaccaagtacctggtgtccatcagcgccttcaatgctgctggagatggccccaagagtgacccccagcagggccgcacccaccaggccgcccctggggcccccagcttcctggccttcagcgagatcaccagcaccaccctgaatgtgtcctggggcgagcctgctgctgccaacggcatcctgcagggctacagagtggtgtatgagcccctggcccctgtgcagggcgtgtccaaggtggtgacagtggaggtgcggggcaactggcagcgctggctgaaggtgcgggacctgaccaagggcgtgacctacttcttccgggtgcaggcccggaccatcacctacggccctgagctgcaggccaacatcacagctggccctgctgagggcagccctggcagccccagagatgtgctggtgaccaagagcgccagcgagctgaccctgcagtggacagagggccacagcggggacacccccaccaccggctacgtgattgaggcccggcccagtgatgagggcctgtgggacatgtttgtgaaggacatccccaggtctgccaccagctacaccctgagcctggacaagctgcggcagggcgtgacctatgagttccgggtggtggccgtgaatgaggccggctacggggagcccagcaaccccagcacagctgtgtctgcccaggtggaggcccccttctatgaggagtggtggttcctgctggtgatggccctgagcagcctcatcgtcatcctgctggtggtgtttgccctggtgctgcacggccagaacaagaagtacaagaactgcagcacaggcaagggcatcagcaccatggaggagagcgtgaccctggacaatggaggctttgctgccctggagctgagcagccgccacctgaatgtgaagagcaccttcagcaagaagaatggcaccaggagccccccccggcccagccctgggggcctgcactacagtgatgaggacatctgcaacaagtacaacggggctgtgctgacagaatctgtgtccctgaaggagaagtctgcagatgccagcgagagcgaggccacagacagcgactatgaagatgccctgcccaagcacagctttgtgaaccactacatgtctgaccccacctactacaacagctggaagaggcgggcccagggccgggccccagccccccacagatatgaggccgtggccggcagcgaggccggggcccagctgcaccctgtgatcaccacccagagcgctggaggagtgtacaccccagctggccctggggcccggacccccctgaccggcttcagcagctttgtgtag

SEQ ID NO: 38007 - DNA, 6651 bp, Artificial Sequence
  Description of Artificial Sequence: Synthetic coding sequence
atgtggggcctgctgatctggaccctgctggccctgcaccagatccgggccgcccgggcccaggatgatgtgagcccctacttcaagacagagcctgtgaggacccaggtgcacctggagggcaaccggctggtgctgacctgcatggccgagggctcctggcccctggagttcaagtggctgcacaacaaccgggagctgaccaagttcagcctggagtaccgctacatgatcaccagcctggacaggacccacgccggcttctaccgctgcatcgtgaggaacaggatgggcgccctgctgcagaggcagacagaggtgcaggtggcctacatgggcagctttgaggagggggagaagcaccagagcgtgagccacggggaggccgccgtcatccgggcccccagaattgccagcttcccccagccccaggtgacctggttcagagatggcaggaagatcccccccagcagccgcatcgccatcaccctggagaacaccctggtgatcctgagcacagtggccccagatgctggccgctactacgtgcaggccgtgaatgacaagaatggagacaacaagaccagccagcccatcaccctgactgtggagaatgtgggcggccctgctgaccccatcgcccccaccatcatcatcccccccaagaacacctctgtggtggccggcaccagcgaggtgaccctggagtgtgtggccaatgcccggcccctcatcaagctgcacatcatctggaagaaggatggagtgctgctgagcggcggcatcagtgaccacaacagaaggctgaccatccccaaccccactggaagtgatgctggctactatgaatgtgaggccgtgctgcggagcagctctgtgcccagcgtggtgcggggggcctacctgtctgtgctggagcccccccagtttgtgaaggagcctgagcggcacatcacagctgagatggagaaggtggtggacatcccctgccaggccaagggcgtgcccccacccagcatcacctggtacaaggatgctgctgtggtggaggtggagaagctgacccgcttccggcagagaaatgatggcggcctgcagatcagcggcctggtgcctgatgacaccggcatgttccagtgctttgccagaaatgctgctggggaggtgcagaccagcacctacctggccgtgaccagcatcgcccccaacatcacccggggccccctggacagcacagtgattgatggcatgtctgtggtgctggcctgtgagaccagcggggcccccaggcctgccatcacctggcagaagggggagcgcatcctggccagcggctctgtgcagctgccccgcttcacccccctggagagcggcagcctgctgatcagccccacccacatcagtgatgctggcacctacacctgcctggccaccaacagccggggcgtggatgaggccagcgctgacctggtggtgtgggcccggacccgcatcaccaagccaccccaggaccagagcgtcatcaagggcacccaggcctccatggtgtgtggggtgacccatgacccccgggtgaccatccgctacatctgggagaaggatggagccaccctgggcacagagagccacccccgcatccggctggacagaaatggcagcctgcacatcagccagacctggagcggggacatcggcacctacacctgcagggtcatctctgctggaggaaatgacagccgcagcgcccacctgcgggtgcggcagctgccccacgcccctgagcaccctgtggccaccctgagcacagtggagcggcgggccatcaacctgacctggaccaagccctttgatggcaacagccccctcatccgctacatcctggagatgtctgaaaataatgccccctggacagtgctgctggcctctgtggaccccaaggccacctctgtgacagtgaagggcctggtgcctgcccggagctaccagttccggctgtgtgctgtgaatgatgtgggcaagggccagttcagcaaggacacagagcgggtgtccctgcctgaggagcccccaacagccccaccccagaatgtcatcgccagcggccgcaccaaccagagcatcatgatccagtggcagcccccacctgagagccaccagaatggcatcctgaagggctacatcatccgctactgcctggccggcctgcctgtgggctaccagttcaagaacatcacagatgctgatgtgaacaacctgctgctggaggacctgatcatctggaccaactatgaaattgaggtggccgcctacaacagcgctggcctgggcgtgtacagcagcaaggtgacagagtggaccctgcagggcgtgcccaccgtgcccccaggaaatgtgcacgccgaggccaccaacagcaccaccatccgcttcacctggaatgcccccagcccccagttcatcaatggcatcaaccagggctacaagctgattgcctgggagcctgagcaggaggaggaggtgaccatggtgacagcccggcccaacttccaggacagcatccacgtgggctttgtgtctggcctgaagaagttcacagagtacttcacctctgtgctgtgcttcaccaccccaggagatggccccaggagcaccccccagctggtgaggacccatgaagatgtgcccggccctgtgggccacctgtccttcagcgagatcctggacaccagcctgaaggtgtcctggcaggagcccggggagaagaatggcatcctgaccggctaccgcatctcctgggaggagtacaacagaaccaacaccagggtgacccactacctgcccaacgtgaccctggagtacagagtgacaggcctgacagccctgaccacctacaccatcgaggtggccgccatgaccagcaagggccagggccaggtgtctgccagcaccatcagcagcggcgtgcccccagagctgcccggcccccccaccaacctgggcatcagcaacatcggccccaggtctgtgaccctgcagttccggcccggctatgatggcaagaccagcatcagccgctggctggtggaggcccaggtgggcgtggtgggggagggggaggagtggctgctgatccaccagctgagcaatgaaccagatgcccgctccatggaggtgcctgacctgaaccccttcacctgctacagcttcaggatgaggcaggtgaacatcgtgggcaccagcccccccagccagcccagcaggaagatccagaccctgcaggcccccccagacatggccccagccaacgtgtccctgaggacagccagcgagaccagcctgtggctgcgctggatgcccctgcctgagatggagtacaacggcaaccctgagagcgtgggctacaagatcaagtacagcagaagtgatggccacggcaagaccctgagccacgtggtgcaggacagagtggagcgggactacaccatcgaggacctggaggagtggacagagtacagagtgcaggtgcaggccttcaatgccatcggcagcggcccctggagccagacagtggtgggccgcacccgggagagcgtgcccagcagcggccccaccaacgtgtctgccctggccaccaccagcagctccatgctggtgcgctggagcgaggtgcctgaggccgacagaaatggcctggtgctgggctacaaggtgatgtacaaggagaaggacagcgacacccagccccgcttctggctggtggagggcaacagcagccgcagcgcccagctgaccggcctgggcaagtatgtgctgtatgaggtgcaggtgctggccttcaccagaattggagatggcagccccagccacccccccatcctggagaggaccctggatgatgtgcccggcccccccatgggcatcctcttccctgaggtgaggaccacctctgtgcggctcatctggcagcccccagctgcccccaacggcatcatcctggcctaccagatcacccaccggctgaacaccaccacagccaacacagccaccgtggaggtgctggcccccagcgcccggcagtacacagccaccggcctgaagccagagagcgtgtacctgttccgcatcacagcccagaccaggaagggctggggcgaggccgctgaggccctggtggtgaccacagagaagagggaccggccccagccccccagccggcccatggtgcagcaggaggatgtgcgggcccggtctgtgctgctgtcctgggagcccggcagtgatggcctgagccctgtgcgctactacaccatccagacccgggagctgcccagcggccgctgggccctgcacagcgcctctgtgagccacaatgccagcagcttcatcgtggaccggctgaagcccttcaccagctacaagttccgggtgaaggccaccaatgacatcggggacagcgagttcagcgaggagagcgagagcctgaccaccctgcaggccgccccagatgaggcccccaccatcctgtctgtgaccccccacaccaccacctctgtgctgatccgctggcagcccccagctgaggacaagatcaatggcatcctgctgggcttccgcatccgctaccgggagctgctgtatgagggcctgcggggcttcaccctgcggggcatcaacaaccctggggccacctgggccgagctgacctccatgtacagcatgaggaacctgagccggcccagcctgacccagtatgagctggacaacctgaacaagcacagaagatatgagatccgcatgtctgtgtacaatgctgtgggggagggccccagcagccccccccaggaggtgtttgtgggggaggccgtgcccacagctgcccccagaaatgtggtggtgcatggagccacagccacccagctggatgtgacctgggagcccccacccctggacagccagaatggagacatccagggctacaagatctacttctgggaggcccagaggggcaacctgacagagcgggtgaagaccctcttcctggccgagaacagcgtgaagctgaagaacctgaccggctacacagcctacatggtgtctgtggccgccttcaatgctgctggagatggccccaggagcacccccacccagggccagacccagcaggccgcccccagcgcccccagctctgtgaagttcagcgagctgaccaccacctctgtgaatgtgtcctgggaggccccccagttccccaacggcatcctggagggctaccgcctggtgtatgagccctgcagccctgtggatggagtgtccaagatcgtgacagtggatgtgaagggcaacagccccctgtggctgaaggtgaaggacctggccgagggcgtgacctaccgcttccgcatccgggccaagaccttcacctacggccctgagattgaggccaacgtgaccaccggccctggagagggcgcccctggccccccaggagtgcccatcatcgtgcgctacagcagcgccatcgccatccactggagcagcggggaccccgggaagggccccatcaccaggtatgtgattgaggcccggcccagtgatgagggcctgtgggacatcctgatcaaggacatccccaaggaggtgagcagctacaccttctccatggacatcctgaagccaggagtgtcctatgacttccgggtgattgctgtgaatgactatggcttcggcacccccagcagccccagccagagcgtgcctgcccagaaggccaaccccttctatgaggagtggtggttcctggtggtgattgccctggtgggcctcatcttcatcctgctgctggtgtttgtgctgatcatccggggccagagcaagaagtatgccaagaagacagacagcggcaacagcgccaagagcggggccctgggccacagcgagatgatgagcctggatgagagcagcttccctgccctggagctgaacaacagaaggctgtctgtgaagaacagcttctgcaggaagaatggcctgtacaccaggagccccccccggcccagccctggcagcctgcactacagtgatgaagatgtgaccaagtacaatgacctgatcccagctgagagcagcagcctgacagagaagcccagcgagatcagtgacagccagggcagtgacagtgaatatgaggtggacagcaaccaccagaaggcccacagctttgtgaaccactacatcagtgaccccacctactacaacagctggaggcggcagcagaagggcatcagccgggcccaggcctacagctacacagaaagtgacagcggggagccagaccacaccaccgtgaccaacagcaccagcacccagcagggcagcctcttccggcccaaggccagcaggacccccaccccccagaacccccccaacccccccagccagcagagcaccctgtacagaccacccagcaaggccggcgtgcagaaggagggggagaaccgggagaggatgtgtgtggccagcagcagcagcgccctgcgctggtggggcagcctgctgccctgggagctgcacggggccggggaggtggccgtgtccctgctgtggaccaggtctggggccggcatctggagggagcggggcagcggcggctag

SEQ ID NO: 38008 - DNA, 6462 bp, Artificial Sequence
  Description of Artificial Sequence: Synthetic coding sequence
atgtggggcctgctgatctggaccctgctggccctgcaccagatccgggccgcccgggcccaggatgatgtgagcccctacttcaagacagagcctgtgaggacccaggtgcacctggagggcaaccggctggtgctgacctgcatggccgagggctcctggcccctggagttcaagtggctgcacaacaaccgggagctgaccaagttcagcctggagtaccgctacatgatcaccagcctggacaggacccacgccggcttctaccgctgcatcgtgaggaacaggatgggcgccctgctgcagaggcagacagaggtgcaggtggcctacatgggcagctttgaggagggggagaagcaccagagcgtgagccacggggaggccgccgtcatccgggcccccagaattgccagcttcccccagccccaggtgacctggttcagagatggcaggaagatcccccccagcagccgcatcgccatcaccctggagaacaccctggtgatcctgagcacagtggccccagatgctggccgctactacgtgcaggccgtgaatgacaagaatggagacaacaagaccagccagcccatcaccctgactgtggagaatgtgggcggccctgctgaccccatcgcccccaccatcatcatcccccccaagaacacctctgtggtggccggcaccagcgaggtgaccctggagtgtgtggccaatgcccggcccctcatcaagctgcacatcatctggaagaaggatggagtgctgctgagcggcggcatcagtgaccacaacagaaggctgaccatccccaaccccactggaagtgatgctggctactatgaatgtgaggccgtgctgcggagcagctctgtgcccagcgtggtgcggggggcctacctgtctgtgctggagcccccccagtttgtgaaggagcctgagcggcacatcacagctgagatggagaaggtggtggacatcccctgccaggccaagggcgtgcccccacccagcatcacctggtacaaggatgctgctgtggtggaggtggagaagctgacccgcttccggcagagaaatgatggcggcctgcagatcagcggcctggtgcctgatgacaccggcatgttccagtgctttgccagaaatgctgctggggaggtgcagaccagcacctacctggccgtgaccagcatcgcccccaacatcacccggggccccctggacagcacagtgattgatggcatgtctgtggtgctggcctgtgagaccagcggggcccccaggcctgccatcacctggcagaagggggagcgcatcctggccagcggctctgtgcagctgccccgcttcacccccctggagagcggcagcctgctgatcagccccacccacatcagtgatgctggcacctacacctgcctggccaccaacagccggggcgtggatgaggccagcgctgacctggtggtgtgggcccggacccgcatcaccaagccaccccaggaccagagcgtcatcaagggcacccaggcctccatggtgtgtggggtgacccatgacccccgggtgaccatccgctacatctgggagaaggatggagccaccctgggcacagagagccacccccgcatccggctggacagaaatggcagcctgcacatcagccagacctggagcggggacatcggcacctacacctgcagggtcatctctgctggaggaaatgacagccgcagcgcccacctgcgggtgcggcagctgccccacgcccctgagcaccctgtggccaccctgagcacagtggagcggcgggccatcaacctgacctggaccaagccctttgatggcaacagccccctcatccgctacatcctggagatgtctgaaaataatgccccctggacagtgctgctggcctctgtggaccccaaggccacctctgtgacagtgaagggcctggtgcctgcccggagctaccagttccggctgtgtgctgtgaatgatgtgggcaagggccagttcagcaaggacacagagcgggtgtccctgcctgaggagcccccaacagccccaccccagaatgtcatcgccagcggccgcaccaaccagagcatcatgatccagtggcagcccccacctgagagccaccagaatggcatcctgaagggctacatcatccgctactgcctggccggcctgcctgtgggctaccagttcaagaacatcacagatgctgatgtgaacaacctgctgctggaggacctgatcatctggaccaactatgaaattgaggtggccgcctacaacagcgctggcctgggcgtgtacagcagcaaggtgacagagtggaccctgcagggcgtgcccaccgtgcccccaggaaatgtgcacgccgaggccaccaacagcaccaccatccgcttcacctggaatgcccccagcccccagttcatcaatggcatcaaccagggctacaagctgattgcctgggagcctgagcaggaggaggaggtgaccatggtgacagcccggcccaacttccaggacagcatccacgtgggctttgtgtctggcctgaagaagttcacagagtacttcacctctgtgctgtgcttcaccaccccaggagatggccccaggagcaccccccagctggtgaggacccatgaagatgtgcccggccctgtgggccacctgtccttcagcgagatcctggacaccagcctgaaggtgtcctggcaggagcccggggagaagaatggcatcctgaccggctaccgcatctcctgggaggagtacaacagaaccaacaccagggtgacccactacctgcccaacgtgaccctggagtacagagtgacaggcctgacagccctgaccacctacaccatcgaggtggccgccatgaccagcaagggccagggccaggtgtctgccagcaccatcagcagcggcgtgcccccagagctgcccggcccccccaccaacctgggcatcagcaacatcggccccaggtctgtgaccctgcagttccggcccggctatgatggcaagaccagcatcagccgctggctggtggaggcccaggtgggcgtggtgggggagggggaggagtggctgctgatccaccagctgagcaatgaaccagatgcccgctccatggaggtgcctgacctgaaccccttcacctgctacagcttcaggatgaggcaggtgaacatcgtgggcaccagcccccccagccagcccagcaggaagatccagaccctgcaggcccccccagacatggccccagccaacgtgtccctgaggacagccagcgagaccagcctgtggctgcgctggatgcccctgcctgagatggagtacaacggcaaccctgagagcgtgggctacaagatcaagtacagcagaagtgatggccacggcaagaccctgagccacgtggtgcaggacagagtggagcgggactacaccatcgaggacctggaggagtggacagagtacagagtgcaggtgcaggccttcaatgccatcggcagcggcccctggagccagacagtggtgggccgcacccgggagagcgtgcccagcagcggccccaccaacgtgtctgccctggccaccaccagcagctccatgctggtgcgctggagcgaggtgcctgaggccgacagaaatggcctggtgctgggctacaaggtgatgtacaaggagaaggacagcgacacccagccccgcttctggctggtggagggcaacagcagccgcagcgcccagctgaccggcctgggcaagtatgtgctgtatgaggtgcaggtgctggccttcaccagaattggagatggcagccccagccacccccccatcctggagaggaccctggatgatgtgcccggcccccccatgggcatcctcttccctgaggtgaggaccacctctgtgcggctcatctggcagcccccagctgcccccaacggcatcatcctggcctaccagatcacccaccggctgaacaccaccacagccaacacagccaccgtggaggtgctggcccccagcgcccggcagtacacagccaccggcctgaagccagagagcgtgtacctgttccgcatcacagcccagaccaggaagggctggggcgaggccgctgaggccctggtggtgaccacagagaagagggaccggccccagccccccagccggcccatggtgcagcaggaggatgtgcgggcccggtctgtgctgctgtcctgggagcccggcagtgatggcctgagccctgtgcgctactacaccatccagacccgggagctgcccagcggccgctgggccctgcacagcgcctctgtgagccacaatgccagcagcttcatcgtggaccggctgaagcccttcaccagctacaagttccgggtgaaggccaccaatgacatcggggacagcgagttcagcgaggagagcgagagcctgaccaccctgcaggccgccccagatgaggcccccaccatcctgtctgtgaccccccacaccaccacctctgtgctgatccgctggcagcccccagctgaggacaagatcaatggcatcctgctgggcttccgcatccgctaccgggagctgctgtatgagggcctgcggggcttcaccctgcggggcatcaacaaccctggggccacctgggccgagctgacctacctgaacaagcaccggcgctatgagatccgcatgtctgtgtacaatgctgtgggggagggccccagcagccccccccaggaggtgtttgtgggggaggccgtgcccacagctgcccccagaaatgtggtggtgcacggggccacagccacccagctggatgtgacctgggagcccccacccctggacagccagaatggagacatccagggctacaagatctacttctgggaggcccagaggggcaacctgacagagcgggtgaagaccctcttcctggctgaaaattctgtgaagctgaagaacctgaccggctacacagcctacatggtgtctgtggccgccttcaatgctgctggagatggccccaggagcacccccacccagggccagacccagcaggccgcccccagcgcccccagctctgtgaagttcagcgagctgaccaccacctctgtgaatgtgtcctgggaggccccccagttccccaacggcatcctggagggctaccgcctggtgtatgagccctgcagccctgtggatggagtgtccaagatcgtgacagtggatgtgaagggcaacagccccctgtggctgaaggtgaaggacctggccgagggcgtgacctaccgcttccgcatccgggccaagaccttcacctacggccctgagattgaggccaacgtgaccactggacctggagagggcgcccctggccccccaggagtgcccatcatcgtgcgctacagcagcgccatcgccatccactggagcagcggggaccccgggaagggccccatcacccgctacgtgattgaggcccggcccagtgatgagggcctgtgggacatcctgatcaaggacatccccaaggaggtgtcctcctacaccttctccatggacatcctgaagccaggagtgtcctatgacttccgggtgattgctgtgaatgactatggcttcggcacccccagcagccccagccagagcgtgcctgcccagaaggccaaccccttctatgaggagtggtggttcctggtggtgattgccctggtgggcctcatcttcatcctgctgctggtgtttgtgctgatcatccggggccagagcaagaagtatgccaagaagacagattctggcaacagcgccaagagcggggccctgggccacagcgagatgatgagcctggatgagagcagcttccctgccctggagctgaacaacagaaggctgtctgtgaagaacagcttctgcaggaagaatggcctgtacaccaggagccccccccggcccagccctggcagcctgcactacagtgatgaagatgtgaccaagtacaatgacctgatcccagctgagagcagcagcctgacagagaagcccagcgagatcagtgacagccagggcagtgacagtgaatatgaggtggacagcaaccaccagaaggcccacagctttgtgaaccactacatcagtgaccccacctactacaacagctggaggcggcagcagaagggcatcagccgggcccaggcctacagctacacagaaagtgacagcggggagccagaccacaccaccgtgaccaacagcaccagcacccagcagggcagcctcttccggcccaaggccagcaggacccccaccccccagaacccccccaacccccccagccagcagagcaccctgtaccggccccccagcagcctggcccctggcagccgggcccccatcgccggcttcagcagctttgtgtag

SEQ ID NO: 38009 - DNA, 6519 bp, Artificial Sequence
  Description of Artificial Sequence: Synthetic coding sequence
atgtggggcctgctgatctggaccctgctggccctgcaccagatccgggccgcccgggcccaggatgatgtgagcccctacttcaagacagagcctgtgaggacccaggtgcacctggagggcaaccggctggtgctgacctgcatggccgagggctcctggcccctggagttcaagtggctgcacaacaaccgggagctgaccaagttcagcctggagtaccgctacatgatcaccagcctggacaggacccacgccggcttctaccgctgcatcgtgaggaacaggatgggcgccctgctgcagaggcagacagaggtgcaggtggcctacatgggcagctttgaggagggggagaagcaccagagcgtgagccacggggaggccgccgtcatccgggcccccagaattgccagcttcccccagccccaggtgacctggttcagagatggcaggaagatcccccccagcagccgcatcgccatcaccctggagaacaccctggtgatcctgagcacagtggccccagatgctggccgctactacgtgcaggccgtgaatgacaagaatggagacaacaagaccagccagcccatcaccctgactgtggagaatgtgggcggccctgctgaccccatcgcccccaccatcatcatcccccccaagaacacctctgtggtggccggcaccagcgaggtgaccctggagtgtgtggccaatgcccggcccctcatcaagctgcacatcatctggaagaaggatggagtgctgctgagcggcggcatcagtgaccacaacagaaggctgaccatccccaaccccactggaagtgatgctggctactatgaatgtgaggccgtgctgcggagcagctctgtgcccagcgtggtgcggggggcctacctgtctgtgctggagcccccccagtttgtgaaggagcctgagcggcacatcacagctgagatggagaaggtggtggacatcccctgccaggccaagggcgtgcccccacccagcatcacctggtacaaggatgctgctgtggtggaggtggagaagctgacccgcttccggcagagaaatgatggcggcctgcagatcagcggcctggtgcctgatgacaccggcatgttccagtgctttgccagaaatgctgctggggaggtgcagaccagcacctacctggccgtgaccagcatcgcccccaacatcacccggggccccctggacagcacagtgattgatggcatgtctgtggtgctggcctgtgagaccagcggggcccccaggcctgccatcacctggcagaagggggagcgcatcctggccagcggctctgtgcagctgccccgcttcacccccctggagagcggcagcctgctgatcagccccacccacatcagtgatgctggcacctacacctgcctggccaccaacagccggggcgtggatgaggccagcgctgacctggtggtgtgggcccggacccgcatcaccaagccaccccaggaccagagcgtcatcaagggcacccaggcctccatggtgtgtggggtgacccatgacccccgggtgaccatccgctacatctgggagaaggatggagccaccctgggcacagagagccacccccgcatccggctggacagaaatggcagcctgcacatcagccagacctggagcggggacatcggcacctacacctgcagggtcatctctgctggaggaaatgacagccgcagcgcccacctgcgggtgcggcagctgccccacgcccctgagcaccctgtggccaccctgagcacagtggagcggcgggccatcaacctgacctggaccaagccctttgatggcaacagccccctcatccgctacatcctggagatgtctgaaaataatgccccctggacagtgctgctggcctctgtggaccccaaggccacctctgtgacagtgaagggcctggtgcctgcccggagctaccagttccggctgtgtgctgtgaatgatgtgggcaagggccagttcagcaaggacacagagcgggtgtccctgcctgaggagcccccaacagccccaccccagaatgtcatcgccagcggccgcaccaaccagagcatcatgatccagtggcagcccccacctgagagccaccagaatggcatcctgaagggctacatcatccgctactgcctggccggcctgcctgtgggctaccagttcaagaacatcacagatgctgatgtgaacaacctgctgctggaggacctgatcatctggaccaactatgaaattgaggtggccgcctacaacagcgctggcctgggcgtgtacagcagcaaggtgacagagtggaccctgcagggcgtgcccaccgtgcccccaggaaatgtgcacgccgaggccaccaacagcaccaccatccgcttcacctggaatgcccccagcccccagttcatcaatggcatcaaccagggctacaagctgattgcctgggagcctgagcaggaggaggaggtgaccatggtgacagcccggcccaacttccaggacagcatccacgtgggctttgtgtctggcctgaagaagttcacagagtacttcacctctgtgctgtgcttcaccaccccaggagatggccccaggagcaccccccagctggtgaggacccatgaagatgtgcccggccctgtgggccacctgtccttcagcgagatcctggacaccagcctgaaggtgtcctggcaggagcccggggagaagaatggcatcctgaccggctaccgcatctcctgggaggagtacaacagaaccaacaccagggtgacccactacctgcccaacgtgaccctggagtacagagtgacaggcctgacagccctgaccacctacaccatcgaggtggccgccatgaccagcaagggccagggccaggtgtctgccagcaccatcagcagcggcgtgcccccagagctgcccggcccccccaccaacctgggcatcagcaacatcggccccaggtctgtgaccctgcagttccggcccggctatgatggcaagaccagcatcagccgctggctggtggaggcccaggtgggcgtggtgggggagggggaggagtggctgctgatccaccagctgagcaatgaaccagatgcccgctccatggaggtgcctgacctgaaccccttcacctgctacagcttcaggatgaggcaggtgaacatcgtgggcaccagcccccccagccagcccagcaggaagatccagaccctgcaggcccccccagacatggccccagccaacgtgtccctgaggacagccagcgagaccagcctgtggctgcgctggatgcccctgcctgagatggagtacaacggcaaccctgagagcgtgggctacaagatcaagtacagcagaagtgatggccacggcaagaccctgagccacgtggtgcaggacagagtggagcgggactacaccatcgaggacctggaggagtggacagagtacagagtgcaggtgcaggccttcaatgccatcggcagcggcccctggagccagacagtggtgggccgcacccgggagagcgtgcccagcagcggccccaccaacgtgtctgccctggccaccaccagcagctccatgctggtgcgctggagcgaggtgcctgaggccgacagaaatggcctggtgctgggctacaaggtgatgtacaaggagaaggacagcgacacccagccccgcttctggctggtggagggcaacagcagccgcagcgcccagctgaccggcctgggcaagtatgtgctgtatgaggtgcaggtgctggccttcaccagaattggagatggcagccccagccacccccccatcctggagaggaccctggatgatgtgcccggcccccccatgggcatcctcttccctgaggtgaggaccacctctgtgcggctcatctggcagcccccagctgcccccaacggcatcatcctggcctaccagatcacccaccggctgaacaccaccacagccaacacagccaccgtggaggtgctggcccccagcgcccggcagtacacagccaccggcctgaagccagagagcgtgtacctgttccgcatcacagcccagaccaggaagggctggggcgaggccgctgaggccctggtggtgaccacagagaagagggaccggccccagccccccagccggcccatggtgcagcaggaggatgtgcgggcccggtctgtgctgctgtcctgggagcccggcagtgatggcctgagccctgtgcgctactacaccatccagacccgggagctgcccagcggccgctgggccctgcacagcgcctctgtgagccacaatgccagcagcttcatcgtggaccggctgaagcccttcaccagctacaagttccgggtgaaggccaccaatgacatcggggacagcgagttcagcgaggagagcgagagcctgaccaccctgcaggccgccccagatgaggcccccaccatcctgtctgtgaccccccacaccaccacctctgtgctgatccgctggcagcccccagctgaggacaagatcaatggcatcctgctgggcttccgcatccgctaccgggagctgctgtatgagggcctgcggggcttcaccctgcggggcatcaacaaccctggggccacctgggccgagctgacctccatgtacagcatgaggaacctgagccggcccagcctgacccagtatgagctggacaacctgaacaagcacagaagatatgagatccgcatgtctgtgtacaatgctgtgggggagggccccagcagccccccccaggaggtgtttgtgggggaggccgtgcccacagctgcccccagaaatgtggtggtgcatggagccacagccacccagctggatgtgacctgggagcccccacccctggacagccagaatggagacatccagggctacaagatctacttctgggaggcccagaggggcaacctgacagagcgggtgaagaccctcttcctggccgagaacagcgtgaagctgaagaacctgaccggctacacagcctacatggtgtctgtggccgccttcaatgctgctggagatggccccaggagcacccccacccagggccagacccagcaggccgcccccagcgcccccagctctgtgaagttcagcgagctgaccaccacctctgtgaatgtgtcctgggaggccccccagttccccaacggcatcctggagggctaccgcctggtgtatgagccctgcagccctgtggatggagtgtccaagatcgtgacagtggatgtgaagggcaacagccccctgtggctgaaggtgaaggacctggccgagggcgtgacctaccgcttccgcatccgggccaagaccttcacctacggccctgagattgaggccaacgtgaccaccggccctggagagggcgcccctggccccccaggagtgcccatcatcgtgcgctacagcagcgccatcgccatccactggagcagcggggaccccgggaagggccccatcaccaggtatgtgattgaggcccggcccagtgatgagggcctgtgggacatcctgatcaaggacatccccaaggaggtgagcagctacaccttctccatggacatcctgaagccaggagtgtcctatgacttccgggtgattgctgtgaatgactatggcttcggcacccccagcagccccagccagagcgtgcctgcccagaaggccaaccccttctatgaggagtggtggttcctggtggtgattgccctggtgggcctcatcttcatcctgctgctggtgtttgtgctgatcatccggggccagagcaagaagtatgccaagaagacagacagcggcaacagcgccaagagcggggccctgggccacagcgagatgatgagcctggatgagagcagcttccctgccctggagctgaacaacagaaggctgtctgtgaagaacagcttctgcaggaagaatggcctgtacaccaggagccccccccggcccagccctggcagcctgcactacagtgatgaagatgtgaccaagtacaatgacctgatcccagctgagagcagcagcctgacagagaagcccagcgagatcagtgacagccagggcagtgacagtgaatatgaggtggacagcaaccaccagaaggcccacagctttgtgaaccactacatcagtgaccccacctactacaacagctggaggcggcagcagaagggcatcagccgggcccaggcctacagctacacagaaagtgacagcggggagccagaccacaccaccgtgaccaacagcaccagcacccagcagggcagcctcttccggcccaaggccagcaggacccccaccccccagaacccccccaacccccccagccagcagagcaccctgtacagaccacccagcagcctggcccctggcagccgggcccccatcgccggcttcagcagctttgtgtag

SEQ ID NO: 38010 - DNA, 969 bp, Artificial Sequence
  Description of Artificial Sequence: Synthetic coding sequence
atgtctggagagctgccccccaacatcaacatcaaggagccccgctgggaccagagcaccttcatcggccgggccaaccacttcttcaccgtgacagaccccaggaacatcctgctgaccaatgagcagctggagagcgccaggaagatcgtgcatgactaccggcagggcatcgtgcccccaggcctgacagaaaatgagctgtggagggccaagtacatctatgattctgccttccacccagacacaggagagaagatgatcctgattggccgcatgtctgcccaggtgcccatgaacatgaccatcaccggctgcatgatgaccttctaccgcaccaccccagctgtgctcttctggcagtggatcaaccagagcttcaatgctgtggtgaactacaccaacagaagtggagatgcccccctgactgtgaatgagctgggcacagcctacgtgtctgccaccaccggggctgtggccacagccctgggcctgaatgccctgaccaagcacgtgagccccctcatcggccgctttgtgccctttgctgctgtggccgccgccaactgcatcaacatccccctgatgaggcagcgggagctgaaggtgggcatccctgtgacagatgaaaatggaaaccggctgggggagagcgccaatgctgccaagcaggccatcacccaggtggtggtgagccgcatcctgatggccgcccctggcatggccatcccccccttcatcatgaacaccctggagaagaaggccttcctgaagcgcttcccctggatgtctgcccccatccaggtgggcctggtgggcttctgcctggtgtttgccacccccctgtgctgtgccctcttcccccagaagagctccatgtctgtgaccagcctggaggccgagctgcaggccaagatccaggagagccaccctgagctgcggcgggtgtacttcaacaagggcctgtag

SEQ ID NO: 38011 - DNA, 585 bp, Artificial Sequence
  Description of Artificial Sequence: Synthetic coding sequence
atgtctggagagctgccccccaacatcaacatcaaggagccccgctgggaccagagcaccttcatcggccgggccaaccacttcttcaccgtgacagaccccaggaacatcctgctgaccaatgagcagctggagagcgccaggaagatcgtgcatgactaccggcagggcatcgtgcccccaggcctgacagaaaatgagctgtggagggccaagtacatctatgattctgccttccacccagacacaggagagaagatgatcctgattggccgcatgtctgcccaggtgcccatgaacatgaccatcaccggctgcatgatgaccttctaccgcaccaccccagctgtgctcttctggcagtggatcaaccagagcttcaatgctgtggtgaactacaccaacagaagtggagatgcccccctgactgtgaatgagctgggcacagcctacgtgtctgccaccaccggggctgtggccacagccctgggcctgaatgccctgaccaagcacgtgagccccctcatcggccgctttgtgccctttgctgctgtggccgccgccaactgcatcaacatcccctag

SEQ ID NO: 38012 - DNA, 435 bp, Artificial Sequence
  Description of Artificial Sequence: Synthetic coding sequence
atgtctggagagctgccccccaacatcaacatcaaggagccccgctgggaccagagcaccttcatcggccgggccaaccacttcttcaccgtgacagaccccaggaacatcctgctgaccaatgagcagctggagagcgccaggaagatcgtgcatgactaccggcagggcatcgtgcccccaggcctgacagaaaatgagctgtggagggccaagtacatctatgattctgccttccacccagacacaggagagaagatgatcctgattggccgcatgtctgcccaggtgcccatgaacatgaccatcaccggctgcatgatgaccttctaccgcaccaccccagctgtgctcttctggcagtggatcaaccagagcttcaatgctgtggtgaactacaccaacagaagtggagatgcccccctgactgtgtag

SEQ ID NO: 38013 - DNA, 969 bp, Artificial Sequence
  Description of Artificial Sequence: Synthetic coding sequence
atggaggccgacctgagcggcttcaacattgatgccccccgctgggaccagaggaccttcctgggccgggtgaagcacttcctgaacatcacagaccccaggacagtgtttgtgtctgagcgggagctggactgggccaaggtgatggtggagaagagcaggatgggcgtggtgcccccaggcacccaggtggagcagctgctgtatgccaagaagctgtatgacagcgccttccacccagacaccggggagaagatgaatgtgattggaaggatgtccttccagctgcccggcggcatgatcatcaccggcttcatgctgcagttctaccgcaccatgcctgctgtgatcttctggcagtgggtgaaccagagcttcaatgccctggtgaactacaccaacagaaatgctgccagccccacctctgtgcggcagatggccctgagctacttcaccgccaccaccacagctgtggccacagctgtgggcatgaacatgctgaccaagaaggccccacccctggtgggccgctgggtgccctttgctgctgtggccgccgccaactgtgtgaacatccccatgatgaggcagcaggagctgatcaagggcatctgtgtgaaggacagaaatgaaaatgagatcggccacagccggcgggctgctgccatcggcatcacccaggtggtgatcagccgcatcaccatgtctgcccctggcatgatcctgctgcccgtcatcatggagcggctggagaagctgcacttcatgcagaaggtgaaggtgctgcacgcccccctgcaggtgatgctgagcggctgcttcctgatcttcatggtgcctgtggcctgtggcctcttcccccagaagtgtgagctgcctgtgtcctacctggagcccaagctgcaggacaccatcaaggccaagtatggagagctggagccctacgtgtacttcaacaagggcctgtag

SEQ ID NO: 38014 - DNA, 1134 bp, Artificial Sequence
  Description of Artificial Sequence: Synthetic coding sequence
atgtgtgaggaggaggacagcacagccctggtgtgtgacaatggcagcggcctgtgcaaggccggctttgctggagatgatgcccccagggctgtgttccccagcatcgtgggccggcccaggcaccagggcgtgatggtgggcatgggccagaaggacagctatgtgggagatgaggcccagagcaagaggggcatcctgaccctgaagtaccccattgaacatggcatcatcaccaactgggatgacatggagaagatctggcaccacagcttctacaatgagctgcgggtggcccctgaggagcaccccaccctgctgacagaggcccccctgaaccccaaggccaaccgggagaagatgacccagatcatgtttgagaccttcaacgtgcctgccatgtatgtggccatccaggccgtgctgagcctgtatgccagcggccgcaccactggaattgtgctggacagcggagatggagtgacccacaacgtgcccatctatgagggctacgccctgccccacgccatcatgaggctggacctggccggccgggacctgacagactacctgatgaagatcctgacagagcggggctacagctttgtgaccacagctgagcgggagatcgtgcgggacatcaaggagaagctgtgctacgtggccctggactttgaaaatgagatggccacagctgccagcagcagcagcctggagaagagctatgagctgcctgatggccaggtgatcaccatcggaaatgaacgcttccgctgcccagagaccctcttccagcccagcttcatcggcatggagagcgctggcatccacgagaccacctacaacagcatcatgaagtgtgacatcgacatcaggaaggacctgtatgccaacaacgtgctgagcggcggcaccaccatgtacccaggcattgctgacaggatgcagaaggagatcacagccctggcccccagcaccatgaagatcaagatcatcgcccctcctgagaggaagtacagcgtgtggattggaggcagcatcctggccagcctgagcaccttccagcagatgtggatcagcaagcaggagtatgatgaagctggccccagcatcgtgcacaggaagtgcttctag

SEQ ID NO: 38015 - DNA, 966 bp, Artificial Sequence
  Description of Artificial Sequence: Synthetic coding sequence
atgggagagctgcccctggacatcaacatccaggagccccgctgggaccagagcaccttcctgggccgggcccggcacttcttcaccgtgacagaccccaggaacctgctgctgagcggggcccagctggaggccagcagaaatattgtgcagaactacagagctggggtggtgaccccaggcatcacagaggaccagctgtggagggccaagtatgtgtatgacagcgccttccacccagacaccggggagaaggtggtgctgattggaaggatgtctgcccaggtgcccatgaacatgaccatcaccggctgcatgctgaccttctacaggaagacccccaccgtggtgttctggcagtgggtgaaccagagcttcaatgccatcgtgaactacagcaacagaagtggggacacccccatcaccgtgcggcagctgggcacagcctacgtgtctgccaccactggagctgtggccacagccctgggcctgaagagcctgaccaagcacctgccccccctggtgggccgctttgtgccctttgctgctgtggccgccgccaactgcatcaacatccccctgatgaggcagcgggagctgcaggtgggcatccctgtggctgatgaggccggccagaggctgggctacagcgtgacagctgccaagcagggcatcttccaggtggtgatcagccgcatctgcatggccatcccagccatggccatccccccactcatcatggacaccctggagaagaaggacttcctgaagaggcggccctggctgggcgcccccctgcaggtgggcctggtgggcttctgcctggtgtttgccacccccctgtgctgtgccctcttcccccagaagagcagcatccacatcagcaacctggagcctgagctgcgggcccagatccacgagcagaaccccagcgtggaggtggtgtactacaacaagggcctgtag

SEQ ID NO: 38016 - DNA, 987 bp, Artificial Sequence
  Description of Artificial Sequence: Synthetic coding sequence
atgagcctggagcaggaggaggagacccagcccggccgcctgctgggcagaagagatgctgtgcctgccttcatcgagcccaacgtgcgcttctggatcacagagcggcagagcttcatccgccgcttcctgcagtggacagagctgctggaccccaccaacgtgttcatctctgtggagagcattgagaacagccggcagctgctgtgcaccaatgaagatgtgagcagccctgccagcgctgaccagagggccaccgtgcacccagacagcagcaacctgatccccaagctgttccggcctgctgccttcctgcccttcatggcccccaccgtcttcctgtccatgacccccctgaagggcatcaagagcgtcatcctgccccaggtgttcctgtgtgcctacatggccgccttcaacagcatcaatggaaacagaagctacacctgcaagcccctggagaggagcctgctgatggccggggctgtggccagcagcaccttcctgggcgtcatcccccagtttgtgcagatgaagtatggcctgaccggcccctggatcaagaggctgctgcccgtcatcttcctggtgcaggccagcggcatgaatgtgtacatgagccgcagcctggagagcatcaagggcattgctgtgatggacaaggagggcaatgtgctgggccacagcagaattgctggcaccaaggctgtgcgggagaccctggccagcagaattgtgctgtttggcaccagcgccctgatccctgaggtgttcacctacttcttcaagaggacccagtacttcaggaagaaccctggcagcctgtggatcctgaagctgagctgcaccgtgctggccatgggcctgatggtgcccttctccttcagcatcttcccccagatcggccagatccagtactgcagcctggaggagaagatccagagccccacagaggagacagagatcttctaccacagaggagtgtag

SEQ ID NO: 38017 - DNA, 1014 bp, Artificial Sequence
  Description of Artificial Sequence: Synthetic coding sequence
atgagcctggagcaggaggaggagacccagcccggccgcctgctgggcagaagagatgctgtgcctgccttcatcgagcccaacgtgcgcttctggatcacagagcggcagagcttcatccgccgcttcctgcagtggacagagctgctggaccccaccaacgtgttcatctctgtggagagcattgagaacagccggcagctgctgtgcaccaatgaagatgtgagcagccctgccagcgctgaccagaggatccaggaggcctggaagaggagcctggccaccgtgcacccagacagcagcaacctgatccccaagctgttccggcctgctgccttcctgcccttcatggcccccaccgtcttcctgtccatgacccccctgaagggcatcaagagcgtcatcctgccccaggtgttcctgtgtgcctacatggccgccttcaacagcatcaatggaaacagaagctacacctgcaagcccctggagaggagcctgctgatggccggggctgtggccagcagcaccttcctgggcgtcatcccccagtttgtgcagatgaagtatggcctgaccggcccctggatcaagaggctgctgcctgtgatcttcctggtgcaggccagcggcatgaatgtgtacatgagccgcagcctggagagcatcaagggcattgctgtgatggacaaggagggcaatgtgctgggccacagcagaattgctggcaccaaggctgtgcgggagaccctggccagccgcatcgtgctgtttggcaccagcgccctgatccctgaggtgttcacctacttcttcaagaggacccagtacttcaggaagaaccctggcagcctgtggatcctgaagctgagctgcaccgtgctggccatgggcctgatggtgcccttctccttcagcatcttcccccagatcggccagatccagtactgcagcctggaggagaagatccagagccccacagaggagacagagatcttctaccaccggggcgtgtag

SEQ ID NO: 38018 - DNA, 537 bp, Artificial Sequence
  Description of Artificial Sequence: Synthetic coding sequence
atggcccccaccgtcttcctgtccatgacccccctgaagggcatcaagagcgtcatcctgccccaggtgttcctgtgtgcctacatggccgccttcaacagcatcaatggaaacagaagctacacctgcaagcccctggagaggagcctgctgatggccggggctgtggccagcagcaccttcctgggcgtcatcccccagtttgtgcagatgaagtatggcctgaccggcccctggatcaagaggctgctgcctgtgatcttcctggtgcaggccagcggcatgaatgtgtacatgagccgcagcctggagagcatcaagggcattgctgtgatggacaaggagggcaatgtgctgggccacagcagaattgctggcaccaaggctgtgcgggagaccctggccagccgcatcgtgctgtttggcaccagcgccctgatccctgaggtgttcacctacttcttcaagaggacccagtacttcaggaagaaccctggcagcctgtggatcctgaagctgagctgcaccgtgctgtag

SEQ ID NO: 38019 - DNA, 663 bp, Artificial Sequence
  Description of Artificial Sequence: Synthetic coding sequence
agccccctggtgttcctgtccatgacccccctgaagggcatcaagagcgtcatcctgccccaggtgttcctgtgtgcctacatggccgccttcaacagcatcaatggaaacagaagctacacctgcaagcccctggagaggagcctgctgatggccggggctgtggccagcagcaccttcctgggcgtcatcccccagtttgtgcagatgaagtatggcctgaccggcccctggatcaagaggctgctgcccgtcatcttcctggtgcaggccagcggcatgaatgtgtacatgagccgcagcctggagagcatcaagggcattgctgtgatggacaaggagggcaatgtgctgggccacagcagaattgctggcaccaaggctgtgcgggagaccctggccagcagaattgtgctgtttggcaccagcgccctgatccctgaggtgttcacctacttcttcaagaggacccagtacttcaggaagaaccctggcagcctgtggatcctgaagctgagctgcaccgtgctggccatgggcctgatggtgcccttctccttcagcatcttcccccagatcggccagatccagtactgcagcctggaggagaagatccagagccccacagaggagacagagatcttctaccacagaggagtgtag

SEQ ID NO: 38020 - DNA, 192 bp, Artificial Sequence
  Description of Artificial Sequence: Synthetic coding sequence
atggcccccaccgtcttcctgtccatgacccccctgaagggcatcaagagcgtcatcctgccccaggtgttcctgtgtgcctacatggccgccttcaacagcatcaatggaaacagaagctacacctgcaagcccctggagaggagcctgctgatggccggggctgtggccagcagcaccttcctgggctag

SEQ ID NO: 38021 - DNA, 1023 bp, Artificial Sequence
  Description of Artificial Sequence: Synthetic coding sequence
atggctgacacagccaccacagccagcgctgctgctgccagcgctgccagcgccagcagtgatgccccacccttccagctgggcaagccccgcttccagcagaccagcttctacggccgcttccgccacttcctggacatcatcgaccccaggaccctgtttgtgacagagcggcggctgcgggaggccgtgcagctgctggaggactacaagcacggcaccctgcggcctggggtgaccaatgagcagctgtggagcgcccagaagatcaagcaggccatcctgcacccagacaccaatgagaagatcttcatgcccttcaggatgagcggctacatccccttcggcacccccatcgtggtgggcctgctgctgcccaaccagaccctggccagcacagtgttctggcagtggctgaaccagagccacaatgcctgtgtgaactatgccaacagaaatgccaccaagcccagccctgccagcaagttcatccagggctacctgggcgccgtcatctctgctgtgtccattgctgtgggcctgaatgtgctggtgcagaaggccaacaagttcaccccagccacccggctgctgatccagagatttgtgcccttccctgctgtggccagcgccaacatctgcaatgtggtgctgatgagatatggagagctggaggagggcattgatgtgctggacagtgatggcaacctggtgggcagcagcaagattgctgcccggcatgccctgctggagacagccctgaccagggtggtgctgcccatgcccatcctggtgctgccccccatcgtgatgtccatgctggagaagacagccctgctgcaggcccggccccggctgctgctgcctgtgcagagcctggtgtgcctggccgccttcggcctggccctgcccctggccatcagcctcttcccccagatgtctgaaattgagaccagccagctggagcctgagatcgcccaggccaccagcagcaggacagtggtgtacaacaagggcctgtag

SEQ ID NO: 38022 - DNA, 4389 bp, Artificial Sequence
  Description of Artificial Sequence: Synthetic coding sequence
atgggcgcccaggaccggccccagtgccactttgatattgagatcaaccgggagcctgtgggccgcatcatgttccagctgttcagtgacatctgccccaagacctgcaagaacttcctgtgcctgtgcagcggggagaagggcctgggcaagaccaccgggaagaagctgtgctacaagggcagcaccttccaccgggtggtgaagaacttcatgatccagggcggggacttcagcgagggcaatggcaagggcggggagagcatctacggcggctacttcaaggatgagaacttcatcctgaagcatgaccgggccttcctgctgtccatggccaacagaggcaagcacaccaacggcagccagttcttcatcaccaccaagccagccccccacctggatggagtgcacgtggtgtttggcctggtgatcagcggctttgaagtcatcgagcagatcgagaacctgaagacagatgctgccagccggccctatgcagatgtgcgggtgattgactgtggggtgctggccaccaagagcatcaaggatgtgtttgagaagaagaggaagaagcccacccacagcgagggcagtgacagcagcagcaacagcagcagcagcagcgagagcagcagcgagagcgagctggagcacgagaggagcagaagaaggaagcacaagaggcggcccaaggtgaagaggagcaagaagaggaggaaggaggccagcagcagcgaggagcccaggaacaagcacgccatgaaccccaagggccacagcgagaggagtgacaccaatgagaagaggtctgtggacagcagcgccaagcgggagaagcctgtggtgcggcctgaggagatcccccctgtgcctgagaaccgcttcctgctgcggcgggacatgcctgtggtgacagctgagcctgagcccaagatcccagatgtggcccccatcgtgtctgaccagaagcccagcgtgtccaagagcggcaggaagatcaagggccggggcaccatccgctaccacaccccacccaggagccgcagctgcagcgagagtgatgatgatgacagcagcgagaccccaccccactggaaggaggagatgcagaggctgcgggcctacagacctccttctggagagaagtggagcaaaggagacaagctgagtgacccctgcagcagccgctgggatgagaggagcctgagccagaggagccgctcctggagctacaacggctactacagcgacctgagcacagcccggcacagcggccaccacaagaagaggaggaaggagaagaaggtgaagcacaagaagaagggcaagaagcagaagcactgcagaagacacaagcagaccaagaagaggcgcatcctgatccccagcgacatcgagagcagcaagagcagcaccaggaggatgaagagcagctgtgaccgggagaggagcagccgcagcagcagcctgagcagccaccacagcagcaagagggactggagcaagagtgacaaggatgtgcagagcagcctgacccacagcagccgggacagctaccgcagcaagagccacagccagagctacagccggggcagcagccgcagcaggacagccagcaagagcagcagccacagccgcagccgcagcaagagccgcagcagcagcaagagcggccacaggaagagggccagcaagagccccaggaagacagccagccagctgtctgagaacaagcctgtgaagacagagcccctgcgggccaccatggcccagaatgaaaatgtggtggtgcagcctgtggtggccgagaacatccctgtgatccccctgagtgacagccccccacccagccgctggaagccaggccagaagccctggaagcccagctatgaaagaatccaggagatgaaggccaagaccacccacctgctgcccatccagagcacctacagcctggccaacatcaaggagaccggcagcagcagcagctaccacaagcgggagaagaacagcgagagtgaccagagcacctacagcaagtacagcgacaggagcagcgagagcagccccaggagccgcagccgcagcagccgcagccgcagctacagccgcagctacaccaggagccgcagcctggccagcagccacagccgcagccgcagccccagcagccgcagccacagcaggaacaagtacagcgaccacagccagtgcagccgcagcagcagctacaccagcatcagcagtgatgatggaagaagagccaagaggcggctgcggagcagcggcaagaagaacagcgtgagccacaagaagcacagcagcagcagcgagaagaccctgcacagcaaatatgtgaagggccgggacaggagcagctgtgtgaggaagtacagcgagagccgcagcagcctggactacagcagtgacagcgagcagagctctgtgcaggccacccagagcgcccaggagaaggagaagcagggccagatggagaggacccacaacaagcaggagaagaacagaggagaggagaagagcaagtctgagcgggagtgcccccacagcaagaagaggaccctgaaggagaacctgagtgaccacctgagaaatggcagcaagcccaagaggaagaactatgccggcagcaagtgggacagcgagagcaacagcgagagagatgtgaccaagaacagcaagaatgacagccaccccagcagtgacaaggaggagggggaggccaccagtgacagcgagagcgaggtgtctgagatccacatcaaggtgaagcccaccaccaagagcagcaccaacaccagcctgcctgatgacaatggagcctggaagagcagcaagcagaggaccagcaccagtgacagcgagggcagctgcagcaacagcgagaacaacagaggcaagccccagaagcacaagcacggcagcaaagaaaacctgaagcgggagcacaccaagaaggtgaaggagaagctgaagggcaagaaggacaagaagcacaaggcccccaagaggaagcaggccttccactggcagccccccctggagtttggagaggaggaggaggaggagattgatgacaagcaggtgacccaggagagcaaggagaagaaggtgtctgagaacaatgagaccatcaaggacaacatcctgaagacagagaagagcagcgaggaggacctgagcggcaagcatgacacagtgacagtgtccagtgacctggaccagttcaccaaggatgacagcaagctgagcatcagccccacagccctgaacacagaggagaatgtggcctgcctgcagaacatccagcacgtggaggagagcgtgcccaatggagtggaggatgtgctgcagacagatgacaacatggagatctgcaccccagacaggagcagccctgccaaggtggaggagaccagccccctgggcaatgcccggctggacaccccagacatcaacatcgtgctgaagcaggacatggccacagagcacccccaggccgaggtggtgaagcaggagagctccatgtctgagagcaaggtgctgggggaggtgggcaagcaggacagcagcagcgccagcctggccagcgctggggagagcacaggcaagaaggaggtggccgagaagagccagatcaacctgattgacaagaagtggaagcccctgcagggcgtgggcaacctggccgccccaaatgctgccaccagcagcgctgtggaggtgaaggtgctgaccaccgtgcctgagatgaagccccagggcctgcgcatcgagatcaagagcaagaacaaggtgcggcccggcagcctgtttgatgaggtgaggaagacagcccggctgaacagaagacccaggaaccaggagagcagcagtgatgagcagacccccagcagagatgatgacagccagagccgcagccccagccgcagccgcagcaagtctgagaccaagagccgccacaggaccaggtctgtgtcctacagccacagccgcagccgcagccgcagcagcaccagcagctaccgcagccgcagctacagccgcagccgcagccggggctggtacagccggggccgcaccaggagccgcagcagcagctaccgcagctacaagagccacaggaccagcagccgcagccgcagccgcagcagcagctatgacccccacagccgcagccgcagctacacctatgacagctactacagccgcagccgcagccgcagccgcagccagaggagtgacagctaccaccggggccgcagctacaacagaagaagccgcagctgccgctcctatggcagtgacagcgagagtgacaggagctacagccaccacaggagccccagcgagagcagccgctacagctag

SEQ ID NO: 38023 - DNA, 681 bp, Artificial Sequence
  Description of Artificial Sequence: Synthetic coding sequence
atggctgctgctgctgtgcagggcggccgcagcggcggcagcggcggctgcagcggggccggcggggccagcaactgtggcaccggcagcggccgcagcggcctgctggacaagtggaagattgatgacaagcctgtgaagattgacaagtgggatggcagcgctgtgaagaacagcctggatgattctgccaagaaggtgctgctggagaagtacaagtatgtggagaactttggcctgattgatggccgcctgaccatctgcaccatcagctgcttctttgccatcgtggccctgatctgggactacatgcaccccttccctgagagcaagcctgtgctggccctgtgtgtgatctcctactttgtgatgatgggcatcctgaccatctacaccagctacaaggagaagagcatcttcctggtggcccacaggaaggaccccaccggcatggaccctgatgacatctggcagctgagcagcagcctgaagagatttgatgacaagtacaccctgaagctgaccttcatcagcggccgcaccaagcagcagcgggaggccgagttcaccaagagcatcgccaagttctttgaccacagcggcaccctggtgatggatgcctatgagcctgagatcagccggctgcatgacagcctggccattgaaaggaagatcaagtag

SEQ ID NO: 38024 - DNA, 543 bp, Artificial Sequence
  Description of Artificial Sequence: Synthetic coding sequence
atgaacacagtgctgagccgggccaacagcctgtttgccttcagcctgtctgtgatggccgccctgaccttcggctgcttcatcaccacagccttcaaggacagatctgtgcctgtgcggctgcacgtgagccgcatcatgctgaagaatgtggaggacttcaccggcccccgggagaggagtgacctgggcttcatcacctttgacatcacagctgacctggagaacatctttgactggaatgtgaagcagctgttcctgtacctgtctgctgagtacagcaccaagaacaatgccctgaaccaggtggtgctgtgggacaagatcgtgctgcggggggacaaccccaagctgctgctgaaggacatgaagaccaagtacttcttctttgatgatggaaatggcctgaagggcaacagaaatgtgaccctgaccctgtcctggaatgtggtgcccaatgccggcatcctgcccctggtgactggaagtggccacgtgtctgtgcccttcccagacacctatgagatcaccaagagctactag

SEQ ID NO: 38025 - DNA, 1563 bp, Artificial Sequence
  Description of Artificial Sequence: Synthetic coding sequence
atgggcccccagaggcggctgagccctgctggggccgccctgctgtggggcttcctgctgcagctgacagctgcccaggaggccatcctgcacgccagcggaaatggcaccaccaaggactactgcatgctgtacaacccctactggacagccctgcccagcaccctggagaatgccaccagcatcagcctgatgaacctgaccagcacccccctgtgcaacctgagtgacatcccccctgtgggcatcaagagcaaggctgtggtggtgccctggggcagctgccacttcctggagaaggccagaattgcccagaagggcggcgctgaggccatgctggtggtgaacaacagcgtgctcttcccccccagcggcaacagaagtgagttcccagatgtgaagatcctgattgccttcatctcctacaaggacttccgggacatgaaccagaccctgggggacaacatcaccgtgaagatgtacagccccagctggcccaactttgactacaccatggtggtgatctttgtgattgctgtgttcaccgtggccctgggcggctactggagcggcctggtggagctggagaacctgaaggctgtgaccacagaggaccgggagatgaggaagaagaaggaggagtacctgaccttcagccccctgactgtggtgatctttgtggtgatctgctgcgtgatgatggtgctgctgtacttcttctacaagtggctggtgtatgtgatgattgccatcttctgcatcgccagcgccatgagcctgtacaactgcctggccgccctgatccacaagatcccctacggccagtgcaccatcgcctgccggggcaagaacatggaggtgcggctcatcttcctgagcggcctgtgcatcgctgtggccgtggtgtgggccgtgttcagaaatgaagatcgctgggcctggatcctgcaggacatcctgggcatcgccttctgcctgaacctgatcaagaccctgaagctgcccaacttcaagagctgtgtgatcctgctgggcctgctgctgctgtatgatgtgttctttgtgttcatcacccccttcatcaccaagaatggagagagcatcatggtggagctggccgccggcccctttggaaataatgagaagctgcctgtggtgatccgggtgcccaagctgatctacttctctgtgatgtctgtgtgcctgatgcctgtgtccatcctgggctttggagacatcatcgtgcccggcctgctgattgcctactgccgccgctttgatgtgcagacaggcagcagctacatctactacgtgagcagcacagtggcctatgccatcggcatgatcctgacctttgtggtgctggtgctgatgaagaagggccagcctgccctgctgtacctggtgccctgcaccctcatcacagcctctgtggtggcctggaggaggaaggagatgaagaagttctggaagggcaacagctaccagatgatggaccacctggactgtgccaccaatgaggagaaccctgtgatctctggagagcagatcgtgcagcagtag

SEQ ID NO: 38026 - DNA, 2055 bp, Artificial Sequence
  Description of Artificial Sequence: Synthetic coding sequence
atggcctgcctgggcttcctgctgcctgtgggcttcctgctgctgatcagcacagtggccggcggcaagtatggagtggcccacgtggtgtctgagaactggagcaaggactactgcatcctcttcagcagtgactacatcaccctgccccgggacctgcaccacgcccccctgctgcccctgtatgatggcaccaaggccccctggtgccctggagaggacagcccccaccaggcccagctgcggagccccagccagaggcccctgcggcagaccacagccatggtgatgaggggcaactgcagcttccacaccaagggctggctggcccagggccagggcgcccacggcctgctgattgtgtcccgggtgtctgaccagcagtgcagcgacaccaccctggccccccaggacccccggcagcccctggccgacctgaccatccctgtggccatgctgcactacgccgacatgctggacatcctgagccacaccagaggagaggccgtggtgcgggtggccatgtatgcccctcctgagcccatcatcgactacaacatgctggtgatcttcatcctggccgtgggcaccgtggccgccggcggctactgggccggcctgacagaggccaaccggctgcagaggcggcgggccaggagaggaggcggcagcggcggccaccaccagctgcaggaggccgctgctgctgagggcgcccagaaggaggacaatgaagacatccctgtggacttcaccccagccatgactggagtggtggtgaccctgagctgcagcctgatgctgctgctgtacttcttctatgaccactttgtgtatgtgaccatcggcatcttcggcctgggcgccggcatcggcctgtacagctgcctgagccccctggtgtgccgcctgagcctgcggcagtaccagaggcctccccacagcctgtgggccagcctgcccctgcccctgctgctgctggccagcctgtgtgccaccgtcatcatcttctgggtggcctacagaaatgaagatcgctgggcctggctgctgcaggacaccctgggcatctcctactgcctgtttgtgctgcaccgggtgcggctgcccaccctgaagaactgcagcagcttcctgctggccctgctggcctttgatgtgttctttgtgtttgtgacccccttcttcaccaagacaggagagagcatcatggcccaggtggccctgggccctgctgagagcagcagccatgagcggctgcccatggtgctgaaggtgccccggctgcgggtgtctgccctgaccctgtgcagccagcccttcagcatcctgggctttggagacatcgtggtgcccggcttcctggtggcctactgctgccgctttgatgtgcaggtgtgcagccggcagatctactttgtggcctgcaccgtggcctatgctgtgggcctgctggtgaccttcatggccatggtgctgatgcagatgggccagcctgccctgctgtacctggtgagcagcaccctgctgaccagcctggccgtggccgcctgccggcaggagctgagcctcttctggacaggccagggccgggccaagatgtgtggcctgggctgtgcccccagcgctggcagccggcagaagcaggagggcgctgctgatgcccacacagccagcaccctggagcggggcaccagcagaggagctggggacctggacagcaaccctggagaggacaccacagaaattgtgaccatcagtgaaaatgaggccaccaacccagaagatagaagtgacagcagcgagggctggagcgatgcccacctggaccccaatgagctgcccttcatccccccaggggccagcgaggagctgatgcccctgatgcccatggccatgctgatccccctgatgcccctgatgcctcctccttctgagctgggccacgtgcacgcccaggcccaggcccatgaaacaggcctgccctgggccggcctgcacaagaggaagggcctgaaggtgaggaagtccatgagcacccaggcccccctgtag

SEQ ID NO: 38027 - DNA, 1155 bp, Artificial Sequence
  Description of Artificial Sequence: Synthetic coding sequence
atggccgagcagacctacagctgggcctacagcctggtggacagcagccaggtgtccaccttcctgatcagcatcctgctgattgtgtatggcagcttccgcagcctgaacatggactttgagaaccaggacaaggagaaggacagcaacagcagcagcggcagcttcaatggaaacagcaccaacaacagcatccagaccatcgacagcacccaggccctcttcctgcccatcggggcctctgtgtccctgctggtgatgttcttcttctttgattctgtgcaggtggtgttcaccatctgcacagctgtgctggccaccatcgcctttgccttcctgctgctgcccatgtgccagtacctgacccggccctgcagcccccagaacaagatcagctttggctgctgcggccgcttcaccgctgctgagctgctgtccttcagcctgtctgtgatgctggtgctgatctgggtgctgaccggccactggctgctgatggatgccctggccatgggcctgtgtgtggccatgattgcctttgtgcggctgcccagcctgaaggtgtcctgcctgctgctgagcggcctgctgatctatgatgtgttctgggtgttcttcagcgcctacatcttcaacagcaatgtgatggtgaaggtggccacccagcctgctgacaaccccctggatgtgctgagcaggaagctgcacctgggccccaacgtgggcagagatgtgccccggctgagcctgcccgggaagctggtgttccccagcagcacaggcagccacttctccatgctgggcattggagacatcgtgatgcctggcctgctgctgtgctttgtgctgcgctatgacaactacaagaagcaggccagcggggacagctgtggggcccctggccctgccaacatcagcggccgcatgcagaaggtgtcctacttccactgcaccctcatcggctactttgtgggcctgctgacagccaccgtggccagccgcatccaccgggccgcccagcctgccctgctgtacctggtgcccttcaccctgctgcccctgctgaccatggcctacctgaagggggacctgcggaggatgtggagcgagcccttccacagcaagagcagcagcagccgcttcctggaggtgtag

SEQ ID NO: 38028 - DNA, 1152 bp, Artificial Sequence
  Description of Artificial Sequence: Synthetic coding sequence
tccatccgcacccactgcatggcctacagcctggtggacagcagccaggtgtccaccttcctgatcagcatcctgctgattgtgtatggcagcttccgcagcctgaacatggactttgagaaccaggacaaggagaaggacagcaacagcagcagcggcagcttcaacggcaacagccccatcatcggcatccagaccatcgacagcacccaggccctcttcctgcccatcggggcctctgtgtccctgctggtgatgttcttcttctttgacagcgtgcaggtggtgttcaccatctgcacagctgtgctggccaccatcgcctttgccttcctgctgctgcccatgtgccagtacctgacccggccctgcagcccccagaacaagatcagctttggctgctgcggccgcttcaccgctgctgagctgctgtccttcagcctgtctgtgatgctggtgctgatctgggtgctgaccggccactggctgctgatggatgccctggccatgggcctgtgtgtggccatgattgcctttgtgcggctgcccagcctgaaggtgtcctgcctgctgctgagcggcctgctgatctatgatgtgttctgggtgttcttcagcgcctacatcttcaacagcaatgtgatggtgaaggtggccacccagcctgctgacaaccccctggatgtgctgagcaggaagctgcacctgggccccaacgtgggcagagatgtgccccggctgagcctgcccgggaagctggtgttccccagcagcacaggcagccacttctccatgctgggcatcggggacatcgtgatgcctggcctgctgctgtgctttgtgctgcgctatgacaactacaagaagcaggccagcggggacagctgtggggcccctggccctgccaacatcagcggccgcatgcagaaggtgtcctacttccactgcaccctgattggctactttgtgggcctgctgacagccaccgtggccagccgcatccacagagctgcccagcctgccctgctgtacctggtgcccttcaccctgctgcccctgctgaccatggcctacctgaagggggacctgcggaggatgtggagcgagcccttccacagcaagagcagcagcagccgcttcctggaggtgtag

SEQ ID NO: 38029 - DNA, 816 bp, Artificial Sequence
  Description of Artificial Sequence: Synthetic coding sequence
atggccagcgctgacagcagaagagtggctgatggcggcggggccggcggcaccttccagccctacctggacaccctgcggcaggagctgcagcagacagaccccaccctgctgtctgtggtggtggccgtgctggccgtgctgctgaccctggtgttctggaagctgatccgcagccgccgcagcagccagagagctgtgctgctggtgggcctgtgtgacagcggcaagaccctgctgtttgtgcggctgctgaccggcctgtacagagacacccagaccagcatcacagacagctgtgctgtgtacagagtgaacaacaacagaggcaacagcctgaccctgattgacctgcccggccacgagagcctgcggctgcagttcctggagcgcttcaagagcagcgcccgggccatcgtgtttgtggtggacagcgctgccttccagcgggaggtgaaggatgtggccgagttcctgtaccaggtgctgattgacagcatgggcctgaagaacacccccagcttcctgattgcctgcaacaagcaggacatcgccatggccaagagcgccaagctgatccagcagcagctggagaaggagctgaacaccctgcgggtgaccaggtctgctgcccccagcaccctggacagcagcagcacagccccagcccagctgggcaagaagggcaaggagtttgagttcagccagctgcccctgaaggtggagttcctggagtgcagcgccaagggcggcagaggagatgtgggcagcgctgacatccaggacctggagaagtggctggccaagatcgcctag

SEQ ID NO: 38030 - DNA, 279 bp, Artificial Sequence
  Description of Artificial Sequence: Synthetic coding sequence
atggccagcgctgacagcagaagagtggctgatggcggcggggccggcggcaccttccagccctacctggacaccctgcggcaggagctgcagcagacagaccccaccctgctgtctgtggtggtggccgtgctggccgtgctgctgaccctggtgttctggaagctgatccgcagccgccgcagcagccagagagctgtgctgctggtgggcctgtgtgacagcggcaagaccctgctgtttgtgcggctgctgaccggcctgtacagagacacctag

SEQ ID NO: 38031 - DNA, 861 bp, Artificial Sequence
  Description of Artificial Sequence: Synthetic coding sequence
atgaggctgctgccccggctgctgctgctgctgctgctggtgtttcctgccaccgtgctcttccggggcggcccccggggcctgctggccgtggcccaggacctgacagaagatgaggagaccgtggaggacagcatcattgaagatgaagatgatgaggccgaggtggaggaggatgagcccacagacctggtggaggacaaggaggaggaggatgtgtctggagagcctgaggccagccccagcgctgacaccaccatcctgtttgtgaagggggaggacttccctgccaacaacatcgtgaagttcctggtgggcttcaccaacaagggcacagaggacttcatcgtggagagcctggatgccagcttccgctacccccaggactaccagttctacatccagaacttcaccgccctgcccctgaacacagtggtgcccccccagaggcaggccacctttgagtacagcttcatcccagctgagcccatgggcggccggcccttcggcctggtgatcaacctgaactacaaggacctgaatggaaatgtgttccaggatgctgtgttcaaccagacagtgacagtgattgagcgggaggatggcctggatggagagaccatcttcatgtacatgttcctggccggcctgggcctgctggtgattgtgggcctgcaccagctgctggagagcaggaagaggaagaggcccatccagaaggtggagatgggcaccagcagccagaatgatgtggacatgtcctggatcccccaggagaccctgaaccagatcaacaaggccagcccccggcggctgcccaggaagagggcccagaagaggtctgtgggcagtgatgaatag

SEQ ID NO: 38032 - DNA, 780 bp, Artificial Sequence
  Description of Artificial Sequence: Synthetic coding sequence
atgaggctgctgccccggctgctgctgctgctgctgctggtgtttcctgccaccgtgctcttccggggcggcccccggggcctgctggccgtggcccaggacctgacagaagatgaggagaccgtggaggacagcatcattgaagatgaagatgatgaggccgaggtggaggaggatgagcccacagacctggtgaagtacttccctgccaacaacatcgtgaagttcctggtgggcttcaccaacaagggcacagaggacttcatcgtggagagcctggatgccagcttccgctacccccaggactaccagttctacatccagaacttcaccgccctgcccctgaacacagtggtgcccccccagaggcaggccacctttgagtacagcttcatcccagctgagcccatgggcggccggcccttcggcctggtgatcaacctgaactacaaggacctgaatggaaatgtgttccaggatgctgtgttcaaccagacagtgaccgtcatcgagagagaagatggcctggatggagagaccatcttcatgtacatgttcctggccggcctgggcctgctggtgattgtgggcctgcaccagctgctggagagcaggaagaggaagaggcccatccagaaggtggagatgggcaccagcagccagaatgatgtggacatgtcctggatcccccaggagaccctgaaccagatcaacaaggccagcccccggcggctgcccaggaagagggcccagaagaggtctgtgggcagtgatgaatag

SEQ ID NO: 38033 - DNA, 558 bp, Artificial Sequence
  Description of Artificial Sequence: Synthetic coding sequence
atggcccccaagggcagcagcaagcagcagagcgaggaggacctgctgctgcaggacttcagcaggaacctgagcgccaagagcagcgccctcttctttggaaatgccttcatcgtgtctgccatccccatctggctgtactggaggatctggcacatggacctgatccagagcgctgtgctgtacagcgtgatgaccctggtgtccacctacctggtggcctttgcctacaagaatgtgaagtttgtgctgaagcacaaggtggcccagaagagagaagatgctgtgtccaaggaggtgaccaggaagctgtctgaggccgacaacaggaagatgagcaggaaggagaaggatgagcgcatcctgtggaagaagaatgaggtggccgactatgaggccaccaccttcagcatcttctacaacaacaccctcttcctggtggtggtgattgtggccagcttcttcatcctgaagaacttcaaccccaccgtgaactacatcctgagcatcagcgccagcagcggcctgattgccctgctgagcacaggcagcaagtag

SEQ ID NO: 38034 - DNA, 597 bp, Artificial Sequence
  Description of Artificial Sequence: Synthetic coding sequence
atggcccccaagggcagcagcaagcagcagagcgaggaggacctgctgctgcaggacttcagcaggaacctgagcgccaagagcagcgccctcttctttggaaatgccttcatcgtgtctgccatccccatctggctgtactggaggatctggcacatggacctgatccagagcgctgtgctgtacagcgtgatgaccctggtgtccacctacctggtggcctttgcctacaagaatgtgaagtttgtgctgaagcacaaggtggcccagaagagagaagatgctgtgtccaaggaggtgaccaggaagctgtctgaggccgacaacaggaagatgagcaggaaggagaaggatgaaagatttgacagctgcctgaagtatggccaccacaagaggggcatcctgtggaagaagaatgaggtggccgactatgaggccaccaccttcagcatcttctacaacaacaccctcttcctggtggtggtgattgtggccagcttcttcatcctgaagaacttcaaccccaccgtgaactacatcctgagcatcagcgccagcagcggcctcatcgccctgctgagcacaggcagcaagtag

SEQ ID NO: 38035 - DNA, 5352 bp, Artificial Sequence
  Description of Artificial Sequence: Synthetic coding sequence
atgaccagcctgaagaggagccagacagagcggcccctggccacagaccgggcctctgtggtgggcacagatggcacccccaaggtgcacacagatgacttctacatgaggcgcttccgcagccagaatggcagcctgggcagctctgtgatggcccctgtgggcccccccaggtctgagggcagccaccacatcaccagcaccccaggagtgcccaagatgggcgtgcgggccagaattgctgactggccacccaggaaggagaacatcaaggagagcagccgcagcagccaggagattgagaccagcagctgcctggacagcctgagcagcaagagcagccctgtgtcccagggcagctctgtgtccctgaacagcaatgattctgccatgctgaagagcatccagaacaccctgaagaacaagacccggcccagcgagaacatggacagccgcttcctgatgcctgaggcctaccccagcagccccaggaaggccctgcggcgcatccggcagaggagcaacagcgacatcaccatcagcgagctggatgtggacagctttgatgagtgcatcagccccacctacaagacaggccccagcctgcaccgggagtatggcagcaccagcagcattgacaagcagggcaccagcggggagagcttctttgacctgctgaagggctacaaggatgacaagagtgaccggggccccacccccaccaagctgagtgacttcctgatcactggaggcggcaaaggaagtggcttcagcctggatgtgattgatggccccatcagccagcgggagaacctgcggctcttcaaggagcgggagaagcccctgaagaggaggagcaagtctgagaccggggacagcagcatcttcaggaagctgagaaatgccaagggggaggagctgggcaagagcagtgacctggaggacaacagaagtgaagattctgtgcggccctggacctgccccaagtgctttgcccactatgatgtgcagagcatcctgtttgacctgaatgaggccatcatgaacagacacaacgtcatcaagagaagaaacaccaccactggagccagcgctgctgctgtggccagcctggtgtctggccccctgagccacagcgccagcttcagcagccccatgggcagcacagaggacctgaacagcaagggcagcctgtccatggaccagggagatgacaagagcaatgagctggtgatgagctgcccctacttcagaaatgaaattggaggagagggggagaggaagatcagcctgagcaagagcaacagcggcagcttcagcggctgtgagagcgccagctttgagagcaccctgagcagccactgcaccaatgctggggtggccgtgctggaggtgcccaaggagaacctggtgctgcacctggacagagtgaagcgctacatcgtggagcacgtggacctgggcgcctactactacaggaagttcttctaccagaaggagcactggaactactttggagcagatgagaacctgggccctgtggccgtgtccatcagaagagagaagccagatgagatgaaggaaaatggcagcccctacaactaccgcatcatcttccgcaccagcgagctgatgaccctgcggggctctgtgctggaggatgccatccccagcacagccaagcacagcacagcccggggcctgcccctgaaggaggtgctggagcacgtggtgcctgagctgaatgtgcagtgcctgcggctggccttcaacacccccaaggtgacagagcagctgatgaagctggatgagcagggcctgaactaccagcagaaggtgggcatcatgtactgcaaggccggccagagcacagaggaggagatgtacaacaatgaatctgctggccctgcctttgaggagttcctgcagctgctgggggagcgggtgcggctgaagggctttgagaagtaccgggcccagctggacaccaagacagacagcacaggcacccacagcctgtacaccacctacaaggactatgagatcatgtttcatgtgtccaccatgctgccctacacccccaacaacaagcagcagctgctgaggaagaggcacatcggaaatgacatcgtgaccatcgtgttccaggagcccggggcccagcccttcagccccaagaacatccgcagccacttccagcacgtgtttgtgattgtgcgggtgcacaacccctgcagcgacagcgtgtgctacagcgtggccgtgaccaggagcagagatgtgcccagctttggcccccccatccccaagggcgtgaccttccccaagagcaatgtgttccgggacttcctgctggccaaggtgatcaatgcagaaaatgctgcccacaagtctgagaagttccgggccatggccaccaggacccggcaggagtacctgaaggacctggccgagaagaatgtgaccaacacccccatcgaccccagcggcaagttccccttcatcagcctggccagcaagaagaaggagaagagcaagccctacccaggagctgagctgagctccatgggcgccatcgtgtgggccgtgcgggcagaggactacaacaaggccatggagctggactgcctgctgggcatcagcaatgagttcatcgtgctgattgagcaggagaccaagtctgtggtgttcaactgcagctgcagagatgtgattggctggaccagcacagacaccagcctgaagatcttctatgaaagaggagaatgtgtgtctgtgggcagcttcatcaacatcgaggagatcaaggagatcgtgaagaggctgcagtttgtgtccaagggctgtgagagcgtggagatgaccctgcggagaaatggcctgggccagctgggcttccacgtgaactatgagggcatcgtggctgatgtggagccctacggctacgcctggcaggccggcctgcggcagggcagccggctggtggagatctgcaaggtggccgtggccaccctgagccatgagcagatgattgacctgctgcggacctctgtgacagtgaaggtggtgatcatcccccctcatgatgactgcaccccccggcgcagctgcagcgagacctacaggatgcctgtgatggagtacaagatgaatgaaggagtgtcctatgagttcaagttccccttcaggaacaacaacaagtggcagagaaatgccagcaagggcccccacagcccccaggtgcccagccaggtgcagagccccatgaccagccggctgaatgctggaaaaggagatggcaagatgcctcctcctgagcgggccgccaacatccccaggagcatcagcagtgatggccggcccctggagcggcggctgagccctggcagtgacatctacgtgacagtgtcctccatggccctggcccggagccagtgcaggaacagccccagcaacctgagcagcagcagtgacaccggctctgtgggcggcacctaccggcagaagtccatgcctgagggctttggagtgtccagaagaagccctgccagcattgaccggcagaacacccagagcgacatcggcggcagcggcaagagcacccccagctggcagaggtctgaggacagcattgctgaccagatggagcccacctgccacctgcctgctgtgtccaaggtgctgcctgccttccgggagagccccagcggccgcctgatgaggcaggaccctgtggtgcacctgagccccaacaagcagggccacagcgacagccactacagcagccacagcagcagcaacaccctgagcagcaatgccagcagcgcccacagtgatgagaagtggtatgatggagacagaacagagagcgagctgaacagctacaactacctgcagggcaccagcgctgacagcggcatcgacaccaccagctatggccccagccacggcagcacagccagcctgggcgccgccaccagcagccccaggagcggccctgggaaggagaaggtggcccccctgtggcacagcagcagcgaggtgatctccatggctgacaggaccctggagacagagagccacggcctggacaggaagacagagagcagcctgagcctggacatccacagcaagagccaggccggcagcacccccctgacccgggagaacagcaccttcagcatcaatgatgctgccagccacaccagcaccatgagcagccgccacagcgccagccctgtggtgttcaccagcgcccggagcagccccaaggaggagctgcaccctgctgcccccagccagctggcccccagcttcagcagcagcagcagcagcagcagcggccccaggagcttctacccccggcagggcgccaccagcaagtacctgattggctggaagaagccagagggcaccatcaacagcgtgggcttcatggacaccaggaagaggcaccagagtgatggaaatgagatcgcccacacccggctgcgggccagcacccgggacctgcgggccagccccaagcccaccagcaagagcaccatcgaggaggacctgaagaagctgattgacctggagagccccaccccagagagccagaagagcttcaagttccacgccctgagcagcccccagagccccttccccagcacccccaccagccggcgggccctgcacaggaccctgagtgatgagagcatctacaacagccagcgggagcacttcttcaccagccgggccagcctgctggaccaggccctgcccaatgatgtgctcttcagcagcacctaccccagcctgcccaagagcctgcccctgcggcggcccagctacaccctgggcatgaagagcctgcacggggagttcagcgccagtgacagcagcctgacagacatccaggagacccggcggcagcccatgccagaccccggcctgatgcccctgcctgacacagctgctgacctggactggagcaacctggtggatgctgccaaggcctatgaggtgcagagggccagcttctttgctgccagtgatgagaaccaccggcccctgtctgctgccagcaacagcgaccagctggaggaccaggccctggcccagatgaagccctacagcagcagcaaggacagcagccccaccctggccagcaaggtggaccagctggagggcatgctgaagatgctgcgggaggacctgaagaaggagaaggaggacaaggcccacctgcaggccgaggtgcagcacctgcgggaggacaacctgcggctgcaggaggagagccagaatgccagtgacaagctgaagaagttcacagagtgggtgttcaacaccatcgacatgtcctag

SEQ ID NO: 38036 - DNA, 3774 bp, Artificial Sequence
  Description of Artificial Sequence: Synthetic coding sequence
atgaaggaaaatggcagcccctacaactaccgcatcatcttccgcaccagcgagctgatgaccctgcggggctctgtgctggaggatgccatccccagcacagccaagcacagcacagcccggggcctgcccctgaaggaggtgctggagcacgtggtgcctgagctgaatgtgcagtgcctgcggctggccttcaacacccccaaggtgacagagcagctgatgaagctggatgagcagggcctgaactaccagcagaaggtgggcatcatgtactgcaaggccggccagagcacagaggaggagatgtacaacaatgaatctgctggccctgcctttgaggagttcctgcagctgctgggggagcgggtgcggctgaagggctttgagaagtaccgggcccagctggacaccaagacagacagcacaggcacccacagcctgtacaccacctacaaggactatgagatcatgttccacgtgtccaccatgctgccctacacccccaacaacaagcagcagctgctgaggaagaggcacatcggaaatgacatcgtgaccatcgtgttccaggagcccggggcccagcccttcagccccaagaacatccgcagccacttccagcacgtgtttgtgattgtgcgggtgcacaacccctgcagcgacagcgtgtgctacagcgtggccgtgaccaggagcagagatgtgcccagctttggaccacccatccccaagggcgtgaccttccccaagagcaatgtgttccgggacttcctgctggccaaggtgatcaatgcagaaaatgctgcccacaagtctgagaagttccgggccatggccaccaggacccggcaggagtacctgaaggacctggccgagaagaatgtgaccaacacccccatcgaccccagcggcaagttccccttcatcagcctggccagcaagaagaaggagaagagcaagccctacccaggagctgagctgagctccatgggcgccatcgtgtgggccgtgcgggcagaggactacaacaaggccatggagctggactgcctgctgggcatcagcaatgagttcatcgtgctgattgagcaggagaccaagtctgtggtgttcaactgcagctgcagagatgtgattggctggaccagcacagacaccagcctgaagatcttctatgaaagaggagaatgtgtgtctgtgggcagcttcatcaacatcgaggagatcaaggagatcgtgaagaggctgcagtttgtgtccaagggctgtgagagcgtggagatgaccctgcggagaaatggcctgggccagctgggcttccacgtgaactatgagggcatcgtggctgatgtggagccctacggctacgcctggcaggccggcctgcggcagggcagccggctggtggagatctgcaaggtggccgtggccaccctgagccatgagcagatgattgacctgctgcggacctctgtgacagtgaaggtggtgatcatcccccctcatgatgactgcaccccaagaagaagctgcagcgagacctacaggatgcctgtgatggagtacaagatgaatgaaggagtgtcctatgagttcaagttccccttcaggaacaacaacaagtggcagagaaatgccagcaagggcccccacagcccccaggtgcccagccaggtgcagagccccatgaccagccggctgaatgctggaaaaggagatggcaagatgcctcctcctgagagagctgccaacatccccaggagcatcagcagtgatggccggcccctggagcggcggctgagccctggcagtgacatctacgtgacagtgtcctccatggccctggcccggagccagtgcaggaacagccccagcaacctgagcagcagcagtgacaccggctctgtgggcggcacctaccggcagaagtccatgcctgagggcttcggcgtgagccgccgcagccctgccagcattgaccggcagaacacccagagcgacattggaggcagcggcaagagcacccccagctggcagaggagtgaagattccattgctgaccagatggagcccacctgccacctgcctgctgtgtccaaggtgctgcctgccttccgggagagccccagcggccgcctgatgaggcaggaccctgtggtgcacctgagccccaacaagcagggccacagcgacagccactacagcagccacagcagcagcaacaccctgagcagcaatgccagcagcgcccacagtgatgagaagtggtatgatggagacagaacagaaagtgagctgaacagctacaactacctgcagggcaccagcgctgacagcggcatcgacaccaccagctatggccccagccacggcagcacagccagcctgggcgccgccaccagcagccccaggagcggccctgggaaggagaaggtggcccccctgtggcacagcagcagcgaggtgatctccatggctgacaggaccctggagacagagagccacggcctggacaggaagacagagagcagcctgagcctggacatccacagcaagagccaggccggcagcacccccctgacccgggagaacagcaccttcagcatcaatgatgctgccagccacaccagcaccatgagcagccgccacagcgccagccctgtggtgttcaccagcgcccggagcagccccaaggaggagctgcaccctgctgcccccagccagctggcccccagcttcagcagcagcagcagcagcagcagcggccccaggagcttctacccccggcagggcgccaccagcaagtacctgattggctggaagaagccagagggcaccatcaacagcgtgggcttcatggacaccaggaagaggcaccagagtgatggaaatgaaattgcccacacccggctgcgggccagcacccgggacctgcgggccagccccaagcccaccagcaagagcaccatcgaggaggacctgaagaagctgattgacctggagagccccaccccagagagccagaagagcttcaagttccacgccctgagcagcccccagagccccttccccagcacccccaccagcagaagagccctgcacaggaccctgagtgatgagagcatctacaacagccagcgggagcacttcttcaccagccgggccagcctgctggaccaggccctgcccaatgatgtgctcttcagcagcacctaccccagcctgcccaagagcctgcccctgcggcggcccagctacaccctgggcatgaagagcctgcatggagagttcagcgccagtgacagcagcctgacagacatccaggagacccggcggcagcccatgccagaccccggcctgatgcccctgcctgacacagctgctgacctggactggagcaacctggtggatgctgccaaggcctatgaggtgcagagggccagcttctttgctgccagtgatgagaaccaccggcccctgtctgctgccagcaacagcgaccagctggaggaccaggccctggcccagatgaagccctacagcagcaaggacagcagccccaccctggccagcaaggtggaccagctggagggcatgctgaagatgctgcgggaggacctgaagaaggagaaggaggacaaggcccacctgcaggccgaggtgcagcacctgcgggaggacaacctgcggctgcaggaggagagccagaatgccagtgacaagctgaagaagttcacagagtgggtgttcaacaccatcgacatgtcctag

SEQ ID NO: 38037 - DNA, 5415 bp, Artificial Sequence
  Description of Artificial Sequence: Synthetic coding sequence
atgaccagcctgaagaggagccagacagagcggcccctggccacagaccgggcctctgtggtgggcacagatggcacccccaaggtgcacacagatgacttctacatgaggcgcttccgcagccagaatggcagcctgggcagctctgtgatggcccctgtgggcccccccaggtctgagggcagccaccacatcaccagcaccccaggagtgcccaagatgggcgtgcgggccagaattgctgactggccacccaggaaggagaacatcaaggagagcagccgcagcagccaggagattgagaccagcagctgcctggacagcctgagcagcaagagcagccctgtgtcccagggcagctctgtgtccctgaacagcaatgattctgccatgctgaagagcatccagaacaccctgaagaacaagacccggcccagcgagaacatggacagccgcttcctgatgcctgaggcctaccccagcagccccaggaaggccctgcggcgcatccggcagaggagcaacagcgacatcaccatcagcgagctggatgtggacagctttgatgagtgcatcagccccacctacaagacaggccccagcctgcaccgggagtatggcagcaccagcagcattgacaagcagggcaccagcggggagagcttctttgacctgctgaagggctacaaggatgacaagagtgaccggggccccacccccaccaagctgagtgacttcctgatcactggaggcggcaaaggaagtggcttcagcctggatgtgattgatggccccatcagccagcgggagaacctgcggctcttcaaggagcgggagaagcccctgaagaggaggagcaagtctgagaccggggacagcagcatcttcaggaagctgagaaatgccaagggggaggagctgggcaagagcagtgacctggaggacaacagaagtgaagattctgtgcggccctggacctgccccaagtgctttgcccactatgatgtgcagagcatcctgtttgacctgaatgaggccatcatgaacagacacaacgtcatcaagagaagaaacaccaccactggagccagcgctgctgctgtggccagcctggtgtctggccccctgagccacagcgccagcttcagcagccccatgggcagcacagaggacctgaacagcaagggcagcctgtccatggaccagggagatgacaagagcaatgagctggtgatgagctgcccctacttcagaaatgaaattggaggagagggggagaggaagatcagcctgagcaagagcaacagcggcagcttcagcggctgtgagagcgccagctttgagagcaccctgagcagccactgcaccaatgctggggtggccgtgctggaggtgcccaaggagaacctggtgctgcacctggacagagtgaagcgctacatcgtggagcacgtggacctgggcgcctactactacaggaagttcttctaccagaaggagcactggaactactttggagcagatgagaacctgggccctgtggccgtgtccatcagaagagagaagccagatgagatgaaggaaaatggcagcccctacaactaccgcatcatcttccgcaccagcgagctgatgaccctgcggggctctgtgctggaggatgccatccccagcacagccaagcacagcacagcccggggcctgcccctgaaggaggtgctggagcacgtggtgcctgagctgaatgtgcagtgcctgcggctggccttcaacacccccaaggtgacagagcagctgatgaagctggatgagcagggcctgaactaccagcagaaggtgggcatcatgtactgcaaggccggccagagcacagaggaggagatgtacaacaatgaatctgctggccctgcctttgaggagttcctgcagctgctgggggagcgggtgcggctgaagggctttgagaagtaccgggcccagctggacaccaagacagacagcacaggcacccacagcctgtacaccacctacaaggactatgagatcatgtttcatgtgtccaccatgctgccctacacccccaacaacaagcagcagctgctgaggaagaggcacatcggaaatgacatcgtgaccatcgtgttccaggagcccggggcccagcccttcagccccaagaacatccgcagccacttccagcacgtgtttgtgattgtgcgggtgcacaacccctgcagcgacagcgtgtgctacagcgtggccgtgaccaggagcagagatgtgcccagctttggcccccccatccccaagggcgtgaccttccccaagagcaatgtgttccgggacttcctgctggccaaggtgatcaatgcagaaaatgctgcccacaagtctgagaagttccgggccatggccaccaggacccggcaggagtacctgaaggacctggccgagaagaatgtgaccaacacccccatcgaccccagcggcaagttccccttcatcagcctggccagcaagaagaaggagaagagcaagccctacccaggagctgagctgagctccatgggcgccatcgtgtgggccgtgcgggcagaggactacaacaaggccatggagctggactgcctgctgggcatcagcaatgagttcatcgtgctgattgagcaggagaccaagtctgtggtgttcaactgcagctgcagagatgtgattggctggaccagcacagacaccagcctgaagatcttctatgaaagaggagaatgtgtgtctgtgggcagcttcatcaacatcgaggagatcaaggagatcgtgaagaggctgcagtttgtgtccaagggctgtgagagcgtggagatgaccctgcggagaaatggcctgggccagctgggcttccacgtgaactatgagggcatcgtggctgatgtggagccctacggctacgcctggcaggccggcctgcggcagggcagccggctggtggagatctgcaaggtggccgtggccaccctgagccatgagcagatgattgacctgctgcggacctctgtgacagtgaaggtggtgatcatcccccctcatgatgactgcaccccccggcgcagctgcagcgagacctacaggatgcctgtgatggagtacaagatgaatgaaggagtgtcctatgagttcaagttccccttcaggaacaacaacaagtggcagagaaatgccagcaagggcccccacagcccccaggtgcccagccaggtgcagagccccatgaccagccggctgaatgctggaaaaggagatggcaagatgcctcctcctgagcgggccgccaacatccccaggagcatcagcagtgatggccggcccctggagcggcggctgagccctggcagtgacatctacgtgacagtgtcctccatggccctggcccggagccagtgcaggaacagccccagcaacctgagcagcagcagtgacaccggctctgtgggcggcacctaccggcagaagtccatgcctgagggctttggagtgtccagaagaagccctgccagcattgaccggcagaacacccagagcgacatcggcggcagcggcaagagcacccccagctggcagaggtctgaggacagcattgctgaccagatggcctacagctaccggggcccccaggacttcaacagctttgtgctggagcagcacgagtacacagagcccacctgccacctgcctgctgtgtccaaggtgctgcctgccttccgggagagccccagcggccgcctgatgaggcaggaccctgtggtgcacctgagccccaacaagcagggccacagcgacagccactacagcagccacagcagcagcaacaccctgagcagcaatgccagcagcgcccacagtgatgagaagtggtatgatggagacagaacagaaagtgagctgaacagctacaactacctgcagggcaccagcgctgacagcggcatcgacaccaccagctatggccccagccacggcagcacagccagcctgggcgccgccaccagcagccccaggagcggccctgggaaggagaaggtggcccccctgtggcacagcagcagcgaggtgatctccatggctgacaggaccctggagacagagagccacggcctggacaggaagacagagagcagcctgagcctggacatccacagcaagagccaggccggcagcacccccctgacccgggagaacagcaccttcagcatcaatgatgctgccagccacaccagcaccatgagcagccgccacagcgccagccctgtggtgttcaccagcgcccggagcagccccaaggaggagctgcaccctgctgcccccagccagctggcccccagcttcagcagcagcagcagcagcagcagcggccccaggagcttctacccccggcagggcgccaccagcaagtacctgattggctggaagaagccagagggcaccatcaacagcgtgggcttcatggacaccaggaagaggcaccagagtgatggaaatgaaattgcccacacccggctgcgggccagcacccgggacctgcgggccagccccaagcccaccagcaagagcaccatcgaggaggacctgaagaagctgattgacctggagagccccaccccagagagccagaagagcttcaagttccacgccctgagcagcccccagagccccttccccagcacccccaccagcagaagagccctgcacaggaccctgagtgatgagagcatctacaacagccagcgggagcacttcttcaccagccgggccagcctgctggaccaggccctgcccaatgatgtgctcttcagcagcacctaccccagcctgcccaagagcctgcccctgcggcggcccagctacaccctgggcatgaagagcctgcatggagagttcagcgccagtgacagcagcctgacagacatccaggagacccggcggcagcccatgccagaccccggcctgatgcccctgcctgacacagctgctgacctggactggagcaacctggtggatgctgccaaggcctatgaggtgcagagggccagcttctttgctgccagtgatgagaaccaccggcccctgtctgctgccagcaacagcgaccagctggaggaccaggccctggcccagatgaagccctacagcagcagcaaggacagcagccccaccctggccagcaaggtggaccagctggagggcatgctgaagatgctgcgggaggacctgaagaaggagaaggaggacaaggcccacctgcaggccgaggtgcagcacctgcgggaggacaacctgcggctgcaggaggagagccagaatgccagtgacaagctgaagaagttcacagagtgggtgttcaacaccatcgacatgtcctag

SEQ ID NO: 38038 - DNA, 591 bp, Artificial Sequence
  Description of Artificial Sequence: Synthetic coding sequence
atgaaccaggccgacccccggctgcgggctgtgtgcctgtggaccctgaccagcgctgccatgagcagaggagacaactgcacagacctgctggccctgggcatccccagcatcacccaggcctggggcctgtgggtgctgctgggcgctgtgaccctgctcttcctgatcagcctggccgcccacctgagccagtggacccggggccgcagccgcagccaccctggccagggccgcagcggggagagcgtggaggaggtgcccctgtatggcaacctgcactacctgcagacaggccgcctgagccaggaccctgagccagaccagcaggaccccaccctgggcggccctgcccgggctgctgaggaggtgatgtgctacaccagcctgcagctgcggcccccccagggccgcatccctggccctggcacccctgtgaagtacagcgaggtggtgctggacagcgagcccaagagccaggccagcggccctgagcctgagctgtatgcctctgtgtgtgcccagacccggcgggcccgggccagcttcccagaccaggcctatgccaacagccagcctgctgccagctag

SEQ ID NO: 38039 - DNA, 1515 bp, Artificial Sequence
  Description of Artificial Sequence: Synthetic coding sequence
atggagcccgccggccctgcccctggccgcctgggccccctgctgtgcctgctgctggccgccagctgtgcctggagcggcgtggccggggaggaggagctgcaggtgatccagcctgacaagtctgtgctggtggccgccggggagacagccaccctgcgctgcacagccaccagcctcatccctgtgggccccatccagtggttccggggggccggccctggccgggagctgatctacaaccagaaggagggccacttcccccgggtgaccaccgtgtctgacctgaccaagaggaacaacatggacttcagcatccgcatcggcaacatcaccccagcagatgctggcacctactactgtgtgaagttcaggaagggcagcccagatgatgtggagttcaagagcggggccggcacagagctgtctgtgcgggccaagcccagcgcccctgtggtgtctggccctgctgcccgggccaccccccagcacacagtgtccttcacctgtgagagccacggcttcagcccccgggacatcaccctgaagtggttcaagaatggaaatgagctgagtgacttccagaccaacgtggaccctgtgggggagagcgtgtcctacagcatccacagcacagccaaggtggtgctgacccgggaggatgtgcacagccaggtgatctgtgaggtggcccacgtgaccctgcagggcgaccccctgcggggcacagccaacctgtctgagaccatccgggtgccccccaccctggaggtgacccagcagcctgtgcgggcagagaaccaggtgaatgtgacctgccaggtgaggaagttctacccccagaggctgcagctgacctggctggagaatggaaatgtgtccaggacagaaacagccagcacagtgacagagaacaaggatggcacctacaactggatgtcctggctgctggtgaatgtgtctgcccacagagatgatgtgaagctgacctgccaggtggagcatgatggccagcctgctgtgtccaagagccatgacctgaaggtgtctgcccaccccaaggagcagggcagcaacacagctgctgaaaatacaggcagcaatgaaagaaacatctacatcgtggtgggcgtggtgtgcaccctgctggtggccctgctgatggccgccctgtacctggtgcgcatccggcagaagaaggcccagggcagcaccagcagcacccggctgcacgagcctgagaagaatgcccgggagatcacccaggacaccaatgacatcacctacgccgacctgaacctgcccaagggcaagaagccagccccccaggccgctgagcccaacaaccacacagaatatgccagcatccagaccagcccccagcctgccagcgaggacaccctgacctatgctgacctggacatggtgcacctgaacagaacacccaagcagcctgcccccaagccagagcccagcttctctgaatatgcctctgtgcaggtgcccaggaagtag

SEQ ID NO: 38040 - DNA, 1515 bp, Artificial Sequence; identical to SEQ ID NO: 38039
  Description of Artificial Sequence: Synthetic coding sequence

SEQ ID NO: 38041 - DNA, 1527 bp, Artificial Sequence
  Description of Artificial Sequence: Synthetic coding sequence
atggagcccgccggccctgcccctggccgcctgggccccctgctgtgcctgctgctggccgccagctgtgcctggagcggcgtggccggggaggaggagctgcaggtgatccagcctgacaagtctgtgctggtggccgccggggagacagccaccctgcgctgcacagccaccagcctcatccctgtgggccccatccagtggttccggggggccggccctggccgggagctgatctacaaccagaaggagggccacttcccccgggtgaccaccgtgtctgacctgaccaagaggaacaacatggacttcagcatccgcatcggcaacatcaccccagcagatgctggcacctactactgtgtgaagttcaggaagggcagcccagatgatgtggagttcaagagcggggccggcacagagctgtctgtgcgggccaagcccagcgcccctgtggtgtctggccctgctgcccgggccaccccccagcacacagtgtccttcacctgtgagagccacggcttcagcccccgggacatcaccctgaagtggttcaagaatggaaatgagctgagtgacttccagaccaacgtggaccctgtgggggagagcgtgtcctacagcatccacagcacagccaaggtggtgctgacccgggaggatgtgcacagccaggtgatctgtgaggtggcccacgtgaccctgcagggcgaccccctgcggggcacagccaacctgtctgagaccatccgggtgccccccaccctggaggtgacccagcagcctgtgcgggcagagaaccaggtgaatgtgacctgccaggtgaggaagttctacccccagaggctgcagctgacctggctggagaatggaaatgtgtccaggacagaaacagccagcacagtgacagagaacaaggatggcacctacaactggatgtcctggctgctggtgaatgtgtctgcccacagagatgatgtgaagctgacctgccaggtggagcatgatggccagcctgctgtgtccaagagccatgacctgaaggtgtctgcccaccccaaggagcagggcagcaacacagctgctgaaaatacaggcagcaatgaaagaaacatctacatcgtggtgggcgtggtgtgcaccctgctggtggccctgctgatggccgccctgtacctggtgcgcatccggcagaagaaggcccagggcagcaccagcagcacccggctgcacgagcctgagaagaatgcccgggagatcacccaggtgcagagcctggacaccaatgacatcacctacgccgacctgaacctgcccaagggcaagaagccagccccccaggccgctgagcccaacaaccacacagaatatgccagcatccagaccagcccccagcctgccagcgaggacaccctgacctatgctgacctggacatggtgcacctgaacagaacacccaagcagcctgcccccaagccagagcccagcttctctgaatatgcctctgtgcaggtgcccaggaagtag

SEQ ID NO: 38042 - DNA, 543 bp, Artificial Sequence
  Description of Artificial Sequence: Synthetic coding sequence
atgcctgtgcctgcctcctggccccaccccccctgccccttcctgctgctgaccctgctgctgggcctgactggagtggccggagaagatgagctgcaggtgatccagcctgagaagtctgtgtctgtggccgccggggagagcgccaccctgcgctgtgccatgaccagcctcatccctgtgggccccatcatgtggttccggggggccggggccggccgggagctgatctacaaccagaaggagggccacttcccccgggtgaccaccgtgtctgagctgaccaagaggaacaacctggacttcagcatcagcatcagcaacatcaccccagcagatgctggcacctactactgtgtgaagttcaggaagggcagcccagatgatgtggagttcaagagcggggccggcacagagctgtctgtgcgggaggccgccctggcccccacagcccccctgctggtggccctgctgctgggccccaagctgctgctggtggtgggcgtgtctgccatctacatctgctggaagcagaaggcctag

SEQ ID NO: 38043 - DNA, 1197 bp, Artificial Sequence
  Description of Artificial Sequence: Synthetic coding sequence
atgcctgtgcctgcctcctggccccacctgcccagccccttcctgctgatgaccctgctgctgggccgcctgactggagtggccggggaggaggagctgcaggtgatccagcctgacaagagcatctctgtggccgccggggagagcgccaccctgcactgcaccgtgaccagcctcatccctgtgggccccatccagtggttcagaggagctggccctggccgggagctgatctacaaccagaaggagggccacttcccccgggtgaccaccgtgtctgacctgaccaagaggaacaacatggacttcagcatccgcatcagcaacatcaccccagcagatgctggcacctactactgtgtgaagttcaggaagggcagcccagaccacgtggagttcaagtctggagctggaacagagctgtctgtgcgggccaagcccagcgcccctgtggtgtctggccctgctgcccgggccaccccccagcacacagtgtccttcacctgtgagagccacggcttcagcccccgggacatcaccctgaagtggttcaagaatggaaatgagctgagtgacttccagaccaacgtggaccctgctggggacagcgtgtcctacagcatccacagcacagccaaggtggtgctgaccagagaagatgtgcacagccaggtgatctgtgaggtggcccacgtgaccctgcagggcgaccccctgcggggcacagccaacctgtctgagaccatccgggtgccccccaccctggaggtgacccagcagcctgtgcgggcagagaaccaggtgaatgtgacctgccaggtgaggaagttctacccccagaggctgcagctgacctggctggagaatggaaatgtgtccaggacagaaacagccagcaccctgacagagaacaaggatggcacctacaactggatgtcctggctgctggtgaatgtgtctgcccacagagatgatgtgaagctgacctgccaggtggagcatgatggccagcctgctgtgtccaagagccatgacctgaaggtgtctgcccaccccaaggagcagggcagcaacacagcccctggccctgccctggccagcgctgcccccctgctgattgccttcctgctgggccccaaggtgctgctggtggtgggcgtgtctgtcatctacgtgtactggaagcagaaggcctag

SEQ ID NO: 38044 - DNA, 519 bp, Artificial Sequence
  Description of Artificial Sequence: Synthetic coding sequence
atgcctgtgcctgcctcctggccccacctgcccagccccttcctgctgatgaccctgctgctgggccgcctgactggagtggccggggaggaggagctgcaggtgatccagcctgacaagagcatctctgtggccgccggggagagcgccaccctgcactgcaccgtgaccagcctcatccctgtgggccccatccagtggttcagaggagctggccctggccgggagctgatctacaaccagaaggagggccacttcccccgggtgaccaccgtgtctgacctgaccaagaggaacaacatggacttcagcatccgcatcagcaacatcaccccagcagatgctggcacctactactgtgtgaagttcaggaagggcagcccagaccacgtggagttcaagtctggagctggaacagagctgtctgtgcgggtgctgcaggtgaaggagatcaagatccccaggaccctggcctctgtggtgatccaggtgtacctgctgcagcaccctgtggcctag

SEQ ID NO: 38045 - DNA, 546 bp, Artificial Sequence
  Description of Artificial Sequence: Synthetic coding sequence
atgcctgtgcctgcctcctggccccacctgcccagccccttcctgctgatgaccctgctgctgggccgcctgactggagtggccggggaggatgagctgcaggtgatccagcctgagaagtctgtgtctgtggccgccggggagagcgccaccctgcgctgtgccatgaccagcctcatccctgtgggccccatcatgtggttcagaggagctggagctggccgggagctgatctacaaccagaaggagggccacttcccccgggtgaccaccgtgtctgagctgaccaagaggaacaacctggacttcagcatcagcatcagcaacatcaccccagcagatgctggcacctactactgtgtgaagttcaggaagggcagcccagatgatgtggagttcaagtctggagctggaacagagctgtctgtgcgggaggccgccctggcccccacagcccccctgctggtggccctgctgctgggccccaagctgctgctggtggtgggcgtgtctgccatctacatctgctggaagcagaaggcctag

SEQ ID NO: 38046 - DNA, 1197 bp, Artificial Sequence
  Description of Artificial Sequence: Synthetic coding sequence
atgcctgtgcctgcctcctggccccacctgcccagccccttcctgctgatgaccctgctgctgggccgcctgactggagtggccggggaggatgagctgcaggtgatccagcctgagaagtctgtgtctgtggccgccggggagagcgccaccctgcgctgtgccatgaccagcctcatccctgtgggccccatcatgtggttcagaggagctggagctggccgggagctgatctacaaccagaaggagggccacttcccccgggtgaccaccgtgtctgagctgaccaagaggaacaacctggacttcagcatcagcatcagcaacatcaccccagcagatgctggcacctactactgtgtgaagttcaggaagggcagcccagatgatgtggagttcaagtctggagctggaacagagctgtctgtgcgggccaagcccagcgcccctgtggtgtctggccctgctgtgcgggccaccccagagcacacagtgtccttcacctgtgagagccacggcttcagcccccgggacatcaccctgaagtggttcaagaatggaaatgagctgagtgacttccagaccaacgtggaccctgctggggacagcgtgtcctacagcatccacagcacagcccgggtggtgctgaccagaggagatgtgcacagccaggtgatctgtgaaattgcccacatcaccctgcagggcgaccccctgcggggcacagccaacctgtctgaggccatccgggtgccccccaccctggaggtgacccagcagcccatgagagctgagaaccaggccaacgtgacctgccaggtgagcaacttctacccccggggcctgcagctgacctggctggagaatggaaatgtgtccaggacagaaacagccagcaccctgattgagaacaaggatggcacctacaactggatgtcctggctgctggtgaacacctgtgcccacagagatgatgtggtgctgacctgccaggtggagcatgatggccagcaggccgtgtccaagagctatgccctggagatcagcgcccaccagaaggagcacggcagtgacatcacccatgaagctgccctggcccccacagcccccctgctggtggccctgctgctgggccccaagctgctgctggtggtgggcgtgtctgccatctacatctgctggaagcagaaggcctag

SEQ ID NO: 38047 - DNA, 519 bp, Artificial Sequence
  Description of Artificial Sequence: Synthetic coding sequence
atgctggccgccggcgtgggcggccagggcgagcggctggccggcagaagaaggaagatggctgtggagagccgggtgacccaggaggagatcaagaaggagcctgagaagcccatcgaccgggagaagacctgccccctgctgctgcgggtcttcaccaccaacaacggccgccaccacaggatggatgagttcagcagaggaaatgtgcccagcagcgagctgcagatctacacctggatggatgccaccctgaaggagctgaccagcctggtgaaggaggtgtacccagaggccaggaagaagggcacccacttcaactttgccatcgtgttcacagatgtgaagaggcctggctacagagtgaaggagatcggcagcaccatgagcggcaggaaaggaacagatgacagcatgaccctgcagagccagaagttccagatcggggactacctggacatcgccatcaccccacccaacagagcccccccacccagcggccgcatgaggccctactag

SEQ ID NO: 38048 - DNA, 1020 bp, Artificial Sequence
  Description of Artificial Sequence: Synthetic coding sequence
atggagagcaggaaggacatcaccaaccaggaggagctgtggaagatgaagcccaggaggaacctggaggaggatgactacctgcacaaggacaccggggagacctccatgctgaagaggcctgtgctgctgcacctgcaccagacagcccacgcagatgaatttgactgccccagcgagctgcagcacacccaggagctgttcccccagtggcacctgcccatcaagattgctgccatcatcgccagcctgaccttcctgtacaccctgctgcgggaggtgatccaccccctggccaccagccaccagcagtacttctacaagatccccatcctggtgatcaacaaggtgctgcccatggtgtccatcaccctgctggccctggtgtacctgcccggggtgattgctgccatcgtgcagctgcacaacggcaccaagtacaagaagttcccccactggctggacaagtggatgctgaccaggaagcagtttggcctgctgtccttcttctttgctgtgctgcacgccatctacagcctgagctaccccatgagaagaagctaccgctacaagctgctgaactgggcctaccagcaggtgcagcagaacaaggaggatgcctggattgaacatgatgtgtggaggatggagatctacgtgtccctgggcatcgtgggcctggccatcctggccctgctggccgtgaccagcatccccagcgtgtctgacagcctgacctggagggagttccactacatccagagcaagctgggcatcgtgtccctgctgctgggcaccatccacgccctgatctttgcctggaacaagtggattgacatcaagcagtttgtgtggtacaccccacccaccttcatgattgctgtgttcctgcccatcgtggtgctgatcttcaagagcatcctcttcctgccctgcctgaggaagaagatcctgaagatccgccacggctgggaggatgtgaccaagatcaacaagacagagatctgcagccagctgtag

SEQ ID NO: 38049 - DNA, 597 bp, Artificial Sequence
  Description of Artificial Sequence: Synthetic coding sequence
atgtgtgccttcccctggctgctgctgctgctgctgctgcaggagggcagccagaggcggctgtggcgctggtgtggcagcgaggaggtggtggccgtgctgcaggagagcatcagcctgcccctggagatccccccagatgaggaggtggagaacatcatctggagcagccacaagagcctggccaccgtggtgcctgggaaggagggccacccagccaccatcatggtgaccaacccccactaccagggccaggtgtccttcctggaccccagctacagcctgcacatcagcaacctgtcctgggaggacagcggcctgtaccaggcccaggtgaacctgcggaccagccagatcagcaccatgcagcagtacaacatctgtgtgtaccaccccaactatgccagcgagaagcccagcacagccttctgcctgctggccaagggcctgctgatcttcctgctgctggtgatcctggccatgggcctgtgggtgatccgggtgcagaagaggcacaagatgcccaggatgaagaagctgatgaggaacaggatgaagctgaggaaggaggccaagccaggcagcagccctgcctag

SEQ ID NO: 38050 - DNA, 870 bp, Artificial Sequence
  Description of Artificial Sequence: Synthetic coding sequence
atgtgtgccttcccctggctgctgctgctgctgctgctgcaggagggcagccagaggcggctgtggcgctggtgtggcagcgaggaggtggtggccgtgctgcaggagagcatcagcctgcccctggagatccccccagatgaggaggtggagaacatcatctggagcagccacaagagcctggccaccgtggtgcctgggaaggagggccacccagccaccatcatggtgaccaacccccactaccagggccaggtgtccttcctggaccccagctacagcctgcacatcagcaacctgtcctgggaggacagcggcctgtaccaggcccaggtgaacctgcggaccagccagatcagcaccatgcagcagtacaacatctgtgtgtaccgctggctgtctgagccccagatcaccgtgaactttgagagcagtggagagggcgcctgcagcatgagcctggtgtgcagcgtggagaaggccggcatggacatgacctacagctggctgagcagaggagacagcacctacaccttccacgagggccctgtgctgagcacctcctggaggcctggggacagcgccctgagctacacctgccgggccaacaaccccatcagcaatgtgagcagctgccccatcccagatggccccttctatgctgaccccaactatgccagcgagaagcccagcacagccttctgcctgctggccaagggcctgctgatcttcctgctgctggtgatcctggccatgggcctgtgggtgatccgggtgcagaagaggcacaagatgcccaggatgaagaagctgatgaggaacaggatgaagctgaggaaggaggccaagccaggcagcagccctgcctag

SEQ ID NO: 38051 - DNA, 519 bp, Artificial Sequence
  Description of Artificial Sequence: Synthetic coding sequence
atgaagatctggagcagcgagcacgtgtttggccacccctgggacaccgtcatccaggccgccatgaggaagtaccccaaccccatgaaccccagcgtgctgggcgtggatgtgctgcagaggagagtggatggccggggccgcctgcacagcctgcggctgctgagcacagagtggggcctgcccagcctggtgcgggccatcctgggcaccagcaggaccctgacctacatccgggagcacagcgtggtggaccctgtggagaagaagatggagctgtgcagcaccaacatcaccctgaccaacctggtgtctgtgaatgaaaggctggtgtacaccccccacccagaaaatcctgagatgacagtgctgacccaggaggccatcatcaccgtgaagggcatcagcctgggcagctacctggagagcctgatggccaacaccatcagcagcaatgccaagaagggctgggccgccatcgagtggatcatcgagcacagcgagagcgctgtgtcctag

SEQ ID NO: 38052 - DNA, 519 bp, Artificial Sequence; identical to SEQ ID NO: 38051
  Description of Artificial Sequence: Synthetic coding sequence

SEQ ID NO: 38053 - DNA, 585 bp, Artificial Sequence
  Description of Artificial Sequence: Synthetic coding sequence
atgaagatctggaccagcgagcacgtgtttgaccacccctgggagaccgtgaccacagctgccatgcagaagtaccccaaccccatgaaccccagcgtggtgggcgtggatgtgctggacagacacatcgaccccagcggcaagctgcacagccaccggctgctgagcacagagtggggcctgcccagcatcgtgaagagcctgattggagctgcccggaccaagacctacgtgcaggagcacagcgtggtggaccctgtggagaagaccatggagctgaagagcaccaacatctccttcaccaacatggtgtctgtggatgagcggctcatctacaagccccacccccaggaccctgagaagacagtgctgacccaggaggccatcatcaccgtgaagggcgtgtccctgagcagctacctggagggcctgatggccagcaccatcagcagcaatgccagcaagggccgggaggccatggagtgggtgatccacaagctgaatgctgagattgaggagctgacagccagcgcccggggcaccatccgcacccccatggctgctgctgcctttgctgagaagtag

SEQ ID NO: 38054 - DNA, 2247 bp, Artificial Sequence
  Description of Artificial Sequence: Synthetic coding sequence
atgagcaaccctgggggcagaagaaatggacctgtgaagctgcggctgactgtgctgtgtgccaagaacctggtgaagaaggacttcttccggctgcctgacccctttgccaaggtggtggtggatggcagcggccagtgccacagcacagacacagtgaagaacaccctggaccccaagtggaaccagcactatgacctgtacatcggcaagagtgacagcgtgaccatctctgtgtggaaccacaagaagatccacaagaagcagggcgccggcttcctgggctgtgtgcggctgctgagcaatgccatcaaccggctgaaggacaccggctaccagaggctggacctgtgcaagctgggccccaatgacaatgacacagtgcggggccagatcgtggtgtccctgcagagccgggaccgcatcggcaccggcggccaggtggtggactgcagccggctgtttgacaatgacctgcctgatggctgggaggagaggagaacagccagcggccgcatccagtacctgaaccacatcaccaggaccacccagtgggagcggcccaccaggcctgccagcgagtacagcagccctggccggcccctgagctgctttgtggatgagaacacccccatcagcggcaccaacggggccacctgtggccagagcagtgacccccggctggccgagaggagagtgcgcagccagaggcacaggaactacatgagcaggacccacctgcacaccccaccagacctgcctgagggctatgagcagaggaccacccagcagggccaggtgtacttcctgcacacccagacaggagtgtccacctggcatgacccccgggtgccccgggacctgagcaacatcaactgtgaggagctgggccccctgcccccaggctgggagatccggaacacagccaccggccgggtgtactttgtggaccacaacaacagaaccacccagttcacagacccccggctgagcgccaacctgcacctggtgctgaaccggcagaaccagctgaaggaccagcagcagcagcaggtggtgtccctgtgcccagatgacacagaatgtctgactgtgccccgctacaagagggacctggtgcagaagctgaagatcctgcggcaggagctgagccagcagcagccccaggccggccactgcagaattgaggtgtcccgggaggagatctttgaggagagctaccggcaggtgatgaagatgaggcccaaggacctgtggaagaggctgatgatcaagttccggggggaggagggcctggactatggaggagtggcccgggagtggctgtacctgctgagccatgagatgctgaacccctactacggcctcttccagtacagcagagatgacatctacaccctgcagatcaacccagattctgctgtgaaccctgagcacctgagctacttccactttgtgggccgcatcatgggcatggctgtgttccacggccactacattgatggcggcttcaccctgcccttctacaagcagctgctgggcaagagcatcaccctggatgacatggagctggtggaccctgacctgcacaacagcctggtgtggatcctggagaatgacatcaccggggtgctggaccacaccttctgtgtggagcacaatgcctacggggagatcatccagcacgagctgaagcccaacgggaagagcatccctgtgaatgaggagaacaagaaggagtatgtgcggctgtatgtgaactggaggttcctgcggggcatcgaggcccagttcctggccctgcagaagggcttcaatgaggtgatcccccagcacctgctgaagacctttgatgagaaggagctggagctgatcatctgtggcctgggcaagattgatgtgaatgactggaaggtgaacacccggctgaagcactgcaccccagacagcaacatcgtgaagtggttctggaaggctgtggagttctttgatgaggagcggcgggcccggctgctgcagtttgtgacaggcagcagccgggtgcccctgcagggcttcaaggccctgcagggcgctgctggccccaggctcttcaccatccaccagattgatgcctgcaccaacaacctgcccaaggcccacacctgcttcaacagaattgacatccccccctatgagagctatgagaagctgtatgagaagctgctgacagccatcgaggagacctgtggctttgctgtggagtag

SEQ ID NO: 38055 - DNA, 294 bp, Artificial Sequence
  Description of Artificial Sequence: Synthetic coding sequence
atgaccagcctgctgaccacccccagcccccgggaggagctgatgaccacccccatcctgcagcccacagaggccctgagcccagaagatggagccagcacagccctgattgctgtggtgatcaccgtggtgttcctgaccctgctgtctgtggtgatcctgatcttcttctacctgtacaagaacaagggcagctatgtgacctatgagcccacagaaggagagcccagcgccatcgtgcagatggagagtgacctggccaagggcagcgagaaggaggagtacttcatctag

SEQ ID NO: 38056 - DNA, 294 bp, Artificial Sequence; identical to SEQ ID NO: 38055
  Description of Artificial Sequence: Synthetic coding sequence

SEQ ID NO: 38057 - DNA, 3282 bp, Artificial Sequence
  Description of Artificial Sequence: Synthetic coding sequence
atggccagcgccccagctgaggccgagacccggcagaggctgctgaggacagtgaagaaggaggtgaagcagatcatggaggaggccgtgaccaggaagtttgtgcatgaggacagcagccacatcatctccttctgtgccgctgtggaggcctgtgtgctgcacggcctgcggaggagagctgctggcttcctgcggagcaacaagattgctgccctcttcatgaaggtgggcaagaacttccccccagctgaggacctgagcaggaaggtgcaggacctggagcagctgattgagagcgccaggaaccagatccagggcctgcaggagaatgtgaggaagctgcccaagctgcccaacctgagccccctggccatcaagcacctgtggatcagaacagccctgtttgagaaggtgctggacaagatcgtgcactacctggtggagaacagcagcaagtactatgagaaggaggccctgctgatggaccctgtggatggccccatcctggccagcctgctggtgggcccctgtgccctggagtacaccaagatgaagacagctgaccacttctggacagaccccagcgcagatgagctggtgcagaggcaccgcatccacagcagccacgtgcggcaggacagccccaccaagaggcctgccctgtgcatccagaagaggcacagcagcggctccatggatgaccggcccagcctgagcgcccgggactatgtggagagcctgcaccagaacagccgggccaccctgctgtatggcaagaacaacgtgctggtgcagcccagagatgacatggaggccgtgcccggctacctgagcctgcaccagacagcagatgtgatgaccctgaagtggacccccaaccagctgatgaatggatctgtgggggacctggactatgagaagtctgtgtactgggactatgccatgaccatccggctggaggagatcgtgtacctgcactgccaccagcaggtggacagcggcggcaccgtggtgctggtgtcccaggacggcatccagaggcctcccttccgcttccccaagggcggccacctgctgcagttcctgagctgcctggagaatggcctgctgccccacggccagctggacccccccctgtggagccagaggggcaagggcaaggtgttccccaagctgaggaagaggagcccccagggcagcgctgagagcaccagcagtgacaaggatgatgatgaggccacagattatgtgttccgcatcatctacccaggcatgcagagcgagtttgtgccccaggacctgatggatgtgtctgtgagcaacctgcccagcctgtggcagcccagccccaggaagagcagctgcagcagctgcagccagagcggcagcgcagatggcagcagcaccaacggctgcaaccacgagcgggcccccctgaagctgctgtgtgacaacatgaagtaccagatcctgagccgggccttctacggctggctggcctactgccgccacctgagcacagtgaggacccacctgagcgccctggtgaaccacatgattgtgtccccagacctgccctgtgatgctggccagggcctgacagcccgcatctgggagcagtacctgcatgacagcaccagctatgaggagcaggagctgctgcggctcatctactacggcggcatccagcctgagatcaggaaggctgtgtggcccttcctgctgggccactaccagtttggcatgacagaaacagagaggaaggaggtggatgagcagatccacgcctgctacgcccagaccatggccgagtggctgggctgtgaggccatcgtgcggcagcgggagcgggagagccacgccgccgccctggccaagtgcagcagcggggccagcctggacagccacctgcacaggatgctgcaccgggacagcaccatcagcaatgaaagcagccagagctgcagcagcggccggcagaacatccggctgcacagcgacagcagcagcagcacccaggtgtttgagagcgtggatgaggtggagcaggtggaggccgagggccgcctggaggagaagcagcccaagatccccaacggcaacctggtgaatggcacctgcagcccagacagcggccaccccagcagccacaacttcagcagcggcctgtctgagcacagcgagcccagcctgagcacagaagattctgtgctggatgcccagaggaacacccccaccgtgctgcggcccagagatggctctgtggatgaccggcagagcagcgaggccaccaccagccaggatgaggccccccgggaggagctggccgtgcaggacagcctggagagtgacctgctggccaatgaatccatggatgagttcatgagcatcaccggcagcctggacatggccctgcctgagaaggatgatgtggtgatggagggctggaggagcagcgagacagagaagcacggccaggccgacagcgaggacaacctgtctgaggagcctgagatggagagcctcttccctgccctggccagcctggccgtgaccaccagcgccaatgaggtgtcccctgtgagcagcagtggagtgacctacagccctgagctgctggacctgtacacagtgaacctgcaccgcatcgagaaggatgtgcagagatgtgacaggaactactggtacttcaccccagccaacctggagaagctgaggaacatcatgtgcagctacatctggcagcacatcgagatcggctacgtgcagggcatgtgtgacctgctggcccccctgctggtgatcctggatgatgaggccctggccttcagctgcttcacagagctgatgaagaggatgaaccagaacttcccccacggcggggccatggacacccactttgccaacatgaggagcctcatccagatcctggacagcgagctgtttgagctgatgcaccagaatggagactacacccacttctacttctgctaccgctggttcctgctggacttcaagcgggagctggtgtatgatgatgtgttcctggtgtgggagaccatctgggccgccaagcacgtgagcagcgcccactacgtgctcttcatcgccctggccctggtggaggtgtacagagacatcatcctggagaacaacatggacttcacagacatcatcaagttcttcaatgagatggccgagcggcacaacaccaagcaggtgctgaagctggcccgggacctggtgtacaaggtgcagaccctgattgagaacaagtag

SEQ ID NO: 38058 - DNA, 3447 bp, Artificial Sequence
  Description of Artificial Sequence: Synthetic coding sequence
atggccagcgccccagctgaggccgagacccggcagaggctgctgaggacagtgaagaaggaggtgaagcagatcatggaggaggccgtgaccaggaagtttgtgcatgaggacagcagccacatcatctccttctgtgccgctgtggaggcctgtgtgctgcacggcctgcggaggagagctgctggcttcctgcggagcaacaagattgctgccctcttcatgaaggtgggcaagaacttccccccagctgaggacctgagcaggaaggtgcaggacctggagcagctgattgagagcgccaggaaccagatccagggcctgcaggagaatgtgaggaagctgcccaagctgcccaacctgagccccctggccatcaagcacctgtggatcagaacagccctgtttgagaaggtgctggacaagatcgtgcactacctggtggagaacagcagcaagtactatgagaaggaggccctgctgatggaccctgtggatggccccatcctggccagcctgctggtgggcccctgtgccctggagtacaccaagatgaagacagctgaccacttctggacagaccccagcgcagatgagctggtgcagaggcaccgcatccacagcagccacgtgcggcaggacagccccaccaagaggcctgccctgtgcatccagaagaggcacagcagcggctccatggatgaccggcccagcctgagcgcccgggactatgtggagagcctgcaccagaacagccgggccaccctgctgtatggcaagaacaacgtgctggtgcagcccagagatgacatggaggccgtgcccggctacctgagcctgcaccagacagcagatgtgatgaccctgaagtggacccccaaccagctgatgaatggatctgtgggggacctggactatgagaagtctgtgtactgggactatgccatgaccatccggctggaggagatcgtgtacctgcactgccaccagcaggtggacagcggcggcaccgtggtgctggtgtcccaggacggcatccagaggcctcccttccgcttccccaagggcggccacctgctgcagttcctgagctgcctggagaatggcctgctgccccacggccagctggacccccccctgtggagccagaggggcaagggcaaggtgttccccaagctgaggaagaggagcccccagggcagcgctgagagcaccagcagtgacaaggatgatgatgaggccacagattatgtgttccgcatcatctacccaggcatgcagagcgagtttgtggccccagacttcctgggcagcaccagctctgtgtctgtgggccctgcctggatgatggtgcctgctggccgctccatgctggtggtggcccggggcagccagtgggagcccgcccgctgggacaccaccctgcccacccccagccccaaggagcagccccccatgccccaggacctgatggatgtgtctgtgagcaacctgcccagcctgtggcagcccagccccaggaagagcagctgcagcagctgcagccagagcggcagcgcagatggcagcagcaccaacggctgcaaccacgagcgggcccccctgaagctgctgtgtgacaacatgaagtaccagatcctgagccgggccttctacggctggctggcctactgccgccacctgagcacagtgaggacccacctgagcgccctggtgaaccacatgattgtgtccccagacctgccctgtgatgctggccagggcctgacagcccgcatctgggagcagtacctgcatgacagcaccagctatgaggagcaggagctgctgcggctcatctactatggaggcatccagcctgagatcaggaaggctgtgtggcccttcctgctgggccactaccagtttggcatgacagaaacagagaggaaggaggtggatgagcagatccacgcctgctacgcccagaccatggccgagtggctgggctgtgaggccatcgtgcggcagcgggagcgggagagccatgctgctgccctggccaagtgcagcagcggggccagcctggacagccacctgcacaggatgctgcaccgggacagcaccatcagcaatgaaagcagccagagctgcagcagcggccggcagaacatccggctgcacagcgacagcagcagcagcacccaggtgtttgaatctgtggatgaggtggagcaggtggaggccgagggccgcctggaggagaagcagcccaagatccccaatggaaacctggtgaatggcacctgcagcccagattctggccaccccagcagccacaacttcagcagcggcctgtctgagcacagcgagcccagcctgagcacagaggacagcgtgctggatgcccagaggaacacccccaccgtgctgcggcccagagatggctctgtggatgaccggcagagcagcgaggccaccaccagccaggatgaggccccccgggaggagctggccgtgcaggacagcctggagagtgacctgctggccaatgaatccatggatgagttcatgagcatcaccggcagcctggacatggccctgcctgagaaggatgatgtggtgatggagggctggaggagcagcgagacagagaagcacggccaggccgacagcgaggacaacctgtctgaggagcctgagatggagagcctcttccctgccctggccagcctggccgtgaccaccagcgccaatgaggtgtcccctgtgagcagcagcggcgtgacctacagccctgagctgctggacctgtacacagtgaacctgcacagaattgagaaggatgtgcagagatgtgacaggaactactggtacttcaccccagccaacctggagaagctgaggaacatcatgtgcagctacatctggcagcacattgaaattggctacgtgcagggcatgtgtgacctgctggcccccctgctggtgatcctggatgatgaggccctggccttcagctgcttcacagagctgatgaagaggatgaaccagaacttcccccatggaggagccatggacacccactttgccaacatgaggagcctcatccagatcctggacagcgagctgtttgagctgatgcaccagaatggagactacacccacttctacttctgctaccgctggttcctgctggacttcaagcgggagctggtgtatgatgatgtgttcctggtgtgggagaccatctgggccgccaagcacgtgtcctctgcccactacgtgctcttcatcgccctggccctggtggaggtgtacagagacatcatcctggagaacaacatggacttcacagacatcatcaagttcttcaatgagatggccgagcggcacaacaccaagcaggtgctgaagctggcccgggacctggtgtacaaggtgcagaccctgattgagaacaagtag

SEQ ID NO: 38059 - DNA, 3447 bp, Artificial Sequence
  Description of Artificial Sequence: Synthetic coding sequence
atggaggaggccgtgaccaggaagtttgtgcatgaggacagcagccacatcatctccttctgtgccgctgtggaggcctgtgtgctgcacggcctgcggcggcgggctgctggcttcctgcggagcaacaagattgctgccctcttcatgaaggtgggcaagaacttccccccagctgaggacctgagcaggaaggtgcaggacctggagcagctgattgaaagtgccaggaaccagatccagggcctgcaggagaatgtgaggaagctgcccaagctgcccaacctgagccccctggccatcaagcacctgtggatcagaacagccctgtttgagaaggtgctggacaagatcgtgcactacctggtggagaacagcagcaagtactatgagaaggaggccctgctgatggaccctgtggatggccccatcctggccagcctgctggtgggcccctgtgccctggagtacaccaagatgaagacagctgaccacttctggacagaccccagcgcagatgagctggtgcagaggcaccgcatccacagcagccacgtgcggcaggacagccccaccaagaggcctgccctgtgcatccagaagaggcacagcagcggctccatggatgaccggcccagcctgagcgcccgggactatgtggagagcctgcaccagaacagccgggccaccctgctgtatggcaagaacaacgtgctggtgcagcccggcctgaccccaggctaccggggcaagggcctgagcggcagccggctgcccatccacagcagcatctatgccctgacccacgcccacatccacccccccaacacccacagcagcatccacctgtacctgcacgcccccatcctgaccagcatccacccccccatcgtcatcagcatccacccccccatcgtgaccaccatccaccccagcacccacctgtacatccacctgagcaaccacctgtacatccaccccagcacccacctgtacatccaccccagcacccacctgtacatctaccccagcatccaccccagcatccaccccagcatctaccccagcatccacttcagtgactatgtgttcctgaaccagacaggccagacctacgtgcacagcaacagcagcaccatggcccggccagaagatgacatggaggccgtgcccggctacctgagcctgcaccagacagcagatgtgatgaccctgaagtggacccccaaccagctgatgaatggatctgtgggggacctggactatgagaagtctgtgtactgggactatgccatgaccatccggctggaggagatcgtgtacctgcactgccaccagcaggtggacagcggcggcaccgtggtgctggtgtcccaggacggcatccagaggcctcccttccgcttccccaagggcggccacctgctgcagttcctgagctgcctggagaatggcctgctgccccacggccagctggacccccccctgtggagccagaggggcaagggcaaggtgttccccaagctgaggaagaggagcccccagggcagcgctgagagcaccagcagtgacaaggatgatgatgaggccacagattatgtgttccgcatcatctacccaggcatgcagagcgagtttgtgccccaggacctgatggatgtgtctgtgagcaacctgcccagcctgtggcagcccagccccaggaagagcagctgcagcagctgcagccagagcggcagcgcagatggcagcagcaccaacggctgcaaccacgagcgggcccccctgaagctgctgtgtgacaacatgaagtaccagatcctgagccgggccttctacggctggctggcctactgccgccacctgagcacagtgaggacccacctgagcgccctggtgaaccacatgattgtgtccccagacctgccctgtgatgctggccagggcctgacagcccgcatctgggagcagtacctgcatgacagcaccagctatgaggagcaggagctgctgcggctcatctactacggcggcatccagcctgagatcaggaaggctgtgtggcccttcctgctgggccactaccagtttggcatgacagaaacagagaggaaggagagcagccagagctgcagcagcggccggcagaacatccggctgcacagcgacagcagcagcagcacccaggtgtttgaatctgtggatgaggtggagcaggtggaggccgagggccgcctggaggagaagcagcccaagatccccaatggaaacctggtgaatggcacctgcagcccagattctggccaccccagcagccacaacttcagcagcggcctgtctgagcacagcgagcccagcctgagcacagaggacagcgtgctggatgcccagaggaacacccccaccgtgctgcggcccagagatggctctgtggatgaccggcagagcagcgaggccaccaccagccaggatgaggccccccgggaggagctggccgtgcaggacagcctggagagtgacctgctggccaatgaatccatggatgagttcatgagcatcaccggcagcctggacatggccctgcctgagaaggatgatgtggtgatggagggctggaggagcagcgagacagagaagcacggccaggccgacagcgaggacaacctgtctgaggagcctgagatggagagcctcttccctgccctggccagcctggccgtgaccaccagcgccaatgaggtgtcccctgtgagcagcagcggcgtgacctacagccctgagctgctggacctgtacacagtgaacctgcacagaattgagaaggatgtgcagagatgtgacaggaactactggtacttcaccccagccaacctggagaagctgaggaacatcatgtgcagctacatctggcagcacattgaaattggctacgtgcagggcatgtgtgacctgctggcccccctgctggtgatcctggatgatgaggccctggccttcagctgcttcacagagctgatgaagaggatgaaccagaacttcccccatggaggagccatggacacccactttgccaacatgaggagcctcatccagatcctggacagcgagctgtttgagctgatgcaccagaatggagactacacccacttctacttctgctaccgctggttcctgctggacttcaagcgggagctggtgtatgatgatgtgttcctggtgtgggagaccatctgggccgccaagcacgtgtcctctgcccactacgtgctcttcatcgccctggccctggtggaggtgtacagagacatcatcctggagaacaacatggacttcacagacatcatcaagttcttcaatgagatggccgagcggcacaacaccaagcaggtgctgaagctggcccgggacctggtgtacaaggtgcagaccctgattgagaacaagtag

SEQ ID NO: 38060 - DNA, 234 bp, Artificial Sequence
  Description of Artificial Sequence: Synthetic coding sequence
atgggcctgtgcttcccctgccctggagagagcgccccacccaccccagacctggaggagaagagggccaagctggccgaggccgctgagcggcggcagaaggaggccgccagccggggcatcctggatgtgcagagcgtgcaggagaagaggaagaagaaggagaagattgagaagcagatcgccaccagcggccccccacctgagggcggcctgcgctggacagtgtcctag

SEQ ID NO: 38061 - DNA, 1365 bp, Artificial Sequence
  Description of Artificial Sequence: Synthetic coding sequence
atggccgagttcagccagaagaggggcaagagaagaagtgatgagggcctgggctccatggtggacttcctgctggccaatgcccggctggtgctgggcgtgggcggcgctgctgtgctgggcatcgccaccctggccgtgaagcgcttcatcgaccgggccaccagccccagagatgaagatgacaccaaggctgacagctggaaggagctgagcctgctgaaggccaccccccacctgcagccccggcccccacctgctgccctgagccagcctgtgctgcccctggcccccagcagcagcgcccctgagggccctgctgagacagatcctgaggtgaccccccagctgagcagccctgcccccctgtgcctgaccctgcaggagcggctgctggcctttgagcgggacagagtgaccatcccagctgcccaggtggccctggccaagcagctggccggggacatcgccctggagctgcaggcctacttccgcagcaagtttcctgagctgccctttggagcctttgtgcctgggggccccctgtatgatggcctgcaggccggggctgctgaccacgtgcggctgctggtgcccctggtgctggagcccggcctgtggagcctggtgcctggggtggacacagtggcccgggacccccgctgctgggccgtgcggaggacccagctggagttctgcccccggggcagcagcccctgggaccgcttcctggtgggcggctacctgagcagccgggtgctgctggagctgctgaggaaggccctggccgcctctgtgaactggccagccatcggcagcctgctgggctgcctgatccggcccagcatggccagcgaggagctgctgctggaggtgcagcacgagcggctggagctgactgtggccgtgctggtggccgtgcctggggtggatgctgatgaccggctgctgctggcctggcccctggagggcctggccggcaacctgtggctgcaggacctgtaccctgtggaggccgcccggctgcgggccctggatgaccatgatgctggcacccggcggcggctgctgctgctgctgtgtgctgtgtgccggggctgcagcgccctgggccagctgggccggggccacctgacccaggtggtgctgcggctgggagaagataatgtggactggacagaggaggccctgggggagcgcttcctgcaggccctggagctgctgattggcagcctggagcaggccagcctgccctgccacttcaaccccagcgtgaacctcttcagcagcctgcgggaggaggagattgatgacatcggctacgccctgtacagcggcctgcaggagcctgagggcctgctgtag

SEQ ID NO: 38062 - DNA, 492 bp, Artificial Sequence
  Description of Artificial Sequence: Synthetic coding sequence
atggccgagttcagccagaagaggggcaagagaagaagtgatgagggcctgggctccatggtggacttcctgctggccaatgcccggctggtgctgggcgtgggcggcgctgctgtgctgggcatcgccaccctggccgtgaagcgcttcatcgaccgggccaccagccccagagatgaagatgacaccaaggctgacagctggaaggagctgagcctgctgaaggccaccccccacctgcagccccggcccccacctgctgccctgagccagcctgtgctgcccctggcccccagcagcagcgcccctggagagtggcacagcttccccagctttggagtgaccttcaagaggaggagccctggctttgccctgacagactgtgtgaccctgcgggagagcctgctgctgagccggctgtgggccccccagatcttcaatggaggcggcgtgtccctgccctgctcctggagcaaggtggtggccctgtag

SEQ ID NO: 38063 - DNA, 618 bp, Artificial Sequence
  Description of Artificial Sequence: Synthetic coding sequence
atggccgagttcagccagaagaggggcaagagaagaagtgatgagggcctgggctccatggtggacttcctgctggccaatgcccggctggtgctgggcgtgggcggcgctgctgtgctgggcatcgccaccctggccgtgaagcgcttcatcgaccgggccaccagccccagagatgaagatgacaccaaggctgacagctggaaggagctgagcctgctgaaggccaccccccacctgcagccccggcccccacctgctgccctgagccagcctgtgctgcccctggcccccagcagcagcgcccctggagaggccgccggcctgcgggccggcccctgtgaccaccccagcagccctgggggcttcggccagacagctggctggaggcacaggcctggagctgctggcctgctgtctgagcaggtgcccggcacagccctgtggggcatccgggcctggggcgccgccctgcggcgggccgccggcggcggctgcggcccctgtgccagccctggggccactggagctggagctggccctgtggagcccggggccggccggggccactgtggggagggccccagcctgctgggccgggcccaggatgctgcctag

SEQ ID NO: 38064 - DNA, 1398 bp, Artificial Sequence
  Description of Artificial Sequence: Synthetic coding sequence
atgggcctgagccccaacctggaccggcagaccatggccgagttcagccagaagaggggcaagagaagaagtgatgagggcctgggctccatggtggacttcctgctggccaatgcccggctggtgctgggcgtgggcggcgctgctgtgctgggcatcgccaccctggccgtgaagcgcttcatcgaccgggccaccagccccagagatgaagatgacaccaaggctgacagctggaaggagctgagcctgctgaaggccaccccccacctgcagcccaggcctcctcctgctgccctgagccagcctgtgctgcccctggcccccagcagcagcgcccctgagggccctgctgagacagatcctgaggtgaccccccagctgagcagccctgcccccctgtgcctgaccctgcaggagcggctgctggcctttgagcgggacagagtgaccatcccagctgcccaggtggccctggccaagcagctggccggggacatcgccctggagctgcaggcctacttccgcagcaagtttcctgagctgccctttggagcctttgtgcctgggggccccctgtatgatggcctgcaggccggggctgctgaccacgtgcggctgctggtgcccctggtgctggagcccggcctgtggagcctggtgcctggggtggacacagtggcccgggacccccgctgctgggccgtgcggaggacccagctggagttctgcccccggggcagcagcccctgggaccgcttcctggtgggcggctacctgagcagccgggtgctgctggagctgctgaggaaggccctggccgcctctgtgaactggccagccatcggcagcctgctgggctgcctgatccggcccagcatggccagcgaggagctgctgctggaggtgcagcacgagcggctggagctgactgtggccgtgctggtggccgtgcctggggtggatgctgatgaccggctgctgctggcctggcccctggagggcctggccggcaacctgtggctgcaggacctgtaccctgtggaggccgcccggctgcgggccctggatgaccatgatgctggcacccggcggcggctgctgctgctgctgtgtgctgtgtgccggggctgcagcgccctgggccagctgggccggggccacctgacccaggtggtgctgcggctgggggaggacaacgtggactggacagaggaggccctgggggagcgcttcctgcaggccctggagctgctgattggcagcctggagcaggccagcctgccctgccacttcaaccccagcgtgaacctcttcagcagcctgcgggaggaggagattgatgacatcggctacgccctgtacagcggcctgcaggagcctgagggcctgctgtag

SEQ ID NO: 38065 - DNA, 1392 bp, Artificial Sequence
  Description of Artificial Sequence: Synthetic coding sequence
atggccggggccggggagaggaagggcaagaaggatgacaatggcatcggcacagccatcgactttgtgctgagcaatgcccggctggtgctgggcgtgggcggggccgccatgctgggcatcgccaccctggccgtgaagaggatgtatgaccgggccatcagcgcccccaccagccccacccggctgagccacagcggcaagaggtcctgggaggagcccaactggatgggcagcccccggctgctgaacagagacatgaagacaggcctgagccgcagcctgcagaccctgcccacagacagcagcacctttgacacagacaccttctgccccccccggcccaagcctgtggccaggaagggccaggtggacctgaagaagagccggctgaggatgagcctgcaggagaagctgctgacctactacagaaacagagctgccatcccagctggggagcaggcccgggccaagcaggccgctgtggacatctgtgccgagctgcggagcttcctgcgggccaagctgcctgacatgcccctgcgggacatgtacctgagcggcagcctgtatgatgacctgcaggtggtgacagctgaccacatccagctgattgtgcccctggtgctggagcagaacctgtggagctgcatccctggagaggacaccatcatgaatgtgcccggcttcttcctggtgcggcgggagaaccctgagtacttcccccggggcagcagctactgggacagatgtgtggtgggcggctacctgagccccaagacagtggccgacacctttgagaaggtggtggccggcagcatcaactggccagccatcggcagcctgctggactatgtgatccggcctgcccctcctcctgaggccctgaccctggaggtgcagtatgaaagagacaagcacctgttcatcgacttcctgcccagcgtgaccctgggggacacagtgctggtggccaagccccaccggctggcccagtatgacaacctgtggaggctgagcctgcggcctgctgagacagcccggctgcgggccctggaccaggccgacagcggctgccgcagcctgtgcctgaagatcctgaaggccatctgcaagagcaccccagccctgggccacctgacagccagccagctgaccaacgtcatcctgcacctggcccaggaggaggccgactggagcccagacatgctggccgaccgcttcctgcaggccctgcggggcctcatctcctacctggaggccggcgtgctgcccagcgccctgaaccccaaggtgaacctgtttgctgagctgaccccagaggagattgatgagctgggctacaccctgtactgcagcctgtctgagcctgaggtgctgctgcagacctag

SEQ ID NO: 38066 - DNA, 1437 bp, Artificial Sequence
  Description of Artificial Sequence: Synthetic coding sequence
atggccggggccggggagaggaagggcaagaaggatgacaatggcatcggcacagccatcgactttgtgctgagcaatgcccggctggtgctgggcgtgggcggggccgccatgctgggcatcgccaccctggccgtgaagaggatgtatgaccgggccatcagcgcccccaccagccccacccggctgagccacagcggcaagaggtcctgggaggagcccaactggatgggcagcccccggctgctgaacagagacatgaagacaggcctgagccgcagcctgcagaccctgcccacagacagcagcacctttgacacagacaccttctgccccccccggcccaagcctgtggccaggaagggccaggtggacctgaagaagagccggctgaggatgagcctgcaggagaagctgctgacctactacagaaacagagctgccatcccagctggggagcaggcccgggccaagcaggccgctgtggacatctgtgccgagctgcggagcttcctgcgggccaagctgcctgacatgcccctgcgggacatgtacctgagcggcagcctgtatgatgacctgcaggtggtgacagctgaccacatccagctgattgtgcccctggtgctggagcagaacctgtggagctgcatccctggagaggacaccatcatgaatgtgcccggcttcttcctggtgcggcgggagaaccctgagtacttcccccggggcagcagctactgggacagatgtgtggtgggcggctacctgagccccaagacagtggccgacacctttgagaaggtggtggccggcagcatcaactggccagccatcggcagcctgctggactatgtgatccggcctgcccctcctcctgaggccctgaccctggaggtgcagtatgaaagagacaagcacctgttcatcgacttcctgcccagcgtgaccctgggggacacagtgctggtggccaagccccaccggctggcccagtatgacaacctgtggaggctgagcctgcggcctgctgagacagcccggctgcgggccctggaccaggccgacagcggctgccgcagcctgtgcctgaagatcctgaaggccatctgcaagagcaccccagccctgggccacctgacagccagccagctgaccaacgtcatcctgcacctggcccaggaggaggccgactggagcccagacatgctggccgaccgcttcctgcaggccctgcggggcctcatctcctacctggaggccggcgtgctgcccagcgccctgaaccccaaggacaaggccctgaaggagaggagcctgcggcaccaggtgaggatgatggaggtggacagccggctgaatgtgtcctggaagatccagagcctggtgggcgtgtggtggccctgcttcctgccccggcaggccctgctcttctag

SEQ ID NO: 38067 - DNA, 1392 bp, Artificial Sequence; identical to SEQ ID NO: 38065
  Description of Artificial Sequence: Synthetic coding sequence

SEQ ID NO: 38068 - DNA, 447 bp, Artificial Sequence
  Description of Artificial Sequence: Synthetic coding sequence
atggccggggccggggagaggaagggcaagaaggatgacaatggcatcggcacagccatcgactttgtgctgagcaatgcccggctggtgctgggcgtgggcggggccgccatgctgggcatcgccaccctggccgtgaagaggatgtatgaccgggccatcagcgcccccaccagccccacccggctgagccacagcggcaagaggtcctgggaggagcccaactggatgggcagcccccggctgctgaacagagacatgaagacaggcctgagccgcagcctgcagaccctgcccacagacagcagcacctttgacacaggagagaccagctacctgctgcctgagcccggcagccacccctgctggagggctggcagcggccaggccagctgctgcggccacatgtgccgggcccctgagctgcctgctggccaggtggcctag

SEQ ID NO: 38069 - DNA, 447 bp, Artificial Sequence; identical to SEQ ID NO: 38068
  Description of Artificial Sequence: Synthetic coding sequence

SEQ ID NO: 38070 - DNA, 132 bp, Artificial Sequence
  Description of Artificial Sequence: Synthetic coding sequence
atggccggggccggggagaggaagggcaagaaggatgacaatggcatcggcacagccatcgactttgtgctgagcaatgcccggctggtgctgggcgtgggcggggccgccatgctgggcatcgccacctag

SEQ ID NO: 38071 - DNA, 2067 bp, Artificial Sequence
  Description of Artificial Sequence: Synthetic coding sequence
atggctgctgagattgacttcctgcgggagcagaacagaaggctgaatgaagacttccgccgctaccagatggagagcttcagcaagtacagctctgtgcagaaggctgtgtgccagggcgagggagatgacacctttgagaacctggtgtttgaccagagcttcctggcccccctggtgacagaatatgacaagcacctgggggagctgaatggccagctgaagtactaccagaagcaggtgggggagatgaagctgcagctggagaatgtcatcaaggaaaatgaaaggctgcacagcgagctgaaggatgctgtggagaagaagctggaggccttccccctgggcacagaggtgggcacagacatctatgcagatgatgaaacagtgaggaacctgcaggagcagctgcagctggccaaccaggagaagacccaggccgtggagctgtggcagacagtgtcccaggagctggaccggctgcacaagctgtaccaggagcacatgacagaggcccagatccacgtgtttgagagccagaagcagaaggaccagctgtttgacttccagcagctgaccaagcagctgcacgtgaccaatgaaaacatggaggtgaccaaccagcagttcctgaagacagtgacagagcagagcgtcatcatcgagcagctgaggaagaagctgcggcaggccaagctggagctgcgggtggccgtggccaaggtggaggagctgaccaacgtgacagaggacctgcagggccagatgaagaagaaggagaaggatgtggtgtctgcccacggccgggaggaggccagtgaccggcggctgcagcagctgcagagcagcatcaagcagctggagatccggctgtgtgtgaccatccaggaggccaaccagctgaggacagagaacacccacctggagaagcagacccgggagctgcaggccaagtgcaatgagctggagaatgaaagatatgaggccatcgtgcgggccaggaacagcatgcagctgctggaggaggccaacctgcagaagagccaggccctgctggaggagaagcagaaggaggaggacatcgagaagatgaaggagaccgtgtccagatttgtgcaggatgccaccatccgcaccaagaaggaggtggccaacaccaagaagcagtgcaacatccagatcagccggctgacagaggagctgagcgccctgcagatggagtgtgccgagaagcagggccagatcgagagggtcatcaaggagaagaaggctgtggaggaggagctggagaagatctaccgggagggcagaggaaatgaaagtgactacaggaagctggaggagatgcaccagcgcttcctggtgtctgagaggagcaaggatgacctgcagctgcggctgaccagggcagaaaatcgcatcaagcagctggagacagacagcagcgaggagatcagccgctaccaggagatgatccagaagctgcagaatgtgctggagagcgagcgggagaactgtggcctggtgtctgagcagaggctgaagctgcagcaggagaacaagcagctgaggaaggagacagagagcctgaggaagatcgccctggaggcccagaagaaggccaaggtgaagatcagcaccatggagcacgagttcagcatcaaggagcggggctttgaggtgcagctgcgggagatggaggacagcaacagaaattccatcgtggagctgcggcacctgctggccacccagcagaaggccgccaaccgctggaaggaggagaccaagaagctgacagaatctgctgagatccgcatcaacaacctgaagtctgagctgagccggcagaagctgcacacccaggagctgctgagccagctggagatggccaatgagaaggtggccgagaatgagaagctgatcctggagcaccaggagaaggccaaccggctgcagaggcggctgagccaggccgaggagcgggccgccagcgccagccagcagctgagcgtcatcaccgtgcagaggaggaaggccgccagcctgatgaacctggagaacatctag

SEQ ID NO: 38072 - DNA, 924 bp, Artificial Sequence
  Description of Artificial Sequence: Synthetic coding sequence
atggctgctgagattgacttcctgcgggagcagaacagaaggctgaatgaagacttccgccgctaccagatggagagcttcagcaagtacagctctgtgcagaaggctgtgtgccagggcgagggagatgacacctttgagaacctggtgtttgaccagagcttcctggcccccctggtgacagaatatgacaagcacctgggggagctgaatggccagctgaagtactaccagaagcaggtgggggagatgaagctgcagctggagaatgtcatcaaggaaaatgaaaggctgcacagcgagctgaaggatgctgtggagaagaagctggaggccttccccctgggcacagaggtgggcacagacatctatgcagatgatgaaacagtgaggaacctgcaggagcagctgcagctggccaaccaggagaagacccaggccgtggagctgtggcagacagtgtcccaggagctggaccggctgcacaagctgtaccaggagcacatgacagaggcccagatccacgtgtttgagagccagaagcagaaggaccagctgtttgacttccagcagctgaccaagcagctgcacgtgaccaatgaaaacatggaggtgaccaaccagcagttcctgaagacagtgacagagcagagcgtcatcatcgagcagctgaggaagaagctgcggtctgagctgagccggcagaagctgcacacccaggagctgctgagccagctggagatggccaatgagaaggtggctgaaaatgagaagctgatcctggagcaccaggagaaggccaaccggctgcagaggcggctgagccaggccgaggagagagctgccagcgccagccagcagctgagcgtcatcaccgtgcagaggaggaaggccgccagcctgatgaacctggagaacatctag

SEQ ID NO: 38073 - DNA, 528 bp, Artificial Sequence
  Description of Artificial Sequence: Synthetic coding sequence
atggctgctgagattgacttcctgcgggagcagaacagaaggctgaatgaagacttccgccgctaccagatggagagcttcagcaagtacagctctgtgcagaaggctgtgtgccagggcgagggagatgacacctttgagaacctggtgtttgaccagagcttcctggcccccctggtgacagaatatgacaagcacctgggggagctgaatggccagctgaagtactaccagaagcaggtgggggagatgaagctgcagctggagaatgtcatcaaggaaaatgaaagaagtgagctgagccggcagaagctgcacacccaggagctgctgagccagctggagatggccaatgagaaggtggctgaaaatgagaagctgatcctggagcaccaggagaaggccaaccggctgcagaggcggctgagccaggccgaggagagagctgccagcgccagccagcagctgagcgtcatcaccgtgcagaggaggaaggccgccagcctgatgaacctggagaacatctag

SEQ ID NO: 38074 - DNA, 240 bp, Artificial Sequence
  Description of Artificial Sequence: Synthetic coding sequence
atggctgctgagattgacttcctgcgggagcagaacagaaggctgaatgaagacttccgccgctaccagatggagagcttcagcaagtacagctctgtgcagaaggctgtgtgccagggcgagggagatgacacctttgagaacctggtgtttgaccagagcttcctggcccccctggtgacagaatatgacaagcacctgggggagctgaatggccagctgaagtactaccaggcctag

SEQ ID NO: 38075 - DNA, 738 bp, Artificial Sequence
  Description of Artificial Sequence: Synthetic coding sequence
atggagggcaacaagctggaggagcaggacagcagccccccccagagcaccccaggcctgatgaagggcaacaagcgggaggagcagggcctgggccctgagcctgctgccccccagcagcccacagctgaggaggaggccctgattgagttccacaggagctaccgggagctgtttgagttcttctgcaacaacaccaccatccatggagccatccggctggtgtgcagccagcacaacaggatgaagacagccttctgggccgtgctgtggctgtgcaccttcggcatgatgtactggcagtttggcctgctgtttggagagtacttctcctaccctgtgtccctgaacatcaacctgaacagcgacaagctggtgtttcctgctgtgaccatctgcaccctgaacccctaccgctacccagagatcaaggaggagctggaggagctggaccgcatcacagagcagaccctgtttgacctgtacaagtacagcagcttcaccaccctggtggccggcagccgcagcagaagagacctgcggggcaccctgccccaccccctgcagaggctgcgggtgcccccaccaccccacggggcccggcgggcccggtctgtggccagcagcctgcgggacaacaacccccaggtggactggaaggactggaagattggcttccagctggagctgctgagcctgcccccaccagatgtgtggaagctgctgtacttccagtag

SEQ ID NO: 38076 - DNA, 2187 bp, Artificial Sequence
  Description of Artificial Sequence: Synthetic coding sequence
atgggcatggcccggggcagcctgaccagggtgcctggggtgatgggagagggcacccagggccctgagctgagcctggaccctgacccctgcagcccccagagcaccccaggcctgatgaagggcaacaagctggaggagcaggacccccggcccctgcagcccatccctggcctgatggagggcaacaagctggaggagcaggacagcagccccccccagagcaccccaggcctgatgaagggcaacaagcgggaggagcagggcctgggccctgagcctgctgccccccagcagcccacagctgaggaggaggccctgattgagttccacaggagctaccgggagctgtttgagttcttctgcaacaacaccaccatccacggggccatccggctggtgtgcagccagcacaacaggatgaagacagccttctgggccgtgctgtggctgtgcaccttcggcatgatgtactggcagtttggcctgctgtttggagagtacttctcctaccctgtgtccctgaacatcaacctgaacagcgacaagctggtgtttcctgctgtgaccatctgcaccctgaacccctaccgctacccagagatcaaggaggagctggaggagctggaccgcatcacagagcagaccctgtttgacctgtacaagtacagcagcttcaccaccctggtggccggcagccgcagccggcgggacctgcggggcaccctgccccaccccctgcagaggctgcgggtgcccccacctcctcatggagcccggcgggcccggtctgtggccagcagcctgcgggacaacaacccccaggtggactggaaggactggaagattggcttccagctgtgcaaccagaacaagagtgactgcttctaccagacctacagcagcggcgtggatgctgtgcgggagtggtaccgcttccactacatcaacatcctgagccggctgcctgagaccctgcccagcctggaggaggacaccctgggcaacttcatctttgcctgccgcttcaaccaggtgtcctgcaaccaggccaactacagccacttccaccaccccatgtatggcaactgctacaccttcaatgacaagaacaacagcaacctgtggatgagctccatgcctggcatcaacaacggcctgagcctgatgctgcgggcagagcagaatgacttcatccccctgctgagcacagtgactggagcccgggtgatggtgcacggccaggatgagcccgccttcatggatgatggcggcttcaacctgcggcctggggtggagaccagcatctccatgaggaaggagaccctggaccggctgggcggggactatggagactgcaccaagaatggaagtgatgtgcctgtggagaacctgtaccccagcaagtacacccagcaggtgtgcatccacagctgcttccaggagagcatgatcaaggaatgtggctgtgcctacatcttctacccccggccccagaatgtggagtactgtgactacaggaagcacagctcctggggctactgctactacaagctgcaggtggacttcagcagtgaccacctgggctgcttcaccaagtgcaggaagccctgcagcgtgaccagctaccagctgtctgctggctacagccgctggcccagcgtgaccagccaggagtgggtgttccagatgctgagccggcagaacaactacacagtgaacaacaagagaaatggagtggccaaggtgaacatcttcttcaaggagctgaactacaagaccaacagcgagagccccagcgtgaccatggtgaccctgctgagcaacctgggcagccagtggagcctgtggtttggcagctctgtgctgtctgtggtggagatggccgagctggtgtttgacctgctggtgatcatgttcctgatgctgctgcggcgcttccgcagccgctactggagccctggccggggcggccgcggggcccaggaggtggccagcaccctggccagcagcccccccagccacttctgcccccaccccatgagcctgagcctgagccagcccggccctgcccccagccctgccctgacagcccctcctccagcctatgccaccctgggcccccggcccagccctgggggcagcgctggggccagcagcagcacctgccccctgggcggcccctag

SEQ ID NO: 38077 - DNA, 2079 bp, Artificial Sequence
  Description of Artificial Sequence: Synthetic coding sequence
atgagcagcatcaagggcaacaagctggaggagcaggacccccggcccctgcagcccatccctggcctgatggagggcaacaagctggaggagcaggacagcagccccccccagagcaccccaggcctgatgaagggcaacaagcgggaggagcagggcctgggccctgagcctgctgccccccagcagcccacagctgaggaggaggccctgattgagttccacaggagctaccgggagctgtttgagttcttctgcaacaacaccaccatccacggggccatccggctggtgtgcagccagcacaacaggatgaagacagccttctgggccgtgctgtggctgtgcaccttcggcatgatgtactggcagtttggcctgctgtttggagagtacttctcctaccctgtgtccctgaacatcaacctgaacagcgacaagctggtgtttcctgctgtgaccatctgcaccctgaacccctaccgctacccagagatcaaggaggagctggaggagctggaccgcatcacagagcagaccctgtttgacctgtacaagtacagcagcttcaccaccctggtggccggcagccgcagccggcgggacctgcggggcaccctgccccaccccctgcagaggctgcgggtgcccccacctcctcatggagcccggcgggcccggtctgtggccagcagcctgcgggacaacaacccccaggtggactggaaggactggaagattggcttccagctgtgcaaccagaacaagagtgactgcttctaccagacctacagcagcggcgtggatgctgtgcgggagtggtaccgcttccactacatcaacatcctgagccggctgcctgagaccctgcccagcctggaggaggacaccctgggcaacttcatctttgcctgccgcttcaaccaggtgtcctgcaaccaggccaactacagccacttccaccaccccatgtatggcaactgctacaccttcaatgacaagaacaacagcaacctgtggatgagctccatgcctggcatcaacaacggcctgagcctgatgctgcgggcagagcagaatgacttcatccccctgctgagcacagtgactggagcccgggtgatggtgcacggccaggatgagcccgccttcatggatgatggcggcttcaacctgcggcctggggtggagaccagcatctccatgaggaaggagaccctggaccggctgggcggggactatggagactgcaccaagaatggaagtgatgtgcctgtggagaacctgtaccccagcaagtacacccagcaggtgtgcatccacagctgcttccaggagagcatgatcaaggaatgtggctgtgcctacatcttctacccccggccccagaatgtggagtactgtgactacaggaagcacagctcctggggctactgctactacaagctgcaggtggacttcagcagtgaccacctgggctgcttcaccaagtgcaggaagccctgcagcgtgaccagctaccagctgtctgctggctacagccgctggcccagcgtgaccagccaggagtgggtgttccagatgctgagccggcagaacaactacacagtgaacaacaagagaaatggagtggccaaggtgaacatcttcttcaaggagctgaactacaagaccaacagcgagagccccagcgtgaccatggtgaccctgctgagcaacctgggcagccagtggagcctgtggtttggcagctctgtgctgtctgtggtggagatggccgagctggtgtttgacctgctggtgatcatgttcctgatgctgctgcggcgcttccgcagccgctactggagccctggccggggcggccgcggggcccaggaggtggccagcaccctggccagcagcccccccagccacttctgcccccaccccatgagcctgagcctgagccagcccggccctgcccccagccctgccctgacagcccctcctccagcctatgccaccctgggcccccggcccagccctgggggcagcgctggggccagcagcagcacctgccccctgggcggcccctag

SEQ ID NO: 38078 - DNA, 477 bp, Artificial Sequence
  Description of Artificial Sequence: Synthetic coding sequence
atggtgccccacgccatcctggcccggggcagagatgtgtgcagaagaaatggcctgctgatcctgtctgtgctgagcgtcatcgtgggctgcctgctgggcttcttcctgcggacccggcggctgagcccccaggagatctcctacttccagtttcctggagagctgctgatgaggatgctgaagatgatgatcctgcccctggtggtgagcagcctgatgagcggcctggccagcctggatgccaagaccagcagccggctgggcgtgctgactgtggcctactacctgtggaccaccttcatggctgtgattgtgggcatcttcatggtgtccatcatccaccctggcagcgctgcccagaaggagaccacagagcagagcggcaagcccatcatgagcagcgcagatgccctgctggacctgatccggcagaaggaggagagctggagaaatggccccaagggccctggatag

SEQ ID NO: 38079 - DNA, 1683 bp, Artificial Sequence
  Description of Artificial Sequence: Synthetic coding sequence
atggtgccccacgccatcctggcccggggcagagatgtgtgcagaagaaatggcctgctgatcctgtctgtgctgagcgtcatcgtgggctgcctgctgggcttcttcctgcggacccggcggctgagcccccaggagatctcctacttccagtttcctggagagctgctgatgaggatgctgaagatgatgatcctgcccctggtggtgagcagcctgatgagcggcctggccagcctggatgccaagaccagcagccggctgggcgtgctgactgtggcctactacctgtggaccaccttcatggctgtgattgtgggcatcttcatggtgtccatcatccaccctggcagcgctgcccagaaggagaccacagagcagagcggcaagcccatcatgagcagcgcagatgccctgctggacctgatccggaacatgtttcctgccaacctggtggaggccaccttcaagcagtaccgcaccaagaccacccctgtggtgaagagccccaaggtggcccctgaggaggccccaccccggcgcatcctgatctatggagtgcaggaggagaatggcagccacgtgcagaactttgccctggacctgaccccacctcctgaggtggtgtacaagtctgagcccggcaccagtgatggcatgaatgtgctgggcatcgtgttcttcagcgccaccatgggcatcatgctgggccgcatgggagacagcggggcccccctggtgtccttctgccagtgcctgaatgaatctgtgatgaagatcgtggccgtggccgtgtggtacttccccttcggcatcgtgttcctgattgctgggaagatcctggagatggatgaccccagggctgtgggcaagaagctgggcttctacagcgtgacagtggtgtgtggcctggtgctgcacggcctcttcatcctgcccctgctgtacttcttcatcaccaagaagaaccccatcgtgttcatccggggcatcctgcaggccctgctgattgccctggccaccagcagcagcagcgccaccctgcccatcaccttcaagtgcctgctggagaacaaccacatcgacagaagaattgccaggtttgtgctgcctgtgggcgccaccatcaacatggatggaacagccctgtatgaggccgtggccgccatcttcatcgcccaggtgaacaactatgagctggactttggccagatcatcaccatcagcatcacagccacagctgccagcattggagctgctggcatcccccaggccggcctggtgaccatggtgattgtgctgacctctgtgggcctgcccacagatgacatcaccctcatcatcgctgtggactgggccctggaccgcttccgcaccatgatcaacgtgctgggagatgccctggccgccggcatcatggcccacatctgcaggaaggactttgcccgggacacaggaacagagaagctgctgccctgtgagaccaagcctgtgtccctgcaggagatcgtggccgcccagcagaatggctgtgtgaagtctgtggccgaggccagcgagctgaccctgggccccacctgcccccaccacgtgcctgtgcaggtggagcaggatgaggagctgcctgctgccagcctgaaccactgcaccatccagatcagcgagctggagaccaacgtgtag

SEQ ID NO: 38080 - DNA, 729 bp, Artificial Sequence
  Description of Artificial Sequence: Synthetic coding sequence
atgagcaaccccaggagcctggaggaggagaagtatgacatgtctggggcccggctggccctgatcctgtgtgtgaccaaggcccgggagggcagcgaggaggacctggatgccctggagcacatgttccggcagctgcgctttgagagcaccatgaagagggaccccacagctgagcagttccaggaggagctggagaagttccagcaggccatcgacagccgggaggaccctgtgtcctgtgcctttgtggtgctgatggcccacggccgggagggcttcctgaagggggaggatggagagatggtgaagctggagaacctgtttgaggccctgaacaacaagaactgccaggccctgcgggccaagcccaaggtgtacatcatccaggcctgccgcggggagcagagggaccctggagagaccgtgggcggagatgagatcgtgatggtgatcaaggacagcccccagaccatccccacctacacagatgccctgcacgtgtacagcacagtggagggctacatcgcctacagacatgaccagaagggcagctgcttcatccagaccctggtggatgtgttcaccaagaggaagggccacatcctggagctgctgacagaggtgaccaggaggatggccgaggccgagctggtgcaggagggcaaggccaggaagaccaaccctgagatccagagcaccctgaggaagaggctgtacctgcagtag

SEQ ID NO: 38081 - DNA, 1503 bp, Artificial Sequence
  Description of Artificial Sequence: Synthetic coding sequence
atgagcattgaccacgagcagccctggcagcagcctgtgcctgctggggagaggcctgctgctggccctgggggcctggccgctgctgctgctgggaagccagctgctgagagcacagcccacgccccagccccagctgaccatgacccccgggcccgggccgccctgcctgcccccaagaggctgcacagcgcagatggccagaggcggggccactggggccagcccggcctgtgcccagcccccatcagcgcccacctgcccccagaccaggtgctgctcttctcctggagggccagtgatgaagatgctgctgatgctggggtgaccagccactgcctgcagcccggccacaggaacatgtttcctcccaacctggtggaggcctgcttcaagcagttcaagacccagtacagcaccagggtggtgaccaggaccatggtgaggacagaaaatggcagcgagcccggggcctccatgcccccacccttctctgtggagaatggcaccagcttcctggagaatgtgacccgggccctgggcaccctgcaggagatgctgagctttgaggagaccgtgcctgtgcccggcagcgccaacggcatcaatgccctgggcctggtggtgttttctgtggccttcggcctggtgattggaggcatgaagcacaagggccgggtgctgcgggacttctttgacagcctgaatgaggccatcatgaggctggtgggcatcatcatctggtacgcccctgtgggcatcctcttcctgattgctgggaagatcctggagatggaggacatggctgtgctgggcggccagctgggcatgtacaccctgactgtgattgtgggcctcttcctgcacgccggcatcgtgctgcccctcatctacttcctggtgacccacaggaaccccttccccttcatcggcggcatgctgcaggccctgatcacagccatgggcaccagcagcagcagcgccaccctgcccatcaccttccgctgcctggaggagggcctgggcgtggaccggcgcatcaccaggtttgtgctgcctgtgggcgccaccgtgaacatggatggaacagccctgtatgaggccctggccgccatcttcatcgcccaggtgaacaactatgagctgaacctgggccagatcaccaccatcagcatcacagccacagctgcctctgtgggcgccgccggcatcccccaggccggcctggtgaccatggtgattgtgctgacctctgtgggcctgcccacagaggacatcaccctcatcatcgctgtggactggttcctggaccggctgcggaccatgaccaacgtgctgggggacagcatcggggctgctgtgattgagcacctgagccagcgggagctggagctgcaggaggccgagctgaccctgcccagcctgggcaagccctacaagagcctgatggcccaggagaagggggccagccggggccggggcggcaatgaaagtgccatgtag

SEQ ID NO: 38082 - DNA, 618 bp, Artificial Sequence
  Description of Artificial Sequence: Synthetic coding sequence
accatgagcagccacggcaacagcctcttcctgcgggagagcggccagaggctgggccgggtgggctggctgcagaggctgcaggagagcctgcagcagagggccctgcggacccggctgcggctgcagaccatgaccctggagcacgtgctgcgcttcctgcggagaaatgccttcatcctgctgactgtgtctgctgtggtgattggagtgtccctggcctttgccctgcggccctaccagctgacctaccggcagatcaagtacttctccttccctggagagctgctgatgaggatgctgcagatgctggtgctgcccctgattgtgagcagcctggtgacaggcatggccagcctggacaacaaggccactggaaggatgggcatgagagctgctgtgtactacatggtgaccaccatcatcgctgtgttcatcggcatcctgatggtgaccatcatccaccctgggaagggcagcaaggagggcctgcaccgggagggccgcatcgagaccatccccacagcagatgccttcatggacctgatccggaacatgttcccccccaacctggtggaggcctgcttcaagcaggtgcggggcaagtacacagtgtag

SEQ ID NO: 38083 - DNA, 939 bp, Artificial Sequence
  Description of Artificial Sequence: Synthetic coding sequence
atgagcagccacggcaacagcctcttcctgcgggagagcggccagaggctgggccgggtgggctggctgcagaggctgcaggagagcctgcagcagagggccctgcggacccggctgcggctgcagaccatgaccctggagcacgtgctgcgcttcctgcggagaaatgccttcatcctgctgactgtgtctgctgtggtgattggagtgtccctggcctttgccctgcggccctaccagctgacctaccggcagatcaagtacttctccttccctggagagctgctgatgaggatgctgcagatgctggtgctgcccctcatcgtgagcagcctggtgacaggcatggccagcctggacaacaaggccaccggccgcatgggcatgagagctgctgtgtactacatggtgaccaccatcatcgctgtgttcatcggcatcctgatggtgaccatcatccaccctgggaagggcagcaaggagggcctgcaccgggagggcagaattgagaccatccccacagcagatgccttcatggacctgatccggaacatgtttcctcccaacctggtggaggcctgcttcaagcagttcaagacccagtacagcaccagggtggtgaccaggaccatggtgaggacagaaaatggcagcgagcccggggcctccatgcccccacccttctctgtggagaatggcaccagcttcctggagaatgtgacccgggccctgggcaccctgcaggagatgctgagctttgaggagaccgtgcctgtgcccggcagcgccaacggcatcaatgccctgggcctggtggtgttttctgtggccttcggcctggtgattggaggcatgaagcacaagggccgggtgctgcgggacttctttgacagcctgaatgaggccatcatgaggctggtgggcatcatcatctggtag

SEQ ID NO: 38084 - DNA, 1317 bp, Artificial Sequence
  Description of Artificial Sequence: Synthetic coding sequence
atgatcaggaagctgttcatcgtgctgctgctgctgctggtgaccatcgaggaggccaggatgagcagcctgtccttcctgaacatcgagaagacagagatcctcttcttcaccaagacagaggagaccatcctggtgagcagcagctatgagaacaagaggcccaacagcagccacctgtttgtgaagattgaggaccccaagatcctgcagatggtgaatgtggccaagaagatcagcagtgatgccaccaacttcaccatcaacctggtgacagatgaggagggggagaccaacgtgaccatccagctgtgggacagcgagggccggcaggagcggctgattgaggagatcaagaatgtgaaggtgaaggtgctgaagcagaaggacagcctgctgcaggcccccatgcacatcgacaggaacatcctgatgctgatcctgcccctcatcctgctgaacaagtgtgccttcggctgcaagattgagctgcagctgttccagacagtgtggaagaggcccctgcccgtcatcctgggcgctgtgacccagttcttcctgatgcccttctgtggcttcctgctgagccagatcgtggccctgcctgaggcccaggcctttggagtggtgatgacctgcacctgccctgggggcggcggcggctacctgtttgccctgctgctggatggagacttcaccctggccatcctgatgacctgcaccagcaccctgctggccctgatcatgatgcctgtgaacagctacatctacagccgcatcctgggcctgagcggcaccttccacatccctgtgtccaagatcgtgtccaccctgctcttcatcctggtgcctgtgtccattggaattgtcatcaagcaccgcatccctgagaaggccagcttcctggagcgcatcatccggcccctgtccttcatcctgatgtttgtgggcatctacctgaccttcaccgtgggcctggtgttcctgaagacagacaacctggaggtgatcctgctgggcctgctggtgcctgccctgggcctgctgtttggctacagctttgccaaggtgtgcaccctgcccctgcctgtgtgcaagacagtggccatcgagagcggcatgctgaacagcttcctggccctggccgtcatccagctgtccttcccccagagcaaggccaacctggcctctgtggcccccttcaccgtggccatgtgcagcggctgtgagatgctgctgatcatcctggtgtacaaggccaagaagcgctgcatcttcttcctgcaggacaagaggaagaggaacttcctgatctag

SEQ ID NO: 38085 - DNA, 258 bp, Artificial Sequence
  Description of Artificial Sequence: Synthetic coding sequence
atgaggctgctggagaggatgaggaaggactggttcatggtgggcatcgtgctggccatcgccggggccaagctggagcccagcattggagtgaatggaggccccctgaagccagagatcaccgtgtcctacatcgctgtggccaccatcttcttcaacagcggcctgagcctgaagacagaatttgctgacagccggctgcacgccagcgcctgtgtgttctgcagcgacttcaaccagggctcctggtggaagtag

SEQ ID NO: 38086 - DNA, 1023 bp, Artificial Sequence
  Description of Artificial Sequence: Synthetic coding sequence
atgaggctgctggagaggatgaggaaggactggttcatggtgggcatcgtgctggccatcgccggggccaagctggagcccagcattggagtgaatggaggccccctgaagccagagatcaccgtgtcctacatcgctgtggccaccatcttcttcaacagcggcctgagcctgaagacagaggagctgaccagcgccctggtgcacctgaagctgcacctgttcatccagatcttcaccctggccttcttccctgccaccatctggctgttcctgcagctgctgagcatcacccccatcaatgagtggctgctgaagggcctgcagacagtgggctgcatgcctcctcctgtgagcagcgctgtgatcctgaccaaggctgtgggcggcaatgaagctgctgccatcttcaacagcgccttcggcagcttcctgggcatcgtcatcacccccctgctgctgctgctcttcctgggcagcagcagctctgtgcccttcaccagcatcttcagccagctgttcatgacagtggtggtgcccctcatcatcggccagatcgtgcggcgctacatcaaggactggctggagaggaagaagcccccatttggagccatcagcagctctgtgctgctgatgatcatctacaccaccttctgtgacaccttcagcaaccccaacatcgacctggacaagttcagcctggtgctgatcctcttcatcatcttcagcatccagctgtccttcatgctgctgaccttcatcttcagcaccaggaacaacagcggcttcaccccagctgacacagtggccatcatcttctgcagcacccacaagagcctgaccctgggcatccccatgctgaagatcgtgtttgctggccacgagcacctgagcctcatctctgtgcccctgctgatctaccacccagcccagatcctgctgggctctgtgctggtgcccaccatcaagtcctggatggtgtcccggcagaagggcgtgaagctgacccggcccaccgtgtag

SEQ ID NO: 38087 - DNA, 480 bp, Artificial Sequence
  Description of Artificial Sequence: Synthetic coding sequence
atgaggctgctggagaggatgaggaaggactggttcatggtgggcatcgtgctggccatcgccggggccaagctggagcccagcattggagtgaatggaggccccctgaagccagagatcaccgtgtcctacatcgctgtggccaccatcttcttcaacagcggcctgagcctgaagacagaggagctgaccagcgccctggtgcacctgaagctgcacctgttcatccagatcttcaccctggccttcttccctgccaccatctggctgttcctgcagctgctgagcatcacccccatcaatgagtggctgctgaagggcctgcagacagtgggctgcatgcctcctcctgtgagcagcgctgtgatcctgaccaaggctgtgggcggcaatgaagctgctgccatcttcaacagcgccttcggcagcttcctggtgtccaagcacagcctgacctgcctgctgcagctgctgctgtag

SEQ ID NO: 38088 - DNA, 1077 bp, Artificial Sequence
  Description of Artificial Sequence: Synthetic coding sequence
atgaggctgctggagaggatgaggaaggactggttcatggtgggcatcgtgctggccatcgccggggccaagctggagcccagcattggagtgaatggaggccccctgaagccagagatcaccgtgtcctacatcgctgtggccaccatcttcttcaacagcggcctgagcctgaagacagaggagctgaccagcgccctggtgcacctgaagctgcacctgttcatccagatcttcaccctggccttcttccctgccaccatctggctgttcctgcagctgctgagcatcacccccatcaatgagtggctgctgaagggcctgcagacagtgggctgcatgcctcctcctgtgagcagcgctgtgatcctgaccaaggctgtgggcggcaatgaagctgctgccatcttcaacagcgccttcggcagcttcctgggcatcgtcatcacccccctgctgctgctgctcttcctgggcagcagcagctctgtgcccttcaccagcatcttcagccagctgttcatgacagtggtggtgcccctcatcatcggccagatcgtgcggcgctacatcaaggactggctggagaggaagaagcccccatttggagccatcagcagctctgtgctgctgatgatcatctacaccaccttctgtgacaccttcagcaaccccaacatcgacctggacaagttcagcctggtgctgatcctcttcatcatcttcagcatccagctgtccttcatgctgctgaccttcatcttcagcaccaggaacaacagcggcttcaccccagctgacacagtggccatcatcttctgcagcacccacaagagcctgaccctgggcatccccatgctgaagatcgtgtttgctggccacgagcacctgagcctcatctctgtgcccctgctgatctaccacccagcccagatcctgctgggctctgtgctggtgcccaccatcaagtcctggatggtgtcccggcagaagaagctgctgcagacccggggccccctggccaacctgaacaaccctgagggcctggagtacctgagcatcaagtttggccactag

SEQ ID NO: 38089 - DNA, 984 bp, Artificial Sequence
  Description of Artificial Sequence: Synthetic coding sequence
atgaggctgctggagaggatgaggaaggactggttcatggtgggcatcgtgctggccatcgccggggccaagctggagcccagcattggagtgaatggaggccccctgaagccagagatcaccgtgtcctacatcgctgtggccaccatcttcttcaacagcggcctgagcctgaagacagaggagctgaccagcgccctggtgcacctgaagctgcacctgttcatccagatcttcaccctggccttcttccctgccaccatctggctgttcctgcagctgctgagcatcacccccatcaatgagtggctgctgaagggcctgcagacagtgggctgcatgcctcctcctgtgagcagcgctgtgatcctgaccaaggctgtgggcggcaatgaaggcatcgtcatcacccccctgctgctgctgctcttcctgggcagcagcagctctgtgcccttcaccagcatcttcagccagctgttcatgacagtggtggtgcccctcatcatcggccagatcgtgcggcgctacatcaaggactggctggagaggaagaagcccccatttggagccatcagcagctctgtgctgctgatgatcatctacaccaccttctgtgacaccttcagcaaccccaacatcgacctggacaagttcagcctggtgctgatcctcttcatcatcttcagcatccagctgtccttcatgctgctgaccttcatcttcagcaccaggaacaacagcggcttcaccccagctgacacagtggccatcatcttctgcagcacccacaagagcctgaccctgggcatccccatgctgaagatcgtgtttgctggccacgagcacctgagcctcatctctgtgcccctgctgatctaccacccagcccagatcctgctgggctctgtgctggtgcccaccatcaagtcctggatggtgtcccggcagaagggcgtgaagctgacccggcccaccgtgtag

SEQ ID NO: 38090 - DNA, 195 bp, Artificial Sequence
  Description of Artificial Sequence: Synthetic coding sequence
atgaggctgctggagaggatgaggaaggactggttcatggtgggcatcgtgctggccatcgccggggccaagctggagcccagcattggagtgaatggaggccccctgaagccagagatcaccgtgtcctacatcgctgtggccaccatcttcttcaacagcggcctgagcctgaagacagagctgctgacctag

SEQ ID NO: 38091 - DNA, 1077 bp, Artificial Sequence; identical to SEQ ID NO: 38088
  Description of Artificial Sequence: Synthetic coding sequence

SEQ ID NO: 38092 - DNA, 1707 bp, Artificial Sequence
  Description of Artificial Sequence: Synthetic coding sequence
atggtgctgggccctgagcagaagatgtctgatgattctgtgtctggggaccacggggagagcgccagcctgggcaacatcaacccagcctacagcaaccccagcctgagccagagccctggggacagcgaggagtactttgccacctacttcaatgagaagatcagcatccctgaggaggagtacagctgcttctccttcaggaagctgtgggccttcaccggccctggcttcctgatgagcatcgcctacctggaccccggcaacatcgagagtgacctgcagagcggggctgtggccggcttcaagctgctgtggatcctgctgctggccaccctggtgggcctgctgctgcagaggctggccgcccggctgggcgtggtgacaggcctgcacctggccgaggtgtgccaccggcagtaccccaaggtgcccagggtcatcctgtggctgatggtggagctggccatcatcggcagtgacatgcaggaggtgattggcagcgccatcgccatcaacctgctgtctgtgggccgcatccccctgtggggcggcgtgctgatcaccatcgctgacacctttgtgttcctgttcctggacaagtatggcctgaggaagctggaggccttcttcggcttcctgatcaccatcatggccctgaccttcggctatgaatatgtgacagtgaagcccagccagagccaggtgctgaagggcatgtttgtgcccagctgcagcggctgcaggaccccccagatcgagcaggccgtgggcatcgtgggcgccgtcatcatgccccacaacatgtacctgcacagcgccctggtgaagagccggcaggtgaacagaaacaacaagcaggaggtgcgggaggccaacaagtacttcttcatcgagagctgcatcgccctgtttgtgtccttcatcatcaacgtgtttgtggtgtctgtgtttgctgaggccttcttcggcaagaccaatgagcaggtggtggaggtgtgcaccaacaccagcagcccccacgccggcctcttccccaaggacaacagcaccctggccgtggacatctacaagggcggcgtggtgctgggctgctactttggacctgctgccctgtacatctgggccgtgggcatcctggccgccggccagagcagcaccatgacaggcacctacagcggccagtttgtgatggagggcttcctgaacctgaagtggagcagatttgcccgggtggtgctgaccaggagcatcgccatcatccccaccctgctggtggccgtgttccaggatgtggagcacctgaccggcatgaatgacttcctgaatgtgctgcagagcctgcagctgccctttgccctgatccccatcctgaccttcaccagcctgcggcctgtgatgtctgactttgccaacggcctgggctggagaattgctgggggcatcctggtgctgatcatctgcagcatcaacatgtactttgtggtggtgtatgtgcgggacctgggccacgtggccctgtatgtggtggccgctgtggtgtctgtggcctacctgggctttgtgttctacctgggctggcagtgcctgattgccctgggcatgtccttcctggactgtggccacacctgccacctgggcctgacagcccagcctgagctgtacctgctgaacaccatggatgctgacagcctggtgtccaggtag

SEQ ID NO: 38093 - DNA, 1686 bp, Artificial Sequence
  Description of Artificial Sequence: Synthetic coding sequence
atggtgctgggccctgagcagaagatgtctgatgattctgtgtctggggaccacggggagagcgccagcctgggcaacatcaacccagcctacagcaaccccagcctgagccagagccctggggacagcgaggagtactttgccacctacttcaatgagaagatcagcatccctgaggaggagtacagctgcttctccttcaggaagctgtgggccttcaccggccctggcttcctgatgagcatcgcctacctggaccccggcaacatcgagagtgacctgcagagcggggctgtggccggcttcaagctgctgtggatcctgctgctggccaccctggtgggcctgctgctgcagaggctggccgcccggctgggcgtggtgacaggcctgcacctggccgaggtgtgccaccggcagtaccccaaggtgcccagggtcatcctgtggctgatggtggagctggccatcatcggcagtgacatgcaggaggtgattggcagcgccatcgccatcaacctgctgtctgtgggccgcatccccctgtggggcggcgtgctgatcaccatcgctgacacctttgtgttcctgttcctggacaagtatggcctgaggaagctggaggccttcttcggcttcctgatcaccatcatggccctgaccttcggctatgaatatgtgacagtgaagcccagccagagccaggtgctgaagggcatgtttgtgcccagctgcagcggctgcaggaccccccagatcgagcaggccgtgggcatcgtgggcgccgtcatcatgccccacaacatgtacctgcacagcgccctggtgaagagccggcaggtgaacagaaacaacaagcaggaggtgcgggaggccaacaagtacttcttcatcgagagctgcatcgccctgtttgtgtccttcatcatcaacgtgtttgtggtgtctgtgtttgctgaggccttcttcggcaagaccaatgagcaggtggtggaggtgtgcaccaacaccagcagcccccacgccggcctcttccccaaggacaacagcaccctggccgtggacatctacaagggcggcgtggtgctgggctgctactttggacctgctgccctgtacatctgggccgtgggcatcctggccgccggccagagcagcaccatgacaggcacctacagcggccagtttgtgatggagggcttcctgaacctgaagtggagcagatttgcccgggtggtgctgaccaggagcatcgccatcatccccaccctgctggtggccgtgttccaggatgtggagcacctgaccggcatgaatgacttcctgaatgtgctgcagagcctgcagctgccctttgccctgatccccatcctgaccttcaccagcctgcggcctgtgatgtctgactttgccaacggcctgggctggagaattgctgggggcatcctggtgctgatcatctgcagcatcaacatgtactttgtggtggtgtatgtgcgggacctgggccacgtggccctgtatgtggtggccgctgtggtgtctgtggcctacctgggctttgtgttctacctgggctggcagtgcctgattgccctgggcatgtccttcctggactgtggccacacagtgtccatcagcaagggcctgctgacagaggaggccacccggggctacgtgaagtag

SEQ ID NO: 38094 - DNA, 1773 bp, Artificial Sequence
  Description of Artificial Sequence: Synthetic coding sequence
atgaggaagaagcagctgaagacagaggccgccccccactgtgagctgaagagctacagcaagaacagcgccacccaggtgtccaccatggtgctgggccctgagcagaagatgtctgatgacagcgtgtctggggaccatggagagagcgccagcctgggcaacatcaacccagcctacagcaaccccagcctgagccagagccctggggacagcgaggagtactttgccacctacttcaatgagaagatcagcatccctgaggaggagtacagctgcttctccttcaggaagctgtgggccttcaccggccctggcttcctgatgagcatcgcctacctggaccccggcaacattgaaagtgacctgcagagcggggctgtggccggcttcaagctgctgtggatcctgctgctggccaccctggtgggcctgctgctgcagaggctggccgcccggctgggcgtggtgacaggcctgcacctggccgaggtgtgccaccggcagtaccccaaggtgcccagggtcatcctgtggctgatggtggagctggccatcattggaagtgacatgcaggaggtgattggcagcgccatcgccatcaacctgctgtctgtgggccgcatccccctgtggggcggcgtgctgatcaccatcgctgacacctttgtgttcctgttcctggacaagtatggcctgaggaagctggaggccttcttcggcttcctgatcaccatcatggccctgaccttcggctatgaatatgtgacagtgaagcccagccagagccaggtgctgaagggcatgtttgtgcccagctgcagcggctgcaggaccccccagatcgagcaggccgtgggcatcgtgggcgctgtgatcatgccccacaacatgtacctgcacagcgccctggtgaagagccggcaggtgaacagaaacaacaagcaggaggtgcgggaggccaacaagtacttcttcatcgagagctgcatcgccctgtttgtgtccttcatcatcaacgtgtttgtggtgtctgtgtttgctgaggccttcttcggcaagaccaatgagcaggtggtggaggtgtgcaccaacaccagcagcccccatgctggcctcttccccaaggacaacagcaccctggccgtggacatctacaagggcggcgtggtgctgggctgctacttcggccctgctgccctgtacatctgggccgtgggcatcctggccgccggccagagcagcaccatgacaggcacctacagcggccagtttgtgatggagggcttcctgaacctgaagtggagcagatttgcccgggtggtgctgaccaggagcatcgccatcatccccaccctgctggtggccgtgttccaggatgtggagcacctgaccggcatgaatgacttcctgaatgtgctgcagagcctgcagctgccctttgccctgatccccatcctgaccttcaccagcctgcggcctgtgatgtctgactttgccaacggcctgggctggagaattgctgggggcatcctggtgctgatcatctgcagcatcaacatgtactttgtggtggtgtatgtgcgggacctgggccacgtggccctgtatgtggtggccgctgtggtgtctgtggcctacctgggctttgtgttctacctgggctggcagtgcctgattgccctgggcatgtccttcctggactgtggccacacagtgtccatcagcaagggcctgctgacagaggaggccacccggggctacgtgaagtag

SEQ ID NO: 38095 - DNA, 1686 bp, Artificial Sequence; identical to SEQ ID NO: 38093
  Description of Artificial Sequence: Synthetic coding sequence

SEQ ID NO: 38096 - DNA, 1674 bp, Artificial Sequence
  Description of Artificial Sequence: Synthetic coding sequence
atgagcacagtggactacctgaacagcgtgtctggggaccacggggagagcgccagcctgggcaacatcaacccagcctacagcaaccccagcctgagccagagccctggggacagcgaggagtactttgccacctacttcaatgagaagatcagcatccctgaggaggagtacagctgcttctccttcaggaagctgtgggccttcaccggccctggcttcctgatgagcatcgcctacctggaccccggcaacatcgagagtgacctgcagagcggggctgtggccggcttcaagctgctgtggatcctgctgctggccaccctggtgggcctgctgctgcagaggctggccgcccggctgggcgtggtgacaggcctgcacctggccgaggtgtgccaccggcagtaccccaaggtgcccagggtcatcctgtggctgatggtggagctggccatcatcggcagtgacatgcaggaggtgattggcagcgccatcgccatcaacctgctgtctgtgggccgcatccccctgtggggcggcgtgctgatcaccatcgctgacacctttgtgttcctgttcctggacaagtatggcctgaggaagctggaggccttcttcggcttcctgatcaccatcatggccctgaccttcggctatgaatatgtgacagtgaagcccagccagagccaggtgctgaagggcatgtttgtgcccagctgcagcggctgcaggaccccccagatcgagcaggccgtgggcatcgtgggcgccgtcatcatgccccacaacatgtacctgcacagcgccctggtgaagagccggcaggtgaacagaaacaacaagcaggaggtgcgggaggccaacaagtacttcttcatcgagagctgcatcgccctgtttgtgtccttcatcatcaacgtgtttgtggtgtctgtgtttgctgaggccttcttcggcaagaccaatgagcaggtggtggaggtgtgcaccaacaccagcagcccccacgccggcctcttccccaaggacaacagcaccctggccgtggacatctacaagggcggcgtggtgctgggctgctactttggacctgctgccctgtacatctgggccgtgggcatcctggccgccggccagagcagcaccatgacaggcacctacagcggccagtttgtgatggagggcttcctgaacctgaagtggagcagatttgcccgggtggtgctgaccaggagcatcgccatcatccccaccctgctggtggccgtgttccaggatgtggagcacctgaccggcatgaatgacttcctgaatgtgctgcagagcctgcagctgccctttgccctgatccccatcctgaccttcaccagcctgcggcctgtgatgtctgactttgccaacggcctgggctggagaattgctgggggcatcctggtgctgatcatctgcagcatcaacatgtactttgtggtggtgtatgtgcgggacctgggccacgtggccctgtatgtggtggccgctgtggtgtctgtggcctacctgggctttgtgttctacctgggctggcagtgcctgattgccctgggcatgtccttcctggactgtggccacacagtgtccatcagcaagggcctgctgacagaggaggccacccggggctacgtgaagtag

SEQ ID NO: 38097 - DNA, 1707 bp, Artificial Sequence; identical to SEQ ID NO: 38092
  Description of Artificial Sequence: Synthetic coding sequence

SEQ ID NO: 38098 - DNA, 1449 bp, Artificial Sequence
  Description of Artificial Sequence: Synthetic coding sequence
atgagcatcgcctacctggaccccggcaacattgaaagtgacctgcagagcggggctgtggccggcttcaagctgctgtggatcctgctgctggccaccctggtgggcctgctgctgcagaggctggccgcccggctgggcgtggtgacaggcctgcacctggccgaggtgtgccaccggcagtaccccaaggtgcccagggtcatcctgtggctgatggtggagctggccatcattggaagtgacatgcaggaggtgattggcagcgccatcgccatcaacctgctgtctgtgggccgcatccccctgtggggcggcgtgctgatcaccatcgctgacacctttgtgttcctgttcctggacaagtatggcctgaggaagctggaggccttcttcggcttcctgatcaccatcatggccctgaccttcggctatgaatatgtgacagtgaagcccagccagagccaggtgctgaagggcatgtttgtgcccagctgcagcggctgcaggaccccccagatcgagcaggccgtgggcatcgtgggcgctgtgatcatgccccacaacatgtacctgcacagcgccctggtgaagagccggcaggtgaacagaaacaacaagcaggaggtgcgggaggccaacaagtacttcttcatcgagagctgcatcgccctgtttgtgtccttcatcatcaacgtgtttgtggtgtctgtgtttgctgaggccttcttcggcaagaccaatgagcaggtggtggaggtgtgcaccaacaccagcagcccccatgctggcctcttccccaaggacaacagcaccctggccgtggacatctacaagggcggcgtggtgctgggctgctacttcggccctgctgccctgtacatctgggccgtgggcatcctggccgccggccagagcagcaccatgacaggcacctacagcggccagtttgtgatggagggcttcctgaacctgaagtggagcagatttgcccgggtggtgctgaccaggagcatcgccatcatccccaccctgctggtggccgtgttccaggatgtggagcacctgaccggcatgaatgacttcctgaatgtgctgcagagcctgcagctgccctttgccctgatccccatcctgaccttcaccagcctgcggcctgtgatgtctgactttgccaacggcctgggctggagaattgctgggggcatcctggtgctgatcatctgcagcatcaacatgtactttgtggtggtgtatgtgcgggacctgggccacgtggccctgtatgtggtggccgctgtggtgtctgtggcctacctgggctttgtgttctacctgggctggcagtgcctgattgccctgggcatgtccttcctggactgtggccacacagtgtccatcagcaagggcctgctgacagaggaggccacccggggctacgtgaagtag

SEQ ID NO: 38099 - DNA, 1707 bp, Artificial Sequence; identical to SEQ ID NO: 38092
  Description of Artificial Sequence: Synthetic coding sequence

SEQ ID NO: 38100 - DNA, 1773 bp, Artificial Sequence; identical to SEQ ID NO: 38094
  Description of Artificial Sequence: Synthetic coding sequence

SEQ ID NO: 38101 - DNA, 12 bp, Artificial Sequence
  Description of Artificial Sequence: Synthetic coding sequence
atggtgctgtag

SEQ ID NO: 38102 - DNA, 450 bp, Artificial Sequence
  Description of Artificial Sequence: Synthetic coding sequence
atggtgctgggccctgagcagaagatgtctgatgattctgtgtctggggaccacggggagagcgccagcctgggcaacatcaacccagcctacagcaaccccagcctgagccagagccctggggacagcgaggagtactttgccacctacttcaatgagaagatcagcatccctgaggaggagtacagctgcttctccttcaggaagctgtgggccttcaccggccctggcttcctgatgagcatcgcctacctggaccccggcaacatcgagagtgacctgcagagcggggctgtggccggcttcaagctgctgtggatcctgctgctggccaccctggtgggcctgctgctgcagaggctggccgcccggctgggcgtggtgacaggcctgcacctggccgaggtgtgccaccggcagtaccccaaggtgcccagggtcatcctgtag

SEQ ID NO: 38103 - DNA, 2145 bp, Artificial Sequence
  Description of Artificial Sequence: Synthetic coding sequence
atgacccagatgagccaggtgcaggagctgttccacgaggccgcccagcaggatgccctggcccagccccagccctggtggaagacccagctgttcatgtgggagcctgtgctgtttggcacctgggatggagtcttcaccagctgcatgatcaacatcttcggcgtggtgctcttcctgaggacaggctggctggtgggcaacacaggagtgctgctgggcatgttcctggtgtcctttgtgatcctggtggccctggtgacagtgctgtctggaattggagtgggggagaggagcagcatcggcagcggaggagtgtacagcatgatcagctctgtgctgggcggccagacaggaggcaccatcggcctgctgtatgtgtttggccagtgtgtggccggggccatgtacatcactggatttgctgagagcatcagtgacctgctgggcctgggcaacatctgggccgtgcggggcatctctgtggccgtgctgctggccctgctgggcatcaacctggccggcgtgaagtggatcatccggctgcagctgctgctgctcttcctgctggccgtgtccaccctggactttgtggtgggcagcttcacccacctggaccctgagcacggcttcatcggctacagccctgagctgctgcagaacaacaccctgcctgactacagccctggagagagcttcttcaccgtgtttggagtcttcttccctgctgccactggagtgatggccggcttcaacatgggcggggacctgcgggagcctgctgccagcatccccccaggcagcctggccgctgtgggcatctcctggttcctgtacatcatctttgtgttcctgctgggcgccatctgcacccgggaggccctgcgctatgacttcctgattgctgagaaggtgtccctgatgggcttcctgttcctgctgggcctgtacatcagcagcctggccagctgcatgggcggcctgtatggagccccccgcatcctgcagtgcatcgcccaggagaaggtgatcccagccctggcctgcctgggccagggcaagggccccaacaagacccctgtggccgccatctgcctgaccagcctggtgaccatggcctttgtgtttgtgggccaggtgaatgtgctggcccccatcgtgaccatcaacttcatgctgacctacgtggccgtggactacagctacttcagcctgtccatgtgcagctgcagcctgacccctgtgcctgagcctgtgctgcgggagggcgctgagggcctgcactgcagcgagcacctgctgctggagaaggcccccagctatggcagcgagggccctgcccagagggtgctggagggcaccctgctggagttcaccaaggacatggaccagctgctgcagctgaccaggaagctggagagcagccagccccggcagggcgagggcaacagaacacctgagagccagaagaggaagagcaagaaggccaccaagcagaccctgcaggacagcttcctgctggacctgaagagcccccccagcttccctgtggagatcagtgaccggctgcctgctgcctcctgggagggccaggagagctgctggaacaagcagaccagcaagtctgagggcacccagcctgagggcacctatggagagcagctggtgcctgagctgtgcaaccagagcgagagcagcggggaggacttcttcctgaagagccggctgcaggagcaggatgtgtggaggaggagcaccagcttctacacccacatgtgcaacccctgggtgtccctgctgggcgctgtgggcagcctgctgatcatgtttgtgatccagtgggtgtacaccctggtgaacatgggcgtggccgccatcgtgtacttctacatcggccgggccagccctggcctgcacctgggcagcgccagcaacttctccttcttccgctggatgaggagcctgctgctgcccagctgccgcagcctgcggagcccccaggagcagatcatcctggcccccagcctggccaaggtggacatggagatgacccagctgacccaggagaatgctgactttgccacccgggaccgctaccaccacagcagcctggtgaaccgggagcagctgatgccccactactag

SEQ ID NO: 38104 - DNA, 2145 bp, Artificial Sequence; identical to SEQ ID NO: 38103
  Description of Artificial Sequence: Synthetic coding sequence

SEQ ID NO: 38105 - DNA, 1617 bp, Artificial Sequence
  Description of Artificial Sequence: Synthetic coding sequence
atggccagcgagagcagccccctgctggcctaccgcctgctgggggaggagggcgtggccctgcctgccaacggggccggcggccctggaggagccagcgccaggaagctgagcaccttcctgggcgtggtggtgcccaccgtgctgtccatgttcagcatcgtggtgttcctgagaattgatgccaccggccccagcggcctgcgggtgctgccccagggctacggctggaacctgctgtatggcagcctgctgctgggcctggtgggcggcgtgtgcaccctgggcgccggcctgtatgcccgggccagcttcctgaccttcctgctggtgtctggcagcctggcctctgtgctgatcagctttgtggccgtgggcccccgggacatccggctgaccccccggcccggccccaacggcagcagcctgccccccaggtttggccacttcaccggcttcaacagcagcaccctgaaggacaacctgggcgccggctatgcagaggactacaccaccggggctgtgatgaactttgcctctgtgtttgctgtgctcttcaacggctgcaccggcatcatggccggggccaacatgtctggagagctgaaggaccccagccgggccatccccctgggcaccatcgtggccgtggcctacaccttctttgtgtatgtgctgctcttcttcctgagcagcttcacctgtgacaggaccctgctgcaggaggactatggcttcttccgggccatcagcctgtggccacccctggtgctgattggcatctatgccacagccctgagcgcctccatgagcagcctcatcggggccagccgcatcctgcacgccctggccagagatgacctgtttggagtcatcctggccccagccaaggtggtgtcccggggcggcaacccctgggccgctgtgctgtacagctggggcctggtgcagctggtgctgctggccggcaagctgaacaccctggccgctgtggtgacagtgttctacctggtggcctatgctgctgtggacctgagctgcctgagcctggagtgggccagcgcccccaacttccggcccaccttcagcctcttctcctggcacacctgcctgctgggcgtggccagctgcctgctgatgatgttcctgatcagccctggagctgctgggggcagcctgctgctgatgggcctgctggccgccctgctgacagcccggggcggccccagctcctggggctacgtgtcccaggccctgctcttccaccaggtgaggaagtacctgctgcggctggatgtgaggaaggaccacgtgaagttctggaggccccagctgctgctgctggtgggcaaccccaggggggccctgcccctgctgcggctggccaaccagctgaagaagggcggcctgtatgtgctgggccacgtgaccctgggggacctggacagcctgcccagcgaccctgtgcagccccagtatggagcctggctgagcctggtggaccgggcccaggtgaaggcctttgtggacctgaccctgagccccagcgtgcggcagggcgcccagcacctgctgcgcatcagcggcctggagagcaacagccaccccctgccctag

SEQ ID NO: 38106 - DNA, 2745 bp, Artificial Sequence
  Description of Artificial Sequence: Synthetic coding sequence
atggccagcgagagcagccccctgctggcctaccgcctgctgggggaggagggcgtggccctgcctgccaacggggccggcggccctggaggagccagcgccaggaagctgagcaccttcctgggcgtggtggtgcccaccgtgctgtccatgttcagcatcgtggtgttcctgcgcatcggctttgtggtgggccatgctggcctgctgcaggccctggccatgctgctggtggcctacttcatcctggccctgactgtgctgtctgtgtgtgccatcgccaccaacggggctgtgcagggcggcggggcctacttcatgatcagcaggaccctgggccctgaggtgggcggcagcatcggcctgatgttctacctggccaacgtgtgtggctgtgctgtgtccctgctgggcctggtggagagcgtgctggatgtgtttggagcagatgccaccggccccagcggcctgcgggtgctgccccagggctacggctggaacctgctgtatggcagcctgctgctgggcctggtgggcggcgtgtgcaccctgggcgccggcctgtatgcccgggccagcttcctgaccttcctgctggtgtctggcagcctggcctctgtgctgatcagctttgtggccgtgggcccccgggacatccggctgacccccaggcctggccccaacggcagcagcctgcccccacgcttcggccacttcaccggcttcaacagcagcaccctgaaggacaacctgggcgccggctatgcagaggactacaccactggagctgtgatgaactttgcctctgtgtttgctgtgctcttcaacggctgcaccggcatcatggccggggccaacatgtctggagagctgaaggaccccagccgggccatccccctgggcaccatcgtggccgtggcctacaccttctttgtgtatgtgctgctcttcttcctgagcagcttcacctgtgacaggaccctgctgcaggaggactatggcttcttccgggccatcagcctgtggccacccctggtgctgattggcatctatgccacagccctgagcgcctccatgagcagcctgattggagccagccgcatcctgcacgccctggccagagatgacctgtttggagtcatcctggccccagccaaggtggtgtccagaggaggcaacccctgggccgctgtgctgtacagctggggcctggtgcagctggtgctgctggccggcaagctgaacaccctggccgctgtggtgaccgtcttctacctggtggcctatgctgctgtggacctgagctgcctgagcctggagtgggccagcgcccccaacttccggcccaccttcagcctcttctcctggcacacctgcctgctgggcgtggccagctgcctgctgatgatgttcctgatcagccctggagctgctgggggcagcctgctgctgatgggcctgctggccgccctgctgacagcccggggcggccccagctcctggggctacgtgtcccaggccctgctcttccaccaggtgaggaagtacctgctgcggctggatgtgaggaaggaccacgtgaagttctggaggccccagctgctgctgctggtgggcaaccccaggggggccctgcccctgctgcggctggccaaccagctgaagaagggcggcctgtatgtgctgggccacgtgaccctgggggacctggacagcctgcccagcgaccctgtgcagccccagtacggggcctggctgagcctggtggaccgggcccaggtgaaggcctttgtggacctgaccctgagccccagcgtgcggcagggcgcccagcacctgctgcgcatcagcggcctgggcggcatgaagcccaacaccctggtgctgggcttctatgatgatgccccaccccaggaccacttcctgacagatcctgccttcagcgagcctgctgacagcacccgggagggcagcagccctgccctgagcaccctcttccccccaccccgggcccctggcagcccccgggccctgaacccccaggactatgtggccaccgtggctgatgccctgaagatgaacaagaatgtggtgctggcccgggccagcggggccctgcccccagagcggctgagccggggcagcggcggcaccagccagctgcaccacgtggatgtgtggcccctgaacctgctgcggccccggggcggccctggctacgtggatgtgtgtggcctcttcctgctgcagatggccaccatcctgggcatggtgcctgcctggcacagcgcccggctgcgcatcttcctgtgcctgggcccccgggaggcccctggagctgctgagggccgcctgcgggccctgctgagccagctgcgcatccgggcagaggtgcaggaggtggtgtggggcgagggcgctggggccggggagcctgaggccgaggaggagggggactttgtgaacagcggcagaggagatgctgaggccgaggccctggcccggagcgccaatgccctggtgcgggcccagcagggccggggcactggaggcggccctgggggccctgagggcggagatgctgagggccccatcacagccctgaccttcctgtacctgccccggcccccagctgaccctgcccgctacccccgctacctggccctgctggagaccctgacccgggacctgggccccaccctgctggtgcacggcgtgacccctgtgacctgcacagacctgtag

SEQ ID NO: 38107 - DNA, 1617 bp, Artificial Sequence; identical to SEQ ID NO: 38105
  Description of Artificial Sequence: Synthetic coding sequence

SEQ ID NO: 38108 - DNA, 1884 bp, Artificial Sequence
  Description of Artificial Sequence: Synthetic coding sequence
atggccagcgagagcagccccctgctggcctaccgcctgctgggggaggagggcgtggccctgcctgccaacggggccggcggccctggaggagccagcgccaggaagctgagcaccttcctgggcgtggtggtgcccaccgtgctgtccatgttcagcatcgtggtgttcctgcgcatcggctttgtggtgggccatgctggcctgctgcaggccctggccatgctgctggtggcctacttcatcctggccctgactgtgctgtctgtgtgtgccatcgccaccaacggggctgtgcagggcggcggggcctacttcatgatcagcaggaccctgggccctgaggtgggcggcagcatcggcctgatgttctacctggccaacgtgtgtggctgtgctgtgtccctgctgggcctggtggagagcgtgctggatgtgtttggagcagatgccaccggccccagcggcctgcgggtgctgccccagggctacggctggaacctgctgtatggcagcctgctgctgggcctggtgggcggcgtgtgcaccctgggcgccggcctgtatgcccgggccagcttcctgaccttcctgctggtgtctggcagcctggcctctgtgctgatcagctttgtggccgtgggcccccgggacatccggctgacccccaggcctggccccaacggcagcagcctgcccccacgcttcggccacttcaccggcttcaacagcagcaccctgaaggacaacctgggcgccggctatgcagaggactacaccactggagctgtgatgaactttgcctctgtgtttgctgtgctcttcaacggctgcaccggcatcatggccggggccaacatgtctggagagctgaaggaccccagccgggccatccccctgggcaccatcgtggccgtggcctacaccttctttgtgtatgtgctgctcttcttcctgagcagcttcacctgtgacaggaccctgctgcaggaggactatggcttcttccgggccatcagcctgtggccacccctggtgctgattggcatctatgccacagccctgagcgcctccatgagcagcctgattggagccagccgcatcctgcacgccctggccagagatgacctgtttggagtcatcctggccccagccaaggtggtgtccagaggaggcaacccctgggccgctgtgctgtacagctggggcctggtgcagctggtgctgctggccggcaagctgaacaccctggccgctgtggtgaccgtcttctacctggtggcctatgctgctgtggacctgagctgcctgagcctggagtgggccagcgcccccaacttccggcccaccttcagcctcttctcctggcacacctgcctgctgggcgtggccagctgcctgctgatgatgttcctgatcagccctggagctgctgggggcagcctgctgctgatgggcctgctggccgccctgctgacagcccggggcggccccagctcctggggctacgtgtcccaggccctgctcttccaccaggtgaggaagtacctgctgcggctggatgtgaggaaggaccacgtgaagttctggaggccccagctgctgctgctggtgggcaaccccaggggggccctgcccctgctgcggctggccaaccagctgaagaagggcggcctgtatgtgctgggccacgtgaccctgggggacctggacagcctgcccagcgaccctgtgcagccccagtacggggcctggctgagcctggtggaccgggcccaggtgaaggcctttgtggacctgaccctgagccccagcgtgcggcagggcgcccagcacctgctgcgcatcagcggcctggagagcaacagccaccccctgccctag

SEQ ID NO: 38109 - DNA, 390 bp, Artificial Sequence
  Description of Artificial Sequence: Synthetic coding sequence
atggccagcgagagcagccccctgctggcctaccgcctgctgggggaggagggcgtggccctgcctgccaacggggccggcggccctggaggagccagcgccaggaagctgagcaccttcctgggcgtggtggtgcccaccgtgctgtccatgttcagcatcgtggtgttcctgcgcatcggctttgtggtgggccatgctggcctgctgcaggccctggccatgctgctggtggcctacttcatcctggccctgactgtgctgtctgtgtgtgccatcgccaccaacggggctgtgcagggcggcggggcctacttcatgatcagcaggaccctgggccctgaggtgggcggcagcatcggcctgatgttctacctggccaacgtgtag

SEQ ID NO: 38110 - DNA, 1461 bp, Artificial Sequence
  Description of Artificial Sequence: Synthetic coding sequence
cactttggagtgcactggcacagcctggtgttcaccggcatcctgggcgtgcactggcacttcggcaccacagcccggctgctggccctggcccagctggtgctgctggccggcaagctgaacaccctggccgctgtggtgaccgtcttctacctggtggcctatgctgctgtggacctgagctgcctgagcctggagtgggccagcgcccccaacttccggcccaccttcagcctcttctcctggcacacctgcctgctgggcgtggccagctgcctgctgatgatgttcctgatcagccctggagctgctgggggcagcctgctgctgatgggcctgctggccgccctgctgacagcccggggcggccccagctcctggggctacgtgtcccaggccctgctcttccaccaggtgaggaagtacctgctgcggctggatgtgaggaaggaccacgtgaagttctggaggccccagctgctgctgctggtgggcaaccccaggggggccctgcccctgctgcggctggccaaccagctgaagaagggcggcctgtatgtgctgggccacgtgaccctgggggacctggacagcctgcccagcgaccctgtgcagccccagtacggggcctggctgagcctggtggaccgggcccaggtgaaggcctttgtggacctgaccctgagccccagcgtgcggcagggcgcccagcacctgctgcgcatcagcggcctgggcggcatgaagcccaacaccctggtgctgggcttctatgatgatgccccaccccaggaccacttcctgacagatcctgccttcagcgagcctgctgacagcacccgggagggcagcagccctgccctgagcaccctcttccccccaccccgggcccctggcagcccccgggccctgaacccccaggactatgtggccaccgtggctgatgccctgaagatgaacaagaatgtggtgctggcccgggccagcggggccctgcccccagagcggctgagccggggcagcggcggcaccagccagctgcaccacgtggatgtgtggcccctgaacctgctgcggccccggggcggccctggctacgtggatgtgtgtggcctcttcctgctgcagatggccaccatcctgggcatggtgcctgcctggcacagcgcccggctgcgcatcttcctgtgcctgggcccccgggaggcccctggagctgctgagggccgcctgcgggccctgctgagccagctgcgcatccgggcagaggtgcaggaggtggtgtggggcgagggcgctggggccggggagcctgaggccgaggaggagggggactttgtgaacagcggcagaggagatgctgaggccgaggccctggcccggagcgccaatgccctggtgcgggcccagcagggccgccacagaagaagagctggctgggccggcggctggggctgctag

SEQ ID NO: 38111 - DNA, 1896 bp, Artificial Sequence
  Description of Artificial Sequence: Synthetic coding sequence
atggccagcgagagcagccccctgctggcctaccgcctgctgggggaggagggcgtggccctgcctgccaacggggccggcggccctggaggagccagcgccaggaagctgagcaccttcctgggcgtggtggtgcccaccgtgctgtccatgttcagcatcgtggtgttcctgcgcatcggctttgtggtgggccatgctggcctgctgcaggccctggccatgctgctggtggcctacttcatcctggccctgactgtgctgtctgtgtgtgccatcgccaccaacggggctgtgcagggcggcggggcctacttcatgatcagcaggaccctgggccctgaggtgggcggcagcatcggcctgatgttctacctggccaacgtgtgtggctgtgctgtgtccctgctgggcctggtggagagcgtgctggatgtgtttggagcagatgccaccggccccagcggcctgcgggtgctgccccagggctacggctggaacctgctgtatggcagcctgctgctgggcctggtgggcggcgtgtgcaccctgggcgccggcctgtatgcccgggccagcttcctgaccttcctgctggtgtctggcagcctggcctctgtgctgatcagctttgtggccgtgggcccccgggacatccggctgacccccaggcctggccccaacggcagcagcctgcccccacgcttcggccacttcaccggcttcaacagcagcaccctgaaggacaacctgggcgccggctatgcagaggactacaccactggagctgtgatgaactttgcctctgtgtttgctgtgctcttcaacggctgcaccggcatcatggccggggccaacatgtctggagagctgaaggaccccagccgggccatccccctgggcaccatcgtggccgtggcctacaccttctttgtgtatgtgctgctcttcttcctgagcagcttcacctgtgacaggaccctgctgcaggaggactatggcttcttccgggccatcagcctgtggccacccctggtgctgattggcatctatgccacagccctgagcgcctccatgagcagcctgattggagccagccgcatcctgcacgccctggccagagatgacctgtttggagtcatcctggccccagccaaggtggtgtccagaggaggcaacccctgggccgctgtgctgtacagctggggcctggtgcagctggtgctgctggccggcaagctgaacaccctggccgctgtggtgaccgtcttctacctggtggcctatgctgctgtggacctgagctgcctgagcctggagtgggccagcgcccccaacttccggcccaccttcagcctcttctcctggcacacctgcctgctgggcgtggccagctgcctgctgatgatgttcctgatcagccctggagctgctgggggcagcctgctgctgatgggcctgctggccgccctgctgacagcccggggcggccccagctcctggggctacgtgtcccaggccctgctcttccaccaggtgaggaagtacctgctgcggctggatgtgaggaaggaccacgtgaagttctggaggccccagctgctgctgctggtgggcaaccccaggggggccctgcccctgctgcggctggccaaccagctgaagaagggcggcctgtatgtgctgggccacgtgaccctgggggacctggacagcctgcccagcgaccctgtgcagccccagtacggggcctggctgagcctggtggaccgggcccaggtgaaggcctttgtggacctgaccctgagccccagcgtgcggcagggcgcccagcacctgctgcgcatcagcggcctggagagcggcaccctgctgccctggggcttccgctcctag

SEQ ID NO: 38112 - DNA, 2097 bp, Artificial Sequence
  Description of Artificial Sequence: Synthetic coding sequence
atgaaccccttccagaagaatgaaagcaaggagaccctcttcagccctgtgtccattgaggaggtgcccccccggccccccagcccccccaagaagcccagccccaccatctgtggcagcaactaccccctgagcatcgccttcatcgtggtgaatgagttctgtgagcgcttctcctactacggcatgaaggctgtgctgatcctgtacttcctgtacttcctgcactggaatgaagacaccagcaccagcatctaccacgccttcagcagcctgtgctacttcacccccatcctgggcgccgccatcgctgacagctggctgggcaagttcaaggtgctgagcctgattggcctgagcctcatcgccctgggcaccggcggcatcaagccctgtgtggccgccttcggcggggaccagtttgaggagaagcacgccgaggagaggacccgctacttcagcgtcttctacctgagcatcaatgccggcagcctcatcagcaccttcatcacccccatgctgcggggagatgtgcagtgctttggagaggactgctacgccctggccttcggcgtgcccggcctgctgatggtgattgccctggtggtgtttgccatgggcagcaagatctacaacaagcccccacctgagggcaacatcgtggcccaggtgttcaagtgcatctggtttgccatcagcaaccgcttcaagaacagaagtggggacatccccaagaggcagcactggctggactgggccgctgagaagtaccccaagcagctgatcatggatgtgaaggccctgaccagggtgctcttcctgtacatccccctgcccatgttctgggccctgctggaccagcagggcagccgctggaccctgcaggccatccgcatgaacagaaacctgggcttctttgtgctgcagcctgaccagatgcaggtgctgaaccccctgctggtgctgatcttcatccccctgtttgattttgtgatctaccgcctggtgtccaaatgtggcatcaacttcagcagcctgaggaagatggctgtgggcatgatcctggcctgcctggcctttgctgtggccgctgctgtggagatcaagatcaatgagatggccccagcccagcccggcccccaggaggtgttcctgcaggtgctgaacctggctgatgatgaggtgaaggtgacagtggtgggcaatgaaaacaacagcctgctgattgagagcatcaagagcttccagaagaccccccactacagcaagctgcacctgaagaccaagagccaggacttccacttccacctgaagtaccacaacctgagcctgtacacagagcacagcgtgcaggagaagaactggtacagcctggtgatccgggaggatggcaacagcatcagctccatgatggtgaaggacacagagagcaggaccaccaacggcatgaccaccgtgcgctttgtgaacaccctgcacaaggatgtgaacatcagcctgagcacagacaccagcctgaatgtgggggaggactatggagtgtctgcctacagaacagtgcagagaggagagtacccagctgtgcactgcaggacagaggacaagaacttcagcctgaacctgggcctgctggactttggagctgcctacctgtttgtgatcaccaacaacaccaaccagggcctgcaggcctggaagattgaggacatcccagccaacaagatgagcatcgcctggcagctgccccagtatgccctggtgacagctggggaggtgatgttttctgtgacaggcctggagttctcctacagccaggcccccagctccatgaagtctgtgctgcaggccgcctggctgctgaccatcgctgtgggcaacatcatcgtgctggtggtggcccagttcagcggcctggtgcagtgggccgagttcatcctcttcagctgcctgctgctggtgatctgcctgatcttcagcatcatgggctactactacgtgcctgtgaagacagaggacatgaggggccctgctgacaagcacatcccccacatccagggcaacatgatcaagctggagaccaagaagaccaagctgtag

SEQ ID NO: 38113 - DNA, 2190 bp, Artificial Sequence
  Description of Artificial Sequence: Synthetic coding sequence
atgaaccccttccagaagaatgaaagcaaggagaccctcttcagccctgtgtccattgaggaggtgcccccccggccccccagcccccccaagaagcccagccccaccatctgtggcagcaactaccccctgagcatcgccttcatcgtggtgaatgagttctgtgagcgcttctcctactacggcatgaaggctgtgctgatcctgtacttcctgtacttcctgcactggaatgaagacaccagcaccagcatctaccacgccttcagcagcctgtgctacttcacccccatcctgggcgccgccatcgctgacagctggctgggcaagttcaagaccatcatctacctgagcctggtgtatgtgctgggccacgtgatcaagagcctgggcgccctgcccatcctgggcggccaggtggtgcacacagtgctgagcctcatcggcctgagcctgattgccctgggcactggaggcatcaagccctgtgtggccgcctttggaggagaccagtttgaggagaagcatgctgaggagaggacccgctacttctctgtgttctacctgagcatcaatgccggcagcctcatcagcaccttcatcacccccatgctgcggggagatgtgcagtgcttcggggaggactgctacgccctggcctttggagtgcccggcctgctgatggtgattgccctggtggtgtttgccatgggcagcaagatctacaacaagcccccacctgagggcaacatcgtggcccaggtgttcaagtgcatctggtttgccatcagcaaccgcttcaagaacagaagtggggacatccccaagaggcagcactggctggactgggccgctgagaagtaccccaagcagctgatcatggatgtgaaggccctgaccagggtgctcttcctgtacatccccctgcccatgttctgggccctgctggaccagcagggcagccgctggaccctgcaggccatccgcatgaacagaaacctgggcttctttgtgctgcagcctgaccagatgcaggtgctgaaccccctgctggtgctgatcttcatccccctgtttgattttgtgatctaccgcctggtgtccaaatgtggcatcaacttcagcagcctgaggaagatggctgtgggcatgatcctggcctgcctggcctttgctgtggccgctgctgtggagatcaagatcaatgagatggccccagcccagcccggcccccaggaggtgttcctgcaggtgctgaacctggctgatgatgaggtgaaggtgacagtggtgggcaatgaaaacaacagcctgctgattgagagcatcaagagcttccagaagaccccccactacagcaagctgcacctgaagaccaagagccaggacttccacttccacctgaagtaccacaacctgagcctgtacacagagcacagcgtgcaggagaagaactggtacagcctggtgatcagagaagatggcaacagcatcagctccatgatggtgaaggacacagagagcaggaccaccaacggcatgaccaccgtgcgctttgtgaacaccctgcacaaggatgtgaacatcagcctgagcacagacaccagcctgaatgtgggagaagattatggagtgtctgcctacagaacagtgcagagaggagagtacccagctgtgcactgcaggacagaggacaagaacttcagcctgaacctgggcctgctggactttggagctgcctacctgtttgtgatcaccaacaacaccaaccagggcctgcaggcctggaagattgaggacatcccagccaacaagatgagcatcgcctggcagctgccccagtatgccctggtgacagctggggaggtgatgttttctgtgacaggcctggagttctcctacagccaggcccccagctccatgaagtctgtgctgcaggccgcctggctgctgaccatcgctgtgggcaacatcatcgtgctggtggtggcccagttcagcggcctggtgcagtgggccgagttcatcctcttcagctgcctgctgctggtgatctgcctgatcttcagcatcatgggctactactacgtgcctgtgaagacagaggacatgaggggccctgctgacaagcacatcccccacatccagggcaacatgatcaagctggagaccaagaagaccaagctgtag

SEQ ID NO: 38114 - DNA, 2076 bp, Artificial Sequence
  Description of Artificial Sequence: Synthetic coding sequence
atgagccccaggaagctgttcttccctgtgtccattgaggaggtgccccccaggcctcccagcccccccaagaagcccagccccaccatctgtggcagcaactaccccctgagcatcgccttcatcgtggtgaatgagttctgtgagcgcttctcctactacggcatgaaggctgtgctgatcctgtacttcctgtacttcctgcactggaatgaagacaccagcaccagcatctaccacgccttcagcagcctgtgctacttcacccccatcctgggcgccgccatcgctgacagctggctgggcaagttcaaggtgctgagcctcatcggcctgagcctgattgccctgggcactggaggcatcaagccctgtgtggccgcctttggaggagaccagtttgaggagaagcatgctgaggagaggacccgctacttctctgtgttctacctgagcatcaatgccggcagcctcatcagcaccttcatcacccccatgctgcggggagatgtgcagtgcttcggggaggactgctacgccctggcctttggagtgcccggcctgctgatggtgattgccctggtggtgtttgccatgggcagcaagatctacaacaagcccccacctgagggcaacatcgtggcccaggtgttcaagtgcatctggtttgccatcagcaaccgcttcaagaacagaagtggggacatccccaagaggcagcactggctggactgggccgctgagaagtaccccaagcagctgatcatggatgtgaaggccctgaccagggtgctcttcctgtacatccccctgcccatgttctgggccctgctggaccagcagggcagccgctggaccctgcaggccatccgcatgaacagaaacctgggcttctttgtgctgcagcctgaccagatgcaggtgctgaaccccctgctggtgctgatcttcatccccctgtttgattttgtgatctaccgcctggtgtccaaatgtggcatcaacttcagcagcctgaggaagatggctgtgggcatgatcctggcctgcctggcctttgctgtggccgctgctgtggagatcaagatcaatgagatggccccagcccagcccggcccccaggaggtgttcctgcaggtgctgaacctggctgatgatgaggtgaaggtgacagtggtgggcaatgaaaacaacagcctgctgattgagagcatcaagagcttccagaagaccccccactacagcaagctgcacctgaagaccaagagccaggacttccacttccacctgaagtaccacaacctgagcctgtacacagagcacagcgtgcaggagaagaactggtacagcctggtgatcagagaagatggcaacagcatcagctccatgatggtgaaggacacagagagcaggaccaccaacggcatgaccaccgtgcgctttgtgaacaccctgcacaaggatgtgaacatcagcctgagcacagacaccagcctgaatgtgggagaagattatggagtgtctgcctacagaacagtgcagagaggagagtacccagctgtgcactgcaggacagaggacaagaacttcagcctgaacctgggcctgctggactttggagctgcctacctgtttgtgatcaccaacaacaccaaccagggcctgcaggcctggaagattgaggacatcccagccaacaagatgagcatcgcctggcagctgccccagtatgccctggtgacagctggggaggtgatgttttctgtgacaggcctggagttctcctacagccaggcccccagctccatgaagtctgtgctgcaggccgcctggctgctgaccatcgctgtgggcaacatcatcgtgctggtggtggcccagttcagcggcctggtgcagtgggccgagttcatcctcttcagctgcctgctgctggtgatctgcctgatcttcagcatcatgggctactactacgtgcctgtgaagacagaggacatgaggggccctgctgacaagcacatcccccacatccagggcaacatgatcaagctggagaccaagaagaccaagctgtag

SEQ ID NO: 38115 - DNA, 1506 bp, Artificial Sequence
  Description of Artificial Sequence: Synthetic coding sequence
atggccgcctcctggaggctgggctgtgacccccggctgctgcgctacctggtgggcttccctggaagaagatctgtgggcctggtgaagggggccctgggctggagcgtgtccagaggagccaactggcgctggttccacagcacccagtggctgcggggggaccccatcaagatcctgatgcccagcctgagccccaccatggaggagggcaacatcgtgaagtggctgaagaaggagggggaggccgtgtctgctggagatgccctgtgtgaaattgaaacagacaaggctgtggtgaccctggatgccagtgatgatggcatcctggccaagatcgtggtggaggagggcagcaagaacatccggctgggcagcctcatcggcctgattgtggaggagggggaggactggaagcacgtggagatccccaaggatgtgggccccccacctcctgtgtccaagcccagcgagccccggcccagccctgagccccagatcagcatccctgtgaagaaggagcacatccctggcaccctgcgcttccggctgagccctgctgccaggaacatcctggagaagcacagcctggatgccagccagggcacagccaccggcccccggggcatcttcaccaaggaggatgccctgaagctggtgcagctgaagcagacaggcaagatcacagagagccggcccaccccagcccccacagccacccccacagcccccagccccctgcaggccacagctggccccagctaccccaggcctgtgattcctcctgtgtccaccccaggccagcccaatgctgtgggcaccttcacagagatcccagccagcaacatccggcgggtgattgccaagaggctgacagagagcaagagcacagtgccccacgcctatgccacagctgactgtgacctgggcgctgtgctgaaggtgcggcaggacctggtgaaggatgacatcaaggtgtctgtgaatgacttcatcatcaaggctgctgctgtgaccctgaagcagatgccagatgtgaatgtgtcctgggatggagagggccccaagcagctgcccttcatcgacatctctgtggccgtggccacagacaagggcctgctgacccccatcatcaaggatgctgctgccaagggcatccaggagattgctgacagcgtgaaggccctgagcaagaaggccagagatggcaagctgctgcctgaggagtaccagggcggcagcttcagcatcagcaacctgggcatgtttggaattgatgagttcaccgctgtgatcaaccccccccaggcctgcatcctggccgtgggccgcttccggcctgtgctgaagctgacagaagatgaggagggcaatgccaagctgcagcagaggcagctgatcaccgtgaccatgagcagtgacagccgggtggtggatgatgagctggccacccgcttcctgaagagcttcaaggccaacctggagaaccccatccggctggcctag

SEQ ID NO: 38116 - DNA, 942 bp, Artificial Sequence
  Description of Artificial Sequence: Synthetic coding sequence
atgcctgccccccgggcccgggagcagccccgggtgcctggagagcggcagcccctgctgcccaggggggcccggggcccccggcgctggaggagagctgctggagctgctgtgctgctggtggagatgctggagagagctgccttcttcggcgtgacagccaacctggtgctgtacctgaacagcaccaacttcaactggacaggagagcaggccaccagggctgccctggtgttcctgggcgccagctacctgctggcccctgtgggcggctggctggctgatgtgtacctgggccgctacagagctgtggccctgagcctgctgctgtacctggccgccagcggcctgctgcctgccacagccttcccagatggccgcagcagcttctgtggggagatgcctgccagccccctgggccctgcctgccccagcgctggctgccccaggagcagccccagcccctactgtgcccctgtgctgtatgccggcctgctgctgctgggcctggccgccagctctgtgcgcagcaacctgaccagctttggagctgaccaggtgatggacctgggcagagatgccacccggcgcttcttcaactggttcaccggggccagcacctgggtgctgtgctgccgctgctggtggtggaggctcttcagcaggaccagcgccagctgctgggccacagccagcctgtgggccgtgtgggcctggcacttcagcagcagcagcctgcccccacccagcagcagccccagcccccgctgggccgccaagtgccccctgtgcctgagcagcctgagcaagacagctgcccccagctgtggaaatgacaccaggcctgagaccgtgaatgtgcctgcctgctggcccacccggggcctgcccagccagggcctgcccaggaagaggaccagccccaccagccgctgctggtag

SEQ ID NO: 38117 - DNA, 1734 bp, Artificial Sequence
  Description of Artificial Sequence: Synthetic coding sequence
atggagggcagcggcggcggggccggggagcgggcccccctgctgggcgcccggcgggctgctgctgctgctgctgctgctggggcctttgctggaagaagagctgcctgtggggctgtgctgctgacagagctgctggagagagctgccttctacggcatcaccagcaacctggtgctcttcctgaatggagcccccttctgctgggagggcgcccaggccagcgaggccctgctgctcttcatgggcctgacctacctgggcagcccctttggaggctggctggctgatgcccggctgggccgggcccgggccatcctgctgagcctggccctgtacctgctgggcatgctggccttccccctgctggccgccccagccacccgggccgccctgtgtggcagcgcccggctgctgaactgcacagcccctggcccagatgctgctgcccgctgctgcagccctgccacctttgctggcctggtgctggtgggcctgggcgtggccaccgtgaaggccaacatcaccccatttggagctgaccaggtgaaggaccggggccctgaggccacccggcgcttcttcaactggttctactggagcatcaacctgggcgccatcctgagcctgggcggcatcgcctacatccagcagaatgtgtcctttgtgacaggctacgccatccccaccgtgtgtgtgggcctggcctttgtggtgttcctgtgtggccagagcgtcttcatcaccaagcccccagatggcagcgccttcacagacatgttcaagatcctgacctacagctgctgcagccagaagaggtctggagagcggcagagcaatggagagggcatcggggtcttccagcagagcagcaagcagagcctgtttgacagctgcaagatgagccatggaggccccttcacagaggagaaggtggaggatgtgaaggccctggtgaagatcgtgcctgtgttcctggccctgatcccctactggacagtgtacttccagatgcagaccacctacgtgctgcagagcctgcacctgcgcatccctgagatcagcaacatcaccaccaccccccacaccctgcctgctgcctggctgaccatgtttgatgctgtgctgatcctgctgctgatccccctgaaggacaagctggtggaccccatcctgcggagacatggcctgctgcccagcagcctgaagagaattgctgtgggcatgttctttgtgatgtgcagcgcctttgctgctggcatcctggagagcaagaggctgaacctggtgaaggagaagaccatcaaccagaccatcggaaatgtggtgtaccacgccgctgacctgagcctgtggtggcaggtgccccagtacctgctgattggcatcagcgagatctttgccagcattgctggcctggagtttgcctacagcgctgcccccaagtccatgcagagcgccatcatgggcctcttcttcttcttcagcggcgtgggcagctttgtgggcagcggcctgctggccctggtgtccatcaaggccatcggctggatgagcagccacacagactttggaaacatcaatggctgctacctgaactactacttcttcctgctggccgccatccagggcgccaccctgctgctcttcctgatcatctctgtgaagtatgaccaccaccgggaccaccagaggagccgggccaatggagtgcccaccagcagaagagcctag

SEQ ID NO: 38118 - DNA, 1320 bp, Artificial Sequence
  Description of Artificial Sequence: Synthetic coding sequence
atgctgaagcgggagggcaaggtgcagccctacaccaagaccctggatggcggctggggctggatgatcgtcatccacttcttcctggtgaatgtgtttgtgatgggcatgaccaagacctttgccatcttctttgtggtgttccaggaggagtttgagggcaccagcgagcagatcggctggattggcagcatcatgagcagcctgcgcttctgtgccggcctgggcagcgccttcctgtaccaggtggccgctgtggtgaccaccaagtacttcaagaagaggctggccctgagcacagccatcgcccggagcggcatgggcctgaccttcctgctggcccccttcaccaagttcctgattgacctgtatgactggacaggagccctgatcctgtttggagccatcgccctgaacctggtgcccagctccatgctgctgcggcccatccacatcaagtctgagaacaacagcggcatcaaggacaagggcagcagcctgagcgcccacggccctgaggcccacgccacagagacccactgccacgagacagaggagagcaccatcaaggacagcaccacccagaaggccggcctgcccagcaagaacctgactgtgtcccagaaccagagcgaggagttctacaacggccccaacagaaaccggctgctgctgaagagtgatgaggagagtgacaaggtgatctcctggagctgcaagcagctgtttgacatcagcctcttcaggaaccccttcttctacatcttcacctggagcttcctgctgagccagctggcctacttcatccccaccttccacctggtggcccgggccaagaccctgggcatcgacatcatggatgccagctacctggtgtctgtggccggcatcctggagaccgtgtcccagatcatcagcggctgggtggccgaccagaactggatcaagaagtaccactaccacaagagctacctgatcctgtgtggcatcaccaacctgctggcccccctggccaccaccttccccctgctgatgacctacaccatctgctttgccatctttgctgggggctacctggccctgatcctgcctgtgctggtggacctgtgcaggaacagcacagtgaaccgcttcctgggcctggccagcttctttgctggcatggctgtgctgagcggcccccccatcgccggctggctgtatgactacacccagacctacaacggcagcttctacttcagcggcatctgctacctgctgagctctgtgtccttcttctttgtgcccctggccgagcgctggaagaacagcctgacctag

SEQ ID NO: 38119 - DNA, 1416 bp, Artificial Sequence
  Description of Artificial Sequence: Synthetic coding sequence
atgcctgccccccagaggaagcacagaagaggaggcttcagccaccgctgcttccccaccccccagacagccatgaccccccagcctgctggccccccagatggcggctggggctgggtggtggccgccgccgcctttgccatcaatggcctgtcctatggcctgctgcggagcctgggcctggccttcccagacctggccgagcactttgacagaagtgcccaggacacagcctggatcagcgccctggccctggccgtgcagcaggccgccagccctgtgggcagcgccctgagcacccgctggggcgcccggcctgtggtgatggtgggcggcgtgctggccagcctgggctttgtgttcagcgcctttgccagtgacctgctgcacctgtacctgggcctgggcctgctggccggcttcggctgggccctggtgtttgccccagccctgggcaccctgagccgctacttcagcagaagaagagtgctggccgtgggcctggccctgactggaaatggagccagcagcctgctgctggccccagccctgcagctgctgctggacaccttcggctggaggggggccctgctgctgctgggcgccatcaccctgcacctgaccccctgtggggccctgctgctgcccctggtgctgcccggggaccccccagccccacccaggagccccctggccgccctgggcctgagcctcttcacccggcgggccttcagcatctttgccctgggcacagccctggtgggcggcggctactttgtgccctacgtgcacctggccccccacgccctggaccggggcctgggcggctatggagctgccctggtggtggccgtggccgccatgggagatgctggggcccggctggtgtgtggctggctggccgaccagggctgggtgcccctgccccggctgctggccgtgtttggagccctgaccggcctgggcctgtgggtggtgggcctggtgcctgtggtgggcggggaggagagctggggcggccccctgctggccgctgctgtggcctacggcctgtctgctggcagctatgcccccctggtgtttggagtgctgcccggcctggtgggcgtgggcggcgtggtgcaggccaccggcctggtgatgatgctgatgagcctgggcggcctgctgggcccccccctgagcggcttcctgagagatgagaccggggacttcaccgccagcttcctgctgagcggcagcctcatcctgagcggcagcttcatctacatcggcctgccccgggccctgcccagctgtggccctgccagccccccagccaccccacctcctgagaccggggagctgctgcctgccccccaggccgtgctgctgagccctgggggccctggcagcaccctggacaccacctgctag

SEQ ID NO: 38120 - DNA, 1320 bp, Artificial Sequence
  Description of Artificial Sequence: Synthetic coding sequence
atgaccccccagcctgctggccccccagatggcggctggggctgggtggtggccgccgccgcctttgccatcaatggcctgtcctatggcctgctgcggagcctgggcctggccttcccagacctggccgagcactttgacagaagtgcccaggacacagcctggatcagcgccctggccctggccgtgcagcaggccgccagccctgtgggcagcgccctgagcacccgctggggcgcccggcctgtggtgatggtgggcggcgtgctggccagcctgggctttgtgttcagcgcctttgccagtgacctgctgcacctgtacctgggcctgggcctgctggccggcttcggctgggccctggtgtttgccccagccctgggcaccctgagccgctacttcagcagaagaagagtgctggccgtgggcctggccctgactggaaatggagccagcagcctgctgctggccccagccctgcagctgctgctggacaccttcggctggaggggggccctgctgctgctgggcgccatcaccctgcacctgaccccctgtggggccctgctgctgcccctggtgctgcccggggaccccccagccccacccaggagccccctggccgccctgggcctgagcctcttcacccggcgggccttcagcatctttgccctgggcacagccctggtgggcggcggctactttgtgccctacgtgcacctggccccccacgccctggaccggggcctgggcggctatggagctgccctggtggtggccgtggccgccatgggagatgctggggcccggctggtgtgtggctggctggccgaccagggctgggtgcccctgccccggctgctggccgtgtttggagccctgaccggcctgggcctgtgggtggtgggcctgtcctggggcggccccctgctggccgctgctgtggcctacggcctgtctgctggcagctatgcccccctggtgtttggagtgctgcccggcctggtgggcgtgggcggcgtggtgcaggccaccggcctggtgatgatgctgatgagcctgggcggcctgctgggcccccccctgagcggcttcctgagagatgagaccggggacttcaccgccagcttcctgctgagcggcagcctcatcctgagcggcagcttcatctacatcggcctgccccgggccctgcccagctgtggccctgccagccccccagccaccccacctcctgagaccggggagctgctgcctgccccccaggccgtgctgctgagccctgggggccctggcagcaccctggacaccacctgctag

SEQ ID NO: 38121 - DNA, 1281 bp, Artificial Sequence
  Description of Artificial Sequence: Synthetic coding sequence
atggccaggagaacagagcccccagatggcggctggggctgggtggtggtgctgagcgccttcttccagagcgccctggtgtttggagtgctgcggagctttggagtcttctttgtggagtttgtggccgcctttgaggagcaggccgcccgggtgtcctggatcgccagcatcggcattgctgtgcagcagtttggcagccctgtgggcagcgccctgagcaccaagtttggccccaggcctgtggtgatgactggaggcatcctggccgccctgggcatgctgctggccagctttgccaccagcctgacccacctgtacctgagcatcggcctgctgagcggcagcggctgggccctgacctttgcccccaccctggcctgcctgagctgctacttcagcagaagaagaagcctggccaccggcctggccctgactggagtgggcctgagcagcttcacctttgcccccttcttccagtggctgctgagccactacgcctggaggggcagcctgctgctggtgtctgccctgagcctgcacctggtggcctgtggggccctgctgcggccccccagcctggccgaggaccctgctgtgggcggcccccgggcccagctgaccagcctgctgcaccacggccccttcctgcgctacacagtggccctgaccctcatcaacacaggctacttcatcccctacctgcacctggtggcccacctgcaggacctggactgggaccccctgcctgctgccttcctgctgtctgtggtggccatcagtgacctggtgggccgggtggtgtctggctggctgggagatgctgtgcccggccctgtgacccggctgctgatgctgtggaccaccctgactggagtgtccctggccctcttccctgtggcccaggcccccacagccctggtggccctggccgtggcctacggcttcaccagcggggccctggcccccctggccttctctgtgctgcctgagctgattggcacccggcgcatctactgcggcctgggcctgctgcagatgattgagagcattggaggcctgctgggcccccccctgagcggctacctgagagatgtgactggaaactacacagccagctttgtggtggccggggccttcctgctgagcggcagcggcatcctgctgaccctgccccacttcttctgcttcagcaccaccaccagcggcccccaggacctggtgacagaggccctggacaccaaggtgcccctgcccaaggagggcctggaggaggactag

SEQ ID NO: 38122 - DNA, 1533 bp, Artificial Sequence
  Description of Artificial Sequence: Synthetic coding sequence
atgtacaccagccatgaggacatcggctatgactttgaagatggccccaaggacaagaagaccctgaagccccaccccaacattgatggcggctgggcctggatgatggtgctgagcagcttctttgtgcacatcctgatcatgggcagccagatggccctgggcgtgctgaatgtggagtggctggaggagttccaccagagccggggcctgacagcctgggtgagcagcctgtccatgggcatcaccctgattgtgggccccttcatcggcctcttcatcaacacctgtggctgccggcagacagccatcattggaggcctggtgaacagcctgggctgggtgctgagcgcctatgctgccaacgtgcactacctgttcatcaccttcggcgtggccgccggcctgggcagcggcatggcctacctgcctgctgtggtgatggtgggccgctacttccagaagaggcgggccctggcccagggcctgagcaccaccggcaccggcttcggcaccttcctgatgacagtgctgctgaagtacctgtgtgccgagtatggctggagaaatgccatgctgatccagggcgctgtgtccctgaacctgtgtgtgtgtggggccctgatgaggcccctgagccctgggaagaaccccaatgaccctggagagaaggatgtgcggggcctgcctgcccacagcacagagagcgtgaagagcacaggccagcagggccgcacagaggagaaggatggcggcctgggcaatgaggagaccctgtgtgacctgcaggcccaggagtgcccagaccaggccggccacaggaagaacatgtgtgccctgcgcatcctgaagacagtgtcctggctgaccatgagggtgaggaaaggatttgaggactggtacagcggctactttggaacagccagcctcttcaccaacaggatgtttgtggccttcatcttctgggccctgtttgcctacagcagctttgtgatccccttcatccacctgcctgagatcgtgaacctgtacaacctgtctgagcagaatgatgtgttccccctgaccagcatcatcgccatcgtgcacatctttgggaaggtgatcctgggcgtgattgctgacctgccctgcatctctgtgtggaatgtgttcctgctggccaacttcaccctggtgctgagcatcttcatcctgcccctgatgcacacctacgccggcctggccgtcatctgtgccctgattggcttcagcagcggctacttcagcctgatgcctgtggtgacagaggacctggtgggcatcgagcacctggccaatgcctacggcatcatcatctgtgccaacggcatcagcgccctgctgggccccccatttgctggctggatctatgacatcacccagaagtatgacttctccttctacatctgtggcctgctgtacatgattggcatcctcttcctgctgatccagccctgcatccgcatcatcgagcagagcaggaggaagtacatggatggagcccacgtgtag

SEQ ID NO: 38123 - DNA, 1458 bp, Artificial Sequence
  Description of Artificial Sequence: Synthetic coding sequence
atgtacaccagccatgaggacatcggctatgactttgaagatggccccaaggacaagaagaccctgaagccccaccccaacattgatggcggctgggcctggatgatggtgctgagcagcttctttgtgcacatcctgatcatgggcagccagatggccctgggcgtgctgaatgtggagtggctggaggagttccaccagagccggggcctgacagcctgggtgagcagcctgtccatgggcatcaccctgattgtgggccccttcatcggcctcttcatcaacacctgtggctgccggcagacagccatcattggaggcctggtgaacagcctgggctgggtgctgagcgcctatgctgccaacgtgcactacctgttcatcaccttcggcgtggccgccggcctgggcagcggcatggcctacctgcctgctgtggtgatggtgggccgctacttccagaagaggcgggccctggcccagggcctgagcaccaccggcaccggcttcggcaccttcctgatgacagtgctgctgaagtacctgtgtgccgagtatggctggagaaatgccatgctgatccagggcgctgtgtccctgaacctgtgtgtgtgtggggccctgatgaggcccctgagccctgggaagaaccccaatgaccctggagagaaggatgtgcggggcctgcctgcccacagcacagagagcgtgaagagcacaggccagcagggccgcacagaggagaaggatggcggcctgggcaatgaggagaccctgtgtgacctgcaggcccaggagtgcccagaccaggccggccacaggaagaacatgtgtgccctgcgcatcctgaagacagtgtcctggctgaccatgagggtgaggaaaggatttgaggactggtacagcggctactttggaacagccagcctcttcaccaacaggatgtttgtggccttcatcttctgggccctgtttgcctacagcagctttgtgatccccttcatccacctgcctgagatcgtgaacctgtacaacctgtctgagcagaatgatgtgttccccctgaccagcatcatcgccatcgtgcacatctttgggaaggtgatcctgggcgtgattgctgacctgccctgcatctctgtgtggaatgtgttcctgctggccaacttcaccctggtgctgagcatcttcatcctgcccctgatgcacacctacgccggcctggccgtcatctgtgccctgattggcttcagcagcggctacttcagcctgatgcctgtggtgacagaggacctggtgggcatcgagcacctggccaatgcctacggcatcatcatctgtgccaacggcatcagcgccctgctgggccccccatttgctgggaagctgtctgaggtgctgcgggcccagagcgcctgcacctatggagccctgtgctacaaggtgcctgacaagtag

SEQ ID NO: 38124 - DNA, 129 bp, Artificial Sequence
  Description of Artificial Sequence: Synthetic coding sequence
atgtacaccagccatgaggacatcggctatgactttgaagatggccccaaggacaagaagaccctgaagccccaccccaacattgatggcggctgggcctggatgatggtgctgagcagcttcttctag

SEQ ID NO: 38125 - DNA, 57 bp, Artificial Sequence
  Description of Artificial Sequence: Synthetic coding sequence
atgtacaccagccatgaggacatcggctatgactttgaagatggccccaaggactag

SEQ ID NO: 38126 - DNA, 1470 bp, Artificial Sequence
  Description of Artificial Sequence: Synthetic coding sequence
atgtacaccagccatgaggacatcggctatgactttgaagatggccccaaggacaagaagaccctgaagccccaccccaacattgatggcggctgggcctggatgatggtgctgagcagcttctttgtgcacatcctgatcatgggcagccagatggccctgggcgtgctgaatgtggagtggctggaggagttccaccagagccggggcctgacagcctgggtgagcagcctgtccatgggcatcaccctgattgtgggccccttcatcggcctcttcatcaacacctgtggctgccggcagacagccatcattggaggcctggtgaacagcctgggctgggtgctgagcgcctatgctgccaacgtgcactacctgttcatcaccttcggcgtggccgccggcctgggcagcggcatggcctacctgcctgctgtggtgatggtgggccgctacttccagaagaggcgggccctggcccagggcctgagcaccaccggcaccggcttcggcaccttcctgatgacagtgctgctgaagtacctgtgtgccgagtatggctggagaaatgccatgctgatccagggcgctgtgtccctgaacctgtgtgtgtgtggggccctgatgaggcccctgagccctgggaagaaccccaatgaccctggagagaaggatgtgcggggcctgcctgcccacagcacagagagcgtgaagagcacaggccagcagggccgcacagaggagaaggatggcggcctgggcaatgaggagaccctgtgtgacctgcaggcccaggagtgcccagaccaggccggccacaggaagaacatgtgtgccctgcgcatcctgaagacagtgtcctggctgaccatgagggtgaggaaaggatttgaggactggtacagcggctactttggaacagccagcctcttcaccaacaggatgtttgtggccttcatcttctgggccctgtttgcctacagcagctttgtgatccccttcatccacctgcctgagatcgtgaacctgtacaacctgtctgagcagaatgatgtgttccccctgaccagcatcatcgccatcgtgcacatctttgggaaggtgatcctgggcgtgattgctgacctgccctgcatctctgtgtggaatgtgttcctgctggccaacttcaccctggtgctgagcatcttcatcctgcccctgatgcacacctacgccggcctggccgtcatctgtgccctgattggcttcagcagcggctacttcagcctgatgcctgtggtgacagaggacctggtgggcatcgagcacctggccaatgcctacggcatcatcatctgtgccaacggcatcagcgccctgctgggccccccatttgctgggaagctgtctgaggtgctgcgggcccagagcgcctgcacctatggagccctgtgctacaaggtgcctgacaaggaggagggcttctag

SEQ ID NO: 38127 - DNA, 1464 bp, Artificial Sequence
  Description of Artificial Sequence: Synthetic coding sequence
atgctgaagcgggagggcaaggtgcagccctacaccaagaccctggatggcggctggggctggatgatcgtcatccacttcttcctggtgaatgtgtttgtgatgggcatgaccaagacctttgccatcttctttgtggtgttccaggaggagtttgagggcaccagcgagcagatcggctggattggcagcatcatgagcagcctgcgcttctgtgccggccccctggtggccatcatctgtgacatcctgggggagaagaccaccagcatcctgggcgcctttgtggtgactggaggctacctgatcagctcctgggccaccagcatccccttcctgtgtgtgaccatgggcctgctgcccggcctgggcagcgccttcctgtaccaggtggccgctgtggtgaccaccaagtacttcaagaagaggctggccctgagcacagccatcgcccggagcggcatgggcctgaccttcctgctggcccccttcaccaagttcctgattgacctgtatgactggacaggagccctgatcctgtttggagccatcgccctgaacctggtgcccagctccatgctgctgcggcccatccacatcaagtctgagaacaacagcggcatcaaggacaagggcagcagcctgagcgcccacggccctgaggcccacgccacagagacccactgccacgagacagaggagagcaccatcaaggacagcaccacccagaaggccggcctgcccagcaagaacctgactgtgtcccagaaccagagcgaggagttctacaacggccccaacagaaaccggctgctgctgaagagtgatgaggagagtgacaaggtgatctcctggagctgcaagcagctgtttgacatcagcctcttcaggaaccccttcttctacatcttcacctggagcttcctgctgagccagctggcctacttcatccccaccttccacctggtggcccgggccaagaccctgggcatcgacatcatggatgccagctacctggtgtctgtggccggcatcctggagaccgtgtcccagatcatcagcggctgggtggccgaccagaactggatcaagaagtaccactaccacaagagctacctgatcctgtgtggcatcaccaacctgctggcccccctggccaccaccttccccctgctgatgacctacaccatctgctttgccatctttgctgggggctacctggccctgatcctgcctgtgctggtggacctgtgcaggaacagcacagtgaaccgcttcctgggcctggccagcttctttgctggcatggctgtgctgagcggcccccccatcgccggctggctgtatgactacacccagacctacaacggcagcttctacttcagcggcatctgctacctgctgagctctgtgtccttcttctttgtgcccctggccgagcgctggaagaacagcctgacctag

SEQ ID NO: 38128 - DNA, 960 bp, Artificial Sequence
  Description of Artificial Sequence: Synthetic coding sequence
atgctgaagcgggagggcaaggtgcagccctacaccaagaccctggatggcggctggggctggatgatcgtcatccacttcttcctggtgaatgtgtttgtgatgggcatgaccaagacctttgccatcttctttgtggtgttccaggaggagtttgagggcaccagcgagcagatcggctggattggcagcatcatgagcagcctgcgcttctgtgccggccccctggtggccatcatctgtgacatcctgggggagaagaccaccagcatcctgggcgcctttgtggtgactggaggctacctgatcagctcctgggccaccagcatccccttcctgtgtgtgaccatgggcctgctgcccggcctgggcagcgccttcctgtaccaggtggccgctgtggtgaccaccaagtacttcaagaagaggctggccctgagcacagccatcgcccggagcggcatgggcctgaccttcctgctggcccccttcaccaagttcctgattgacctgtatgactggacaggcatcctggagaccgtgtcccagatcatcagcggctgggtggccgaccagaactggatcaagaagtaccactaccacaagagctacctgatcctgtgtggcatcaccaacctgctggcccccctggccaccaccttccccctgctgatgacctacaccatctgctttgccatctttgctgggggctacctggccctgatcctgcctgtgctggtggacctgtgcaggaacagcacagtgaaccgcttcctgggcctggccagcttctttgctggcatggctgtgctgagcggcccccccatcgccggctggctgtatgactacacccagacctacaacggcagcttctacttcagcggcatctgctacctgctgagctctgtgtccttcttctttgtgcccctggccgagcgctggaagaacagcctgacctag

SEQ ID NO: 38129 - DNA, 1149 bp, Artificial Sequence
  Description of Artificial Sequence: Synthetic coding sequence
atgggcatggatgactgtgacagcttcttccctggcctgggcagcgccttcctgtaccaggtggccgctgtggtgaccaccaagtacttcaagaagaggctggccctgagcacagccatcgcccggagcggcatgggcctgaccttcctgctggcccccttcaccaagttcctgattgacctgtatgactggacaggagccctgatcctgtttggagccatcgccctgaacctggtgcccagctccatgctgctgcggcccatccacatcaagtctgagaacaacagcggcatcaaggacaagggcagcagcctgagcgcccacggccctgaggcccacgccacagagacccactgccacgagacagaggagagcaccatcaaggacagcaccacccagaaggccggcctgcccagcaagaacctgactgtgtcccagaaccagagcgaggagttctacaacggccccaacagaaaccggctgctgctgaagagtgatgaggagagtgacaaggtgatctcctggagctgcaagcagctgtttgacatcagcctcttcaggaaccccttcttctacatcttcacctggagcttcctgctgagccagctggcctacttcatccccaccttccacctggtggcccgggccaagaccctgggcatcgacatcatggatgccagctacctggtgtctgtggccggcatcctggagaccgtgtcccagatcatcagcggctgggtggccgaccagaactggatcaagaagtaccactaccacaagagctacctgatcctgtgtggcatcaccaacctgctggcccccctggccaccaccttccccctgctgatgacctacaccatctgctttgccatctttgctgggggctacctggccctgatcctgcctgtgctggtggacctgtgcaggaacagcacagtgaaccgcttcctgggcctggccagcttctttgctggcatggctgtgctgagcggcccccccatcgccgagatcatccccagcttccaggccggctacatgatcatccccaggcacaccatggccctgagcaccagcctggcctatgccatcagcagcctgcagttccccttcttcctgtaccactggcccaaggatggcaagacagtgtag

SEQ ID NO: 38130 - DNA, 1278 bp, Artificial Sequence
  Description of Artificial Sequence: Synthetic coding sequence
atgggcatggatgactgtgacagcttcttccctggccccctggtggccatcatctgtgacatcctgggggagaagaccaccagcatcctgggcgcctttgtggtgactggaggctacctgatcagctcctgggccaccagcatccccttcctgtgtgtgaccatgggcctgctgcccggcctgggcagcgccttcctgtaccaggtggccgctgtggtgaccaccaagtacttcaagaagaggctggccctgagcacagccatcgcccggagcggcatgggcctgaccttcctgctggcccccttcaccaagttcctgattgacctgtatgactggacaggagccctgatcctgtttggagccatcgccctgaacctggtgcccagctccatgctgctgcggcccatccacatcaagtctgagaacaacagcggcatcaaggacaagggcagcagcctgagcgcccacggccctgaggcccacgccacagagacccactgccacgagacagaggagagcaccatcaaggacagcaccacccagaaggccggcctgcccagcaagaacctgactgtgtcccagaaccagagcgaggagttctacaacggccccaacagaaaccggctgctgctgaagagtgatgaggagagtgacaaggtgatctcctggagctgcaagcagctgtttgacatcagcctcttcaggaaccccttcttctacatcttcacctggagcttcctgctgagccagctggcctacttcatccccaccttccacctggtggcccgggccaagaccctgggcatcgacatcatggatgccagctacctggtgtctgtggccggcatcctggagaccgtgtcccagatcatcagcggctgggtggccgaccagaactggatcaagaagtaccactaccacaagagctacctgatcctgtgtggcatcaccaacctgctggcccccctggccaccaccttccccctgctgatgacctacaccatctgctttgccatctttgctgggggctacctggccctgatcctgcctgtgctggtggacctgtgcaggaacagcacagtgaaccgcttcctgggcctggccagcttctttgctggcatggctgtgctgagcggcccccccatcgccggctggctgtatgactacacccagacctacaacggcagcttctacttcagcggcatctgctacctgctgagctctgtgtccttcttctttgtgcccctggccgagcgctggaagaacagcctgacctag

SEQ ID NO: 38131 - DNA, 1518 bp, Artificial Sequence
  Description of Artificial Sequence: Synthetic coding sequence
atgccccaggccctggagcgggcagatggctcctgggcctgggtggtgctgctggccaccatggtgacccagggcctgaccctgggcttccccacctgcatcggcatcttcttcacagagctgcagtgggagttccaggccagcaacagcgagacctcctggttccccagcatcctgacagctgtgctgcacatggccggccccctgtgcagcatcctggtgggccgcttcggctgccgggtgacagtgatgctgggcggcgtgctggccagcctgggcatggtggccagcagcttcagccacaacctgagccagctgtacttcaccgctggcttcatcaccggcctgggcatgtgcttctccttccagagcagcatcaccgtgctgggcttctactttgtgagaagaagagtgctggccaatgccctggcctccatgggcgtgtccctgggcatcaccctgtggcccctgctgagccgctacctgctggagaacctgggctggaggggcaccttcctggtgtttggaggcatcttcctgcactgctgcatctgtggggccatcatccggcctgtggccacctctgtggcccctgagaccaaggagtgccccccacctcctcctgagaccccagccctgggctgcctggccgcctgtggccgcaccatccagaggcacctggcctttgacatcctgcggcacaacacaggctactgtgtgtacatcctgggcgtgatgtggagcgtgctgggcttccccctgccccaggtgttcctggtgccctatgccatgtggcacagcgtggatgagcagcaggccgccctgctgatcagcatcatcggcttcagcaacatcttcctgcggcccctggccggcctgatggccggccggcctgcctttgccagccacaggaagtacctgttcagcctggccctgctgctgaatggcctgaccaacctggtgtgtgccgccagcggggacttctgggtgctggtgggctactgcctggcctacagcgtgtccatgtctggaattggagccctgatcttccaggtgctgatggacatcgtgcccatggaccagttcccccgggccctgggcctcttcaccgtgctggatggcctggccttcctgatcagcccccccctggccggcctgctgctggatgccaccaacaacttctcctatgtgttctacatgagcagcttcttcctgatctctgctgccctcttcatgggcggcagcttctacgccctgcagaagaaggagcagggcaagcaggccgtggccgcagatgccctggagcgggacctcttcctggaggccaaggatggccctgggaagcagaggagccctgagatcatgtgccagagcagccggcagcccaggcctgctggggtgaacaagcacctgtggggctgcccagccagcagcaggaccagccatgagtggctgctgtggcccaaggctgtgctgcaggccaagcagacagccctgggctggaacagccccacctag

SEQ ID NO: 38132 - DNA, 1518 bp, Artificial Sequence; identical to SEQ ID NO: 38131
  Description of Artificial Sequence: Synthetic coding sequence

SEQ ID NO: 38133 - DNA, 1503 bp, Artificial Sequence
  Description of Artificial Sequence: Synthetic coding sequence
atgccccggcccacccggggccccctggccaccagccagggctggtgccccagcgtgaccccaggcacctgggccgccgccaccctggccgtgcggccctggcagaggcggcagcagaggatgccccaggccctggagcgggcagatggctcctgggcctgggtggtgctgctggccaccatggtgacccagggcctgaccctgggcttccccacctgcatcggcatcttcttcacagagctgcagtgggagttccaggccagcaacagcgagacctcctggttccccagcatcctgacagctgtgctgcacatggccggccccctgtgcagcatcctggtgggccgcttcggctgccgggtgacagtgatgctgggcggcgtgctggccagcctgggcatggtggccagcagcttcagccacaacctgagccagctgtacttcaccgctggcttcatcaccggcctgggcatgtgcttctccttccagagcagcatcaccgtgctgggcttctactttgtgagaagaagagtgctggccaatgccctggcctccatgggcgtgtccctgggcatcaccctgtggcccctgctgagccgctacctgctggagaacctgggctggaggggcaccttcctggtgtttggaggcatcttcctgcactgctgcatctgtggggccatcatccggcctgtggccacctctgtggcccctgagaccaaggagtgccccccacctcctcctgagaccccagccctgggctgcctggccgcctgtggccgcaccatccagaggcacctggcctttgacatcctgcggcacaacacaggctactgtgtgtacatcctgggcgtgatgtggagcgtgctgggcttccccctgccccaggtgttcctggtgccctatgccatgtggcacagcgtggatgagcagcaggccgccctgctgatcagcatcatcggcttcagcaacatcttcctgcggcccctggccggcctgatggccggccggcctgcctttgccagccacaggaagtacctgttcagcctggccctgctgctgaatggcctgaccaacctggtgtgtgccgccagcggggacttctgggtgctggtgggctactgcctggcctacagcgtgtccatgtctggaattggagccctgatcttccaggtgctgatggacatcgtgcccatggaccagttcccccgggccctgggcctcttcaccgtgctggatggcctggccttcctgatcagcccccccctggccggcctgctgctggatgccaccaacaacttctcctatgtgttctacatgagcagcttcttcctgatctctgctgccctcttcatgggcggcagcttctacgccctgcagaagaaggagcagggcaagcaggccgtggccgcagatgccctggagcgggacctcttcctggaggccaaggatggccctgggaagcagaggagccctgagatcatgtatgtgacctctgtgtag

SEQ ID NO: 38134 - DNA, 1572 bp, Artificial Sequence
  Description of Artificial Sequence: Synthetic coding sequence
atgacccagaacaagctgaagctgtgcagcaaggccaacgtgtacacagaggtgcctgatggcggctggggctgggccgtggccgtgtccttcttctttgtggaggtgttcacctacggcatcatcaagacctttggagtcttcttcaatgacctgatggacagcttcaatgaaagcaacagccgcatctcctggatcatcagcatctgtgtgtttgtgctgaccttcagcgcccccctggccaccgtgctgagcaaccgcttcggccaccggctggtggtgatgctgggcggcctgctggtgtccacaggcatggtggccgccagcttcagccaggaggtgagccacatgtatgtggccatcggcatcatcagcggcctgggctactgcttctccttcctgcccaccgtgaccatcctgagccagtactttgggaagagaagaagcatcgtgacagctgtggccagcactggagaatgttttgctgtgtttgcctttgccccagccatcatggccctgaaggagagaattggctggagatacagcctgctgtttgtgggcctgctgcagctgaacatcgtcatctttggagccctgctgcggcccatcttcatccggggccctgccagccccaagatcgtcatccaggagaacaggaaggaggcccagtacatgctggagaatgagaagaccaggaccagcattgacagcattgacagcggcgtggagctgaccaccagccccaagaatgtgcccacccacaccaacctggagctggagcccaaggctgacatgcagcaggtgctggtgaagaccagcccccggcccagcgagaagaaggcccccctgctggacttcagcatcctgaaggagaagagcttcatctgctacgccctgtttggcctgtttgccaccctgggcttctttgcccccagcctgtacatcatccccctgggcatcagcctgggcatcgaccaggacagagctgccttcctgctgagcaccatggccatcgccgaggtgtttggaagaattggagctggctttgtgctgaaccgggagcccatcaggaagatctacatcgagctgatctgtgtgatcctgctgactgtgtccctgtttgccttcacctttgccacagagttctggggcctgatgagctgcagcatcttcttcggcttcatggtgggcaccatcggcggcacccacatccccctgctggctgaagatgatgtggtgggcatcgagaagatgagcagcgctgctggggtgtacatcttcatccagagcattgctggcctggccggcccccccctggccggcctgctggtggaccagagcaagatctacagccgggccttctacagctgtgccgccggcatggccctggccgctgtgtgcctggccctggtgcggccctgcaagatgggcctgtgccagcaccaccacagcggggagaccaaggtggtgagccaccggggcaagaccctgcaggacatccctgaggacttcctggagatggacctggccaagaatgagcaccgggtgcacgtgcagatggagcctgtgtag

SEQ ID NO: 38135 - DNA, 1515 bp, Artificial Sequence
  Description of Artificial Sequence: Synthetic coding sequence
atgggcgccggcggccccaggagaggagagggccccccagatggcggctggggctgggtggtgctgggcgcctgctttgtggtgactggatttgcctacggcttccccaaggctgtgtctgtgttcttccgggccctgatgagggactttgatgctggctacagcgacacagcctgggtgagcagcatcatgctggccatgctgtatggaactggacctgtgagcagcatcctggtgacccgcttcggctgcaggcctgtgatgctggccggcggcctgctggccagcgctggcatgatcctggccagctttgccacccggctgctggagctgtacctgacagctggggtgctgaccggcctgggcctggccctgaacttccagcccagcctcatcatgctgggcctgtactttgagaggagaagacccctggccaacggcctggccgctgctggcagccctgtgttcctgagcgccctgagccccctgggccagcagctgctggagagatttggctggaggggcggcttcctgctgctgggcggcctgctgctgcactgctgtgcctgtggggctgtgatgaggcctcctcctggccctggcccccggccccggcgggacagcgctggggacagagctggagatgcccctggagaggccgaggctgatggagctggcctgcagctgcgggaggccagcccccgggtgcggccccggcggcggctgctggacctggccgtgtgcacagaccgggcctttgctgtgtatgctgtgaccaagttcctgatggccctgggcctgtttgtgcctgccatcctgctggtgaactatgccaaggatgctggggtgcctgacacagatgctgccttcctgctgagcatcgtgggctttgtggacatcgtggcccggcctgcctgtggggccctggccggcctggcccggctgcggccccacgtgccctacctgttcagcctggccctgctggccaacggcctgacagacctgagcagcgcccgggcccggagctatggagccctggtggccttctgtgtggccttcggcctgtcctatggcatggtgggcgccctgcagtttgaggtgctgatggctgctgtgggcgccccccgcttccccagcgccctgggcctggtgctgctggtggaggccgctgctgtgctgattggcccccccagcgctggccgcctggtggatgtgctgaagaactatgagatcatcttctacctggccggcagcgaggtggccctggccggggtcttcatggctgtggccaccaactgctgcctgcgctgtgccaaggccgcccccagcggccctggaacagaaggaggagccagtgacacagaagatgctgaggccgagggggacagcgagcccctgcctgtggtggccgaggagcccggcaacctggaggccctggaggtgctgagcgcccggggggagcccacagagcctgagattgaggcccggccccggctggccgctgagagcgtgtag

SEQ ID NO: 38136 - DNA, 294 bp, Artificial Sequence
  Description of Artificial Sequence: Synthetic coding sequence
atgggcgccggcggccccaggagaggagagggccccccagatggcggctggggctgggtggtgctgggcgcctgctttgtggtgactggatttgcctacggcttccccaaggctgtgtctgtgttcttccgggccctgatgagggactttgatgctggctacagcgacacagcctgggtgagcagcatcatgctggccatgctgtatggaactggacctgtgagcagcatcctggtgacccgcttcggctgcaggcctgtgatgctggccggcggcctgctggccagcgcctag

SEQ ID NO: 38137 - DNA, 1500 bp, Artificial Sequence
  Description of Artificial Sequence: Synthetic coding sequence
atgctgcacgccctgctgcggagcaggatgatccagggccgcatcctgctgctgaccatctgtgccgccggcattggaggcaccttccagtttggctacaacctgagcatcatcaatgcccccaccctgcacatccaggagttcaccaatgagacctggcaggccaggactggagagcccctgcctgaccacctggtgctgctgatgtggagcctgattgtgtccctgtaccccctgggcggcctgtttggagccctgctggccggccccctggccatcaccctgggcaggaagaagagcctgctggtgaacaacatctttgtggtgtctgctgccatcctgtttggcttcagcaggaaggccggcagctttgagatgatcatgctgggccgcctgctggtgggcgtgaatgctggggtgtccatgaacatccagcccatgtacctgggggagagcgcccccaaggagctgcggggagctgtggccatgagcagcgccatcttcaccgccctgggcatcgtgatgggccaggtggtgggcctgcgggagctgctgggcggcccccaggcctggcccctgctgctggccagctgcctggtgcctggggccctgcagctggccagcctgcccctgctgcctgagagcccccgctacctgctgattgactgtggggacacagaggcctgcctggccgccctgcggcggctgcggggcagcggggacctggccggggagctggaggagctggaggaggagcgggccgcctgccagggctgccgggcccggcggccctgggagctgttccagcaccgggccctgcggcggcaggtgaccagcctggtggtgctgggcagcgccatggagctgtgtggaaatgacagcgtgtatgcctatgccagctctgtgttcaggaaggccggcgtgcctgaggccaagatccagtatgccatcatcggcaccggcagctgtgagctgctgacagctgtggtgtcctgtgtggtgattgagcgggtgggccggcgggtgctgctgattggaggctacagcctgatgacctgctggggcagcatcttcaccgtggccctgtgcctgcagagcagcttcccctggaccctgtacctggccatggcctgcatctttgccttcatcctgagctttggcatcggccctgctggggtgacaggcatcctggccacagagctgtttgaccagatggcccggcctgctgcctgcatggtgtgtggggccctgatgtggatcatgctgatcctggtgggcctgggcttccccttcatcatggaggccctgagccacttcctgtatgtgcccttcctgggcgtgtgtgtgtgtggggccatctacacaggcctcttcctgcctgagaccaagggcaagaccttccaggagatcagcaaggagctgcaccggctgaacttcccccggcgggcccagggccccacctggaggagcctggaggtgatccagagcacagagctgtag

SEQ ID NO: 38138 - DNA, 1491 bp, Artificial Sequence
  Description of Artificial Sequence: Synthetic coding sequence
atgagggccctgcggcggctcatccagggccgcatcctgctgctgaccatctgtgccgccggcatcggcggcaccttccagtttggctacaacctgagcatcatcaatgcccccaccctgcacatccaggagttcaccaatgagacctggcaggccaggactggagagcccctgcctgaccacctggtgctgctgatgtggagcctcatcgtgtccctgtaccccctgggcggcctgtttggagccctgctggccggccccctggccatcaccctgggcaggaagaagagcctgctggtgaacaacatctttgtggtgtctgctgccatcctgtttggcttcagcaggaaggccggcagctttgagatgatcatgctgggccgcctgctggtgggcgtgaatgccggcgtgtccatgaacatccagcccatgtacctgggggagagcgcccccaaggagctgcggggagctgtggccatgagcagcgccatcttcaccgccctgggcatcgtgatgggccaggtggtgggcctgcgggagctgctgggcggcccccaggcctggcccctgctgctggccagctgcctggtgcctggggccctgcagctggccagcctgcccctgctgcctgagagcccccgctacctgctgattgactgtggggacacagaggcctgcctggccgccctgcggcggctgcggggcagcggggacctggccggggagctggaggagctggaggaggagagagctgcctgccagggctgccgggcccggcggccctgggagctgttccagcaccgggccctgcggcggcaggtgaccagcctggtggtgctgggcagcgccatggagctgtgtggaaatgattctgtgtatgcctatgccagcagcgtcttcaggaaggccggcgtgcctgaggccaagatccagtatgccatcattggaacaggcagctgtgagctgctgacagctgtggtgtcctgtgtggtgattgaaagagtgggcagaagagtgctgctgattggaggctacagcctgatgacctgctggggcagcatcttcaccgtggccctgtgcctgcagagcagcttcccctggaccctgtacctggccatggcctgcatctttgccttcatcctgagctttggaattggccctgctggggtgacaggcatcctggccacagagctgtttgaccagatggcccggcctgctgcctgcatggtgtgtggggccctgatgtggatcatgctgatcctggtgggcctgggcttccccttcatcatggaggccctgagccacttcctgtatgtgcccttcctgggcgtgtgtgtgtgtggggccatctacacaggcctcttcctgcctgagaccaagggcaagaccttccaggagatcagcaaggagctgcaccggctgaacttcccccggcgggcccagggccccacctggaggagcctggaggtgatccagagcacagagctgtag

SEQ ID NO: 38139 - DNA, 1512 bp, Artificial Sequence
  Description of Artificial Sequence: Synthetic coding sequence
atggaggatgagctggagcccagcctgcggcccaggacccagatccagggccgcatcctgctgctgaccatctgtgccgccggcattggaggcaccttccagtttggctacaacctgagcatcatcaatgcccccaccctgcacatccaggagttcaccaatgagacctggcaggccaggactggagagcccctgcctgaccacctggtgctgctgatgtggagcctgattgtgtccctgtaccccctgggcggcctgtttggagccctgctggccggccccctggccatcaccctgggcaggaagaagagcctgctggtgaacaacatctttgtggtgtctgctgccatcctgtttggcttcagcaggaaggccggcagctttgagatgatcatgctgggccgcctgctggtgggcgtgaatgctggggtgtccatgaacatccagcccatgtacctgggggagagcgcccccaaggagctgcggggagctgtggccatgagcagcgccatcttcaccgccctgggcatcgtgatgggccaggtggtgggcctgcgggagctgctgggcggcccccaggcctggcccctgctgctggccagctgcctggtgcctggggccctgcagctggccagcctgcccctgctgcctgagagcccccgctacctgctgattgactgtggggacacagaggcctgcctggccgccctgcggcggctgcggggcagcggggacctggccggggagctggaggagctggaggaggagcgggccgcctgccagggctgccgggcccggcggccctgggagctgttccagcaccgggccctgcggcggcaggtgaccagcctggtggtgctgggcagcgccatggagctgtgtggaaatgacagcgtgtatgcctatgccagctctgtgttcaggaaggccggcgtgcctgaggccaagatccagtatgccatcatcggcaccggcagctgtgagctgctgacagctgtggtgtcctgtgtggtgattgagcgggtgggccggcgggtgctgctgattggaggctacagcctgatgacctgctggggcagcatcttcaccgtggccctgtgcctgcagagcagcttcccctggaccctgtacctggccatggcctgcatctttgccttcatcctgagctttggcatcggccctgctggggtgacaggcatcctggccacagagctgtttgaccagatggcccggcctgctgcctgcatggtgtgtggggccctgatgtggatcatgctgatcctggtgggcctgggcttccccttcatcatggaggccctgagccacttcctgtatgtgcccttcctgggcgtgtgtgtgtgtggggccatctacacaggcctcttcctgcctgagaccaagggcaagaccttccaggagatcagcaaggagctgcaccggctgaacttcccccggcgggcccagggccccacctggaggagcctggaggtgatccagagcacagagctgtag

SEQ ID NO: 38140 - DNA, 1104 bp, Artificial Sequence
  Description of Artificial Sequence: Synthetic coding sequence
atggaggatgagctggagcccagcctgcggcccaggacccagatccagggccgcatcctgctgctgaccatctgtgccgccggcattggaggcaccttccagtttggctacaacctgagcatcatcaatgcccccaccctgcacatccaggagttcaccaatgagacctggcaggccaggactggagagcccctgcctgaccacctggtgctgctgatgtggagcctgattgtgtccctgtaccccctgggcggcctgtttggagccctgctggccggccccctggccatcaccctgggcaggaagaagagcctgctggtgaacaacatctttgtggtgtctgctgccatcctgtttggcttcagcaggaaggccggcagctttgagatgatcatgctgggccgcctgctggtgggcgtgaatgctggggtgtccatgaacatccagcccatgtacctgggggagagcgcccccaaggagctgcggggagctgtggccatgagcagcgccatcttcaccgccctgggcatcgtgatgggccaggtggtgggcctgcgggagctgctgggcggcccccaggcctggcccctgctgctggccagctgcctggtgcctggggccctgcagctggccagcctgcccctgctgcctgagagcccccgctacctgctgattgactgtggggacacagaggcctgcctggccgccctgcggcggctgcggggcagcggggacctggccggggagctggaggagctggaggaggagcgggccgcctgccagggctgccgggcccggcggccctgggagctgttccagcaccgggccctgcggcggcaggtgaccagcctggtggtgctgggcagcgccatggagctgtgtggaaatgacagcgtgtatgcctatgccagctctgtgttcaggaaggccggcgtgcctgaggccaagatccagtatgccatcatcggcaccggcagctgtgagctgctgacagctgtggtgtctgtgtccctggagggcgccctgcccccaccagccctgtggggcggcacccccaggagcagcgccctgaaccagttcaccctgcagaagaagaagaagtag

SEQ ID NO: 38141 - DNA, 1104 bp, Artificial Sequence
  Description of Artificial Sequence: Synthetic coding sequence
atgagggccctgcggcggctcatccagggccgcatcctgctgctgaccatctgtgccgccggcatcggcggcaccttccagtttggctacaacctgagcatcatcaatgcccccaccctgcacatccaggagttcaccaatgagacctggcaggccaggactggagagcccctgcctgaccacctggtgctgctgatgtggagcctcatcgtgtccctgtaccccctgggcggcctgtttggagccctgctggccggccccctggccatcaccctgggcaggaagaagagcctgctggtgaacaacatctttgtggtgtctgctgccatcctgtttggcttcagcaggaaggccggcagctttgagatgatcatgctgggccgcctgctggtgggcgtgaatgccggcgtgtccatgaacatccagcccatgtacctgggggagagcgcccccaaggagctgcggggagctgtggccatgagcagcgccatcttcaccgccctgggcatcgtgatgggccaggtggtgggcctgagcaccacagctgcccctggcctgcggggcctgggcagaggagctggaggagctgggggcggggcccgctgcctgcccggcctgccctgccggccctgggagctgttccagcaccgggccctgcggcggcaggtgaccagcctggtggtgctgggcagcgccatggagctgtgtggaaatgacagcgtgtatgcctatgccagctctgtgttcaggaaggccggcgtgcctgaggccaagatccagtatgccatcatcggcaccggcagctgtgagctgctgacagctgtggtgtctgtgtccctggagggcgccctgcccccaccagccctgtggggcggcacccccaggagcagcgccctgaaccagttcaccctgcagctgatggtgctgaagtgcagcgagggccctggagctgtggcccacgcctgcaagcccagcaccctgggcggccggggcggctggatcaccaggtctggagtgcgggaccagcccggccagcacagcgagacccctgtgtccaccaagaagtacaagaagctgagcagaagaggaggcggccgcctgtag

SEQ ID NO: 38142 - DNA, 1392 bp, Artificial Sequence
  Description of Artificial Sequence: Synthetic coding sequence
atggaggatgagctggagcccagcctgcggcccaggacccagatccagggccgcatcctgctgctgaccatctgtgccgccggcattggaggcaccttccagtttggctacaacctgagcatcatcaatgcccccaccctgcacatccaggagttcaccaatgagacctggcaggccaggactggagagcccctgcctgaccacctggtgctgctgatgtggagcctgattgtgtccctgtaccccctgggcggcctgtttggagccctgctggccggccccctggccatcaccctgggcaggaagaagagcctgctggtgaacaacatctttgtggtgtctgctgccatcctgtttggcttcagcaggaaggccggcagctttgagatgatcatgctgggccgcctgctggtgggcgtgaatgctggggtgtccatgaacatccagcccatgtacctgggggagagcgcccccaaggagctgcggggagctgtggccatgagcagcgccatcttcaccgccctgggcatcgtgatgggccaggtggtgggcctgcgggagctgctgggcggcccccaggcctggcccctgctgctggccagctgcctggtgcctggggccctgcagctggccagcctgcccctgctgcctgagagcccccgctacctgctgattgactgtggggacacagaggcctgcctggccgccctgcggcggctgcggggcagcggggacctggccggggagctggaggagctggaggaggagcgggccgcctgccagggctgccgggcccggcggccctgggagctgttccagcaccgggccctgcggcggcaggtgaccagcctggtggtgctgggcagcgccatggagctgtgtggaaatgacagcgtgtatgcctatgccagctctgtgttcaggaaggccggcgtgcctgaggccaagatccagtatgccatcatcggcaccggcagctgtgagctgctgacagctgtggtgtctgtggccggcgtggatgagggctggggcgtgcaggccggcctgaccagcaccagccccccaccccggccccggcagagcagcttcccctggaccctgtacctggccatggcctgcatctttgccttcatcctgagctttggaattggccctgctggggtgacaggcatcctggccacagagctgtttgaccagatggcccggcctgctgcctgcatggtgtgtggggccctgatgtggatcatgctgatcctggtgggcctgggcttccccttcatcatggtgctgggcagcttcctgattgctgggggcctggtgcccctgcccctgtgccccttcccctggtgcctgtgcctgtggggccacctgcactggcctgtgcccagctag

SEQ ID NO: 38143 - DNA, 1854 bp, Artificial Sequence
  Description of Artificial Sequence: Synthetic coding sequence
atggtgcctgtggagaacacagagggccccagcctgctgaaccagaagggcacagctgtggagacagagggcagcggcagccgccaccccccctgggcccggggctgcggcatgttcaccttcctgagctctgtgacagctgctgtgtctggcctgctggtgggctatgagctgggcatcatcagcggggccctgctgcagatcaagaccctgctggccctgagctgccacgagcaggagatggtggtgagcagcctggtgattggagccctgctggccagcctgaccggcggcgtgctgattgacagatatggccgcaggacagccatcatcctgagcagctgcctgctgggcctgggcagcctggtgctgatcctgagcctgagctacacagtgctgattgtgggccgcatcgccatcggcgtgtccatcagcctgagcagcatcgccacctgtgtgtacatcgccgagatcgccccccagcacagaagaggcctgctggtgtccctgaatgagctgatgattgtgattggcatcctgagcgcctacatcagcaactatgcctttgccaacgtgttccacggctggaagtacatgtttggcctggtgatccccctgggcgtgctgcaggccatcgccatgtacttcctgccccccagcccccgcttcctggtgatgaagggccaggagggcgccgccagcaaggtgctgggccgcctgcgggccctgagtgacaccacagaggagctgaccgtcatcaagagcagcctgaaggatgagtaccagtacagcttctgggacctcttccgcagcaaggacaacatgaggacccgcatcatgattggcctgaccctggtgttctttgtgcagatcaccggccagcccaacatcctcttctacgccagcacagtgctgaagtctgtgggcttccagagcaatgaagctgccagcctggccagcactggagtgggcgtggtgaaggtgatcagcaccatcccagccaccctgctggtggaccacgtgggcagcaagaccttcctgtgcatcggcagctctgtgatggccgccagcctggtgaccatgggcatcgtgaacctgaacatccacatgaacttcacccacatctgccgcagccacaacagcatcaaccagagcctggatgaatctgtcatctacggccctggcaacctgagcaccaacaacaacaccctgcgggaccacttcaagggcatcagcagccacagccgcagcagcctgatgcccctgagaaatgatgtggacaagagaggagagaccaccagcgccagcctgctgaatgccggcctgagccacacagagtaccagatcgtgacagatcctggagatgtgcctgccttcctgaagtggctgagcctggccagcctgctggtgtatgtggccgccttcagcatcggcctgggccccatgccctggctggtgctgtctgagatcttccctgggggcatccggggccgggccatggccctgaccagctccatgaactggggcatcaacctgctgatcagcctgaccttcctgactgtgacagacctgattggcctgccctgggtgtgcttcatctacaccatcatgagcctggccagcctgctgtttgtggtgatgttcatccctgagaccaagggctgcagcctggagcagatctccatggagctggccaaggtgaactacgtgaagaacaacatctgcttcatgagccaccaccaggaggagctggtgcccaagcagccccagaagaggaagccccaggagcagctgctggagtgcaacaagctgtgtggccggggccagagccggcagctgagccctgagacctag

SEQ ID NO: 38144 - DNA, 1656 bp, Artificial Sequence
  Description of Artificial Sequence: Synthetic coding sequence
atggcccagtttgtgcaggtgctggccgagattggagactttggccgcttccagatccagctgctgatcctgctgtgtgtgctgaacttcctgagccccttctacttctttgcccacgtgttcatggtgctggatgagccccaccactgtgctgtggcctgggtgaagaaccacaccttcaacctgtctgctgctgagcagctggtgctgtctgtgcccctggacacagctggccaccctgagccctgcctgatgttccggcccccaccagccaatgccagcctgcaggacatcctgagccaccgcttcaatgagacccagccctgtgacatgggctgggagtacccagaaaatcggctgcccagcctgaagaatgagttcaacctggtgtgtgacaggaagcacctgaaggacaccacccagagcgtcttcatggccggcctgctggtgggcaccctgatgtttggccccctgtgtgaccgcatcggcaggaaggccaccatcctggcccagctgctgctcttcaccctcatcggcctggccacagcctttgtgcccagctttgagctgtacatggccctgcgctttgctgtggccacagctgtggccggcctgtccttcagcaatgtgaccctgctgacagagtgggtgggccccagctggaggacccaggccgtggtgctggcccagtgcaacttcagcctgggccagatggtgctggccggcctggcctacggcttcaggaactggaggctgctgcagatcaccggcacagcccctggcctgctgctcttcttctacttctgggccctgcctgagagcgcccgctggctgctgacccggggccgcatggatgaggccatccagctgatccagaaggccgcctctgtgaacagaaggaagctgagccctgagctgatgaaccagctggtgcctgagaagacaggccccagcggaaatgccctggacctcttccgccacccccagctgaggaaggtgaccctcatcatcttctgtgtgtggtttgtggacagcctgggctactacggcctgagcctgcaggtgggggactttggcctggatgtgtacctgacccagctgatctttggagctgtggaggtgcctgcccgctgcagcagcatcttcatgatgcagagatttggaaggaagtggagccagctgggcaccctggtgctgggcggcctgatgtgcatcatcatcatcttcatcccagctgacctgcctgtggtggtgaccatgctggccgtggtgggcaagatggccacagctgctgccttcaccatctcctatgtgtacagcgctgagctgttccccaccatcctgcggcagacaggcatgggcctggtgggcatcttcagccgcatcggcggcatcctgacccccctggtgatcctgctgggggagtaccacgccgccctgcccatgctgatctacggcagcctgcccatcgtggccggcctgctgtgcaccctgctgcctgagacccacggccagggcctgaaggacaccctgcaggacctggagctgggcccccaccccaggagccccaagtctgtgcccagcgagaaggagacagaggccaagggccgcaccagcagccctggggtggcctttgtgagcagcacctacttctag

SEQ ID NO: 38145 - DNA, 618 bp, Artificial Sequence
  Description of Artificial Sequence: Synthetic coding sequence
atggtgctggatgagccccaccactgtgctgtggcctgggtgaagaaccacaccttcaacctgtctgctgctgagcagctggtgctgtctgtgcccctggacacagctggccaccctgagccctgcctgatgttccggcccccaccagccaatgccagcctgcaggacatcctgagccaccgcttcaatgagacccagccctgtgacatgggctgggagtacccagagaaccggctgcccagcctgaagaatgagttcaacctggtgtgtgacaggaagcacctgaaggacaccacccagagcgtcttcatggccggcctgctggtgggcaccctgatgtttggccccctgtgtgaccgggacaggatgggcggggccctgatggaggatgctggccggggccctggccctgtgcagctgctgcccagggcagatggagcctgtggcacccggctgcgcttcccccagctggaggcccccagcgaccaccgccactgtgcctggctgacagccctgctgctgctgctgggcagcgcccgcatctgcaccctggccccagacccctgggaggatggccgcggggacaccacagatcctgagggcggcctgggccagtag

SEQ ID NO: 38146 - DNA, 1662 bp, Artificial Sequence
  Description of Artificial Sequence: Synthetic coding sequence
atggccttccaggacctgctgggccacgccggggacctgtggaggttccagatcctgcagacagtgttcctgagcatctttgctgtggccacctacctgcacttcatgctggagaacttcaccgccttcatccctggccaccgctgctgggtgcacatcctggacaatgacacagtgtctgacaatgacaccggggccctgagccaggatgccctgctgcgcatcagcatccccctggacagcaacatgaggcctgagaagtgcagaagatttgtgcacccccagtggcagctgctgcacctgaatggcaccttccccaacaccagtgatgctgacatggagccctgtgtggatggctgggtgtatgaccgcatctccttcagcagcaccatcgtgacagagtgggacctggtgtgtgacagccagagcctgacctctgtggccaagtttgtgttcatggccggcatgatggtgggcggcatcctgggcggccacctgagtgaccgcttcggccgccgctttgtgctgcgctggtgctacctgcaggtggccatcgtgggcacctgtgccgccctggcccccaccttcctgatctactgcagcctgcgcttcctgagcggcattgctgccatgagcctcatcaccaacaccatcatgctgattgctgagtgggccacccaccgcttccaggccatgggcatcaccctgggcatgtgccccagcggcatcgccttcatgaccctggccggcctggcctttgccatccgggactggcacatcctgcagctggtggtgtctgtgccctacttcgtcatcttcctgaccagctcctggctgctggagagcgcccgctggctgatcatcaacaacaagccagaggagggcctgaaggagctgaggaaggccgcccacaggagcggcatgaagaatgcccgggacaccctgaccctggagatcctgaagagcaccatgaagaaggagctggaggccgcccagaagaagaagcccagcctgtgtgagatgctgcacatgcccaacatctgcaagaggatcagcctgctgtccttcaccaggtttgccaacttcatggcctacttcggcctgaacctgcacgtgcagcacctgggcaacaacgtgttcctgctgcagaccctgtttggagctgtgatcctgctggccaactgtgtggccccctgggccctgaagtacatgaacagaagagccagccagatgctgctgatgttcctgctggccatctgcctgctggccatcatctttgtgccccaggagatgcagaccctgcgggaggtgctggccaccctgggcctgggcgccagcgccctggccaacaccctggcctttgcccacggcaatgaggtgatccccaccatcatccgggcccgggccatgggcatcaatgccacctttgccaacattgctggggccctggcccccctgatgatgatcctgtctgtgtacagcccccccctgccctggatcatctacggcgtcttccccttcatcagcggctttgccttcctgctgctgcctgagaccaggaacaagcccctgtttgacaccatccaggatgagaagaatgaaaggaaggacccccgggagcccaagcaggaggacccccgggtggaggtgacccagttctag

SEQ ID NO: 38147 - DNA, 717 bp, Artificial Sequence
  Description of Artificial Sequence: Synthetic coding sequence
atggccttccaggacctgctgggccacgccggggacctgtggaggttccagatcctgcagacagtgttcctgagcatctttgctgtggccacctacctgcacttcatgctggagaacttcaccgccttcatccctggccaccgctgctgggtgcacatcctggacaatgacacagtgtctgacaatgacaccggggccctgagccaggatgccctgctgcgcatcagcatccccctggacagcaacatgaggcctgagaagtgcagaagatttgtgcacccccagtggcagctgctgcacctgaatggcaccttccccaacaccagtgatgctgacatggagccctgtgtggatggctgggtgtatgaccgcatctccttcagcagcaccatcgtgacagagtgggacctggtgtgtgacagccagagcctgacctctgtggccaagtttgtgttcatggccggcatgatggtgggcggcatcctgggcggccacctgagtgacagcagccgggtgggcaacacccagatccctggccacggcaactacatcggaaatgtgcccttctggtactgcatctatgaccccggccggcccggcttctgccacagccggctggcctacccacctgctggaggagtgtgcaccatcctgtgtgacctgagtgacctgaagctggccgcccgggtgtgcagcgtggcccactaccagcagtag

SEQ ID NO: 38148 - DNA, 1626 bp, Artificial Sequence
  Description of Artificial Sequence: Synthetic coding sequence
atggcctttgaggagctgctgagccaggtgggcggcctgggccgcttccagatgctgcacctggtgttcatcctgcccagcctgatgctgctgatcccccacatcctgctggagaactttgctgctgccatccctggccaccgctgctgggtgcacatgctggacaacaacacaggcagcggaaatgagaccggcatcctgtctgaagatgccctgctgcgcatcagcatccccctggacagcaacctgcggcctgagaagtgcagaagatttgtgcacccccagtggcagctgctgcacctgaatggcaccatccacagcaccagcgaggccgacacagagccctgtgtggatggctgggtgtatgaccagagctacttccccagcaccatcgtgaccaagtgggacctggtgtgtgactaccagagcctgaagtctgtggtgcagttcctgctgctgaccggcatgctggtgggcggcatcatcggcggccacgtgtctgaccgcttcggccgccgcttcatcctgcgctggtgcctgctgcagctggccatcacagacacctgtgccgcctttgcccccaccttccctgtgtactgtgtgctgcgcttcctggccggcttcagctccatgatcatcatcagcaacaacagcctgcccatcacagagtggatccggcccaacagcaaggccctggtggtgatcctgagcagcggggccctgagcatcggccagatcatcctgggcggcctggcctacgtgttccgggactggcagaccctgcacgtggtggcctctgtgcccttctttgtgttcttcctgctgagccgctggctggtggagagcgcccgctggctgatcatcaccaacaagctggatgagggcctgaaggccctgaggaaggtggcccggaccaacggcatcaagaatgctgaggagaccctgaacatcgaggtggtgcgcagcaccatgcaggaggagctggatgctgcccagaccaagaccaccgtgtgtgacctcttcaggaaccccagcatgaggaagaggatctgcatcctggtgttcctgcgctttgccaacaccatccccttctacggcaccatggtgaacctgcagcacgtgggcagcaacatcttcctgctgcaggtgctgtatggagctgtggccctgattgtgcgctgcctggccctgctgaccctgaaccacatgggccgccgcatcagccagatcctcttcatgttcctggtgggcctgagcatcctggccaacacctttgtgcccaaggagatgcagaccctgcgggtggccctggcctgcctgggcatcggctgcagcgctgccaccttcagctctgtggccgtgcacttcatcgagctgatccccaccgtgctgcgggcccgggccagcggcatcgacctgacagccagccgcatcggggccgccctggcccccctgctgatgaccctgaccgtcttcttcaccaccctgccctggatcatctacggcatcttccccatcattggaggcctgattgtgttcctgctgcctgagaccaagaacctgcccctgcctgacaccatcaaggatgtggagaaccagaagaagaacctgaaggagaaggcctag

SEQ ID NO: 38149 - DNA, 1119 bp, Artificial Sequence
  Description of Artificial Sequence: Synthetic coding sequence
atgctggacaacaacacaggcagcggaaatgagaccggcatcctgtctgaagatgccctgctgcgcatcagcatccccctggacagcaacctgcggcctgagaagtgcagaagatttgtgcacccccagtggcagctgctgcacctgaatggcaccatccacagcaccagcgaggccgacacagagccctgtgtggatggctgggtgtatgaccagagctacttccccagcaccatcgtgaccaagtgggacctggtgtgtgactaccagagcctgaagtctgtggtgcagttcctgctgctgaccggcatgctggtgggcggcatcatcggcggccacgtgtctgaccgcttcggccgccgcttcatcctgcgctggtgcctgctgcagctggccatcacagacacctgtgccgcctttgcccccaccttccctgtgtactgtgtgctgcgcttcctggccggcttcagctccatgatcatcatcagcaacaacagcctgcccatcacagagtggatccggcccaacagcaaggccctggtggtgatcctgagcagcggggccctgagcatcggccagatcatcctgggcggcctggcctacgtgttccgggactggcagaccctgcacgtggtggcctctgtgcccttctttgtgttcttcctgctgagccgctggctggtggagagcgcccgctggctgatcatcaccaacaagctggatgagggcctgaaggccctgaggaaggtggcccggaccaacggcatcaagaatgctgaggagaccctgaacatcgaggtggtgcgcagcaccatgcaggaggagctggatgctgcccagaccaagaccaccgtgtgtgacctcttcaggaaccccagcatgaggaagaggatctgcatcctggtgttcctgcgctttgccaacaccatccccttctacggcaccatggtgaacctgcagcacgtgggcagcaacatcttcctgctgcagaagtgccggccctgtgtgtggctgtggcacgtgtgggagagcgctgtgctgctgctgctcttccctgtgctgctcttcaccagcctgaacagcagccccctcttcagcggccaggagctgcaggagtag

SEQ ID NO: 38150 - DNA, 444 bp, Artificial Sequence
  Description of Artificial Sequence: Synthetic coding sequence
atgatcatcatcagcaacaacagcctgcccatcacagagtggatccggcccaacagcaaggccctggtggtgatcctgagcagcggggccctgagcatcggccagatcatcctgggcggcctggcctacgtgttccgggactggcagaccctgcacgtggtggcctctgtgcccttctttgtgttcttcctgctgagccgctggctggtggagagcgcccgctggctgatcatcaccaacaagctggatgagggcctgaaggccctgaggaaggtggcccggaccaacggcatcaagaatgctgaggagaccctgaacatcgaggtggtgcgcagcaccatgcaggaggagctggatgctgcccagaccaagaccaccgtgtgtgacctcttcaggaaccccagcatgaggaagaggatctgcatcctggtgttcctgaggtag

SEQ ID NO: 38151 - DNA, 810 bp, Artificial Sequence
  Description of Artificial Sequence: Synthetic coding sequence
atgctggtgggcggcatcattggaggccacgtgtctgacagatttggaagacgcttcatcctgcgctggtgcctgctgcagctggccatcacagacacctgtgccgcctttgcccccaccttccctgtgtactgtgtgctgcgcttcctggccggcttcagctccatgatcatcatcagcaacaacagcctgcccatcacagagtggatccggcccaacagcaaggccctggtggtgatcctgagcagcggggccctgagcatcggccagatcatcctgggcggcctggcctacgtgttccgggactggcagaccctgcacgtggtggcctctgtgcccttctttgtgttcttcctgctgagccgctggctggtggagagcgcccgctggctgatcatcaccaacaagctggatgagggcctgaaggccctgaggaaggtggcccggaccaacggcatcaagaatgctgaggagaccctgaacatcgaggtggtgcgcagcaccatgcaggaggagctggatgctgcccagaccaagaccaccgtgtgtgacctcttcaggaaccccagcatgaggaagaggatctgcatcctggtgttcctgcgctttgccaacaccatccccttctacggcaccatggtgaacctgcagcacgtgggcagcaacatcttcctgctgcagaagtgccggccctgtgtgtggctgtggcacgtgtgggagagcgctgtgctgctgctgctcttccctgtgctgctcttcaccagcctgaacagcagccccctcttcagcggccaggagctgcaggagtag

SEQ ID NO: 38152 - DNA, 1785 bp, Artificial Sequence
  Description of Artificial Sequence: Synthetic coding sequence
atggccggggaggagaacttcaaggaggagctgcggagccaggatgccagcaggaacctgaaccagcacgaggtggccggccacccccacagctggagcctggagatgctgctgcggcggctgcgggctgtgcacaccaagcaggatgacaagtttgccaacctgctggatgctgtgggggagtttggcaccttccagcagaggctggtggccctgaccttcatccccagcatcatgtctgccttcttcatgtttgctgaccactttgtgttcaccgcccagaagccctactgcaacacctcctggatcctggccgtgggcccccacctgagcaaggccgagcagctgaacctgaccatcccccaggccccaaatggcagcttcctgacctgcttcatgtacctgcctgtgccctggaacctggacagcatcatccagtttggcctgaatgacacagacacctgccaggacggctggatctacccagatgccaagaagaggagcctcatcaatgaatttgacctggtgtgtggcatggagaccaagaaggacacagcccagatcatgttcatggccggcctgcccatcggcagcctcatcttccgcctcatcacagacaagatgggccgctacccagccatcctgctgagcctgctgggcctcatcatcttcggcttcggcacagccttcatgaacagcttccacctgtacctgttcttccgcttcggcatcagccagagcgtggtgggctacgccatcagcagcatcagcctggccacagagtggctggtgggggagcaccgggcccacgccatcatcctgggccactgcttctttgctgtgggcgctgtgctgctgactggaattgcctacagcctgccccactggcagctgctcttcctggtgggcggcatcctggtgatccccttcatctcctacatctggatcctgcctgagagcccccgctggctgatgatgaagggcaaggtgaaggaggccaagcaggtgctgtgctacgccgcctctgtgaacaagaagaccatccccagcaacctgctggatgagctgcagctgcccaggaagaaggtgacccgggcctctgtgctggacttctgcaagaaccggcagctgtgcaaggtgaccctggtgatgagctgtgtgtggttcaccgtgtcctacacctacttcaccctgagcctgaggatgagggagctgggcgtgtctgtgcacttcagacatgtggtgcccagcatcatggaggtgcctgcccggctgtgctgcatcttcctgctgcagcagatcggcaggaagtggagcctggccgtgaccctgctgcaggccatcatctggtgcctgctgctgctcttcctgcctgaaggagaagatggcctgcggctgaagtggccccgctgcccagccacagagctgaagtccatgaccatcctggtgctgatgctgcgggagttcagcctggccgccaccgtgaccgtcttcttcctgtacacagctgagctgctgcccaccgtgctgcgggccaccggcctgggcctggtgtccctggcctctgtggccggggccatcctgagcctgaccatcatcagccagacccccagcctgctgcccatcttcctgtgctgcgtgctggccatcgtggccttcagcctgagcagcctgctgcctgagacccgggaccagcccctgtctgagagcctgaaccacagcagccagatccggaacaaggtgaaggacatgaagaccaaggagaccagcagtgatgatgtgtag

SEQ ID NO: 38153 - DNA, 1785 bp, Artificial Sequence; identical to SEQ ID NO: 38152
  Description of Artificial Sequence: Synthetic coding sequence

SEQ ID NO: 38154 - DNA, 1275 bp, Artificial Sequence
  Description of Artificial Sequence: Synthetic coding sequence
atgcagggcgcccgggccccccgggaccagggccgcagccctggccgcatgtctgccctgggccgcagcagcgtcatcctgctgacctacgtgctggccgccacagagctgacctgcctcttcatgcagttcagcatcgtgccctacctgagcaggaagctgggcctggacagcatcgccttcggctacctgcagaccaccttcggcgtgctgcagctgctgggcggccctgtgtttggccgctttgctgaccagagaggagcccgggccgccctgaccctgtccttcctggccgccctggccctgtacctgctgctggccgccgccagcagccctgccctgcccggggtgtacctgctgtttgccagccggctgcccggggccctgatgcacaccctgcctgctgcccagatggtgatcacagacctgagcgcccctgaggagaggcctgctgccctgggccgcctgggcctgtgcttcggcgtgggcgtcatcctgggcagcctgctgggcggcaccctggtgtctgcctacggcatccagtgcccagccatcctggccgccctggccaccctgctgggcgctgtgctgtccttcacctgcatcccagccagcaccaagggggccaagacagatgcccaggcccccctgcccggcggcccccgggcctctgtgtttgacctgaaggccatcgccagcctgctgcggctgcctgatgtgccccgcatcttcctggtgaaggtggccagcaactgccccaccggcctcttcatggtgatgttcagcatcatctccatggacttcttccagctggaggccgcccaggccggctacctgatgtccttcttcggcctgctgcagatggtgacccagggcctggtgattggccagctgagcagccacttcagcgaggaggtgctgctgcgggcctctgtgctggtgttcatcgtggtgggcctggccatggcctggatgagctctgtgttccacttctgcctgctggtgcccggcctggtgttcagcctgtgcaccctgaatgtggtgacagacagcatgctgatcaaggctgtgtccaccagtgacaccggcaccatgctgggcctgtgtgcctctgtgcagcccctgctgcggaccctgggccccaccgtgggcggcctgctgtaccgcagctttggagtgcctgtgtttggccacgtgcaggtggccatcaacaccctggtgctgctggtgctgtggaggaagcccatgccccagaggaaggacaaggtgaggtag

SEQ ID NO: 38155 - DNA, 1275 bp, Artificial Sequence; identical to SEQ ID NO: 38154
  Description of Artificial Sequence: Synthetic coding sequence

SEQ ID NO: 38156 - DNA, 1275 bp, Artificial Sequence; identical to SEQ ID NO: 38154
  Description of Artificial Sequence: Synthetic coding sequence

SEQ ID NO: 38157 - DNA, 981 bp, Artificial Sequence
  Description of Artificial Sequence: Synthetic coding sequence
atgcagggcgcccgggccccccgggaccagggccgcagccctggccgcatgtctgccctgggccgcagcagcgtcatcctgctgacctacgtgctggccgccacagagctgacctgcctcttcatgcagttcagcatcgtgccctacctgagcaggaagctgggcctggacagcatcgccttcggctacctgcagaccaccttcggcgtgctgcagctgctgggcggccctgtgtttggccgcatccagtgcccagccatcctggccgccctggccaccctgctgggcgctgtgctgtccttcacctgcatcccagccagcaccaagggggccaagacagatgcccaggcccccctgcccggcggcccccgggcctctgtgtttgacctgaaggccatcgccagcctgctgcggctgcctgatgtgccccgcatcttcctggtgaaggtggccagcaactgccccaccggcctcttcatggtgatgttcagcatcatctccatggacttcttccagctggaggccgcccaggccggctacctgatgtccttcttcggcctgctgcagatggtgacccagggcctggtgattggccagctgagcagccacttcagcgaggaggtgctgctgcgggcctctgtgctggtgttcatcgtggtgggcctggccatggcctggatgagctctgtgttccacttctgcctgctggtgcccggcctggtgttcagcctgtgcaccctgaatgtggtgacagacagcatgctgatcaaggctgtgtccaccagtgacaccggcaccatgctgggcctgtgtgcctctgtgcagcccctgctgcggaccctgggccccaccgtgggcggcctgctgtaccgcagctttggagtgcctgtgtttggccacgtgcaggtggccatcaacaccctggtgctgctggtgctgtggaggaagcccatgccccagaggaaggacaaggtgaggtag

SEQ ID NO: 38158 - DNA, 405 bp, Artificial Sequence
  Description of Artificial Sequence: Synthetic coding sequence
atgcagggcgcccgggccccccgggaccagggccgcagccctggccgcatgtctgccctgggccgcagcagcgtcatcctgctgacctacgtgctggccgccacagagctgacctgcctcttcatgcagttcagcatcgtgccctacctgagcaggaagctgggcctggacagcatcgccttcggctacctgcagaccaccttcggcgtgctgcagctgctgggcggccctgtgtttggccgctttgctgaccagagaggagcccgggccgccctgaccctgtccttcctggccgccctggccctgtacctgctgctggccgccgccagcagccctgccctgcccggggtgtacctgctgtttgccagccggctgcccggggccctgatgcacaccctgccctag

SEQ ID NO: 38159 - DNA, 1644 bp, Artificial Sequence
  Description of Artificial Sequence: Synthetic coding sequence
atggccttccaggacctgctggaccaggtgggcggcctgggccgcttccagatcctgcagatggtgttcctgatcatgttcaacgtcatcgtgtaccaccagacccagctggagaactttgctgccttcatcctggaccaccgctgctgggtgcacatcctggacaatgacaccatcccagacaatgaccccggcaccctgagccaggatgccctgctgcgcatcagcatcccctttgacagcaacctgcggcctgagaagtgcagaagatttgtgcacccccagtggaagctgatccacctgaatggcaccttccccaacaccagcgagccagacacagagccctgtgtggatggctgggtgtatgaccagagcagcttccccagcaccatcgtgaccaagtgggacctggtgtgtgagagccagcccctgaacagcgtggccaagttcctgttcatggccggcatgatggtgggcggcaacctgtatggccacctgagtgaccgcttcggcaggaagtttgtgctgcgctggagctacctgcagctggccatcgtgggcacctgtgccgcctttgcccccaccatcctggtgtactgcagcctgcgcttcctggccggggccgccaccttcagcatcatcgtgaacacagtgctgctgattgtggagtggatcacccaccagttctgtgccatggccctgaccctgaccctgtgtgccgccagcatcggccacatcaccctgggcagcctggcctttgtgatccgggaccagtgcatcctgcagctggtgatgtctgccccctgctttgtgttcttcctgttcagccgctggctggccgagagcgcccgctggctgatcatcaacaacaagccagaggagggcctgaaggagctgaggaaggccgcccacagaaatggcatgaagaatgctgaggacatcctgaccatggaggtgctgaagagcaccatgaagcaggagctggaggccgcccagaagaagcacagcctgtgtgagctgctgcgcatccccaacatctgcaagaggatctgcttcctgagctttgtgcgctttgccagcaccatccccttctggggcctgaccctgcacctgcagcacctgggcaacaacgtgttcctgctgcagaccctgtttggagctgtgaccctgctggccaactgtgtggccccctgggccctgaaccacatgagccggcggctgagccagatgctgctgatgttcctgctggccacctgcctgctggccatcatctttgtgccccaggagatgcagaccctgcgggtggtgctggccaccctgggcgtgggcgccgccagcctgggcatcacctgcagcacagcccaggagaatgaactcatccccagcatcatccggggccgggccaccggcatcaccggcaactttgccaacatcggcggggccctggccagcctgatgatgatcctgagcatctacagccggcccctgccctggatcatctatggagtgtttgccatcctgagcggcctggtggtgctgctgctgcctgagaccaggaaccagcccctgctggacagcatccaggatgtggagaatgaaggagtgaacagcctggccgccccccagaggagctctgtgctgtag

SEQ ID NO: 38160 - DNA, 705 bp, Artificial Sequence
  Description of Artificial Sequence: Synthetic coding sequence
atgaacatgtttggaaggaagtttgtgctgcgctggagctacctgcagctggccatcgtgggcacctgtgccgcctttgcccccaccatcctggtgtactgcagcctgcgcttcctggccggggccgccaccttcagcatcatcgtgaacacagtgctgctgattgtggagtggatcacccaccagttctgtgccatggccctgaccctgaccctgtgtgccgccagcatcggccacatcaccctgggcagcctggcctttgtgatccgggaccagtgcatcctgcagctggtgatgtctgccccctgctttgtgttcttcctgttcagccgctggctggccgagagcgcccgctggctgatcatcaacaacaagccagaggagggcctgaaggagctgaggaaggccgcccacagaaatggcatgaagaatgctgaggacatcctgaccatggaggtgctgaagagcaccatgaagcaggagctggaggccgcccagaagaagcacagcctgtgtgagctgctgcgcatccccaacatctgcaagaggatctgcttcctgagctttgtgcgctctgctggggtgtgctggaggagcaccccagaccctgtgtgcctgggcatcaccagcggcggctgcaggacagccaagatcccagcctgcagcttcctgtggaagctgcacttccggggggccccagcctag

SEQ ID NO: 38161 - DNA, 609 bp, Artificial Sequence
  Description of Artificial Sequence: Synthetic coding sequence
atggccttccaggacctgctggaccaggtgggcggcctgggccgcttccagatcctgcagatggtgttcctgatcatgttcaacgtcatcgtgtaccaccagacccagctggagaactttgctgccttcatcctggaccaccgctgctgggtgcacatcctggacaatgacaccatcccagacaatgaccccggcaccctgagccaggatgccctgctgcgcatcagcatcccctttgacagcaacctgcggcctgagaagtgcagaagatttgtgcacccccagtggaagctgatccacctgaatggcaccttccccaacaccagcgagccagacacagagccctgtgtggatggctgggtgtatgaccagagcagcttccccagcaccatcgtgaccaagtgggacctggtgtgtgagagccagcccctgaacagcgtggccaagttcctgttcatggccggcatgatggtgggcggcaacctgtatggccacctgagtgacaggaagcccctgagcagccccaaccacgtgtccacagactgtgatgagggcctggaggtgcccatcgccatccaccagcaccacgtgttctggtacctgtcctag

SEQ ID NO: 38162 - DNA, 1200 bp, Artificial Sequence
  Description of Artificial Sequence: Synthetic coding sequence
tgattccaggacctgctggaccaggtgggcggcctgggccgcttccagatcctgcagatggtgttcctgatcatgtttaatgtgattgtgtaccaccagacccagctggagaactttgctgccttcatcctggaccaccgctgctgggtgcacatcctggacaatgacaccatcccagacaatgaccccggcaccctgagccaggatgccctgctgcgcatcagcatcccctttgacagcaacctgcggcctgagaagtgccgccgctttgtgcacccccagtggaagctgatccacctgaatggcaccttccccaacaccagcgagccagacacagagccctgtgtggatggctgggtgtatgaccagagcagcttccccagcaccatcgtgaccaagtgggacctggtgtgtgagagccagcccctgaacagcgtggccaagttcctgttcatggccggcatgatggtgggcggcaacctgtatggccacctgagtgacagatttggaaggaagtttgtgctgcgctggagctacctgcagctggccatcgtgggcacctgtgccgcctttgcccccaccatcctggtgtactgcagcctgcgcttcctggccggggccgccaccttcagcatcatcgtgaacacagtgctgctgattgtggagtggatcacccaccagttctgtgccatggccctgaccctgaccctgtgtgccgccagcatcggccacatcaccctgggcagcctggccttcgtcatccgggaccagtgcatcctgcagctggtgatgtctgccccctgctttgtgttcttcctgttcagccgctggctggccgagagcgcccgctggctgatcatcaacaacaagccagaggagggcctgaaggagctgaggaaggccgcccacagaaatggcatgaagaatgctgaggacatcctgaccatggaggtgctgaagagcaccatgaagcaggagctggaggccgcccagaagaagcacagcctgtgtgagctgctgcgcatccccaacatctgcaagaggatctgcttcctgagctttgtgcgctctgctggggtgtgctggaggagcaccccagaccctgtgtgcctgggcatcaccagcggcggctgcaggacagccaagatcccagcctgcagcttcctgtggaagctgcacttccggggggccccagcctag

SEQ ID NO: 38163 - DNA, 1482 bp, Artificial Sequence
  Description of Artificial Sequence: Synthetic coding sequence
atgagccgcagccccctgaaccccagccagctgcggtctgtgggcagccaggatgccctggcccccctgcccccaccagccccccagaaccccagcacccacagctgggaccccctgtgtggcagcctgccctggggcctgagctgcctgctggccctgcagcacgtgctggtgatggccagcctgctgtgtgtgagccacctgctgctgctgtgcagcctgagccctgggggcctgagctacagccccagccagctgctggccagcagcttcttcagctgtggcatgagcaccatcctgcagacctggatgggcagccggctgcccctggtgcaggcccccagcctggagttcctgatcccagccctggtgctgaccagccagaagctgccccgggccatccagaccccaggcaacagcagcctgatgctgcacctgtgccggggccccagctgccacggcctgggccactggaacaccagcctgcaggaggtgtctggagctgtggtggtgtctggcctgctgcagggcatgatgggcctgctgggcagccctggccacgtgttcccccactgcggccccctggtgctggcccccagcctggtggtggccggcctgagcgcccaccgggaggtggcccagttctgcttcacccactggggcctggccctgctgacctgggccccagccagcttcatgtgtgcccctggaggagagctgcagaggcaccagctgaccctgctgagcctgagcagcggcagcttcaggaactgcctgcccccacccaggcaccacggcttcggctgcctgacccaggccggcagccagcaggtggcccacctggtgggcctgctgtgtgtgggcctgggcctgagcccccggctggcccagctgctgaccaccatccccctgcctgtggtgggcggcgtgctgggcgtgacccaggccgtggtgctgtctgctggcttcagcagcttctacctggccgacattgattctggaagaaacatcttcatcgtgggcttcagcatcttcatggccctgctgctgccccgctggttccgggaggcccctgtgctcttcagcacaggctggagccccctggatgtgctgctgcacagcctgctgacccagcccatcttcctggccggcctgagcggcttcctgctggagaacaccatccctggcacccagctggagcggggcctgggccagggcctgcccagccccttcaccgcccaggaggccaggatgccccagaagccccgggagaaggccgcccaggtgtaccgcctgcccttccccatccagaacctgtgcccctgcatcccccagcccctgcactgcctgtgccccctgcctgaagatcctggagatgaggagggcggcagcagcgagcctgaggagatggctgacctgctgcccggcagcggggagccctgcccagagagcagccgggagggcttccgcagccagaagtag

SEQ ID NO: 38164 - DNA, 585 bp, Artificial Sequence
  Description of Artificial Sequence: Synthetic coding sequence
atggccagcctgctgtgtgtgagccacctgctgctgctgtgcagcctgagccctgggggcctgagctacagccccagccagctgctggccagcagcttcttcagctgtggcatgagcaccatcctgcagacctggatgggcagccggctgcccctggtgcaggcccccagcctggagttcctgatcccagccctggtgctgaccagccagaagctgccccgggccatccagaccccaggcaacagcagcctgatgctgcacctgtgccggggccccagctgccacggcctgggccactggaacaccagcctgcaggagggctacccagcccatggaggcctcttcagcgcccctggcctgctgcctgtgtcctgtgtgcccctggaggccagcttcaacgtcatcaacagccacagcagcccctgcctgcctgccccctttggagctgaccccagcggcctgtgtgtggactgcttctgcctgtgtggcatccagtgctacccacctggcaccgtgtgcccccaccagggcaccatggacctggccgccagcccccggctggacctgagcaagtggctgacctag

SEQ ID NO: 38165 - DNA, 1833 bp, Artificial Sequence
  Description of Artificial Sequence: Synthetic coding sequence
atgagccgcagccccctgaaccccagccagctgcggtctgtgggcagccaggatgccctggcccccctgcccccaccagccccccagaaccccagcacccacagctgggaccccctgtgtggcagcctgccctggggcctgagctgcctgctggccctgcagcacgtgctggtgatggccagcctgctgtgtgtgagccacctgctgctgctgtgcagcctgagccctgggggcctgagctacagccccagccagctgctggccagcagcttcttcagctgtggcatgagcaccatcctgcagacctggatgggcagccggctgcccctggtgcaggcccccagcctggagttcctgatcccagccctggtgctgaccagccagaagctgccccgggccatccagaccccaggcaacagcagcctgatgctgcacctgtgccggggccccagctgccacggcctgggccactggaacaccagcctgcaggaggtgtctggagctgtggtggtgtctggcctgctgcagggcatgatgggcctgctgggcagccctggccacgtgttcccccactgcggccccctggtgctggcccccagcctggtggtggccggcctgagcgcccaccgggaggtggcccagttctgcttcacccactggggcctggccctgctggtgatcctgctgatggtggtgtgcagccagcacctgggcagctgccagttccacgtgtgcccctggaggcgggccagcaccagcagcacccacacccccctgcccgtcttccggctgctgtctgtgctgatccctgtggcctgtgtgtggatcgtgtctgcctttgtgggcttcagcgtcatcccccaggagctgagcgcccccaccaaggccccctggatctggctgccccaccctggagagtggaactggcccctgctgaccccccgggccctggccgccggcatctccatggccctggccgccagcaccagcagcctgggctgctacgccctgtgtggccgcctgctgcacctgcccccacctccaccccacgcctgcagccggggcctgagcctggagggcctgggctctgtgctggccggcctgctgggcagccccatgggcacagccagcagcttccccaacgtgggcaaggtgggcctcatccaggccggcagccagcaggtggcccacctggtgggcctgctgtgtgtgggcctgggcctgagcccccggctggcccagctgctgaccaccatccccctgcctgtggtgggcggcgtgctgggcgtgacccaggccgtggtgctgtctgctggcttcagcagcttctacctggccgacatcgacagcggcaggaacatcttcatcgtgggcttcagcatcttcatggccctgctgctgccccgctggttccgggaggcccctgtgctcttcagcacaggctggagccccctggatgtgctgctgcacagcctgctgacccagcccatcttcctggccggcctgagcggcttcctgctggagaacaccatccctggcacccagctggagcggggcctgggccagggcctgcccagccccttcaccgcccaggaggccaggatgccccagaagccccgggagaaggccgcccaggtgtaccgcctgcccttccccatccagaacctgtgcccctgcatcccccagcccctgcactgcctgtgccccctgcctgaggaccctggagatgaggagggcggcagcagcgagcctgaggagatggctgacctgctgcccggcagcggggagccctgcccagagagcagccgggagggcttccgcagccagaagtag

SEQ ID NO: 38166 - DNA, 1857 bp, Artificial Sequence
  Description of Artificial Sequence: Synthetic coding sequence
atgagccgcagccccctgaaccccagccagctgcggtctgtgggcagccaggatgccctggcccccctgcccccaccagccccccagaaccccagcacccacagctgggaccccctgtgtggcagcctgccctggggcctgagctgcctgctggccctgcagcacgtgctggtgatggccagcctgctgtgtgtgagccacctgctgctgctgtgcagcctgagccctgggggcctgagctacagccccagccagctgctggccagcagcttcttcagctgtggcatgagcaccatcctgcagacctggatgggcagccggctgcccctggtgcaggcccccagcctggagttcctgatcccagccctggtgctgaccagccagaagctgccccgggccatccagaccccaggcaactgtgagcaccgggcccgggcccgggccagcctgatgctgcacctgtgccggggccccagctgccacggcctgggccactggaacaccagcctgcaggaggtgtctggagctgtggtggtgtctggcctgctgcagggcatgatgggcctgctgggcagccctggccacgtgttcccccactgcggccccctggtgctggcccccagcctggtggtggccggcctgagcgcccaccgggaggtggcccagttctgcttcacccactggggcctggccctgctggtgatcctgctgatggtggtgtgcagccagcacctgggcagctgccagttccacgtgtgcccctggaggcgggccagcaccagcagcacccacacccccctgcccgtcttccggctgctgtctgtgctgatccctgtggcctgtgtgtggatcgtgtctgcctttgtgggcttcagcgtcatcccccaggagctgagcgcccccaccaaggccccctggatctggctgccccaccctggagagtggaactggcccctgctgaccccccgggccctggccgccggcatctccatggccctggccgccagcaccagcagcctgggctgctacgccctgtgtggccgcctgctgcacctgcccccacctccaccccacgcctgcagccggggcctgagcctggagggcctgggctctgtgctggccggcctgctgggcagccccatgggcacagccagcagcttccccaacgtgggcaaggtgggcctcatccaggccggcagccagcaggtggcccacctggtgggcctgctgtgtgtgggcctgggcctgagcccccggctggcccagctgctgaccaccatccccctgcctgtggtgggcggcgtgctgggcgtgacccaggccgtggtgctgtctgctggcttcagcagcttctacctggccgacatcgacagcggcaggaacatcttcatcgtgggcttcagcatcttcatggccctgctgctgccccgctggttccgggaggcccctgtgctcttcagcacaggctggagccccctggatgtgctgctgcacagcctgctgacccagcccatcttcctggccggcctgagcggcttcctgctggagaacaccatccctggcacccagctggagcggggcctgggccagggcctgcccagccccttcaccgcccaggaggccaggatgccccagaagccccgggagaaggccgcccaggtgtaccgcctgcccttccccatccagaacctgtgcccctgcatcccccagcccctgcactgcctgtgccccctgcctgaggaccctggagatgaggagggcggcagcagcgagcctgaggagatggctgacctgctgcccggcagcggggagccctgcccagagagcagccgggagggcttccgcagccagaagtag

SEQ ID NO: 38167 - DNA, 1434 bp, Artificial Sequence
  Description of Artificial Sequence: Synthetic coding sequence
atgctgcgctggctgcgggactttgtgctgcccacagctgcctgccaggatgctgagcagcccaccaggtatgagaccctcttccaggccctggacagaaatggagatggagtggtggacattggagagctgcaggagggcctgaggaacctgggcatccccctgggccaggatgctgaggagaagatcttcaccactggagatgtgaacaaggatggcaagctggactttgaggagttcatgaagtacctgaaggaccacgagaagaagatgaagctggccttcaagagcctggacaagaacaatgatggcaagattgaggccagcgagatcgtgcagagcctgcagaccctgggcctgaccatcagcgagcagcaggccgagctgatcctgcagagcattgatgtggatggcaccatgacagtggactggaatgagtggagggactacttcctgttcaaccctgtgacagacatcgaggagatcatccgcttctggaagcacagcacaggcatcgacatcggggacagcctgaccatcccagatgagttcacagaagatgagaagaagagcggccagtggtggaggcagctgctggccggcggcattgctggagctgtgtccaggaccagcacagcccccctggaccggctgaagatcatgatgcaggtgcacggcagcaagagtgacaagatgaacatctttggaggcttccggcagatggtgaaggagggcggcatccgcagcctgtggagaggaaatggcaccaacgtcatcaagatcgcccctgagacagctgtgaagttctgggcctatgagcagtacaagaagctgctgacagaggagggccagaagattggcacctttgagcgcttcatcagcggctccatggccggggccacagcccagaccttcatctaccccatggaggtgatgaagacccggctggccgtgggcaagacaggccagtacagcggcatctatgactgtgccaagaagatcctgaagcatgagggcctgggcgccttctacaagggctacgtgcccaacctgctgggcatcatcccctatgccggcatcgacctggccgtgtatgagctgctgaagagctactggctggacaactttgccaaggacagcgtgaaccctggggtgatggtgctgctgggctgtggggccctgagcagcacctgtggccagctggccagctaccccctggccctggtgaggaccaggatgcaggcccaggccatgctggagggcagcccccagctgaacatggtgggcctcttccgccgcatcatcagcaaggagggcatccctggcctgtaccggggcatcacccccaacttcatgaaggtgctgcctgctgtgggcatctcctatgtggtgtatgagaacatgaagcagaccctgggcgtgacccagaagtag

SEQ ID NO: 38168 - DNA, 1449 bp, Artificial Sequence
  Description of Artificial Sequence: Synthetic coding sequence
atgaggggcagccctggagatgctgagcggcggcagcgctggggccgcctgtttgaggagctggacagcaacaaggatggccgggtggatgtgcatgagctgcggcagggcctggcccggctgggcggcggcaacccagaccccggggcccagcagggcatcagcagtgaaggagatgctgaccctgatggcggcctggacctggaggagttcagccgctacctgcaggagcgggagcagaggctgctgctgatgttccacagcctggacaggaaccaggacggccacattgatgtgtctgagatccagcagagcttccgggccctgggcatcagcatcagcctggagcaggccgagaagatcctgcacagcatggacagagatggcaccatgaccatcgactggcaggagtggagggaccacttcctgctgcacagcctggagaatgtggaggatgtgctgtacttctggaagcacagcaccctgagcagcgctggcttcagcgcctggatcaaggacagcacagctgagcagaacagaagcaagaccaccgtgctggcccggcgcagcggcagccacctgaagagccagcacttcggccggcccaagtgggccgaccacgaggtgctggacatcggggagtgcctgactgtgcctgatgagttcagcaagcaggagaagctgaccggcatgtggtggaagcagctggtggccggggctgtggccggggctgtgtccaggactggaacagcccccctggaccggctgaaggtgttcatgcaggtgcacgccagcaagaccaaccggctgaacatcctgggcggcctgcgctccatggtgctggagggcggcatccgcagcctgtggagaggaaatggcatcaacgtgctgaagatcgcccctgagagcgccatcaagttcatggcctatgagcagatcaagagggccatcctgggccagcaggagaccctgcacgtgcaggagagatttgtggccggcagcctggccggggccacagcccagaccatcatctaccccatggaggtgctgaagacccggctgaccctgcggaggacaggccagtacaagggcctgctggactgtgcccggcgcatcctggagcgggagggcccccgggccttctaccggggctacctgcccaacgtgctgggcatcatcccctatgccggcatcgacctggccgtgtatgagaccctgaagaactggtggctgcagcagtacagccatgacagcgctgaccccggcatcctggtgctgctggcctgtggcaccatcagcagcacctgtggccagatcgccagctaccccctggccctggtgaggaccaggatgcaggcccagggctggagcacagtggcccgcttccagatcacagccaccagcgccttccaggtgcaggccatcctgctgccccagcccccagagtag

SEQ ID NO: 38169 - DNA, 1407 bp, Artificial Sequence
  Description of Artificial Sequence: Synthetic coding sequence
atgaggggcagccctggagatgctgagcggcggcagcgctggggccgcctgtttgaggagctggacagcaacaaggatggccgggtggatgtgcatgagctgcggcagggcctggcccggctgggcggcggcaacccagaccccggggcccagcagggcatcagcagtgaaggagatgctgaccctgatggcggcctggacctggaggagttcagccgctacctgcaggagcgggagcagaggctgctgctgatgttccacagcctggacaggaaccaggacggccacattgatgtgtctgagatccagcagagcttccgggccctgggcatcagcatcagcctggagcaggccgagaagatcctgcacagcatggacagagatggcaccatgaccatcgactggcaggagtggagggaccacttcctgctgcacagcctggagaatgtggaggatgtgctgtacttctggaagcacagcacagtgctggacattggagaatgtctgactgtgcctgatgagttcagcaagcaggagaagctgaccggcatgtggtggaagcagctggtggccggggctgtggccggggctgtgtccaggactggaacagcccccctggaccggctgaaggtgttcatgcaggtgcacgccagcaagaccaaccggctgaacatcctgggcggcctgcgctccatggtgctggagggcggcatccgcagcctgtggagaggaaatggcatcaacgtgctgaagatcgcccctgagagcgccatcaagttcatggcctatgagcagatcaagagggccatcctgggccagcaggagaccctgcacgtgcaggagagatttgtggccggcagcctggccggggccacagcccagaccatcatctaccccatggaggtgctgaagacccggctgaccctgcggaggacaggccagtacaagggcctgctggactgtgcccggcgcatcctggagcgggagggcccccgggccttctaccggggctacctgcccaacgtgctgggcatcatcccctatgccggcatcgacctggccgtgtatgagaccctgaagaactggtggctgcagcagtacagccatgattctgctgaccccggcatcctggtgctgctggcctgtggcaccatcagcagcacctgtggccagatcgccagctaccccctggccctggtgaggaccaggatgcaggcccaggccagcattgagggcggcccccagctgtccatgctgggcctgctgcggcacatcctgagccaggagggcatgaggggcctgtaccggggcatcgcccccaacttcatgaaggtgatcccagctgtgtccatctcctatgtggtgtatgagaacatgaagcaggccctgggcgtgaccagcaggtag

SEQ ID NO: 38170 - DNA, 1317 bp, Artificial Sequence
  Description of Artificial Sequence: Synthetic coding sequence
atgaggggcagccctggagatgctgagcggcggcagcgctggggccgcctgtttgaggagctggacagcaacaaggatggccgggtggatgtgcatgagctgcggcagggcctggcccggctgggcggcggcaacccagaccccggggcccagcagggcatcagcagtgaaggagatgctgaccctgatggcggcctggacctggaggagttcagccgctacctgcaggagcgggagcagaggctgctgctgatgttccacagcctggacaggaaccaggacggccacattgatgtgtctgagatccagcagagcttccgggccctgggcatcagcatcagcctggagcaggccgagaagatcctgcacagcatggacagagatggcaccatgaccatcgactggcaggagtggagggaccacttcctgctgcacagcctggagaatgtggaggatgtgctgtacttctggaagcacagcacagtgctggacattggagaatgtctgactgtgcctgatgagttcagcaagcaggagaagctgaccggcatgtggtggaagcagctggtggccggggctgtggccggggctgtgtccaggactggaacagcccccctggaccggctgaaggtgttcatgcaggtgcacgccagcaagaccaaccggctgaacatcctgggcggcctgcgctccatggtgctggagggcggcatccgcagcctgtggagaggaaatggcatcaacgtgctgaagatcgcccctgagagcgccatcaagttcatggcctatgagcagatcaagagggccatcctgggccagcaggagaccctgcacgtgcaggagagatttgtggccggcagcctggccggggccacagcccagaccatcatctaccccatggaggtgctgaagacccggctgaccctgcggaggacaggccagtacaagggcctgctggactgtgcccggcgcatcctggagcgggagggcccccgggccttctaccggggctacctgcccaacgtgctgggcatcatcccctatgccggcatcgacctggccgtgtatgagaccctgaagaactggtggctgcagcagtacagccatgattctgctgaccccggcatcctggtgctgctggcctgtggcaccatcagcagcacctgtggccagatcgccagctaccccctggccctggtgaggaccaggatgcaggcccaggatgtgtctgtgtacaagacagacacagtgcccaccctgattgagctgaccggccggcggggcaggaagatgctgaacaagagcttctggaactag

SEQ ID NO: 38171 - DNA, 690 bp, Artificial Sequence
  Description of Artificial Sequence: Synthetic coding sequence
atgtggtggaagcagctggtggccggggctgtggccggggctgtgtccaggactggaacagcccccctggaccggctgaaggtgttcatgcaggtgcacgccagcaagaccaaccggctgaacatcctgggcggcctgcgctccatggtgctggagggcggcatccgcagcctgtggagaggaaatggcatcaacgtgctgaagatcgcccctgagagcgccatcaagttcatggcctatgagcagatcaagagggccatcctgggccagcaggagaccctgcacgtgcaggagagatttgtggccggcagcctggccggggccacagcccagaccatcatctaccccatggagaccctgaagaactggtggctgcagcagtacagccatgacagcgctgaccccggcatcctggtgctgctggcctgtggcaccatcagcagcacctgtggccagatcgccagctaccccctggccctggtgaggaccaggatgcaggcccaggccagcattgaaggaggcccccagctgtccatgctgggcctgctgcggcacatcctgagccaggagggcatgaggggcctgtaccggggcatcgcccccaacttcatgaaggtgatcccagctgtgtccatctcctatgtggtgtatgagaacatgaagcaggccctgggcgtgaccagcaggtag

SEQ ID NO: 38172 - DNA, 372 bp, Artificial Sequence
  Description of Artificial Sequence: Synthetic coding sequence
atggaggtgctgaagacccggctgaccctgcggaggacaggccagtacaagggcctgctggactgtgcccggcgcatcctggagcgggagggcccccgggccttctaccggggctacctgcccaacgtgctgggcatcatcccctatgccggcatcgacctggccgtgtatgagaccctgaagaactggtggctgcagcagtacagccatgacagcgctgaccccggcatcctggtgctgctggcctgtggcaccatcagcagcacctgtggccagatcgccagctaccccctggccctggtgaggaccaggatgcaggcccaggccggcggccacgccatgagcagcctgatggagaggaccatgtggtag

SEQ ID NO: 38173 - DNA, 1434 bp, Artificial Sequence; identical to SEQ ID NO: 38167
  Description of Artificial Sequence: Synthetic coding sequence

SEQ ID NO: 38174 - DNA, 1377 bp, Artificial Sequence
  Description of Artificial Sequence: Synthetic coding sequence
atggacagcctgtatggagacctcttctggtacctggactacaacaaggatggcaccctggacatctttgagctgcaggagggcctggaggatgtgggcgccatccagagcctggaggaggccaagaagatcttcaccactggagatgtgaacaaggatggcaagctggactttgaggagttcatgaagtacctgaaggaccacgagaagaagatgaagctggccttcaagagcctggacaagaacaatgatggcaagattgaggccagcgagatcgtgcagagcctgcagaccctgggcctgaccatcagcgagcagcaggccgagctgatcctgcagagcattgatgtggatggcaccatgacagtggactggaatgagtggagggactacttcctgttcaaccctgtgacagacatcgaggagatcatccgcttctggaagcacagcactggaattgatattggagacagcctgaccatcccagatgagttcacagaagatgagaagaagagcggccagtggtggaggcagctgctggccggcggcattgctggagctgtgtccaggaccagcacagcccccctggaccggctgaagatcatgatgcaggtgcacggcagcaagagtgacaagatgaacatctttggaggcttccggcagatggtgaaggagggcggcatccgcagcctgtggagaggaaatggcaccaacgtcatcaagatcgcccctgagacagctgtgaagttctgggcctatgagcagtacaagaagctgctgacagaggagggccagaagattggcacctttgagcgcttcatcagcggctccatggccggggccacagcccagaccttcatctaccccatggaggtgatgaagacccggctggccgtgggcaagacaggccagtacagcggcatctatgactgtgccaagaagatcctgaagcatgagggcctgggcgccttctacaagggctacgtgcccaacctgctgggcatcatcccctatgccggcatcgacctggccgtgtatgagctgctgaagagctactggctggacaactttgccaaggacagcgtgaaccctggggtgatggtgctgctgggctgtggggccctgagcagcacctgtggccagctggccagctaccccctggccctggtgaggaccaggatgcaggcccaggccatgctggagggcagcccccagctgaacatggtgggcctcttccgccgcatcatcagcaaggagggcatccctggcctgtaccggggcatcacccccaacttcatgaaggtgctgcctgctgtgggcatctcctatgtggtgtatgagaacatgaagcagaccctgggcgtgacccagaagtag

SEQ ID NO: 38175 - DNA, 1410 bp, Artificial Sequence
  Description of Artificial Sequence: Synthetic coding sequence
atgctgtgcctgtgcctgtatgtgcctgtgattggagaggcccagacagagttccagtactttgagagcaagggcctgcctgctgagctgaagagcatcttcaagctgtctgtgttcatccccagccaggagttcagcacctaccggcagtggaagcagaagatcgtgcaggccggggacaaggacctggatggccagctggactttgaggagtttgtgcactacctgcaggaccacgagaagaagctgcggctggtgttcaagagcctggacaagaagaatgatggaagaattgatgcccaggagatcatgcagagcctgcgggacctgggcgtgaagatcagcgagcagcaggccgagaagatcctgaagtccatggacaagaatggcaccatgaccatcgactggaatgagtggagggactaccacctgctgcaccctgtggagaacatccctgagatcatcctgtactggaagcacagcaccatctttgatgtgggggagaacctgactgtgcctgatgagttcaccgtggaggagcggcagacaggcatgtggtggaggcacctggtggccggcggcggggccggggctgtgtccaggacctgcacagcccccctggaccggctgaaggtgctgatgcaggtgcacgccagccgcagcaacaacatgggcatcgtgggcggcttcacccagatgatccgggagggcggggcccggagcctgtggagaggaaatggcatcaacgtgctgaagatcgcccctgagagcgccatcaagttcatggcctatgagcagatcaagaggctggtgggcagtgaccaggagaccctgcgcatccacgagcggctggtggccggcagcctggccggggccatcgcccagagcagcatctaccccatggaggtgctgaagaccaggatggccctgaggaagacaggccagtacagcggcatgctggactgtgcccggcgcatcctggcccgggagggcgtggccgccttctacaagggctacgtgcccaacatgctgggcatcatcccctatgccggcatcgacctggccgtgtatgagaccctgaagaatgcctggctgcagcactatgctgtgaacagcgctgaccccggggtgtttgtgctgctggcctgtggcaccatgagcagcacctgtggccagctggccagctaccccctggccctggtgaggaccaggatgcaggcccaggccagcattgaaggagcccctgaggtgaccatgagcagcctcttcaagcacatcctgaggacagaaggagccttcggcctgtaccggggcctggcccccaacttcatgaaggtgatcccagctgtgtccatctcctatgtggtgtatgagaacctgaagatcaccctgggcgtgcagagcaggtag

SEQ ID NO: 38176 - DNA, 1506 bp, Artificial Sequence
  Description of Artificial Sequence: Synthetic coding sequence
atgctgcagatgctgtggcacttcctggccagcttcttcccccgggccggctgccacggcagccgggagggagatgaccgggaggtgcggggcaccccagccccagcctggagggaccagatggccagcttcctgggcaagcaggacggccgggcagaggccacagagaagaggcccaccatcctgctggtggtgggccctgctgagcagttccccaagaagatcgtgcaggccggggacaaggacctggatggccagctggactttgaggagtttgtgcactacctgcaggaccacgagaagaagctgcggctggtgttcaagagcctggacaagaagaatgatggaagaattgatgcccaggagatcatgcagagcctgcgggacctgggcgtgaagatcagcgagcagcaggccgagaagatcctgaagaggatcagaacaggccacttctggggccctgtgacctacatggacaagaatggcaccatgaccatcgactggaatgagtggagggactaccacctgctgcaccctgtggagaacatccctgagatcatcctgtactggaagcacagcaccatctttgatgtgggggagaacctgactgtgcctgatgagttcaccgtggaggagcggcagacaggcatgtggtggaggcacctggtggccggcggcggggccggggctgtgtccaggacctgcacagcccccctggaccggctgaaggtgctgatgcaggtgcacgccagccgcagcaacaacatgggcatcgtgggcggcttcacccagatgatccgggagggcggggcccggagcctgtggagaggaaatggcatcaacgtgctgaagatcgcccctgagagcgccatcaagttcatggcctatgagcagatcaagaggctggtgggcagtgaccaggagaccctgcgcatccacgagcggctggtggccggcagcctggccggggccatcgcccagagcagcatctaccccatggaggtgctgaagaccaggatggccctgaggaagacaggccagtacagcggcatgctggactgtgcccggcgcatcctggcccgggagggcgtggccgccttctacaagggctacgtgcccaacatgctgggcatcatcccctatgccggcatcgacctggccgtgtatgagaccctgaagaatgcctggctgcagcactatgctgtgaacagcgctgaccccggggtgtttgtgctgctggcctgtggcaccatgagcagcacctgtggccagctggccagctaccccctggccctggtgaggaccaggatgcaggcccaggccagcattgaaggagcccctgaggtgaccatgagcagcctcttcaagcacatcctgaggacagaaggagccttcggcctgtaccggggcctggcccccaacttcatgaaggtgatcccagctgtgtccatctcctatgtggtgtatgagaacctgaagatcaccctgggcgtgcagagcaggtag

SEQ ID NO: 38177 - DNA, 1512 bp, Artificial Sequence
  Description of Artificial Sequence: Synthetic coding sequence
atggtgtcctctgtgctgtgccgctgtgtggccagccccccaccagatgctgctgccacagctgccagcagcagcgccagcagccctgcctctgtgggggacccctgtggcggggccatctgtggcggccctgaccaccggctgcggctgtggaggctcttccagaccctggatgtgaacagagatggcggcctgtgtgtgaatgacctggccgtgggcctgcggcggctgggcctgcacaggacagaaggagagctgcagaagatcgtgcaggccggggacaaggacctggatggccagctggactttgaggagtttgtgcactacctgcaggaccacgagaagaagctgcggctggtgttcaagagcctggacaagaagaatgatggaagaattgatgcccaggagatcatgcagagcctgcgggacctgggcgtgaagatcagcgagcagcaggccgagaagatcctgaagtccatggacaagaatggcaccatgaccatcgactggaatgagtggagggactaccacctgctgcaccctgtggagaacatccctgagatcatcctgtactggaagcacagcaccatctttgatgtgggggagaacctgactgtgcctgatgagttcaccgtggaggagcggcagacaggcatgtggtggaggcacctggtggccggcggcggggccggggctgtgtccaggacctgcacagcccccctggaccggctgaaggtgctgatgcaggtgcacgccagccgcagcaacaacatgggcatcgtgggcggcttcacccagatgatccgggagggcggggcccggagcctgtggagaggaaatggcatcaacgtgctgaagatcgcccctgagagcgccatcaagttcatggcctatgagcagatcaagaggctggtgggcagtgaccaggagaccctgcgcatccacgagcggctggtggccggcagcctggccggggccatcgcccagagcagcatctaccccatggaggtgctgaagaccaggatggccctgaggaagacaggccagtacagcggcatgctggactgtgcccggcgcatcctggcccgggagggcgtggccgccttctacaagggctacgtgcccaacatgctgggcatcatcccctatgccggcatcgacctggccgtgtatgagaccctgaagaatgcctggctgcagcactatgctgtgaacagcgctgaccccggggtgtttgtgctgctggcctgtggcaccatgagcagcacctgtggccagctggccagctaccccctggccctggtgaggaccaggatgcaggcccaggccagcattgaaggagcccctgaggtgaccatgagcagcctcttcaagcacatcctgaggacagaaggagccttcggcctgtaccggggcctggcccccaacttcatgaaggtgatcccagctgtgtccatctcctatgtggtgtatgagaacctgaagatcaccctgggcgtgcagagcaggtag

SEQ ID NO: 38178 - DNA, 1548 bp, Artificial Sequence
  Description of Artificial Sequence: Synthetic coding sequence
atggtgtcctctgtgctgtgccgctgtgtggccagccccccaccagatgctgctgccacagctgccagcagcagcgccagcagccctgcctctgtgggggacccctgtggcggggccatctgtggcggccctgaccaccggctgcggctgtggaggctcttccagaccctggatgtgaacagagatggcggcctgtgtgtgaatgacctggccgtgggcctgcggcggctgggcctgcacaggacagaaggagagctgcagaagatcgtgcaggccggggacaaggacctggatggccagctggactttgaggagtttgtgcactacctgcaggaccacgagaagaagctgcggctggtgttcaagagcctggacaagaagaatgatggaagaattgatgcccaggagatcatgcagagcctgcgggacctgggcgtgaagatcagcgagcagcaggccgagaagatcctgaagaggatcagaacaggccacttctggggccctgtgacctacatggacaagaatggcaccatgaccatcgactggaatgagtggagggactaccacctgctgcaccctgtggagaacatccctgagatcatcctgtactggaagcacagcaccatctttgatgtgggggagaacctgactgtgcctgatgagttcaccgtggaggagcggcagacaggcatgtggtggaggcacctggtggccggcggcggggccggggctgtgtccaggacctgcacagcccccctggaccggctgaaggtgctgatgcaggtgcacgccagccgcagcaacaacatgggcatcgtgggcggcttcacccagatgatccgggagggcggggcccggagcctgtggagaggaaatggcatcaacgtgctgaagatcgcccctgagagcgccatcaagttcatggcctatgagcagatcaagaggctggtgggcagtgaccaggagaccctgcgcatccacgagcggctggtggccggcagcctggccggggccatcgcccagagcagcatctaccccatggaggtgctgaagaccaggatggccctgaggaagacaggccagtacagcggcatgctggactgtgcccggcgcatcctggcccgggagggcgtggccgccttctacaagggctacgtgcccaacatgctgggcatcatcccctatgccggcatcgacctggccgtgtatgagaccctgaagaatgcctggctgcagcactatgctgtgaacagcgctgaccccggggtgtttgtgctgctggcctgtggcaccatgagcagcacctgtggccagctggccagctaccccctggccctggtgaggaccaggatgcaggcccaggccagcattgaaggagcccctgaggtgaccatgagcagcctcttcaagcacatcctgaggacagaaggagccttcggcctgtaccggggcctggcccccaacttcatgaaggtgatcccagctgtgtccatctcctatgtggtgtatgagaacctgaagatcaccctgggcgtgcagagcaggtag

SEQ ID NO: 38179 - DNA, 1470 bp, Artificial Sequence
  Description of Artificial Sequence: Synthetic coding sequence
atgctgcagatgctgtggcacttcctggccagcttcttcccccgggccggctgccacggcagccgggagggagatgaccgggaggtgcggggcaccccagccccagcctggagggaccagatggccagcttcctgggcaagcaggacggccgggcagaggccacagagaagaggcccaccatcctgctggtggtgggccctgctgagcagttccccaagaagatcgtgcaggccggggacaaggacctggatggccagctggactttgaggagtttgtgcactacctgcaggaccacgagaagaagctgcggctggtgttcaagagcctggacaagaagaatgatggaagaattgatgcccaggagatcatgcagagcctgcgggacctgggcgtgaagatcagcgagcagcaggccgagaagatcctgaagtccatggacaagaatggcaccatgaccatcgactggaatgagtggagggactaccacctgctgcaccctgtggagaacatccctgagatcatcctgtactggaagcacagcaccatctttgatgtgggggagaacctgactgtgcctgatgagttcaccgtggaggagcggcagacaggcatgtggtggaggcacctggtggccggcggcggggccggggctgtgtccaggacctgcacagcccccctggaccggctgaaggtgctgatgcaggtgcacgccagccgcagcaacaacatgggcatcgtgggcggcttcacccagatgatccgggagggcggggcccggagcctgtggagaggaaatggcatcaacgtgctgaagatcgcccctgagagcgccatcaagttcatggcctatgagcagatcaagaggctggtgggcagtgaccaggagaccctgcgcatccacgagcggctggtggccggcagcctggccggggccatcgcccagagcagcatctaccccatggaggtgctgaagaccaggatggccctgaggaagacaggccagtacagcggcatgctggactgtgcccggcgcatcctggcccgggagggcgtggccgccttctacaagggctacgtgcccaacatgctgggcatcatcccctatgccggcatcgacctggccgtgtatgagaccctgaagaatgcctggctgcagcactatgctgtgaacagcgctgaccccggggtgtttgtgctgctggcctgtggcaccatgagcagcacctgtggccagctggccagctaccccctggccctggtgaggaccaggatgcaggcccaggccagcattgaaggagcccctgaggtgaccatgagcagcctcttcaagcacatcctgaggacagaaggagccttcggcctgtaccggggcctggcccccaacttcatgaaggtgatcccagctgtgtccatctcctatgtggtgtatgagaacctgaagatcaccctgggcgtgcagagcaggtag

SEQ ID NO: 38180 - DNA, 1101 bp, Artificial Sequence
  Description of Artificial Sequence: Synthetic coding sequence
atgcagagcctgcgggacctgggcgtgaagatcagcgagcagcaggccgagaagatcctgaagtccatggacaagaatggcaccatgaccatcgactggaatgagtggagggactaccacctgctgcaccctgtggagaacatccctgagatcatcctgtactggaagcacagcaccatctttgatgtgggggagaacctgactgtgcctgatgagttcaccgtggaggagcggcagacaggcatgtggtggaggcacctggtggccggcggcggggccggggctgtgtccaggacctgcacagcccccctggaccggctgaaggtgctgatgcaggtgcacgccagccgcagcaacaacatgggcatcgtgggcggcttcacccagatgatccgggagggcggggcccggagcctgtggagaggaaatggcatcaacgtgctgaagatcgcccctgagagcgccatcaagttcatggcctatgagcagatcaagaggctggtgggcagtgaccaggagaccctgcgcatccacgagcggctggtggccggcagcctggccggggccatcgcccagagcagcatctaccccatggaggtgctgaagaccaggatggccctgaggaagacaggccagtacagcggcatgctggactgtgcccggcgcatcctggcccgggagggcgtggccgccttctacaagggctacgtgcccaacatgctgggcatcatcccctatgccggcatcgacctggccgtgtatgagaccctgaagaatgcctggctgcagcactatgctgtgaacagcgctgaccccggggtgtttgtgctgctggcctgtggcaccatgagcagcacctgtggccagctggccagctaccccctggccctggtgaggaccaggatgcaggcccaggccagcattgagggcgcccctgaggtgaccatgagcagcctcttcaagcacatcctgaggacagagggcgccttcggcctgtaccggggcctggcccccaacttcatgaaggtgatcccagctgtgtccatctcctatgtggtgtatgagaacctgaagatcaccctgggcgtgcagagcaggtag

SEQ ID NO: 38181 - DNA, 894 bp, Artificial Sequence; identical to SEQ ID NO: 35786
  Description of Artificial Sequence: Synthetic coding sequence

SEQ ID NO: 38182 - DNA, 912 bp, Artificial Sequence
  Description of Artificial Sequence: Synthetic coding sequence
atggccctggacttcctggccggctgtgccggcggcgtggccggcgtgctggtgggccacccctttgacacagtgaaggtgcggctgcaggtgcagagcgtggagaagccccagtaccggggcaccctgcactgcttcaagagcatcatcaagcaggagagcgtgctgggcctgtacaagggcctgggcagccccctgatgggcctgaccttcatcaatgccctggtgtttggagtgcagggcaacaccctgcgggccctgggccatgacagccccctgaaccagttcctggccggggctgctgctggggccatccagtgtgtgatctgctgccccatggagctggccaagacccggctgcagctgcaggatgctggccctgcccggacctacaagggcagcctggactgcctggcccagatctacggccacgagggcctgcggggcgtgaacagaggcatggtgtccaccctgctgcgggagacccccagctttggagtgtacttcctgacctatgatgccctgacccgggccctgggctgtgagcccggggaccggctgctggtgcccaagctgctgctggccggcggcaccagcggcatcgtgtcctggctgagcacctaccctgtggatgtggtgaagagccggctgcaggctgatggcctgcggggggccccccgctaccggggcatcctggactgtgtgcaccagagctacagagctgagggctggagggtcttcacccggggcctggccagcaccctgctgcgggccttccctgtgaatgctgccacctttgccaccgtgacagtggtgctgacctacgcccggggggaggaggccggccctgagggggaggccgtgcctgctgccccagctggccctgccctggcccagcccagcagcctgtag

SEQ ID NO: 38183 - DNA, 714 bp, Artificial Sequence
  Description of Artificial Sequence: Synthetic coding sequence
atgggcctgaccttcatcaatgccctggtgtttggagtgcagggcaacaccctgcgggccctgggccatgacagccccctgaaccagttcctggccggggctgctgctggggccatccagtgtgtgatctgctgccccatggagctggccaagacccggctgcagctgcaggatgctggccctgcccggacctacaagggcagcctggactgcctggcccagatctacggccacgagggcctgcggggcgtgaacagaggcatggtgtccaccctgctgcgggagacccccagctttggagtgtacttcctgacctatgatgccctgacccgggccctgggctgtgagcccggggaccggctgctggtgcccaagctgctgctggccggcggcaccagcggcatcgtgtcctggctgagcacctaccctgtggatgtggtgaagagccggctgcaggctgatggcctgcggggggccccccgctaccggggcatcctggactgtgtgcaccagagctacagagctgagggctggagggtcttcacccggggcctggccagcaccctgctgcgggccttccctgtgaatgctgccacctttgccaccgtgacagtggtgctgacctacgcccggggggaggaggccggccctgagggggaggccgtgcctgctgccccagctggccctgccctggcccagcccagcagcctgtag

SEQ ID NO: 38184 - DNA, 714 bp, Artificial Sequence; identical to SEQ ID NO: 38183
  Description of Artificial Sequence: Synthetic coding sequence

SEQ ID NO: 38185 - DNA, 714 bp, Artificial Sequence; identical to SEQ ID NO: 38183
  Description of Artificial Sequence: Synthetic coding sequence

SEQ ID NO: 38186 - DNA, 714 bp, Artificial Sequence; identical to SEQ ID NO: 38183
  Description of Artificial Sequence: Synthetic coding sequence

SEQ ID NO: 38187 - DNA, 936 bp, Artificial Sequence
  Description of Artificial Sequence: Synthetic coding sequence
atgagccagagggacaccctggtgcacctgtttgctgggggctgcggcggcaccgtgggcgccatcctgacctgccccctggaggtggtgaagacccggctgcagagcagctctgtgaccctgtacatcagcgaggtgcagctgaacaccatggccggggcctctgtgaacagagtggtgtccccaggccccctgcactgcctgaaggtgatcctggagaaggagggccccaggagcctcttccggggcctgggccccaacctggtgggcgtggcccccagccgggccatctactttgctgcctacagcaactgcaaggagaagctgaatgatgtgtttgatcctgacagcacccaggtgcacatgatctctgctgccatggccggcttcaccgccatcacagccaccaaccccatctggctgatcaagacccggctgcagctggatgccaggaacagaggagagaggaggatgggcgcctttgaatgtgtgaggaaggtgtaccagacagatggcctgaagggcttctaccggggcatgtctgccagctatgccggcatcagcgagaccgtcatccacttcgtcatctatgagagcatcaagcagaagctgctggagtacaagacagccagcaccatggagaatgatgaggagagcgtgaaggaggccagtgactttgtgggcatgatgctggccgccgccaccagcaagacctgtgccaccaccatcgcctacccccatgaggtggtgaggacccggctgcgggaggagggcaccaagtaccgctccttcttccagaccctgagcctgctggtgcaggaggagggctacggcagcctgtaccggggcctgaccacccacctggtgcggcagatccccaacacagccatcatgatggccacctatgagctggtggtgtacctgctgaatggatag

SEQ ID NO: 38188 - DNA, 933 bp, Artificial Sequence
  Description of Artificial Sequence: Synthetic coding sequence
atgagccagagggacaccctggtgcacctgtttgctgggggctgcggcggcaccgtgggcgccatcctgacctgccccctggaggtggtgaagacccggctgcagagcagctctgtgaccctgtacatcagcgaggtgcagctgaacaccatggccggggcctctgtgaacagagtggtgtccccaggccccctgcactgcctgaaggtgatcctggagaaggagggccccaggagcctcttccggggcctgggccccaacctggtgggcgtggcccccagccgggccatctactttgctgcctacagcaactgcaaggagaagctgaatgatgtgtttgatcctgacagcacccaggtgcacatgatctctgctgccatggccggcttcaccgccatcacagccaccaaccccatctggctgatcaagacccggctgcagctggatgccaggaacagaggagagaggaggatgggcgcctttgaatgtgtgaggaaggtgtaccagacagatggcctgaagggcttctaccggggcatgtctgccagctatgccggcatcagcgagaccgtcatccacttcgtcatctatgagagcatcaagcagaagctgctggagtacaagacagccagcaccatggagaatgatgaggagagcgtgaaggaggccagtgactttgtgggcatgatgctggccgccgccaccagcaagacctgtgccaccaccatcgcctacccccacgtggtgaggacccggctgcgggaggagggcaccaagtaccgctccttcttccagaccctgagcctgctggtgcaggaggagggctacggcagcctgtaccggggcctgaccacccacctggtgcggcagatccccaacacagccatcatgatggccacctatgagctggtggtgtacctgctgaatggatag

SEQ ID NO: 38189 - DNA, 927 bp, Artificial Sequence
  Description of Artificial Sequence: Synthetic coding sequence
atggactttgtggccggggccatcggcggcgtgtgtggggtggccgtgggctaccccctggacacagtgaaggtgcgcatccagacagagcccaagtacacaggcatctggcactgtgtgcgggacacctaccaccgggagcgggtgtggggcttctaccggggcctgagcctgcctgtgtgcaccgtgtccctggtgtcctctgtgtcctttggcacctaccgccactgcctggcccacatctgccgcctgcgctatggcaacccagatgccaagcccaccaaggctgacatcaccctgagcggctgtgccagcggcctggtgcgggtcttcctgaccagccccacagaggtggccaaggtgcggctgcagacccagacccaggcccagaagcagcagaggcggctgagcgccagcggccccctggccgtgccccccatgtgccctgtgcccccagcctgcccagagcccaagtaccggggccccctgcactgcctggccaccgtggcccgggaggagggcctgtgtggcctgtacaagggcagcagcgccctggtgctgagagatggccacagctttgccacctacttcctgtcctatgctgtgctgtgtgagtggctgagccctgctggccacagcaggccagatgtgcctggggtgctggtggccggcggctgtgccggcgtgctggcctgggccgtggccacccccatggatgtgatcaagagccggctgcaggctgatggccagggccagaggcgctaccggggcctgctgcactgcatggtgacctctgtgcgggaggagggcccccgggtgctcttcaagggcctggtgctgaactgctgccgggccttccctgtgaacatggtggtgtttgtggcctatgaggccgtgctgcggctggcccggggcctgctgacctag

SEQ ID NO: 38190 - DNA, 876 bp, Artificial Sequence
  Description of Artificial Sequence: Synthetic coding sequence
atgggcagcttccagctggaggactttgctgctggctggattggaggagctgcctctgtgattgtgggccaccccctggacacagtgaagacccggctgcaggccggcgtgggctacggcaacaccctgagctgcatccgggtggtgtacagaagagagagcatgtttggcttcttcaagggcatgtccttccccctggccagcattgctgtgtacaacagcgtggtgtttggagtcttcagcaacacccagcgcttcctgagccagcaccgctgtggggagcctgaggccagcccccccaggaccctgagtgacctgctgctggcctccatggtggccggcgtggtgtctgtgggcctgggcggccctgtggacctgatcaagatccggctgcagatgcagacccagcccttcagagatgccaacctgggcctgaagagcagagctgtggccccagctgagcagcctgcctaccagggccctgtgcactgcatcaccaccatcgtgagaaatgaaggcctggccggcctgtacagaggagccagcgccatgctgctgagagatgtgcccggctactgcctgtacttcatcccctacgtgttcctgtctgagtggatcaccccagaggcctgcaccggccccagcccctgtgctgtgtggctggccggcggcatggccggcaagggcagcagctcctggagcaggacccctgtgcaggccacagctgtgggccagctgggcaactgccacgccctgctgagccctgggggcggccaggacaccttccgctacagccccaacaacagcctgctgggcacctacagcgtgcccggccccctgcccccccagagccaccccttccccatgcagctgtag

SEQ ID NO: 38191 - DNA, 474 bp, Artificial Sequence
  Description of Artificial Sequence: Synthetic coding sequence
atgggcagcttccagctggaggactttgctgctggctggattggaggagctgcctctgtgattgtgggccaccccctggacacagtgaagacccggctgcaggccggcgtgggctacggcaacaccctgagctgcatccgggtggtgtacagaagagagagcatgtttggcttcttcaagggcatgtccttccccctggccagcattgctgtgtacaacagcgtggtgtttggagtcttcagcaacacccagcgcttcctgagccagcaccgctgtggggagcctgaggccagcccccccaggaccctgagtgacctgctgctggcctccatggtggccggcgtggtgtctgtgggcctgggcggccctgtggacctgatcaagatccggctgcagatgcagacccagcccttcagagatggaggagagcacaggatgaccaccgtcttccctggcccccacctgtgcatgtag

SEQ ID NO: 38192 - DNA, 936 bp, Artificial Sequence
  Description of Artificial Sequence: Synthetic coding sequence
atgggcagcttccagctggaggactttgctgctggctggattggaggagctgcctctgtgattgtgggccaccccctggacacagtgaagacccggctgcaggccggcgtgggctacggcaacaccctgagctgcatccgggtggtgtacagaagagagagcatgtttggcttcttcaagggcatgtccttccccctggccagcattgctgtgtacaacagcgtggtgtttggagtcttcagcaacacccagcgcttcctgagccagcaccgctgtggggagcctgaggccagcccccccaggaccctgagtgacctgctgctggcctccatggtggccggcgtggtgtctgtgggcctgggcggccctgtggacctgatcaagatccggctgcagatgcagacccagcccttcagagatgccaacctgggcctgaagagcagagctgtggccccagctgagcagcctgcctaccagggccctgtgcactgcatcaccaccatcgtgagaaatgaaggcctggccggcctgtacagaggagccagcgccatgctgctgagagatgtgcccggctactgcctgtacttcatcccctacgtgttcctgtctgagtggatcaccccagaggcctgcaccggccccagcccctgtgctgtgtggctggccggcggcatggccggggccatctcctggggcacagccacccccatggatgtggtgaagagccggctgcaggctgatggagtgtacctgaacaagtacaagggcgtgctggactgcatcagccagagctaccagaaggagggcctgaaggtgttcttccggggcatcaccgtgaatgctgtgcggggcttccccatgtctgctgccatgttcctgggctatgagctgagcctgcaggccatccggggggaccatgctgtgaccagcccctag

SEQ ID NO: 38193 - DNA, 774 bp, Artificial Sequence
  Description of Artificial Sequence: Synthetic coding sequence
atgtttggcttcttcaagggcatgtccttccccctggccagcattgctgtgtacaacagcgtggtgtttggagtcttcagcaacacccagcgcttcctgagccagcaccgctgtggggagcctgaggccagcccccccaggaccctgagtgacctgctgctggcctccatggtggccggcgtggtgtctgtgggcctgggcggccctgtggacctgatcaagatccggctgcagatgcagacccagcccttcagagatgccaacctgggcctgaagagcagagctgtggccccagctgagcagcctgcctaccagggccctgtgcactgcatcaccaccatcgtgagaaatgaaggcctggccggcctgtacagaggagccagcgccatgctgctgagagatgtgcccggctactgcctgtacttcatcccctacgtgttcctgtctgagtggatcaccccagaggcctgcaccggccccagcccctgtgctgtgtggctggccggcggcatggccggggccatctcctggggcacagccacccccatggatgtggtgaagagccggctgcaggctgatggagtgtacctgaacaagtacaagggcgtgctggactgcatcagccagagctaccagaaggagggcctgaaggtgttcttccggggcatcaccgtgaatgctgtgcggggcttccccatgtctgctgccatgttcctgggctatgagctgagcctgcaggccatccggggggaccatgctgtgaccagcccctag

SEQ ID NO: 38194 - DNA, 2106 bp, Artificial Sequence
  Description of Artificial Sequence: Synthetic coding sequence
atggatgagagccctgagcccctgcagcagggccggggccctgtgcctgtgcggcggcagaggcctgccccccggggcctgcgggagatgctgaaggcccggctgtggtgcagctgcagctgcagcgtgctgtgtgtgcgggccctggtgcaggacctgctgcctgccacccgctggctgcggcagtaccggccccgggagtacctggccggagatgtgatgagcggcctggtgattggcatcatcctggtgccccaggccatcgcctacagcctgctggccggcctgcagcccatctacagcctgtacaccagcttctttgccaacctgatctacttcctgatgggcaccagccgccacgtgtctgtgggcatcttcagcctgctgtgcctgatggtgggccaggtggtggaccgggagctgcagctggccggctttgaccccagccaggacggcctgcagcccggggccaacagcagcaccctgaatggatctgctgccatgctggactgtggccgggactgctacgccatccgggtggccacagccctgaccctgatgacaggcctgtaccaggtgctgatgggcgtgctgcggctgggctttgtgtctgcctacctgagccagcccctgctggatggctttgccatgggcgcctctgtgaccatcctgaccagccagctgaagcacctgctgggcgtgcgcatccccaggcaccagggccctggcatggtggtgctgacctggctgagcctgctgcggggggccggccaggccaacgtgtgtgatgtggtgaccagcacagtgtgcctggccgtgctgctggccgccaaggagctgagtgaccgctaccgccaccggctgcgggtgcccctgcccacagagctgctggtgattgtggtggccaccctggtgagccacttcggccagctgcacaagagatttggcagctctgtggccggggacatccccaccggcttcatgccaccccaggtgcctgagccccggctgatgcagagggtggccctggatgctgtggccctggccctggtggccgccgccttcagcatcagcctggccgagatgtttgcccggagccacggctacagcgtgcgggccaaccaggagctgctggccgtgggctgctgcaatgtgctgcctgccttcctgcactgctttgccaccagcgctgccctggccaagagcctggtgaagacagccaccggctgcaggacccagctgagctctgtggtgtctgccaccgtggtgctgctggtgctgctggccctggcccccctcttccatgacctgcagaggtctgtgctggcctgcgtcatcgtggtgtccctgcggggggccctgaggaaggtgtgggacctgccccggctgtggaggatgagccctgcagatgccctggtgtgggccggcacagctgccacctgcatgctggtgtccacagaggccggcctgctggccggggtcatcctgagcctgctgagcctggccggccgcacccagaggcccaggacagccctgctggcccgcatcggggacacagccttctatgaagatgccacagaatttgagggcctggtgcctgagcccggggtgcgggtcttccgctttggaggccccctgtactatgccaacaaggacttcttcctgcagagcctgtacagcctgaccggcctggatgctggctgcatggccgcccggaggaaggagggcggcagcgagaccggggtgggggagggcggccctgcccagggcgaggacctgggccctgtgtccacccgggccgccctggtgcctgctgctgctggcttccacacagtggtgattgactgtgcccccctgctcttcctggatgctgctggggtgtccaccctgcaggacctgcggcgggactatggagccctgggcatcagcctgctgctggcctgctgcagcccccctgtgcgggacatcctgagccggggcggcttcctgggggagggccctggggacacagctgaggaggagcagctgttcctgtctgtgcatgatgctgtgcagacagcccgggcccggcaccgggagctggaggccacagatgcccacctgtag

SEQ ID NO: 38195 - DNA, 2106 bp, Artificial Sequence; identical to SEQ ID NO: 38194
  Description of Artificial Sequence: Synthetic coding sequence

SEQ ID NO: 38196 - DNA, 675 bp, Artificial Sequence
  Description of Artificial Sequence: Synthetic coding sequence
atggatgagagccctgagcccctgcagcagggccggggccctgtgcctgtgcggcggcagaggcctgccccccggggcctgcgggagatgctgaaggcccggctgtggtgcagctgcagctgcagcgtgctgtgtgtgcgggccctggtgcaggacctgctgcctgccacccgctggctgcggcagtaccggccccgggagtacctggccggagatgtgatgagcggcctggtgattggcatcatcctggtgccccaggccatcgcctacagcctgctggccggcctgcagcccatctacagcctgtacaccagcttctttgccaacctgatctacttcctgatgggcaccagccgccacgtgtctgtgggcatcttcagcctgctgtgcctgatggtgggccaggtggtggaccgggagctgcagctggccggctttgaccccagccaggacggcctgcagcccggggccaacagcagcaccctgaatggatctgctgccatgctggactgtggccgggactgctacgccatccgggtggccacagccctgaccctgatgacaggcctgtaccagacctcctggggcagaaattccttccagcagcacccctggcagctgacccagaggagtgacagccaggagctgctggaggaggaggagaggagctgctag

SEQ ID NO: 38197 - DNA, 1365 bp, Artificial Sequence
  Description of Artificial Sequence: Synthetic coding sequence
atgaggctggacctggccagcctgatgtctgcccccaagagcctgggcagcgccttcaagtcctggaggctggacaaggcccccagcccccagcacaccttccccagcaccagcatccctggcatggcctttgccctgctggcctctgtgccccctgtgtttggcctgtacaccagcttcttccctgtgctgatctacagcctgctgggcaccggccgccacctgagcacaggcacctttgccatcctgagcctgatgactggatctgctgtggagcggctggtgcctgagcccctggtgggcaacctgagcggcatcgagaaggagcagctggatgcccagagggtgggcgtggccgctgctgtggccttcggcagcggggccctgatgctgggcatgtttgtgctgcagctgggcgtgctgagcaccttcctgtctgagcctgtggtgaaggccctgaccagcggggccgccctgcacgtgctgctgagccagctgcccagcctgctgggcctgagcctgccccggcagatcggctgcttcagcctcttcaagaccctggccagcctgctgacagccctgcccaggagcagccctgctgagctgaccatcagcgccctgagcctggccctgctggtgcctgtgaaggagctgaatgtgcgcttccgggaccggctgcccacccccatccctggagaggtggtgctggtgctgctggcctctgtgctgtgcttcaccagctctgtggacacccgctaccaggtgcagatcgtgggcctgctgcccggcggcttcccccagcccctgctgcccaacctggccgagctgccccgcatcctggccgacagcctgcccatcgccctggtgtcctttgctgtgtctgccagcctggccagcatccacgccgacaagtacagctacaccatcgacagcaaccaggagttcctggcccacggggccagcaacctgatcagcagcctcttcagctgcttccccaacagcgccaccctggccaccaccaacctgctggtggatgctgggggcaagacccagctggccggcctcttcagctgcaccgtggtgctgtctgtgctgctgtggctgggccccttcttctactacctgcccaaggctgtgctggcctgcatcaacatcagctccatgaggcaggtgttctgccagatgcaggagctgccccagctgtggcacatcagccgggtggactttgctgtgtggatggtgacctgggtggccgtggtgaccctgtctgtggacctgggcctggccgtgggcgtggtgttctccatgatgacagtggtgtgcaggaccaggagcagcagccgcagccggggcagcgccagctag

SEQ ID NO: 38198 - DNA, 1821 bp, Artificial Sequence
  Description of Artificial Sequence: Synthetic coding sequence
atgcccagctctgtgacagccctgggccaggcccggagcagcggccctggcatggcccccagcgcctgctgctgcagccctgctgccctgcagaggcggctgcccatcctggcctggctgcccagctacagcctgcagtggctgaagatggactttgtggccggcctgtctgtgggcctgacagccatcccccaggccctggcctatgcagaggtggccggcctgcccccccagtatggcctgtacagcgccttcatgggctgctttgtgtacttcttcctgggcaccagcagagatgtgaccctgggccccacagccatcatgagcctgctggtgtccttctacaccttccacgagcccgcctatgctgtgctgctggccttcctgagcggctgcatccagctggccatgggcgtgctgcggctgggcttcctgctggacttcatctcctaccctgtgatcaagggcttcaccagcgctgctgctgtgaccatcggcttcggccagatcaagaacctgctgggcctgcagaacatcccccggcccttcttcctgcaggtgtaccacaccttcctgagaattgctgagaccagggtgggagatgctgtgctgggcctggtgtgcatgctgctgctgctggtgctgaagctgatgagggaccacgtgccccctgtgcaccctgagatgcctcctggggtgcggctgagccggggcctggtgtgggccgccaccacagccagaaatgccctggtggtgtcctttgctgccctggtggcctacagctttgaggtgacaggctaccagcccttcatcctgactggagaaacagctgagggcctgccccctgtgcgcatcccccccttctctgtgaccacagccaacggcaccatctccttcacagagatggtgcaggacatgggcgccggcctggccgtggtgcccctgatgggcctgctggagagcattgctgtggccaaggcctttgccagccagaacaactacagaattgatgccaaccaggagctgctggccatcggcctgaccaacatgctgggcagcctggtgtcctcctaccctgtgacaggcagctttggccgcacagctgtgaatgcccagagcggcgtgtgcaccccagctgggggcctggtgactggagtgctggtgctgctgagcctggactacctgaccagcctcttctactacatccccaagagcgccctggccgctgtgatcatcatggctgtggcccccctgtttgacaccaagatcttccgcaccctgtggagggtgaagaggctggacctgctgcccctgtgtgtgaccttcctgctgtgcttctgggaggtgcagtatggcatcctggccggggccctggtgtccctgctgatgctgctgcacagcgctgcccggcctgagaccaaggtgtctgagggccctgtgctggtgctgcagcctgccagcggcctgtccttccctgccatggaggccctgcgggaggagatcctgagccgggccctggaggtgagccccccacgctgcctggtgctggagtgcacccacgtgtgcagcattgactacacagtggtgctgggcctgggggagctgctgcaggacttccagaagcagggcgtggccctggcctttgtgggcctgcaggtgcctgtgctgcgggtgctgctgtctgctgacctgaagggcttccagtacttcagcaccctggaggaggccgagaagcacctgcggcaggagcccggcacccagccctacaacatcagagaagattccatcctggaccagaaggtggccctgctgaaggcctag

SEQ ID NO: 38199 - DNA, 1821 bp, Artificial Sequence; identical to SEQ ID NO: 38198
  Description of Artificial Sequence: Synthetic coding sequence

SEQ ID NO: 38200 - DNA, 1821 bp, Artificial Sequence; identical to SEQ ID NO: 38198
  Description of Artificial Sequence: Synthetic coding sequence

SEQ ID NO: 38201 - DNA, 1971 bp, Artificial Sequence
  Description of Artificial Sequence: Synthetic coding sequence
atgaccggggccaagaggaagaagaagtccatgctgtggagcaagatgcacaccccccagtgtgaggacatcatccagtggtgcagaagaaggctgcccatcctggactgggccccccactacaacctgaaggagaacctgctgcctgacacagtgtctggcatcatgctggccgtgcagcaggtgacccagggcctggcctttgctgtgctgagctctgtgcaccctgtgtttggcctgtatggcagcctcttccctgccatcatctatgccatcttcggcatgggccaccacgtggccaccggcacctttgccctgaccagcctcatcagcgccaatgctgtggagcgcatcgtgccccagaacatgcagaacctgaccacccagagcaacacctctgtgctgggcctgagtgactttgagatgcagaggatccacgtggccgctgctgtgtccttcctgggcggcgtcatccaggtggccatgtttgtgctgcagctgggcagcgccacctttgtggtgacagagcctgtgatcagcgccatgaccaccggggccgccacccacgtggtgaccagccaggtgaagtacctgctgggcatgaagatgccctacatcagcggccccctgggcttcttctacatctatgcctacgtgtttgagaacatcaagtctgtgcggctggaggccctgctgctgagcctgctgagcatcgtggtgctggtgctggtgaaggagctgaatgagcagttcaagaggaagatcaaggtggtgctgcctgtggacctggtgctgatcatcgccgccagctttgcctgctactgcaccaacatggagaacacctacggcctggaggtggtgggccacatcccccagggcatccccagcccccgggccccacccatgaacatcctgtctgctgtgatcacagaggcctttggagtggccctggtgggctacgtggccagcctggccctggcccagggcagcgccaagaagttcaagtacagcattgatgacaaccaggagttcctggcccacggcctgagcaacatcgtgtcctccttcttcttctgcatccccagcgctgctgccatgggccgcacagctggcctgtacagcactggagccaagacccaggtggcctgcctgatcagctgcatctttgtgctgattgtcatctatgccatcggccccctgctgtactggctgcccatgtgtgtgctggccagcatcatcgtggtgggcctgaagggcatgctgatccagttccgggacctgaagaagtactggaatgtggacaagattgactggggcatctgggtgtccacctacgtgttcaccatctgctttgctgccaacgtgggcctgctgtttggagtggtgtgcaccatcgccatcgtgattggccgcttcccccgggccatgacagtgtccatcaagaacatgaaggagatggagttcaaggtgaagacagagatggacagcgagaccctgcagcaggtgaagatcatcagcatcaacaaccccctggtgttcctgaatgccaagaagttctacacagacctgatgaacatgatccagaaggaaaatgcctgcaaccagcccctggatgacatcagcaaatgtgagcagaacaccctgctgaacagcctgagcaatggaaactgcaatgaggaggccagccagagctgccccaatgagaagtgctacctgatcctggactgcagcggcttcaccttctttgactacagcggcgtgtccatgctggtggaggtgtacatggactgcaagggccgctctgtggatgtgctgctggcccactgcacagccagcctcatcaaggccatgacctactacggcaacctggacagcgagaagcccatcttctttgaatctgtgtctgctgccatcagccacatccacagcaacaagaacctgagcaagctgagtgaccacagcgaggtgtag

SEQ ID NO: 38202 - DNA, 1992 bp, Artificial Sequence
  Description of Artificial Sequence: Synthetic coding sequence
atgaccggggccaagaggaagaagaagtccatgctgtggagcaagatgcacaccccccagtgtgaggacatcatccagtggtgcagaagaaggctgcccatcctggactgggccccccactacaacctgaaggagaacctgctgcctgacacagtgtctggcatcatgctggccgtgcagcaggtgacccagggcctggcctttgctgtgctgagctctgtgcaccctgtgtttggcctgtatggcagcctcttccctgccatcatctatgccatcttcggcatgggccaccacgtggccaccggcacctttgccctgaccagcctcatcagcgccaatgctgtggagcgcatcgtgccccagaacatgcagaacctgaccacccagagcaacacctctgtgctgggcctgagtgactttgagatgcagaggatccacgtggccgctgctgtgtccttcctgggcggcgtcatccaggtggccatgtttgtgctgcagctgggcagcgccacctttgtggtgacagagcctgtgatcagcgccatgaccaccggggccgccacccacgtggtgaccagccaggtgaagtacctgctgggcatgaagatgccctacatcagcggccccctgggcttcttctacatctatgcctacgtgtttgagaacatcaagtctgtgcggctggaggccctgctgctgagcctgctgagcatcgtggtgctggtgctggtgaaggagctgaatgagcagttcaagaggaagatcaaggtggtgctgcctgtggacctggtgctgatcatcgccgccagctttgcctgctactgcaccaacatggagaacacctacggcctggaggtggtgggccacatcccccagggcatccccagcccccgggccccacccatgaacatcctgtctgctgtgatcacagaggcctttggagtggccctggtgggctacgtggccagcctggccctggcccagggcagcgccaagaagttcaagtacagcattgatgacaaccaggagttcctggcccacggcctgagcaacatcgtgtcctccttcttcttctgcatccccagcgctgctgccatgggccgcacagctggcctgtacagcactggagccaagacccaggtggcctgcctgatcagctgcatctttgtgctgattgtcatctatgccatcggccccctgctgtactggctgcccatgtgtgtgctggccagcatcatcgtggtgggcctgaagggcatgctgatccagttccgggacctgaagaagtactggaatgtggacaagattgactggggcatctgggtgtccacctacgtgttcaccatctgctttgctgccaacgtgggcctgctgtttggagtggtgtgcaccatcgccatcgtgattggccgcttcccccgggccatgacagtgtccatcaagaacatgaaggagatggagttcaaggtgaagacagagatggacagcgagaccctgcagcaggtgaagatcatcagcatcaacaaccccctggtgttcctgaatgccaagaagttctacacagacctgatgaacatgatccagaaggaaaatgcctgcaaccagcccctggatgacatcagcaaatgtgagcagaacaccctgctgaacagcctgagcaatggaaactgcaatgaggaggccagccagagctgccccaatgagaagtgctacctgatcctggactgcagcggcttcaccttctttgactacagcggcgtgtccatgctggtggaggtgtacatggactgcaagggccgctctgtggatgtgctgctggcccactgcacagccagcctcatcaaggccatgacctactacggcaacctggacagcgagaagcccatcttctttgaatctgtgtctgctgccatcagccacatccacagcaacaaggccagctacaagctgctgtttgacaacctggacctgcccaccatgccacccctgtag

SEQ ID NO: 38203 - DNA, 624 bp, Artificial Sequence
  Description of Artificial Sequence: Synthetic coding sequence
atgaccggggccaagaggaagaagaagtccatgctgtggagcaagatgcacaccccccagtgtgaggacatcatccagtggtgcagaagaaggctgcccatcctggactgggccccccactacaacctgaaggagaacctgctgcctgacacagtgtctggcatcatgctggccgtgcagcaggtgacccagggcctggcctttgctgtgctgagctctgtgcaccctgtgtttggcctgtatggcagcctcttccctgccatcatctatgccatcttcggcatgggccaccacgtggccaccggcacctttgccctgaccagcctcatcagcgccaatgctgtggagcgcatcgtgccccagaacatgcagaacctgaccacccagagcaacacctctgtgctgggcctgagtgactttgagatgcagaggatccacgtggccgctgctgtgtccttcctgggcggcgtcatccaggtggccatgtttgtgctgcagctgggcagcgccacctttgtggtgacagagcctgtgatcagcgccatgaccaccggggccgccacccacgtggtgaccagccaggtgaagtacctgctgggcatgaagatgccctacatctcctag

SEQ ID NO: 38204 - DNA, 1971 bp, Artificial Sequence; identical to SEQ ID NO: 38201
  Description of Artificial Sequence: Synthetic coding sequence

SEQ ID NO: 38205 - DNA, 2913 bp, Artificial Sequence
  Description of Artificial Sequence: Synthetic coding sequence
atggcccagctggagaggtctgccatcagcggcttcagcagcaagagcagaagaaacagctttgcctatgatgtgaagcgggaggtgtacaatgaggagaccttccagcaggagcacaagaggaaggccagcagcagcggcaacatgaacatcaacatcaccaccttccgccaccacgtgcagtgccgctgctcctggcaccgcttcctgcgctgtgtgctgaccatcttccccttcctggagtggatgtgcatgtaccgcctgaaggactggctgctgggggacctgctggccggcatctctgtgggcctggtgcaggtgccccagggcctgaccctgagcctgctggcccggcagctgatcccccccctgaacatcgcctatgctgccttctgcagcagcgtcatctacgtgatcttcggcagctgccaccagatgagcatcggcagcttcttcctggtgtctgccctgctgatcaacgtgctgaaggtgagccccttcaacaacggccagctggtgatgggcagctttgtgaagaatgagttcagcgcccccagctacctgatgggctacaacaagagcctgtctgtggtggccaccaccaccttcctgaccggcatcatccagctgatcatgggcgtgctgggcctgggcttcatcgccacctacctgcctgagagcgccatgtctgcctacctggccgctgtggccctgcacatcatgctgagccagctgaccttcatcttcggcatcatgatctccttccacgccggccccatctccttcttctatgacatcatcaactactgtgtggccctgcccaaggccaacagcaccagcatcctggtgttcctgactgtggtggtggccctgcgcatcaacaagtgcatccgcatctccttcaaccagtaccccatcgagttccccatggagctgttcctgatcatcggcttcaccgtgattgccaacaagatctccatggccacagagaccagccagaccctgattgacatgatcccctacagcttcctgctgcctgtgaccccagacttcagcctgctgcccaagatcatcctgcaggccttcagcctgagcctggtgtcctccttcctgctgatcttcctgggcaagaagatcgccagcctgcacaactacagcgtgaacagcaaccaggacctgattgccatcggcctgtgcaatgtggtgagcagcttcttccgcagctgtgtgttcaccggggccatcgcccggaccatcatccaggacaagagcggcggccggcagcagtttgccagcctggtgggcgctggggtgatgctgctgctgatggtgaagatgggccacttcttctacaccctgcccaatgctgtgctggccggcatcatcctgagcaatgtcatcccctacctggagaccatcagcaacctgcccagcctgtggaggcaggaccagtatgactgtgccctgtggatgatgaccttcagcagcagcatcttcctgggcctggacatcggcctcatcatctctgtggtgtctgccttcttcatcaccaccgtgcgcagccaccgggccaagatcctgctgctgggccagatccccaacaccaacatctaccgcagcatcaatgactaccgggagatcatcaccatccctggggtgaagatcttccagtgctgcagcagcatcacctttgtgaatgtgtactacctgaagcacaagctgctgaaggaggtggacatggtgaaggtgcccctgaaggaggaggagatcttcagcctcttcaacagcagtgacaccaacctgcagggcggcaagatctgccgctgcttctgcaactgtgatgacctggagcccctgccccgcatcctgtacacagaaagatttgagaacaagctggaccctgaggccagcagcatcaacctgatccactgcagccactttgagagcatgaacaccagccagacagccagcgaggaccaggtgccctacacagtgtcctctgtgtcccagaagaaccagggccagcagtatgaggaggtggaggaggtgtggctgcccaacaacagcagcaggaacagcagccctggcctgcctgatgtggccgagagccagggccgccgcagcctcatcccctacagtgatgccagcctgctgcccagcgtgcacaccatcatcctggacttctccatggtgcactacgtggacagccggggcctggtggtgctgcggcagatctgcaatgccttccagaatgccaacatcctgatcctgattgctggctgccacagcagcatcgtgcgggcctttgaaagaaatgacttctttgatgctggcatcaccaagacccagctgttcctgtctgtgcatgatgctgtgctgtttgccctgagcaggaaggtgattggcagcagcgagctgagcattgatgaaagtgaaacagtcatccgggagacctacagcgagacagacaagaatgacaacagccgctacaagatgagcagcagcttcctgggcagccagaagaatgtgtccccaggcttcatcaagatccagcagcctgtggaggaggagagcgagctggacctggagctggagagcgagcaggaggccggcctgggcctggacctggacctggaccgggagctggagcctgagatggagcccaaggccgagacagagaccaagacccagacagagatggagccccagcctgagacagagcctgagatggagcccaaccccaagagccggccccgggcccacaccttcccccagcagcgctactggcccatgtaccaccccagcatggccagcacccagagccagacccagaccaggacctggagcgtggagaggagaagacaccccatggacagctacagccctgagggcaacagcaatgaagatgtgtag

SEQ ID NO: 38206 - DNA, 2598 bp, Artificial Sequence
  Description of Artificial Sequence: Synthetic coding sequence
atggcccagctggagaggtctgccatcagcggcttcagcagcaagagcagaagaaacagctttgcctatgatgtgaagcgggaggtgtacaatgaggagaccttccagcaggagcacaagaggaaggccagcagcagcggcaacatgaacatcaacatcaccaccttccgccaccacgtgcagtgccgctgctcctggcaccgcttcctgcgctgtgtgctgaccatcttccccttcctggagtggatgtgcatgtaccgcctgaaggactggctgctgggggacctgctggccggcatctctgtgggcctggtgcaggtgccccagggcctgaccctgagcctgctggcccggcagctgatcccccccctgaacatcgcctatgctgccttctgcagcagcgtcatctacgtgatcttcggcagctgccaccagatgagcatcggcagcttcttcctggtgtctgccctgctgatcaacgtgctgaaggtgagccccttcaacaacggccagctggtgatgggcagctttgtgaagaatgagttcagcgcccccagctacctgatgggctacaacaagagcctgtctgtggtggccaccaccaccttcctgaccggcatcatccagatcatcggcttcaccgtcatcgccaacaagatctccatggccacagagaccagccagaccctgattgacatgatcccctacagcttcctgctgcctgtgaccccagacttcagcctgctgcccaagatcatcctgcaggccttcagcctgagcctggtgagcagcttcctgctgatcttcctgggcaagaagatcgccagcctgcacaactacagcgtgaacagcaaccaggacctgattgccatcggcctgtgcaatgtggtgtcctccttcttccgcagctgtgtgttcaccggggccatcgcccggaccatcatccaggacaagagcggcggccggcagcagtttgccagcctggtgggcgccggcgtgatgctgctgctgatggtgaagatgggccacttcttctacaccctgcccaatgctgtgctggccggcatcatcctgagcaatgtcatcccctacctggagaccatcagcaacctgcccagcctgtggaggcaggaccagtatgactgtgccctgtggatgatgaccttcagcagcagcatcttcctgggcctggacatcggcctcatcatctctgtggtgtctgccttcttcatcaccaccgtgcgcagccaccgggccaagatcctgctgctgggccagatccccaacaccaacatctaccgcagcatcaatgactaccgggagatcatcaccatccctggggtgaagatcttccagtgctgcagcagcatcacctttgtgaatgtgtactacctgaagcacaagctgctgaaggaggtggacatggtgaaggtgcccctgaaggaggaggagatcttcagcctcttcaacagcagtgacaccaacctgcagggcggcaagatctgccgctgcttctgcaactgtgatgacctggagcccctgccccgcatcctgtacacagaaagatttgagaacaagctggaccctgaggccagcagcatcaacctgatccactgcagccactttgagagcatgaacaccagccagacagccagcgaggaccaggtgccctacacagtgtcctctgtgtcccagaagaaccagggccagcagtatgaggaggtggaggaggtgtggctgcccaacaacagcagcaggaacagcagccctggcctgcctgatgtggccgagagccagggcagaagaagcctcatcccctacagtgatgccagcctgctgcccagcgtgcacaccatcatcctggacttctccatggtgcactacgtggacagccggggcctggtggtgctgcggcagatctgcaatgccttccagaatgccaacatcctgatcctgattgctggctgccacagcagcatcgtgcgggcctttgaaagaaatgacttctttgatgctggcatcaccaagacccagctgttcctgtctgtgcatgatgctgtgctgtttgccctgagcaggaaggtgattggcagcagcgagctgagcattgatgagagcgagaccgtcatccgggagacctacagcgagacagacaagaatgacaacagccgctacaagatgagcagcagcttcctgggcagccagaagaatgtgtccccaggcttcatcaagatccagcagcctgtggaggaggagagcgagctggacctggagctggagagcgagcaggaggccggcctgggcctggacctggacctggaccgggagctggagcctgagatggagcccaaggccgagacagagaccaagacccagacagagatggagccccagcctgagacagagcctgagatggagcccaaccccaagagccggccccgggcccacaccttcccccagcagcgctactggcccatgtaccaccccagcatggccagcacccagagccagacccagaccaggacctggagcgtggagcggcggcggcaccccatggacagctacagccctgagggcaacagcaatgaagatgtgtag

SEQ ID NO: 38207 - DNA, 2913 bp, Artificial Sequence; identical to SEQ ID NO: 38205
  Description of Artificial Sequence: Synthetic coding sequence

SEQ ID NO: 38208 - DNA, 2664 bp, Artificial Sequence
  Description of Artificial Sequence: Synthetic coding sequence
atgagccagccccggccccgctacgtggtggacagagctgcctacagcctgaccctgtttgatgatgaatttgagaagaaggacaggacctaccctgtgggggagaagctgagaaatgccttccgctgcagcagcgccaagatcaaggctgtggtgtttggcctgctgcctgtgctgtcctggctgcccaagtacaagatcaaggactacatcatcccagacctgctgggcggcctgagcggcggcagcatccaggtgccccagggcatggcctttgccctgctggccaacctgcctgctgtgaatggcctgtacagcagcttcttccccctgctgacctacttcttcctgggcggcgtgcaccagatggtgcccggcacctttgctgtgatcagcatcctggtgggcaacatctgcctgcagctggcccctgagagcaagttccaggtgttcaacaatgccaccaatgaaagctatgtggacacagctgccatggaggccgagcggctgcacgtgtctgccaccctggcctgcctgacagccatcatccagatgggcctgggcttcatgcagtttggatttgtggccatctacctgtctgagagcttcatccggggcttcatgacagctgctggcctgcagatcctgatctctgtgctgaagtacatcttcggcctgaccatccccagctacacaggccctggcagcatcgtgttcaccttcatcgacatctgcaagaacctgccccacaccaacatcgccagcctcatctttgccctgatcagcggggccttcctggtgctggtgaaggagctgaatgcccgctacatgcacaagatccgcttccccatccccacagagatgattgtggtggtggtggccacagccatcagcggcggctgcaagatgcccaagaagtaccacatgcagatcgtgggggagatccagaggggcttccccacccctgtgtcccctgtggtgtcccagtggaaggacatgattggaacagccttcagcctggccatcgtgtcctatgtgatcaacctggccatgggccgcaccctggccaacaagcacggctatgatgtggacagcaaccaggagatgattgccctgggctgcagcaacttcttcggcagcttcttcaagatccacgtgatctgctgtgccctgtctgtgaccctggccgtggatggagctgggggcaagagccaggtggccagcctgtgtgtgtccctggtggtgatgatcaccatgctggtgctgggcatctacctgtaccccctgcccaagtctgtgctgggcgccctgattgctgtgaacctgaagaacagcctgaagcagctgacagacccctactacctgtggaggaagagcaagctggactgctgcatctgggtggtgtccttcctgagcagcttcttcctgagcctgccctacggcgtggccgtgggcgtggccttctctgtgctggtggtggtgttccagacccagttcagaaatggctacgccctggcccaggtgatggacacagacatctacgtgaaccccaagacctacaacagagcccaggacatccagggcatcaagatcatcacctactgcagccccctgtactttgccaacagcgagatcttccggcagaaggtgattgccaagacaggcatggacccccagaaggtgctgctggccaagcagaagtacctgaagaagcaggagaagaggaggatgaggcccacccagcagaggaggagcctcttcatgaagaccaagacagtgtccctgcaggagctgcagcaggactttgaaaatgccccacccacagaccccaacaacaaccagaccccagccaacggcacctctgtgtcctacatcaccttctccccagacagcagcagccctgcccagagcgagcccccagccagcgctgaggcccctggagagcccagcgacatgctggcctctgtgcccccatttgtgaccttccacaccctcatcctggacatgtctggagtgtcctttgtggacctgatgggcatcaaggccctggccaagctgagcagcacctacggcaagattggagtgaaggtgttcctggtgaacatccacgcccaggtgtacaatgacatcagccacggcggcgtgtttgaagatggcagcctggagtgcaagcacgtgttccccagcatccatgatgctgtgctgtttgcccaggccaatgccagagatgtgaccccaggccacaacttccagggcgcccctggagatgctgagctgagcctgtatgacagcgaggaggacatccgcagctactgggacctggagcaggagatgtttggctccatgttccacgccgagaccctgacagccctggagagcctgtctgctgctgggggctgctacccctacagaagtgagagcctggtgagccccctcttcacccggcaggccctggccgccatggacaagcccccagcccacagcaccccacccaccagcgccctgagcctggccgctgagggccacctggacttccagctgctgcgggtgtcccagaagcagaaggacaagtacaactgtgccggcctgctgtacaagctgcagaaggtgtcccagagcccccacggctctgtgtctgatggagtgcggctgagcaggacatag

SEQ ID NO: 38209 - DNA, 2664 bp, Artificial Sequence; identical to SEQ ID NO: 38208
  Description of Artificial Sequence: Synthetic coding sequence

SEQ ID NO: 38210 - DNA, 2376 bp, Artificial Sequence
  Description of Artificial Sequence: Synthetic coding sequence
atgagccagccccggccccgctacgtggtggacagagctgcctacagcctgaccctgtttgatgatgaatttgagaagaaggacaggacctaccctgtgggggagaagctgagaaatgccttccgctgcagcagcgccaagatcaaggctgtggtgtttggcctgctgcctgtgctgtcctggctgcccaagtacaagatcaaggactacatcatcccagacctgctgggcggcctgagcggcggcagcatccaggtgccccagggcatggcctttgccctgctggccaacctgcctgctgtgaatggcctgtacagcagcttcttccccctgctgacctacttcttcctgggcggcgtgcaccagatggtgcccggcacctttgctgtgatcagcatcctggtgggcaacatctgcctgcagctggcccctgagagcaagttccaggtgttcaacaatgccaccaatgaaagctatgtggacacagctgccatggaggccgagcggctgcacgtgtctgccaccctggcctgcctgacagccatcatccagatgggcctgggcttcatgcagtttggatttgtggccatctacctgtctgagagcttcatccggggcttcatgacagctgctggcctgcagatcctgatctctgtgctgaagtacatcttcggcctgaccatccccagctacacaggccctggcagcatcgtgttcaccttcatcgacatctgcaagaacctgccccacaccaacatcgccagcctcatctttgccctgatcagcggggccttcctggtgctggtgaaggagctgaatgcccgctacatgcacaagatccgcttccccatccccacagagatgattgtggtggtggtggccacagccatcagcggcggctgcaagatgcccaagaagtaccacatgcagatcgtgggggagatccagaggggcttccccacccctgtgtcccctgtggtgtcccagtggaaggacatgattggaacagccttcagcctggccatcgtgtcctatgtgatcaacctggccatgggccgcaccctggccaacaagcacggctatgatgtggacagcaaccaggagatgattgccctgggctgcagcaacttcttcggcagcttcttcaagatccacgtgatctgctgtgccctgtctgtgaccctggccgtggatggagctgggggcaagagccaggtggccagcctgtgtgtgtccctggtggtgatgatcaccatgctggtgctgggcatctacctgtaccccctgcccaagtctgtgctgggcgccctgattgctgtgaacctgaagaacagcctgaagcagctgacagacccctactacctgtggaggaagagcaagctggactgctgcatctgggtggtgtccttcctgagcagcttcttcctgagcctgccctacggcgtggccgtgggcgtggccttctctgtgctggtggtggtgttccagacccagttcagaaatggctacgccctggcccaggtgatggacacagacatctacgtgaaccccaagacctacaacagagcccaggacatccagggcatcaagatcatcacctactgcagccccctgtactttgccaacagcgagatcttccggcagaaggtgattgccaagacaggcatggacccccagaaggtgctgctggccaagcagaagtacctgaagaagcaggagaagaggaggatgaggcccacccagcagaggaggagcctcttcatgaagaccaagacagtgtccctgcaggagctgcagcaggactttgaaaatgccccacccacagaccccaacaacaaccagaccccagccaacggcacctctgtgtcctacatcaccttctccccagacagcagcagccctgcccagagcgagcccccagccagcgctgaggcccctggagagcccagcgacatgctggcctctgtgcccccatttgtgaccttccacaccctcatcctggacatgtctggagtgtcctttgtggacctgatgggcatcaaggccctggccaagctgagcagcacctacggcaagattggagtgaaggtgttcctggtgaacatccacgcccaggtgtacaatgacatcagccacggcggcgtgtttgaagatggcagcctggagtgcaagcacgtgttccccagcatccatgatgctgtgctgtttgcccaggccaatgccagagatgtgaccccaggccacaacttccagggcgcccctggagatgctgagctgagcctgtatgacagcgaggaggacatccgcagctactgggacctggagcaggagatgtttggctccatgttccacgccgagaccctgacagccctgtag

SEQ ID NO: 38211 - DNA, 1860 bp, Artificial Sequence
  Description of Artificial Sequence: Synthetic coding sequence
atgctgctgtcctggctgactgtgctgggcgccggcatggtggtgctgcacttcctgcagaagctgctcttcccctacttctgggatgacttctggtttgtgctgaaggtggtgctgatcatcatccggctgaagaagtatgagaagagaggagagctggtgacagtgctggacaagttcctgagccacgccaagaggcagcccaggaagcccttcatcatctatgaaggagacatctacacctaccaggatgtggacaagaggagcagccgggtggcccacgtgttcctgaaccacagcagcctgaagaagggggacacagtggccctgctgatgagcaatgaaccagactttgtgcacgtgtggtttggcctggccaagctgggctgtgtggtggccttcctgaacaccaacatccgcagcaacagcctgctgaactgcatccgggcctgtggcccccgggccctggtggtgggcgctgacctgctgggcaccgtggaggagatcctgcccagcctgtctgagaacatctctgtgtggggcatgaaggacagcgtgccccagggcgtcatcagcctgaaggagaagctgagcaccagcccagatgagcctgtgcccaggagccaccacgtggtgtccctgctgaagagcacctgcctgtacatcttcaccagcggcaccaccggcctgcccaaggccgccgtcatcagccagctgcaggtgctgcggggcagcgctgtgctgtgggccttcggctgcacagcccatgacatcgtgtacatcaccctgcccctgtaccacagcagcgctgccatcctgggcatcagcggctgtgtggagctgggcgccacctgtgtgctgaagaagaagttcagcgccagccagttctggagcgactgcaagaagtatgatgtgaccgtcttccagtacatcggggagctgtgccgctacctgtgcaagcagagcaagcgggagggggagaaggaccacaaggtgcggctggccatcggaaatggcatccgcagtgatgtgtggagggagttcctggaccgcttcggcaacatcaaggtgtgtgagctgtatgctgccacagagagcagcatctccttcatgaactacacaggaagaattggagccatcggccgcaccaacctcttctacaagctgctgagcacctttgacctgatcaagtatgacttccagaaggatgagcccatgagaaatgagcagggctggtgcatccacgtgaagaagggggagcccggcctgctgatcagccgggtgaatgccaagaaccccttcttcggctacgccggcccctacaagcacaccaaggacaagctgctgtgtgatgtgttcaagaagggagatgtgtacctgaacacaggagacctgattgtgcaggaccaggacaacttcctgtacttctgggacagaactggagacaccttccgctggaagggagaaaatgtggccaccacagaggtggctgatgtgattggcatgctggacttcatccaggaggccaacgtgtatggagtggccatcagcggctatgagggccgggccggcatggccagcatcatcctgaagcccaacaccagcctggacctggagaaggtgtatgagcaggtggtgaccttcctgcctgcctatgcctgcccccgcttcctgcgcatccaggagaagatggaggccaccggcaccttcaagctgctgaagcaccagctggtggaggatggcttcaaccccctgaagatcagcgagcccctgtacttcatggacaacctgaagaagagctatgtgctgctgacccgggagctgtatgaccagatcatgctgggggagatcaagctgtag

SEQ ID NO: 38212 - DNA, 1860 bp, Artificial Sequence; identical to SEQ ID NO: 38211
  Description of Artificial Sequence: Synthetic coding sequence

SEQ ID NO: 38213 - DNA, 1860 bp, Artificial Sequence; identical to SEQ ID NO: 38211
  Description of Artificial Sequence: Synthetic coding sequence

SEQ ID NO: 38214 - DNA, 1593 bp, Artificial Sequence
  Description of Artificial Sequence: Synthetic coding sequence
atgggctctgtgggcagccagaggctggaggagcccagcgtggccggcaccccagaccccggggtggtgatgtccttcacctttgacagccaccagctggaggaggccgctgaggccgcccagggccagggcctgcgggcccggggcgtgcctgccttcacagacaccaccctggatgagcctgtgcctgatgaccgctaccacgccatctactttgccatgctgctggccggcgtgggcttcctgctgccctacaacagcttcatcacagatgtggactacctgcaccacaagtacccaggcaccagcatcgtgtttgacatgagcctgacctacatcctggtggccctggccgctgtgctgctgaacaacgtgctggtggagcggctgaccctgcacacccgcatcacagctggctacctgctggccctgggccccctgctcttcatcagcatctgtgatgtgtggctgcagctgttcagccgggaccaggcctatgccatcaacctggccgctgtgggcaccgtggccttcggctgcaccgtgcagcagagcagcttctacggctacacaggcatgctgcccaagcgctacacccagggcgtgatgaccggggagagcacagctggggtgatgatcagcctgagccgcatcctgaccaagctgctgctgcctgatgagcgggccagcaccctcatcttcttcctggtgtctgtggccctggagctgctgtgcttcctgctgcacctgctggtgagaagaagcagatttgtgctcttctacaccacccggccccgggacagccaccggggccggcccggcctgggccggggctacggctacagagtgcaccatgatgtggtggccggagatgtgcactttgagcacccagccccagccctggccccaaatgaaagccccaaggacagccctgcccacgaggtgacaggcagcggcggggcctacatgagatttgatgtgccccggccccgggtgcagaggtcctggcccaccttccgggccctgctgctgcacagatatgtggtggcccgggtcatctgggccgacatgctgagcattgctgtgacctacttcatcaccctgtgcctcttccctggcctggagagcgagatccgccactgcatcctgggggagtggctgcccatcctgatcatggctgtgttcaacctgagtgactttgtgggcaagatcctggccgccctgcctgtggactggaggggcacccacctgctggcctgcagctgcctgcgggtggtgttcatccccctcttcatcctgtgtgtgtaccccagcggcatgcctgccctgcggcacccagcctggccctgcatcttcagcctgctgatgggcatcagcaatggctactttggatctgtgcccatgatcctggccgccggcaaggtgagccccaagcagcgggagctggccggcaacaccatgacagtgtcctacatgagcggcctgaccctgggcagcgctgtggcctactgcacctacagcctgaccagagatgcccacggcagctgcctgcacgccagcacagccaacggcagcatcctggccggcctgtag

SEQ ID NO: 38215 - DNA, 1593 bp, Artificial Sequence; identical to SEQ ID NO: 38214
  Description of Artificial Sequence: Synthetic coding sequence

SEQ ID NO: 38216 - DNA, 492 bp, Artificial Sequence
  Description of Artificial Sequence: Synthetic coding sequence
atgggctctgtgggcagccagaggctggaggagcccagcgtggccggcaccccagaccccggggtggtgatgtccttcacctttgacagccaccagctggaggaggccgctgaggccgcccagggccagggcctgcgggcccggggcgtgcctgccttcacagacaccaccctggatgagcctgtgcctgatgaccgctaccacgccatctactttgccatgctgctggccggcgtgggcttcctgctgccctacaacagcttcatcacagatgtggactacctgcaccacaagtacccaggcaccagcatcgtgtttgacatgagcctgacctacatcctggtggccctggccgctgtgctgctgaacaacgtgctggtggagcggctgaccctgcacacccgcatcacagctggctacctgctggccctgggccccctgctcttcatcagcatctgtgatgtgtggctgcagctgttcagccgggactag

SEQ ID NO: 38217 - DNA, 1707 bp, Artificial Sequence
  Description of Artificial Sequence: Synthetic coding sequence
atgctgcccggcctggccgctgctgctgcccaccgctgctcctggagcagcctgtgccgcctgcggctgcgctgcagagctgctgcctgcaaccccagcgaccggcaggagtggcagaacctggtgaccttcggcagcttcagcaacatggtgccctgcagccacccctacatcggcaccctgagccaggtgaagctgtacagcaccaacgtgcagaaggagggccagggcagccagaccctgcgggtggagaaggtgcccagctttgaaacagctgagggcattggaacagagctgaaggcccccctgaagcaggagcccctgcaggtgcgggtgaaggctgtgctgaagaagcgggagtatggcagcaagtacacccagaacaacttcatcaccggggtgcgggccatcaatgagttctgcctgaagagcagtgacctggagcagctgaggaagatcagaagaagaagcccccatgaggacacagagagcttcaccgtgtacctgcggagtgatgtggaggccaagagcctggaggtgtggggcagccctgaggccctggcccgggagaagaagctgaggaaggaggccgagattgagtaccgggagcggctcttcaggaaccagaagatcctgcgggagtacagagacttcctgggcaacaccaagcccaggagcaggacagccagcgtcttcttcaagggccctgggaaggtggtgatggtggccatctgcatcaatggcctgaactgcttcttcaagttcctggcctggatctacacaggcagcgcctccatgttcagcgaggccatccacagcctgagtgacacctgcaaccagggcctgctggccctgggcatcagcaagtctgtgcagaccccagaccccagccacccctacggcttcagcaacatgagatacatcagcagcctcatctctggagtgggcatcttcatgatgggcgccggcctgtcctggtaccacggcgtgatgggcctgctgcacccccagcccatcgagagcctgctgtgggcctactgcatcctggccggcagcctggtgtctgagggcgccaccctgctggtggccgtgaatgagctgcggagaaatgcccgggccaagggcatgtccttctacaagtatgtgatggagagccgggaccccagcaccaacgtcatcctgctggaggacacagctgctgtgctgggcgtcatcatcgccgccacctgcatgggcctgaccagcatcactggaaaccccctgtatgacagcctgggcagcctgggcgtgggcaccctgctgggcatggtgtctgccttcctgatctacaccaacacagaggccctgctgggccgcagcatccagcctgagcaggtgcagaggctgacagagctgctggagaatgaccccagcgtgcgggccatccatgatgtgaaggccacagacctgggcctgggcaaggtgcgcttcaaggccgaggtggactttgatggccgggtggtgaccaggagctacctggagaagcaggactttgaccagatgctgcaggagatccaggaggtgaagaccccagaggagctggagaccttcatgctgaagcacggggagaacatcatcgacaccctgggcgctgaggtggaccggctggagaaggagctgaagaagaggaaccctgaggtgcgccacgtggacctggagatcctgtag

SEQ ID NO: 38218 - DNA, 1191 bp, Artificial Sequence
  Description of Artificial Sequence: Synthetic coding sequence
atgtggaagcagaacctgtggaagtttggagaggccctgaagctgctgcctgagaagaagctgaggaaggaggccgagattgagtaccgggagcggctcttcaggaaccagaagatcctgcgggagtacagagacttcctgggcaacaccaagcccaggagcaggacagccagcgtcttcttcaagggccctgggaaggtggtgatggtggccatctgcatcaatggcctgaactgcttcttcaagttcctggcctggatctacacaggcagcgcctccatgttcagcgaggccatccacagcctgagtgacacctgcaaccagggcctgctggccctgggcatcagcaagtctgtgcagaccccagaccccagccacccctacggcttcagcaacatgagatacatcagcagcctcatctctggagtgggcatcttcatgatgggcgccggcctgtcctggtaccacggcgtgatgggcctgctgcacccccagcccatcgagagcctgctgtgggcctactgcatcctggccggcagcctggtgtctgagggcgccaccctgctggtggccgtgaatgagctgcggagaaatgcccgggccaagggcatgtccttctacaagtatgtgatggagagccgggaccccagcaccaacgtcatcctgctggaggacacagctgctgtgctgggcgtcatcatcgccgccacctgcatgggcctgaccagcatcactggaaaccccctgtatgacagcctgggcagcctgggcgtgggcaccctgctgggcatggtgtctgccttcctgatctacaccaacacagaggccctgctgggccgcagcatccagcctgagcaggtgcagaggctgacagagctgctggagaatgaccccagcgtgcgggccatccatgatgtgaaggccacagacctgggcctgggcaaggtgcgcttcaaggccgaggtggactttgatggccgggtggtgaccaggagctacctggagaagcaggactttgaccagatgctgcaggagatccaggaggtgaagaccccagaggagctggagaccttcatgctgaagcacggggagaacatcatcgacaccctgggcgctgaggtggaccggctggagaaggagctgaagaagaggaaccctgaggtgcgccacgtggacctggagatcctgtag

SEQ ID NO: 38219 - DNA, 1446 bp, Artificial Sequence
  Description of Artificial Sequence: Synthetic coding sequence
atgggcgccctggcccgggccctgcccagcatcctgctggccctgctgctgaccagcaccccagaggccctgggcgccaaccctggcctggtggcccgcatcacagacaagggcctgcagtatgctgcccaggagggcctgctggccctgcagagcgagctgctgcgcatcaccctgcctgacttcaccggggacctgcgcatcccccacgtgggccggggccgctatgagttccacagcctgaacatccacagctgtgagctgctgcacagcgccctgcggcctgtgcccggccagggcctgagcctgagcatcagtgacagcagcatccgggtgcagggccgctggaaggtgaggaagagcttcttcaagctgcagggcagctttgatgtgtctgtgaagggcatcagcatctctgtgaacctgctgctgggcagcgagagcagcggccggcccaccgtgacagccagcagctgcagcagtgacattgctgatgtggaggtggacatgtctggggacctgggctggctgctgaacctcttccacaaccagatcgagagcaagttccagaaggtgctggagagccgcatctgtgagatgatccagaagtctgtgtccagtgacctgcagccctacctgcagaccctgcctgtgaccacagaaattgacagctttgctgacatcgactacagcctggtggaggccccccgggccacagcccagatgctggaggtgatgttcaagggggagatcttccacaggaaccacaggagccctgtgaccctgctggccgctgtgatgagcctgcctgaggagcacaacaagatggtgtactttgccatcagtgactatgtgttcaacacagccagcctggtgtaccacgaggagggctacctgaacttcagcatcacagatgacatgatccccccagacagcaacatccggctgaccaccaagagcttccggccctttgtgccccggctggcccggctgtaccccaacatgaacctggagctgcagggctctgtgcccagcgcccccctgctgaacttcagccctggcaacctgtctgtggacccctacatggagattgatgcctttgtgctgctgcccagcagcagcaaggagcctgtgttccggctgtctgtggccaccaacgtgtctgccaccctgaccttcaacaccagcaagatcaccggcttcctgaagccaggcaaggtgaaggtggagctgaaggagagcaaggtgggcctcttcaatgctgagctgctggaggccctgctgaactactacatcctgaacaccttctaccccaagttcaatgacaagctggccgagggcttccccctgcccctgctgaagagggtgcagctgtatgacctgggcctgcagatccacaaggacttcctgttcctgggcgccaacgtgcagtacatgagggtgtag

SEQ ID NO: 38220 - DNA, 1233 bp, Artificial Sequence
  Description of Artificial Sequence: Synthetic coding sequence
atggctgctgctgctgtgggcgccggccacggggccggcggccctggagctgccagcagcagtggaggagcccgggagggcgcccgggtggccgccctgtgcctgctgtggtacgccctgtctgctggaggaaatgtggtgaacaaggtgatcctgagcgccttccccttccctgtgacagtgtccctgtgccacatcctggccctgtgtgccggcctgccccccctgctgcgggcctggagggtgcccccagcccctcctgtgtctggccctggccccagcccccaccccagcagcggccccctgctgcccccacgcttctaccccaggtatgtgctgcccctggccttcggcaagtactttgcctctgtgtctgcccacgtgtccatctggaaggtgcctgtgtcctatgcccacacagtgaaggccaccatgcccatctgggtggtgctgctgagccgcatcatcatgaaggagaagcagagcaccaaggtgtacctgagcctcatccccatcatcagcggcgtgctgctggccaccgtgacagagctgagctttgacatgtggggcctggtgtctgccctggccgccaccctgtgcttcagcctgcagaacatcttcagcaagaaggtgctgcgggacagccgcatccaccacctgcggctgctgaacatcctgggctgccacgctgtgttcttcatgatccccacctgggtgctggtggacctgagcgccttcctggtgtccagtgacctgacctacgtgtaccagtggccctggaccctgctgctgctggccgtgtctggcttctgcaactttgcccagaatgtcatcgccttcagcatcctgaacctggtgagccccctgagctacagcgtggccaatgccaccaagaggatcatggtgatcaccgtgtccctcatcatgctgagaaatcctgtgaccagcaccaacgtgctgggcatgatgacagccatcctgggcgtcttcctgtacaacaagaccaagtatgatgccaaccagcaggccaggaagcacctgctgcctgtgaccacagctgacctgagcagcaaggagcggcacaggagccccctggagaagccccacaacggcctgctcttcccccagcacggggactaccagtatggcaggaacaacatcctgacagaccacttccagtacagccggcagagctaccccaacagctacagcctgaacagatatgatgtgtag

SEQ ID NO: 38221 - DNA, 1458 bp, Artificial Sequence
  Description of Artificial Sequence: Synthetic coding sequence
atggatgtgaaggccgcccccaacggggtggccaccatcgaggaccgcatcctgcgcatcaccggctactacggctactacccaggctacagcagccagaagagcaccagccgcagctctgtgacccgctgcaagccaggggccaactgccccagcagccacagcggcatcagccggcagctgagccccctgtctgtgacagaggacagcagcgcccccatcctggagctgcagaaccagggcagcagtggagtgtgtggccaccgggtggagcggcagaacagatctgcagatgatggcacccagacccacagcgagaacagcagccaggagaaccgcatcaaggcccgctgcctgagctgcacctccatggtgctgaagggcatctggggcctgctgatcatcctgtctgtgagcagctcctgggtgggcaccacccagatcgtgaagatcacctacaagaacttctactgccccttcttcatgacctggttcagcaccaactggaacatcatgttcttccctgtgtactacagcggccacctggccacagcccaggagaagcagagccccatgaagaagttcagagaatgtagccgcatctttggagaagatggcctgaccctgaagctgttcctgaagaggacagcccccttcagcatcctgtggaccctgaccaactacctgtacctgctggccctgaagaagctgacagccacagatgtgtctgccctcttctgctgcaacaaggcctttgtgttcctgctgtcctggatcgtgctgaaggaccgcttcatgggcgtgcgcatcgtggccgccatcatggccatcaccggcatcgtgatgatggcctatgctgacaacttccacgccgacagcatcattggagtggcctttgctgtgggcagcgccagcaccagcgccctgtacaaggtgctcttcaagatgttcctgggcagcgccaactttggagaggccgcccactttgtgtccaccctgggcttcttcaacctgatcttcatctccttcacccctgtgatcctgtacttcaccaaggtggagcactggagcagctttgctgccctgccctggggctgcctgtgtggcatggccggcctgtggctggccttcaacatcctggtgaatgtgggcgtggtgctgacctaccccatcctgatcagcattggaacagtgctgtctgtgcctggaaatgctgctgtggacctgctgaagcaggaggtgatcttcaacgtggtgcggctggccgccaccatcatcatctgcatcggcttcctgctgatgctgctgcctgaggagtgggatgagatcaccctgcgcttcatcaacagcctgaaggagaagaagtctgaggagcacgtggatgatgtgacagaccccagcatccacctgcggggccggggccgggccaatggaacagtgtccatccccctggcctag

SEQ ID NO: 38222 - DNA, 975 bp, Artificial Sequence
  Description of Artificial Sequence: Synthetic coding sequence
atgtctgtggaggatggcggcatgcctggcctgggccggccccggcaggcccgctggaccctgatgctgctgctgagcacagccatgtacggggcccacgcccccctgctggccctgtgccacgtggatggccgggtgcccttccggcccagcagcgctgtgctgctgacagagctgaccaagctgctgctgtgtgccttcagcctgctggtgggctggcaggcctggccccagggccccccaccctggaggcaggccgccccctttgccctgagcgccctgctgtatggagccaacaacaacctggtgatctacctgcagcgctacatggaccccagcacctaccaggtgctgagcaacctgaagattggcagcacagctgtgctgtactgcctgtgcctgcggcaccggctgtctgtgcggcagggcctggccctgctgctgctgatggccgccggggcctgctatgctgctgggggcctgcaggtgcccggcaacaccctgcccagccccccacctgctgctgctgccagccccatgcccctgcacatcacccccctgggcctgctgctgctgatcctgtactgcctgatcagcggcctgagctctgtgtacacagagctgctgatgaagaggcagaggctgcccctggccctgcagaacctcttcctgtacacctttggagtgctgctgaacctgggcctgcatgctgggggcggcagcggccctggcctgctggagggcttcagcggctgggccgccctggtggtgctgagccaggccctgaatggcctgctgatgtctgctgtgatgaagcacggcagcagcatcacccggctgtttgtggtgtcctgcagcctggtggtgaatgctgtgctgtctgctgtgctgctgcggctgcagctgacagctgccttcttcctggccaccctgctgattggcctggccatgaggctgtactacggcagcaggtag

SEQ ID NO: 38223 - DNA, 537 bp, Artificial Sequence
  Description of Artificial Sequence: Synthetic coding sequence
atgcccctcatcctgagcatcctgtctggaaatgtgccccggctgctgctgcccggctcctggctgcacaacctgatcttccccaagagggtggccatcccagctgcccctggcaccagcgagcccctgcccctgcacttctggtgtgccagcgagagccgcagcgcctgctggaggcggctgtggcccaggcctcctggccgcttcctgaggatgggcagcaccagaggagctgagcccggcaccaagtggacagcccacgtgtgctgccacgaggcctggcagcagcaccacacccccctgtgtggggtgctgctggccggcggccagaggcgggccctgagcagccctgccacagctgctgcccacagccggctgctgcccggccacatcgcccactggccaggccacgcccctgtgctgtggcagcccctggtgcctgacaacttccacccagacagcggcccctgccgcctgggcgccaccaccaggagccccagccaggccttcctgcccctgcccagcgctgccctgtag

SEQ ID NO: 38224 - DNA, 975 bp, Artificial Sequence; identical to SEQ ID NO: 38222
  Description of Artificial Sequence: Synthetic coding sequence

SEQ ID NO: 38225 - DNA, 267 bp, Artificial Sequence
  Description of Artificial Sequence: Synthetic coding sequence
atggagaagcagtgctgcagccaccctgtgatctgcagcctgagcaccatgtacaccttcctgctgggcgccatcttcatcgccctgagcagcagccgcatcctgctggtgaagtacagcgccaatgaggagaacaagtatgactacctgcccaccaccgtgaatgtgtgcagcgagctggtgaagctggtgttctgtgtgctggtgtccttctgtgtgatcaagaaggaccaccagagcaggaacctgaagtatgcctcctggtag

SEQ ID NO: 38226 - DNA, 444 bp, Artificial Sequence
  Description of Artificial Sequence: Synthetic coding sequence
atggagaagcagtgctgcagccaccctgtgatctgcagcctgagcaccatgtacaccttcctgctgggcgccatcttcatcgccctgagcagcagccgcatcctgctggtgaagtacagcgccaatgaggagaacaagtatgactacctgcccaccaccgtgaatgtgtgcagcgagctggtgaagctggtgttctgtgtgctggtgtccttctgtgtgatcaagaaggaccaccagagcaggaacctgaagtatgcctcctggaaggagttcagtgacttcatgaagtggagcatcccagccttcctgtacttcctggacaacctgattgtgttctacgtgctgagctacctgcagcctgccatggctgtgatcttcagcaacttcagcatcatcaccacagccctgctcttccgcatcgtgctgaagaggcggctgaactag

SEQ ID NO: 38227 - DNA, 1275 bp, Artificial Sequence
  Description of Artificial Sequence: Synthetic coding sequence
atggagaagcagtgctgcagccaccctgtgatctgcagcctgagcaccatgtacaccttcctgctgggcgccatcttcatcgccctgagcagcagccgcatcctgctggtgaagtacagcgccaatgaggagaacaagtatgactacctgcccaccaccgtgaatgtgtgcagcgagctggtgaagctggtgttctgtgtgctggtgtccttctgtgtgatcaagaaggaccaccagagcaggaacctgaagtatgcctcctggaaggagttcagtgacttcatgaagtggagcatcccagccttcctgtacttcctggacaacctgattgtgttctacgtgctgagctacctgcagcctgccatggctgtgatcttcagcaacttcagcatcatcaccacagccctgctcttccgcatcgtgctgaagaggcggctgaactggatccagtgggccagcctgctgaccctcttcctgagcatcgtggccctgacagctggcaccaagaccctgcagcacaacctggccggccggggcttccaccatgatgccttcttcagccccagcaacagctgcctgctcttccgctctgagtgccccaggaaggacaactgcacagccaaggagtggaccttccctgaggccaagtggaacaccacagcccgggtcttcagccacatccggctgggcatgggccacgtgctgatcatcgtgcagtgcttcatcagctccatggccaacatctacaatgagaagatcctgaaggagggcaaccagctgacagagagcatcttcatccagaacagcaagctgtacttcttcggcatcctcttcaacggcctgaccctgggcctgcagaggagcaacagagaccagatcaagaactgtggcttcttctacggccacagcgccttctctgtggccctgatctttgtgacagccttccagggcctgtctgtggccttcatcctgaagttcctggacaacatgttccacgtgctgatggcccaggtgaccaccgtcatcatcaccaccgtgtctgtgctggtgtttgacttccggcccagcctggagttcttcctggaggcccccagcgtgctgctgagcatcttcatctacaatgccagcaagccccaggtgcctgaatatgccccccggcaggagcgcatccgggacctgagcggcaacctgtgggagaggagcagtggagatggagaggagctggagcggctgaccaagcccaagagtgatgaaagtgatgaggacaccttctag

SEQ ID NO: 38228 - DNA, 1098 bp, Artificial Sequence
  Description of Artificial Sequence: Synthetic coding sequence
atgggccgctgggccctggatgtggccttcctgtggaaggctgtgctgaccctgggcctggtgctgctgtactactgcttcagcatcggcatcaccttctacaacaagtggctgaccaagagcttccacttccccctcttcatgaccatgctgcacctggccgtcatcttcctgttcagcgccctgagccgggccctggtgcagtgcagcagccaccgggcccgggtggtgctgtcctgggccgactacctgcggcgggtggcccccacagccctggccacagccctggatgtgggcctgagcaactggagcttcctgtatgtgacagtgtccctgtacaccatgaccaagagcagcgctgtgctcttcatcctgatcttcagcctcatcttcaagctggaggagctgcgggccgccctggtgctggtggtgctgctgattgctgggggcctcttcatgttcacctacaagagcacccagttcaacgtggagggctttgccctggtgctgggcgccagcttcatcggcggcatccgctggaccctgacccagatgctgctgcagaaggccgagctgggcctgcagaaccccatcgacaccatgttccacctgcagcccctgatgttcctgggcctcttccccctgtttgctgtgtttgagggcctgcacctgagcaccagcgagaagatcttccgcttccaggacaccggcctgctgctgcgggtgctgggcagcctcttcctgggcggcatcctggccttcggcctgggcttcagcgagttcctgctggtgtccaggaccagcagcctgaccctgagcattgctggcatcttcaaggaggtgtgcaccctgctgctggccgcccacctgctgggggaccagatcagcctgctgaactggctgggctttgccctgtgcctgagcggcatcagcctgcacgtggccctgaaggccctgcacagcagaggagatggcggccccaaggccctgaagggcctgggcagcagcccagacctggagctgctgctgcggagcagccagcgggaggagggggacaatgaggaggaggagtactttgtggcccagggccagcagtag

SEQ ID NO: 38229 - DNA, 1035 bp, Artificial Sequence
  Description of Artificial Sequence: Synthetic coding sequence
atgggccgctgggccctggatgtggccttcctgtggaaggctgtgctgaccctgggcctggtgctgctgtactactgcttcagcatcggcatcaccttctacaacaagtggctgaccaagagcttccacttccccctcttcatgaccatgctgcacctggccgtcatcttcctgttcagcgccctgagccgggccctggtgcagtgcagcagccaccgggcccgggtggtgctgtcctgggccgactacctgcggcgggtggcccccacagccctggccacagccctggatgtgggcctgagcaactggagcttcctgtatgtgacagtgtccctgtacaccatgaccaagagcagcgctgtgctcttcatcctgatcttcagcctcatcttcaagctggaggagctgagcacccagttcaacgtggagggctttgccctggtgctgggcgccagcttcatcggcggcatccgctggaccctgacccagatgctgctgcagaaggccgagctgggcctgcagaaccccatcgacaccatgttccacctgcagcccctgatgttcctgggcctcttccccctgtttgctgtgtttgagggcctgcacctgagcaccagcgagaagatcttccgcttccaggacaccggcctgctgctgcgggtgctgggcagcctcttcctgggcggcatcctggccttcggcctgggcttcagcgagttcctgctggtgtccaggaccagcagcctgaccctgagcattgctggcatcttcaaggaggtgtgcaccctgctgctggccgcccacctgctgggggaccagatcagcctgctgaactggctgggctttgccctgtgcctgagcggcatcagcctgcacgtggccctgaaggccctgcacagcagaggagatggcggccccaaggccctgaagggcctgggcagcagcccagacctggagctgctgctgcggagcagccagcgggaggagggggacaatgaggaggaggagtactttgtggcccagggccagcagtag

SEQ ID NO: 38230 - DNA, 477 bp, Artificial Sequence
  Description of Artificial Sequence: Synthetic coding sequence
atgggccgctgggccctggatgtggccttcctgtggaaggctgtgctgaccctgggcctggtgctgctgtactactgcttcagcatcggcatcaccttctacaacaagtggctgaccaagagcttccacttccccctcttcatgaccatgctgcacctggccgtcatcttcctgttcagcgccctgagccgggccctggtgcagtgcagcagccaccgggcccgggtggtgctgtcctgggccgactacctgcggcgggtggcccccacagccctggccacagccctggatgtgggcctgagcaactggagcttcctgtatgtgacagtgtccctggcccggcactggagctggtggagcagcagcagccctggggtgagcagctgcagccccaccagcccccacagcagcacctggagggccagcccctggtgctggggccccaggagctctgtggcctttgctggccccagctag

SEQ ID NO: 38231 - DNA, 702 bp, Artificial Sequence
  Description of Artificial Sequence: Synthetic coding sequence
atggagctgaagagagctgccctggtgctggtggtgctgctgattgctgggggcctcttcatgttcacctacaagagcacccagttcaacgtggagggctttgccctggtgctgggcgccagcttcatcggcggcatccgctggaccctgacccagatgctgctgcagaaggccgagctgggcctgcagaaccccatcgacaccatgttccacctgcagcccctgatgttcctgggcctcttccccctgtttgctgtgtttgagggcctgcacctgagcaccagcgagaagatcttccgcttccaggacaccggcctgctgctgcgggtgctgggcagcctcttcctgggcggcatcctggccttcggcctgggcttcagcgagttcctgctggtgtccaggaccagcagcctgaccctgagcattgctggcatcttcaaggaggtgtgcaccctgctgctggccgcccacctgctgggggaccagatcagcctgctgaactggctgggctttgccctgtgcctgagcggcatcagcctgcacgtggccctgaaggccctgcacagcagaggagatggcggccccaaggccctgaagggcctgggcagcagcccagacctggagctgctgctgcggagcagccagcgggaggagggggacaatgaggaggaggagtactttgtggcccagggccagcagtag

SEQ ID NO: 38232 - DNA, 1098 bp, Artificial Sequence; identical to SEQ ID NO: 38228
  Description of Artificial Sequence: Synthetic coding sequence

SEQ ID NO: 38233 - DNA, 699 bp, Artificial Sequence
  Description of Artificial Sequence: Synthetic coding sequence
atggagctgcgggccgccctggtgctggtggtgctgctgattgctgggggcctcttcatgttcacctacaagagcacccagttcaacgtggagggctttgccctggtgctgggcgccagcttcatcggcggcatccgctggaccctgacccagatgctgctgcagaaggccgagctgggcctgcagaaccccatcgacaccatgttccacctgcagcccctgatgttcctgggcctcttccccctgtttgctgtgtttgagggcctgcacctgagcaccagcgagaagatcttccgcttccaggacaccggcctgctgctgcgggtgctgggcagcctcttcctgggcggcatcctggccttcggcctgggcttcagcgagttcctgctggtgtccaggaccagcagcctgaccctgagcattgctggcatcttcaaggaggtgtgcaccctgctgctggccgcccacctgctgggggaccagatcagcctgctgaactggctgggctttgccctgtgcctgagcggcatcagcctgcacgtggccctgaaggccctgcacagcagaggagatggcggccccaaggccctgaagggcctgggcagcagcccagacctggagctgctgctgcggagcagccagcgggaggagggggacaatgaggaggaggagtactttgtggcccagggccagcagtag

SEQ ID NO: 38234 - DNA, 1098 bp, Artificial Sequence; identical to SEQ ID NO: 38228
  Description of Artificial Sequence: Synthetic coding sequence

SEQ ID NO: 38235 - DNA, 591 bp, Artificial Sequence
  Description of Artificial Sequence: Synthetic coding sequence
atgggccgctgggccctggatgtggccttcctgtggaaggctgtgctgaccctgggcctggtgctgctgtactactgcttcagcatcggcatcaccttctacaacaagtggctgaccaagagcttccacttccccctcttcatgaccatgctgcacctggccgtcatcttcctgttcagcgccctgagccgggccctggtgcagtgcagcagccaccgggcccgggtggtgctgtcctgggccgactacctgcggcgggtggcccccacagccctggccacagccctggatgtgggcctgagcaactggagcttcctgtatgtgacagtgtccctgccccacagcagcacctggagggccagcccctggtgctggggccccaggagctctgtggcctttgctggccccagcccccgctgcagctgccggcggctgaacagcgccagccgcatccccagcaccccctgcagcacctgcagccacagctgctcctggggcagcagcctgagcctgctgtacctgaaggtgtccatctgcccccacctgaggaagagctctgtgtccaggacccagggctgcagctgtggctag

SEQ ID NO: 38236 - DNA, 477 bp, Artificial Sequence; identical to SEQ ID NO: 38230
  Description of Artificial Sequence: Synthetic coding sequence

SEQ ID NO: 38237 - DNA, 1185 bp, Artificial Sequence
  Description of Artificial Sequence: Synthetic coding sequence
atgggccgggtgtccaccagccaccagcccctgcggggcgtgcctgccccagctgacagcggggcccctgtgctgcagccccccaggatgggccgctgggccctggatgtggccttcctgtggaaggctgtgctgaccctgggcctggtgctgctgtactactgcttcagcatcggcatcaccttctacaacaagtggctgaccaagagcttccacttccccctcttcatgaccatgctgcacctggccgtcatcttcctgttcagcgccctgagccgggccctggtgcagtgcagcagccaccgggcccgggtggtgctgtcctgggccgactacctgcggcgggtggcccccacagccctggccacagccctggatgtgggcctgagcaactggagcttcctgtatgtgacagtgtccctgtacaccatgaccaagagcagcgctgtgctcttcatcctgatcttcagcctcatcttcaagctggaggagctgcgggccgccctggtgctggtggtgctgctgattgctgggggcctcttcatgttcacctacaagagcacccagttcaacgtggagggctttgccctggtgctgggcgccagcttcatcggcggcatccgctggaccctgacccagatgctgctgcagaaggccgagctgggcctgcagaaccccatcgacaccatgttccacctgcagcccctgatgttcctgggcctcttccccctgtttgctgtgtttgagggcctgcacctgagcaccagcgagaagatcttccgcttccaggacaccggcctgctgctgcgggtgctgggcagcctcttcctgggcggcatcctggccttcggcctgggcttcagcgagttcctgctggtgtccaggaccagcagcctgaccctgagcattgctggcatcttcaaggaggtgtgcaccctgctgctggccgcccacctgctgggggaccagatcagcctgctgaactggctgggctttgccctgtgcctgagcggcatcagcctgcacgtggccctgaaggccctgcacagcagaggagatggcggccccaaggccctgaagggcctgggcagcagcccagacctggagctgctgctgcggagcagccagcgggaggagggggacaatgaggaggaggagtactttgtggcccagggccagcagtag

SEQ ID NO: 38238 - DNA, 1233 bp, Artificial Sequence; identical to SEQ ID NO: 38220
  Description of Artificial Sequence: Synthetic coding sequence

SEQ ID NO: 38239 - DNA, 315 bp, Artificial Sequence
  Description of Artificial Sequence: Synthetic coding sequence
atgaaggagaagcagagcaccaaggtgtacctgagcctcatccccatcatcagcggcgtgctgctggccaccgtgacagagctgagctttgacatgtggggcctggtgtctgccctggccgccaccctgtgcttcagcctgcagaacatcttcagcaagaaggtgctgcgggacagccgcatccaccacctgcggctgctgaacatcctgggctgccacgctgtgttcttcatgatccccacctgggtgctggtggacctgagcgccttcctggtgtccagtgacctgggcctgcccagtgaaaatgtgctgtag

SEQ ID NO: 38240 - DNA, 801 bp, Artificial Sequence
  Description of Artificial Sequence: Synthetic coding sequence
atgagcagctctgtgaagaccccagccctggaggagctggtgcccggcagcgaggagaagcccaagggccgcagccccctgtcctggggcagcctgtttggccacaggtctgagaagatcgtgtttgccaagagtgatggcggcacagatgaaaatgtgctgactgtgaccatcacagagaccaccgtcatcgagagtgacctgggcgtgtggagcagccgggccctgctgtacctgaccctgtggttcttcttctccttctgcaccctcttcctgaacaagtacatcctgagcctgctgggcggggagcccagcatgctgggcgctgtgcagatgctgagcaccaccgtcatcggctgtgtgaagaccctggtgccctgctgcctgtaccagcacaaggcccggctgagctacccacccaacttcctgatgaccatgctgtttgtgggcctgatgagatttgccaccgtggtgctgggcctggtgtccctgaagaatgtggccgtgtcctttgctgagaccgtgaagagcagcgcccccatcttcaccgtcatcatgagcaggatgatcctgggggagtacacaggccggcccagcgaccgggaggagcgggaggagctgcagctgcagcccggcagaggagctgctgccagtgaccggcgcagccctgtgcccccatctgaaagacatggagtgcggccccatggagagaacctgcccggggacttccaggtgccccaggccctgcaccgggtggccctgtccatggccctgccctgccccatgctgcctgccagctag

SEQ ID NO: 38241 - DNA, 741 bp, Artificial Sequence
  Description of Artificial Sequence: Synthetic coding sequence
atgagcagctctgtgaagaccccagccctggaggagctggtgcccggcagcgaggagaagcccaagggccgcagccccctgtcctggggcagcctgtttggccacaggtctgagaagatcgtgtttgccaagagtgatggcggcacagatgaaaatgtgctgactgtgaccatcacagagaccaccgtcatcgagagtgacctgggcgtgtggagcagccgggccctgctgtacctgaccctgtggttcttcttctccttctgcaccctcttcctgaacaagtacatcctgagcctgctgggcggggagcccagcatgctgggcgctgtgcagatgctgagcaccaccgtcatcggctgtgtgaagaccctggtgccctgctgcctgtaccagcacaaggcccggctgagctacccacccaacttcctgatgaccatgctgtttgtgggcctgatgagatttgccaccgtggtgctgggcctggtgtccctgaagaatgtggccgtgtcctttgctgagaccgtgaagagcagcgcccccatcttcaccgtcatcatgagcaggatgatcctgggggagtacacaggccggcccagcgaccgggaggagcgggaggagctgcagctgcagcccggcagaggagctgctgccagtgaccggcgcagccctgtgcccccatctgaaagacatggagtgcggccccatggagagaacctgcccggggacttccaggcccagtag

SEQ ID NO: 38242 - DNA, 741 bp, Artificial Sequence; identical to SEQ ID NO: 38241
  Description of Artificial Sequence: Synthetic coding sequence

SEQ ID NO: 38243 - DNA, 966 bp, Artificial Sequence
  Description of Artificial Sequence: Synthetic coding sequence
atggccctgggcgcctgtggcctgctgctgctgctggccgtgcctggggtgtccctgcggaccctgcagcccggctgcggccggccccaggtgtctgatgctgggggccgcatcgtgggcggccatgctgccccagctggggcctggccctggcaggccagcctgcggctgcggcgggtgcacgtgtgtggcggcagcctgctgagcccccagtgggtgctgacagctgcccactgcttcagcggcagcctgaacagcagtgactaccaggtgcacctgggggagctggagatcaccctgagcccccacttcagcacagtgcggcagatcatcctgcacagcagccccagcggccagcccggcaccagcggggacatcgccctggtggagctgtctgtgcctgtgaccctgagcagccgcatcctgcctgtgtgcctgcctgaggccagtgatgacttctgccccggcatccgctgctgggtgacaggctggggctacacccgggagggggagcccctgcccccaccctacagcctgcgggaggtgaaggtgtctgtggtggacacagagacctgcagaagagactacccaggccctgggggcagcatcctgcagcctgacatgctgtgtgcccggggccctggagatgcctgccaggatgacagcggcggccccctggtgtgccaggtgaatggagcctgggtgcaggccggcaccgtgtcctggggcgagggctgcggccggcccaacagacctggggtgtacaccagggtgcctgcctacgtgaactggatccgccgccacatcacagccagcggcggcagcgagagcggctacccccggctgcccctgctggccggcttcttcctgcccggcctcttcctgctgctggtgtcctgtgtgctgctggccaagtgcctgctgcaccccagcgcagatggcacccccttccctgccccagactag

SEQ ID NO: 38244 - DNA, 1218 bp, Artificial Sequence
  Description of Artificial Sequence: Synthetic coding sequence
atgagcagctctgtgaagaccccagccctggaggagctggtgcccggcagcgaggagaagcccaagggccgcagccccctgtcctggggcagcctgtttggccacaggtctgagaagatcgtgtttgccaagagtgatggcggcacagatgaaaatgtgctgactgtgaccatcacagagaccaccgtcatcgagagtgacctgggcgtgtggagcagccgggccctgctgtacctgaccctgtggttcttcttctccttctgcaccctcttcctgaacaagtacatcctgagcctgctgggcggggagcccagcatgctgggcgctgtgcagatgctgagcaccaccgtcatcggctgtgtgaagaccctggtgccctgctgcctgtaccagcacaaggcccggctgagctacccacccaacttcctgatgaccatgctgtttgtgggcctgatgagatttgccaccgtggtgctgggcctggtgtccctgaagaatgtggccgtgtcctttgctgagaccgtgaagagcagcgcccccatcttcaccgtcatcatgagcaggatgatcctgggggagtacacaggcctgctggtgaacctgagcctcatccctgtgatgggcggcctggccctgtgcacagccacagagatctccttcaacgtgctgggcttctctgctgccctgagcaccaacatcatggactgcctgcagaatgtgttcagcaagaagctgctgagcggggacaagtaccgcttcagcgcccctgagctgcagttctacaccagcgctgctgctgtggccatgctggtgcctgcccgggtcttcttcacagatgtgcctgtgattggccgcagcggcaagagcttctcctacaaccaggatgtggtgctgctgctgctgacagatggagtgctcttccacctgcagagcgtgacagcctatgccctgatgggcaagatcagccctgtgaccttctctgtggccagcacagtgaagcacgccctgagcatctggctgtctgtgattgtgtttggaaacaagatcaccagcctgtctgctgtgggcacagccctggtgacagtgggcgtgctgctgtacaacaaggcccggcagcaccagcaggaggccctgcagagcctggccgccgccaccggccgggccccagatgacacagtggagcccctgctgccccaggacccccggcagcacccctag

SEQ ID NO: 38245 - DNA, 942 bp, Artificial Sequence
  Description of Artificial Sequence: Synthetic coding sequence
atggccctgctggtggacagagtgcggggccactggagaattgctgctggcctgctcttcaacctgctggtgtccatctgcatcgtgttcctgaacaagtggatctacgtgtaccacggcttccccaacatgagcctgaccctggtgcactttgtggtgacctggctgggcctgtacatctgccagaagctggacatctttgcccccaagagcctgccccccagccggctgctgctgctggccctgtccttctgtggctttgtggtgttcaccaacctgagcctgcagaacaacaccatcggcacctaccagctggccaaggccatgaccacccctgtgatcatcgccatccagaccttctgctaccagaagaccttcagcacccgcatccagctgaccctcatccccatcaccctgggcgtcatcctgaacagctactatgatgtgaagttcaacttcctgggcatggtgtttgctgccctgggcgtgctggtgaccagcctgtaccaggtgtgggtgggcgccaagcagcacgagctgcaggtgaacagcatgcagctgctgtactaccaggcccccatgagcagcgccatgctgctggtggccgtgcccttctttgagcctgtgtttggagagggcggcatcttcggcccctggagcgtgtctgccctgctgatggtgctgctgagcggcgtgattgccttcatggtgaacctgagcatctactggatcatcggcaacaccagccctgtgacctacaacatgtttggccacttcaagttctgcatcaccctgtttggaggctacgtgctcttcaaggaccccctgagcatcaaccaggccctgggcatcctgtgcaccctgtttggcatcctggcctacacccacttcaagctgtctgagcaggagggcagccgcagcaagctggcccagaggccctag

SEQ ID NO: 38246 - DNA, 705 bp, Artificial Sequence
  Description of Artificial Sequence: Synthetic coding sequence
atgtgccgctgccccccagagcaccatgatggccgcatgaccagcgctgaggtgggcgctgctgctgggggcgcccaggccgccggccccccagagtggcccccaggcagcccccaggccctgcggcagcccggccgggcccgggtggccatggccgccctggtgtggctgctggccggggcctccatgagcagcctgaacaagtggatcttcaccgtgcacggcttcggccggcccctgctgctgagcgccctgcacatgctggtggccgccctggcctgccacagaggagcccggcggcccatgcctgggggcacccgctgccgggtgctgctgctgagcctgaccttcggcacctccatggcctgtggaaatgtgggcctgcgggctgtgcccctggacctggcccagctggtgaccaccaccacccccctcttcaccctggccctgagcgccctgctgctgggcagaagacaccaccccctgcagctggccgccatgggccccctgtgcctgggcgccgcctgcagcctggccggggagttccgcaccccacccaccggctgcggcttcctgctggccgccacctgcctgcggggcctgaagtctgtgcagcagagcctgtccttccagatctgcaagatggagctgatgatccccatggagcgggtgaggatgaggtctgctggccagggccaggagtag

SEQ ID NO: 38247 - DNA, 1053 bp, Artificial Sequence
  Description of Artificial Sequence: Synthetic coding sequence
atgtgccgctgccccccagagcaccatgatggccgcatgaccagcgctgaggtgggcgctgctgctgggggcgcccaggccgccggccccccagagtggcccccaggcagcccccaggccctgcggcagcccggccgggcccgggtggccatggccgccctggtgtggctgctggccggggcctccatgagcagcctgaacaagtggatcttcaccgtgcacggcttcggccggcccctgctgctgagcgccctgcacatgctggtggccgccctggcctgccacagaggagcccggcggcccatgcctgggggcacccgctgccgggtgctgctgctgagcctgaccttcggcacctccatggcctgtggaaatgtgggcctgcgggctgtgcccctggacctggcccagctggtgaccaccaccacccccctcttcaccctggccctgagcgccctgctgctgggcagaagacaccaccccctgcagctggccgccatgggccccctgtgcctgggcgccgcctgcagcctggccggggagttccgcaccccacccaccggctgcggcttcctgctggccgccacctgcctgcggggcctgaagtctgtgcagcagagcgccctgctgcaggaggagcggctggatgctgtgaccctgctgtatgccaccagcctgcccagcttctgcctgctggccggggccgccctggtgctggaggccggcgtggcccccccacccacagctggggacagccggctgtgggcctgcatcctgctgagctgcctgctgtctgtgctgtacaacctggccagcttcagcctgctggccctgaccagcgccctgactgtgcacgtgctgggcaacctgactgtggtgggcaacctgatcctgagccggctgctgtttggcagccggctgagcgccctgtcctatgtgggcatcgccctgaccctgagcggcatgttcctgtaccacaactgtgaatttgtggcctcctgggccgcccggcggggcctgtggaggcgggaccagcccagcaagggcctgtag

SEQ ID NO: 38248 - DNA, 705 bp, Artificial Sequence; identical to SEQ ID NO: 38246
  Description of Artificial Sequence: Synthetic coding sequence

SEQ ID NO: 38249 - DNA, 1227 bp, Artificial Sequence
  Description of Artificial Sequence: Synthetic coding sequence
atgatccccccagagcagccccagcagcagctgcagccccccagccctgccccacccaaccacgtggtgaccaccatcgagaacctgcctgctgagggcagcggcggcggcggcagcctgagcgccagcagccgggccggcgtgcggcagaggatcaggaaggtgctgaaccgggagatgctgatctctgtggccctgggccaggtgctgagcctgctgatctgtggcatcggcctgaccagcaagtacctgtctgaggacttccacgccaacacccctgtgttccagagcttcctgaactacatcctgctcttcctggtgtacaccaccaccctggccgtgcggcagggcgaggagaacctgctggccatcctgcggcggcgctggtggaagtacatgatcctgggcctgattgacctggaggccaactacctggtggtgaaggcctaccagtacaccaccctgaccagcatccagctgctggactgcttcgtcatccctgtggtgatcctgctgtcctggttcttcctgctgatccgctacaaggctgtgcacttcatcggcatcgtggtgtgcatcctgggcatgggctgcatggtgggcgcagatgtgctggtgggccgccaccagggcgctggggagaacaagctggtgggggacctgctggtgctgggcggggccaccctgtatggcatcagcaatgtgtgggaggagtacatcatccgcaccctgagccgggtggagttcctgggcatgattggcctgtttggagccttcttcagcggcatccagctggccatcatggagcacaaggagctgctgaaggtgccctgggactggcagatcggcctgctgtatgtgggcttcagcgcctgcatgtttggcctgtacagcttcatgcctgtggtgatcaagaagaccagcgccacctctgtgaacctgagcctgctgacagctgacctgtacagcctcttctgtggcctcttcctgttccactacaagttcagcggcctgtacctgctgtccttcttcaccatcctgattggcctggtgctgtacagcagcaccagcacctacatcgcccaggacccccgggtgtacaagcagttcaggaaccccagcggccctgtggtggacctgcccaccacagcccaggtggagcccagcgtgacctacaccagcctgggccaggagacagaggaggagccccacgtgcgggtggcctag

SEQ ID NO: 38250 - DNA, 681 bp, Artificial Sequence
  Description of Artificial Sequence: Synthetic coding sequence
atggccctgtcctggttcatcctgcacgcccgctacagagtcatccacttcatcgctgtggccgtgtgcctgctgggcgtgggcaccatggtgggcgctgacatcctggccggccgggaggacaacagcggcagtgatgtgctgattggagacatcctggtgctgctgggcgccagcctgtatgccatcagcaatgtgtgtgaggagtacatcgtgaagaagctgagccggcaggagttcctgggcatggtgggcctgtttggcaccatcatcagcggcatccagctgctgattgtggagtacaaggacatcgccagcatccactgggactggaagatcgccctgctgtttgtggcctttgccctgtgcatgttctgcctgtacagcttcatgcccctggtgatcaaggtgaccagcgccacctctgtgaacctgggcatcctgacagctgacctgtacagcctgtttgtgggcctcttcctgtttggctacaagttcagcggcctgtacatcctgtccttcaccgtcatcatggtgggcttcatcctgtactgcagcacccccaccaggacagctgagcctgctgagagctctgtgccccctgtgaccagcattggaattgacaacctgggcctgaagctggaggagaacctgcaggagacccacagcgctgtgctgtag

SEQ ID NO: 38251 - DNA, 984 bp, Artificial Sequence
  Description of Artificial Sequence: Synthetic coding sequence
atgctgagcctgtgcatctgtggcacagccatcaccagccagtacctggccgagcgctacaaggtgaacacccccatgctgcagagcttcatcaactactgcctgctcttcctgatctacacagtgatgctggccttccgcagcggcagtgacaacctgctggtgatcctgaagaggaagtggtggaagtacatcctgctgggcctggctgatgtggaggccaactacgtgattgtgcgggcctaccagtacaccaccctgacctctgtgcagctgctggactgcttcggcatccctgtgctgatggccctgtcctggttcatcctgcacgcccgctacagagtcatccacttcatcgctgtggccgtgtgcctgctgggcgtgggcaccatggtgggcgctgacatcctggccggccgggaggacaacagcggcagtgatgtgctgattggagacatcctggtgctgctgggcgccagcctgtatgccatcagcaatgtgtgtgaggagtacatcgtgaagaagctgagccggcaggagttcctgggcatggtgggcctgtttggcaccatcatcagcggcatccagctgctgattgtggagtacaaggacatcgccagcatccactgggactggaagatcgccctgctgtttgtggcctttgccctgtgcatgttctgcctgtacagcttcatgcccctggtgatcaaggtgaccagcgccacctctgtgaacctgggcatcctgacagctgacctgtacagcctgtttgtgggcctcttcctgtttggctacaagttcagcggcctgtacatcctgtccttcaccgtcatcatggtgggcttcatcctgtactgcagcacccccaccaggacagctgagcctgctgagagctctgtgccccctgtgaccagcatcggcatcgacaacctgggcctgaagctggaggagaacctgcaggagacccacagcgctgtgctgtag

SEQ ID NO: 38252 - DNA, 1125 bp, Artificial Sequence
  Description of Artificial Sequence: Synthetic coding sequence
atggaggccgacagccctgctggccctggggcccctgagcccctggccgagggcgctgctgctgagttcagcagcctgctgcggcgcatcaagggcaagctgttcacctggaacatcctgaagaccatcgccctgggccagatgctgagcctgtgcatctgtggcacagccatcaccagccagtacctggccgagcgctacaaggtgaacacccccatgctgcagagcttcatcaactactgcctgctcttcctgatctacacagtgatgctggccttccgcagcggcagtgacaacctgctggtgatcctgaagaggaagtggtggaagtacatcctgctgggcctggctgatgtggaggccaactacgtgattgtgcgggcctaccagtacaccaccctgacctctgtgcagctgctggactgcttcggcatccctgtgctgatggccctgtcctggttcatcctgcacgcccgctacagagtcatccacttcatcgctgtggccgtgtgcctgctgggcgtgggcaccatggtgggcgctgacatcctggccggccgggaggacaacagcggcagtgatgtgctgattggagacatcctggtgctgctgggcgccagcctgtatgccatcagcaatgtgtgtgaggagtacatcgtgaagaagctgagccggcaggagttcctgggcatggtgggcctgtttggcaccatcatcagcggcatccagctgctgattgtggagtacaaggacatcgccagcatccactgggactggaagatcgccctgctgtttgtggcctttgccctgtgcatgttctgcctgtacagcttcatgcccctggtgatcaaggtgaccagcgccacctctgtgaacctgggcatcctgacagctgacctgtacagcctgtttgtgggcctcttcctgtttggctacaagttcagcggcctgtacatcctgtccttcaccgtcatcatggtgggcttcatcctgtactgcagcacccccaccaggacagctgagcctgctgagagctctgtgccccctgtgaccagcattggaattgacaacctgggcctgaagctggaggagaacctgcaggagacccacagcgctgtgctgtag

SEQ ID NO: 38253 - DNA, 1074 bp, Artificial Sequence
  Description of Artificial Sequence: Synthetic coding sequence
atggaggccgacagccctgctggccctggggcccctgagcccctggccgagggcgctgctgctgagttcagcagcctgctgcggcgcatcaagggcaagctgttcacctggaacatcctgaagaccatcgccctgggccagatgctgagcctgtgcatctgtggcacagccatcaccagccagtacctggccgagcgctacaaggtgaacacccccatgctgcagagcttcatcaactactgcctgctcttcctgatctacacagtgatgctggccttccgcagcggcagtgacaacctgctggtgatcctgaagaggaagtggtggaagtacatcctgctgggcctggctgatgtggaggccaactacgtgattgtgcgggcctaccagtacaccaccctgacctctgtgcagctgctggactgcttcggcatccctgtgctgatggccctgtcctggttcatcctgcacgcccgctacagagtcatccacttcatcgctgtggccgtgtgcctgctgggcgtgggcaccatggtgggcgctgacatcctggccggccgggaggacaacagcggcagtgatgtgctgattggagacatcctggtgctgctgggcgccagcctgtatgccatcagcaatgtgtgtgaggagtacatcgtgaagaagctgagccggcaggagttcctgggcatggtgggcctgtttggcaccatcatcagcggcatccagctgctgattgtggagtacaaggacatcgccagcatccactgggactggaagatcgccctgctgtttgtggcctttgccctgtgcatgttctgcctgtacagcttcatgcccctggtgatcaaggtgaccagcgccacctctgtgaacctgggcatcctgacagctgacctgtacagcctgtttgtgggcctcttcctgtttggctacaaggacagcaccagctgccccagcctgagctcctggtggggcctgagctgcacagccccacccctgctggcccggcccagccggctgaaggccgcctgcctgcagagccctgccctgggcctgaccacctggggctag

SEQ ID NO: 38254 - DNA, 1125 bp, Artificial Sequence; identical to SEQ ID NO: 38252
  Description of Artificial Sequence: Synthetic coding sequence

SEQ ID NO: 38255 - DNA, 1266 bp, Artificial Sequence
  Description of Artificial Sequence: Synthetic coding sequence
atgaagaagcacagcgcccgggtggcccccctgagcgcctgcaacagccctgtgctgaccctgaccaaggtggagggggaggagcggccccgggacagccctggccctgctgaggcccaggccccagctggggtggaggccggcggccgggccagccgccgctgctggacctgcagccgggcccagctgaagaagatcttctggggcgtggccgtggtgctgtgtgtgtgcagctcctgggccggcagcacccagctggccaagctgaccttcaggaagtttgatgcccccttcaccctgacctggtttgccaccaactggaacttcctgttcttccccctgtactacgtgggccacgtgtgcaagagcacagagaagcagagcgtgaagcagcgctaccgggagtgctgccgcttcttcggggacaatggcctgaccctgaaggtgttcttcaccaaggccgccccctttggagtgctgtggaccctgaccaactacctgtacctgcacgccatcaagaagatcaacaccacagatgtgtctgtgctcttctgctgcaacaaggcctttgtgttcctgctgtcctggatcgtgctgcgggaccgcttcatgggcgtgcgcatcgtggccgccatcctggccatcgccggcatcgtgatgatgacctatgcagatggcttccacagccacagcgtgattggaattgccctggtggtggccagcgcctccatgtctgccctgtacaaggtgctcttcaagctgctgctgggcagcgccaagtttggagaggccgccctcttcctgagcatcctgggcgtcttcaacatcctcttcatcacctgcatccccatcatcctgtacttcaccaaggtggagtactggagcagctttgatgacatcccctggggcaacctgtgtggcttctctgtgctgctgctgaccttcaacatcgtgctgaactttggaattgctgtgacctaccccaccctgatgagcctgggcatcgtgctgagcatccctgtgaatgctgtgattgaccactacaccagccagatcgtgttcaatggagtgcgggtcatcgccatcatcatcatcggcctgggcttcctgctgctgctgctgcctgaggagtgggatgtgtggctgatcaagctgctgacccggctgaaggtgaggaagaaggaggagcctgctgagggcgctgctgacctgagcagcggcccccagagcaagaacagaagagcccggcccagctttgccaggtag

SEQ ID NO: 38256 - DNA, 1473 bp, Artificial Sequence
  Description of Artificial Sequence: Synthetic coding sequence
atgggcatccgggagttccccagcggggccccccggggcaagagcattgctgtgggcatgagaagaagcccagatgtgagcccccggcggctgagtgacatcagcccccagctgcggcagctgaagtacctggtggtggatgaggccatcaaggaggacctgaagtggagccgctctgtggaggacctgaccagcggccctgtgggcctgaccagcattgaggagcgcatcctgcgcatcaccggctactacggctaccagccctgggccgccagctgcaagcgggaggagcggccccgggacagccctggccctgctgaggcccaggccccagctggggtggaggccggcggccgggccagccgccgctgctggacctgcagccgggcccagctgaagaagatcttctggggcgtggccgtggtgctgtgtgtgtgcagctcctgggccggcagcacccagctggccaagctgaccttcaggaagtttgatgcccccttcaccctgacctggtttgccaccaactggaacttcctgttcttccccctgtactacgtgggccacgtgtgcaagagcacagagaagcagagcgtgaagcagcgctaccgggagtgctgccgcttctttggagacaatggcctgaccctgaaggtgttcttcaccaaggccgcccccttcggcgtgctgtggaccctgaccaactacctgtacctgcacgccatcaagaagatcaacaccacagatgtgtctgtgctcttctgctgcaacaaggcctttgtgttcctgctgtcctggatcgtgctgcgggaccgcttcatgggcgtgagaattgtggccgccatcctggccatcgccggcatcgtgatgatgacctatgcagatggcttccacagccacagcgtcatcggcatcgccctggtggtggccagcgcctccatgtctgccctgtacaaggtgctcttcaagctgctgctgggcagcgccaagtttggagaggccgccctcttcctgagcatcctgggcgtcttcaacatcctcttcatcacctgcatccccatcatcctgtacttcaccaaggtggagtactggagcagctttgatgacatcccctggggcaacctgtgtggcttctctgtgctgctgctgaccttcaacatcgtgctgaactttggaattgctgtgacctaccccaccctgatgagcctgggcatcgtgctgagcatccctgtgaatgctgtgattgaccactacaccagccagatcgtgttcaacggggtgcgggtgattgccatcatcatcatcggcctgggcttcctgctgctgctgctgcctgaggagtgggatgtgtggctgatcaagctgctgacccggctgaaggtgaggaagaaggaggagcctgctgagggcgctgctgacctgagcagcggcccccagagcaagaacagaagagcccggcccagctttgccaggtag

SEQ ID NO: 38257 - DNA, 1566 bp, Artificial Sequence
  Description of Artificial Sequence: Synthetic coding sequence
atggatgagctgctgctggacctcttccacaagctgaccagcggccggcagctggccgctggaaatggcctgtgtggcatcagccacaaggagcaggaggtgtggaagccaggccacaacatcctggtgaagatgaggaaggaggacaagagcctggtgtggctgatccacagcaccctggcccgctacacccaggtgaccaacttcctgggcaccagccgcagctctgtgacccgctgcaagccaggggccaactgccccagcagccacagcggcatcagccggcagctgagccccctgtctgtgacagaggacagcagcgcccccatcctggagctgcagaaccagggcagcagtggagtgtgtggccaccgggtggagcggcagaacagatctgcagatgatggcacccagacccacagcgagaacagcagccaggagaaccgcatcaaggcccgctgcctgagctgcacctccatggtgctgaagggcatctggggcctgctgatcatcctgtctgtgagcagctcctgggtgggcaccacccagatcgtgaagatcacctacaagaacttctactgccccttcttcatgacctggttcagcaccaactggaacatcatgttcttccctgtgtactacagcggccacctggccacagcccaggagaagcagagccccatgaagaagttcagagaatgtagccgcatctttggagaagatggcctgaccctgaagctgttcctgaagaggacagcccccttcagcatcctgtggaccctgaccaactacctgtacctgctggccctgaagaagctgacagccacagatgtgtctgccctcttctgctgcaacaaggcctttgtgttcctgctgtcctggatcgtgctgaaggaccgcttcatgggcgtgcgcatcgtggccgccatcatggccatcaccggcatcgtgatgatggcctatgctgacaacttccacgccgacagcatcattggagtggcctttgctgtgggcagcgccagcaccagcgccctgtacaaggtgctcttcaagatgttcctgggcagcgccaactttggagaggccgcccactttgtgtccaccctgggcttcttcaacctgatcttcatctccttcacccctgtgatcctgtacttcaccaaggtggagcactggagcagctttgctgccctgccctggggctgcctgtgtggcatggccggcctgtggctggccttcaacatcctggtgaatgtgggcgtggtgctgacctaccccatcctgatcagcattggaacagtgctgtctgtgcctggaaatgctgctgtggacctgctgaagcaggaggtgatcttcaacgtggtgcggctggccgccaccatcatcatctgcatcggcttcctgctgatgctgctgcctgaggagtgggatgagatcaccctgcgcttcatcaacagcctgaaggagaagaagtctgaggagcacgtggatgatgtgacagaccccagcatccacctgcggggccggggccgggccaatggaacagtgtccatccccctggcctag

SEQ ID NO: 38258 - DNA, 1572 bp, Artificial Sequence
  Description of Artificial Sequence: Synthetic coding sequence
atggtgcccccaagaagacacagaggagctggccggcctggggtgctgagcagcagcccccccttccggctgcggagcgccaagttcagcggcatcgccctggaggacctgcggcgggccctgaagacccggctgcagatggtgtgtgtgtttgtgatgaacaggatgaacagccagaacagcggcttcacccagaggaggaggatggccctgggcatcgtcatcctgctgctggtggatgtgatctgggtggccagcagcgagctgaccagctatgtgttcacccagtacaacaagcccttcttcagcacctttgccaagacctccatgtttgtgctgtacctgctgggcttcatcatctggaagccctggaggcagcagtgcacccggggcctgcggggcaagcatgctgccttctttgctgatgctgagggctactttgctgcctgcaccacagacaccaccatgaacagcagcctgtctgagcccctgtatgtgcctgtgaagttccatgacctgcccagcgagaagccagagagcaccaacatcgacacagagaagacccccaagaagagccgggtgcgcttcagcaacatcatggagatccggcagctgcccagcagccacgccctggaggccaagctgagcaggatgagctaccctgtgaaggagcaggagagcatcctgaagacagtgggcaagctgacagccacccaggtggccaagatctccttcttcttctgctttgtgtggttcctggccaacctgagctaccaggaggccctgagtgacacccaggtggccatcgtgaacatcctgagcagcaccagcggcctcttcaccctcatcctggccgctgtgttccccagcaacagcggggaccgcttcaccctgagcaagctgctggccgtcatcctgagcatcggcggcgtggtgctggtgaacctggccggcagcgagaagccagctggccgggacacagtgggcagcatctggagcctggccggggccatgctgtatgctgtgtacatcgtgatgatcaagaggaaggtggaccgggaggacaagctggacatccccatgttctttggatttgtgggcctcttcaacctgctgctgctgtggccaggcttcttcctgctgcactacacaggctttgaagattttgagttccccaacaaggtggtgctgatgtgcatcatcatcaatggcctcatcggcaccgtgctgtctgagttcctgtggctgtggggctgcttcctgaccagcagcctcatcggcaccctggccctgagcctgaccatccccctgagcatcatcgctgacatgtgcatgcagaaggtgcagttctcctggctgttctttgctggggccatccctgtgttcttctccttcttcatcgtgaccctgctgtgccactacaacaactgggaccctgtgatggtgggcatccgccgcatctttgccttcatctgcaggaagcaccgcatccagagggtgcctgaggacagcgagcagtgtgagagcctcatctccatgcacagcgtgtcccaggaggatggagccagctag

SEQ ID NO: 38259 - DNA, 1554 bp, Artificial Sequence
  Description of Artificial Sequence: Synthetic coding sequence
atggacagcagcggctggaggggcgtgctgagcagcagcccccccttccggctgcggagcgccaagttcagcggcatcgccctggaggacctgcggcgggccctgaagacccggctgcagatggtgtgtgtgtttgtgatgaacaggatgaacagccagaacagcggcttcacccagaggaggaggatggccctgggcatcgtcatcctgctgctggtggatgtgatctgggtggccagcagcgagctgaccagctatgtgttcacccagtacaacaagcccttcttcagcacctttgccaagacctccatgtttgtgctgtacctgctgggcttcatcatctggaagccctggaggcagcagtgcacccggggcctgcggggcaagcatgctgccttctttgctgatgctgagggctactttgctgcctgcaccacagacaccaccatgaacagcagcctgtctgagcccctgtatgtgcctgtgaagttccatgacctgcccagcgagaagccagagagcaccaacatcgacacagagaagacccccaagaagagccgggtgcgcttcagcaacatcatggagatccggcagctgcccagcagccacgccctggaggccaagctgagcaggatgagctaccctgtgaaggagcaggagagcatcctgaagacagtgggcaagctgacagccacccaggtggccaagatctccttcttcttctgctttgtgtggttcctggccaacctgagctaccaggaggccctgagtgacacccaggtggccatcgtgaacatcctgagcagcaccagcggcctcttcaccctcatcctggccgctgtgttccccagcaacagcggggaccgcttcaccctgagcaagctgctggccgtcatcctgagcatcggcggcgtggtgctggtgaacctggccggcagcgagaagccagctggccgggacacagtgggcagcatctggagcctggccggggccatgctgtatgctgtgtacatcgtgatgatcaagaggaaggtggaccgggaggacaagctggacatccccatgttctttggatttgtgggcctcttcaacctgctgctgctgtggccaggcttcttcctgctgcactacacaggctttgaagattttgagttccccaacaaggtggtgctgatgtgcatcatcatcaatggcctcatcggcaccgtgctgtctgagttcctgtggctgtggggctgcttcctgaccagcagcctcatcggcaccctggccctgagcctgaccatccccctgagcatcatcgctgacatgtgcatgcagaaggtgcagttctcctggctgttctttgctggggccatccctgtgttcttctccttcttcatcgtgaccctgctgtgccactacaacaactgggaccctgtgatggtgggcatccgccgcatctttgccttcatctgcaggaagcaccgcatccagagggtgcctgaggacagcgagcagtgtgagagcctcatctccatgcacagcgtgtcccaggaggatggagccagctag

SEQ ID NO: 38260 - DNA, 1095 bp, Artificial Sequence
  Description of Artificial Sequence: Synthetic coding sequence
atgaggccccaggacagcactggagtggccgagctgcaggagcccggcctgcccctgacagatgatgcccctcctggggccacagaggagcctgctgctgctgaggccgccggggccccagaccggggccgctgctggctgtgcctgagcagcccctgctgcagcaggacagagcccgccaagaagaaggccccctgccccggcctgggcctcttctacaccctgctgagcgccttcctgttctctgtgggcagcctgtttgtgaagaaggtgcaggatgtgcatgctgtggagatcagcgccttccgctgtgtgttccagatgctggtggtgatcccctgcctgatctacaggaagacaggcttcatcggccccaagggccagaggatcttcctgatcctgcggggcgtgctgggcagcacagccatgatgctgatctactatgcctaccagaccatgagcctggctgatgccaccgtcatcaccttcagcagccctgtgttcaccagcatctttgcctggatctgcctgaaggagaagtacagcccctgggatgccctcttcaccgtcttcaccatcaccggggtcatcctgattgtgcggccccccttcctgtttggaagtgacaccagcggcatggaggagagctacagcggccacctgaagggcacctttgctgccatcggcagcgctgtgtttgctgccagcaccctggtgatcctgaggaagatgggcaagtctgtggactacttcctgagcatctggtactacgtggtgctgggcctggtggagagcgtcatcatcctgtctgtgctgggggagtggagcctgccctactgcggcctggacaggctcttcctgatcttcatcggcctgtttggcctgggcggccagatcttcatcaccaaggccctgcagatcgagaaggccggccctgtggccatcatgaagaccatggatgtggtgtttgccttcatcttccagatcatcttcttcaacaacgtgcccacctggtggacagtgggcggggccctgtgtgtggtggccagcaatgtgggcgccgccatcaggaagtggtaccagagcagcaagtag

SEQ ID NO: 38261 - DNA, 1098 bp, Artificial Sequence
  Description of Artificial Sequence: Synthetic coding sequence
atgaggccccaggacagcactggagtggccgagctgcaggagcccggcctgcccctgacagatgatgcccctcctggggccacagaggagcctgctgctgctgaggccgccggggccccagaccggggccgctgctggctgtgcctgagcagcccctgctgcagcaggacagagcctgaggccaagaagaaggccccctgccccggcctgggcctcttctacaccctgctgagcgccttcctgttctctgtgggcagcctgtttgtgaagaaggtgcaggatgtgcatgctgtggagatcagcgccttccgctgtgtgttccagatgctggtggtgatcccctgcctgatctacaggaagacaggcttcatcggccccaagggccagaggatcttcctgatcctgcggggcgtgctgggcagcacagccatgatgctgatctactatgcctaccagaccatgagcctggctgatgccaccgtcatcaccttcagcagccctgtgttcaccagcatctttgcctggatctgcctgaaggagaagtacagcccctgggatgccctcttcaccgtcttcaccatcactggagtcatcctgattgtgcggccccccttcctgtttggaagtgacaccagcggcatggaggagagctacagcggccacctgaagggcacctttgctgccatcggcagcgctgtgtttgctgccagcaccctggtgatcctgaggaagatgggcaagtctgtggactacttcctgagcatctggtactacgtggtgctgggcctggtggagagcgtcatcatcctgtctgtgctgggggagtggagcctgccctactgcggcctggacaggctcttcctgatcttcatcggcctgtttggcctgggcggccagatcttcatcaccaaggccctgcagatcgagaaggccggccctgtggccatcatgaagaccatggatgtggtgtttgccttcatcttccagatcatcttcttcaacaacgtgcccacctggtggacagtgggcggggccctgtgtgtggtggccagcaatgtgggcgccgccatcaggaagtggtaccagagcagcaagtag

SEQ ID NO: 38262 - DNA, 1017 bp, Artificial Sequence
  Description of Artificial Sequence: Synthetic coding sequence
atggccggcagccacccctacttcaaccagcctgacagcacccaccccagcccccccagcgccccacccagcctgcgctggtaccagcgctgccagcccagtgatgccaccagcggcctgctggtggccctgctgggcggcggcctgcctgctggctttgtgggccccctgagcaggatggcctaccaggccagcaacctgcccagcctggagctgctgatctggcgctgcctcttccacctgcccatcgccctgctgctgaagctgcggggggaccccctgctgggcaccccagacatccgcagccgggccttcttctgtgccctgctgaacatcctgagcatcggctgtgcctacagcgctgtgcaggtggtgcctgctggaaatgctgccaccgtgaggaagggcagcagcacagtgtgcagcgctgtgctgaccctgtgcctggagagccagggcctgagcggctatgactggtgtggcctgctgggctgcatcctgggcctcatcatcatcgtgggccctggcctgtggaccctgcaggagggcaccactggagtgtacacagccctgggctacgtggaggccttcctgggcggcctggccctgagcctgcggctgctggtgtaccgcagcctgcacttccccccctgcctgcccaccgtggccttcctgagcggcctggtgggcctgctgggctctgtgcccggcctgtttgtgctgcaggcccctgtgctgcccagcgacctgctgtcctggagctgtgtgggcgctgtgggcatcctggccctggtgtccttcacctgtgtgggctatgctgtgaccaaggcccacccagccctggtgtgtgctgtgctgcacagcgaggtggtggtggccctgatcctgcagtactacatgctgcacgagaccgtggcccccagcgacatcgtggccgccggcgtggtgctgggcagcatcgccatcatcacagcccagaacctgagctgtgagaggacaggccgggtggaggagtag

SEQ ID NO: 38263 - DNA, 1017 bp, Artificial Sequence
  Description of Artificial Sequence: Synthetic coding sequence
atggccggcagccacccctacttcaacctgcctgacagcacccaccccagcccccccagcgccccacccagcctgcgctggcaccagcgctgccagcccagcggggccaccaacggcctgctggtggccctgctgggcggcggcctgcctgctggctttgtgggccccctgagcaggatggcctaccagggcagcaacctgcccagcctggagctgctgatctgccgctgcctcttccacctgcccatcgccctgctgctgaagctgcggggggaccccctgctgggccccccagacatccggggctgggcctgcttctgtgccctgctgaatgtgctgagcatcggctgtgcctacagcgctgtgcaggtggtgcctgctggaaatgctgccaccgtgaggaagggcagcagcacagtgtgcagcgctgtgctgaccctgtgcctggagagccagggcctgggcggctatgagtggtgtggcctgctgggcagcatcctgggcctcatcatcatcctgggccctggcctgtggaccctgcaggagggcaccactggagtgtacaccaccctgggctacgtgcaggccttcctgggcggcctggccctgagcctgggcctgctggtgtaccgcagcctgcacttccccagctgcctgcccaccgtggccttcctgagcggcctggtgggcctgctgggctgtgtgcccggcctgtttgtgctgcagacccctgtgctgcccagcgacctgctgtcctggagctgtgtgggcgctgagggcatcctggccctggtgtccttcacctgtgtgggctatgctgtgaccaaggcccacccagccctggtgtgtgctgtgctgcacagcgaggtggtggtggccctgatcctgcagtactacatgctgcacgagaccgtggccctgagtgacatcatgggcgccggcgtggtgctgggcagcatcgccatcatcacagccaggaacctgagctgtgagaggacaggcaaggtggaggagtag

SEQ ID NO: 38264 - DNA, 1158 bp, Artificial Sequence
  Description of Artificial Sequence: Synthetic coding sequence
atgaggagcagcctggcccctggggtgtggttcttccgggccttcagccgggacagctggttccggggcctcatcctgctgctgaccttcctgatctatgcctgctaccacatgagcaggaagcccatcagcatcgtgaagagccggctgcaccagaactgcagcgagcagatcaagcccatcaatgacacccacagcctgaatgacaccatgtggtgctcctgggccccctttgacaaggacaactacaaggagctgctgggcggcgtggacaatgccttcctgattgcctatgccatcggcatgttcatctctggagtgtttggagagcggctgcccctgcgctactacctgtctgctggcatgctgctgagcggcctcttcaccagcctgtttggcctgggctacttctggaacatccacgagctgtggtactttgtggtgatccaggtgtgcaatggcctggtgcagaccaccggctggcccagcgtggtgacctgtgtgggcaactggtttgggaagggcaagaggggcttcatcatgggcatctggaacagccacacctctgtgggcaacatcctgggcagcctgattgctggcatctgggtgaatggccagtggggcctgtccttcatcgtgcccggcatcatcacagctgtgatgggcgtcatcaccttcctgttcctgattgagcacccagaagatgtggactgtgccccaccccagcaccacggggagcctgctgagaaccaggacaacccagaagatcctggcaacagcccctgcagcatccgggagagcggcctggagaccgtggccaagtgcagcaagggcccctgtgaggagcctgctgccatctccttctttggagccctgcgcatccctggggtggtggagttcagcctgtgcctgctgtttgccaagctggtgtcctacaccttcctgtactggctgcccctgtacatcgccaacgtggcccacttcagcgccaaggaggccggggacctgagcaccctgtttgatgtgggcggcatcattgatgtgcctgtgcagctgcactggccaggccgggactgccagctgcacagtgatgctgaccacctgtggggccctggccagtggcccatccgggcccaccaccactgctgcctgtgctag

SEQ ID NO: 38265 - DNA, 1518 bp, Artificial Sequence
  Description of Artificial Sequence: Synthetic coding sequence
atgaggagcagcctggcccctggggtgtggttcttccgggccttcagccgggacagctggttccggggcctcatcctgctgctgaccttcctgatctatgcctgctaccacatgagcaggaagcccatcagcatcgtgaagagccggctgcaccagaactgcagcgagcagatcaagcccatcaatgacacccacagcctgaatgacaccatgtggtgctcctgggccccctttgacaaggacaactacaaggagctgctgggcggcgtggacaatgccttcctgattgcctatgccatcggcatgttcatctctggagtgtttggagagcggctgcccctgcgctactacctgtctgctggcatgctgctgagcggcctcttcaccagcctgtttggcctgggctacttctggaacatccacgagctgtggtactttgtggtgatccaggtgtgcaatggcctggtgcagaccaccggctggcccagcgtggtgacctgtgtgggcaactggtttgggaagggcaagaggggcttcatcatgggcatctggaacagccacacctctgtgggcaacatcctgggcagcctgattgctggcatctgggtgaatggccagtggggcctgtccttcatcgtgcccggcatcatcacagctgtgatgggcgtcatcaccttcctgttcctgattgagcacccagaagatgtggactgtgccccaccccagcaccacggggagcctgctgagaaccaggacaacccagaagatcctggcaacagcccctgcagcatccgggagagcggcctggagaccgtggccaagtgcagcaagggcccctgtgaggagcctgctgccatctccttctttggagccctgcgcatccctggggtggtggagttcagcctgtgcctgctgtttgccaagctggtgtcctacaccttcctgtactggctgcccctgtacatcgccaacgtggcccacttcagcgccaaggaggccggggacctgagcaccctgtttgatgtgggcggcatcatcggcggcatcgtggccggcctggtgtctgactacaccaacggccgggccaccacctgctgcgtgatgctgatcctggccgcccccatgatgttcctgtacaactacatcggccaggacggcatcgccagcagcatcgtgatgctgatcatctgtggcggcctggtgaatggcccctatgccctgatcaccacagctgtgtctgctgacctgggcacccacaagagcctgaagggaaatgccaaggccctgagcacagtgacagccatcattgatggcaccggcagcatcggggccgccctgggccccctgctggccggcctcatcagccccaccggctggaacaacgtgttctacatgctgatctctgcagatgtgctggcctgcctgctgctgtgccgcctggtgtacaaggagatcctggcctggaaggtgtccctgagccggggcagcggcagctccatggtgctgacccaccagtag

SEQ ID NO: 38266 - DNA, 1506 bp, Artificial Sequence
  Description of Artificial Sequence: Synthetic coding sequence
atgaggagcagcctggcccctggggtgtggttcttccgggccttcagccgggacagctggttccggggcctcatcctgctgctgaccttcctgatctatgcctgctaccacatgagcaggaagcccatcagcatcgtgaagagccggctgcaccagaactgcagcgagcagatcaagcccatcaatgacacccacagcctgaatgacaccatgtggtgctcctgggccccctttgacaaggacaactacaaggagctgctgggcggcgtggacaatgccttcctgattgcctatgccatcggcatgttcatctctggagtgtttggagagcggctgcccctgcgctactacctgtctgctggcatgctgctgagcggcctcttcaccagcctgtttggcctgggctacttctggaacatccacgagctgtggtactttgtggtgatccaggtgtgcaatggcctggtgcagaccaccggctggcccagcgtggtgacctgtgtgggcaactggtttgggaagggcaagaggggcttcatcatgggcatctggaacagccacacctctgtgggcaacatcctgggcagcctgattgctggcatctgggtgaatggccagtggggcctgtccttcatcgtgcccggcatcatcacagctgtgatgggcgtcatcaccttcctgttcctgattgagcacccagaagatgtggactgtgccccaccccagcaccacggggagcctgctgagaaccaggacaacccagaagatcctggcaacagcccctgcagcatccgggagagcggcctggagaccgtggccaagtgcagcaagggcccctgtgaggagcctgctgccatctccttctttggagccctgcgcatccctggggtggtggagttcagcctgtgcctgctgtttgccaagctggtgtcctacaccttcctgtactggctgcccctgtacatcgccaacgtggcccacttcagcgccaaggaggccggggacctgagcaccctgtttgatgtgggcggcatcatcggcggcatcgtggccggcctggtgtctgactacaccaacggccgggccaccacctgctgcgtgatgctgatcctggccgcccccatgatgttcctgtacaactacatcggccaggacggcatcgccagcagcatcgtgatgctgatcatctgtggcggcctggtgaatggcccctatgccctgatcaccacagctgtgtctgctgacctgggcacccacaagagcctgaagggaaatgccaaggccctgagcacagtgacagccatcattgatggcaccggcagcatcggggccgccctgggccccctgctggccggcctcatcagccccaccggctggaacaacgtgttctacatgctgatctctgcagatgtgctggcctgcctgctgctgtgccgcctggtgtacaaggagatcctggcctggaaggtgtccctgagccggggcagcggctacaaggagatctag

SEQ ID NO: 38267 - DNA, 1518 bp, Artificial Sequence; identical to SEQ ID NO: 38265
  Description of Artificial Sequence: Synthetic coding sequence

SEQ ID NO: 38268 - DNA, 1485 bp, Artificial Sequence
  Description of Artificial Sequence: Synthetic coding sequence
atggcctggcccaacgtgttccagaggggcagcctgctgagccagttcagccaccaccacgtggtggtgttcctgctgaccttcttctcctacagcctgctgcacgccagcaggaagaccttcagcaatgtgaaggtgtccatcagcgagcagtggaccccatctgccttcaacacctctgtggagctgcctgtggagatctggagcagcaaccacctgttccccagcgctgagaaggccaccctcttcctgggcaccctggacaccatcttcctgttctcctatgctgtgggcctcttcatcagcggcatcgtgggggaccggctgaacctgcgctgggtgctgagctttggcatgtgcagcagcgccctggtggtgtttgtgtttggagccctgacagagtggctgcgcttctacaacaagtggctgtactgctgcctgtggatcgtgaatggcctgctgcagagcacaggctggccctgtgtggtggccgtgatgggcaactggtttgggaaggccggccggggcgtggtgtttggcctgtggagcgcctgtgcctctgtgggcaacatcctgggcgcctgcctggccagctctgtgctgcagtatggctatgaatatgccttcctggtgacagcctctgtgcagtttgctgggggcatcgtcatcttcttcggcctgctggtgtccccagaggagatcggcctgtctggaattgaagcagaagaaaattttgaggaggacagccaccggcccctcatcaatggaggagaaaatgaagatgaatatgagcccaactacagcatccaggatgacagctctgtggcccaggtgaaggccatctccttctaccaggcctgctgcctgcccggggtcatcccctacagcctggcctatgcctgcctgaagctggtgaactacagcttcttcttctggctgcccttctacctgagcaacaactttggctggaaggaggccgaggccgacaagctgagcatctggtatgatgtgggcggcatcattggaggcaccctgcagggcttcatcagtgatgtgctgcagaagagggcccctgtgctggccctgagcctgctgctggccgtgggcagcctcatcggctacagccgcagccccaatgacaagagcatcaatgccctgctgatgacagtgacaggcttcttcatcggcggccccagcaacatgatcagcagcgccatctctgctgacctgggccggcaggagctgatccagaggagcagcgaggccctggccaccgtgactggaattgtggatggcagcggcagcatcggggctgctgtgggccagtacctggtgtccctcatccgggacaagctgggctggatgtgggtgttctacttcttcatcctgatgaccagctgcaccatcgtgttcatcagccccctcatcgtgcgggagatcttcagcctggtgctgcggcggcaggcccacatcctgcgggagtag

SEQ ID NO: 38269 - DNA, 1332 bp, Artificial Sequence
  Description of Artificial Sequence: Synthetic coding sequence
atggcctggcccaacgtgttccagaggggcagcctgctgagccagttcagccaccaccacgtggtggtgttcctgctgaccttcttctcctacagcctgctgcacgccagcaggaagaccttcagcaatgtgaaggtgtccatcagcgagcagtggaccccatctgccttcaacacctctgtggagctgcctgtggagatctggagcagcaaccacctgttccccagcgctgagaaggccaccctcttcctgggcaccctggacaccatcttcctgttctcctatgctgtgggcctcttcatcagcggcatcgtgggggaccggctgaacctgcgctgggtgctgagctttggcatgtgcagcagcgccctggtggtgtttgtgtttggagccctgacagagtggctgcgcttctacaacaagtggctgtactgctgcctgtggatcgtgaatggcctgctgcagagcacaggctggccctgtgtggtggccgtgatgggcaactggtttgggaaggccggccggggcgtggtgtttggcctgtggagcgcctgtgcctctgtgggcaacatcctgggcgcctgcctggccagctctgtgctgcagtatggctatgaatatgccttcctggtgacagcctctgtgcagtttgctgggggcatcgtcatcttcttcggcctgctggtgtccccagaggagatcggcctgtctggaattgaagcagaagaaaattttgaggaggacagccaccggcccctcatcaatggaggagaaaatgaagatgaatatgagcccaactacagcatccaggatgacagctctgtggcccaggtgaaggccatctccttctaccaggcctgctgcctgcccggggtcatcccctacagcctggcctatgcctgcctgaagctggtgaactacagcttcttcttctggctgcccttctacctgagcaacaactttggctggaaggaggccgaggccgacaagctgagcatctggtatgatgtgggcggcatcatcgtgttttctgtgtctgaccccggccaggccaggatggatgtgggcttcctgctcttccacagccatgacaagctgtacaactgtgtgtacctggccatcaacagcgagggcaacatcctgagccgggccaaggagaccggcagccacattgaaggagtgactggagcccgggagacagagaggaccatgtctgccaccagcggccccctgggcctgcgggtgtgccccaacctgggcctgagccgcagcagcagcctcatcctggactgccaggccagcctgaacacagccagccacctgcgctgctag

SEQ ID NO: 38270 - DNA, 471 bp, Artificial Sequence
  Description of Artificial Sequence: Synthetic coding sequence
atggcctggcccaacgtgttccagaggggcagcctgctgagccagttcagccaccaccacgtggtggtgttcctgctgaccttcttctcctacagcctgctgcacgccagcaggaagaccttcagcaatgtgaaggtgtccatcagcgagcagtggaccccatctgccttcaacacctctgtggagctgcctgtggagatctggagcagcaaccacctgttccccagcgctgagaaggccaccctcttcctgggcaccctggacaccatcttcctgttctcctatgctgtgggcctcttcatcagcggcatcgtgggggaccggctgaacctgcgctgggtgctgagctttggcatgtgcagcagcgccctggtgaccaggagctgcttctggagcctggagtgcctgtgcttcggcggccagcactttggatctgtgcccagcttcttctgcagctctgtgtggctgtag

SEQ ID NO: 38271 - DNA, 1437 bp, Artificial Sequence
  Description of Artificial Sequence: Synthetic coding sequence
atggcctggcccaacgtgttccagaggggcagcctgctgagccagttcagccaccaccacgtggtggtgttcctgctgaccttcttctcctacagcctgctgcacgccagcaggaagaccttcagcaatgtgaaggtgtccatcagcgagcagtggaccccatctgccttcaacacctctgtggagctgcctgtggagatctggagcagcaaccacctgttccccagcgctgagaaggccaccctcttcctgggcaccctggacaccatcttcctgttctcctatgctgtgggcctcttcatcagcggcatcgtgggggaccggctgaacctgcgctgggtgctgagctttggcatgtgcagcagcgccctggtggtgtttgtgtttggagccctgacagagtggctgcgcttctacaacaagtggctgtactgctgcctgtggatcgtgaatggcctgctgcagagcacaggctggccctgtgtggtggccgtgatgggcaactggtttgggaaggccggccggggcgtggtgtttggcctgtggagcgcctgtgcctctgtgggcaacatcctgggcgcctgcctggccagctctgtgctgcagtatggctatgaatatgccttcctggtgacagcctctgtgcagtttgctgggggcatcgtcatcttcttcggcctgctggtgtccccagaggagatcggcctgtctggaattgaagcagaagaaaattttgaggaggacagccaccggcccctcatcaatggaggagaaaatgaagatgaatatgagcccaactacagcatccaggatgacagctctgtggcccaggtgaaggccatctccttctaccaggcctgctgcctgcccggggtcatcccctacagcctggcctatgcctgcctgaagctggtgaactacagcttcttcttctggctgcccttctacctgagcaacaactttggctggaaggaggccgaggccgacaagctgagcatctggtatgatgtgggcggcatcattggaggcaccctgcagggcttcatcagtgatgtgctgcagaagagggcccctgtgctggccctgagcctgctgctggccgtgggcagcctcatcggctacagccgcttcttcatcggcggccccagcaacatgatcagcagcgccatctctgctgacctgggccggcaggagctgatccagaggagcagcgaggccctggccaccgtgactggaattgtggatggcagcggcagcatcggggctgctgtgggccagtacctggtgtccctcatccgggacaagctgggctggatgtgggtgttctacttcttcatcctgatgaccagctgcaccatcgtgttcatcagccccctcatcgtgcgggagatcttcagcctggtgctgcggcggcaggcccacatcctgcgggagtag

SEQ ID NO: 38272 - DNA, 45 bp, Artificial Sequence
  Description of Artificial Sequence: Synthetic coding sequence
atggcctggcccaacgtgttccagaggggcagcctgctgtcctag

SEQ ID NO: 38273 - DNA, 714 bp, Artificial Sequence
  Description of Artificial Sequence: Synthetic coding sequence
atggcctggcccaacgtgttccagaggggcagcctgctgagccagttcagccaccaccacgtggtggtgttcctgctgaccttcttctcctacagcctgctgcacgccagcaggaagaccttcagcaatgtgaaggtgtccatcagcgagcagtggaccccatctgccttcaacacctctgtggagctgcctgtggagatctggagcagcaaccacctgttccccagcgctgagaaggccaccctcttcctgggcaccctggacaccatcttcctgttctcctatgctgtgggcctcttcatcagcggcatcgtgggggaccggctgaacctgcgctgggtgctgagctttggcatgtgcagcagcgccctggtggtgtttgtgtttggagccctgacagagtggctgcgcttctacaacaagtggctgtactgctgcctgtggatcgtgaatggcctgctgcagagcacaggctggccctgtgtggtggccgtgatgggcaactggtttgggaaggccggccggggcgtggtgtttggcctgtggagcgcctgtgcctctgtgggcaacatcctgggcgcctgcctggccagctctgtgctgcagtatggctatgaatatgccttcctggtgacagcctctgtgcagtttgctgggggcatcgtcatcttcttcggcctgctggtgtccccagaggagatcggcaagctgtag

SEQ ID NO: 38274 - DNA, 2343 bp, Artificial Sequence
  Description of Artificial Sequence: Synthetic coding sequence
atgacagctgctgctgccagcaactggggcctcatcaccaacatcgtgaacagcatcgtgggcgtgtctgtgctgaccatgcccttctgcttcaagcagtgtggcatcgtgctgggcgccctgctgctggtgttctgctcctggatgacccaccagagctgcatgttcctggtgaagagcgccagcctgagcaagaggaggacctacgccggcctggccttccacgcctacggcaaggccggcaagatgctggtggagacctccatgattggcctgatgctgggcacctgcatcgccttctacgtggtgattggagacctgggcagcaacttctttgcccggctgtttggcttccaggtgggcggcaccttcaggatgttcctgctgtttgctgtgtccctgtgcatcgtgctgcccctgagcctgcagaggaacatgatggccagcatccagagcttcagcgccatggccctgctcttctacaccgtcttcatgtttgtgattgtgctgagcagcctgaagcacggcctcttcagcggccagtggctgcggcgggtgtcctatgtgcgctgggagggcgtcttccgctgcatccccatcttcggcatgagctttgcctgccagagccaggtgctgcccacctatgacagcctggatgagcccagcgtgaagaccatgagcagcatctttgccagcagcctgaatgtggtgaccaccttctacgtgatggtgggcttcttcggctacgtgtccttcacagaggccacagctggaaatgtgctgatgcacttccccagcaacctggtgacagagatgctgcgggtgggcttcatgatgtctgtggccgtgggcttccccatgatgatcctgccctgccggcaggccctgagcaccctgctgtgtgagcagcagcagaaggatggcacctttgctgctgggggctacatgccacccctgcgcttcaaggccctgaccctgtctgtggtgtttggcaccatggtgggcggcatcctgatccccaacgtggagaccatcctgggcctgactggagccaccatgggcagcctcatctgcttcatctgcccagccctgatctacaagaagatccacaagaatgccctgagcagccaggtggtgctgtgggtgggcctgggcgtgctggtggtgtccacagtgaccaccctgtctgtgtctgaggaggtgcctgaggacctggccgaggaggcccctgggggccgcctgggggaggccgagggcctgatgaaggtggaggccgcccggctgagcgcccaggaccctgtggtggccgtggctgaagatggccgggagaagcccaagctgcccaaggagcgggaggagctggagcaggcccagatcaagggccctgtggatgtgcccggcagagaagatggcaaggaggcccctgaggaggcccagctggacaggcctggccagggcattgctgtgcctgtgggggaggcccacagacatgagccccctgtgccccatgacaaggtggtggtggatgagggccaggaccgggaggtgcctgaggagaacaagccacccagcagacatgctgggggcaaggcccctggggtgcagggccagatggccccacccctgcctgattctgagcgggagaagcaggagcctgagcagggcgaggtgggcaagaggcctggccaggcccaggccctggaggaggccggggacctgcctgaggacccccagaaggtgcctgaggctgatggccagcctgctgtgcagcctgccaaggaggacctgggccctggggaccggggcctgcacccccggccccaggccgtgctgtctgagcagcagaatggcctggccgtgggcggcggggagaaggccaagggcggccccccacctggaaatgctgctggggacaccggccagcctgctgaggacagcgaccacggcggcaagccacccctgcctgctgagaagccagcccctggccctggcctgcccccagagccccgggagcagagagatgtggagcgggccggcggcaaccaggccgccagccagctggagggcaaggccagcgccctgcagcccccagccagcggccctggcagcggcagccccctgccccagccctggggagatgcccaggtgatcctgggcagccctgcccggccccccttctccttccagcccccagctgagcagaccccaagaagagccttctgcagcctgcccatcagcagcctgctgagcggcaacctgctgagcgccctgctgcccttcaagcacctgcggcaccgccacatggcctgtgactaccgcttcatcagcctggcccccctgtag

SEQ ID NO: 38275 - DNA, 3360 bp, Artificial Sequence
  Description of Artificial Sequence: Synthetic coding sequence
atgacagctgctgctgccagcaactggggcctcatcaccaacatcgtgaacagcatcgtgggcgtgtctgtgctgaccatgcccttctgcttcaagcagtgtggcatcgtgctgggcgccctgctgctggtgttctgctcctggatgacccaccagagctgcatgttcctggtgaagagcgccagcctgagcaagaggaggacctacgccggcctggccttccacgcctacggcaaggccggcaagatgctggtggagacctccatgattggcctgatgctgggcacctgcatcgccttctacgtggtgattggagacctgggcagcaacttctttgcccggctgtttggcttccaggtgggcggcaccttcaggatgttcctgctgtttgctgtgtccctgtgcatcgtgctgcccctgagcctgcagaggaacatgatggccagcatccagagcttcagcgccatggccctgctcttctacaccgtcttcatgtttgtgattgtgctgagcagcctgaagcacggcctcttcagcggccagtggctgcggcgggtgtcctatgtgcgctgggagggcgtcttccgctgcatccccatcttcggcatgagctttgcctgccagagccaggtgctgcccacctatgacagcctggatgagcccagcgtgaagaccatgagcagcatctttgccagcagcctgaatgtggtgaccaccttctacgtgatggtgggcttcttcggctacgtgtccttcacagaggccacagctggaaatgtgctgatgcacttccccagcaacctggtgacagagatgctgcgggtgggcttcatgatgtctgtggccgtgggcttccccatgatgatcctgccctgccggcaggccctgagcaccctgctgtgtgagcagcagcagaaggatggcacctttgctgctgggggctacatgccacccctgcgcttcaaggccctgaccctgtctgtggtgtttggcaccatggtgggcggcatcctgatccccaacgtggagaccatcctgggcctgactggagccaccatgggcagcctcatctgcttcatctgcccagccctgatctacaagaagatccacaagaatgccctgagcagccaggtggtgctgtgggtgggcctgggcgtgctggtggtgtccacagtgaccaccctgtctgtgtctgaggaggtgcctgaggacctggccgaggaggcccctgggggccgcctgggggaggccgagggcctgatgaaggtggaggccgcccggctgagcgcccaggaccctgtggtggccgtggctgaagatggccgggagaagcccaagctgcccaaggagcgggaggagctggagcaggcccagatcaagggccctgtggatgtgcccggcagagaagatggcaaggaggcccctgaggaggcccagctggacaggcctggccagggcattgctgtgcctgtgggggaggcccacagacatgagccccctgtgccccatgacaaggtggtggtggatgagggccaggaccgggaggtgcctgaggagaacaagccacccagcagacatgctgggggcaaggcccctggggtgcagggccagatggccccacccctgcctgattctgagcgggagaagcaggagcctgagcagggcgaggtgggcaagaggcctggccaggcccaggccctggaggaggccggggacctgcctgaggacccccagaaggtgcctgaggctgatggccagcctgctgtgcagcctgccaaggaggacctgggccctggggaccggggcctgcacccccggccccaggccgtgctgtctgagcagcagaatggcctggccgtgggcggcggggagaaggccaagggcggccccccacctggaaatgctgctggggacaccggccagcctgctgaggacagcgaccacggcggcaagccacccctgcctgctgagaagccagcccctggccctggcctgcccccagagccccgggagcagagagatgtggagcgggccggcggcaaccaggccgccagccagctggaggaggccggccgggcagagatgctggaccatgctgtgctgctgcaggtgatcaaggagcagcaggtgcagcagaagaggctgctggaccagcaggagaagctgctggccgtcatcgaggagcagcacaaggagatccaccagcagaggcaggaggatgaggaggacaagccccggcaggtggaggtgcaccaggagcccggggctgctgtgccccggggccaggaggcccctgagggcaaggcccgggagaccgtggagaacctgccccccctgcccctggaccctgtgctgcgggcccctgggggccggcctgcccccagccaggacctgaaccagaggagcctggagcacagcgagggccctgtgggccgggaccctgctggccccccagatggcggccctgacacagagccccgggccgcccaggccaagctgagagatggccagaaggatgctgcccccagggctgctggcaccgtgaaggagctgcccaagggccctgagcaggtgcctgtgcctgaccctgcccgggaggccggcggccctgaggagcggctggccgaggagttccctggccagagccaggatgtgactggaggcagccaggacaggaagaagccaggcaaggaggtggccgccaccggcaccagcatcctgaaggaggccaactggctggtggccggccctggagctgagactggagaccccaggatgaagcccaagcaggtgtcccgggacctgggcctggccgctgacctgcccggcggcgctgagggcgctgctgcccagccccaggccgtgctgcggcagcctgagctgcgggtcatcagtgatggagagcagggcggccagcagggccaccggctggaccatggaggccacctggagatgaggaaggcccggggcggggaccacgtgcctgtgtcccatgagcagcccagaggaggagaagatgctgctgtgcaggagccccggcagaggcctgagcctgagctgggcctgaagagagctgtgcctgggggccagaggccagacaatgccaagcccaacagagacctgaagctgcaggccggcagtgacctgcggaggagaagaagagacctgggcccccacgccgagggccagctggcccccagagatggagtcatcatcggcctgaaccccctgcctgatgtgcaggtgaatgacctgcggggggccctggatgcccagctgcggcaggccgccggcggggccctgcaggtggtgcacagccggcagctgcggcaggcccctggccccccagaggagagctag

SEQ ID NO: 38276 - DNA, 1155 bp, Artificial Sequence
  Description of Artificial Sequence: Synthetic coding sequence
atgaagcaggccggcttccccctgggcatcctgctgctcttctgggtgtcctatgtgacagacttcagcctggtgctgctgatcaagggcggggccctgagcggcacagacacctaccagagcctggtgaacaagaccttcggcttccctggctacctgctgctgtctgtgctgcagttcctgtaccccttcatcgtggaccctgaaaatgtgttcatcggccgccacttcatcatcggcctgagcacagtgaccttcaccctgcccctgagcctgtacagaaacatcgccaagctgggcaaggtgtccctcatcagcacaggcctgaccaccctcatcctgggcatcgtgatggcccgggccatcagcctgggcccccacatccccaagacagaagatgcctgggtgtttgccaagcccaatgccatccaggccgtgggcgtgatgagctttgccttcatctgccaccacaacagcttcctggtgtacagcagcctggaggagcccaccgtggccaagtggagccgcctcatccacatgagcatcgtcatctctgtgttcatctgcatcttctttgccacctgtggctacctgaccttcaccggcttcacccagggcgacctgtttgagaactactgcagaaatgatgacctggtgaccttcggccgcttctgctacggcgtgaccgtcatcctgacctaccccatggagtgctttgtgacccgggaggtgattgccaacgtgttcttcggcggcaacctgagcagcgtcttccacatcgtggtgacagtgatggtgatcaccgtggccaccctggtgtccctgctgattgactgcctgggcatcgtgctggagctgaatggagtgctgtgtgccacccccctcatcttcatcatccccagcgcctgctacctgaagctgtctgaggagcccaggacccacagcgacaagatcatgagctgtgtgatgctgcccatcggggctgtggtgatggtgtttggatttgtgatggccatcaccaacacccaggactgcacccacggccaggagatgttctactgcttcccagacaacttcagcctgaccaacaccagcgagagccacgtgcagcagaccacccagctgagcaccctgaacatcagcatcttccagtag

SEQ ID NO: 38277 - DNA, 1221 bp, Artificial Sequence
  Description of Artificial Sequence: Synthetic coding sequence
atgaagcaggccggcttccccctgggcatcctgctgctcttctgggtgtcctatgtgacagacttcagcctggtgctgctgatcaagggcggggccctgagcggcacagacacctaccagagcctggtgaacaagaccttcggcttccctggctacctgctgctgtctgtgctgcagttcctgtaccccttcatcgccatgatctcctacaacatcatcgccggggacaccctgagcaaggtgttccagagaattcctggggtggaccctgaaaatgtgttcatcggccgccacttcatcatcggcctgagcacagtgaccttcaccctgcccctgagcctgtacagaaacatcgccaagctgggcaaggtgtccctcatcagcacaggcctgaccaccctcatcctgggcatcgtgatggcccgggccatcagcctgggcccccacatccccaagacagaagatgcctgggtgtttgccaagcccaatgccatccaggccgtgggcgtgatgagctttgccttcatctgccaccacaacagcttcctggtgtacagcagcctggaggagcccaccgtggccaagtggagccgcctcatccacatgagcatcgtcatctctgtgttcatctgcatcttctttgccacctgtggctacctgaccttcaccggcttcacccagggcgacctgtttgagaactactgcagaaatgatgacctggtgaccttcggccgcttctgctacggcgtgaccgtcatcctgacctaccccatggagtgctttgtgacccgggaggtgattgccaacgtgttcttcggcggcaacctgagcagcgtcttccacatcgtggtgacagtgatggtgatcaccgtggccaccctggtgtccctgctgattgactgcctgggcatcgtgctggagctgaatggagtgctgtgtgccacccccctcatcttcatcatccccagcgcctgctacctgaagctgtctgaggagcccaggacccacagcgacaagatcatgagctgtgtgatgctgcccatcggggctgtggtgatggtgtttggatttgtgatggccatcaccaacacccaggactgcacccacggccaggagatgttctactgcttcccagacaacttcagcctgaccaacaccagcgagagccacgtgcagcagaccacccagctgagcaccctgaacatcagcatcttccagtag

SEQ ID NO: 38278 - DNA, 1221 bp, Artificial Sequence; identical to SEQ ID NO: 38277
  Description of Artificial Sequence: Synthetic coding sequence

SEQ ID NO: 38279 - DNA, 1371 bp, Artificial Sequence
  Description of Artificial Sequence: Synthetic coding sequence
atggaggcctcctggggcagcttcaatgctgagcggggctggtacgtgtctgtgcagcagcctgaggaggccgaggccgaggagctgagccccctgctgagcaatgagctgcaccggcagaggagccctggggtgtcctttggcctgagcgtcttcaacctgatgaatgccatcatgggcagcggcatcctgggcctggcctacgtgctggccaacacaggagtgtttggcttctccttcctgctgctgactgtggccctgctggccagctacagcgtgcacctgctgctgtccatgtgcatccagacagctgtgaccagctatgaggacctgggcctgtttgccttcggcctgcccgggaagctggtggtggccggcaccatcatcatccagaacattggagccatgagcagctacctgctgatcatcaagacagagctgcctgctgccatcgccgagttcctgaccggggactacagccgctactggtacctggatggccagaccctgctgatcatcatctgtgtgggcatcgtgttccccctggccctgctgcccaagattggcttcctgggctacaccagcagcctgtccttcttcttcatgatgttctttgccctggtggtgatcatcaagaagtggagcatcccctgccccctgaccctgaactacgtggagaagggcttccagatcagcaatgtgacagatgactgcaagcccaagctgttccacttcagcaaggagagcgcctatgccctgcccaccatggccttctccttcctgtgccacaccagcatcctgcccatctactgtgagctgcagagccccagcaagaagaggatgcagaatgtgaccaacacagccatcgccctgtccttcctgatctacttcatcagcgccctgtttggctacctgaccttctatgacaaggtggagagcgagctgctgaagggctacagcaagtacctgagccatgatgtggtggtgatgacagtgaagctgtgcatcctgtttgctgtgctgctgactgtgcccctcatccacttccctgccaggaaggctgtgaccatgatgttcttcagcaacttccccttctcctggatccgccacttcctgatcaccctggccctgaacatcatcatcgtgctgctggccatctacgtgcctgacatcagaaatgtgtttggagtggtgggcgccagcaccagcacctgcctgatcttcatcttccctggcctcttctacctgaagctgagccgggaggacttcctgtcctggaagaagctgggcgcctttgtgctgctgatcttcggcatcctggtgggcaacttcagcctggccctgatcatctttgactggatcaacaagtag

SEQ ID NO: 38280 - DNA, 1566 bp, Artificial Sequence
  Description of Artificial Sequence: Synthetic coding sequence
atggaggcctcctggggcagcttcaatgctgagcggggctggtacgtgtctgtgcagcagcctgaggaggccgaggccgaggagctgagccccctgctgagcaatgagctgcaccggcagaggagccctggggtgtcctttggcctgagcgtcttcaacctgatgaatgccatcatgggcagcggcatcctgggcctggcctacgtgctggccaacacaggagtgtttggcttctccttcctgctgctgactgtggccctgctggccagctacagcgtgcacctgctgctgtccatgtgcatccagacagctgtgaccagctatgaggacctgggcctgtttgccttcggcctgcccgggaagctggtggtggccggcaccatcatcatccagaacattggagccatgagcagctacctgctgatcatcaagacagagctgcctgctgccatcgccgagttcctgaccggggactacagccgctactggtacctggatggccagaccctgctgatcatcatctgtgtgggcatcgtgttccccctggccctgctgcccaagattggcttcctgggctacaccagcagcctgtccttcttcttcatgatgttctttgccctggtggtgatcatcaagaagtggagcatcccctgccccctgaccctgaactacgtggagaagggcttccagatcagcaatgtgacagatgactgcaagcccaagctgttccacttcagcaaggagagcgcctatgccctgcccaccatggccttctccttcctgtgccacaccagcatcctgcccatctactgtgagctgcagagccccagcaagaagaggatgcagaatgtgaccaacacagccatcgccctgtccttcctgatctacttcatcagcgccctgtttggctacctgaccttctatgacaaggtggagagcgagctgctgaagggctacagcaagtacctgagccatgatgtggtggtgatgacagtgaagctgtgcatcctgtttgctgtgctgctgactgtgcccctcatccacttccctgccaggaaggctgtgaccatgatgttcttcagcaacttccccttctcctggatccgccacttcctgatcaccctggccctgaacatcatcatcgtgctgctggccatctacgtgcctgacatcagaaatgtgtttggagtggtgggcgccagcaccagcacctgcctgatcttcatcttccctggcctcttctacctgaagctgagccgggaggacttcctgtcctggaagaagctgggcggcctcatcctgagccaccggctggcctgcagcggggtcatcagcgcccactgcaacctgtgcctgcctgacagcagcaacccccccaccagcgccagccgggtggccgagaccaccggccgggacaccatggagatgtgcacccagaggaaaggacatgcccggacccagcaggagggcaactgcctgcaggccaagggccggggcctgcggaggaccaagagggtgcacaccctcatcctgcacttccccaccagcaggacagtgtccaagtag

SEQ ID NO: 38281 - DNA, 1551 bp, Artificial Sequence
  Description of Artificial Sequence: Synthetic coding sequence
ggcagcttcaatgctgagcggggctggtacgtgtctgtgcagcagcctgaggaggccgaggccgaggagctgagccccctgctgagcaatgagctgcaccggcagaggagccctggggtgtcctttggcctgtctgtgttcaacctgatgaatgccatcatgggcagcggcatcctgggcctggcctacgtgctggccaacacaggagtgtttggcttctccttcctgctgctgactgtggccctgctggccagctacagcgtgcacctgctgctgtccatgtgcatccagacagctgtgaccagctatgaggacctgggcctgtttgccttcggcctgcccgggaagctggtggtggccggcaccatcatcatccagaacatcggggccatgagcagctacctgctgatcatcaagacagagctgcctgctgccatcgccgagttcctgactggagactacagccgctactggtacctggatggccagaccctgctgatcatcatctgtgtgggcatcgtgttccccctggccctgctgcccaagattggcttcctgggctacaccagcagcctgtccttcttcttcatgatgttctttgccctggtggtgatcatcaagaagtggagcatcccctgccccctgaccctgaactacgtggagaagggcttccagatcagcaatgtgacagatgactgcaagcccaagctgttccacttcagcaaggagagcgcctatgccctgcccaccatggccttctccttcctgtgccacaccagcatcctgcccatctactgtgagctgcagagccccagcaagaagaggatgcagaatgtgaccaacacagccatcgccctgtccttcctgatctacttcatcagcgccctgtttggctacctgaccttctatgacaaggtggagagcgagctgctgaagggctacagcaagtacctgagccatgatgtggtggtgatgacagtgaagctgtgcatcctgtttgctgtgctgctgactgtgcccctcatccacttccctgccaggaaggctgtgaccatgatgttcttcagcaacttccccttctcctggatccgccacttcctgatcaccctggccctgaacatcatcatcgtgctgctggccatctacgtgcctgacatcagaaatgtgtttggagtggtgggcgccagcaccagcacctgcctgatcttcatcttccctggcctcttctacctgaagctgagccgggaggacttcctgtcctggaagaagctgggcggcctcatcctgagccaccggctggcctgcagcggggtcatcagcgcccactgcaacctgtgcctgcctgacagcagcaacccccccaccagcgccagccgggtggccgagaccaccggccgggacaccatggagatgtgcacccagaggaagggccacgcccggacccagcaggagggcaactgcctgcaggccaagggccggggcctgcggaggaccaagagggtgcacaccctcatcctgcacttccccaccagcaggacagtgtccaagtag

SEQ ID NO: 38282 - DNA, 1464 bp, Artificial Sequence
  Description of Artificial Sequence: Synthetic coding sequence
atgagcggcccccgcatcatgtacagcctgctgctggagctgcaccggcagaggagccctggggtgtcctttggcctgtctgtgttcaacctgatgaatgccatcatgggcagcggcatcctgggcctggcctacgtgctggccaacacaggagtgtttggcttctccttcctgctgctgactgtggccctgctggccagctacagcgtgcacctgctgctgtccatgtgcatccagacagctgtgaccagctatgaggacctgggcctgtttgccttcggcctgcccgggaagctggtggtggccggcaccatcatcatccagaacatcggggccatgagcagctacctgctgatcatcaagacagagctgcctgctgccatcgccgagttcctgactggagactacagccgctactggtacctggatggccagaccctgctgatcatcatctgtgtgggcatcgtgttccccctggccctgctgcccaagattggcttcctgggctacaccagcagcctgtccttcttcttcatgatgttctttgccctggtggtgatcatcaagaagtggagcatcccctgccccctgaccctgaactacgtggagaagggcttccagatcagcaatgtgacagatgactgcaagcccaagctgttccacttcagcaaggagagcgcctatgccctgcccaccatggccttctccttcctgtgccacaccagcatcctgcccatctactgtgagctgcagagccccagcaagaagaggatgcagaatgtgaccaacacagccatcgccctgtccttcctgatctacttcatcagcgccctgtttggctacctgaccttctatgacaaggtggagagcgagctgctgaagggctacagcaagtacctgagccatgatgtggtggtgatgacagtgaagctgtgcatcctgtttgctgtgctgctgactgtgcccctcatccacttccctgccaggaaggctgtgaccatgatgttcttcagcaacttccccttctcctggatccgccacttcctgatcaccctggccctgaacatcatcatcgtgctgctggccatctacgtgcctgacatcagaaatgtgtttggagtggtgggcgccagcaccagcacctgcctgatcttcatcttccctggcctcttctacctgaagctgagccgggaggacttcctgtcctggaagaagctgggcggcctcatcctgagccaccggctggcctgcagcggggtcatcagcgcccactgcaacctgtgcctgcctgacagcagcaacccccccaccagcgccagccgggtggccgagaccacagagaaggaggagatcccctggaggtgtgccccccggggcaaggccacccagggccacagcaagaaggccaccgtgtacaagccccgggaggaggccagcggggagcccaacgtgtccaccccctag

SEQ ID NO: 38283 - DNA, 1686 bp, Artificial Sequence
  Description of Artificial Sequence: Synthetic coding sequence
atggccaacatgaacagcgacagccgccacctgggcaccagcgaggtggaccacgagcgggaccccggccccatgaacatccagtttgagcccagcgacctgcggagcaagaggcccttctgcatcgagcccaccaacatcgtgaatgtgaaccacgtgatccagagggtgtctgaccacgccagcgccatgaacaagaggatccactactacagccggctgaccaccccagctgacaaggccctgattgccccagaccacgtggtgcctgcccctgaggagtgctacgtgtacagccccctgggcagcgcctacaagctgcagagctacacagagggctacggcaagaacaccagcctggtgaccatcttcatgatctggaacaccatgatgggcaccagcatcctgagcatcccctggggcatcaagcaggccggcttcaccaccggcatgtgtgtgatcatcctgatgggcctgctgaccctgtactgctgctacagagtggtgaagagcaggaccatgatgttcagcctggacaccacctcctgggagtacccagatgtgtgccgccactacttcggcagctttggccagtggagcagcctgctcttcagcctggtgtccctcatcggggccatgattgtgtactgggtgctgatgagcaacttcctgttcaacacaggcaagttcatcttcaacttcatccaccacatcaatgacacagacaccatcctgagcaccaacaacagcaaccctgtgatctgccccagcgctggcagcggcggccacccagacaacagctccatgatcttctacgccaatgacaccggggcccagcagtttgagaagtggtgggacaagagcaggacagtgcccttctacctggtgggcctgctgctgcccctgctgaacttcaagagccccagcttcttcagcaagttcaacatcctgggcaccgtgtctgtgctgtacctgatcttcctggtgaccttcaaggctgtgcggctgggcttccacctggagttccactggttcatccccacagagttctttgtgcctgagatccgcttccagttcccccagctgactggagtgctgaccctggccttcttcatccacaactgcatcatcaccctgctgaagaacaacaagaagcaggagaacaacgtgcgggacctgtgcatcgcctacatgctggtgaccctgacctacctgtacatcggcgtgctggtgtttgccagcttccccagcccccccctgagcaaggactgcatcgagcagaacttcctggacaacttccccagcagtgacaccctgtccttcatcgcccgcatcttcctgctcttccagatgatgacagtgtaccccctgctgggctacctggcccgggtgcagctgctgggccacatctttggagacatctaccccagcatcttccacgtgctgatcctgaacctgatcatcgtgggcgctggggtcatcatggcctgcttctaccccaacatcggcggcatcatccgctacagcggggccgcctgtggcctggcctttgtgttcatctaccccagcctcatctacatcatcagcctgcaccaggaggagcggctgacctggcccaagctgatcttccacgtgttcatcatcatcctgggcgtggccaacctgattgtgcagttcttcatgtag

SEQ ID NO: 38284 - DNA, 1686 bp, Artificial Sequence; identical to SEQ ID NO: 38283
  Description of Artificial Sequence: Synthetic coding sequence

SEQ ID NO: 38285 - DNA, 1314 bp, Artificial Sequence
  Description of Artificial Sequence: Synthetic coding sequence
atgatctggaacaccatgatgggcaccagcatcctgagcatcccctggggcatcaagcaggccggcttcaccaccggcatgtgtgtgatcatcctgatgggcctgctgaccctgtactgctgctacagagtggtgaagagcaggaccatgatgttcagcctggacaccacctcctgggagtacccagatgtgtgccgccactacttcggcagctttggccagtggagcagcctgctcttcagcctggtgtccctcatcggggccatgattgtgtactgggtgctgatgagcaacttcctgttcaacacaggcaagttcatcttcaacttcatccaccacatcaatgacacagacaccatcctgagcaccaacaacagcaaccctgtgatctgccccagcgctggcagcggcggccacccagacaacagctccatgatcttctacgccaatgacaccggggcccagcagtttgagaagtggtgggacaagagcaggacagtgcccttctacctggtgggcctgctgctgcccctgctgaacttcaagagccccagcttcttcagcaagttcaacatcctgggcaccgtgtctgtgctgtacctgatcttcctggtgaccttcaaggctgtgcggctgggcttccacctggagttccactggttcatccccacagagttctttgtgcctgagatccgcttccagttcccccagctgactggagtgctgaccctggccttcttcatccacaactgcatcatcaccctgctgaagaacaacaagaagcaggagaacaacgtgcgggacctgtgcatcgcctacatgctggtgaccctgacctacctgtacatcggcgtgctggtgtttgccagcttccccagcccccccctgagcaaggactgcatcgagcagaacttcctggacaacttccccagcagtgacaccctgtccttcatcgcccgcatcttcctgctcttccagatgatgacagtgtaccccctgctgggctacctggcccgggtgcagctgctgggccacatctttggagacatctaccccagcatcttccacgtgctgatcctgaacctgatcatcgtgggcgctggggtcatcatggcctgcttctaccccaacatcggcggcatcatccgctacagcggggccgcctgtggcctggcctttgtgttcatctaccccagcctcatctacatcatcagcctgcaccaggaggagcggctgacctggcccaagctgatcttccacgtgttcatcatcatcctgggcgtggccaacctgattgtgcagttcttcatgtag

SEQ ID NO: 38286 - DNA, 396 bp, Artificial Sequence
  Description of Artificial Sequence: Synthetic coding sequence
atggccaacatgaacagcgacagccgccacctgggcaccagcgaggtggaccacgagcgggaccccggccccatgaacatccagtttgagcccagcgacctgcggagcaagaggcccttctgcatcgagcccaccaacatcgtgaatgtgaaccacgtgatccagagggtgtctgaccacgccagcgccatgaacaagaggatccactactacagccggctgaccaccccagctgacaaggccctgattgccccagaccacgtggtgcctgcccctgaggagtgctacgtgtacagccccctgggcagcgcctacaagctgcagagctacacagagggctacggcaagaacaccagcctggtgaccatcttcatgatctggaacaccatgatgtag

SEQ ID NO: 38287 - DNA, 114 bp, Artificial Sequence
  Description of Artificial Sequence: Synthetic coding sequence
atggccaacatgaacagcgacagccgccacctgggcaccagcgaggtggaccacgagcgggaccccggccccatgaacatccagtttgagcccagcgacctgcggagcaagtag

SEQ ID NO: 38288 - DNA, 114 bp, Artificial Sequence; identical to SEQ ID NO: 38287
  Description of Artificial Sequence: Synthetic coding sequence

SEQ ID NO: 38289 - DNA, 1497 bp, Artificial Sequence
  Description of Artificial Sequence: Synthetic coding sequence
atggccatctgcatcctgacctggaggatccggcccttctgcatcgagcccaccaacatcgtgaatgtgaaccacgtgatccagagggtgtctgaccacgccagcgccatgaacaagaggatccactactacagccggctgaccaccccagctgacaaggccctgattgccccagaccacgtggtgcctgccccagaagaatgttatgtgtacagccccctgggcagcgcctacaagctgcagagctacacagagggctacggcaagaacaccagcctggtgaccatcttcatgatctggaacaccatgatgggcaccagcatcctgagcatcccctggggcatcaagcaggccggcttcaccaccggcatgtgtgtgatcatcctgatgggcctgctgaccctgtactgctgctacagagtggtgaagagcaggaccatgatgttcagcctggacaccacctcctgggagtacccagatgtgtgccgccactacttcggcagctttggccagtggagcagcctgctcttcagcctggtgtccctgattggagccatgattgtgtactgggtgctgatgagcaacttcctgttcaacacaggcaagttcatcttcaacttcatccaccacatcaatgacacagacaccatcctgagcaccaacaacagcaaccctgtgatctgccccagcgctggcagcggcggccacccagacaacagctccatgatcttctacgccaatgacacaggagcccagcagtttgagaagtggtgggacaagagcaggacagtgcccttctacctggtgggcctgctgctgcccctgctgaacttcaagagccccagcttcttcagcaagttcaacatcctggagatccgcttccagttcccccagctgactggagtgctgaccctggccttcttcatccacaactgcatcatcaccctgctgaagaacaacaagaagcaggagaacaacgtgcgggacctgtgcatcgcctacatgctggtgaccctgacctacctgtacatcggcgtgctggtgtttgccagcttccccagcccccccctgagcaaggactgcatcgagcagaacttcctggacaacttccccagcagtgacaccctgtccttcatcgcccgcatcttcctgctcttccagatgatgacagtgtaccccctgctgggctacctggcccgggtgcagctgctgggccacatctttggagacatctaccccagcatcttccacgtgctgatcctgaacctgatcatcgtgggcgctggggtcatcatggcctgcttctaccccaacattggaggcatcatccgctacagcggggccgcctgtggcctggcctttgtgttcatctaccccagcctcatctacatcatcagcctgcaccaggaggagcggctgacctggcccaagctgatcttccacgtgttcatcatcatcctgggcgtggccaacctgattgtgcagttcttcatgtag

SEQ ID NO: 38290 - DNA, 81 bp, Artificial Sequence
  Description of Artificial Sequence: Synthetic coding sequence
atggccaacatgaacagcgacagccgccacctgggcaccagcgaggtggaccacgagcgggaccccggccccatgaactag

SEQ ID NO: 38291 - DNA, 294 bp, Artificial Sequence
  Description of Artificial Sequence: Synthetic coding sequence
atggccaacatgaacagcgacagccgccacctgggcaccagcgaggtggaccacgagcgggaccccggccccatgaacatccagtttgagcccagcgacctgcggagcaagaggcccttctgcatcgagcccaccaacatcgtgaatgtgaaccacgtgatccagagggtgtctgaccacgccagcgccatgaacaagaggatccactactacagccggctgaccaccccagctgacaaggccctgattgccccagaccacgtggtgcctgcccctgaggagtgctacgtgtag

SEQ ID NO: 38292 - DNA, 1497 bp, Artificial Sequence
  Description of Artificial Sequence: Synthetic coding sequence
atgaacaagaggatccactactacagccggctgaccaccccagctgacaaggccctgattgccccagaccacgtggtgcctgccccagaagaatgttatgtgtacagccccctgggcagcgcctacaagctgcagagctacacagagggctacggcaagaacaccagcctggtgaccatcttcatgatctggaacaccatgatgggcaccagcatcctgagcatcccctggggcatcaagcaggccggcttcaccaccggcatgtgtgtgatcatcctgatgggcctgctgaccctgtactgctgctacagagtggtgaagagcaggaccatgatgttcagcctggacaccacctcctgggagtacccagatgtgtgccgccactacttcggcagctttggccagtggagcagcctgctcttcagcctggtgtccctgattggagccatgattgtgtactgggtgctgatgagcaacttcctgttcaacacaggcaagttcatcttcaacttcatccaccacatcaatgacacagacaccatcctgagcaccaacaacagcaaccctgtgatctgccccagcgctggcagcggcggccacccagacaacagctccatgatcttctacgccaatgacacaggagcccagcagtttgagaagtggtgggacaagagcaggacagtgcccttctacctggtgggcctgctgctgcccctgctgaacttcaagagccccagcttcttcagcaagttcaacatcctgggcaccgtgtctgtgctgtacctgatcttcctggtgaccttcaaggctgtgcggctgggcttccacctggagttccactggttcatccccacagagttctttgtgcctgagatccgcttccagttcccccagctgactggagtgctgaccctggccttcttcatccacaactgcatcatcaccctgctgaagaacaacaagaagcaggagaacaacgtgcgggacctgtgcatcgcctacatgctggtgaccctgacctacctgtacatcggcgtgctggtgtttgccagcttccccagcccccccctgagcaaggactgcatcgagcagaacttcctggacaacttccccagcagtgacaccctgtccttcatcgcccgcatcttcctgctcttccagatgatgacagtgtaccccctgctgggctacctggcccgggtgcagctgctgggccacatctttggagacatctaccccagcatcttccacgtgctgatcctgaacctgatcatcgtgggcgctggggtcatcatggcctgcttctaccccaacattggaggcatcatccgctacagcggggccgcctgtggcctggcctttgtgttcatctaccccagcctcatctacatcatcagcctgcaccaggaggagcggctgacctggcccaagctgatcttccacgtgttcatcatcatcctgggcgtggccaacctgattgtgcagttcttcatgtag

SEQ ID NO: 38293 - DNA, 1389 bp, Artificial Sequence
  Description of Artificial Sequence: Synthetic coding sequence
atggccaacatgaacagcgacagccgccacctgggcaccagcgaggtggaccacgagcgggaccccggccccatgaacatccagtttgagcccagcgacctgcggagcaagaggcccttctgcatcgagcccaccaacatcgtgaatgtgaaccacgtgatccagagggtgtctgaccacgccagcgccatgaacaagaggatccactactacagccggctgaccaccccagctgacaaggccctgattgccccagaccacgtggtgcctgcccctgaggagtgctacgtgtacagccccctgggcagcgcctacaagctgcagagctacacagagggctacggcaagaacaccagcctggtgaccatcttcatgatctggaacaccatgatgggcaccagcatcctgagcatcccctggggcatcaagcaggccggcttcaccaccggcatgtgtgtgatcatcctgatgggcctgctgaccctgtactgctgctacagagtggtgaagagcaggaccatgatgttcagcctggacaccacctcctgggagtacccagatgtgtgccgccactacttcggcagctttggccagtggagcagcctgctcttcagcctggtgtccctcatcggggccatgattgtgtactgggtgctgatgagcaacttcctgttcaacacaggcaagttcatcttcaacttcatccaccacatcaatgacacagacaccatcctgagcaccaacaacagcaaccctgtgatctgccccagcgctggcagcggcggccacccagacaacagctccatgatcttctacgccaatgacaccggggcccagcagtttgagaagtggtgggacaagagcaggacagtgcccttctacctggtgggcctgctgctgcccctgctgaacttcaagagccccagcttcttcagcaagttcaacatcctgggcaccgtgtctgtgctgtacctgatcttcctggtgaccttcaaggctgtgcggctgggcttccacctggagttccactggttcatccccacagagttctttgtgcctgagatccgcttccagttcccccagctgactggagtgctgaccctggccttcttcatccacaactgcatcatcaccctgctgaagaacaacaagaagcaggagaacaacgtgcgggacctgtgcatcgcctacatgctggtgaccctgacctacctgtacatcggcgtgctggtgtttgccagcttccccagcccccccctgagcaaggactgcatcgagcaggtgcgccaccgggtgcccagcctgtgtgactgtgtgcacttccacgtgttcatcgtgggccgggtcatccagtggcaggacatcaccagtgaccggcccggcttctag

SEQ ID NO: 38294 - DNA, 1008 bp, Artificial Sequence
  Description of Artificial Sequence: Synthetic coding sequence
atgctgcagggccacagctctgtgttccaggccctgctgggcaccttcttcacctggggcatgacagctgctggggccgccctggtgtttgtgttcagcagcggccagaggcgcatcctggatggcagcctgggctttgctgctggggtgatgctggccgccagctactggagcctgctggccccagctgtggagatggccaccagcagcggcggctttggagcctttgccttcttccctgtggccgtgggcttcaccctgggcgccgcctttgtgtacctggccgacctgctgatgccccacctgggcgctgctgaggacccccagaccaccctggccctgaactttggcagcaccctgatgaagaagaagagtgaccctgagggccctgccctgctcttccctgagagcgagctgagcatcagaattgacaagtcagaaaatggagaggcctaccagaggaagaaggccgccgccaccggcctgcctgagggccctgctgtgcctgtgcccagccggggcaacctggcccagcccggcggcagctcctggaggagaattgccctgctgatcctggccatcaccatccacaacgtgcctgagggcctggccgtgggcgtgggctttggagccatcgagaagacagccagcgccacctttgagagcgccaggaacctggccatcggcatcggcatccagaacttccctgagggcctggccgtgtccctgcccctgcggggggccggcttcagcacctggagggccttctggtacggccagctgagcggcatggtggagcccctggccggcgtgtttggagcctttgctgtggtgctggccgagcccatcctgccctatgccctggcctttgctgctggggccatggtgtatgtggtgatggatgacatcatccctgaggcccagatctctggaaatggcaagctggcctcctgggccagcatcctgggctttgtggtgatgatgagcctggatgtgggcctgggctag

SEQ ID NO: 38295 - DNA, 1029 bp, Artificial Sequence
  Description of Artificial Sequence: Synthetic coding sequence
atgctgcagggccacagctctgtgttccaggccctgctgggcaccttcttcacctggggcatgacagctgctggggccgccctggtgtttgtgttcagcagcggccagaggcgcatcctggatggcagcctgggctttgctgctggggtgatgctggccgccagctactggagcctgctggccccagctgtggagatggccaccagcagcggcggctttggagcctttgccttcttccctgtggccgtgggcttcaccctgggcgccgcctttgtgtacctggccgacctgctgatgccccacctgggcgctgctgaggacccccagaccaccctggccctgaactttggcagcaccctgatgaagaagaagagtgaccctgagggccctgccctgctcttccctgagagcgagctgagcatcagaattggccgggccggcctgctgagtgacaagtcagaaaatggagaggcctaccagaggaagaaggctgctgccaccggcctgcctgagggccctgctgtgcctgtgcccagccggggcaacctggcccagcccggcggcagctcctggaggcgcatcgccctgctgatcctggccatcaccatccacaacgtgcctgagggcctggccgtgggcgtgggctttggagccatcgagaagacagccagcgccacctttgaaagtgccaggaacctggccatcggcatcggcatccagaacttccctgagggcctggccgtgtccctgcccctgcggggagctggcttcagcacctggagggccttctggtacggccagctgagcggcatggtggagcccctggccggcgtgtttggagcctttgctgtggtgctggccgagcccatcctgccctatgccctggcctttgctgctggggccatggtgtatgtggtgatggatgacatcatccctgaggcccagatctctggaaatggcaagctggcctcctgggccagcatcctgggctttgtggtgatgatgagcctggatgtgggcctgggctag

SEQ ID NO: 38296 - DNA, 1623 bp, Artificial Sequence
  Description of Artificial Sequence: Synthetic coding sequence
atgatgggcagccctgtgagccacctgctggccggcttctgtgtgtgggtggtgctgggctgggtgggcggctctgtgcccaacctgggccctgctgagcaggagcagaaccactacctggcccagctgtttggcctgtatggagaaaatggcaccctgacagctgggggcctggcccggctgctgcacagcctgggcctgggccgggtgcagggcctgcggctgggccagcacggccccctgaccggccgggccgccagccctgctgctgacaacagcacccaccggccccagaaccctgagctgtctgtggatgtgtgggccggcatgcccctgggccccagcggctggggagacctggaggagagcaaggccccccacctgccccggggccctgcccccagcggcctggacctgctgcaccggctgctgctgctggaccacagcctggccgaccacctgaatgaagactgcctgaatggcagccagctgctggtgaactttggcctgagccctgctgcccccctgaccccccggcagtttgccctgctgtgcccagccctgctgtaccagattgacagccgggtgtgcatcggggccccagccccagcccctcctggggacctgctgagcgccctgctgcagagcgccctggccgtgctgctgctgagcctgcccagccccctgagcctgctgctgctgcggctgctgggcccccggctgctgcggcccctgctgggcttcctgggcgccctggccgtgggcaccctgtgtggagatgccctgctgcacctgctgccccacgcccaggagggcagacatgctggccctgggggcctgcctgagaaggacctgggccctggcctgtctgtgctgggcggcctcttcctgctgtttgtgctggagaacatgctgggcctgctgcggcaccggggcctgcggccccgctgctgcaggaggaagagaagaaacctggagaccaggaacctggaccctgaaaatggcagcggcatggccctgcagcccctgcaggccgcccctgagcccggggcccagggccagcgggagaagaacagccagcaccccccagccctggcccctcctggccaccagggccacagccacggccaccagggcggcacagacatcacctggatggtgctgctgggagatggcctgcacaacctgacagatggcctggccatcggggccgccttcagtgatggcttcagcagcggcctgagcaccaccctggccgtgttctgccacgagctgccccatgagctgggggactttgccatgctgctgcagagcggcctgtccttccggcggctgctgctgctgagcctggtgtctggggccctgggcctgggcggcgctgtgctgggcgtgggcctgagcctgggccctgtgcccctgaccccctgggtgtttggagtgacagctggggtcttcctgtatgtggccctggtggacatgctgcctgccctgctgcggcccccagagcccctgcccaccccccacgtgctgctgcagggcctgggcctgctgctgggcggcggcctgatgctggccatcaccctgctggaggagcggctgctgcctgtgaccacagagggctag

SEQ ID NO: 38297 - DNA, 390 bp, Artificial Sequence
  Description of Artificial Sequence: Synthetic coding sequence
atgatgggcagccctgtgagccacctgctggccggcttctgtgtgtgggtggtgctgggctgggtgggcggctctgtgcccaacctgggccctgctgagcaggagcagaaccactacctggcccagctgtttggcctgtatggagaaaatggcaccctgacagctgggggcctggcccggctgctgcacagcctgggcctgggccgggtgcagggcctgcggctgggccagcacggccccctgaccggccgggccgccagccctgctgctgacaacagcacccaccggccccagaaccctgagctgtctgtggatgtgtgggccggcatgcccctgggccccagcggctggggagacctggaggagagcaaggccccccacctgccctag

SEQ ID NO: 38298 - DNA, 471 bp, Artificial Sequence
  Description of Artificial Sequence: Synthetic coding sequence
atgatgggcagccctgtgagccacctgctggccggcttctgtgtgtgggtggtgctgggctgggtgggcggctctgtgcccaacctgggccctgctgagcaggagcagaaccactacctggcccagctgtttggcctgtatggagaaaatggcaccctgacagctgggggcctggcccggctgctgcacagcctgggcctgggccgggtgcagggcctgcggctgggccagcacggccccctgaccggccgggccgccagccctgctgctgacaacagcacccaccggccccagaaccctgagctgtctgtggatgtgtgggccggcatgcccctgggccccagcggctggggagacctggaggagagcaaggccccccacctgccccggggccctgcccccagcggcctggacctgctgcaccggctgctgctgctggaccacagcctggccgaccacctgaatgaatag

SEQ ID NO: 38299 - DNA, 372 bp, Artificial Sequence
  Description of Artificial Sequence: Synthetic coding sequence
atgatgggcagccctgtgagccacctgctggccggcttctgtgtgtgggtggtgctgggctgggtgggcggctctgtgcccaacctgggccctgctgagcaggagcagaaccactacctggcccagctgtttggcctgtatggagaaaatggcaccctgacagctgggggcctggcccggctgctgcacagcctgggcctgggccgggtgcagggcctgcggctgggccagcacggccccctgaccggccgggccgccagccctgctgctgacaacagcacccaccggccccagaaccctgagctgtctgtggatgtgtgggccggcatgcccctgggccccagcggctggggagacctggaggagagctag

SEQ ID NO: 38300 - DNA, 381 bp, Artificial Sequence
  Description of Artificial Sequence: Synthetic coding sequence
atgatgggcagccctgtgagccacctgctggccggcttctgtgtgtgggtggtgctgggctgggtgggcggctctgtgcccaacctgggccctgctgagcaggagcagaaccactacctggcccagctgtttggcctgtatggagaaaatggcaccctgacagctgggggcctggcccggctgctgcacagcctgggcctgggccgggtgcagggcctgcggctgggccagcacggccccctgaccggccgggccgccagccctgctgctgacaacagcacccaccggccccagaaccctgagctgtctgtggatgtgtgggccggcatgcccctgggccccagcggctggggagacctggaggagagcaaggccccctag

SEQ ID NO: 38301 - DNA, 1623 bp, Artificial Sequence; identical to SEQ ID NO: 38296
  Description of Artificial Sequence: Synthetic coding sequence

SEQ ID NO: 38302 - DNA, 699 bp, Artificial Sequence
  Description of Artificial Sequence: Synthetic coding sequence
atggatgacttcatcagcatcagcctgctgagcctggccatgctggtgggctgctacgtggccggcatcatccccctggccgtgaacttcagcgaggagcggctgaagctggtgacagtgctgggcgccggcctgctgtgtggcacagccctggccgtcatcgtgcctgagggcgtgcacgccctgtatgaggacatcctggagggcaagcaccaccaggccagcgagacccacaacgtgattgccagtgacaaggctgctgagaagtctgtggtgcatgaacatgagcacagccatgaccacacccagctgcacgcctacatcggcgtgtccctggtgctgggctttgtgttcatgctgctggtggaccagatcggcaacagccacgtgcacagcacagatgatcctgaggccgcccggagcagcaacagcaagatcaccaccaccctgggcctggtggtgcacgccgctgctgatggagtggccctgggcgccgccgccagcaccagccagacctctgtgcagctgattgtgtttgtggccatcatgctgcacaaggccccagctgccttcggcctggtgtccttcctgatgcacgccggcctggagaggaaccgcatcaggaagcacctgctggtgtttgccctggccgcccctgtgatgtccatggtgacctacctgggcctgagcaaggactag

SEQ ID NO: 38303 - DNA, 2496 bp, Artificial Sequence
  Description of Artificial Sequence: Synthetic coding sequence
atgaaggtgcacatgcacaccaagttctgcctgatctgcctgctgaccttcatcttccaccactgcaaccactgccacgaggagcatgaccacggccctgaggccctgcaccggcagcaccggggcatgacagagctggagcccagcaagttcagcaagcaggccgcagaaaatgagaagaagtactacatcgagaagctgtttgaaagatatggagaaaatggccgcctgtccttcttcggcctggagaagctgctgaccaacctgggcctgggggagaggaaggtggtggagatcaaccacgaggacctgggccatgaccacgtgagccacctggacatcctggccgtgcaggagggcaagcacttccacagccacaaccaccagcacagccacaaccacctgaacagcgagaaccagacagtgacctctgtgtccaccaagaggaaccacaagtgtgaccctgagaaggagaccgtggaggtgtctgtgaagagtgatgacaagcacatgcatgaccacaaccaccggctgcggcaccaccaccggctgcaccaccacctggaccacaacaacacccaccacttccacaatgacagcatcacccccagcgagcggggggagcccagcaatgagcccagcacagagaccaacaagacccaggagcagagtgatgtgaagctgcccaagggcaagaggaagaagaagggcaggaagagcaatgaaaacagcgaggtgatcaccccaggcttcccccccaaccacgaccagggcgagcagtatgagcacaacagagtgcacaagccagacagagtgcacaaccctggccacagccacgtgcacctgcctgagagaaatggacatgaccccggccggggccaccaggacctggaccctgacaatgaaggagagctgcggcacaccaggaagcgggaggcccctcatgtgaagaacaatgccatcatcagcctgaggaaggacctgaatgaagatgaccaccaccacgagtgcctgaatgtgacccagctgctgaagtactacggccatggagccaacagccccatcagcacagacctcttcacctacctgtgcccagccctgctgtaccagattgacagccggctgtgcatcgagcactttgacaagctgctggtggaggacatcaacaaggacaagaacctggtgcctgaagatgaggccaacatcggggccagcgcctggatctgtggcatcatcagcatcaccgtcatcagcctgctgagcctgctgggcgtcatcctggtgcccatcatcaaccagggctgcttcaagttcctgctgaccttcctggtggccctggccgtgggcaccatgtctggagatgccctgctgcacctgctgccccacagccagggcggccatgaccacagccaccagcacgcccacggccacggccacagccacggccacgagagcaacaagttcctggaggagtatgatgctgtgctgaagggcctggtggccctgggcggcatctacctgctcttcatcatcgagcactgcatccgcatgttcaagcactacaagcagcagaggggcaagcagaagtggttcatgaagcagaacacagaggagagcaccatcggcaggaagctgagtgaccacaagctgaacaacaccccagacagcgactggctgcagctgaagcccctggccggcacagatgacagcgtggtgtctgaggaccggctgaatgaaacagagctgacagacctggagggccagcaggagagcccccccaagaactacctgtgcatcgaggaggagaagatcatcgaccacagccacagtgatggcctgcacaccatccatgaacatgacctgcatgctgctgcccacaaccaccacggggagaacaagacagtgctgaggaagcacaaccaccagtggcaccacaagcacagccaccacagccacggcccctgccacagcggcagtgacctgaaggagaccggcatcgccaacatcgcctggatggtgatcatgggagatggcatccacaacttcagtgatggcctggccatcggggccgccttctctgctggcctgactggaggcatcagcaccagcattgctgtgttctgccacgagctgccccatgagctgggggactttgctgtgctgctgaaggccggcatgacagtgaagcaggccatcgtgtacaacctgctgagcgccatgatggcctacatcggcatgctgattggaacagctgtgggccagtatgccaacaacatcaccctgtggatctttgctgtgacagctggcatgttcctgtatgtggccctggtggacatgctgcctgagatgctgcatggagatggagacaatgaggagcacggcttctgccctgtgggccagttcatcctgcagaacctgggcctgctgtttggatttgccatcatgctggtgattgccctgtatgaggacaagatcgtgtttgacatccagttctag

SEQ ID NO: 38304 - DNA, 2496 bp, Artificial Sequence; identical to SEQ ID NO: 38303
  Description of Artificial Sequence: Synthetic coding sequence

SEQ ID NO: 38305 - DNA, 117 bp, Artificial Sequence
  Description of Artificial Sequence: Synthetic coding sequence
atgaaggtgcacatgcacaccaagttctgcctgatctgcctgctgaccttcatcttccaccactgcaaccactgccacgaggagcatgaccacggccctgaggccctgcacaggtag

SEQ ID NO: 38306 - DNA, 393 bp, Artificial Sequence
  Description of Artificial Sequence: Synthetic coding sequence
atgaaggtgcacatgcacaccaagttctgcctgatctgcctgctgaccttcatcttccaccactgcaaccactgccacgaggagcatgaccacggccctgaggccctgcaccggcagcaccggggcatgacagagctggagcccagcaagttcagcaagcaggccgcagaaaatgagaagaagtactacatcgagaagctgtttgaaagatatggagaaaatggccgcctgtccttcttcggcctggagaagctgctgaccaacctgggcctgggggagaggaaggtggtggagatcaaccacgaggacctgggccatgaccacgtgagccacctggacatcctggccgtgcaggagggcaagcacttccacagccacaaccaccagcactag

SEQ ID NO: 38307 - DNA, 381 bp, Artificial Sequence
  Description of Artificial Sequence: Synthetic coding sequence
atgaaggtgcacatgcacaccaagttctgcctgatctgcctgctgaccttcatcttccaccactgcaaccactgccacgaggagcatgaccacggccctgaggccctgcaccggcagcaccggggcatgacagagctggagcccagcaagttcagcaagcaggccgcagaaaatgagaagaagtactacatcgagaagctgtttgaaagatatggagaaaatggccgcctgtccttcttcggcctggagaagctgctgaccaacctgggcctgggggagaggaaggtggtggagatcaaccacgaggacctgggccatgaccacgtgagccacctggacatcctggccgtgcaggagggcaagcacttccacagccactag

SEQ ID NO: 38308 - DNA, 1146 bp, Artificial Sequence
  Description of Artificial Sequence: Synthetic coding sequence
atgtctggagatgccctgctgcacctgctgccccacagccagggcggccatgaccacagccaccagcacgcccacggccacggccacagccacggccacgagagcaacaagttcctggaggagtatgatgctgtgctgaagggcctggtggccctgggcggcatctacctgctcttcatcatcgagcactgcatccgcatgttcaagcactacaagcagcagaggggcaagcagaagtggttcatgaagcagaacacagaggagagcaccatcggcaggaagctgagtgaccacaagctgaacaacaccccagacagcgactggctgcagctgaagcccctggccggcacagatgacagcgtggtgtctgaggaccggctgaatgaaacagagctgacagacctggagggccagcaggagagcccccccaagaactacctgtgcatcgaggaggagaagatcatcgaccacagccacagtgatggcctgcacaccatccatgaacatgacctgcatgctgctgcccacaaccaccacggggagaacaagacagtgctgaggaagcacaaccaccagtggcaccacaagcacagccaccacagccacggcccctgccacagcggcagtgacctgaaggagaccggcatcgccaacatcgcctggatggtgatcatgggagatggcatccacaacttcagtgatggcctggccatcggggccgccttctctgctggcctgactggaggcatcagcaccagcattgctgtgttctgccacgagctgccccatgagctgggggactttgctgtgctgctgaaggccggcatgacagtgaagcaggccatcgtgtacaacctgctgagcgccatgatggcctacatcggcatgctgattggaacagctgtgggccagtatgccaacaacatcaccctgtggatctttgctgtgacagctggcatgttcctgtatgtggccctggtggacatgctgcctgagatgctgcatggagatggagacaatgaggagcacggcttctgccctgtgggccagttcatcctgcagaacctgggcctgctgtttggatttgccatcatgctggtgattgccctgtatgaggacaagatcgtgtttgacatccagttctag

SEQ ID NO: 38309 - DNA, 2076 bp, Artificial Sequence
  Description of Artificial Sequence: Synthetic coding sequence
atgtgcttccgcaccaagctgtctgtgtcctgggtgcccctcttcctgctgctgagcagggtcttcagcacagaaacagacaagcccagcgcccaggacagccgcagccggggcagcagcggccagcctgctgacctgctgcaggtgctgtctgctggggaccaccccccccacaaccacagccgcagcctcatcaagaccctgctggagaagacaggctgccccaggagaagaaatggcatgcagggcgactgcaacctgtgctttgagccagatgccctgctgctgattgctgggggcaactttgaggaccagctgcgggaggaggtggtgcagagggtgtccctgctgctgctgtactacatcatccaccaggaggagatctgcagcagcaagctgaacatgagcaacaaggagtacaagttctacctgcacagcctgctgagcctgcggcaggatgaggacagcagcttcctgagccagaatgaaacagaggacatcctggccttcacccggcagtactttgacaccagccagagccagtgcatggagaccaagaccctgcagaagaagagcggcatcgtgtcctctgagggcgccaatgaaagcaccctgccccagctggccgccatgatcatcaccctgagcctgcagggcgtgtgcctgggccagggcaacctgcccagcccagactacttcacagagtacatcttcagcagcctgaacagaaccaacaccctgcggctgtctgagctggaccagctgctgaacaccctgtggaccaggagcacctgcatcaagaatgagaagatccaccagttccagaggaagcagaacaacatcatcacccatgaccaggactacagcaacttcagcagctccatggagaaggagagtgaagatggccctgtgtcctgggaccagacctgcttcagcgcccggcagctggtggagatcttcctgcagaagggcctgagcctcatcagcaaagaagacttcaagcagatgagccctggcatcatccagcagctgctgagctgcagctgccacctgcccaaggaccagcaggccaagctgccccccaccaccctggagaagtatggctacagcacagtggccgtgaccctgctgaccctgggctccatgctgggcacagccctggtgctcttccacagctgtgaggagaactaccgcctcatcctgcagctgtttgtgggcctggccgtgggcaccctgtctggagatgccctgctgcacctgatcccccaggtgctgggcctgcacaagcaggaggcccctgagtttggccacttccacgagagcaagggccacatctggaagctgatgggcctcatcggcggcatccacggcttcttcctgattgagaagtgcttcatcctgctggtgagccccaatgacaagcagggcctgagcctggtgaatggacatgtgggccacagccaccacctggccctgaacagcgagctgagtgaccaggccggccggggcaagagcgccagcaccatccagctgaagagccctgaggacagccaggccgctgagatgcccatcggctccatgacagccagcaacaggaagtgcaaggccatcagcctgctggccatcatgatcctggtgggggacagcctgcacaactttgctgatggcctggccatcggggccgccttcagcagcagcagcgagagcggcgtgaccaccaccatcgccatcctgtgccacgagatcccccatgagatgggagactttgctgtgctgctgagcagcggcctgtccatgaagacagccatcctgatgaacttcatcagcagcctgacagccttcatgggcctgtacatcggcctgtctgtgtctgctgacccctgtgtgcaggactggatcttcaccgtgacagctggcatgttcctgtacctgagcctggtggagatgctgcctgagatgacccacgtgcagacccagaggccctggatgatgttcctgctgcagaactttggcctcatcctgggctggctgagcctgctgctgctggccatctatgagcagaacatcaagatctag

SEQ ID NO: 38310 - DNA, 2073 bp, Artificial Sequence
  Description of Artificial Sequence: Synthetic coding sequence
atgtgcttccgcaccaagctgtctgtgtcctgggtgcccctcttcctgctgctgagcagggtcttcagcacagaaacagacaagcccagcgcccaggacagccgcagccggggcagcagcggccagcctgctgacctgctgcaggtgctgtctgctggggaccaccccccccacaaccacagccgcagcctcatcaagaccctgctggagaagacaggctgccccaggagaagaaatggcatgcagggcgactgcaacctgtgctttgagccagatgccctgctgctgattgctgggggcaactttgaggaccagctgcgggaggaggtggtgcagagggtgtccctgctgctgctgtactacatcatccaccaggaggagatctgcagcagcaagctgaacatgagcaacaaggagtacaagttctacctgcacagcctgctgagcctgcggcaggatgaggacagcagcttcctgagccagaatgaaacagaggacatcctggccttcacccggcagtactttgacaccagccagagccagtgcatggagaccaagaccctgcagaagaagagcggcatcgtgtcctctgagggcgccaatgaaagcaccctgccccagctggccgccatgatcatcaccctgagcctgcagggcgtgtgcctgggccagggcaacctgcccagcccagactacttcacagagtacatcttcagcagcctgaacagaaccaacaccctgcggctgtctgagctggaccagctgctgaacaccctgtggaccaggagcacctgcatcaagaatgagaagatccaccagttccagaggaagcagaacaacatcatcacccatgaccaggactacagcaacttcagcagctccatggagaaggagagtgaagatggccctgtgtcctgggaccagacctgcttcagcgcccggcagctggtggagatcttcctgcagaagggcctgagcctcatcagcaaagaagacttcaagcagatgagccctggcatcatccagcagctgctgagctgcagctgccacctgcccaaggaccagcaggccaagctgccccccaccaccctggagaagtatggctacagcacagtggccgtgaccctgctgaccctgggctccatgctgggcacagccctggtgctcttccacagctgtgaggagaactaccgcctcatcctgcagctgtttgtgggcctggccgtgggcaccctgtctggagatgccctgctgcacctgatcccccaggtgctgggcctgcacaagcaggaggcccctgagtttggccacttccacgagagcaagggccacatctggaagctgatgggcctcatcggcggcatccacggcttcttcctgattgagaagtgcttcatcctgctggtgagccccaatgacaagggcctgagcctggtgaatggccacgtgggccacagccaccacctggccctgaacagcgagctgagtgaccaggccggccggggcaagagcgccagcaccatccagctgaagagccctgaggacagccaggccgctgagatgcccatcggctccatgacagccagcaacaggaagtgcaaggccatcagcctgctggccatcatgatcctggtgggggacagcctgcacaactttgctgatggcctggccatcggggccgccttcagcagcagcagcgagagcggcgtgaccaccaccatcgccatcctgtgccacgagatcccccatgagatgggagactttgctgtgctgctgagcagcggcctgtccatgaagacagccatcctgatgaacttcatcagcagcctgacagccttcatgggcctgtacatcggcctgtctgtgtctgctgacccctgtgtgcaggactggatcttcaccgtgacagctggcatgttcctgtacctgagcctggtggagatgctgcctgagatgacccacgtgcagacccagaggccctggatgatgttcctgctgcagaactttggcctcatcctgggctggctgagcctgctgctgctggccatctatgagcagaacatcaagatctag

SEQ ID NO: 38311 - DNA, 1965 bp, Artificial Sequence
  Description of Artificial Sequence: Synthetic coding sequence
atgtgcttccgcaccaagctgtctgtgtcctgggtgcccctcttcctgctgctgagcagggtcttcagcacagaaacagacaagcccagcgcccaggacagccgcagccggggcagcagcggccagcctgctgacctgctgcaggtgctgtctgctggggaccaccccccccacaaccacagccgcagcctcatcaagaccctgctggagaagacaggctgccccaggagaagaaatggcatgcagggcgactgcaacctgtgctttgagccagatgccctgctgctgattgctgggggcaactttgaggaccagctgcgggaggaggtggtgcagagggtgtccctgctgctgctgtactacatcatccaccaggaggagatctgcagcagcaagctgaacatgagcaacaaggagtacaagttctacctgcacagcctgctgagcctgcggcaggatgaggacagcagcttcctgagccagaatgaaacagaggacatcctggccttcacccggcagtactttgacaccagccagagccagtgcatggagaccaagaccctgcagaagaagagcggcatcgtgtcctctgagggcgccaatgaaagcaccctgccccagctggccgccatgatcatcaccctgagcctgcagggcgtgtgcctgggccagggcaacctgcccagcccagactacttcacagagtacatcttcagcagcctgaacagaaccaacaccctgcggctgtctgagctggaccagctgctgaacaccctgtggaccaggagcacctgcatcaagaatgagaagatccaccagttccagaggaagcagaacaacatcatcacccatgaccaggactacagcaacttcagcagctccatggagaaggagagtgaagatggccctgtgtcctgggaccagacctgcttcagcgcccggcagctggtggagatcttcctgcagaagggcctgagcctcatcagcaaagaagacttcaagcagatgagccctggcatcatccagcagctgctgagctgcagctgccacctgcccaaggaccagcaggccaagctgccccccaccaccctggagaagtatggctacagcacagtggccgtgaccctgctgaccctgggctccatgctgggcacagccctggtgctcttccacagctgtgaggagaactaccgcctcatcctgcagctgtttgtgggcctggccgtgggcaccctgtctggagatgccctgctgcacctgatcccccaggtgctgggcctgcacaagcaggaggcccctgagtttggccacttccacgagagcaagggccacatctggaagctgatgggcctcatcggcggcatccacggcttcttcctgattgagaagtgcttcatcctgctggtgagccccaatgacaagaagagccctgaggacagccaggccgctgagatgcccatcggctccatgacagccagcaacaggaagtgcaaggccatcagcctgctggccatcatgatcctggtgggggacagcctgcacaactttgctgatggcctggccatcggggccgccttcagcagcagcagcgagagcggcgtgaccaccaccatcgccatcctgtgccacgagatcccccatgagatgggagactttgctgtgctgctgagcagcggcctgtccatgaagacagccatcctgatgaacttcatcagcagcctgacagccttcatgggcctgtacatcggcctgtctgtgtctgctgacccctgtgtgcaggactggatcttcaccgtgacagctggcatgttcctgtacctgagcctggtggagatgctgcctgagatgacccacgtgcagacccagaggccctggatgatgttcctgctgcagaactttggcctcatcctgggctggctgagcctgctgctgctggccatctatgagcagaacatcaagatctag

SEQ ID NO: 38312 - DNA, 1836 bp, Artificial Sequence
  Description of Artificial Sequence: Synthetic coding sequence
atgcagggcgactgcaacctgtgctttgagccagatgccctgctgctgattgctgggggcaactttgaggaccagctgcgggaggaggtggtgcagagggtgtccctgctgctgctgtactacatcatccaccaggaggagatctgcagcagcaagctgaacatgagcaacaaggagtacaagttctacctgcacagcctgctgagcctgcggcaggatgaggacagcagcttcctgagccagaatgaaacagaggacatcctggccttcacccggcagtactttgacaccagccagagccagtgcatggagaccaagaccctgcagaagaagagcggcatcgtgtcctctgagggcgccaatgaaagcaccctgccccagctggccgccatgatcatcaccctgagcctgcagggcgtgtgcctgggccagggcaacctgcccagcccagactacttcacagagtacatcttcagcagcctgaacagaaccaacaccctgcggctgtctgagctggaccagctgctgaacaccctgtggaccaggagcacctgcatcaagaatgagaagatccaccagttccagaggaagcagaacaacatcatcacccatgaccaggactacagcaacttcagcagctccatggagaaggagagtgaagatggccctgtgtcctgggaccagacctgcttcagcgcccggcagctggtggagatcttcctgcagaagggcctgagcctcatcagcaaagaagacttcaagcagatgagccctggcatcatccagcagctgctgagctgcagctgccacctgcccaaggaccagcaggccaagctgccccccaccaccctggagaagtatggctacagcacagtggccgtgaccctgctgaccctgggctccatgctgggcacagccctggtgctcttccacagctgtgaggagaactaccgcctcatcctgcagctgtttgtgggcctggccgtgggcaccctgtctggagatgccctgctgcacctgatcccccaggtgctgggcctgcacaagcaggaggcccctgagtttggccacttccacgagagcaagggccacatctggaagctgatgggcctcatcggcggcatccacggcttcttcctgattgagaagtgcttcatcctgctggtgagccccaatgacaagcagggcctgagcctggtgaatggacatgtgggccacagccaccacctggccctgaacagcgagctgagtgaccaggccggccggggcaagagcgccagcaccatccagctgaagagccctgaggacagccaggccgctgagatgcccatcggctccatgacagccagcaacaggaagtgcaaggccatcagcctgctggccatcatgatcctggtgggggacagcctgcacaactttgctgatggcctggccatcggggccgccttcagcagcagcagcgagagcggcgtgaccaccaccatcgccatcctgtgccacgagatcccccatgagatgggagactttgctgtgctgctgagcagcggcctgtccatgaagacagccatcctgatgaacttcatcagcagcctgacagccttcatgggcctgtacatcggcctgtctgtgtctgctgacccctgtgtgcaggactggatcttcaccgtgacagctggcatgttcctgtacctgagcctggtggagatgctgcctgagatgacccacgtgcagacccagaggccctggatgatgttcctgctgcagaactttggcctcatcctgggctggctgagcctgctgctgctggccatctatgagcagaacatcaagatctag

SEQ ID NO: 38313 - DNA, 1674 bp, Artificial Sequence
  Description of Artificial Sequence: Synthetic coding sequence
atgagcaacaaggagtacaagttctacctgcacagcctgctgagcctgcggcaggatgaggacagcagcttcctgagccagaatgaaacagaggacatcctggccttcacccggcagtactttgacaccagccagagccagtgcatggagaccaagaccctgcagaagaagagcggcatcgtgtcctctgagggcgccaatgaaagcaccctgccccagctggccgccatgatcatcaccctgagcctgcagggcgtgtgcctgggccagggcaacctgcccagcccagactacttcacagagtacatcttcagcagcctgaacagaaccaacaccctgcggctgtctgagctggaccagctgctgaacaccctgtggaccaggagcacctgcatcaagaatgagaagatccaccagttccagaggaagcagaacaacatcatcacccatgaccaggactacagcaacttcagcagctccatggagaaggagagtgaagatggccctgtgtcctgggaccagacctgcttcagcgcccggcagctggtggagatcttcctgcagaagggcctgagcctcatcagcaaagaagacttcaagcagatgagccctggcatcatccagcagctgctgagctgcagctgccacctgcccaaggaccagcaggccaagctgccccccaccaccctggagaagtatggctacagcacagtggccgtgaccctgctgaccctgggctccatgctgggcacagccctggtgctcttccacagctgtgaggagaactaccgcctcatcctgcagctgtttgtgggcctggccgtgggcaccctgtctggagatgccctgctgcacctgatcccccaggtgctgggcctgcacaagcaggaggcccctgagtttggccacttccacgagagcaagggccacatctggaagctgatgggcctcatcggcggcatccacggcttcttcctgattgagaagtgcttcatcctgctggtgagccccaatgacaagcagggcctgagcctggtgaatggacatgtgggccacagccaccacctggccctgaacagcgagctgagtgaccaggccggccggggcaagagcgccagcaccatccagctgaagagccctgaggacagccaggccgctgagatgcccatcggctccatgacagccagcaacaggaagtgcaaggccatcagcctgctggccatcatgatcctggtgggggacagcctgcacaactttgctgatggcctggccatcggggccgccttcagcagcagcagcgagagcggcgtgaccaccaccatcgccatcctgtgccacgagatcccccatgagatgggagactttgctgtgctgctgagcagcggcctgtccatgaagacagccatcctgatgaacttcatcagcagcctgacagccttcatgggcctgtacatcggcctgtctgtgtctgctgacccctgtgtgcaggactggatcttcaccgtgacagctggcatgttcctgtacctgagcctggtggagatgctgcctgagatgacccacgtgcagacccagaggccctggatgatgttcctgctgcagaactttggcctcatcctgggctggctgagcctgctgctgctggccatctatgagcagaacatcaagatctag

SEQ ID NO: 38314 - DNA, 1446 bp, Artificial Sequence
  Description of Artificial Sequence: Synthetic coding sequence
atgaagctgctgctgctgcacccagccttccagagctgcctgctgctgaccctgctgggcctgtggaggaccaccccagaggcccacgccagcagcctgggcgccccagccatctctgctgccagcttcctgcaggacctgatccacagatatggagagggggacagcctgaccctgcagcagctgaaggccctgctgaaccacctggatgtgggcgtgggcagaggaaatgtgacccagcacgtgcagggccacaggaacctgagcacctgcttcagcagcggggacctcttcaccgcccacaacttcagcgagcagagcagaattggcagcagcgagctgcaggagttctgccccaccatcctgcagcagctggacagccgggcctgcaccagcgagaaccaggagaatgaagaaaatgagcagacagaggagggccggcccagcgctgtggaggtgtggggctacggcctgctgtgtgtgaccgtcatcagcctgtgcagcctgctgggcgcctctgtggtgcccttcatgaagaagaccttctacaagaggctgctgctgtacttcatcgccctggccatcggcaccctgtacagcaatgccctcttccagctgatccctgaggccttcggcttcaaccccctggaggactactacgtgtccaagtctgctgtggtgtttggaggcttctacctgttcttcttcacagagaagatcctgaagatcctgctgaagcagaagaatgagcaccaccacggccacagccactacgccagcgagagcctgcccagcaagaaggaccaggaggagggcgtgatggagaagctgcagaatggagacctggaccacatgatcccccagcactgcagcagcgagctggatggcaaggcccccatggtggatgagaaggtgattgtgggcagcctgtctgtgcaggacctgcaggccagccagagcgcctgctactggctgaagggcgtgcgctacagcgacatcggcaccctggcctggatgatcaccctgagtgatggcctgcacaacttcattgatggcctggccatcggggccagcttcaccgtgtctgtgttccagggcatcagcacctctgtggccatcctgtgtgaggagttcccccatgagctgggggactttgtgatcctgctgaatgccggcatgagcatccagcaggccctcttcttcaacttcctgagcgcctgctgctgctacctgggcctggccttcggcatcctggccggcagccacttcagcgccaactggatctttgccctggccggcggcatgttcctgtacatcagcctggccgacatgatggagttctgcagcgtggcccaggccggcgtgcagtggtgccacctgagcagcctgcagcccctgcccctgggcctgaagaggctgagctgcctgagcctgcccagcaactag

SEQ ID NO: 38315 - DNA, 1479 bp, Artificial Sequence
  Description of Artificial Sequence: Synthetic coding sequence
atgaagctgctgctgctgcacccagccttccagagctgcctgctgctgaccctgctgggcctgtggaggaccaccccagaggcccacgccagcagcctgggcgccccagccatctctgctgccagcttcctgcaggacctgatccacagatatggagagggggacagcctgaccctgcagcagctgaaggccctgctgaaccacctggatgtgggcgtgggcagaggaaatgtgacccagcacgtgcagggccacaggaacctgagcacctgcttcagcagcggggacctcttcaccgcccacaacttcagcgagcagagcagaattggcagcagcgagctgcaggagttctgccccaccatcctgcagcagctggacagccgggcctgcaccagcgagaaccaggagaatgaagaaaatgagcagacagaggagggccggcccagcgctgtggaggtgtggggctacggcctgctgtgtgtgaccgtcatcagcctgtgcagcctgctgggcgcctctgtggtgcccttcatgaagaagaccttctacaagaggctgctgctgtacttcatcgccctggccatcggcaccctgtacagcaatgccctcttccagctgatccctgaggccttcggcttcaaccccctggaggactactacgtgtccaagtctgctgtggtgtttggaggcttctacctgttcttcttcacagagaagatcctgaagatcctgctgaagcagaagaatgagcaccaccacggccacagccactacgccagcgagagcctgcccagcaagaaggaccaggaggagggcgtgatggagaagctgcagaatggagacctggaccacatgatcccccagcactgcagcagcgagctggatggcaaggcccccatggtggatgagaaggtgattgtgggcagcctgtctgtgcaggacctgcaggccagccagagcgcctgctactggctgaagggcgtgcgctacagcgacatcggcaccctggcctggatgatcaccctgagtgatggcctgcacaacttcattgatggcctggccatcggggccagcttcaccgtgtctgtgttccagggcatcagcacctctgtggccatcctgtgtgaggagttcccccatgagctgggggactttgtgatcctgctgaatgccggcatgagcatccagcaggccctcttcttcaacttcctgagcgcctgctgctgctacctgggcctggccttcggcatcctggccggcagccacttcagcgccaactggatctttgccctggccggcggcatgttcctgtacatcagcctggccgacatgtttcctgagatgaatgaggtgtgccaggaggatgagaggaagggcagcatcctgatccccttcatcatccagaacctgggcctgctgaccggcttcaccatcatggtggtgctgaccatgtacagcggccagatccagattggatag

SEQ ID NO: 38316 - DNA, 1479 bp, Artificial Sequence
  Description of Artificial Sequence: Synthetic coding sequence
atgaagctgctgctgctgcacccagccttccagagctgcctgctgctgaccctgctgggcctgtggaggaccaccccagaggcccacgccagcagcctgggcgccccagccatctctgctgccagcttcctgcaggacctgatccacagatatggagagggggacagcctgaccctgcagcagctgaaggccctgctgaaccacctggatgtgggcgtgggcagaggaaatgtgacccagcacgtgcagggccacaggaacctgagcacctgcttcagcagcggggacctcttcaccgcccacaacttcagcgagcagagcagaattggcagcagcgagctgcaggagttctgccccaccatcctgcagcagctggacagccgggcctgcaccagcgagaaccaggagaatgaagaaaatgagcagacagaggagggccggcccagcgctgtggaggtgtggggcttcggcttcctgtctgtgtccctcatcaacctggccagcctgctgggcgtgctggtgctgccctgcacagagaaggccttcttcagccgggtgctgacctacttcatcgccctgagcatcggcaccctgctgagcaatgccctcttccagctgatccctgaggccttcggcttcaaccccctggaggactactacgtgtccaagtctgctgtggtgtttggaggcttctacctgttcttcttcacagagaagatcctgaagatcctgctgaagcagaagaatgagcaccaccacggccacagccactacgccagcgagagcctgcccagcaagaaggaccaggaggagggcgtgatggagaagctgcagaatggagacctggaccacatgatcccccagcactgcagcagcgagctggatggcaaggcccccatggtggatgagaaggtgattgtgggcagcctgtctgtgcaggacctgcaggccagccagagcgcctgctactggctgaagggcgtgcgctacagcgacatcggcaccctggcctggatgatcaccctgagtgatggcctgcacaacttcattgatggcctggccatcggggccagcttcaccgtgtctgtgttccagggcatcagcacctctgtggccatcctgtgtgaggagttcccccatgagctgggggactttgtgatcctgctgaatgccggcatgagcatccagcaggccctcttcttcaacttcctgagcgcctgctgctgctacctgggcctggccttcggcatcctggccggcagccacttcagcgccaactggatctttgccctggccggcggcatgttcctgtacatcagcctggccgacatgtttcctgagatgaatgaggtgtgccaggaggatgagaggaagggcagcatcctgatccccttcatcatccagaacctgggcctgctgaccggcttcaccatcatggtggtgctgaccatgtacagcggccagatccagattggatag

SEQ ID NO: 38317 - DNA, 1479 bp, Artificial Sequence; identical to SEQ ID NO: 38315
  Description of Artificial Sequence: Synthetic coding sequence

SEQ ID NO: 38318 - DNA, 1383 bp, Artificial Sequence
  Description of Artificial Sequence: Synthetic coding sequence
atggcccctggccgggctgtggccggcctgctgctgctggccgccgccggcctgggcggcgtggccgagggccctggcctggccttctctgaagatgtgctgtctgtgtttggagccaacctgagcctgtctgctgcccagctgcagcacctgctggagcagatgggcgccgccagccgggtgggcgtgcctgagcccggccagctgcacttcaaccagtgcctgacagctgaggagatcttcagcctgcacggcttcagcaatgccacccagatcaccagcagcaagttcagcgtcatctgcccagctgtgctgcagcagctgaacttccacccctgtgaggaccggcccaagcacaagacccggcccagccacagcgaggtgtggggctacggcttcctgtctgtgaccatcatcaacctggccagcctgctgggcctcatcctgacccccctcatcaagaagagctacttccccaagatcctgaccttctttgtgggcctggccatcggcaccctcttcagcaatgccatcttccagctgatccctgaggccttcggctttgaccccaaggtggacagctatgtggagaaggctgtggccgtgtttggaggcttctacctgctcttcttctttgagaggatgctgaagatgctgctgaagacctacggccagaatggccacacccactttggaaatgacaactttggcccccaggagaagacccaccagcccaaggccctgcctgccatcaacggggtgacctgctacgccaacccagctgtgacagaggccaacggccacatccactttgacaacgtgtctgtggtgtccctgcaggacggcaagaaggagcccagcagctgcacctgcctgaagggccccaagctgtctgagatcggcaccatcgcctggatgatcaccctgtgtgatgccctgcacaacttcattgatggcctggccatcggggccagctgcaccctgagcctgctgcagggcctgagcaccagcatcgccatcctgtgtgaggagttcccccatgagctgggggactttgtgatcctgctgaatgccggcatgagcacccggcaggccctgctcttcaacttcctgagcgcctgcagctgctacgtgggcctggccttcggcatcctggtgggcaacaactttgcccccaacatcatctttgccctggccggcggcatgttcctgtacatcagcctggccgacatgtttcctgagatgaatgacatgctgcgggagaaggtgacaggcaggaagacagacttcaccttcttcatgatccagaatgccggcatgctgaccggcttcaccgccatcctgctgatcaccctgtatgctggggagattgagctggagtag

SEQ ID NO: 38319 - DNA, 1383 bp, Artificial Sequence; identical to SEQ ID NO: 38318
  Description of Artificial Sequence: Synthetic coding sequence

SEQ ID NO: 38320 - DNA, 1335 bp, Artificial Sequence
  Description of Artificial Sequence: Synthetic coding sequence
atggcccctggccgggctgtggccggcctgctgctgctggccgccgccggcctgggcggcgtggccgagggccctggcctggccttctctgaagatgtgctgtctgtgtttggagccaacctgagcctgtctgctgcccagctgcagcacctgctggagcagatgggcgccgccagccgggtgggcgtgcctgagcccggccagctgcacttcaaccagtgcctgacagctgaggagatcttcagcctgcacggcttcagcaatgccacccagatcaccagcagcaagttcagcgtcatctgcccagctgtgctgcagcagctgaacttccacccctgtgaggaccggcccaagcacaagacccggcccagccacagcgaggtgtggggctacggcttcctgtctgtgaccatcatcaacctggccagcctgctgggcctcatcctgacccccctcatcaagaagagctacttccccaagatcctgaccttctttgtgggcctggccatcggcaccctcttcagcaatgccatcttccagctgatccctgaggccttcggctttgaccccaaggtggacagctatgtggagaaggctgtggccgtgtttggaggcttctacctgctcttcttctttgagaggatgctgaagatgctgctgaagacctacggccagaatggccacacccactttggaaatgacaactttggcccccaggagaagacccaccagcccaaggccctgcctgccatcaacggggtgacctgctacgccaacccagctgtgacagaggccaacggccacatccactttgacaacgtgtctgtggtgtccctgcaggacggcaagaaggagcccagcagctgcacctgcctgaagggccccaagctgtctgagatcggcaccatcgcctggatgatcaccctgtgtgatgccctgcacaacttcattgatggcctggccatcggggccagctgcaccctgagcctgctgcagggcctgagcaccagcatcgccatcctgtgtgaggagttcccccatgagctgggggactttgtgatcctgctgaatgccggcatgagcacccggcaggccctgctcttcaacttcctgagcgcctgcagctgctacgtgggcctggccttcggcatcctggtgggcaacaactttgcccccaacatcatctttgccctggccggcggcatgttcctgtacatcagcctggccgacatgtttcctgagatgaatgacatgctgcgggagaagatcatcaagtgggccacagatgacatcaagagccagctgcacctgctgtggatctacacagccaggtag

SEQ ID NO: 38321 - DNA, 924 bp, Artificial Sequence
  Description of Artificial Sequence: Synthetic coding sequence
atggatgacttcatcagcatcagcctgctgagcctggccatgctggtgggctgctacgtggccggcatcatccccctggccgtgaacttcagcgaggagcggctgaagctggtgacagtgctgggcgccggcctgctgtgtggcacagccctggccgtcatcgtgcctgagggcgtgcacgccctgtatgaggacatcctggagggcaagcaccaccaggccagcgagacccacaacgtgattgccagtgacaaggctgctgagaagtctgtggtgcatgaacatgagcacagccatgaccacacccagctgcacgcctacatcggcgtgtccctggtgctgggctttgtgttcatgctgctggtggaccagatcggcaacagccacgtgcacagcacagatgatcctgaggccgcccggagcagcaacagcaagatcaccaccaccctgggcctggtggtgcacgccgctgctgatggagtggccctgggcgccgccgccagcaccagccagacctctgtgcagctgattgtgtttgtggccatcatgctgcacaaggccccagctgccttcggcctggtgtccttcctgatgcacgccggcctggagaggaaccgcatcaggaagcacctgctggtgtttgccctggccgcccctgtgatgtccatggtgacctacctgggcctgagcaagagcagcaaggaggccctgtctgaggtgaatgccactggagtggccatgctgttctctgctggcaccttcctgtatgtggccaccgtgcacgtgctgcctgaggtgggcggcatcggccacagccacaagccagatgccaccggcggccggggcctgagccggctggaggtggccgccctggtgctgggctgcctgatccccctcatcctgtctgtgggccaccagcactag

SEQ ID NO: 38322 - DNA, 924 bp, Artificial Sequence; identical to SEQ ID NO: 38321
  Description of Artificial Sequence: Synthetic coding sequence

SEQ ID NO: 38323 - DNA, 2691 bp, Artificial Sequence
  Description of Artificial Sequence: Synthetic coding sequence
atggagatgaagctgcccggccaggagggctttgaggccagcagcgcccccaggaacatccccagcggggagctggacagcaacccagaccccggcaccggccccagcccagatggccccagcgacacagagagcaaggagctgggcgtgcccaaggaccccctgctcttcatccagctgaatgagctgctgggctggccccaggccctggagtggagggagaccggccgctgggtgctgtttgaggagaagctggaggtggccgccggccgctggagcgccccccacgtgcccaccctggccctgcccagcctgcagaagctgcggagcctgctggccgagggcctggtgctgctggactgcccagcccagagcctgctggagctggtggagcaggtgaccagggtggagagcctgagccctgagctgcggggccagctgcaggccctgctgctgcagaggccccagcactacaaccagaccaccggcacccggccctgctggggcagcacccaccccaggaaggccagtgacaatgaggaggcccccctgcgggagcagtgccagaaccccctgcggcagaagctgcccccaggagctgaggccggcaccgtgctggccggggagctgggcttcctggcccagcccctgggcgcctttgtgcggctgaggaaccctgtggtgctgggcagcctgacagaggtgtccctgcccagccgcttcttctgcctgctgctgggcccctgcatgctgggcaagggctaccacgagatgggccgggctgctgctgtgctgctgagtgacccccagttccagtggagcgtgcggcgggccagcaacctgcatgacctgctggccgccctggatgccttcctggaggaggtgacagtgctgcccccaggccgctgggaccccacagcccgcatccccccacccaagtgcctgcccagccagcacaagaggctgcccagccagcagcgggagatccggggccctgctgtgccccggctgaccagcgcagaagatagacaccgccacggcccccacgcccacagccctgagctgcagaggacaggccgcctgtttggaggcctcatccaggatgtgcggaggaaggtgccctggtaccccagcgacttcctggatgccctgcacctgcagtgcttctctgctgtgctgtacatctacctggccaccgtgaccaatgccatcaccttcggcggcctgctgggagatgccacagatggagcccagggcgtgctggagagcttcctgggcacagctgtggccggggccgccttctgcctgatggccggccagcccctgaccatcctgagcagcacaggccctgtgctggtgtttgagcggctgctcttctccttcagccgggactacagcctggactacctgcccttccggctgtgggtgggcatctgggtggccaccttctgcctggtgctggtggccacagaggcctctgtgctggtgcgctacttcacccgcttcacagaggagggcttctgtgccctgatcagcctcatcttcatctatgatgctgtgggcaagatgctgaacctgacccacacctaccccatccagaagccaggcagcagcgcctacggctgcctgtgccagtacccaggccctggaggaaatgaaagccagtggatccgcacccggcccaaggacagagatgacatcgtgtccatggtgaggaagggcctgagtgacttcagctctgtgctggccatcctgctgggctgcggcctggatgccttcctgggcctggccacccccaagctgatggtgccccgggagttcaagcccaccctgcccggccggggctggctggtgagcccctttggagccaacccctggtggtggagcgtggccgccgccctgcctgccctgctgctgagcatcctgatcttcatggaccagcagatcacagctgtgatcctgaacaggatggagtaccgcctgcagaagggagctggcttccacctggacctcttctgtgtggccgtgctgatgctgctgaccagcgccctgggcctgccctggtacgtgtctgccaccgtcatcagcctggcccacatggacagcctgcggcgggagagccgggcctgtgcccctggagagcggcccaacttcctgggcatccgggagcagaggctgaccggcctggtggtgttcatcctgactggagccagcatcttcctggcccctgtgctgaagttcatccccatgcctgtgctgtatggcatcttcctgtacatgggcgtggccgccctgagcagcatccagttcaccaacagagtgaagctgctgctgatgcctgccaagcaccagcctgacctgctgctgctgcggcacgtgcccctgaccagggtgcacctgttcaccgccatccagctggcctgcctgggcctgctgtggatcatcaagagcaccccagctgccatcatcttccccctgatgctgctgggcctggtgggcgtgaggaaggccctggagagggtcttcagcccccaggagctgctgtggctggatgagctgatgcctgaggaggagaggagcatccctgagaagggcctggagcctgagcacagcttcagcggcagtgacagcgaggacagcgagctgatgtaccagcccaaggcccctgagatcaacatctctgtgaactag

SEQ ID NO: 38324 - DNA, 3780 bp, Artificial Sequence
  Description of Artificial Sequence: Synthetic coding sequence
atggccaatggagtcatccccccacctggaggagccagccccctgccccaggtgcgggtgcccctggaggagccccccctgagcccagatgtggaggaggaggatgatgacctgggcaagaccctggccgtgtccagatttggagacctgatcagcaagcccccagcctgggaccctgagaagcccagccgcagctacagcgagcgggactttgagttccaccgccacaccagccaccacacccaccaccccctgagcgcccggctgcccccaccccacaagctgcggcggctgccccccaccagcgcccggcacaccaggaggaagaggaagaaggagaagaccagcgccccacccagcgagggcaccccacccatccaggaggagggcggggccggcgtggatgaggaggaggaggaggaggaggaggaggagggggagagcgaggccgagcctgtggagcccccccacagcggcaccccccagaaggccaagttcagcatcggcagtgatgaagatgacagccctggcctgcccggccgggctgctgtgaccaagcccctgcccagcgtgggcccccacacagacaagagcccccagcacagcagccggccctgcagcgagctgagagatggagatggcaccacagacctggccctgagcagcccccggctgctgtgctgcctgcccagcagccccagcccccgggcccgggccagccggctggccggggagaagagccggccctggagccccagcgccagctatgacctgcgggagcggctgtgccccggcagcgccctgggcaaccctgggggccctgagcagcaggtgcccacagatgaagctgaggcccagatgctgggcagcgctgacctggatgacatgaagagccaccggctggaggacaaccctggggtgcggcggcacctggtgaagaagcccagcaggacccagggcggccggggcagccccagcggcctggcccccatcctgcggaggaagaagaagaagaagaagctggacagaagacctcatgaggtgtttgtggagctgaatgagctgatgctggacaggagccaggagccccactggagggagacagcccgctggatcaagtttgaggaggatgtggaggaggagacagagcgctggggcaagccccacgtggccagcctgtccttccgcagcctgctggagctgcggaggaccatcgcccatggagctgccctgctggacctggagcagaccaccctgcccggcatcgcccacctggtggtggagaccatgattgtgtctgaccagatccggccagaagatcgggcctctgtgctgcggaccctgctgctgaagcacagccaccccaatgatgacaaggacagcggcttcttccccaggaaccccagcagcagctccatgaacagcgtgctgggcaaccaccaccccacccccagccacggcccagatggagctgtgcccaccatggctgatgacctgggggagcccgcccccctgtggccccatgaccctgatgccaaggagaagcccctgcacatgcctggaggagatggccaccggggcaagagcctgaagctgctggagaagatcccagaagatgctgaggccaccgtggtgctggtgggctgtgtgcccttcctggagcagcctgctgctgcctttgtgcggctgaatgaggccgtgctgctggagagcgtgctggaggtgcctgtgcctgtgcgcttcctgtttgtgatgctgggccccagccacaccagcacagactaccacgagctgggccgcagcatcgccaccctgatgtctgacaagctgttccacgaggccgcctaccaggctgatgaccggcaggacctgctgagcgccatcagcgagttcctggatggcagcatcgtcatccccccatctgaggtggagggccgggacctgctgcggtctgtggccgccttccagcgggagctgctgaggaagagaagagagcgggagcagaccaaggtggagatgaccacccggggcggctacacagcccctgggaaggagctgagcctggagctgggcggcagcgaggccaccccagaagatgaccccctgctgaggactggatctgtgtttggaggcctggtgagagatgtgagaagacgctacccccactaccccagcgacctgagagatgccctgcacagccagtgtgtggccgctgtgctcttcatctactttgctgccctgagccctgccatcacctttggaggcctgctgggggagaagacagagggcctgatgggcgtgtctgagctgattgtgtccacagctgtgctgggcgtgctcttcagcctgctgggcgcccagcccctgctggtggtgggcttcagcggccccctgctggtgtttgaggaggccttcttcaagttctgccgggcccaggacctggagtacctgaccggccgggtgtgggtgggcctgtggctggtggtgtttgtgctggccctggtggccgctgagggcagcttcctggtgcgctacatcagccccttcacccaggagatctttgccttcctgatcagcctcatcttcatctatgagaccttctacaagctgtacaaggtgttcacagagcaccccctgctgcccttctacccacctgagggcgccctggagggcagcctggatgctggcctggagcccaacggcagcgccctgcccccaacagagggcccccccagccccaggaaccagcccaacacagccctgctgagcctcatcctgatgctgggcaccttcttcatcgccttcttcctgaggaagttcaggaacagccgcttcctgggcggcaaggcccggcgcatcatcggggactttggcatccccatcagcatcctggtgatggtgctggtggactacagcatcacagacacctacacccagaagctgactgtgcccaccggcctgtctgtgaccagcccagacaagaggtcctggttcatcccccccctgggcagcgcccggcccttccccccctggatgatggtggccgctgctgtgcctgccctgctggtgctgatcctgatcttcatggagacccagatcacagccctgattgtgtcccagaaggcccggcggctgctgaagggcagcggcttccacctggacctgctgctgattggcagcctgggcggcctgtgtggcctgtttggcctgccctggctgacagctgccaccgtgcgctctgtgacccacgtgaatgccctgactgtgatgaggacagccatcgcccctggggacaagccccagatccaggaggtgcgggagcagagggtgactggagtgctgattgccagcctggtgggcctgagcatcgtgatgggcgctgtgctgcggcgcatccccctggccgtgctgtttggcatcttcctgtacatgggcgtgaccagcctgagcggcatccagctgagccagaggctgctgctgatcctgatgcctgccaagcaccaccctgagcagccctacgtgaccaaggtgaagacctggaggatgcacctgttcacctgcatccagctgggctgcatcgccctgctgtgggtggtgaagagcacagctgccagcctggccttccccttcctgctgctgctgactgtgcccctgcggcactgcctgctgcccaggctcttccaggaccgggagctgcaggccctggacagtgaagatgctgagcccaactttgatgaagatggccaggatgagtacaatgagctgcacatgcctgtgtag

SEQ ID NO: 38325 - DNA, 3699 bp, Artificial Sequence
  Description of Artificial Sequence: Synthetic coding sequence
atggccaatggagtcatccccccacctggaggagccagccccctgccccaggtgcgggtgcccctggaggagccccccctgagcccagatgtggaggaggaggatgatgacctgggcaagaccctggccgtgtccagatttggagacctgatcagcaagcccccagcctgggaccctgagaagcccagccgcagctacagcgagcgggactttgagttccaccgccacaccagccaccacacccaccaccccctgagcgcccggctgcccccaccccacaagctgcggcggctgccccccaccagcgcccggcacaccaggaggaagaggaagaaggagaagaccagcgccccacccagcgagggcaccccacccatccaggaggagggcggggccggcgtggatgaggaggaggaggaggaggaggaggaggagggggagagcgaggccgagcctgtggagcccccccacagcggcaccccccagaaggccaagttcagcatcggcagtgatgaagatgacagccctggcctgcccggccgggctgctgtgaccaagcccctgcccagcgtgggcccccacacagacaagagcccccagcacagcagcagcagccccagcccccgggcccgggccagccggctggccggggagaagagccggccctggagccccagcgccagctatgacctgcgggagcggctgtgccccggcagcgccctgggcaaccctgggggccctgagcagcaggtgcccacagatgaggccgaggcccagatgctgggcagcgctgacctggatgacatgaagagccaccggctggaggacaaccctggggtgagaagacacctggtgaagaagcccagcaggacccagggcggccggggcagccccagcggcctggcccccatcctgcggaggaagaagaagaagaagaagctggaccggcggccccatgaggtgtttgtggagctgaatgagctgatgctggacaggagccaggagccccactggagggagacagcccgctggatcaagtttgaagaagatgtggaggaggagacagagcgctggggcaagccccacgtggccagcctgtccttccgcagcctgctggagctgcggaggaccatcgcccacggggccgccctgctggacctggagcagaccaccctgcccggcatcgcccacctggtggtggagaccatgattgtgtctgaccagatccggcctgaggaccgggcctctgtgctgcggaccctgctgctgaagcacagccaccccaatgatgacaaggacagcggcttcttccccaggaaccccagcagcagctccatgaacagcgtgctgggcaaccaccaccccacccccagccacggcccagatggagctgtgcccaccatggctgatgacctgggggagcccgcccccctgtggccccatgaccctgatgccaaggagaagcccctgcacatgcctggaggagatggccaccggggcaagagcctgaagctgctggagaagatcccagaagatgctgaggccaccgtggtgctggtgggctgtgtgcccttcctggagcagcctgctgctgcctttgtgcggctgaatgaagctgtgctgctggagagcgtgctggaggtgcctgtgcctgtgcgcttcctgtttgtgatgctgggccccagccacaccagcacagactaccacgagctgggccgcagcatcgccaccctgatgtctgacaagctgttccatgaagctgcctaccaggctgatgaccggcaggacctgctgagcgccatcagcgagttcctggatggcagcatcgtcatcccccccagcgaggtggagggccgggacctgctgcggtctgtggccgccttccagcgggagctgctgaggaagaggcgggagcgggagcagaccaaggtggagatgaccacccggggcggctacacagcccctgggaaggagctgagcctggagctgggcggcagcgaggccaccccagaagatgaccccctgctgaggacaggctctgtgtttggaggcctggtgagagatgtgagaagacgctacccccactaccccagcgacctgagagatgccctgcacagccagtgtgtggccgctgtgctcttcatctactttgctgccctgagccctgccatcaccttcggcggcctgctgggggagaagacagagggcctgatgggcgtgtctgagctgattgtgtccacagctgtgctgggcgtgctcttcagcctgctgggcgcccagcccctgctggtggtgggcttcagcggccccctgctggtgtttgaggaggccttcttcaagttctgccgggcccaggacctggagtacctgaccggccgggtgtgggtgggcctgtggctggtggtgtttgtgctggccctggtggccgctgagggcagcttcctggtgcgctacatcagccccttcacccaggagatctttgccttcctgatcagcctcatcttcatctatgagaccttctacaagctgtacaaggtgttcacagagcaccccctgctgcccttctacccacctgagggcgccctggagggcagcctggatgctggcctggagcccaatggaagtgccctgcccccaacagagggcccccccagccccaggaaccagcccaacacagccctgctgagcctcatcctgatgctgggcaccttcttcatcgccttcttcctgaggaagttcaggaacagccgcttcctgggcggcaaggcccggcgcatcattggagactttggcatccccatcagcatcctggtgatggtgctggtggactacagcatcacagacacctacacccagaagctgactgtgcccaccggcctgtctgtgaccagcccagacaagaggtcctggttcatcccccccctgggcagcgcccggcccttccccccctggatgatggtggccgctgctgtgcctgccctgctggtgctgatcctgatcttcatggagacccagatcacagccctgattgtgtcccagaaggcccggcggctgctgaagggcagcggcttccacctggacctgctgctgattggcagcctgggcggcctgtgtggcctgtttggcctgccctggctgacagctgccaccgtgcgctctgtgacccacgtgaatgccctgactgtgatgaggacagccatcgcccctggggacaagccccagatccaggaggtgcgggagcagagggtgactggagtgctgattgccagcctggtgggcctgagcatcgtgatgggcgctgtgctgcggcgcatccccctggccgtgctgtttggcatcttcctgtacatgggcgtgaccagcctgagcggcatccagctgagccagaggctgctgctgatcctgatgcctgccaagcaccaccctgagcagccctacgtgaccaaggtgaagacctggaggatgcacctgttcacctgcatccagctgggctgcatcgccctgctgtgggtggtgaagagcacagctgccagcctggccttccccttcctgctgctgctgactgtgcccctgcggcactgcctgctgcccaggctcttccaggaccgggagctgcaggccctggacagtgaagatgctgagcccaactttgatgaagatggccaggatgagtacaatgagctgcacatgcctgtgtag

SEQ ID NO: 38326 - DNA, 1203 bp, Artificial Sequence
  Description of Artificial Sequence: Synthetic coding sequence
atgggcgtgtctgagctgattgtgtccacagctgtgctgggcgtgctcttcagcctgctgggcgcccagcccctgctggtggtgggcttcagcggccccctgctggtgtttgaggaggccttcttcaagttctgccgggcccaggacctggagtacctgaccggccgggtgtgggtgggcctgtggctggtggtgtttgtgctggccctggtggccgctgagggcagcttcctggtgcgctacatcagccccttcacccaggagatctttgccttcctgatcagcctcatcttcatctatgagaccttctacaagctgtacaaggtgttcacagagcaccccctgctgcccttctacccacctgagcctggaggagtgcccggctgctggagcggggccaagtggcagctgcccccaacagagggcccccccagccccaggaaccagcccaacacagccctgctgagcctcatcctgatgctgggcaccttcttcatcgccttcttcctgaggaagttcaggaacagccgcttcctgggcggcaaggcccggcgcatcattggagactttggcatccccatcagcatcctggtgatggtgctggtggactacagcatcacagacacctacacccagaagctgactgtgcccaccggcctgtctgtgaccagcccagacaagaggtcctggttcatcccccccctgggcagcgcccggcccttccccccctggatgatggtggccgctgctgtgcctgccctgctggtgctgatcctgatcttcatggagacccagatcacagccctgattgtgtcccagaaggcccggcggctgctgaagggcagcggcttccacctggacctgctgctgattggcagcctgggcggcctgtgtggcctgtttggcctgccctggctgacagctgccaccgtgcgctctgtgacccacgtgaatgccctgactgtgatgaggacagccatcgcccctggggacaagccccagatccaggaggtgcgggagcagagggtgactggagtgctgattgccagcctggtgggcctgagcatcgtgatgggcgctgtgctgcggcgcatccccctggccgtgctgtttggcatcttcctgtacatgggcgtgaccagcctgagcggcatccagctgagccagaggctgctgctgatcctgatgcctgccaagcactag

SEQ ID NO: 38327 - DNA, 3699 bp, Artificial Sequence; identical to SEQ ID NO: 38325
  Description of Artificial Sequence: Synthetic coding sequence

SEQ ID NO: 38328 - DNA, 3699 bp, Artificial Sequence; identical to SEQ ID NO: 38325
  Description of Artificial Sequence: Synthetic coding sequence

SEQ ID NO: 38329 - DNA, 3780 bp, Artificial Sequence; identical to SEQ ID NO: 38324
  Description of Artificial Sequence: Synthetic coding sequence

SEQ ID NO: 38330 - DNA, 684 bp, Artificial Sequence
  Description of Artificial Sequence: Synthetic coding sequence
atgaccagccccctggagaaggaccctgagcccaacggggccctgagccctggccctggggacaccaacagctggggcttcggccgggaccctgcccccagcccccgggacagcctggcccctgaggacctggagatgtttgtgctggactttgaagatggagacctgtgggagagcatccggggccagctgggccccatggccggcccccccacctgccaccggctggaggacaaccctggggtgagaagacacctggtgaagaagcccagcaggacccagggcggccggggcagccccagcggcctggcccccatcctgcggaggaagaagaagaagaagaagctggaccggcggccccatgaggtgtttgtggagctgaatgagctgatgctggacaggagccaggagccccactggagggagacagcccgctggatcaagtttgaagaagatgtggaggaggagacagagcgctggggcaagccccacgtggccagcctgtccttccgcagcctgctggagctgcggaggaccatcgcccacggggccgccctgctggacctggagcagaccaccctgcccggcatcgcccacctggtggtggagaccatgattgtgtctgaccagatccggcctgaggaccgggcctctgtgctgcggaccctgctgctgaagcactag

SEQ ID NO: 38331 - DNA, 627 bp, Artificial Sequence
  Description of Artificial Sequence: Synthetic coding sequence
atgaagctgctgcccagcgtggtgctgaagctgttcctggccgctgtgctgagcgccctggtgactggagagagcctggagcggctgcggcggggcctggccgccggcaccagcaacccagacccccccaccgtgtccacagaccagctgctgcccctgggcggcggccgggacaggaaggtgcgggacctgcaggaggccgacctggacctgctgcgggtgaccctgagcagcaagccccaggccctggccacccccaacaaggaggagcacggcaagaggaagaagaagggcaagggcctgggcaagaagagggacccctgcctgaggaagtacaaggacttctgcatccacggggagtgcaagtatgtgaaggagctgcgggcccccagctgcatctgccaccctggctaccatggagagcgctgccacggcctgagcctgcctgtggagaaccggctgtacacctatgaccacaccaccatcctggccgtggtggccgtggtgctgagctctgtgtgcctgctggtgattgtgggcctgctgatgttccgctaccaccggcggggcggctatgatgtggagaatgaggagaaggtgaagctgggcatgaccaacagccactag

SEQ ID NO: 38332 - DNA, 2838 bp, Artificial Sequence
  Description of Artificial Sequence: Synthetic coding sequence
atggagatgaagctgcccggccaggagggctttgaggccagcagcgcccccaggaacatccccagcggggagctggacagcaacccagaccccggcaccggccccagcccagatggccccagcgacacagagagcaaggagctgggcgtgcccaaggaccccctgctcttcatccagctgaatgagctgctgggctggccccaggccctggagtggagggagaccggccgctgggtgctgtttgaggagaagctggaggtggccgccggccgctggagcgccccccacgtgcccaccctggccctgcccagcctgcagaagctgcggagcctgctggccgagggcctggtgctgctggactgcccagcccagagcctgctggagctggtggagcaggtgaccagggtggagagcctgagccctgagctgcggggccagctgcaggccctgctgctgcagaggccccagcactacaaccagaccaccggcacccggccctgctggggcagcacccaccccaggaaggccagtgacaatgaggaggcccccctgcgggagcagtgccagaaccccctgcggcagaagctgcccccaggagctgaggccggcaccgtgctggccggggagctgggcttcctggcccagcccctgggcgcctttgtgcggctgaggaaccctgtggtgctgggcagcctgacagaggtgtccctgcccagccgcttcttctgcctgctgctgggcccctgcatgctgggcaagggctaccacgagatgggccgggctgctgctgtgctgctgagtgacccccagttccagtggagcgtgcggcgggccagcaacctgcatgacctgctggccgccctggatgccttcctggaggaggtgacagtgctgcccccaggccgctgggaccccacagcccgcatccccccacccaagtgcctgcccagccagcacaagaggctgcccagccagcagcgggagatccggggccctgctgtgccccggctgaccagcgcagaagatagacaccgccacggcccccacgcccacagccctgagctgcagaggacaggcaggaaggtgccctggtaccccagcgacttcctggatgccctgcacctgcagtgcttctctgctgtgctgtacatctacctggccaccgtgaccaatgccatcacctttggaggcctgctgggagatgccacagatggagcccagggcgtgctggagagcttcctgggcacagctgtggccggggccgccttctgcctgatggccggccagcccctgaccatcctgagcagcactggacctgtgctggtgtttgagcggctgctcttctccttcagccgggactacagcctggactacctgcccttccggctgtgggtgggcatctgggtggccaccttctgcctggtgctggtggccacagaggcctctgtgctggtgcgctacttcacccgcttcacagaggagggcttctgtgccctgatcagcctcatcttcatctatgatgctgtgggcaagatgctgaacctgacccacacctaccccatccagaagccaggcagcagcgcctacggctgcctgtgccagtacccaggccctggaggaaatgaaagccagtggatccgcacccggcccaaggacagagatgacatcgacctgggcctcatcaatgccagcctgctgcccccacctgagtgcacccggcagggcggccacccccggggccctggctgccacacagtgcctgacatcgccttcttcagcctgctgctcttcctgaccagcttcttctttgccatggccctgaagtgtgtgaagaccagccgcttcttccccagcgtggtgaggaagggcctgagtgacttcagctctgtgctggccatcctgctgggctgcggcctggatgccttcctgggcctggccacccccaagctgatggtgccccgggagttcaagcccaccctgcccggccggggctggctggtgagcccctttggagccaacccctggtggtggagcgtggccgccgccctgcctgccctgctgctgagcatcctgatcttcatggaccagcagatcacagctgtgatcctgaacaggatggagtaccgcctgcagaagggggccggcttccacctggacctcttctgtgtggccgtgctgatgctgctgaccagcgccctgggcctgccctggtacgtgtctgccaccgtcatcagcctggcccacatggacagcctgcggcgggagagccgggcctgtgcccctggagagcggcccaacttcctgggcatccgggagcagaggctgaccggcctggtggtgttcatcctgaccggggccagcatcttcctggcccctgtgctgaagttcatccccatgcctgtgctgtatggcatcttcctgtacatgggcgtggccgccctgagcagcatccagttcaccaacagagtgaagctgctgctgatgcctgccaagcaccagcctgacctgctgctgctgcggcacgtgcccctgaccagggtgcacctgttcaccgccatccagctggcctgcctgggcctgctgtggatcatcaagagcaccccagctgccatcatcttccccctgatgctgctgggcctggtgggcgtgaggaaggccctggagagggtcttcagcccccaggagctgctgtggctggatgagctgatgcctgaggaggagaggagcatccctgagaagggcctggagcctgagcacagcttcagcggcagtgacagtgaagattctgagctgatgtaccagcccaaggcccctgagatcaacatctctgtgaactag

SEQ ID NO: 38333 - DNA, 2880 bp, Artificial Sequence
  Description of Artificial Sequence: Synthetic coding sequence
atggagatgaagctgcccggccaggagggctttgaggccagcagcgcccccaggaacatccccagcggggagctggacagcaacccagaccccggcaccggccccagcccagatggccccagcgacacagagagcaaggagctgggcgtgcccaaggaccccctgctcttcatccagctgaatgagctgctgggctggccccaggccctggagtggagggagaccggccgctgggtgctgtttgaggagaagctggaggtggccgccggccgctggagcgccccccacgtgcccaccctggccctgcccagcctgcagaagctgcggagcctgctggccgagggcctggtgctgctggactgcccagcccagagcctgctggagctggtggagcaggtgaccagggtggagagcctgagccctgagctgcggggccagctgcaggccctgctgctgcagaggccccagcactacaaccagaccaccggcacccggccctgctggggcagcacccaccccaggaaggccagtgacaatgaggaggcccccctgcgggagcagtgccagaaccccctgcggcagaagctgcccccaggagctgaggccggcaccgtgctggccggggagctgggcttcctggcccagcccctgggcgcctttgtgcggctgaggaaccctgtggtgctgggcagcctgacagaggtgtccctgcccagccgcttcttctgcctgctgctgggcccctgcatgctgggcaagggctaccacgagatgggccgggctgctgctgtgctgctgagtgacccccagttccagtggagcgtgcggcgggccagcaacctgcatgacctgctggccgccctggatgccttcctggaggaggtgacagtgctgcccccaggccgctgggaccccacagcccgcatccccccacccaagtgcctgcccagccagcacaagaggctgcccagccagcagcgggagatccggggccctgctgtgccccggctgaccagcgcagaagatagacaccgccacggcccccacgcccacagccctgagctgcagaggacaggccgcctgtttggaggcctcatccaggatgtgcggaggaaggtgccctggtaccccagcgacttcctggatgccctgcacctgcagtgcttctctgctgtgctgtacatctacctggccaccgtgaccaatgccatcaccttcggcggcctgctgggagatgccacagatggagcccagggcgtgctggagagcttcctgggcacagctgtggccggggccgccttctgcctgatggccggccagcccctgaccatcctgagcagcacaggccctgtgctggtgtttgagcggctgctcttctccttcagccgggactacagcctggactacctgcccttccggctgtgggtgggcatctgggtggccaccttctgcctggtgctggtggccacagaggcctctgtgctggtgcgctacttcacccgcttcacagaggagggcttctgtgccctgatcagcctcatcttcatctatgatgctgtgggcaagatgctgaacctgacccacacctaccccatccagaagccaggcagcagcgcctacggctgcctgtgccagtacccaggccctggaggaaatgaaagccagtggatccgcacccggcccaaggacagagatgacatcgtgtccatggacctgggcctcatcaatgccagcctgctgcccccacctgagtgcacccggcagggcggccacccccggggccctggctgccacacagtgcctgacatcgccttcttcagcctgctgctcttcctgaccagcttcttctttgccatggccctgaagtgtgtgaagaccagccgcttcttccccagcgtggtgaggaagggcctgagtgacttcagctctgtgctggccatcctgctgggctgcggcctggatgccttcctgggcctggccacccccaagctgatggtgccccgggagttcaagcccaccctgcccggccggggctggctggtgagcccctttggagccaacccctggtggtggagcgtggccgccgccctgcctgccctgctgctgagcatcctgatcttcatggaccagcagatcacagctgtgatcctgaacaggatggagtaccgcctgcagaagggggccggcttccacctggacctcttctgtgtggccgtgctgatgctgctgaccagcgccctgggcctgccctggtacgtgtctgccaccgtcatcagcctggcccacatggacagcctgcggcgggagagccgggcctgtgcccctggagagcggcccaacttcctgggcatccgggagcagaggctgaccggcctggtggtgttcatcctgaccggggccagcatcttcctggcccctgtgctgaagttcatccccatgcctgtgctgtatggcatcttcctgtacatgggcgtggccgccctgagcagcatccagttcaccaacagagtgaagctgctgctgatgcctgccaagcaccagcctgacctgctgctgctgcggcacgtgcccctgaccagggtgcacctgttcaccgccatccagctggcctgcctgggcctgctgtggatcatcaagagcaccccagctgccatcatcttccccctgatgctgctgggcctggtgggcgtgaggaaggccctggagagggtcttcagcccccaggagctgctgtggctggatgagctgatgcctgaggaggagaggagcatccctgagaagggcctggagcctgagcacagcttcagcggcagtgacagtgaagattctgagctgatgtaccagcccaaggcccctgagatcaacatctctgtgaactag

SEQ ID NO: 38334 - DNA, 2952 bp, Artificial Sequence
  Description of Artificial Sequence: Synthetic coding sequence
atggagatgaagctgcccggccaggagggctttgaggccagcagcgcccccaggaacatccccagcggggagctggacagcaacccagaccccggcaccggccccagcccagatggccccagcgacacagagagcaaggagctgggcgtgcccaaggaccccctgctcttcatccagctgaatgagctgctgggctggccccaggccctggagtggagggagaccggcagcagcagcgccagcctgctgctggacatgggagagatgcccagcatcaccctgagcacccacctgcaccaccgctgggtgctgtttgaggagaagctggaggtggccgccggccgctggagcgccccccacgtgcccaccctggccctgcccagcctgcagaagctgcggagcctgctggccgagggcctggtgctgctggactgcccagcccagagcctgctggagctggtggagcaggtgaccagggtggagagcctgagccctgagctgcggggccagctgcaggccctgctgctgcagaggccccagcactacaaccagaccaccggcacccggccctgctggggcagcacccaccccaggaaggccagtgacaatgaggaggcccccctgcgggagcagtgccagaaccccctgcggcagaagctgcccccaggagctgaggccggcaccgtgctggccggggagctgggcttcctggcccagcccctgggcgcctttgtgcggctgaggaaccctgtggtgctgggcagcctgacagaggtgtccctgcccagccgcttcttctgcctgctgctgggcccctgcatgctgggcaagggctaccacgagatgggccgggctgctgctgtgctgctgagtgacccccagttccagtggagcgtgcggcgggccagcaacctgcatgacctgctggccgccctggatgccttcctggaggaggtgacagtgctgcccccaggccgctgggaccccacagcccgcatccccccacccaagtgcctgcccagccagcacaagaggctgcccagccagcagcgggagatccggggccctgctgtgccccggctgaccagcgcagaagatagacaccgccacggcccccacgcccacagccctgagctgcagaggacaggccgcctgtttggaggcctcatccaggatgtgcggaggaaggtgccctggtaccccagcgacttcctggatgccctgcacctgcagtgcttctctgctgtgctgtacatctacctggccaccgtgaccaatgccatcaccttcggcggcctgctgggagatgccacagatggagcccagggcgtgctggagagcttcctgggcacagctgtggccggggccgccttctgcctgatggccggccagcccctgaccatcctgagcagcacaggccctgtgctggtgtttgagcggctgctcttctccttcagccgggactacagcctggactacctgcccttccggctgtgggtgggcatctgggtggccaccttctgcctggtgctggtggccacagaggcctctgtgctggtgcgctacttcacccgcttcacagaggagggcttctgtgccctgatcagcctcatcttcatctatgatgctgtgggcaagatgctgaacctgacccacacctaccccatccagaagccaggcagcagcgcctacggctgcctgtgccagtacccaggccctggaggaaatgaaagccagtggatccgcacccggcccaaggacagagatgacatcgtgtccatggacctgggcctcatcaatgccagcctgctgcccccacctgagtgcacccggcagggcggccacccccggggccctggctgccacacagtgcctgacatcgccttcttcagcctgctgctcttcctgaccagcttcttctttgccatggccctgaagtgtgtgaagaccagccgcttcttccccagcgtggtgaggaagggcctgagtgacttcagctctgtgctggccatcctgctgggctgcggcctggatgccttcctgggcctggccacccccaagctgatggtgccccgggagttcaagcccaccctgcccggccggggctggctggtgagcccctttggagccaacccctggtggtggagcgtggccgccgccctgcctgccctgctgctgagcatcctgatcttcatggaccagcagatcacagctgtgatcctgaacaggatggagtaccgcctgcagaagggggccggcttccacctggacctcttctgtgtggccgtgctgatgctgctgaccagcgccctgggcctgccctggtacgtgtctgccaccgtcatcagcctggcccacatggacagcctgcggcgggagagccgggcctgtgcccctggagagcggcccaacttcctgggcatccgggagcagaggctgaccggcctggtggtgttcatcctgaccggggccagcatcttcctggcccctgtgctgaagttcatccccatgcctgtgctgtatggcatcttcctgtacatgggcgtggccgccctgagcagcatccagttcaccaacagagtgaagctgctgctgatgcctgccaagcaccagcctgacctgctgctgctgcggcacgtgcccctgaccagggtgcacctgttcaccgccatccagctggcctgcctgggcctgctgtggatcatcaagagcaccccagctgccatcatcttccccctgatgctgctgggcctggtgggcgtgaggaaggccctggagagggtcttcagcccccaggagctgctgtggctggatgagctgatgcctgaggaggagaggagcatccctgagaagggcctggagcctgagcacagcttcagcggcagtgacagtgaagattctgagctgatgtaccagcccaaggcccctgagatcaacatctctgtgaactag

SEQ ID NO: 38335 - DNA, 1476 bp, Artificial Sequence
  Description of Artificial Sequence: Synthetic coding sequence
atggccggccagggcctgcccctgcacgtggccaccctgctgaccggcctgctggagtgcctgggctttgctggggtgctgtttggctggcccagcctggtgtttgtgttcaagaatgaagactacttcaaggacctgtgtggcccagatgctggccccatcggaaatgccaccggccaggccgactgcaaggcccaggatgagcgcttcagcctcatcttcaccctgggcagcttcatgaacaacttcatgaccttccccaccggctacatctttgaccgcttcaagaccaccgtggcccggctgattgccatcttcttctacaccacagccaccctcatcatcgccttcaccagcgctggcagcgctgtgctgctcttcctggccatgcccatgctgaccatcggcggcatcctcttcctgatcaccaacctgcagatcggcaacctgtttggccagcacaggagcaccatcatcaccctgtacaatggagcctttgacagcagcagcgctgtgttcctgatcatcaagctgctgtatgagaagggcatcagcctgcgggccagcttcatcttcatctctgtgtgcagcacctggcacgtggcccggaccttcctgctgatgccccggggccacatcccctaccccctgccccccaactacagctatggcctgtgccctggaaatggcaccaccaaggaggagaaggagacagctgagcacgagaaccgggagctgcagagcaaggagttcctgagcgccaaggaggagaccccaggagctggccagaagcaggagctgcgctccttctggagctatgccttcagcagaagatttgcctggcacctggtgtggctgagcgtcatccagctgtggcactacctgttcatcggcaccctgaacagcctgctgaccaacatggccggcggggacatggcccgggtgtccacctacaccaatgcctttgccttcacccagtttggagtgctgtgtgccccctggaatggcctgctgatggaccggctgaagcagaagtaccagaaggaggccaggaagacaggcagcagcaccctggccgtggccctgtgcagcacagtgcccagcctggccctgaccagcctgctgtgcctgggctttgccctgtgtgcctctgtgcccatcctgcccctgcagtacctgaccttcatcctgcaggtgatcagccgctccttcctgtatggcagcaatgctgccttcctgaccctggccttccccagcgagcactttgggaagctgtttggcctggtgatggccctgtctgctgtggtgtccctgctgcagttccccatcttcaccctcatcaagggcagcctgcagaatgaccccttctacgtgaatgtgatgttcatgctggccatcctgctgaccttcttccaccccttcctggtgtacagagaatgtaggacctggaaggagagccccagcgccatcgcctag

SEQ ID NO: 38336 - DNA, 1476 bp, Artificial Sequence; identical to SEQ ID NO: 38335
  Description of Artificial Sequence: Synthetic coding sequence

SEQ ID NO: 38337 - DNA, 1476 bp, Artificial Sequence; identical to SEQ ID NO: 38335
  Description of Artificial Sequence: Synthetic coding sequence

SEQ ID NO: 38338 - DNA, 309 bp, Artificial Sequence
  Description of Artificial Sequence: Synthetic coding sequence
atggccggccagggcctgcccctgcacgtggccaccctgctgaccggcctgctggagtgcctgggctttgctggggtgctgtttggctggcccagcctggtgtttgtgttcaagaatgaagactacttcaaggacctgtgtggcccagatgctggccccatcggaaatgccaccggccaggccgactgcaaggcccaggatgagcgcttcagcctcatcttcaccctgggcagcttcatgaacaacttcatgaccttccccaccggctacatctttgaccgcttcaagaccaccgtggcccggctgtag

SEQ ID NO: 38339 - DNA, 510 bp, Artificial Sequence
  Description of Artificial Sequence: Synthetic coding sequence
atggccggccagggcctgcccctgcacgtggccaccctgctgaccggcctgctggagtgcctgggctttgctggggtgctgtttggctggcccagcctggtgtttgtgttcaagaatgaagactacttcaaggacctgtgtggcccagatgctggccccatcggaaatgccaccggccaggccgactgcaaggcccaggatgagcgcttcagcctcatcttcaccctgggcagcttcatgaacaacttcatgaccttccccaccggctacatctttgaccgcttcaagaccaccgtggcccggctgattgccatcttcttctacaccacagccaccctcatcatcgccttcaccagcgctggcagcgctgtgctgctcttcctggccatgcccatgctgaccatcggcggcatcctcttcctgatcaccaacctgcagatcggcaacctgtttggccagcacaggagcaccatcatcaccctgtacaatggagcctttgacagcagctag

SEQ ID NO: 38340 - DNA, 195 bp, Artificial Sequence
  Description of Artificial Sequence: Synthetic coding sequence
atggccggccagggcctgcccctgcacgtggccaccctgctgaccggcctgctggagtgcctgggctttgctggggtgctgtttggctggcccagcctggtgtttgtgttcaagaatgaagactacttcaaggacctgtgtggcccagatgctggccccatcggaaatgccaccggccaggccggccgcctgtag

SEQ ID NO: 38341 - DNA, 447 bp, Artificial Sequence
  Description of Artificial Sequence: Synthetic coding sequence
atggccggccagggcctgcccctgcacgtggccaccctgctgaccggcctgctggagtgcctgggctttgctggggtgctgtttggctggcccagcctggtgtttgtgttcaagaatgaagactacttcaaggacctgtgtggcccagatgctggccccatcggaaatgccaccggccaggccgactgcaaggcccaggatgagcgcttcagcctcatcttcaccctgggcagcttcatgaacaacttcatgaccttccccaccggctacatctttgaccgcttcaagaccaccgtggcccggctgattgccatcttcttctacaccacagccaccctcatcatcgccttcaccagcgctggcagcgctgtgctgctcttcctggccatgcccatgctgaccatcggcggcatcctcttcctgatcaccaacctgcagattggatag

SEQ ID NO: 38342 - DNA, 360 bp, Artificial Sequence
  Description of Artificial Sequence: Synthetic coding sequence
atggccggccagggcctgcccctgcacgtggccaccctgctgaccggcctgctggagtgcctgggctttgctggggtgctgtttggctggcccagcctggtgtttgtgttcaagaatgaagactacttcaaggacctgtgtggcccagatgctggccccatcggaaatgccaccggccaggccgactgcaaggcccaggatgagcgcttcagcctcatcttcaccctgggcagcttcatgaacaacttcatgaccttccccaccggctacatctttgaccgcttcaagaccaccgtggcccggctgattgccatcttcttctacaccacagccaccctcatcatcgccttcaccagctag

SEQ ID NO: 38343 - DNA, 1476 bp, Artificial Sequence; identical to SEQ ID NO: 38335
  Description of Artificial Sequence: Synthetic coding sequence

SEQ ID NO: 38344 - DNA, 69 bp, Artificial Sequence; identical to SEQ ID NO: 22368
  Description of Artificial Sequence: Synthetic coding sequence

SEQ ID NO: 38345 - DNA, 996 bp, Artificial Sequence
  Description of Artificial Sequence: Synthetic coding sequence
atggccggccagggcctgcccctgcacgtggccaccctgctgaccggcctgctggagtgcctgggctttgctggggtgctgtttggctggcccagcctggtgtttgtgttcaagaatgaagactacttcaaggacctgtgtggcccagatgctggccccatcggaaatgccaccggccaggccgactgcaaggcccaggatgagcgcttcagcctcatcttcaccctgggcagcttcatgaacaacttcatgaccttccccaccggctacatctttgaccgcttcaagaccaccgtggcccggctgattgccatcttcttctacaccacagccaccctcatcatcgccttcaccagcgctggcagcgctgtgctgctcttcctggccatgcccatgctgaccatcggcggcatcctcttcctgatcaccaacctgcagatcggcaacctgtttggccagcacaggagcaccatcatcaccctgtacaatggagcctttgacagcagcagcgctgtgttcctgatcatcaagctgctgtatgagaagggcatcagcctgcgggccagcttcatcttcatctctgtgtgcagcacctggcacgtggcccggaccttcctgctgatgccccggggccacatcccctaccccctgccccccaactacagctatggcctgtgccctggaaatggcaccaccaaggaggagaaggagacagctgagcacgagaaccgggagctgcagagcaaggagttcctgagcgccaaggaggagaccccaggagctggccagaagcaggagctgcgctccttctggagctatgccttcagcagaagatttgcctggcacctggtgtggctgagcgtcatccagctgtggcactacctgttcatcggcaccctgaacagcctgctgaccaacatggccggcggggacatggcccgggtgtccacctacaccaatgcctttgccttcacccagtttggagtgctgtgctag

SEQ ID NO: 38346 - DNA, 135 bp, Artificial Sequence
  Description of Artificial Sequence: Synthetic coding sequence
atggccggccagggcctgcccctgcacgtggccaccctgctgaccggcctgctggagtgcctgggctttgctggggtgctgtttggctggcccagcctggtgtttgtgttcaagaatgaagactacttcaagtag

SEQ ID NO: 38347 - DNA, 9 bp, Artificial Sequence
  Description of Artificial Sequence: Synthetic coding sequence
atggcctag

SEQ ID NO: 38348 - DNA, 297 bp, Artificial Sequence
  Description of Artificial Sequence: Synthetic coding sequence
atggccggccagggcctgcccctgcacgtggccaccctgctgaccggcctgctggagtgcctgggctttgctggggtgctgtttggctggcccagcctggtgtttgtgttcaagaatgaagactacttcaaggacctgtgtggcccagatgctggccccatcggaaatgccaccggccaggccgactgcaaggcccaggatgagcgcttcagcctcatcttcaccctgggcagcttcatgaacaacttcatgaccttccccaccggctacatctttgaccgcttcaagaccacctag

SEQ ID NO: 38349 - DNA, 237 bp, Artificial Sequence
  Description of Artificial Sequence: Synthetic coding sequence
atggccggccagggcctgcccctgcacgtggccaccctgctgaccggcctgctggagtgcctgggctttgctggggtgctgtttggctggcccagcctggtgtttgtgttcaagaatgaagactacttcaaggacctgtgtggcccagatgctggccccatcggaaatgccaccggccaggccgactgcaaggcccaggatgagcgcttcagcctcatcttcaccctgggcagctag

SEQ ID NO: 38350 - DNA, 324 bp, Artificial Sequence
  Description of Artificial Sequence: Synthetic coding sequence
atggccggccagggcctgcccctgcacgtggccaccctgctgaccggcctgctggagtgcctgggctttgctggggtgctgtttggctggcccagcctggtgtttgtgttcaagaatgaagactacttcaaggacctgtgtggcccagatgctggccccatcggaaatgccaccggccaggccgactgcaaggcccaggatgagcgcttcagcctcatcttcaccctgggcagcttcatgaacaacttcatgaccttccccaccggctacatctttgaccgcttcaagaccaccgtggcccggctgattgccatcttcttctag

SEQ ID NO: 38351 - DNA, 333 bp, Artificial Sequence
  Description of Artificial Sequence: Synthetic coding sequence
atggccggccagggcctgcccctgcacgtggccaccctgctgaccggcctgctggagtgcctgggctttgctggggtgctgtttggctggcccagcctggtgtttgtgttcaagaatgaagactacttcaaggacctgtgtggcccagatgctggccccatcggaaatgccaccggccaggccgactgcaaggcccaggatgagcgcttcagcctcatcttcaccctgggcagcttcatgaacaacttcatgaccttccccaccggctacatctttgaccgcttcaagaccaccgtggcccggctgattgccatcttcttctacaccacctag

SEQ ID NO: 38352 - DNA, 1758 bp, Artificial Sequence
  Description of Artificial Sequence: Synthetic coding sequence
atgcactgcctgggcgctgagtacctggtgttcatcatgggctacagcgtggtggccggggccgccggccgcctgctgtttggctatgacagctttggaaacatgtgtgggaagaagaacagccctgtggagggcgcccccctgagcggccaggacatgaccctgaagaagcacgtgttcttcatgaacagctgcaacctggaggtgaagggcagcttcctgtgtgtgtacagcctgaacagcttcaactacacccacagccccaaggctgacagcctgtgcccccggctgcctgtgccccccagcaagagcttccccctcttcaacagatgtgtgccccagaccccagagtgctacagcctgtttgcctctgtgctgatcaatgatgtggacaccctgcaccgcatcctgagcggcatcatgagcggccgggacaccatcctgggcctgtgcatcctggccctggccctgagcctggccatgatgttcaccttccgcttcatcaccaccctgctggtgcacatcttcatcagcctggtgatcctgggcctgctgtttgtgtgtggggtgctgtggtggctgtactatgactacaccaatgacctgagcattgagctggacacagaaagagagaacatgaagtgtgtgctgggctttgccatcgtgtccacaggcatcacagctgtgctgctggtgctgatctttgtgctgaggaagaggatcaagctgactgtggagctgttccagatcaccaacaaggccatcagcagcgcccccttcctgctcttccagcccctgtggacctttgccatcctgatcttcttctgggtgctgtgggtggccgtgctgctgagcctgggcacagctggagctgcccaggtgatggagggcggccaggtggagtacaagcccctgagcggcatccgctacatgtggagctaccacctgattggcctcatctggaccagcgagttcatcctggcctgccagcagatgaccatcgccggggctgtggtgacctgctacttcaacagaagcaagaatgaccccccagaccaccccatcctgagcagcctgagcatcctcttcttctaccaccagggcaccgtggtgaagggcagcttcctgatctctgtggtgcgcatcccccgcatcatcgtgatgtacatgcagaatgccctgaaggagcagcagcacggggccctgagccgctacctgttccgctgctgctactgctgcttctggtgcctggacaagtacctgctgcacctgaaccagaatgcctacaccaccacagccatcaatggaacagacttctgcaccagcgccaaggatgccttcaagatcctgagcaagaacagcagccacttcaccagcatcaactgctttggagacttcatcatcttcctgggcaaggtgctggtggtgtgcttcaccgtgtttggaggcctgatggccttcaactacaacagagccttccaggtgtgggccgtgcccctgctgctggtggccttctttgcctacctggtggcccacagcttcctgtctgtgtttgagaccgtgctggatgccctcttcctgtgctttgctgtggacctggagaccaatgatggcagcagcgagaagccctacttcatggaccaggagttcctgagctttgtgaagaggagcaacaagctgaacaatgcccgggcccagcaggacaagcacagcctgagaaatgaggagggcacagagctgcaggccatcgtgaggtag

SEQ ID NO: 38353 - DNA, 1863 bp, Artificial Sequence
  Description of Artificial Sequence: Synthetic coding sequence
atgcactgcctgggcgctgagtacctggtgtctgctgagggcgccccccggcagcgggagtggaggccccagatctacaggaagtgcacagacacagcctggctgttcctgttcttcctgttctggacaggcctggtgttcatcatgggctacagcgtggtggccggggccgccggccgcctgctgtttggctatgacagctttggaaacatgtgtgggaagaagaacagccctgtggagggcgcccccctgagcggccaggacatgaccctgaagaagcacgtgttcttcatgaacagctgcaacctggaggtgaagggcagcttcctgtgtgtgtacagcctgaacagcttcaactacacccacagccccaaggctgacagcctgtgcccccggctgcctgtgccccccagcaagagcttccccctcttcaacagatgtgtgccccagaccccagagtgctacagcctgtttgcctctgtgctgatcaatgatgtggacaccctgcaccgcatcctgagcggcatcatgagcggccgggacaccatcctgggcctgtgcatcctggccctggccctgagcctggccatgatgttcaccttccgcttcatcaccaccctgctggtgcacatcttcatcagcctggtgatcctgggcctgctgtttgtgtgtggggtgctgtggtggctgtactatgactacaccaatgacctgagcattgagctggacacagaaagagagaacatgaagtgtgtgctgggctttgccatcgtgtccacaggcatcacagctgtgctgctggtgctgatctttgtgctgaggaagaggatcaagctgactgtggagctgttccagatcaccaacaaggccatcagcagcgcccccttcctgctcttccagcccctgtggacctttgccatcctgatcttcttctgggtgctgtgggtggccgtgctgctgagcctgggcacagctggagctgcccaggtgatggagggcggccaggtggagtacaagcccctgagcggcatccgctacatgtggagctaccacctgattggcctcatctggaccagcgagttcatcctggcctgccagcagatgaccatcgccggggctgtggtgacctgctacttcaacagaagcaagaatgaccccccagaccaccccatcctgagcagcctgagcatcctcttcttctaccaccagggcaccgtggtgaagggcagcttcctgatctctgtggtgcgcatcccccgcatcatcgtgatgtacatgcagaatgccctgaaggagcagcacggggccctgagccgctacctgttccgctgctgctactgctgcttctggtgcctggacaagtacctgctgcacctgaaccagaatgcctacaccaccacagccatcaatggaacagacttctgcaccagcgccaaggatgccttcaagatcctgagcaagaacagcagccacttcaccagcatcaactgcttcggggacttcatcatcttcctgggcaaggtgctggtggtgtgcttcaccgtgtttggaggcctgatggccttcaactacaacagagccttccaggtgtgggccgtgcccctgctgctggtggccttctttgcctacctggtggcccacagcttcctgtctgtgtttgaaacagtgctggatgccctcttcctgtgctttgctgtggacctggagaccaatgatggcagcagcgagaagccctacttcatggaccaggagttcctgagctttgtgaagaggagcaacaagctgaacaatgcccgggcccagcaggacaagcacagcctgagaaatgaggagggcacagagctgcaggccatcgtgaggtag

SEQ ID NO: 38354 - DNA, 1962 bp, Artificial Sequence
  Description of Artificial Sequence: Synthetic coding sequence
atgcactgcctgggcgctgagtacctggtgtctgctgagggcgccccccggcagcgggagtggaggccccagatctacaggaagtgcacagacacagcctggctgttcctgttcttcctgttctggacaggcctggtgttcatcatgggctacagcgtggtggccggggccgccggccgcctgctgtttggctatgacagctttggaaacatgtgtgggaagaagaacagccctgtggagggcgcccccctgagcggccaggacatgaccctgaagaagcacgtgttcttcatgaacagctgcaacctggaggtgaagggcacccagctgaacaggatggccctgtgtgtgagcaactgcccagaggagcagctggacagcctggaggaggtgcagttctttgccaacaccagcggcagcttcctgtgtgtgtacagcctgaacagcttcaactacacccacagccccaaggctgacagcctgtgcccccggctgcctgtgccccccagcaagagcttccccctcttcaacagatgtgtgccccagaccccagagtgctacagcctgtttgcctctgtgctgatcaatgatgtggacaccctgcaccgcatcctgagcggcatcatgagcggccgggacaccatcctgggcctgtgcatcctggccctggccctgagcctggccatgatgttcaccttccgcttcatcaccaccctgctggtgcacatcttcatcagcctggtgatcctgggcctgctgtttgtgtgtggggtgctgtggtggctgtactatgactacaccaatgacctgagcattgagctggacacagaaagagagaacatgaagtgtgtgctgggctttgccatcgtgtccacaggcatcacagctgtgctgctggtgctgatctttgtgctgaggaagaggatcaagctgactgtggagctgttccagatcaccaacaaggccatcagcagcgcccccttcctgctcttccagcccctgtggacctttgccatcctgatcttcttctgggtgctgtgggtggccgtgctgctgagcctgggcacagctggagctgcccaggtgatggagggcggccaggtggagtacaagcccctgagcggcatccgctacatgtggagctaccacctgattggcctcatctggaccagcgagttcatcctggcctgccagcagatgaccatcgccggggctgtggtgacctgctacttcaacagaagcaagaatgaccccccagaccaccccatcctgagcagcctgagcatcctcttcttctaccaccagggcaccgtggtgaagggcagcttcctgatctctgtggtgcgcatcccccgcatcatcgtgatgtacatgcagaatgccctgaaggagcagcagcacggggccctgagccgctacctgttccgctgctgctactgctgcttctggtgcctggacaagtacctgctgcacctgaaccagaatgcctacaccaccacagccatcaatggaacagacttctgcaccagcgccaaggatgccttcaagatcctgagcaagaacagcagccacttcaccagcatcaactgctttggagacttcatcatcttcctgggcaaggtgctggtggtgtgcttcaccgtgtttggaggcctgatggccttcaactacaacagagccttccaggtgtgggccgtgcccctgctgctggtggccttctttgcctacctggtggcccacagcttcctgtctgtgtttgagaccgtgctggatgccctcttcctgtgctttgctgtggacctggagaccaatgatggcagcagcgagaagccctacttcatggaccaggagttcctgagctttgtgaagaggagcaacaagctgaacaatgcccgggcccagcaggacaagcacagcctgagaaatgaggagggcacagagctgcaggccatcgtgaggtag

SEQ ID NO: 38355 - DNA, 492 bp, Artificial Sequence
  Description of Artificial Sequence: Synthetic coding sequence
atgggctacagcgtggtggccggggccgccggccgcctgctgtttggctatgacagctttggaaacatgtgtgggaagaagaacagccctgtggagggcgcccccctgagcggccaggacatgaccctgaagaagcacgtgttcttcatgaacagctgcaacctggaggtgaagggcacccagctgaacaggatggccctgtgtgtgagcaactgcccagaggagcagctggacagcctggaggaggtgcagttctttgccaacaccagcggcagcttcctgtgtgtgtacagcctgaacagcttcaactacacccacagccccaaggctgacagcctgtgcccccggctgcctgtgccccccagcaagagcttccccctcttcaacagatgtgtgccccagaccccagagtgctacagcctgtttgcctctgtgctgatcaatgatgtggacaccctgcaccgcatcctgagcggcatcatgagcggctag

SEQ ID NO: 38356 - DNA, 1854 bp, Artificial Sequence
  Description of Artificial Sequence: Synthetic coding sequence
atgcactgcctgggcgctgagtacctggtgttcatcatgggctacagcgtggtggccggggccgccggccgcctgctgtttggctatgacagctttggaaacatgtgtgggaagaagaacagccctgtggagggcgcccccctgagcggccaggacatgaccctgaagaagcacgtgttcttcatgaacagctgcaacctggaggtgaagggcacccagctgaacaggatggccctgtgtgtgagcaactgcccagaggagcagctggacagcctggaggaggtgcagttctttgccaacaccagcggcagcttcctgtgtgtgtacagcctgaacagcttcaactacacccacagccccaaggctgacagcctgtgcccccggctgcctgtgccccccagcaagagcttccccctcttcaacagatgtgtgccccagaccccagagtgctacagcctgtttgcctctgtgctgatcaatgatgtggacaccctgcaccgcatcctgagcggcatcatgagcggccgggacaccatcctgggcctgtgcatcctggccctggccctgagcctggccatgatgttcaccttccgcttcatcaccaccctgctggtgcacatcttcatcagcctggtgatcctgggcctgctgtttgtgtgtggggtgctgtggtggctgtactatgactacaccaatgacctgagcattgagctggacacagaaagagagaacatgaagtgtgtgctgggctttgccatcgtgtccacaggcatcacagctgtgctgctggtgctgatctttgtgctgaggaagaggatcaagctgactgtggagctgttccagatcaccaacaaggccatcagcagcgcccccttcctgctcttccagcccctgtggacctttgccatcctgatcttcttctgggtgctgtgggtggccgtgctgctgagcctgggcacagctggagctgcccaggtgatggagggcggccaggtggagtacaagcccctgagcggcatccgctacatgtggagctaccacctgattggcctcatctggaccagcgagttcatcctggcctgccagcagatgaccatcgccggggctgtggtgacctgctacttcaacagaagcaagaatgaccccccagaccaccccatcctgagcagcctgagcatcctcttcttctaccaccagggcaccgtggtgaagggcagcttcctgatctctgtggtgcgcatcccccgcatcatcgtgatgtacatgcagaatgccctgaaggagcagcagcacggggccctgagccgctacctgttccgctgctgctactgctgcttctggtgcctggacaagtacctgctgcacctgaaccagaatgcctacaccaccacagccatcaatggaacagacttctgcaccagcgccaaggatgccttcaagatcctgagcaagaacagcagccacttcaccagcatcaactgctttggagacttcatcatcttcctgggcaaggtgctggtggtgtgcttcaccgtgtttggaggcctgatggccttcaactacaacagagccttccaggtgtgggccgtgcccctgctgctggtggccttctttgcctacctggtggcccacagcttcctgtctgtgtttgagaccgtgctggatgccctcttcctgtgctttgctgtggacctggagaccaatgatggcagcagcgagaagccctacttcatggaccaggagttcctgagctttgtgaagaggagcaacaagctgaacaatgcccgggcccagcaggacaagcacagcctgagaaatgaggagggcacagagctgcaggccatcgtgaggtag

SEQ ID NO: 38357 - DNA, 1818 bp, Artificial Sequence
  Description of Artificial Sequence: Synthetic coding sequence
atgggctacagcgtggtggccggggccgccggccgcctgctgtttggctatgacagctttggaaacatgtgtgggaagaagaacagccctgtggagggcgcccccctgagcggccaggacatgaccctgaagaagcacgtgttcttcatgaacagctgcaacctggaggtgaagggcacccagctgaacaggatggccctgtgtgtgagcaactgcccagaggagcagctggacagcctggaggaggtgcagttctttgccaacaccagcggcagcttcctgtgtgtgtacagcctgaacagcttcaactacacccacagccccaaggctgacagcctgtgcccccggctgcctgtgccccccagcaagagcttccccctcttcaacagatgtgtgccccagaccccagagtgctacagcctgtttgcctctgtgctgatcaatgatgtggacaccctgcaccgcatcctgagcggcatcatgagcggccgggacaccatcctgggcctgtgcatcctggccctggccctgagcctggccatgatgttcaccttccgcttcatcaccaccctgctggtgcacatcttcatcagcctggtgatcctgggcctgctgtttgtgtgtggggtgctgtggtggctgtactatgactacaccaatgacctgagcattgagctggacacagaaagagagaacatgaagtgtgtgctgggctttgccatcgtgtccacaggcatcacagctgtgctgctggtgctgatctttgtgctgaggaagaggatcaagctgactgtggagctgttccagatcaccaacaaggccatcagcagcgcccccttcctgctcttccagcccctgtggacctttgccatcctgatcttcttctgggtgctgtgggtggccgtgctgctgagcctgggcacagctggagctgcccaggtgatggagggcggccaggtggagtacaagcccctgagcggcatccgctacatgtggagctaccacctgattggcctcatctggaccagcgagttcatcctggcctgccagcagatgaccatcgccggggctgtggtgacctgctacttcaacagaagcaagaatgaccccccagaccaccccatcctgagcagcctgagcatcctcttcttctaccaccagggcaccgtggtgaagggcagcttcctgatctctgtggtgcgcatcccccgcatcatcgtgatgtacatgcagaatgccctgaaggagcagcagcacggggccctgagccgctacctgttccgctgctgctactgctgcttctggtgcctggacaagtacctgctgcacctgaaccagaatgcctacaccaccacagccatcaatggaacagacttctgcaccagcgccaaggatgccttcaagatcctgagcaagaacagcagccacttcaccagcatcaactgctttggagacttcatcatcttcctgggcaaggtgctggtggtgtgcttcaccgtgtttggaggcctgatggccttcaactacaacagagccttccaggtgtgggccgtgcccctgctgctggtggccttctttgcctacctggtggcccacagcttcctgtctgtgtttgagaccgtgctggatgccctcttcctgtgctttgctgtggacctggagaccaatgatggcagcagcgagaagccctacttcatggaccaggagttcctgagctttgtgaagaggagcaacaagctgaacaatgcccgggcccagcaggacaagcacagcctgagaaatgaggagggcacagagctgcaggccatcgtgaggtag

SEQ ID NO: 38358 - DNA, 2160 bp, Artificial Sequence
  Description of Artificial Sequence: Synthetic coding sequence
atgaatgacacagagaagccagctgacacccccagcgaggaggaggactttggagaccccaggacctatgaccctgacttcaagggccctgtggccaacagaagctgcacagatgtgctgtgctgcatgatcttcctgctgtgcatcatcggctacatcgtgctgggcctggtggcctgggtgcacggggacccccggcgggccgcctaccccacagacagccagggccacttctgtggccagaagggcaccccaaatgaaaacaagaccatcctcttctacttcaacctgctgcgctgcaccagccccagcgtgctgctgaacctgcagtgccccaccacccagatctgtgtgtccaagtgcccagagaagttcctgacctacgtggagatgcagctgctgtacaccaaggacaagagctactgggaggactaccggcagttctgcaagaccacagccaagcctgtgaagagcctgacccagctgctgctggatgatgactgccccacagccatcttccccagcaagcccttcctgcagcgctgcttcccagacttcagcaccaagaatggcaccctgaccatcggcagcaagatgatgttccaggatggaaatggaggcaccaggtctgtggtggagctgggcattgctgccaacggcatcaacaagctgctggatgccaagagcctgggcctgaaggtgtttgaggactatgcccggacctggtactggatcctgattggcctgaccatcgccatggtgctgtcctggatcttcctgatcctgctgcgcttcatcgccggctgcctcttctgggtgttcatgattggagtgattggcatcatcggctacggcatctggcactgctaccagcagtacaccaacctgcaggagcggcccagctctgtgctgaccatctatgacatcggcatccagaccaacatctccatgtactttgagctgcagcagacctggttcaccttcatgatcatcctgtgcatcattgaagtcatcgtcatcctgatgctgatcttcctgaggaaccgcatccgggtggccatcatcctgctgaaggagggcagcaaggccatcggctacgtgcccagcaccctggtgtacccagccctgaccttcatcctgctgagcatctgcatctgctactgggtggtgacagctgtgttcctggccaccagcggcgtgcctgtgtacaaggtgattgcccctgggggccactgcatccacgagaaccagacctgtgaccctgagatcttcaacaccacagaaattgccaaggcctgccctggggccctgtgcaactttgccttctatggaggcaagagcctgtaccaccagtacatccccaccttccacgtgtacaacctgtttgtgttcctgtggctgatcaacttcgtcatcgccctgggccagtgtgccctggccggggcctttgccacctactactgggccatgaagaagccagatgacatcccccgctaccccctcttcaccgccttcggccgggccatccgctaccacacaggcagcctggccttcggcagcctcatcatcgccctgatccagatgttcaagatcgtgctggagtacctggaccaccggctgaagaggacccagaacaccctgagcaagttcctgcagtgctgcctgcgctgctgcttctggtgcctggagaatgccatcaagttcctgaacagaaatgcctacatcatgattgccatctacggcaggaacttctgccgcagcgccaaggatgccttcaacctgctgatgagaaatgtgctgaaggtggccgtgacagatgaggtgacctactttgtgctcttcctgggcaagctgctggtggccggcagcattggagtgctggccttcctgttcttcacccagaggctgcctgtgattgcccagggccctgccagcctgaactactactgggtgcccctgctgaccgtcatcttcggcagctacctgattgcccacggcttcttctctgtgtatgccatgtgtgtggagaccatcttcatctgcttctgtgaggacctggagagaaatgatggcagcacagagaagccctactttgtgacccccaacctgcacggcatcctgatcaagaagcagctggtgccccagaagcagaaggagtag

SEQ ID NO: 38359 - DNA, 2154 bp, Artificial Sequence
  Description of Artificial Sequence: Synthetic coding sequence
atgaatgacacagagaagccagctgacacccccagcgaggaggaggactttggagaccccaggacctatgaccctgacttcaagggccctgtggccaacagaagctgcacagatgtgctgtgctgcatgatcttcctgctgtgcatcatcggctacatcgtgctgggcctggtggcctgggtgcacggggacccccggcgggccgcctaccccacagacagccagggccacttctgtggccagaagggcaccccaaatgaaaacaagaccatcctcttctacttcaacctgctgcgctgcaccagccccagcgtgctgctgaacctgcagtgccccaccacccagatctgtgtgtccaagtgcccagagaagttcctgacctacgtggagatgcagctgctgtacaccaaggacaagagctactgggaggactaccggcagttctgcaagaccacagccaagcctgtgaagagcctgacccagctgctgctggatgatgactgccccacagccatcttccccagcaagcccttcctgcagcgctgcttcccagacttcagcaccaagaatggcaccctgaccatcggcagcaagatgatgttccaggatggaaatggaggcaccaggtctgtggtggagctgggcattgctgccaacggcatcaacaagctgctggatgccaagagcctgggcctgaaggtgtttgaggactatgcccggacctggtactggatcctgattggcctgaccatcgccatggtgctgtcctggatcttcctgatcctgctgcgcttcatcgccggctgcctcttctgggtgttcatgattggagtgattggcatcatcggctacggcatctggcactgctaccagcagtacaccaacctgcaggagcggcccagctctgtgctgaccatctatgacatcggcatccagaccaacatctccatgtactttgagctgcagcagacctggttcaccttcatgatcatcctgtgcatcattgaagtcatcgtcatcctgatgctgatcttcctgaggaaccgcatccgggtggccatcatcctgctgaaggagggcagcaaggccatcggctacgtgcccagcaccctggtgtacccagccctgaccttcatcctgctgagcatctgcatctgctactgggtggtgacagctgtgttcctggccaccagcggcgtgcctgtgtacaaggtgattgcccctgggggccactgcatccacgagaaccagacctgtgaccctgagatcttcaacaccacagaaattgccaaggcctgccctggggccctgtgcaactttgccttctatggaggcaagagcctgtaccaccagtacatccccaccttccacgtgtacaacctgtttgtgttcctgtggctgatcaacttcgtcatcgccctgggccagtgtgccctggccggggcctttgccacctactactgggccatgaagaagccagatgacatcccccgctaccccctcttcaccgccttcggccgggccatccgctaccacacaggcagcctggccttcggcagcctcatcatcgccctgatccagatgttcaagatcgtgctggagtacctggaccaccggctgaagaggacccagaacaccctgagcaagttcctgcagtgctgcctgcgctgctgcttctggtgcctggagaatgccatcaagttcctgaacagaaatgcctacatcatgattgccatctacggcaggaacttctgccgcagcgccaaggatgccttcaacctgctgatgagaaatgtgctgaaggtggccgtgacagatgaggtgacctactttgtgctcttcctgggcaagctgctggtggccggcagcattggagtgctggccttcctgttcttcacccagaggctgcctgtgattgcccagggccctgccagcctgaactactactgggtgcccctgctgaccgtcatcttcggcagctacctgattgcccacggcttcttctctgtgtatgccatgtgtgtggagaccatcttcatctgcttcctggaggacctggagagaaatgatggcagcacagcccggccctactacgtgtcccagcccctgctgaagatcttccaggaggagaacccccagaccaggaagcagtag

SEQ ID NO: 38360 - DNA, 1770 bp, Artificial Sequence
  Description of Artificial Sequence: Synthetic coding sequence
atgcagctgctgtacaccaaggacaagagctactgggaggactaccggcagttctgcaagaccacagccaagcctgtgaagagcctgacccagctgctgctggatgatgactgccccacagccatcttccccagcaagcccttcctgcagcgctgcttcccagacttcagcaccaagaatggcaccctgaccatcggcagcaagatgatgttccaggatggaaatggaggcaccaggtctgtggtggagctgggcattgctgccaacggcatcaacaagctgctggatgccaagagcctgggcctgaaggtgtttgaggactatgcccggacctggtactggatcctgattggcctgaccatcgccatggtgctgtcctggatcttcctgatcctgctgcgcttcatcgccggctgcctcttctgggtgttcatgattggagtgattggcatcatcggctacggcatctggcactgctaccagcagtacaccaacctgcaggagcggcccagctctgtgctgaccatctatgacatcggcatccagaccaacatctccatgtactttgagctgcagcagacctggttcaccttcatgatcatcctgtgcatcattgaagtcatcgtcatcctgatgctgatcttcctgaggaaccgcatccgggtggccatcatcctgctgaaggagggcagcaaggccatcggctacgtgcccagcaccctggtgtacccagccctgaccttcatcctgctgagcatctgcatctgctactgggtggtgacagctgtgttcctggccaccagcggcgtgcctgtgtacaaggtgattgcccctgggggccactgcatccacgagaaccagacctgtgaccctgagatcttcaacaccacagaaattgccaaggcctgccctggggccctgtgcaactttgccttctatggaggcaagagcctgtaccaccagtacatccccaccttccacgtgtacaacctgtttgtgttcctgtggctgatcaacttcgtcatcgccctgggccagtgtgccctggccggggcctttgccacctactactgggccatgaagaagccagatgacatcccccgctaccccctcttcaccgccttcggccgggccatccgctaccacacaggcagcctggccttcggcagcctcatcatcgccctgatccagatgttcaagatcgtgctggagtacctggaccaccggctgaagaggacccagaacaccctgagcaagttcctgcagtgctgcctgcgctgctgcttctggtgcctggagaatgccatcaagttcctgaacagaaatgcctacatcatgattgccatctacggcaggaacttctgccgcagcgccaaggatgccttcaacctgctgatgagaaatgtgctgaaggtggccgtgacagatgaggtgacctactttgtgctcttcctgggcaagctgctggtggccggcagcattggagtgctggccttcctgttcttcacccagaggctgcctgtgattgcccagggccctgccagcctgaactactactgggtgcccctgctgaccgtcatcttcggcagctacctgattgcccacggcttcttctctgtgtatgccatgtgtgtggagaccatcttcatctgcttctgtgaggacctggagagaaatgatggcagcacagagaagccctactttgtgacccccaacctgcacggcatcctgatcaagaagcagctggtgccccagaagcagaaggagtag

SEQ ID NO: 38361 - DNA, 2139 bp, Artificial Sequence
  Description of Artificial Sequence: Synthetic coding sequence
accaaggccaagaagaggcccagcaatgctggggaccccaggacctatgaccctgacttcaagggccctgtggccaacagaagctgcacagatgtgctgtgctgcatgatcttcctgctgtgcatcatcggctacatcgtgctgggcctggtggcctgggtgcatggagaccccaggagagctgcctaccccacagacagccagggccacttctgtggccagaagggcaccccaaatgaaaacaagaccatcctcttctacttcaacctgctgcgctgcaccagccccagcgtgctgctgaacctgcagtgccccaccacccagatctgtgtgtccaaatgtcctgagaagttcctgacctacgtggagatgcagctgctgtacaccaaggacaagagctactgggaggactaccggcagttctgcaagaccacagccaagcctgtgaagagcctgacccagctgctgctggatgatgactgccccacagccatcttccccagcaagcccttcctgcagcgctgcttcccagacttcagcaccaagaatggcaccctgaccatcggcagcaagatgatgttccaggatggaaatggaggcaccaggtctgtggtggagctgggcattgctgccaacggcatcaacaagctgctggatgccaagagcctgggcctgaaggtgtttgaagattatgcccggacctggtactggatcctgattggcctgaccatcgccatggtgctgtcctggatcttcctgatcctgctgcgcttcatcgccggctgcctcttctgggtgttcatgattggagtcatcggcatcatcggctacggcatctggcactgctaccagcagtacaccaacctgcaggagcggcccagctctgtgctgaccatctatgacatcggcatccagaccaacatctccatgtactttgagctgcagcagacctggttcaccttcatgatcatcctgtgcatcatcgaggtgattgtcatcctgatgctgatcttcctgaggaaccgcatccgggtggccatcatcctgctgaaggagggcagcaaggccatcggctacgtgcccagcaccctggtgtacccagccctgaccttcatcctgctgagcatctgcatctgctactgggtggtgacagctgtgttcctggccaccagcggcgtgcctgtgtacaaggtgattgcccctgggggccactgcatccacgagaaccagacctgtgaccctgagatcttcaacaccacagagatcgccaaggcctgccctggggccctgtgcaactttgccttctacggcggcaagagcctgtaccaccagtacatccccaccttccacgtgtacaacctgtttgtgttcctgtggctgatcaactttgtgattgccctgggccagtgtgccctggccggggcctttgccacctactactgggccatgaagaagccagatgacatcccccgctaccccctcttcaccgccttcggccgggccatccgctaccacacaggcagcctggccttcggcagcctcatcatcgccctgatccagatgttcaagatcgtgctggagtacctggaccaccggctgaagaggacccagaacaccctgagcaagttcctgcagtgctgcctgcgctgctgcttctggtgcctggagaatgccatcaagttcctgaacagaaatgcctacatcatgattgccatctatggaagaaacttctgccgcagcgccaaggatgccttcaacctgctgatgagaaatgtgctgaaggtggccgtgacagatgaggtgacctactttgtgctcttcctgggcaagctgctggtggccggcagcattggagtgctggccttcctgttcttcacccagaggctgcccgtcatcgcccagggccctgccagcctgaactactactgggtgcccctgctgaccgtcatcttcggcagctacctgattgcccacggcttcttctctgtgtatgccatgtgtgtggagaccatcttcatctgcttctgtgaggacctggagagaaatgatggcagcacagagaagccctactttgtgacccccaacctgcacggcatcctgatcaagaagcagctggtgccccagaagcagaaggagtag

SEQ ID NO: 38362 - DNA, 2271 bp, Artificial Sequence
  Description of Artificial Sequence: Synthetic coding sequence
atgagccgggtgccccagttcaagatgcagaagagccctgccttctgtgtggacctggccggcagccacaggcctgagctgttcctgtttggccacctggccagccacctgttcctgtgcttcttcctggagaagccagctgacaccccatctgaggaggaggactttggagaccccaggacctatgaccctgacttcaagggccctgtggccaacagaagctgcacagatgtgctgtgctgcatgatcttcctgctgtgcatcatcggctacatcgtgctgggcctggtggcctgggtgcatggagaccccaggagagctgcctaccccacagacagccagggccacttctgtggccagaagggcaccccaaatgaaaacaagaccatcctcttctacttcaacctgctgcgctgcaccagccccagcgtgctgctgaacctgcagtgccccaccacccagatctgtgtgtccaaatgtcctgagaagttcctgacctacgtggagatgcagctgctgtacaccaaggacaagagctactgggaggactaccggcagttctgcaagaccacagccaagcctgtgaagagcctgacccagctgctgctggatgatgactgccccacagccatcttccccagcaagcccttcctgcagcgctgcttcccagacttcagcaccaagaatggcaccctgaccatcggcagcaagatgatgttccaggatggaaatggaggcaccaggtctgtggtggagctgggcattgctgccaacggcatcaacaagctgctggatgccaagagcctgggcctgaaggtgtttgaagattatgcccggacctggtactggatcctgattggcctgaccatcgccatggtgctgtcctggatcttcctgatcctgctgcgcttcatcgccggctgcctcttctgggtgttcatgattggagtcatcggcatcatcggctacggcatctggcactgctaccagcagtacaccaacctgcaggagcggcccagctctgtgctgaccatctatgacatcggcatccagaccaacatctccatgtactttgagctgcagcagacctggttcaccttcatgatcatcctgtgcatcatcgaggtgattgtcatcctgatgctgatcttcctgaggaaccgcatccgggtggccatcatcctgctgaaggagggcagcaaggccatcggctacgtgcccagcaccctggtgtacccagccctgaccttcatcctgctgagcatctgcatctgctactgggtggtgacagctgtgttcctggccaccagcggcgtgcctgtgtacaaggtgattgcccctgggggccactgcatccacgagaaccagacctgtgaccctgagatcttcaacaccacagagatcgccaaggcctgccctggggccctgtgcaactttgccttctacggcggcaagagcctgtaccaccagtacatccccaccttccacgtgtacaacctgtttgtgttcctgtggctgatcaactttgtgattgccctgggccagtgtgccctggccggggcctttgccacctactactgggccatgaagaagccagatgacatcccccgctaccccctcttcaccgccttcggccgggccatccgctaccacacaggcagcctggccttcggcagcctcatcatcgccctgatccagatgttcaagatcgtgctggagtacctggaccaccggctgaagaggacccagaacaccctgagcaagttcctgcagtgctgcctgcgctgctgcttctggtgcctggagaatgccatcaagttcctgaacagaaatgcctacatcatgattgccatctatggaagaaacttctgccgcagcgccaaggatgccttcaacctgctgatgagaaatgtgctgaaggtggccgtgacagatgaggtgacctactttgtgctcttcctgggcaagctgctggtggccggcagcattggagtgctggccttcctgttcttcacccagaggctgcccgtcatcgcccagggccctgccagcctgaactactactgggtgcccctgctgaccgtcatcttcggcagctacctgattgcccacggcttcttctctgtgtatgccatgtgtgtggagaccatcttcatctgcttcctggaggacctggagagaaatgatggcagcacagcccggccctactacgtgtcccagcccctgctgaagatcttccaggaggagaacccccagaccaggaagcagtag

SEQ ID NO: 38363 - DNA, 1386 bp, Artificial Sequence
  Description of Artificial Sequence: Synthetic coding sequence
atgaagatcctgtttgtggagcccgccatcttcctgagcgcctttgccatgaccctgaccggccccctgaccacccagtatgtgtaccgccgcatctgggaggagaccggcaactacaccttcagcagtgacagcaacatcagtgaatgtgagaagaacaagagcagccccatctttgccttccaggaggaggtgcagaagaaggtgagccgcttcaacctgcagatggacatcagcggcctcatccctggcctggtgtccaccttcatcctgctgagcatcagtgaccactacggcaggaagttccccatgatcctgagctctgtgggcgccctggccacctctgtgtggctgtgcctgctgtgctactttgccttccccttccagctgctgattgccagcaccttcatcggggccttctgtggcaactacaccaccttctggggcgcctgctttgcctacatcgtggaccagtgcaaggagcacaagcagaagaccatcagaattgccatcatcgacttcctgctgggcctggtgacaggcctgaccggcctgagcagcggctacttcatccgggagctgggctttgagtggagcttcctgatcatcgctgtgtccctggccgtgaacctgatctacatcctcttcttcctgggggaccctgtgaaggagtgcagcagccagaatgtgaccatgagctgcagcgagggcttcaagaacctcttctaccgcacctacatgctgttcaagaatgccagcggcaagaggcgcttcctgctgtgcctgctgctcttcaccgtcatcacctacttctttgtggtgattggaattgcccccatcttcatcctgtatgagctggacagccccctgtgctggaatgaggtgttcatcggctacggcagcgccctgggcagcgccagcttcctgaccagcttcctgggcatctggctgttctcctactgcatggaggacatccacatggccttcatcggcatcttcaccaccatgacaggcatggccatgacagcctttgccagcaccaccctgatgatgttcctggcccgggtgcccttcctgttcaccatcgtgcccttctctgtgctgcgctccatgctgagcaaggtggtgcgcagcacagagcagggcaccctgtttgcctgcatcgccttcctggagaccctgggcggcgtgacagctgtgtccaccttcaacggcatctacagcgccaccgtggcctggtacccaggcttcaccttcctgctgtctgctggcctgctgctgctgcctgccatcagcctgtgtgtggtgaagtgcacctcctggaatgaaggcagctatgagctgctgatccaggaggagagcagtgaagatgccagtgacagatag

SEQ ID NO: 38364 - DNA, 1392 bp, Artificial Sequence
  Description of Artificial Sequence: Synthetic coding sequence
atgaagatcctgtttgtggagcccgccatcttcctgagcgcctttgccatgaccctgaccggccccctgaccacccagtatgtgtaccgccgcatctgggaggagaccggcaactacaccttcagcagtgacagcaacatcagtgaatgtgagaagaacaagagcagccccatctttgccttccaggaggaggtgcagaagaaggtgagccgcttcaacctgcagatggacatcagcggcctcatccctggcctggtgtccaccttcatcctgctgagcatcagtgaccactacggcaggaagttccccatgatcctgagctctgtgggcgccctggccacctctgtgtggctgtgcctgctgtgctactttgccttccccttccagctgctgattgccagcaccttcatcggggccttctgtggcaactacaccaccttctggggcgcctgctttgcctacatcgtggaccagtgcaaggagcacaagcagaagaccatcagaattgccatcatcgacttcctgctgggcctggtgacaggcctgaccggcctgagcagcggctacttcatccgggagctgggctttgagtggagcttcctgatcatcgctgtgtccctggccgtgaacctgatctacatcctcttcttcctgggggaccctgtgaaggagtgcagcagccagaatgtgaccatgagctgcagcgagggcttcaagaacctcttctaccgcacctacatgctgttcaagaatgccagcggcaagaggcgcttcctgctgtgcctgctgctcttcaccgtcatcacctacttctttgtggtgattggaattgcccccatcttcatcctgtatgagctggacagccccctgtgctggaatgaggtgttcatcggctacggcagcgccctgggcagcgccagcttcctgaccagcttcctgggcatctggctgttctcctactgcatggaggacatccacatggccttcatcggcatcttcaccaccatgacaggcatggccatgacagcctttgccagcaccaccctgatgatgttcctggcccgggtgcccttcctgttcaccatcgtgcccttctctgtgctgcgctccatgctgagcaaggtggtgcgcagcacagagcagggcaccctgtttgcctgcatcgccttcctggagaccctgggcggcgtgacagctgtgtccaccttcaacggcatctacagcgccaccgtggcctggtacccaggcttcaccttcctgctgtctgctggcctgctgctgctgcctgccatcagcctgtgtgtggtgaagtgcacctcctggaatgaaggcagctatgagctgctgatccaggaggagagcagtgaagatgccagtgaccgggcctgctag

SEQ ID NO: 38365 - DNA, 453 bp, Artificial Sequence
  Description of Artificial Sequence: Synthetic coding sequence
atggcccccagccggctgcagctgggcctgcgggccgcctacagcggcatcagctctgtggccggcttcagcatcttcctggtgtggacagtggtgtaccggcagcccggcacagctgccatgggcggcctggccggcgtgctggccctgtgggtgctggtgacccacgtgatgtacatgcaggactactggaggacctggctgaagggcctgcggggcttcttctttgtgggcgtgctcttctctgctgtgtccattgctgccttctgcaccttcctggtgctggccatcaccaggcaccagagcctgacagaccccaccagctactacctgagctctgtgtggagcttcatctccttcaagtgggccttcctgctgagcctgcccaagtgctgggactaccgctgtgagcccccctgcccagcctggatctgcttcctgagcacccagtag

SEQ ID NO: 38366 - DNA, 441 bp, Artificial Sequence
  Description of Artificial Sequence: Synthetic coding sequence
atggcccccagccggctgcagctgggcctgcgggccgcctacagcggcatcagctctgtggccggcttcagcatcttcctggtgtggacagtggtgtaccggcagcccggcacagctgccatgggcggcctggccggcgtgctggccctgtgggtgctggtgacccacgtgatgtacatgcaggactactggaggacctggctgaagggcctgcggggcttcttctttgtgggcgtgctcttctctgctgtgtccattgctgccttctgcaccttcctggtgctggccatcaccaggcaccagagcctgacagaccccaccagctactacctgagctctgtgtggagcttcatctccttcaagtgggccttcctgctgagcctgtatgcccaccgctacagagctgactttgctgacatcagcatcctgagtgacttctag

SEQ ID NO: 38367 - DNA, 270 bp, Artificial Sequence
  Description of Artificial Sequence: Synthetic coding sequence
atgtacatgcaggactactggaggacctggctgaagggcctgcggggcttcttctttgtgggcgtgctcttctctgctgtgtccattgctgccttctgcaccttcctggtgctggccatcaccaggcaccagagcctgacagaccccaccagctactacctgagctctgtgtggagcttcatctccttcaagtgggccttcctgctgagcctgtatgcccaccgctacagagctgactttgctgacatcagcatcctgagtgacttctag

SEQ ID NO: 38368 - DNA, 270 bp, Artificial Sequence; identical to SEQ ID NO: 38367
  Description of Artificial Sequence: Synthetic coding sequence

SEQ ID NO: 38369 - DNA, 111 bp, Artificial Sequence
  Description of Artificial Sequence: Synthetic coding sequence
atgtacatgcaggactactggaggacctggctgaagggcctgcggggcttcttctttgtgggcgtgctcttctctgctgtgtccattgctgccttctgcaccttcctgtag

SEQ ID NO: 38370 - DNA, 51 bp, Artificial Sequence
  Description of Artificial Sequence: Synthetic coding sequence
atgtacatgcaggactactggaggacctggctgaagggcctgcggggctag

SEQ ID NO: 38371 - DNA, 1743 bp, Artificial Sequence
  Description of Artificial Sequence: Synthetic coding sequence
atggccttccacgtggagggcctgattgccatcatcgtgttctacctgctgatcctgctggtgggcatctgggccgcctggaggaccaagaacagcggcagcgctgaggagaggtctgaggccatcatcgtgggcggccgggacatcggcctgctggtgggcggcttcaccatgacagccacctgggtgggcggcggctacatcaatggaacagctgaggccgtgtatgtgcccggctacggcctggcctgggcccaggcccccatcggctacagcctgagcctcatcctgggcggcctcttctttgccaagcccatgaggagcaagggctacgtgaccatgctggaccccttccagcagatctacggcaagaggatgggcggcctgctcttcatcccagccctgatgggagagatgttctgggccgccgccatcttcagcgccctgggcgccaccatcagcgtcatcattgatgtggacatgcacatcagcgtcatcatcagcgccctgattgccaccctgtacaccctggtgggcggcctgtacagcgtggcctacacagatgtggtgcagctgttctgcatctttgtgggcctgtggatctctgtgccctttgccctgagccaccctgctgtggccgacatcggcttcaccgctgtgcacgccaagtaccagaagccctggctgggcaccgtggacagcagcgaggtgtacagctggctggacagcttcctgctgctgatgctgggcggcatcccctggcaggcctacttccagagggtgctgagcagcagcagcgccacctacgcccaggtgctgtccttcctggccgccttcggctgcctggtgatggccatcccagccatcctgattggagccatcggggccagcacagactggaaccagacagcctacggcctgcctgaccccaagaccacagaggaggccgacatgatcctgcccatcgtgctgcagtacctgtgccctgtgtacatctccttcttcggcctgggcgctgtgtctgctgctgtgatgagcagcgctgacagcagcatcctgagcgccagctccatgtttgccaggaacatctaccagctgtccttccggcagaatgccagtgacaaggagatcgtgtgggtgatgaggatcaccgtgtttgtgtttggagccagcgccacagccatggccctgctgaccaagacagtgtatggcctgtggtacctgagcagtgacctggtgtacatcgtcatcttcccccagctgctgtgtgtgctgtttgtgaagggcaccaacacctatggagctgtggccggctacgtgtctggcctcttcctgcgcatcaccggcggggagccctacctgtacctgcagcccctcatcttctacccaggctactacccagatgacaatggcatctacaaccagaagttccccttcaagaccctggccatggtgaccagcttcctgaccaacatctgcatctcctacctggccaagtacctgtttgagagcggcaccctgccccccaagctggatgtgtttgatgctgtggtggcccggcacagcgaggagaacatggacaagaccatcctggtgaagaatgaaaacatcaagctggatgagctggccctggtgaagccccggcagagcatgaccctgagcagcaccttcaccaacaaggaggccttcctggatgtggacagcagccctgagggcagcggcacagaggacaacctgcagtag

SEQ ID NO: 38372 - DNA, 1743 bp, Artificial Sequence; identical to SEQ ID NO: 38371
  Description of Artificial Sequence: Synthetic coding sequence

SEQ ID NO: 38373 - DNA, 1428 bp, Artificial Sequence
  Description of Artificial Sequence: Synthetic coding sequence
atgaggagcaagggctacgtgaccatgctggaccccttccagcagatctacggcaagaggatgggcggcctgctcttcatcccagccctgatgggagagatgttctgggccgccgccatcttcagcgccctgggcgccaccatcagcgtcatcattgatgtggacatgcacatcagcgtcatcatcagcgccctgattgccaccctgtacaccctggtgggcggcctgtacagcgtggcctacacagatgtggtgcagctgttctgcatctttgtgggcctgtggatctctgtgccctttgccctgagccaccctgctgtggccgacatcggcttcaccgctgtgcacgccaagtaccagaagccctggctgggcaccgtggacagcagcgaggtgtacagctggctggacagcttcctgctgctgatgctgggcggcatcccctggcaggcctacttccagagggtgctgagcagcagcagcgccacctacgcccaggtgctgtccttcctggccgccttcggctgcctggtgatggccatcccagccatcctgattggagccatcggggccagcacagactggaaccagacagcctacggcctgcctgaccccaagaccacagaggaggccgacatgatcctgcccatcgtgctgcagtacctgtgccctgtgtacatctccttcttcggcctgggcgctgtgtctgctgctgtgatgagcagcgctgacagcagcatcctgagcgccagctccatgtttgccaggaacatctaccagctgtccttccggcagaatgccagtgacaaggagatcgtgtgggtgatgaggatcaccgtgtttgtgtttggagccagcgccacagccatggccctgctgaccaagacagtgtatggcctgtggtacctgagcagtgacctggtgtacatcgtcatcttcccccagctgctgtgtgtgctgtttgtgaagggcaccaacacctacggggctgtggccggctacgtgtctggcctcttcctgcgcatcactggaggagagccctacctgtacctgcagcccctcatcttctacccaggctactacccagatgacaatggcatctacaaccagaagttccccttcaagaccctggccatggtgaccagcttcctgaccaacatctgcatctcctacctggccaagtacctgtttgaaagtggcaccctgccccccaagctggatgtgtttgatgctgtggtggcccggcacagcgaggagaacatggacaagaccatcctggtgaagaatgaaaacatcaagctggatgagctggccctggtgaagccccggcagagcatgaccctgagcagcaccttcaccaacaaggaggccttcctggatgtggacagcagccctgagggcagcggcacagaggacaacctgcagtag

SEQ ID NO: 38374 - DNA, 1980 bp, Artificial Sequence
  Description of Artificial Sequence: Synthetic coding sequence
atggccagcacagtgagccccagcaccatcgccgagaccccagagcccccacccctgagtgaccacatcagaaatgctgctgacatcagcgtcatcgtcatctacttcctggtggtgatggctgtgggcctgtgggccatgctgaagaccaacagaggcaccatcggcggcttcttcctggccggccgggacatggcctggtggcccatgggcgccagcctgtttgccagcaacatcggcagcaaccactacgtgggcctggccggcaccggggccgccagcggcgtggccaccgtgacctttgagtggaccagctctgtgatgctgctgatcctgggctggatctttgtgcccatctacatcaagtctggagtgatgaccatgcctgagtacctgaagaagagatttggaggagagcggctgcaggtgtacctgagcatcctgagcctcttcatctgtgtggtgctgctgatctctgctgacatctttgctggggccatcttcatcaagctggccctgggcctggacctgtacctggccatcttcatcctgctggccatgacagctgtgtacaccaccaccggcggcctggccagcgtcatctacacagacaccctgcagaccatcatcatgctgattggcagcttcatcctgatgggctttgccttcaatgaggtgggcggctatgagagcttcacagagaagtatgtgaatgccacccccagcgtggtggagggggacaacctgaccatcagcgccagctgctacacccccagggctgacagcttccacatcttcagagatgctgtgactggagacatcccctggccaggcatcatcttcggcatgcccatcacagccctgtggtactggtgcaccaaccaggtgattgtgcagcgctgcctgtgtgggaaggacatgagccacgtgaaggccgcctgcatcatgtgtgcctacctgaagctgctgcccatgttcctgatggtgatgcctggcatgatcagccgcatcctgtacacagacatggtggcctgtgtggtgcccagtgaatgtgtgaagcactgcggcgtggatgtgggctgcaccaactatgcctaccccaccatggtgctggagctgatgccccagggcctgcggggcctgatgctgtctgtgatgctggccagcctgatgagcagcctgaccagcatcttcaacagcgccagcaccctcttcaccatcgacctgtacaccaagatgaggaagcaggccagcgagaaggagctgctgattgctggccgcatctttgtgctgctgctgactgtggtgtccatcgtgtgggtgcccctggtgcaggtgtcccagaatggccagctgatccactacacagagagcatcagcagctacctgggcccccccatcgctgctgtgtttgtgctggccatcttctgcaagagggtgaatgagcagggcgccttctggggcctgatggtgggcctggccatgggcctcatccgcatgatcacagaatttgcctacggcaccggcagctgcctggcccccagcaactgccccaagatcatctgtggggtgcactacctgtacttcagcatcgtgctcttcttcggctccatgctggtgaccctgggcatcagcctgctgaccaagcccatcccagatgtgcacctgtaccgcctgtgctgggtgctgaggaacagcacagaggagagaattgatattgatgctgaggagaagagccaggaggagacagatgatggagtggaggaggactacccagagaagagccggggctgcctgaagaaggcctatgacctcttctgtggcctgcagaagggccccaagctgaccaaggaggaggaggaggccctgagcaagaagctgacagacaccagcgagcggcccagctggaggaccatcgtgaacatcaatgccatcctgctgctggccgtggtggtgttcatccacggctactatgcctag

SEQ ID NO: 38375 - DNA, 1836 bp, Artificial Sequence
  Description of Artificial Sequence: Synthetic coding sequence
atggtgtggtggcctgtgggcgccagcctgtttgccagcaatgtgggcagcggccacttcatcggcctggccggcagcggggccgccaccggcatctctgtgtctgcctatgagctgaatggcctcttctctgtgctgatgctggcctggatcttcctgcccatctacatcgccggccaggtgaccaccatgcctgagtacctgaggaagagatttggaggcatccgcatccccatcatcctggccgtgctgtacctgttcatctacatcttcaccaagatctctgtggacatgtatgctggggccatcttcatccagcagagcctgcacctggacctgtacctggccatcgtgggcctgctggccatcacagctgtgtacacagtggccggcggcctggccgctgtgatctacacagatgccctgcagaccctcatcatgctgattggagccctgaccctgatgggctacagctttgctgctgtgggcggcatggagggcctgaaggagaagtacttcctggccctggccagcaacagaagtgagaacagcagctgtggcctgcccagagaagatgccttccacatcttccgggaccccctgaccagtgacctgccctggccaggagtgctgtttggcatgagcatccccagcctgtggtactggtgcacagaccaggtgattgtgcagaggaccctggccgccaagaacctgagccacgccaagggcggggccctgatggccgcctacctgaaggtgctgcccctcttcatcatggtgtttcctggcatggtgagccgcatcctcttcccagaccaggtggcctgtgccgaccctgagatctgccagaagatctgcagcaaccccagcggctgcagcgacatcgcctaccccaagctggtgctggagctgctgcccaccggcctgcggggcctgatgatggctgtgatggtggccgccctgatgagcagcctgaccagcatcttcaacagcgccagcaccatcttcaccatggacctgtggaaccacctgcggccccgggccagcgagaaggagctgatgattgtgggccgggtgtttgtgctgctgctggtgctggtgtccatcctgtggatccctgtggtgcaggccagccagggcggccagctgttcatctacatccagagcatcagcagctacctgcagccccctgtggccgtggtgttcatcatgggctgcttctggaagaggaccaatgagaagggggccttctggggcctcatcagcggcctgctgctgggcctggtgcggctggtgctggacttcatctacgtgcagccccgctgtgaccagccagatgagaggcctgtgctggtgaagagcatccactacctgtacttctccatgatcctgagcacagtgaccctcatcaccgtgtccacagtgtcctggttcacagagccccccagcaaggagatggtgagccacctgacctggttcaccaggcatgaccctgtggtgcagaaggagcaggcccccccagctgcccccctgagcctgaccctgagccagaatggcatgcctgaggccagcagcagcagctctgtgcagtttgagatggtgcaggagaacaccagcaagacccacagctgtgacatgacccccaagcagagcaaggtggtgaaggccatcctgtggctgtgtggcatccaggagaagggcaaggaggagctgcctgcccgggcagaggccatcatcgtgtccctggaggagaaccccctggtgaagaccctgctggatgtgaacctgatcttctgtgtgtcctgtgccatcttcatctggggctactttgcctag

SEQ ID NO: 38376 - DNA, 1701 bp, Artificial Sequence
  Description of Artificial Sequence: Synthetic coding sequence
atgacctggtggcccatcggggccagcctgtttgccagcagcgagggcagcggcctcttcatcggcctggccggcagcggggctgctgggggcctggccgtggccggctttgagtggaatgccacctacgtgctgctggccctggcctgggtgtttgtgcccatctacatcagcagcgagatcgtgaccctgcctgagtacatccagaagagatatggaggccagaggatccgcatgtacctgtctgtgctgagcctgctgctgtctgtgttcaccaagatcagcctggacctgtatgctggggccctgtttgtgcacatctgcctgggctggaacttctacctgagcaccatcctgaccctgggcatcacagccctgtacaccatcgccgcctttgaccagattggaggctacggccagctggaggccgcctatgcccaggccatccccagcaggaccatcgccaacaccacctgccacctgcccaggacagatgccatgcacatgttccgggacccccacactggagacctgccctggacaggcatgaccttcggcctgaccatcatggccacctggtactggtgcacagaccaggtgattgtgcagaggagcctgagcgcccgggacctgaaccacgccaaggccggcagcatcctggccagctacctgaagatgctgcccatgggcctcatcatcatgcctggcatgatcagccgggccctcttccctggggcccacgtgtatgaggagcggcaccaggtgtctgtgtccaggacagatgatgtgggctgtgtggtgcccagcgagtgcctgcgggcctgtggggctgaggtgggctgcagcaacatcgcctaccccaagctggtgatggagctgatgcccatcggcctgcggggcctgatgattgctgtgatgctggccgccctgatgagcagcctgaccagcatcttcaacagcagcagcaccctcttcaccatggacatctggaggcggctgcggcccaggtctggagagcgggagctgctgctggtgggccgcacaggcatccccagcaccccaccagccccccagagccggctgtccttcctgctgcctgagaccccacccctggagcgctacctgctgggcctggtggtgatggacctgtggctggtgattgtggccctgattggagtgtctgtggcctggatccctgtgctgcaggacagcaacagcggccagctgttcatctacatgcagagcgtgaccagcagcctggcccctcctgtgacagctgtgtttgtgctgggcgtcttctggaggcgggccaatgagcagggcgccttctggggcctgattgctggcctggtggtgggcgccacccggctggtgctggagttcctgaacccagccccaccctgtggggagccagacaccaggcctgctgtgctgggcagcatccactacctgcactttgctgtggccctgtttgccctgagcggggctgtggtggtggccggcagcctgctgaccccaccaccccagagcgtgcagatcgagaacctgacctggtggaccctggcccaggatgtgcccctgggcaccaaggctggagatggccagaccccccagaagcacgccttctgggcccgggtgtgtggcttcaatgccatcctgctgatgtgtgtgaacatcttcttctacgcctactttgcctag

SEQ ID NO: 38377 - DNA, 1701 bp, Artificial Sequence; identical to SEQ ID NO: 38376
  Description of Artificial Sequence: Synthetic coding sequence

SEQ ID NO: 38378 - DNA, 1710 bp, Artificial Sequence
  Description of Artificial Sequence: Synthetic coding sequence
atggccgccaacagcaccagtgacctgcacaccccaggcacccagctgtctgtggccgacatcatcgtcatcaccgtgtactttgccctgaatgtggccgtgggcatctggagcagctgccgggccagcaggaacacagtgaatggctacttcctggccggccgggacatgacctggtggcccatcggggccagcctgtttgccagcagcgagggcagcggcctcttcatcggcctggccggcagcggggctgctgggggcctggccgtggccggctttgagtggaatgccacctacgtgctgctggccctggcctgggtgtttgtgcccatctacatcagcagcgagatcgtgaccctgcctgagtacatccagaagagatatggaggccagaggatccgcatgtacctgtctgtgctgagcctgctgctgtctgtgttcaccaagatcagcctggacctgtatgctggggccctgtttgtgcacatctgcctgggctggaacttctacctgagcaccatcctgaccctgggcatcacagccctgtacaccatcgccgcctttgaccagattggaggctacggccagctggaggccgcctatgcccaggccatccccagcaggaccatcgccaacaccacctgccacctgcccaggacagatgccatgcacatgttccgggacccccacactggagacctgccctggacaggcatgaccttcggcctgaccatcatggccacctggtactggtgcacagaccaggtgattgtgcagaggagcctgagcgcccgggacctgaaccacgccaaggccggcagcatcctggccagctacctgaagatgctgcccatgggcctcatcatcatgcctggcatgatcagccgggccctcttcccagatgatgtgggctgtgtggtgcccagcgagtgcctgcgggcctgtggggctgaggtgggctgcagcaacatcgcctaccccaagctggtgatggagctgatgcccatcggcctgcggggcctgatgattgctgtgatgctggccgccctgatgagcagcctgaccagcatcttcaacagcagcagcaccctcttcaccatggacatctggaggcggctgcggcccaggtctggagagcgggagctgctgctggtgggccgcctggtgattgtggccctgattggagtgtctgtggcctggatccctgtgctgcaggacagcaacagcggccagctgttcatctacatgcagagcgtgaccagcagcctggcccctcctgtgacagctgtgtttgtgctgggcgtcttctggaggcgggccaatgagcagggcgccttctggggcctgattgctggcctggtggtgggcgccacccggctggtgctggagttcctgaacccagccccaccctgtggggagccagacaccaggcctgctgtgctgggcagcatccactacctgcactttgctgtggccctgtttgccctgtctggagctgtggtggtggccggcagcctgctgaccccaccaccccagagcgtgcagatcgagaacctgacctggtggaccctggcccaggatgtgcccctgggcaccaaggctggagatggccagaccccccagaagcacgccttctgggcccgggtgtgtggcttcaatgccatcctgctgatgtgtgtgaacatcttcttctacgcctactttgcctag

SEQ ID NO: 38379 - DNA, 1791 bp, Artificial Sequence
  Description of Artificial Sequence: Synthetic coding sequence
atggccgccaacagcaccagtgacctgcacaccccaggcacccagctgtctgtggccgacatcatcgtcatcaccgtgtactttgccctgaatgtggccgtgggcatctggagcagctgccgggccagcaggaacacagtgaatggctacttcctggccggccgggacatgacctggtggcccatcggggccagcctgtttgccagcagcgagggcagcggcctcttcatcggcctggccggcagcggggctgctgggggcctggccgtggccggctttgagtggaatgccacctacgtgctgctggccctggcctgggtgtttgtgcccatctacatcagcagcgagatcgtgaccctgcctgagtacatccagaagagatatggaggccagaggatccgcatgtacctgtctgtgctgagcctgctgctgtctgtgttcaccaagatcagcctggacctgtatgctggggccctgtttgtgcacatctgcctgggctggaacttctacctgagcaccatcctgaccctgggcatcacagccctgtacaccatcgccggcggcctggccgctgtgatctacacagatgccctgcagaccctcatcatggtggtgggcgctgtgatcctgaccatcaaggcctttgaccagatcggcggctacggccagctggaggccgcctatgcccaggccatccccagcaggaccatcgccaacaccacctgccacctgcccaggacagatgccatgcacatgttccgggacccccacactggagacctgccctggacaggcatgaccttcggcctgaccatcatggccacctggtactggtgcacagaccaggtgattgtgcagaggagcctgagcgcccgggacctgaaccacgccaaggccggcagcatcctggccagctacctgaagatgctgcccatgggcctcatcatcatgcctggcatgatcagccgggccctcttcccagatgatgtgggctgtgtggtgcccagtgaatgtctgcgggcctgtggggctgaggtgggctgcagcaacatcgcctaccccaagctggtgatggagctgatgcccatcggcctgcggggcctgatgattgctgtgatgctggccgccctgatgagcagcctgaccagcatcttcaacagcagcagcaccctcttcaccatggacatctggaggcggctgcggcccaggtctggagagcgggagctgctgctggtgggccgcctggtgattgtggccctgattggagtgtctgtggcctggatccctgtgctgcaggacagcaacagcggccagctgttcatctacatgcagagcgtgaccagcagcctggcccctcctgtgacagctgtgtttgtgctgggcgtcttctggaggcgggccaatgagcagggcgccttctggggcctgattgctggcctggtggtgggcgccacccggctggtgctggagttcctgaacccagccccaccctgtggggagccagacaccaggcctgctgtgctgggcagcatccactacctgcactttgctgtggccctgtttgccctgagcggggctgtggtggtggccggcagcctgctgaccccaccaccccagagcgtgcagatcgagaacctgacctggtggaccctggcccaggatgtgcccctgggcaccaaggctggagatggccagaccccccagaagcacgccttctgggcccgggtgtgtggcttcaatgccatcctgctgatgtgtgtgaacatcttcttctacgcctactttgcctag

SEQ ID NO: 38380 - DNA, 1839 bp, Artificial Sequence
  Description of Artificial Sequence: Synthetic coding sequence
atggccgccaacagcaccagtgacctgcacaccccaggcacccagctgtctgtggccgacatcatcgtcatcaccgtgtactttgccctgaatgtggccgtgggcatctggagcagctgccgggccagcaggaacacagtgaatggctacttcctggccggccgggacatgacctggtggcccatcggggccagcctgtttgccagcagcgagggcagcggcctcttcatcggcctggccggcagcggggctgctgggggcctggccgtggccggctttgagtggaatgccacctacgtgctgctggccctggcctgggtgtttgtgcccatctacatcagcagcgagatcgtgaccctgcctgagtacatccagaagagatatggaggccagaggatccgcatgtacctgtctgtgctgagcctgctgctgtctgtgttcaccaagatcagcctggacctgtatgctggggccctgtttgtgcacatctgcctgggctggaacttctacctgagcaccatcctgaccctgggcatcacagccctgtacaccatcgccggcggcctggccgctgtgatctacacagatgccctgcagaccctcatcatggtggtgggcgctgtgatcctgaccatcaaggcctttgaccagatcggcggctacggccagctggaggccgcctatgcccaggccatccccagcaggaccatcgccaacaccacctgccacctgcccaggacagatgccatgcacatgttccgggacccccacactggagacctgccctggacaggcatgaccttcggcctgaccatcatggccacctggtactggtgcacagaccaggtgattgtgcagaggagcctgagcgcccgggacctgaaccacgccaaggccggcagcatcctggccagctacctgaagatgctgcccatgggcctcatcatcatgcctggcatgatcagccgggccctcttccctggggcccacgtgtatgaggagcggcaccaggtgtctgtgtccaggacagatgatgtgggctgtgtggtgcccagtgaatgtctgcgggcctgtggggctgaggtgggctgcagcaacatcgcctaccccaagctggtgatggagctgatgcccatcggcctgcggggcctgatgattgctgtgatgctggccgccctgatgagcagcctgaccagcatcttcaacagcagcagcaccctcttcaccatggacatctggaggcggctgcggcccaggtctggagagcgggagctgctgctggtgggccgcctggtgattgtggccctgattggagtgtctgtggcctggatccctgtgctgcaggacagcaacagcggccagctgttcatctacatgcagagcgtgaccagcagcctggcccctcctgtgacagctgtgtttgtgctgggcgtcttctggaggcgggccaatgagcagggcgccttctggggcctgattgctggcctggtggtgggcgccacccggctggtgctggagttcctgaacccagccccaccctgtggggagccagacaccaggcctgctgtgctgggcagcatccactacctgcactttgctgtggccctgtttgccctgagcggggctgtggtggtggccggcagcctgctgaccccaccaccccagagcgtgcagatcgagaacctgacctggtggaccctggcccaggatgtgcccctgggcaccaaggctggagatggccagaccccccagaagcacgccttctgggcccgggtgtgtggcttcaatgccatcctgctgatgtgtgtgaacatcttcttctacgcctactttgcctag

SEQ ID NO: 38381 - DNA, 1683 bp, Artificial Sequence
  Description of Artificial Sequence: Synthetic coding sequence
atggccgccaacagcaccagtgacctgcacaccccaggcacccagctgtctgtggccgacatcatcgtcatcaccgtgtactttgccctgaatgtggccgtgggcatctggagcagctgccgggccagcaggaacacagtgaatggctacttcctggccggccgggacatgacctggtggcccatcggggccagcctgtttgccagcagcgagggcagcggcctcttcatcggcctggccggcagcggggctgctgggggcctggccgtggccggctttgagtggaatgccacctacgtgctgctggccctggcctgggtgtttgtgcccatctacatcagcagcgagatcgtgaccctgcctgagtacatccagaagagatatggaggccagaggatccgcatgtacctgtctgtgctgagcctgctgctgtctgtgttcaccaagatcagcctggacctgtatgctggggccctgtttgtgcacatctgcctgggctggaacttctacctgagcaccatcctgaccctgggcatcacagccctgtacaccatcgccggcggcctggccgctgtgatctacacagatgccctgcagaccctcatcatggtggtgggcgctgtgatcctgaccatcaaggcctttgaccagatcggcggctacggccagctggaggccgcctatgcccaggccatccccagcaggaccatcgccaacaccacctgccacctgcccaggacagatgccatgcacatgttccgggacccccacactggagacctgccctggacaggcatgaccttcggcctgaccatcatggccacctggtactggtgcacagaccaggtgattgtgcagaggagcctgagcgcccgggacctgaaccacgccaaggccggcagcatcctggccagctacctgaagatgctgcccatgggcctcatcatcatgcctggcatgatcagccgggccctcttccctggcctgcggggcctgatgattgctgtgatgctggccgccctgatgagcagcctgaccagcatcttcaacagcagcagcaccctcttcaccatggacatctggaggcggctgcggcccaggtctggagagcgggagctgctgctggtgggccgcctggtgattgtggccctgattggagtgtctgtggcctggatccctgtgctgcaggacagcaacagcggccagctgttcatctacatgcagagcgtgaccagcagcctggcccctcctgtgacagctgtgtttgtgctgggcgtcttctggaggcgggccaatgagcagggcgccttctggggcctgattgctggcctggtggtgggcgccacccggctggtgctggagttcctgaacccagccccaccctgtggggagccagacaccaggcctgctgtgctgggcagcatccactacctgcactttgctgtggccctgtttgccctgagcggggctgtggtggtggccggcagcctgctgaccccaccaccccagagcgtgcagatcgagaacctgacctggtggaccctggcccaggatgtgcccctgggcaccaaggctggagatggccagaccccccagaagcacgccttctgggcccgggtgtgtggcttcaatgccatcctgctgatgtgtgtgaacatcttcttctacgcctactttgcctag

SEQ ID NO: 38382 - DNA, 2028 bp, Artificial Sequence
  Description of Artificial Sequence: Synthetic coding sequence
atggagagcggcaccagcagcccccagcccccccagctggaccccctggatgccttcccccagaagggcctggagcccggggacattgctgtgctggtgctgtacttcctgtttgtgctggccgtgggcctgtggagcacagtgaagaccaagagggacacagtgaagggctacttcctggccggcggggacatggtgtggtggcctgtgggcgccagcctgtttgccagcaatgtgggcagcggccacttcatcggcctggccggcagcggggccgccaccggcatctctgtgtctgcctatgagctgaatggcctcttctctgtgctgatgctggcctggatcttcctgcccatctacatcgccggccaggtgaccaccatgcctgagtacctgaggaagagatttggaggcatccgcatccccatcatcctggccgtgctgtacctgttcatctacatcttcaccaagatctctgtggacatgtatgctggggccatcttcatccagcagagcctgcacctggacctgtacctggccatcgtgggcctgctggccatcacagctgtgtacacagtggccggcggcctggccgctgtgatctacacagatgccctgcagaccctcatcatgctgattggagccctgaccctgatgggctacagctttgctgctgtgggcggcatggagggcctgaaggagaagtacttcctggccctggccagcaacagaagtgagaacagcagctgtggcctgcccagagaagatgccttccacatcttccgggaccccctgaccagtgacctgccctggccaggagtgctgtttggcatgagcatccccagcctgtggtactggtgcacagaccaggtgattgtgcagaggaccctggccgccaagaacctgagccacgccaagggcggggccctgatggccgcctacctgaaggtgctgcccctcttcatcatggtgtttcctggcatggtgagccgcatcctcttcccagaccaggtggcctgtgccgaccctgagatctgccagaagatctgcagcaaccccagcggctgcagcgacatcgcctaccccaagctggtgctggagctgctgcccaccggcctgcggggcctgatgatggctgtgatggtggccgccctgatgagcagcctgaccagcatcttcaacagcgccagcaccatcttcaccatggacctgtggaaccacctgcggccccgggccagcgagaaggagctgatgattgtgggccgggtgtttgtgctgctgctggtgctggtgtccatcctgtggatccctgtggtgcaggccagccagggcggccagctgttcatctacatccagagcatcagcagctacctgcagccccctgtggccgtggtgttcatcatgggctgcttctggaagaggaccaatgagaagggggccttctggggcctcatcagcggcctgctgctgggcctggtgcggctggtgctggacttcatctacgtgcagccccgctgtgaccagccagatgagaggcctgtgctggtgaagagcatccactacctgtacttctccatgatcctgagcacagtgaccctcatcaccgtgtccacagtgtcctggttcacagagccccccagcaaggagatggtgagccacctgacctggttcaccaggcatgaccctgtggtgcagaaggagcaggcccccccagctgcccccctgagcctgaccctgagccagaatggcatgcctgaggccagcagcagcagctctgtgcagtttgagatggtgcaggagaacaccagcaagacccacagctgtgacatgacccccaagcagagcaaggtggtgaaggccatcctgtggctgtgtggcatccaggagaagggcaaggaggagctgcctgcccgggcagaggccatcatcgtgtccctggaggagaaccccctggtgaagaccctgctggatgtgaacctgatcttctgtgtgtcctgtgccatcttcatctggggctactttgcctag

SEQ ID NO: 38383 - DNA, 1923 bp, Artificial Sequence
  Description of Artificial Sequence: Synthetic coding sequence
atggagagcggcaccagcagcccccagcccccccagctggaccccctggatgccttcccccagaagggcctggagcccggggacattgctgtgctggtgctgtacttcctgtttgtgctggccgtgggcctgtggagcacagtgaagaccaagagggacacagtgaagggctacttcctggccggcggggacatggtgtggtggcctgtgggcgccagcctgtttgccagcaatgtgggcagcggccacttcatcggcctggccggcagcggggccgccaccggcatctctgtgtctgcctatgagctgaatggcctcttctctgtgctgatgctggcctggatcttcctgcccatctacatcgccggccaggtggacatgtatgctggggccatcttcatccagcagagcctgcacctggacctgtacctggccatcgtgggcctgctggccatcacagctgtgtacacagtggccggcggcctggccgccgtcatctacacagatgccctgcagaccctcatcatgctgattggagccctgaccctgatgggctacagctttgctgctgtgggcggcatggagggcctgaaggagaagtacttcctggccctggccagcaacagaagtgagaacagcagctgtggcctgccccgggaggatgccttccacatcttccgggaccccctgaccagtgacctgccctggccaggagtgctgtttggcatgagcatccccagcctgtggtactggtgcacagaccaggtgattgtgcagaggaccctggccgccaagaacctgagccacgccaagggcggggccctgatggccgcctacctgaaggtgctgcccctcttcatcatggtgtttcctggcatggtgagccgcatcctcttcccagaccaggtggcctgtgccgaccctgagatctgccagaagatctgcagcaaccccagcggctgcagcgacatcgcctaccccaagctggtgctggagctgctgcccaccggcctgcggggcctgatgatggctgtgatggtggccgccctgatgagcagcctgaccagcatcttcaacagcgccagcaccatcttcaccatggacctgtggaaccacctgcggccccgggccagcgagaaggagctgatgattgtgggccgggtgtttgtgctgctgctggtgctggtgtccatcctgtggatccctgtggtgcaggccagccagggcggccagctgttcatctacatccagagcatcagcagctacctgcagccccctgtggccgtggtgttcatcatgggctgcttctggaagaggaccaatgaaaaaggagccttctggggcctcatcagcggcctgctgctgggcctggtgcggctggtgctggacttcatctacgtgcagccccgctgtgaccagccagatgagaggcctgtgctggtgaagagcatccactacctgtacttctccatgatcctgagcacagtgaccctcatcaccgtgtccacagtgtcctggttcacagagccccccagcaaggagatggtgagccacctgacctggttcaccaggcatgaccctgtggtgcagaaggagcaggcccctcctgctgcccccctgagcctgaccctgagccagaatggcatgcctgaggccagcagcagcagctctgtgcagtttgagatggtgcaggagaacaccagcaagacccacagctgtgacatgacccccaagcagagcaaggtggtgaaggccatcctgtggctgtgtggcatccaggagaagggcaaggaggagctgcctgcccgggcagaggccatcatcgtgtccctggaggagaaccccctggtgaagaccctgctggatgtgaacctgatcttctgtgtgtcctgtgccatcttcatctggggctactttgcctag

SEQ ID NO: 38384 - DNA, 1560 bp, Artificial Sequence
  Description of Artificial Sequence: Synthetic coding sequence
atggtgtggtggcctgtgggcgccagcctgtttgccagcaatgtgggcagcggccacttcatcggcctggccggcagcggggccgccaccggcatctctgtgtctgcctatgagctgaatggcctcttctctgtgctgatgctggcctggatcttcctgcccatctacatcgccggccaggtgaccaccatgcctgagtacctgaggaagagatttggaggcatccgcatccccatcatcctggccgtgctgtacctgttcatctacatcttcaccaagatctctgtggacatgtatgctggggccatcttcatccagcagagcctgcacctggacctgtacctggccatcgtgggcctgctggccatcacagctgtgtacacagtggccggcggcctggccgctgtgatctacacagatgccctgcagaccctcatcatgctgattggagccctgaccctgatgggctacagcgactgcccagctgacagcggctgccaggagcctgtgccctgccagaggcgctgcagtgatggctgcatccctgagggcgccgcccccctgcacaacggggtgccctgggatggccagccccaccccctgcccaggagcagcggcctgtgccgcagccgggacctgcctgaggacctgcagcagcccctgcggctgtttggccaccgggtgtcccagaccagggctggcaccccagcccacagcgccagcaccatcttcaccatggacctgtggaaccacctgcggccccgggccagcgagaaggagctgatgattgtgggccgggtgtttgtgctgctgctggtgctggtgtccatcctgtggatccctgtggtgcaggccagccagggcggccagctgttcatctacatccagagcatcagcagctacctgcagccccctgtggccgtggtgttcatcatgggctgcttctggaagaggaccaatgagaagggggccttctggggcctcatcagcggcctgctgctgggcctggtgcggctggtgctggacttcatctacgtgcagccccgctgtgaccagccagatgagaggcctgtgctggtgaagagcatccactacctgtacttctccatgatcctgagcacagtgaccctcatcaccgtgtccacagtgtcctggttcacagagccccccagcaaggagatggtgagccacctgacctggttcaccaggcatgaccctgtggtgcagaaggagcaggcccccccagctgcccccctgagcctgaccctgagccagaatggcatgcctgaggccagcagcagcagctctgtgcagtttgagatggtgcaggagaacaccagcaagacccacagctgtgacatgacccccaagcagagcaaggtggtgaaggccatcctgtggctgtgtggcatccaggagaagggcaaggaggagctgcctgcccgggcagaggccatcatcgtgtccctggaggagaaccccctggtgaagaccctgctggatgtgaacctgatcttctgtgtgtcctgtgccatcttcatctggggctactttgcctag

SEQ ID NO: 38385 - DNA, 1836 bp, Artificial Sequence; identical to SEQ ID NO: 38375
  Description of Artificial Sequence: Synthetic coding sequence

SEQ ID NO: 38386 - DNA, 1818 bp, Artificial Sequence
  Description of Artificial Sequence: Synthetic coding sequence
atggagagcggcaccagcagcccccagcccccccagctggaccccctggatgccttcccccagaagggcctggagcccggggacattgctgtgctggtgctgtacttcctgtttgtgctggccgtgggcctgtggagcacagtgaagaccaagagggacacagtgaagggctacttcctggccggcggggacatggtgtggtggccaggcctcttctctgtgctgatgctggcctggatcttcctgcccatctacatcgccggccaggtggacatgtatgctggggccatcttcatccagcagagcctgcacctggacctgtacctggccatcgtgggcctgctggccatcacagctgtgtacacagtggccggcggcctggccgctgtgatctacacagatgccctgcagaccctcatcatgctgattggagccctgaccctgatgggctacagctttgctgctgtgggcggcatggagggcctgaaggagaagtacttcctggccctggccagcaacagaagtgagaacagcagctgtggcctgcccagagaagatgccttccacatcttccgggaccccctgaccagtgacctgccctggccaggagtgctgtttggcatgagcatccccagcctgtggtactggtgcacagaccaggtgattgtgcagaggaccctggccgccaagaacctgagccacgccaagggcggggccctgatggccgcctacctgaaggtgctgcccctcttcatcatggtgtttcctggcatggtgagccgcatcctcttcccagaccaggtggcctgtgccgaccctgagatctgccagaagatctgcagcaaccccagcggctgcagcgacatcgcctaccccaagctggtgctggagctgctgcccaccggcctgcggggcctgatgatggctgtgatggtggccgccctgatgagcagcctgaccagcatcttcaacagcgccagcaccatcttcaccatggacctgtggaaccacctgcggccccgggccagcgagaaggagctgatgattgtgggccgggtgtttgtgctgctgctggtgctggtgtccatcctgtggatccctgtggtgcaggccagccagggcggccagctgttcatctacatccagagcatcagcagctacctgcagccccctgtggccgtggtgttcatcatgggctgcttctggaagaggaccaatgagaagggggccttctggggcctcatcagcggcctgctgctgggcctggtgcggctggtgctggacttcatctacgtgcagccccgctgtgaccagccagatgagaggcctgtgctggtgaagagcatccactacctgtacttctccatgatcctgagcacagtgaccctcatcaccgtgtccacagtgtcctggttcacagagccccccagcaaggagatggtgagccacctgacctggttcaccaggcatgaccctgtggtgcagaaggagcaggcccccccagctgcccccctgagcctgaccctgagccagaatggcatgcctgaggccagcagcagcagctctgtgcagtttgagatggtgcaggagaacaccagcaagacccacagctgtgacatgacccccaagcagagcaaggtggtgaaggccatcctgtggctgtgtggcatccaggagaagggcaaggaggagctgcctgcccgggcagaggccatcatcgtgtccctggaggagaaccccctggtgaagaccctgctggatgtgaacctgatcttctgtgtgtcctgtgccatcttcatctggggctactttgcctag

SEQ ID NO: 38387 - DNA, 2121 bp, Artificial Sequence
  Description of Artificial Sequence: Synthetic coding sequence
atgagcaaggagctggccgccatgggccctggggccagcggagatggagtgaggacagaaacagccccccacatcgccctggacagccgggtgggcctgcacgcctatgacatctctgtggtggtgatctactttgtgtttgtgattgctgtgggcatctggagcagcatccgggccagccggggcaccatcggcggctacttcctggccggccgctccatgtcctggtggcccatcggggccagcctgatgagcagcaatgtgggcagcggcctcttcatcggcctggccggcactggagctgctgggggcctggccgtgggcggctttgagtggaacatgaggaagagccgctctggaggagaccggggcatccaccccaggagccacggccgcactggagtgcgcagccaggccacctggctgctgctggccctgggctgggtgtttgtgcctgtgtacatcgctgctggggtggtgaccatgccccagtacctgaagaagagatttggaggccagaggatccaggtgtacatgtctgtgctgagcctcatcctgtacatcttcaccaagatcagcacagacatcttcagcggggccctcttcatccagatggccctgggctggaacctgtacctgagcacaggcatcctgctggtggtgacagctgtgtacaccatcgccggcggcctgatggctgtgatctacacagatgccctgcagaccgtcatcatggtgggcggggccctggtgctgatgttcctgggcttccaggatgtgggctggtacccaggcctggagcagcgctaccggcaggccatccccaacgtgacagtgcccaacaccacctgccacctgcccaggccagatgccttccacatcctgcgggaccctgtgtctggggacatcccctggccaggcctcatcttcggcctgactgtgctggccacctggtgctggtgcacagaccaggtgattgtgcagaggagcctgagcgccaagagcctgagccacgccaagggcggctctgtgctgggcggctacctgaagatcctgcccatgttcttcatcgtgatgcctggcatgatcagccgggccctcttcccagatgaggtgggctgtgtggaccctgatgtgtgccagaggatctgtggggcccgggtgggctgcagcaacatcgcctaccccaagctggtgatggccctgatgcctgtgggcctgcggggcctgatgattgctgtgatcatggccgccctgatgagcagcctgaccagcatcttcaacagcagcagcaccctcttcaccattgatgtgtggcagcgcttccggaggaagagcacagagcaggagctgatggtggtgggccgggtgtttgtggtgttcctggtggtgatcagcatcctgtggatccccatcatccagagcagcaacagcggccagctgtttgactacatccaggccgtgaccagctacctggccccacccatcacagccctcttcctgctggccatcttctgcaagagggtgacagagcccggggccttctggggcctggtgtttggcctgggcgtgggcctgctgaggatgatcctggagttctcctacccagccccagcctgtggggaggtggacagaagacctgctgtgctgaaggacttccactacctgtactttgccatcctgctgtgtggcctgacagccatcgtcatcgtcatcgtgtccctgtgcaccacccccatccctgaggagcagctgacccggctgacctggtggaccaggaactgccccctgtctgagctggagaaggaggcccacgagagcaccccagagatcagcgagaggcctgctggggagtgcccagctgggggcggcgctgctgagaacagcagcctgggccaggagcagcctgaggcccccagccgctcctggggcaagctgctgtggagctggttctgtggcctgagcggcaccccagagcaggccctgagccctgctgagaaggccgccctggagcagaagctgaccagcattgaggaggagcccctgtggaggcatgtgtgcaacatcaatgctgtgctgctgctggccatcaacatcttcctgtggggctactttgcctag

SEQ ID NO: 38388 - DNA, 501 bp, Artificial Sequence
  Description of Artificial Sequence: Synthetic coding sequence
atgggccctggggccagcggagatggagtgaggacagaaacagccccccacatcgccctggacagccgggtgggcctgcacgcctatgacatctctgtggtggtgatctactttgtgtttgtgattgctgtgggcatctggagcagcatccgggccagccggggcaccatcggcggctacttcctggccggccgctccatgtcctggtggcccatcggggccagcctgatgagcagcaatgtgggcagcggcctcttcatcggcctggccggcaccggggctgctgggggcctggccgtgggcggctttgagtggaatgccacctggctgctgctggccctgggctgggtgtttgtgcctgtgtacatcgctgctggggtggtgaccatgccccagtacctgaagaagagatttggaggccagaggatccaggtgtacatgtctgtgctgagcctcatcctgtacatcttcaccaagatcagcggcagctgctggtggtag

SEQ ID NO: 38389 - DNA, 2046 bp, Artificial Sequence
  Description of Artificial Sequence: Synthetic coding sequence
atgagcaaggagctggccgccatgggccctggggccagcggagatggagtgaggacagaaacagccccccacatcgccctggacagccgggtgggcctgcacgcctatgacatctctgtggtggtgatctactttgtgtttgtgattgctgtgggcatctggagcagcatccgggccagccggggcaccatcggcggctacttcctggccggccgctccatgtcctggtggcccatcggggccagcctgatgagcagcaatgtgggcagcggcctcttcatcggcctggccggcactggagctgctgggggcctggccgtgggcggctttgagtggaatgccacctggctgctgctggccctgggctgggtgtttgtgcctgtgtacatcgccgccggcgtggtgaccatgccccagtacctgaagaagagatttggaggccagaggatccaggtgtacatgtctgtgctgagcctcatcctgtacatcttcaccaagatcagcacagacatcttcagcggggccctcttcatccagatggccctgggctggaacctgtacctgagcacaggcatcctgctggtggtgacagctgtgtacaccatcgccggcggcctgatggccgtcatctacacagatgccctgcagaccgtcatcatggtgggcggggccctggtgctgatgttcctgggcttccaggatgtgggctggtacccaggcctggagcagcgctaccggcaggccatccccaacgtgacagtgcccaacaccacctgccacctgcccaggccagatgccttccacatcctgcgggaccctgtgtctggggacatcccctggccaggcctcatcttcggcctgactgtgctggccacctggtgctggtgcacagaccaggtgattgtgcagaggagcctgagcgccaagagcctgagccacgccaagggcggctctgtgctgggcggctacctgaagatcctgcccatgttcttcatcgtgatgcctggcatgatcagccgggccctcttcccagatgaggtgggctgtgtggaccctgatgtgtgccagaggatctgtggggcccgggtgggctgcagcaacatcgcctaccccaagctggtgatggccctgatgcctgtgggcctgcggggcctgatgattgctgtgatcatggccgccctgatgagcagcctgaccagcatcttcaacagcagcagcaccctcttcaccattgatgtgtggcagcgcttccggaggaagagcacagagcaggagctgatggtggtgggccgggtgtttgtggtgttcctggtggtgatcagcatcctgtggatccccatcatccagagcagcaacagcggccagctgtttgactacatccaggccgtgaccagctacctggccccacccatcacagccctcttcctgctggccatcttctgcaagagggtgacagagcccggggccttctggggcctggtgtttggcctgggcgtgggcctgctgaggatgatcctggagttctcctacccagccccagcctgtggggaggtggaccggcggcctgctgtgctgaaggacttccactacctgtactttgccatcctgctgtgtggcctgacagccatcgtgattgtgattgtgtccctgtgcaccacccccatccctgaggagcagctgacccggctgacctggtggaccaggaactgccccctgtctgagctggagaaggaggcccacgagagcaccccagagatcagcgagaggcctgctggagaatgtcctgctgggggcggcgctgctgagaacagcagcctgggccaggagcagcctgaggcccccagccgctcctggggcaagctgctgtggagctggttctgtggcctgagcggcaccccagagcaggccctgagccctgctgagaaggccgccctggagcagaagctgaccagcattgaggaggagcccctgtggaggcatgtgtgcaacatcaatgctgtgctgctgctggccatcaacatcttcctgtggggctactttgcctag

SEQ ID NO: 38390 - DNA, 522 bp, Artificial Sequence
  Description of Artificial Sequence: Synthetic coding sequence
tgaagcaaggagctggccgccatgggccctggggccagcggagatggagtgaggacagaaacagccccccacatcgccctggacagccgggtgggcctgcacgcctatgacatctctgtggtggtgatctactttgtgtttgtgattgctgtgggcatctggagcagcatccgggccagccggggcaccatcggcggctacttcctggccggccgctccatgtcctggtggcccatcggggccagcctgatgagcagcaatgtgggcagcggcctcttcatcggcctggccggcactggagctgctgggggcctggccgtgggcggctttgagtggaatgccacctggctgctgctggccctgggctgggtgtttgtgcctgtgtacatcgccgccggcgtggtgaccatgccccagtacctgaagaagagatttggaggccagaggatccaggtgtacatgtctgtgctgagcctcatcctgtacatcttcaccaagatcagcggcagctgctggtggtag

SEQ ID NO: 38391 - DNA, 1908 bp, Artificial Sequence
  Description of Artificial Sequence: Synthetic coding sequence
atgtctgtgggcgtgtccaccagcgcccccctgagccccaccagcggcacctctgtgggcatgagcaccttcagcatcatggactatgtggtgtttgtgctgctgctggtgctgagcctggccatcggcctgtaccacgcctgccggggctggggccgccacacagtgggggagctgctgatggctgacaggaagatgggctgcctgcctgtggccctgagcctgctggccaccttccagagcgctgtggccatcctgggcgtgcccagcgagatctacagatttggcacccagtactggttcctgggctgctgctacttcctgggcctgctgatcccagcccacatcttcatccctgtgttctaccgcctgcacctgaccagcgcctatgagtacctggagctgcgcttcaacaagacagtgcgggtgtgtggcaccgtgaccttcatcttccagatggtgatctacatgggcgtggtgctgtatgcccccagcctggccctgaatgctgtgacaggctttgacctgtggctgtctgtgctggccctgggcatcgtgtgcaccgtgtacacagccctgggcggcctgaaggccgtcatctggacagatgtgttccagaccctggtgatgttcctgggccagctggccgtcatcatcgtgggcagcgccaaggtgggcggcctgggccgggtgtgggccgtggccagccagcacggccgcatcagcggctttgagctggaccctgacccctttgtgcgccacaccttctggaccctggcctttggaggagtcttcatgatgctgagcctgtatggagtgaaccaggcccaggtgcagcgctacctgagcagcaggacagagaaggctgctgtgctgagctgctatgctgtgttccccttccagcaggtgtccctgtgtgtgggctgcctgattggcctggtgatgtttgcctactaccaggagtaccccatgagcatccagcaggcccaggccgccccagaccagtttgtgctgtactttgtgatggacctgctgaagggcctgcccggcctgcccggcctcttcatcgcctgcctcttcagcggcagcctgagcaccatcagcagcgccttcaacagcctggccaccgtgaccatggaggacctgatccggccctggttccctgagttcagcgaggcccgggccatcatgctgagccggggcctggccttcggctacggcctgctgtgcctgggcatggcctacatcagcagccagatgggccctgtgctgcaggccgccatcagcatcttcggcatggtgggcggccccctgctgggcctcttctgcctgggcatgttcttcccctgtgccaaccccccaggagctgtggtgggcctgctggccggcctggtgatggccttctggattggcatcggcagcatcgtgacctccatgggcagctccatgccacccagccccagcaatggcagcagcttcagcctgcccaccaacctgactgtggccaccgtgaccaccctgatgcccctgaccaccttcagcaagcccaccggcctgcagcgcttctacagcctgagctacctgtggtacagcgcccacaacagcaccaccgtgattgtggtgggcctcatcgtgtccctgctgactggaaggatgaggggccgcagcctgaacccagccaccatctaccctgtgctgcccaagctgctgagcctgctgcccctgagctgccagaagaggctgcactgccgctcctatggccaggaccacctggacaccggcctcttccctgagaagcccagaaatggagtgctgggggacagccgggacaaggaggccatggccctggatggaacagcctaccagggcagcagcagcacctgcatcctgcaggagaccagcctgtag

SEQ ID NO: 38392 - DNA, 444 bp, Artificial Sequence
  Description of Artificial Sequence: Synthetic coding sequence
atgtctgtgggcgtgtccaccagcgcccccctgagccccaccagcggcacctctgtgggcatgagcaccttcagcatcatggactatgtggtgtttgtgctgctgctggtgctgagcctggccatcggcctgtaccacgcctgccggggctggggccgccacacagtgggggagctgctgatggctgacaggaagatgggctgcctgcctgtggccctgagcctgctggccaccttccagagcgctgtggccatcctgggcgtgcccagcgagatctacagatttggcacccagtactggttcctgggctgctgctacttcctgggcctgctgatcccagcccacatcttcatccctgtgttctaccgcctgcacctgaccagcgcctatgagtacctggagctgcgcttcaacaagacagtgcgggtgtgtggcaccgtgtag

SEQ ID NO: 38393 - DNA, 1908 bp, Artificial Sequence; identical to SEQ ID NO: 38391
  Description of Artificial Sequence: Synthetic coding sequence

SEQ ID NO: 38394 - DNA, 582 bp, Artificial Sequence
  Description of Artificial Sequence: Synthetic coding sequence
atgtctgtgggcgtgtccaccagcgcccccctgagccccaccagcggcacctctgtgggcatgagcaccttcagcatcatggactatgtggtgtttgtgctgctgctggtgctgagcctggccatcggcctgtaccacgcctgccggggctggggccgccacacagtgggggagctgctgatggctgacaggaagatgggctgcctgcctgtggccctgagcctgctggccaccttccagagcgctgtggccatcctgggcgtgcccagcgagatctacagatttggcacccagtactggttcctgggctgctgctacttcctgggcctgctgatcccagcccacatcttcatccctgtgttctaccgcctgcacctgaccagcgcctatgagtacctggagctgcgcttcaacaagacagtgcgggtgtgtggcaccgtgaccttcatcttccagatggtgatctacatgggcgtggtgctgtatgcccccagcctggccctgaatgctgtgacaggctttgacctgtggctgtctgtgctggccctgggcatcgtgtgcaccgtgtacacagccctgtag

SEQ ID NO: 38395 - DNA, 237 bp, Artificial Sequence
  Description of Artificial Sequence: Synthetic coding sequence
atgtctgtgggcgtgtccaccagcgcccccctgagccccaccagcggcacctctgtgggcatgagcaccttcagcatcatggactatgtggtgtttgtgctgctgctggtgctgagcctggccatcggcctgtaccacgcctgccggggctggggccgccacacagtgggggagctgctgatggctgacaggaagatgggctgcctgcctgtggccctgagcctgctggccacctag

SEQ ID NO: 38396 - DNA, 348 bp, Artificial Sequence
  Description of Artificial Sequence: Synthetic coding sequence
atgtctgtgggcgtgtccaccagcgcccccctgagccccaccagcggcacctctgtgggcatgagcaccttcagcatcatggactatgtggtgtttgtgctgctgctggtgctgagcctggccatcggcctgtaccacgcctgccggggctggggccgccacacagtgggggagctgctgatggctgacaggaagatgggctgcctgcctgtggccctgagcctgctggccaccttccagagcgctgtggccatcctgggcgtgcccagcgagatctacagatttggcacccagtactggttcctgggctgctgctacttcctgggcctgctgatcccagcccactag

SEQ ID NO: 38397 - DNA, 180 bp, Artificial Sequence
  Description of Artificial Sequence: Synthetic coding sequence
atgtctgtgggcgtgtccaccagcgcccccctgagccccaccagcggcacctctgtgggcatgagcaccttcagcatcatggactatgtggtgtttgtgctgctgctggtgctgagcctggccatcggcctgtaccacgcctgccggggctggggccgccacacagtgggggagctgtag

SEQ ID NO: 38398 - DNA, 120 bp, Artificial Sequence
  Description of Artificial Sequence: Synthetic coding sequence
atgtctgtgggcgtgtccaccagcgcccccctgagccccaccagcggcacctctgtgggcatgagcaccttcagcatcatggactatgtggtgtttgtgctgctgctggtgctgtcctag

SEQ ID NO: 38399 - DNA, 402 bp, Artificial Sequence
  Description of Artificial Sequence: Synthetic coding sequence
atgtctgtgggcgtgtccaccagcgcccccctgagccccaccagcggcacctctgtgggcatgagcaccttcagcatcatggactatgtggtgtttgtgctgctgctggtgctgagcctggccatcggcctgtaccacgcctgccggggctggggccgccacacagtgggggagctgctgatggctgacaggaagatgggctgcctgcctgtggccctgagcctgctggccaccttccagagcgctgtggccatcctgggcgtgcccagcgagatctacagatttggcacccagtactggttcctgggctgctgctacttcctgggcctgctgatcccagcccacatcttcatccctgtgttctaccgcctgcacctgaccagcgcctatgagtacctgtag

SEQ ID NO: 38400 - DNA, 84 bp, Artificial Sequence
  Description of Artificial Sequence: Synthetic coding sequence
atgtctgtgggcgtgtccaccagcgcccccctgagccccaccagcggcacctctgtgggcatgagcaccttcagcatcatgtag

SEQ ID NO: 38401 - DNA, 462 bp, Artificial Sequence
  Description of Artificial Sequence: Synthetic coding sequence
atgtctgtgggcgtgtccaccagcgcccccctgagccccaccagcggcacctctgtgggcatgagcaccttcagcatcatggactatgtggtgtttgtgctgctgctggtgctgagcctggccatcggcctgtaccacgcctgccggggctggggccgccacacagtgggggagctgctgatggctgacaggaagatgggctgcctgcctgtggccctgagcctgctggccaccttccagagcgctgtggccatcctgggcgtgcccagcgagatctacagatttggcacccagtactggttcctgggctgctgctacttcctgggcctgctgatcccagcccacatcttcatccctgtgttctaccgcctgcacctgaccagcgcctatgagtacctggagctgcgcttcaacaagacagtgcgggtgtgtggcaccgtgaccttcatcttccagatgtag

SEQ ID NO: 38402 - DNA, 1746 bp, Artificial Sequence
  Description of Artificial Sequence: Synthetic coding sequence
atggagcggcagaaccagtgcatccagagctggaagagaagaaggaagatggccccctggagcggcggcaccggcaccacccgctggagcctgtgcaatgtgtggaggttcccctacctgtgctacaagaatggaggaggagccttcttcatcccctacctggtgttcctgttcacctgtggcatccctgtgttcctgctggagacagccctgggccagtacaccagccagggcggcgtgacagcctggaggaagatctgccccatctttgagggcatcggctacgccagccagatgatcgtcatcctgctgaatgtgtactacatcatcgtgctggcctgggccctcttctacctgttcagcagcttcaccatcgacctgccctggggcggctgctaccacgagtggaacacagagcactgcatggagttccagaagaccaacggcagcctgaatggcaccagtgaaaatgccaccagccctgtgattgagttctgggagcggcgggtgctgaagatcagtgatggcatccagcacctgggcgccctgcgctgggagctggccctgtgcctgctgctggcctgggtgatctgctacttctgcatctggaagggcgtgaagagcacaggcaaggtggtgtacttcaccgccaccttcccctacctgatgctggtggtgctgctgatccggggcgtgaccctgcctggagctgcccagggcatccagttctacctgtaccccaacctgacccggctgtgggacccccaggtgtggatggatgctggcacccagatcttcttctcctttgccatctgcctgggctgcctgacagccctgggcagctacaacaagtaccacaacaactgctacagagactgcatcgccctgtgcttcctgaacagcggcaccagctttgtggccggctttgccatcttcagcatcctgggcttcatgagccaggagcagggcgtgcccatcagcgaggtggccgagagcggccctggcctggccttcatcgcctaccccagggctgtggtgatgctgcccttcagccccctgtgggcctgctgcttcttcttcatggtggtgctgctgggcctggacagccagtttgtgtgtgtggagagcctggtgacagccctggtggacatgtacccccacgtgttcaggaagaagaacagaagagaggtgctgatcctgggcgtgtctgtggtgtccttcctggtgggcctcatcatgctgacagaaggaggcatgtatgtgttccagctgtttgactactatgctgccagcggcatgtgcctgctgtttgtggccatctttgagagcctgtgtgtggcctgggtgtatggagccaagcgcttctatgacaacatcgaggacatgattggctaccggccctggcccctcatcaagtactgctggctgttcctgaccccagctgtgtgcacagccaccttcctgttcagcctcatcaagtacacccccctgacctacaacaagaagtacacctacccctggtggggagatgccctgggctggctgctggccctgagctccatggtgtgcatcccagcctggagcctgtaccgcctgggcaccctgaagggccccttccgggagcgcatccggcagctgatgtgcccagctgaggacctgccccagaggaacccagctggccccagcgccccagccacccccaggaccagcctgctgcggctgacagagctggagagccactgctag

SEQ ID NO: 38403 - DNA, 1809 bp, Artificial Sequence
  Description of Artificial Sequence: Synthetic coding sequence
atggacagccgggtgtctggcaccaccagcaatggagagaccaagcctgtgtaccctgtgatggagaagaaggaggaggatggcaccctggagcggggccactggaacaacaagatggagtttgtgctgtctgtggccggggagatcatcggcctgggcaatgtgtggaggttcccctacctgtgctacaagaatggaggaggagccttcttcatcccctacctggtgttcctgttcacctgtggcatccctgtgttcctgctggagacagccctgggccagtacaccagccagggcggcgtgacagcctggaggaagatctgccccatctttgagggcatcggctacgccagccagatgatcgtcatcctgctgaatgtgtactacatcatcgtgctggcctgggccctcttctacctgttcagcagcttcaccatcgacctgccctggggcggctgctaccacgagtggaacacagagcactgcatggagttccagaagaccaacggcagcctgaatggcaccagtgaaaatgccaccagccctgtgattgagttctgggagaggagagtgctgaagatcagtgatggcatccagcacctgggcgccctgcgctgggagctggccctgtgcctgctgctggcctgggtgatctgctacttctgcatctggaagggcgtgaagagcacaggcaaggtggtgtacttcaccgccaccttcccctacctgatgctggtggtgctgctgatccggggcgtgaccctgcccggggccgcccagggcatccagttctacctgtaccccaacctgacccggctgtgggacccccaggtgtggatggatgctggcacccagatcttcttctcctttgccatctgcctgggctgcctgacagccctgggcagctacaacaagtaccacaacaactgctacagagactgcatcgccctgtgcttcctgaacagcggcaccagctttgtggccggctttgccatcttcagcatcctgggcttcatgagccaggagcagggcgtgcccatcagcgaggtggccgagagcggccctggcctggccttcatcgcctaccccagggctgtggtgatgctgcccttcagccccctgtgggcctgctgcttcttcttcatggtggtgctgctgggcctggacagccagtttgtgtgtgtggagagcctggtgacagccctggtggacatgtacccccacgtgttcaggaagaagaacagaagagaggtgctgatcctgggcgtgtctgtggtgtccttcctggtgggcctcatcatgctgacagagggcggcatgtatgtgttccagctgtttgactactatgctgccagcggcatgtgcctgctgtttgtggccatctttgagagcctgtgtgtggcctgggtgtatggagccaagcgcttctatgacaacatcgaggacatgattggctaccggccctggcccctcatcaagtactgctggctgttcctgaccccagctgtgtgcacagccaccttcctgttcagcctcatcaagtacacccccctgacctacaacaagaagtacacctacccctggtggggagatgccctgggctggctgctggccctgagctccatggtgtgcatcccagcctggagcctgtaccgcctgggcaccctgaagggccccttccgggagcgcatccggcagctgatgtgcccagctgaggacctgccccagagaaatcctgctggccccagcgccccagccacccccaggaccagcctgctgcggctgacagagctggagagccactgctag

SEQ ID NO: 38404 - DNA, 294 bp, Artificial Sequence
  Description of Artificial Sequence: Synthetic coding sequence
atggacagccgggtgtctggcaccaccagcaatggagagaccaagcctgtgtaccctgtgatggagaagaaggaggaggatggcaccctggagcggggccactggaacaacaagatggagtttgtgctgtctgtggccggggagatcatcggcctgggcaatgtgtggaggttcccctacctgtgctacaagaatggaggaggagagatgagggccctggtgcccccccaccccctgctggagggcggctacttccacctgctgcacctgcggcccctgtggggcgtgccctag

SEQ ID NO: 38405 - DNA, 1533 bp, Artificial Sequence
  Description of Artificial Sequence: Synthetic coding sequence
atggacagccgggtgtctggcaccaccagcaatggagagaccaagcctgtgtaccctgtgatggagaagaaggaggaggatggcaccctggagcggggccactggaacaacaagatggagtttgtgctgtctgtggccggggagatcatcggcctgggcaatgtgtggaggttcccctacctgtgctacaagaatggaggagagcactgcatggagttccagaagaccaacggcagcctgaatggcaccagtgaaaatgccaccagccctgtgattgagttctgggagaggagagtgctgaagatcagtgatggcatccagcacctgggcgccctgcgctgggagctggccctgtgcctgctgctggcctgggtgatctgctacttctgcatctggaagggcgtgaagagcacaggcaaggtggtgtacttcaccgccaccttcccctacctgatgctggtggtgctgctgatccggggcgtgaccctgcccggggccgcccagggcatccagttctacctgtaccccaacctgacccggctgtgggacccccaggtgtggatggatgctggcacccagatcttcttctcctttgccatctgcctgggctgcctgacagccctgggcagctacaacaagtaccacaacaactgctacagagactgcatcgccctgtgcttcctgaacagcggcaccagctttgtggccggctttgccatcttcagcatcctgggcttcatgagccaggagcagggcgtgcccatcagcgaggtggccgagagcggccctggcctggccttcatcgcctaccccagggctgtggtgatgctgcccttcagccccctgtgggcctgctgcttcttcttcatggtggtgctgctgggcctggacagccagtttgtgtgtgtggagagcctggtgacagccctggtggacatgtacccccacgtgttcaggaagaagaacagaagagaggtgctgatcctgggcgtgtctgtggtgtccttcctggtgggcctcatcatgctgacagagggcggcatgtatgtgttccagctgtttgactactatgctgccagcggcatgtgcctgctgtttgtggccatctttgagagcctgtgtgtggcctgggtgtatggagccaagcgcttctatgacaacatcgaggacatgattggctaccggccctggcccctcatcaagtactgctggctgttcctgaccccagctgtgtgcacagccaccttcctgttcagcctcatcaagtacacccccctgacctacaacaagaagtacacctacccctggtggggagatgccctgggctggctgctggccctgagctccatggtgtgcatcccagcctggagcctgtaccgcctgggcaccctgaagggccccttccgggagcgcatccggcagctgatgtgcccagctgaggacctgccccagagaaatcctgctggccccagcgccccagccacccccaggaccagcctgctgcggctgacagagctggagagccactgctag

SEQ ID NO: 38406 - DNA, 2193 bp, Artificial Sequence
  Description of Artificial Sequence: Synthetic coding sequence
atgcccaagaacagcaaggtggtgaagcgggagctggatgatgatgtgacagaatctgtgaaggacctgctgagcaatgaagatgctgctgatgatgccttcaagaccagcgagctgattgtggatggccaggaggagaaggacacagatgtggaggagggcagcgaggtggaggatgagaggcctgcctggaacagcaagctgcagtacatcctggcccaggtgggcttctctgtgggcctgggcaatgtgtggaggttcccctacctgtgccagaagaatggaggaggagcctacctgctgccctacctgatcctgctgatggtgattggcatccccctcttcttcctggagctgtctgtgggccagaggatccggcggggcagcattggagtgtggaactacatcagccccaagctgggcggcattggatttgccagctgtgtggtgtgctactttgtggccctgtactacaacgtcatcatcggctggagcctcttctacttcagccagagcttccagcagcccctgccctgggaccagtgccccctggtgaagaatgccagccacacctttgtggagccagaatgtgagcagagcagcgccaccacctactactggtaccgggaggccctgaacatcagcagcagcatcagcgagagcggcggcctgaactggaagatgaccatctgcctgctggccgcctgggtgatggtgtgcctggccatgatcaagggcatccagagcagcggcaagatcatctacttcagcagcctcttcccctacgtggtgctgatctgcttcctgatccgggccttcctgctgaatggcagcattgatggcatccgccacatgttcacccccaagctggagatcatgctggagcccaaggtgtggagggaggccgccacccaggtgttctttgccctgggcctgggctttggaggagtcatcgccttcagcagctacaacaagagggacaacaactgccactttgatgctgtgctggtgtccttcatcaacttcttcacctctgtgctggccaccctggtggtgtttgctgtgctgggcttcaaggccaacgtcatcaatgagaagtgcatcacccagaacagcgagaccatcatgaagttcctgaagatgggcaacatcagccaggacatcatcccccaccacatcaacctgagcacagtgacagctgaggactaccacctggtgtatgacatcatccagaaggtgaaggaggaggagttccctgccctgcacctgaacagctgcaagattgaggaggagctgaacaaggctgtgcagggcaccggcctggccttcatcgccttcacagaggccatgacccacttccctgccagccccttctggagcgtgatgttcttcctgatgctggtgaacctgggcctgggctccatgtttggcaccatcgagggcatcgtgacccccatcgtggacaccttcaaggtgaggaaggagatcctgaccgtcatctgctgcctgctggccttctgcatcggcctcatctttgtgcagaggagcggcaactactttgtgaccatgtttgatgactacagcgccaccctgcccctgctgattgtggtgatcctggagaacattgctgtgtgctttgtgtatggcatcgacaagttcatggaggacctgaaggacatgctgggctttgcccccagccgctactactactacatgtggaagtacatcagccccctgatgctgctgagcctgctgattgcctctgtggtgaacatgggcctgagccccccaggctacaatgcctggattgaggacaaggccagcgaggagttcctgagctaccccacctggggcctggtggtgtgtgtgtccctggtggtgtttgccatcctgcctgtgcctgtggtgttcatcgtgcggcgcttcaacctgattgatgacagcagcggcaacctggcctctgtgacctacaagaggggccgggtgctgaaggagcctgtgaacctggagggagatgacaccagcctcatccacggcaagatccccagcgagatgcccagccccaactttgggaagaacatctacaggaagcagagcggcagccccaccctggacacagccccaaatggccgctatggcatcggctacctgatggctgacatcatgccagacatgcctgagagtgacctgtag

SEQ ID NO: 38407 - DNA, 750 bp, Artificial Sequence
  Description of Artificial Sequence: Synthetic coding sequence
atgttcacccccaagctggagatcatgctggagcccaaggtgtggagggaggccgccacccaggtgttctttgccctgggcctgggctttggaggagtcatcgccttcagcagctacaacaagagggacaacaactgccactttgatgctgtgctggtgtccttcatcaacttcttcacctctgtgctggccaccctggtggtgtttgctgtgctgggcttcaaggccaacgtcatcaatgagaagtgcatcacccagaacagcgagaccatcatgaagttcctgaagatgggcaacatcagccaggacatcatcccccaccacatcaacctgagcacagtgacagctgaggactaccacctggtgtatgacatcatccagaaggtgaaggaggaggagttccctgccctgcacctgaacagctgcaagattgaggaggagctgaacaaggctgtgcagggcaccggcctggccttcatcgccttcacagaggccatgacccacttccctgccagccccttctggagcgtgatgttcttcctgatgctggtgaacctgggcctgggctccatgtttggcaccatcgagggcatcgtgacccccatcgtggacaccttcaaggtgaggaaggagatcctgaccgtcatctgctgcctgctggccttctgcatcggcctcatcctgtgcaatgccctggagatcaccctgctgcagtgcctgatgatcatcctgctgcactgcctgtgctag

SEQ ID NO: 38408 - DNA, 870 bp, Artificial Sequence
  Description of Artificial Sequence: Synthetic coding sequence
atgcccaagaacagcaaggtggtgaagcgggagctggatgatgatgtgacagaatctgtgaaggacctgctgagcaatgaagatgctgctgatgatgccttcaagaccagcgagctgattgtggatggccaggaggagaaggacacagatgtggaggagggcagcgaggtggaggatgagaggcctgcctggaacagcaagctgcagtacatcctggcccaggtgggcttctctgtgggcctgggcaatgtgtggaggttcccctacctgtgccagaagaatggaggaggagcctacctgctgccctacctgatcctgctgatggtgattggcatccccctcttcttcctggagctgtctgtgggccagaggatccggcggggcagcattggagtgtggaactacatcagccccaagctgggcggcattggatttgccagctgtgtggtgtgctactttgtggccctgtactacaacgtcatcatcggctggagcctcttctacttcagccagagcttccagcagcccctgccctgggaccagtgccccctggtgaagaatgccagccacacctttgtggagccagaatgtgagcagagcagcgccaccacctactactggtaccgggaggccctgaacatcagcagcagcatcagcgagagcggcggcctgaactggaagatgaccatctgcctgctggccgcctgggtgatggtgtgcctggccatgatcaagggcatccagagcagcggcaaggtgtccatgctggagcccttcctgatcctgctgatcaccatcagcggcttcatccccctgagcaacagcgtgacagacttctgtggccagatcacccacaacaccagcttctag

SEQ ID NO: 38409 - DNA, 291 bp, Artificial Sequence
  Description of Artificial Sequence: Synthetic coding sequence
atgcccaagaacagcaaggtggtgaagcgggagctggatgatgatgtgacagaatctgtgaaggacctgctgagcaatgaagatgctgctgatgatgccttcaagaccagcgagctgattgtggatggccaggaggagaaggacacagatgtggaggagggcagcgaggtggaggatgagaggcctgcctggaacagcaagctgcagtacatcctggcccaggtgggcttctctgtgggcctgggcaatgtgtggaggttcccctacctgtgccagaagaatggaggatag

SEQ ID NO: 38410 - DNA, 1872 bp, Artificial Sequence
  Description of Artificial Sequence: Synthetic coding sequence
atggtgattggcatccccctcttcttcctggagctgtctgtgggccagaggatcagaagaggcagcattggagtgtggaactacatcagccccaagctgggcggcatcggctttgccagctgtgtggtgtgctactttgtggccctgtactacaacgtcatcatcggctggagcctcttctacttcagccagagcttccagcagcccctgccctgggaccagtgccccctggtgaagaatgccagccacacctttgtggagccagaatgtgagcagagcagcgccaccacctactactggtaccgggaggccctgaacatcagcagcagcatcagcgagagcggcggcctgaactggaagatgaccatctgcctgctggccgcctgggtgatggtgtgcctggccatgatcaagggcatccagagcagcggcaagatcatctacttcagcagcctcttcccctacgtggtgctgatctgcttcctgatccgggccttcctgctgaatggcagcattgatggcatccgccacatgttcacccccaagctggagatcatgctggagcccaaggtgtggagggaggccgccacccaggtgttctttgccctgggcctgggctttggaggagtgattgccttcagcagctacaacaagagggacaacaactgccactttgatgctgtgctggtgtccttcatcaacttcttcacctctgtgctggccaccctggtggtgtttgctgtgctgggcttcaaggccaacgtcatcaatgagaagtgcatcacccagaacagcgagaccatcatgaagttcctgaagatgggcaacatcagccaggacatcatcccccaccacatcaacctgagcacagtgacagctgaggactaccacctggtgtatgacatcatccagaaggtgaaggaggaggagttccctgccctgcacctgaacagctgcaagattgaggaggagctgaacaaggctgtgcagggcaccggcctggccttcatcgccttcacagaggccatgacccacttccctgccagccccttctggagcgtgatgttcttcctgatgctggtgaacctgggcctgggctccatgtttggcaccatcgagggcatcgtgacccccatcgtggacaccttcaaggtgaggaaggagatcctgaccgtcatctgctgcctgctggccttctgcatcggcctcatctttgtgcagaggagcggcaactactttgtgaccatgtttgatgactacagcgccaccctgcccctgctgattgtggtgatcctggagaacattgctgtgtgctttgtgtatggaattgacaagttcatggaggacctgaaggacatgctgggctttgcccccagccgctactactactacatgtggaagtacatcagccccctgatgctgctgagcctgctgattgcctctgtggtgaacatgggcctgagccccccaggctacaatgcctggattgaggacaaggccagcgaggagttcctgagctaccccacctggggcctggtggtgtgtgtgtccctggtggtgtttgccatcctgcctgtgcctgtggtgttcatcgtgcggcgcttcaacctgattgatgacagcagcggcaacctggcctctgtgacctacaagaggggccgggtgctgaaggagcctgtgaacctggagggagatgacaccagcctcatccacggcaagatccccagcgagatgcccagccccaactttgggaagaacatctacaggaagcagagcggcagccccaccctggacacagcccccaacggccgctatggaattggctacctgatggctgacatcatgccagacatgcctgagagtgacctgtag

SEQ ID NO: 38411 - DNA, 2211 bp, Artificial Sequence
  Description of Artificial Sequence: Synthetic coding sequence
atgaagacagaggcccagcccagcaccagcctgctggccaacacctcctggacaggcaccgtcatcagtgacagcgtgcccggcagccagacctgggaggacaagggcagcctgaccaggtctgccacctcctggaccagcgaggcccaggtgtctgctgcccgggtggccgaggcccaggcccggaccagccagcccaagcagatctctgtgctggaggccctgacagccagcgccctgaaccagaagcccacccatgagaaggtgcagatgacagagaagaaggagagcgaggtgctgctggcccggcccttctggagcagcaagacagagtacatcctggcccaggtgggcttctccatgaagcccagctgcctgtggaggtttgcctacctgtggctgaacagcggcggctgcagctttgctgccatctacatcttcatgctgttcctggtgggcgtgcccctgctcttcctggagatggctgctggccagagcatgaggcagggcggcatgggcgtgtggaagatcatcgccccctggattggaggagtgggctacagcagcttcatggtgtgcttcatcctgggcctgtacttcaacgtggtgaacagctggatcatcttctacatgagccagagcttccagtttcctgtgccctgggagaagtgccccctgaccatgaacagcagcggctttgatcctgaatgtgagaggaccacccccagcatctacttctggtaccagcaggccctgaaggccagtgacagaattgaagatggcggcagccctgtgtacagcctggtgctgcccttcttcctgtgctggtgcctggtgggcgccttcatgatcaatggcctgaagagcacaggcaaggtgatctacgtgctggtgctgctgccctgcttcatcatcgtgggcttcttcatccgcaccctgctgctggagggcgccaagtttggcctgcagcagctggtggtggccaagatcagtgatgtgtacaacatgtctgtgtggagcctggccggcggccaggtgctgagcaacacaggcatcggcctgggctctgtggccagcctggccagctacatgccccagagcaacaactgcctgagtgatgccttcctggtgtctgtcatcaacctgctgaccctgctggtgttcaccagcttcaacttctgtgtgctgggcttctgggccaccgtcatcacccaccgctgctgtgaaagaaatgctgagatcctgctgaagctgatcaacctgggcaagctgcccccagatgccaagccccctgtgaacctgctgtacaaccccaccagcatctacaatgcctggctgagcggcctgccccagcacatcaagtccatggtgctgcgggaggtgacagagtgcaacatcgagacccagttcctgaaggccagcgagggccccaagtttgccttcctgagctttgtggaggccatgtccttcctgccccccagcgtcttctggagcttcatcttcttcctgatgctgctggccatgggcctgagcagcgccatcggcatcatgcagggcatcatcacccccctgcaggacaccttctccttcttcaggaagcacaccaagctgctgattgtgggcgtcttcctgctgatgtttgtgtgtggcctcttcttcacccggcccagcggcagctacttcatccggctgctgagtgactactggatcgtgttccccatcatcgtggtggtggtgtttgagaccatggctgtgtcctgggcctatggagcccggcgcttcctggccgacctgaccatcctgctgggccaccccatcagccccatcttcggctggctgtggccccacctgtgccctgtggtgctgctgatcatctttgtgaccatgatggtgcacctgtgcatgaagcccatcacctacatgtcctgggacagcagcaccagcaaggaggtgctgcggccctacccaccctgggccctgctgctgatgatcaccctgtttgccatcgtcatcctgcccatcccagcctactttgtgtactgccgcatccaccgcatccccttccggcccaagtctggagatggccccatgacagccagcaccagcctgcccctgagccaccagctgacccccagcaaggaggtgcagaaggaggagatcctgcaggtggatgagaccaagtaccccagcacctgcaatgtgaccagctag

SEQ ID NO: 38412 - DNA, 1980 bp, Artificial Sequence
  Description of Artificial Sequence: Synthetic coding sequence
atgaagacagaggcccagcccagcaccagcctgctggccaacacctcctggacaggcaccgtcatcagtgacagcgtgcccggcagccagacctgggaggacaagggcagcctgaccaggtctgccacctcctggaccagcgaggcccaggtgtctgctgcccgggtggccgaggcccaggcccggaccagccagcccaagcagatctctgtgctggaggccctgacagccagcgccctgaaccagaagcccacccatgagaaggtgcagatgacagagaagaaggagagcgaggtgctgctggcccggcccttctggagcagcaagacagagtacatcctggcccaggtgggcttctccatgaagcccagctgcctgtggaggtttgcctacctgtggctgaacagcggcggctgcagctttgctgccatctacatcttcatgctgttcctggtgggcgtgcccctgctcttcctggagatggctgctggccagagcatgaggcagggcggcatgggcgtgtggaagatcatcgccccctggattggaggagtgggctacagcagcttcatggtgtgcttcatcctgggcctgtacttcaacgtggtgaacagctggatcatcttctacatgagccagagcttccagtttcctgtgccctgggagaagtgccccctgaccatgaacagcagcggctttgatcctgaatgtgagaggaccacccccagcatctacttctggtaccagcaggccctgaaggccagtgacagaattgaagatggcggcagccctgtgtacagcctggtgctgcccttcttcctgtgctggtgcctggtgggcgccttcatgatcaatggcctgaagagcacaggcaaggtgatctacgtgctggtgctgctgccctgcttcatcatcgtgggcttcttcatccgcaccctgctgctggagggcgccaagtttggcctgcagcagctggtggtggccaagatcagtgatgtgtacaacatgtctgtgtggagcctggccggcggccaggtgctgagcaacacaggcatcggcctgggctctgtggccagcctggccagctacatgccccagagcaacaactgcctgagtgatgccttcctggtgtctgtcatcaacctgctgaccctgctggtgttcaccagcttcaacttctgtgtgctgggcttctgggccaccgtcatcacccaccgctgctgtgaaagaaatgctgagatcctgctgaagctgatcaacctgggcaagctgcccccagatgccaagccccctgtgaacctgctgtacaaccccaccagcatctacaatgcctggctgagcggcctgccccagcacatcaagtccatggtgctgcgggaggtgacagagtgcaacatcgagacccagttcctgaaggccagcgagggccccaagtttgccttcctgagctttgtggaggccatgtccttcctgccccccagcgtcttctggagcttcatcttcttcctgatgctgctggccatgggcctgagcagcgccatcggcatcatgcagggcatcatcacccccctgcaggacaccttctccttcttcaggaagcacaccaagctgctgattgtgggcgtcttcctgctgatgtttgtgtgtggcctcttcttcacccggcccagcggcagctacttcatccggctgctgagtgactactggatcgtgttccccatcatcgtggtggtggtgtttgagaccatggctgtgtcctgggcctatggagcccggcgcttcctggccgacctgaccatcctgctgggccaccccatcagccccatcttcggctggctgtggccccacctgtgccctgtggtgctgctgatcatctttgtgaccatgatggtgcacctgtgcatgaagcccatcacctacatgtcctgggacagcagcacagtgtccctgccccaggaccctgagcccctgtgggagtag

SEQ ID NO: 38413 - DNA, 2184 bp, Artificial Sequence
  Description of Artificial Sequence: Synthetic coding sequence
atgcccaagaacagcaaggtgacccagcgggagcacagcagcgagcacgtgacagagagcgtggccgacctgctggccctggaggagcctgtggactacaagcagagcgtgctgaatgtggccggggaggccggcggcaagcagaaggctgtggaggaggagctggatgctgaggacaggcctgcctggaacagcaagctgcagtacatcctggcccagatcggcttctctgtgggcctgggcaacatctggaggttcccctacctgtgccagaagaatggaggaggagcctacctggtgccctacctggtgctgctgatcatcatcggcatccccctcttcttcctggagctggccgtgggccagaggatcagaagaggcagcattggagtgtggcactacatctgcccccggctgggcggcatcggcttcagcagctgcatcgtgtgcctgtttgtgggcctgtactacaacgtcatcatcggctggagcatcttctacttcttcaagagcttccagtaccccctgccctggagcgagtgccctgtggtgagaaatggatctgtggccgtggtggaggctgaatgtgagaagagcagcgccaccacctacttctggtaccgggaggccctggacatcagtgacagcatcagcgagagcggcggcctgaactggaagatgaccctgtgcctgctggtggcctggagcatcgtgggcatggctgtggtgaagggcatccagagcagcggcaaggtgatgtacttcagcagcctcttcccctacgtggtgctggcctgcttcctggtgcggggcctgctgctgcggggagctgtggatggcatcctgcacatgttcacccccaagctggacaagatgctggacccccaggtgtggagggaggccgccacccaggtgttctttgccctgggcctgggctttggaggagtgattgccttcagcagctacaacaagcaggacaacaactgccactttgatgctgccctggtgtccttcatcaacttcttcacctctgtgctggccaccctggtggtgtttgctgtgctgggcttcaaggccaacatcatgaatgaaaaatgtgtggtggagaatgctgagaagatcctgggctacctgaacaccaacgtgctgagccgggacctgatcccccctcatgtgaacttcagccacctgaccaccaaggactacatggagatgtacaacgtcatcatgacagtgaaggaggaccagttcagcgccctgggcctggacccctgcctgctggaggatgagctggacaagtctgtgcagggcaccggcctggccttcatcgccttcacagaggccatgacccacttccctgccagccccttctggagcgtgatgttcttcctgatgctgatcaacctgggcctgggctccatgattggcaccatggccggcatcaccacccccatcatcgacaccttcaaggtgcccaaggagatgttcaccgtgggctgctgcgtgtttgccttcctggtgggcctgctgtttgtgcagaggagcggcaactactttgtgaccatgtttgatgactacagcgccaccctgcccctgaccctgattgtcatcctggagaacattgctgtggcctggatctacggcaccaagaagttcatgcaggagctgacagagatgctgggcttccggccctaccgcttctacttctacatgtggaagtttgtgagccccctgtgcatggctgtgctgaccacagccagcatcatccagctgggcgtgaccccacctggctacagcgcctggatcaaggaggaggccgctgagcgctacctgtacttccccaactgggccatggccctgctgatcaccctgattgtggtggccaccctgcccatccctgtggtgtttgtgctgcggcacttccacctgctgagtgatggcagcaacaccctgtctgtgtcctacaagaagggccgcatgatgaaggacatcagcaacctggaggagaatgatgagacccgcttcatcctgagcaaggtgcccagcgaggcccccagccccatgcccacccacaggagctacctgggccctggcagcaccagccccctggagaccagcggcaaccccaacggccgctatggcagcggctacctgctggccagcaccccagagagcgagctgtag

SEQ ID NO: 38414 - DNA, 2184 bp, Artificial Sequence; identical to SEQ ID NO: 38413
  Description of Artificial Sequence: Synthetic coding sequence

SEQ ID NO: 38415 - DNA, 1506 bp, Artificial Sequence
  Description of Artificial Sequence: Synthetic coding sequence
atggtgaggaagcctgtggtgtccaccatcagcaagggcggctacctgcagggcaatgtgaatggccgcctgcccagcctgggcaacaaggagcccccaggccaggagaaggtgcagctgaagaggaaggtgaccctgctgcggggcgtgtccatcatcatcggcaccatcatcggggccggcatcttcatcagccccaagggcgtgctgcagaacacaggctctgtgggcatgagcctgaccatctggacagtgtgtggggtgctgagcctgtttggagccctgtcctatgcagagctgggcaccaccatcaagaagagcggcggccactacacctacatcctggaggtgtttggccccctgcctgcctttgtgcgggtgtgggtggagctgctgatcatccggcctgctgccacagctgtgatcagcctggccttcggccgctacatcctggagcccttcttcatccagtgtgagatccctgagctggccatcaagctgatcacagctgtgggcatcaccgtggtgatggtgctgaacagcatgtctgtgtcctggagcgcccgcatccagatcttcctgaccttctgcaagctgacagccatcctgatcatcatcgtgcctggggtgatgcagctgatcaagggccagacccagaacttcaaggatgccttcagcggccgggacagcagcatcacccggctgcccctggccttctactacggcatgtatgcctatgccggctggttctacctgaactttgtgacagaggaggtggagaaccctgagaagaccatccccctggccatctgcatctccatggccatcgtgaccatcggctacgtgctgaccaacgtggcctacttcaccaccatcaatgctgaggagctgctgctgagcaatgctgtggccgtgaccttcagcgagcggctgctgggcaacttcagcctggccgtgcccatctttgtggccctgagctgcttcggctccatgaatggaggagtgtttgctgtgagccgcctcttctacgtggccagccgggagggccacctgcctgagatcctgtccatgattcatgtgaggaagcacacccccctgcctgctgtgattgtgctgcaccccctgaccatgatcatgctgttcagcggggacctggacagcctgctgaacttcctgagctttgcccgctggctgttcatcggcctggccgtggccggcctcatctacctgcgctacaagtgcccagacatgcaccggcccttcaaggtgcccctcttcatcccagccctcttctccttcacctgcctcttcatggtggccctgagcctgtacagcgaccccttcagcacaggcatcggcttcgtcatcaccctgactggagtgcctgcctactacctgttcatcatctgggacaagaagccccgctggttccgcatcatgtctgagaagatcaccaggaccctgcagatcatcctggaggtggtgcctgaggaggacaagctgtag

SEQ ID NO: 38416 - DNA, 1413 bp, Artificial Sequence
  Description of Artificial Sequence: Synthetic coding sequence
atggacagaggagagaagatccagctgaagagggtgtttggctactggtggggcaccagcttcctgctgatcaacatcattggagctggcatctttgtgagccccaagggcgtgctggcctacagctgcatgaatgtgggcgtgtccctgtgtgtgtgggccggctgtgccatcctggccatgaccagcaccctgtgcagcgctgagatcagcatctccttcccctgcagcggggcccagtactacttcctgaagcgctacttcggcagcacagtggccttcctgaacctgtggaccagcctcttcctgggcagcggcgtggtggccggccaggccctgctgctggccgagtacagcatccagcccttcttccccagctgcagcgtgcccaagctgcccaagaagtgcctggccctggccatgctgtggatcgtgggcatcctgaccagccggggcgtgaaggaggtgacctggctgcagatcgccagctctgtgctgaaggtgtccatcctgtccttcatcagcctgactggagtggtgttcctgatccggggcaagaaggaaaatgtggagcgcttccagaatgcctttgatgctgagctgcctgacatcagccacctgatccaggccatcttccagggctactttgcctacagcggcggggcctgcttcaccctgattgctggggagctgaagaagcccaggaccaccatccccaagtgcatcttcaccgccctgcccctggtgacagtggtgtacctgctggtgaacatctcctacctgactgtgctgaccccccgggagatcctgagcagtgatgctgtggccatcacctgggccgaccgggccttccccagcctggcctggatcatgccctttgccatcagcaccagcctcttcagcaacctgctgatcagcatcttcaagagcagccggcccatctacctggccagccaggagggccagctgcccctgctcttcaacaccctgaacagccacagcagccccttcaccgctgtgctgctgctggtgaccctgggcagcctggccatcatcctgaccagcctgattgacctgatcaactacatcttcttcaccggcagcctgtggagcatcctgctgatgattggcatcctgcggcggcgctaccaggagcccaacctgagcatcccctacaaggtgttcctgtccttccccctggccaccatcgtgattgatgtgggcctggtggtgatccccctggtgaagagccccaacgtgcactacgtgtatgtgctgctgctggtgctgagcggcctgctcttctacatccccctcatccacttcaagatccggctggcctggtttgagaagatgacctgctacctgcagctgctcttcaacatctgcctgcctgatgtgtctgaggagtag

SEQ ID NO: 38417 - DNA, 1302 bp, Artificial Sequence
  Description of Artificial Sequence: Synthetic coding sequence
atggacagaggagagaagatccagctgaagagggtgtttggctactggtggggcaccagcttcctgctgatcaacatcattggagctggcatctttgtgagccccaagggcgtgctggcctacagctgcatgaatgtgggcgtgtccctgtgtgtgtgggccggctgtgccatcctggccatgaccagcaccctgtgcagcgctgagatcagcatctccttcccctgcagcggggcccagtactacttcctgaagcgctacttcggcagcacagtggccttcctgaacctgtggaccagcctcttcctgggcagcggcgtggtggccggccaggccctgctgctggccgagtacagcatccagcccttcttccccagctgcagcgtgcccaagctgcccaagaagtgcctggccctggccatgctgtggatcgtgggcatcctgaccagccggggcgtgaaggaggtgacctggctgcagatcgccagctctgtgctgaaggtgtccatcctgtccttcatcagcctgactggagtggtgttcctgatccggggcaagaaggaaaatgtggagcgcttccagaatgcctttgatgctgagctgcctgacatcagccacctgatccaggccatcttccagggctactttgcctacagcggggagctgaagaagcccaggaccaccatccccaagtgcatcttcaccgccctgcccctggtgacagtggtgtacctgctggtgaacatctcctacctgactgtgctgaccccccgggagatcctgagcagtgatgctgtggccatcacctgggccgaccgggccttccccagcctggcctggatcatgccctttgccatcagcaccagcctcttcagcaacctgctgatcagcatcttcaagagcagccggcccatctacctggccagccaggagggccagctgcccctgctcttcaacaccctgaacagccacagcagccccttcaccgctgtgctgctgctggtgaccctgggcagcctggccatcatcctgaccagcctgattgacctgatcaactacatcttcttcaccggcagcctgtggagcatcctgctgatgattggcatcctgcggcggcgctaccaggagcccaacctgagcatcccctacaagagcctcatcctggtggtgcaggccggggaggccggcgtgcagtggcatgacctgggcctgctgcagcccctgctgcccggcttcaagcgcttcagctgcctgagcctgcccagctcctgggactaccgctgcttctgccacttccactag

SEQ ID NO: 38418 - DNA, 1860 bp, Artificial Sequence
  Description of Artificial Sequence: Synthetic coding sequence
atgccctggcaggccttcagaagatttggccagaagctggtgagaagaaggaccctggagagcggcatggccgagacccggctggcccgctgcctgagcaccctggacctggtggccctgggcgtgggcagcaccctgggcgctggggtgtatgtgctggccggggaggtggccaaggacaaggccggccccagcatcgtcatctgcttcctggtggccgccctgagctctgtgctggccggcctgtgctacgccgagtttggagcccgggtgcccaggagcggcagcgcctacctgtacagctatgtgacagtgggggagctgtgggccttcaccaccggctggaacctgatcctgtcctatgtgattggaacagcctctgtggcccgggcctggagcagcgcctttgacaacctgattggcaaccacatcagcaagaccctgcagggcagcatcgccctgcacgtgccccacgtgctggccgagtacccagacttctttgccctgggcctggtgctgctgctgaccggcctgctggccctgggcgccagcgagagcgccctggtgaccaaggtgttcaccggggtgaacctgctggtgctgggctttgtgatgatcagcggctttgtgaagggagatgtgcacaactggaagctgacagaggaggactatgagctggccatggccgagctgaatgacacctacagcctgggccccctgggcagcggcggctttgtgcccttcggctttgagggcatcctgcggggagctgccacctgcttctacgcctttgtgggctttgactgcatcgccaccactggagaggaggcccagaacccccagaggagcatccccatgggcatcgtcatcagcctgtctgtgtgcttcctggcctactttgctgtgagcagcgccctgaccctgatgatgccctactaccagctgcagcctgagagccccctgcctgaggccttcctgtacatcggctgggccccagcccgctacgtggtggccgtgggcagcctgtgtgccctgagcaccagcctgctgggctccatgttccccatgcccagggtcatctatgccatggctgaagatggcctgctcttccgggtgctggcccgcatccacacaggcaccaggacccccatcatcgccaccgtggtgtctggcatcatcgccgccttcatggccttcctgttcaagctgacagacctggtggacctgatgagcatcggcaccctgctggcctacagcctggtgtccatctgtgtgctgatcctgcgctaccagcctgaccaggagaccaagacaggagaggaggtggagctgcaggaggaggccatcaccacagaaagtgagaagctgaccctgtggggcctcttcttccccctgaacagcatccccacccccctgagcggccagatcgtgtatgtgtgcagcagcctgctggccgtgctgctgacagccctgtgcctggtgctggcccagtggagcgtgcccctgctgagcggggacctgctgtggacagctgtggtggtgctgctgctgctgctgatcatcggcatcatcgtggtgatctggaggcagccccagagcagcacccccctgcacttcaaggtgcctgccctgcccctgctgcccctgatgagcatctttgtgaacatctacctgatgatgcagatgacagctggcacctgggcccgcttcggcgtgtggatgctgattggatttgccatctacttcggctacggcatccagcacagcctggaggagatcaagagcaaccagcccagcaggaagagccgggccaagacagtggacctggaccccggcaccctgtatgtgcacagcgtgtag

SEQ ID NO: 38419 - DNA, 1860 bp, Artificial Sequence; identical to SEQ ID NO: 38418
  Description of Artificial Sequence: Synthetic coding sequence

SEQ ID NO: 38420 - DNA, 1572 bp, Artificial Sequence
  Description of Artificial Sequence: Synthetic coding sequence
atggccggccacacccagcagcccagcggccggggcaaccccaggcctgcccccagccccagccctgtgcccggcaccgtgcctggggccagcgagcgggtggccctgaagaaggagatcggcctgctgagcgcctgcaccatcatcatcggcaacatcatcggcagcggcatcttcatcagccccaagggcgtgctggagcacagcggctctgtgggcctggccctgtttgtgtgggtgctgggcggcggcgtgacagccctgggcagcctgtgctacgccgagctgggcgtggccatccccaagtctggaggagactatgcctacgtgacagagatctttggaggcctggccggcttcctgctgctgtggagcgctgtgctgatcatgtaccccaccagcctggccgtcatctccatgaccttcagcaactacgtgctgcagcctgtgttccccaactgcatcccccccaccacagccagccgggtgctgtccatggcctgcctgatgctgctgacctgggtgaacagcagctctgtgcgctgggccacccgcatccaggacatgttcaccggcggcaagctgctggccctgagcctcatcatcggcgtgggcctgctgcagatcttccagggccactttgaggagctgcggcccagcaatgcctttgccttctggatgacccccagcgtgggccacctggccctggccttcctgcagggcagctttgccttcagcggctggaacttcctgaactacgtgacagaggagatggtggatgccaggaagaacctgccccgggccatcttcatcagcatccccctggtgacctttgtgtacaccttcaccaacatcgcctacttcaccgccatgagcccccaggagctgctgagcagcaatgctgtggccgtgaccttcggggagaagctgctgggctacttctcctgggtgatgcctgtgtctgtggccctgagcacctttggaggcatcaatggctacctgttcacctacagccggctgtgcttcagcggggcccgggagggccacctgcccagcctgctggccatgatccacgtgcgccactgcacccccatcccagccctgctggtgtgctgcggggccacagctgtgatcatgctggtgggggacacctacaccctcatcaactacgtgtccttcatcaactacctgtgctatggagtgaccatcctgggcctgctgctgctgcgctggaggaggcctgccctgcaccggcccatcaaggtgaacctgctgatccctgtggcctacctggtgttctgggccttcctgctggtgttctccttcatcagcgagcccatggtgtgtggggtgggcgtcatcatcatcctgactggagtgcccatcttcttcctgggcgtcttctggaggagcaagcccaagtgtgtgcaccggctgacagagagcatgacccactggggccaggagctgtgctttgtggtgtacccccaggatgcccctgaggaggaggagaatggcccctgcccccccagcctgctgcctgccacagacaagcccagcaagccccagtag

SEQ ID NO: 38421 - DNA, 1080 bp, Artificial Sequence
  Description of Artificial Sequence: Synthetic coding sequence
atggcccccaacggcacagccagcagcttctgcctggacagcacagcctgcaagatcaccatcaccgtggtgctggccgtgctgatcctgatcaccgtggccggaaatgtggtggtgtgcctggccgtgggcctgaacagaaggctgaggaacctgaccaactgcttcatcgtgtccctggccatcacagacctgctgctgggcctgctggtgctgcccttcagcgccatctaccagctgagctgcaagtggagctttgggaaggtgttctgcaacatctacaccagcctggatgtgatgctgtgcacagccagcatcctgaacctcttcatgatcagcctggaccgctactgtgctgtgatggaccccctgcgctaccctgtgctggtgacccctgtgcgggtggccatcagcctggtgctgatctgggtgatcagcatcaccctgtccttcctgagcatccacctgggctggaacagcagaaatgagaccagcaagggcaaccacaccaccagcaagtgcaaggtgcaggtgaatgaggtgtatggcctggtggatggcctggtgaccttctacctgcccctgctgatcatgtgcatcacctactaccgcatcttcaaggtggcccgggaccaggccaagaggatcaaccacatcagctcctggaaggccgccaccatccgggagcacaaggccaccgtgaccctggccgctgtgatgggcgccttcatcatctgctggttcccctacttcaccgcctttgtgtaccggggcctgcggggagatgatgccatcaatgaggtgctggaggccatcgtgctgtggctgggctacgccaacagcgccctgaaccccatcctgtatgctgccctgaacagagacttcagaacaggctaccagcagctgttctgctgccgcctggccaacagaaacagccacaagaccagcctgcggagcaatgccagccagctgagcaggacccagagccgggagccccggcagcaggaggagaagcccctgaagctgcaggtgtggagcggcacagaggtgacagccccccagggcgccacagacagatag

SEQ ID NO: 38422 - DNA, 1296 bp, Artificial Sequence
  Description of Artificial Sequence: Synthetic coding sequence
atgtctgtgaatgtgaacagatctgtgtctgaccagttctaccgctacaagatgcccaggctcatcgccaaggtggagggcaaaggaaatggcatcaagacagtcatcgtgaacatggtggatgtggccaaggccctgaacagaccacccacctaccccaccaagtacttcggctgtgagctgggcgcccagacccagtttgatgtgaagaatgaccgctacatcgtgaatggcagccatgaggccaacaagctgcaggacatgctggatggcttcatcaagaagtttgtgctgtgcccagaatgtgaaaatcctgagacagacctgcacgtgaaccccaagaagcagaccatcggcaacagctgcaaggcctgtggctaccggggcatgctggacacccaccacaagctgtgcaccttcatcctgaagaaccccccagaaaattctgattctggaacaggcaagaaggagaaggagaagaagaacaggaagggcaaggacaaggaaaatggatctgtgagcagcagcgagaccccacctcctcctcctcctccaaatgagatcaaccccccaccccacaccatggaggaggaggaggatgatgactggggcgaggacaccacagaggaggcccagaggaggaggatggatgagatcagtgaccacgccaaggtgctgaccctgagtgatgacctggagaggaccatcgaggagcgggtgaacatcctgtttgattttgtgaagaagaagaaggaggagggcgtcatcgacagcagtgacaaggagatcgtggccgaggccgagcggctggatgtgaaggccatgggccccctggtgctgacagaggtgctcttcaatgagaagatccgggagcagatcaagaagtacagaagacacttcctgcgcttctgccacaacaacaagaaggcccagcgctacctgctgcacggcctggagtgtgtggtggccatgcaccaggcccagctgatcagcaagatcccccacatcctgaaggagatgtatgatgctgacctgctggaggaggaggtgatcatctcctggagcgagaaggccagcaagaagtatgtgtccaaggagctggccaaggagatccgggtgaaggccgagcccttcatcaagtggctgaaggaggccgaggaggagagcagcggcggggaggaggaggatgaagatgaaaatattgaggtggtgtacagcaaggccgcctctgtgcccaaggtggagaccgtgaagagtgacaacaaggatgatgacatcgacattgatgccatctag

SEQ ID NO: 38423 - DNA, 2766 bp, Artificial Sequence
  Description of Artificial Sequence: Synthetic coding sequence
atggcctggctgcggctgcagcccctgaccagcgccttcctgcacttcggcctggtgacctttgtgctcttcctgaatggcctgcgggcagaggccggcggcagcggagatgtgcccagcacaggccagaacaatgaaagctgcagcggcagcagtgactgcaaggagggcgtcatcctgcccatctggtacccagagaaccccagcctgggggacaagatcgcccgggtcatcgtgtactttgtggccctgatctacatgttcctgggcgtgtccatcatcgctgaccgcttcatggccagcattgaggtgatcaccagccaggagcgggaggtgaccatcaagaagcccaacggggagaccagcaccaccaccatccgggtgtggaatgagaccgtgagcaacctgaccctgatggccctgggcagcagcgcccctgagatcctgctgagcctgattgaggtgtgtggccacggcttcatcgccggggacctgggccccagcaccatcgtgggcagcgctgccttcaacatgttcatcatcatcggcatctgtgtgtatgtgatcccagatggagagaccaggaagatcaagcacctgcgggtcttcttcatcacagctgcctggagcatctttgcctacatctggctgtacatgatcctggccgtgttcagccctggggtggtgcaggtgtgggagggcctgctgaccctcttcttcttccctgtgtgtgtgctgctggcctgggtggccgacaagaggctgctcttctacaagtacatgcacaagaagtacagaacagacaagcaccggggcatcatcattgaaacagaaggagaccaccccaagggcatcgagatggatggcaagatgatgaacagccacttcctggatggcaacctggtgcccctggagggcaaggaggtggatgagagcagaagagagatgatccgcatcctgaaggacctgaagcagaagcaccctgagaaggacctggaccagctggtggagatggccaactactatgccctgagccaccagcagaagagccgggccttctaccgcatccaggccaccaggatgatgactggagctggcaacatcctgaagaagcatgctgctgagcaggccaagaaggccagctccatgtctgaggtgcacacagatgagcctgaggacttcatcagcaaggtgttctttgacccctgcagctaccagtgcctggagaactgtggggctgtgctgctgactgtggtgaggaaaggaggagacatgagcaagaccatgtatgtggactacaagacagaagatggcagcgccaatgctggagctgactatgagttcacagagggcaccgtggtgctgaagccaggagagacccagaaggagttctctgtgggcatcattgatgatgacatctttgaggaggatgagcacttctttgtgcggctgagcaatgtgagaattgaggaggagcagcctgaggagggcatgcccccagccatcttcaacagcctgcccctgcccagggctgtgctggccagcccctgtgtggccaccgtgaccatcctggatgatgaccatgctggcatcttcacctttgaatgtgacaccatccacgtgtctgagagcattggagtgatggaggtgaaggtgctgcggaccagcggggcccggggcaccgtgattgtgcccttcagaacagtggagggcacagccaagggcggcggggaggactttgaggacacctacggggagctggagttcaagaatgatgagaccgtgaagaccatccgggtgaagatcgtggatgaggaggagtatgaaaggcaggagaacttcttcatcgccctgggggagcccaagtggatggagcggggcatcagtgatgtgacagacaggaagctgaccatggaggaggaggaggccaagagaattgctgagatgggcaagcctgtgctgggggagcaccccaagctggaggtgatcatcgaggagagctatgagttcaagaccaccgtggacaagctgatcaagaagaccaacctggccctggtggtgggcacccacagctggagggaccagttcatggaggccatcaccgtgtctgctgctggagatgaagatgaagatgaaagtggagaggagcggctgcccagctgctttgattatgtgatgcacttcctgaccgtcttctggaaggtgctgtttgcctgtgtgcccccaacagagtactgccacggctgggcctgctttgctgtgtccatcctgatcatcggcatgctgacagccatcatcggggacctggccagccacttcggctgcaccatcggcctgaaggacagcgtgacagctgtggtgtttgtggccttcggcacctctgtgcctgacacctttgccagcaaggccgccgccctgcaggatgtgtatgcagatgccagcattggaaatgtgacaggcagcaatgctgtgaatgtgttcctgggcatcggcctggcctggagcgtggccgccatctactgggccctgcagggccaggagttccacgtgtctgctggcaccctggccttctctgtgaccctcttcaccatctttgcctttgtgtgcatctctgtgctgctgtacagaagaagaccccacctgggcggggagctgggcggcccccggggctgcaagctggccaccacctggctgtttgtgtccctgtggctgctgtacatcctgtttgccaccctggaggcctactgctacatcaagggcttctag

SEQ ID NO: 38424 - DNA, 2778 bp, Artificial Sequence
  Description of Artificial Sequence: Synthetic coding sequence
atggcctggctgcggctgcagcccctgaccagcgccttcctgcacttcggcctggtgacctttgtgctcttcctgaatggcctgcgggcagaggccggcggcagcggagatgtgcccagcacaggccagaacaatgaaagctgcagcggcagcagtgactgcaaggagggcgtcatcctgcccatctggtacccagagaaccccagcctgggggacaagatcgcccgggtcatcgtgtactttgtggccctgatctacatgttcctgggcgtgtccatcatcgctgaccgcttcatggccagcattgaggtgatcaccagccaggagcgggaggtgaccatcaagaagcccaacggggagaccagcaccaccaccatccgggtgtggaatgagaccgtgagcaacctgaccctgatggccctgggcagcagcgcccctgagatcctgctgagcctgattgaggtgtgtggccacggcttcatcgccggggacctgggccccagcaccatcgtgggcagcgctgccttcaacatgttcatcatcatcggcatctgtgtgtatgtgatcccagatggagagaccaggaagatcaagcacctgcgggtcttcttcatcacagctgcctggagcatctttgcctacatctggctgtacatgatcctggccgtgttcagccctggggtggtgcaggtgtgggagggcctgctgaccctcttcttcttccctgtgtgtgtgctgctggcctgggtggccgacaagaggctgctcttctacaagtacatgcacaagaagtacagaacagacaagcaccggggcatcatcattgaaacagaaggagaccaccccaagggcatcgagatggatggcaagatgatgaacagccacttcctggatggcaacctggtgcccctggagggcaaggaggtggatgagagcagaagagagatgatccgcatcctgaaggacctgaagcagaagcaccctgagaaggacctggaccagctggtggagatggccaactactatgccctgagccaccagcagaagagccgggccttctaccgcatccaggccaccaggatgatgactggagctggcaacatcctgaagaagcatgctgctgagcaggccaagaaggccagctccatgtctgaggtgcacacagatgagcctgaggacttcatcagcaaggtgttctttgacccctgcagctaccagtgcctggagaactgtggggctgtgctgctgactgtggtgaggaaaggaggagacatgagcaagaccatgtatgtggactacaagacagaagatggcagcgccaatgctggagctgactatgagttcacagagggcaccgtggtgctgaagccaggagagacccagaaggagttctctgtgggcatcattgatgatgacatctttgaggaggatgagcacttctttgtgcggctgagcaatgtgagaattgaggaggagcagcctgaggagggcatgcccccagccatcttcaacagcctgcccctgcccagggctgtgctggccagcccctgtgtggccaccgtgaccatcctggatgatgaccatgctggcatcttcacctttgaatgtgacaccatccacgtgtctgagagcattggagtgatggaggtgaaggtgctgcggaccagcggggcccggggcaccgtgattgtgcccttcagaacagtggagggcacagccaagggcggcggggaggactttgaggacacctacggggagctggagttcaagaatgatgagaccgtgaagaccatccacatcaaggtgattgatgatgaggcctatgagaagaacaagaactacttcatcgagatgatgggccccaggatggtggacatgtccttccagaaggccctgctgctgagcccagacaggaagctgaccatggaggaggaggaggccaagagaattgctgagatgggcaagcctgtgctgggggagcaccccaagctggaggtgatcatcgaggagagctatgagttcaagaccaccgtggacaagctgatcaagaagaccaacctggccctggtggtgggcacccacagctggagggaccagttcatggaggccatcaccgtgtctgctgctggagatgaagatgaagatgaaagtggagaggagcggctgcccagctgctttgattatgtgatgcacttcctgaccgtcttctggaaggtgctgtttgcctgtgtgcccccaacagagtactgccacggctgggcctgctttgctgtgtccatcctgatcatcggcatgctgacagccatcatcggggacctggccagccacttcggctgcaccatcggcctgaaggacagcgtgacagctgtggtgtttgtggccttcggcacctctgtgcctgacacctttgccagcaaggccgccgccctgcaggatgtgtatgcagatgccagcattggaaatgtgacaggcagcaatgctgtgaatgtgttcctgggcatcggcctggcctggagcgtggccgccatctactgggccctgcagggccaggagttccacgtgtctgctggcaccctggccttctctgtgaccctcttcaccatctttgcctttgtgtgcatctctgtgctgctgtacagaagaagaccccacctgggcggggagctgggcggcccccggggctgcaagctggccaccacctggctgtttgtgtccctgtggctgctgtacatcctgtttgccaccctggaggcctactgctacatcaagggcttctag

SEQ ID NO: 38425 - DNA, 2784 bp, Artificial Sequence
  Description of Artificial Sequence: Synthetic coding sequence
atggcctggctgcggctgcagcccctgaccagcgccttcctgcacttcggcctggtgacctttgtgctcttcctgaatggcctgcgggcagaggccggcggcagcggagatgtgcccagcacaggccagaacaatgaaagctgcagcggcagcagtgactgcaaggagggcgtcatcctgcccatctggtacccagagaaccccagcctgggggacaagatcgcccgggtcatcgtgtactttgtggccctgatctacatgttcctgggcgtgtccatcatcgctgaccgcttcatggccagcattgaggtgatcaccagccaggagcgggaggtgaccatcaagaagcccaacggggagaccagcaccaccaccatccgggtgtggaatgagaccgtgagcaacctgaccctgatggccctgggcagcagcgcccctgagatcctgctgagcctgattgaggtgtgtggccacggcttcatcgccggggacctgggccccagcaccatcgtgggcagcgctgccttcaacatgttcatcatcatcggcatctgtgtgtatgtgatcccagatggagagaccaggaagatcaagcacctgcgggtcttcttcatcacagctgcctggagcatctttgcctacatctggctgtacatgatcctggccgtgttcagccctggggtggtgcaggtgtgggagggcctgctgaccctcttcttcttccctgtgtgtgtgctgctggcctgggtggccgacaagaggctgctcttctacaagtacatgcacaagaagtacagaacagacaagcaccggggcatcatcattgaaacagaaggagaccaccccaagggcatcgagatggatggcaagatgatgaacagccacttcctggatggcaacctggtgcccctggagggcaaggaggtggatgagagcagaagagagatgatccgcatcctgaaggacctgaagcagaagcaccctgagaaggacctggaccagctggtggagatggccaactactatgccctgagccaccagcagaagagccgggccttctaccgcatccaggccaccaggatgatgactggagctggcaacatcctgaagaagcatgctgctgagcaggccaagaaggccagctccatgtctgaggtgcacacagatgagcctgaggacttcatcagcaaggtgttctttgacccctgcagctaccagtgcctggagaactgtggggctgtgctgctgactgtggtgaggaaaggaggagacatgagcaagaccatgtatgtggactacaagacagaagatggcagcgccaatgctggagctgactatgagttcacagagggcaccgtggtgctgaagccaggagagacccagaaggagttctctgtgggcatcattgatgatgacatctttgaggaggatgagcacttctttgtgcggctgagcaatgtgagaattgaggaggagcagcctgaggagggcatgcccccagccatcttcaacagcctgcccctgcccagggctgtgctggccagcccctgtgtggccaccgtgaccatcctggatgatgaccatgctggcatcttcacctttgaatgtgacaccatccacgtgtctgagagcattggagtgatggaggtgaaggtgctgcggaccagcggggcccggggcaccgtgattgtgcccttcagaacagtggagggcacagccaagggcggcggggaggactttgaggacacctacggggagctggagttcaagaatgatgagaccgtgaagaccatccgggtgaagatcgtggatgaggaggagtatgaaaggcaggagaacttcttcatcgccctgggggagcccaagtggatggagcggggcatcagcgccctgctgctgagcccagatgtgacagacaggaagctgaccatggaggaggaggaggccaagagaattgctgagatgggcaagcctgtgctgggggagcaccccaagctggaggtgatcatcgaggagagctatgagttcaagaccaccgtggacaagctgatcaagaagaccaacctggccctggtggtgggcacccacagctggagggaccagttcatggaggccatcaccgtgtctgctgctggagatgaagatgaagatgaaagtggagaggagcggctgcccagctgctttgattatgtgatgcacttcctgaccgtcttctggaaggtgctgtttgcctgtgtgcccccaacagagtactgccacggctgggcctgctttgctgtgtccatcctgatcatcggcatgctgacagccatcatcggggacctggccagccacttcggctgcaccatcggcctgaaggacagcgtgacagctgtggtgtttgtggccttcggcacctctgtgcctgacacctttgccagcaaggccgccgccctgcaggatgtgtatgcagatgccagcattggaaatgtgacaggcagcaatgctgtgaatgtgttcctgggcatcggcctggcctggagcgtggccgccatctactgggccctgcagggccaggagttccacgtgtctgctggcaccctggccttctctgtgaccctcttcaccatctttgcctttgtgtgcatctctgtgctgctgtacagaagaagaccccacctgggcggggagctgggcggcccccggggctgcaagctggccaccacctggctgtttgtgtccctgtggctgctgtacatcctgtttgccaccctggaggcctactgctacatcaagggcttctag

SEQ ID NO: 38426 - DNA, 855 bp, Artificial Sequence
  Description of Artificial Sequence: Synthetic coding sequence
atggaggaggaggaggccaagagaattgctgagatgggcaagcctgtgctgggggagcaccccaagctggaggtgatcatcgaggagagctatgagttcaagaccaccgtggacaagctgatcaagaagaccaacctggccctggtggtgggcacccacagctggagggaccagttcatggaggccatcaccgtgtctgctgctggagatgaagatgaagatgagagcggggaggagcggctgcccagctgctttgattatgtgatgcacttcctgactgtgttctggaaggtgctgtttgcctgtgtgcccccaacagagtactgccacggctgggcctgctttgctgtgtccatcctgatcatcggcatgctgacagccatcattggagacctggccagccacttcggctgcaccatcggcctgaaggacagcgtgacagctgtggtgtttgtggccttcggcacctctgtgcctgacacctttgccagcaaggctgctgccctgcaggatgtgtatgcagatgccagcattggaaatgtgacaggcagcaatgctgtgaatgtgttcctgggcatcggcctggcctggagcgtggccgccatctactgggccctgcagggccaggagttccacgtgtctgctggcaccctggccttctctgtgaccctcttcaccatctttgcctttgtgtgcatctctgtgctgctgtacagaagaagaccccacctgggcggggagctgggcggcccccggggctgcaagctggccaccacctggctgtttgtgtccctgtggctgctgtacatcctgtttgccaccctggaggcctactgctacatcaagggcttctag

SEQ ID NO: 38427 - DNA, 1863 bp, Artificial Sequence
  Description of Artificial Sequence: Synthetic coding sequence
atggcctggctgcggctgcagcccctgaccagcgccttcctgcacttcggcctggtgacctttgtgctcttcctgaatggcctgcgggcagaggccggcggcagcggagatgtgcccagcacaggccagaacaatgaaagctgcagcggcagcagtgactgcaaggagggcgtcatcctgcccatctggtacccagagaaccccagcctgggggacaagatcgcccgggtcatcgtgtactttgtggccctgatctacatgttcctgggcgtgtccatcatcgctgaccgcttcatggccagcattgaggtgatcaccagccaggagcgggaggtgaccatcaagaagcccaacggggagaccagcaccaccaccatccgggtgtggaatgagaccgtgagcaacctgaccctgatggccctgggcagcagcgcccctgagatcctgctgagcctgattgaggtgtgtggccacggcttcatcgccggggacctgggccccagcaccatcgtgggcagcgctgccttcaacatgttcatcatcatcggcatctgtgtgtatgtgatcccagatggagagaccaggaagatcaagcacctgcgggtcttcttcatcacagctgcctggagcatctttgcctacatctggctgtacatgatcctggccgtgttcagccctggggtggtgcaggtgtgggagggcctgctgaccctcttcttcttccctgtgtgtgtgctgctggcctgggtggccgacaagaggctgctcttctacaagtacatgcacaagaagtacagaacagacaagcaccggggcatcatcattgaaacagaaggagaccaccccaagggcatcgagatggatggcaagatgatgaacagccacttcctggatggcaacctggtgcccctggagggcaaggaggtggatgagagcagaagagagatgatccgcatcctgaaggacctgaagcagaagcaccctgagaaggacctggaccagctggtggagatggccaactactatgccctgagccaccagcagaagagccgggccttctaccgcatccaggccaccaggatgatgactggagctggcaacatcctgaagaagcatgctgctgagcaggccaagaaggccagctccatgtctgaggtgcacacagatgagcctgaggacttcatcagcaaggtgttctttgacccctgcagctaccagtgcctggagaactgtggggctgtgctgctgactgtggtgaggaaaggaggagacatgagcaagaccatgtatgtggactacaagacagaagatggcagcgccaatgctggagctgactatgagttcacagagggcaccgtggtgctgaagccaggagagacccagaaggagttctctgtgggcatcattgatgatgacatctttgaggaggatgagcacttctttgtgcggctgagcaatgtgagaattgaggaggagcagcctgaggagggcatgcccccagccatcttcaacagcctgcccctgcccagggctgtgctggccagcccctgtgtggccaccgtgaccatcctggatgatgaccatgctggcatcttcacctttgaatgtgacaccatccacgtgtctgagagcattggagtgatggaggtgaaggtgctgcggaccagcggggcccggggcaccgtgattgtgcccttcagaacagtggagggcacagccaagggcggcggggaggactttgaggacacctacggggagctggagttcaagaatgatgagaccgtgtgtgaccggcaggaggccgactatggaagaagaggaggccaggaggacagcagagatggcaaggccagcattggatag

SEQ ID NO: 38428 - DNA, 2778 bp, Artificial Sequence; identical to SEQ ID NO: 38424
  Description of Artificial Sequence: Synthetic coding sequence

SEQ ID NO: 38429 - DNA, 2775 bp, Artificial Sequence
  Description of Artificial Sequence: Synthetic coding sequence
atggcctggctgcggctgcagcccctgaccagcgccttcctgcacttcggcctggtgacctttgtgctcttcctgaatggcctgcgggcagaggccggcggcagcggagatgtgcccagcacaggccagaacaatgaaagctgcagcggcagcagtgactgcaaggagggcgtcatcctgcccatctggtacccagagaaccccagcctgggggacaagatcgcccgggtcatcgtgtactttgtggccctgatctacatgttcctgggcgtgtccatcatcgctgaccgcttcatggccagcattgaggtgatcaccagccaggagcgggaggtgaccatcaagaagcccaacggggagaccagcaccaccaccatccgggtgtggaatgagaccgtgagcaacctgaccctgatggccctgggcagcagcgcccctgagatcctgctgagcctgattgaggtgtgtggccacggcttcatcgccggggacctgggccccagcaccatcgtgggcagcgctgccttcaacatgttcatcatcatcggcatctgtgtgtatgtgatcccagatggagagaccaggaagatcaagcacctgcgggtcttcttcatcacagctgcctggagcatctttgcctacatctggctgtacatgatcctggccgtgttcagccctggggtggtgcaggtgtgggagggcctgctgaccctcttcttcttccctgtgtgtgtgctgctggcctgggtggccgacaagaggctgctcttctacaagtacatgcacaagaagtacagaacagacaagcaccggggcatcatcattgaaacagaaggagaccaccccaagggcatcgagatggatggcaagatgatgaacagccacttcctggatggcaacctggtgcccctggagggcaaggaggtggatgagagcagaagagagatgatccgcatcctgaaggacctgaagcagaagcaccctgagaaggacctggaccagctggtggagatggccaactactatgccctgagccaccagcagaagagccgggccttctaccgcatccaggccaccaggatgatgactggagctggcaacatcctgaagaagcatgctgctgagcaggccaagaaggccagctccatgtctgaggtgcacacagatgagcctgaggacttcatcagcaaggtgttctttgacccctgcagctaccagtgcctggagaactgtggggctgtgctgctgactgtggtgaggaaaggaggagacatgagcaagaccatgtatgtggactacaagacagaagatggcagcgccaatgctggagctgactatgagttcacagagggcaccgtggtgctgaagccaggagagacccagaaggagttctctgtgggcatcattgatgatgacatctttgaggaggatgagcacttctttgtgcggctgagcaatgtgagaattgaggaggagcagcctgaggagggcatgcccccagccatcttcaacagcctgcccctgcccagggctgtgctggccagcccctgtgtggccaccgtgaccatcctggatgatgaccatgctggcatcttcacctttgaatgtgacaccatccacgtgtctgagagcattggagtgatggaggtgaaggtgctgcggaccagcggggcccggggcaccgtgattgtgcccttcagaacagtggagggcacagccaagggcggcggggaggactttgaggacacctacggggagctggagttcaagaatgatgagaccgtgaagaccatccgggtgaagatcgtggatgaggaggagtatgaaaggcaggagaacttcttcatcgccctgggggagcccaagtggatggagcggggcatcagcgccctgctgctgagcccagacaggaagctgaccatggaggaggaggaggccaagagaattgctgagatgggcaagcctgtgctgggggagcaccccaagctggaggtgatcatcgaggagagctatgagttcaagaccaccgtggacaagctgatcaagaagaccaacctggccctggtggtgggcacccacagctggagggaccagttcatggaggccatcaccgtgtctgctgctggagatgaagatgaagatgagagcggggaggagcggctgcccagctgctttgattatgtgatgcacttcctgactgtgttctggaaggtgctgtttgcctgtgtgcccccaacagagtactgccacggctgggcctgctttgctgtgtccatcctgatcatcggcatgctgacagccatcattggagacctggccagccacttcggctgcaccatcggcctgaaggacagcgtgacagctgtggtgtttgtggccttcggcacctctgtgcctgacacctttgccagcaaggctgctgccctgcaggatgtgtatgcagatgccagcattggaaatgtgacaggcagcaatgctgtgaatgtgttcctgggcatcggcctggcctggagcgtggccgccatctactgggccctgcagggccaggagttccacgtgtctgctggcaccctggccttctctgtgaccctcttcaccatctttgcctttgtgtgcatctctgtgctgctgtacagaagaagaccccacctgggcggggagctgggcggcccccggggctgcaagctggccaccacctggctgtttgtgtccctgtggctgctgtacatcctgtttgccaccctggaggcctactgctacatcaagggcttctag

SEQ ID NO: 38430 - DNA, 3375 bp, Artificial Sequence
  Description of Artificial Sequence: Synthetic coding sequence
atgagcagctacttctgggcccagaatgaaagcaacagaccagacctgctgtgtggccagcctgctgactacctggtggaggagaagcacttcaccaccctggtgtgcttcatcgtggtgctgggcggcctgctgaagatgtgcctgaagaactgtgaggtgattgtgctgaccatcctgagcctgagcggctttgtgattggccacatggcctacaacagcgtggaggtgcaccagatcgtgtaccccctgctgcggaccagcagcttcagcctgtacagctacttcagccccctcatcatcttcatggtggccctggatgtggagttctacaccctgaagaagatgttctggcaggtgctgctgaccggcctcatctccttcagcacagccagcatcatcatcggctacgtggtgatcaagttcaacaaggacagctgggacctgcagagctgcctgctcttcagcatcaccctgggcatcatcgaccccctgcggtctgtgaacagcctgaagaccatcggcatcagcaagatctacatcgacctgatccggggggagagcctcatcatctgcagcatcgccagcatcttctttggaaacttccggggcaaccgcatccacttcagcatcttccgggacctgcacgtgggcatcgagctgtcctatgacatcctgggcagcatcatcttcggctactggtgtgccaagatcatccagtgcatcctggctgatgtgttcagcaacatgctgaccaacatcatcctgtgcttctccatggtgtacatgaccttctacatcgtggagttcctgggcatgagcggcaccctggccctggccgctgtgggcctgaacctggacagcctgaccttcaagcccaagattgagctggtgatcaccaagttcctgcgcatcttcagctctgtgtatgagcacctgatctatgccttcttcggcatcgtcatcggctgtggggagctgagccactatgagttccacaccatccccttcatcttcatcctcttcaccaccgtgaacctggtgcggctgctgaccatcctgctggtgagccccatcctgatgcacagcaactatgagtacaactggcgctggggcgtggtgatcacctggagcggcatcaagggcgtcttcaacctgctgtgggccccagatgtgtacaacctggccgagaggaaggtggaggtgccccagatgttcatcctgtatgtgcaggtgatcagcctgctgaccatgggcatcaacagctatgtgatgacccagagcgccaggaagctggacctgtgtgtgctgagcctgccccggcagatgatcctgcagaatgccacccagcacatccaggagatcgtgcagaacaccatcaccctcttcaagacagagaagatcctgaccaacgtgaactggaccctggtggaggacaagaccagaattgagtacatccccttcagccacgtgagccacaatgacatgaagacagagagcaccacagatgaggccctgatggaggaggcccggctgcacgtggccgccatccagatgagcagctttgagaagcagaggaacaacggcatcctggagattgaagctgcccgcatcctgattggagctgccaagtgctactacagcatccagggcaagttcatgagcatctatgatgtgtccacctacatgaggaccaggtcctggctgatcaagttcaagaatgtgctgaccttcctggagtactgcatcgagaagatccacttcatccccccagagagcaacaccttcctgaccttcatcttccacatcgtgttcagcgaggagtttgagtacacaggccagatcatcaacctgatctacatctaccccatgatcatccacctgtggcccatggcccggggcctgaatgtgtctgccctgatcagcatcaactactacttcatgttcctgtatgtgctggagagcaccctgaagatcatcatcctgaagaggaagtacttccagcagtgctggaacaccctggagttcttcatcctggtgattggcatcatcgacatcttctgtgtgtactttgtgaagctgcggccagacaacctggccctgatccagctgaccgtcatcatgggctacctgcgcatcatccgcttcctgcccctcttcaagatcatcgtgcccatcctgatcagaattgctgatgtgcagatcaagaagaggctgagcctgatgtacagcatcaccaagggctacatcaagagccaggaggatgccaagctgctgatcaagcagattgctgtgtgtgagagcatctaccagaagctgtgtgagatcctggagaccaacaagcaggatgctgtgaaggagctggtgctgatggagcacgagggcagagatgtggtgattgccctgaagaccaagcaggccatcagaaatgtcatcgccaaggccctgaagaacctgaccttcctgtgcagccggggcatcatcgacaagcatgaagtcatcgagatcaacaaggtgctgctgaagaagctgaaggccctgaacaacttccccaaggccatccccccacccaccccagacatctacctgcacaacatcatctggctggagggcaaggatgtgctgattgacttcttcaaggagcgggccaagctggcctgctttgacagcggggacaccatctgcaagggcggggagatgccccagggcatctacctgatcatcagcggcatggccatcctgcacagcctgagccccacctttggaattgagagcaaccagagatgtgaccggggcagccgggacatgttcacagagttctgcaccactggagacatcattggagagctgagctgcctgctgaagcgggagattgagtacaccgtcatctgtgagaccagcctgcaggcctgcttcatcagcctggaggacctgtatgagggctttgatgccttctggcccagcctggagtacaagatctggctgaagctggccctgagcacagcctaccagtactttgagagcagcctgattgatgaggacctgcgcttccagaactgtgtgatgttcaaccaggcctacgtggagaccctgagcagctacagcgacatgatcatcgacaacatgaccatgaagtttgtgatcatcgtgtatggctctgtgattgacaccaagacagaggagccctactttgccccctgcatcatccccaccacctgtgagcaggtgcagggcaccagtgacctgagcaagctgctgatcatccaggccagcgagctgacccagaggaacagcaacaccaacgtgatggcctctgtgaacacagtgtttgagcagcccgggaagaacatcaatggccggcagaagatgtcctag

SEQ ID NO: 38431 - DNA, 1353 bp, Artificial Sequence
  Description of Artificial Sequence: Synthetic coding sequence
atggtggccctggatgtggagttctacaccctgaagaagatgttctggcaggtgctgctgaccggcctcatctccttcagcacagccagcatcatcatcggctacgtggtgatcaagttcaacaaggacagctgggacctgcagagctgcctgctcttcagcatcaccctgggcatcatcgaccccctgcggtctgtgaacagcctgaagaccatcggcatcagcaagatctacatcgacctgatccggggggagagcctcatcatctgcagcatcgccagcatcttctttggaaacttccggggcaaccgcatccacttcagcatcttccgggacctgcacgtgggcatcgagctgtcctatgacatcctgggcagcatcatcttcggctactggtgtgccaagatcatccagtgcatcctggctgatgtgttcagcaacatgctgaccaacatcatcctgtgcttctccatggtgtacatgaccttctacatcgtggagttcctgggcatgagcggcaccctggccctggccgctgtgggcctgaacctggacagcctgaccttcaagcccaagattgagctggtgatcaccaagttcctgcgcatcttcagctctgtgtatgagcacctgatctatgccttcttcggcatcgtcatcggctgtggggagctgagccactatgagttccacaccatccccttcatcttcatcctcttcaccaccgtgaacctggtgcggctgctgaccatcctgctggtgagccccatcctgatgcacagcaactatgagtacaactggcgctggggcgtggtgatcacctggagcggcatcaagggcgtcttcaacctgctgtgggccccagatgtgtacaacctggccgagaggaaggtggaggtgccccagatgttcatcctgtatgtgcaggtgatcagcctgctgaccatgggcatcaacagctatgtgatgacccagagcgccaggaagctggacctgtgtgtgctgagcctgccccggcagatgatcctgcagaatgccacccagcacatccaggagatcgtgcagaacaccatcaccctcttcaagacagagaagatcctgaccaacgtgaactggaccctggtggaggacaagaccagaattgagtacatccccttcagccacgtgagccacaatgacatgaagacagagagcaccacagatgaggccctgatggaggaggcccggctgcacgtggccgccatccagatgagcagctttgagaagcagaggaacaacggcatcctggagattgaagctgcccgcatcctgattggagctgccaagtgctactacagcatccagggcaagtag

SEQ ID NO: 38432 - DNA, 1548 bp, Artificial Sequence
  Description of Artificial Sequence: Synthetic coding sequence
atgcacaccacagagagcaagaatgagcacctggaggatgagaacttccagaccagcaccaccccccagagcctgattgaccccaacaacacagcccaggaggagaccaagacagtgctgagtgacacagaggagatcaagccccagaccaagaaggagacctacatcagctgccccctgcggggcgtgctgaatgtcatcatcaccaacggggtcatcctgtttgtgatctggtgcatgacctggagcatcctgggcagcgaggccctgcccggcggcaacctgtttggcctcttcatcatcttctacagcgccatcattggaggcaagatcctgcagctgatccgcatccccctggtgccccccctgccccccctgctgggcatgctgctggccggcttcaccatcagaaatgtgcccttcatcaatgaacatgtgcacgtgcccaacacctggagcagcatcctgcggagcatcgccctgaccatcatcctgatccgggccggcctgggcctggacccccaggccctgcggcacctgaaggtggtgtgcttccggctggccgtgggcccctgcctgatggaggccagcgctgctgctgtgttcagccacttcatcatgaagttcccctggcagtgggccttcctgctgggctttgtgctgggcgctgtgtccccagctgtggtggtgccctacatgatggtgctgcaggagaatggctatggagtggaggagggcatccccaccctgctgatggccgccagctccatggatgacatcctggccatcaccggcttcaacacctgcctgagcatcgtgttcagcagcggcggcatcctgaacaatgccatcgccagcatcagaaatgtgtgcatcagcctgctggccggcatcgtgctgggcttctttgtgcgctacttccccagcgaggaccagaagaagctgaccctgaagaggggcttcctggtgctgaccatgtgtgtgtctgctgtgctgggcagccagagaattggcctgcacggcagcggcggcctgtgcaccctggtgctgtccttcatcgccggcaccaagtggagccaggagaagatgaaggtgcagaagatcatcaccaccgtgtgggacatcttccagcccctgctgtttggcctggtgggcgctgaggtgtctgtgagcagcctggagagcaacatcgtgggcatctctgtggccaccctgagcctggccctgtgtgtgcgcatcctgaccacctacctgctgatgtgctttgctggcttctccttcaaggagaagatcttcatcgccctggcctggatgcccaaggccaccgtgcaggccgtgctgggccccctggccctggagacagcccgggtgtctgccccccacctggagccctatgccaaggatgtgatgacagtggccttcctggccatcctgatcacagccccaaatggagccctgctgatgggcatcctgggccccaagatgctgaccaggcactatgaccccagcaagatcaagctgcagctgagcaccctggagcaccactag

SEQ ID NO: 38433 - DNA, 1428 bp, Artificial Sequence
  Description of Artificial Sequence: Synthetic coding sequence
atgcacaccacagagagcaagaatgagcacctggaggatgagaacttccagaccagcaccaccccccagagcctgattgaccccaacaacacagcccaggaggagaccaagacagtgctgagtgacacagaggagatcaagccccagaccaagaaggagacctacatcagctgccccctgcggggcgtgctgaatgtcatcatcaccaacggggtcatcctgtttgtgatctggtgcatgacctggagcatcctgggcagcgaggccctgcccggcggcaacctgtttggcctcttcatcatcttctacagcgccatcattggaggcaagatcctgcagctgatccgcatccccctggtgccccccctgccccccctgctgggcatgctgctggccggcttcaccatcagaaatgtgcccttcatcaatgaacatgtgcacgtgcccaacacctggagcagcatcctgcggagcatcgccctgaccatcatcctgatccgggccggcctgggcctggacccccaggccctgcggcacctgaaggtggtgtgcttccggctggccgtgggcccctgcctgatggaggccagcgctgctgctgtgttcagccacttcatcatgaagttcccctggcagtgggccttcctgctgggctttgtgctgggcgctgtgtccccagctgtggtggtgccctacatgatggtgctgcaggagaatggctatggagtggaggagggcatccccaccctgctgatggccgccagctccatggatgacatcctggccatcaccggcttcaacacctgcctgagcatcgtgttcagcagcggcggcatcctgaacaatgccatcgccagcatcagaaatgtgtgcatcagcctgctggccggcatcgtgctgggcttctttgtgcgctacttccccagcgaggaccagaagaagctgaccctgaagaggggcttcctggtgctgaccatgtgtgtgtctgctgtgctgggcagccagagaattggcctgcacggcagcggcggcctgtgcaccctggtgctgtccttcatcgccggcaccaagtggagccaggagaagatgaaggtgcagaagatcatcaccaccgtgtgggacatcttccagcccctgctgtttggcctggtgggcgctgaggtgtctgtgagcagcctggagagcaacatcgtgggcatctctgtggccaccctgagcctggccctgtgtgtgcgcatcctgaccacctacctgctgatgtgctttgctggcttctccttcaaggagaagatcttcatcgccctggcctggatgcccaaggccaccgtgcagatcaaccaggccatcctgctgctcttcctgctgcgggaggagtggaccaactgcaaggtggccaagaagtgtgagtacaccaaggagcggcagtag

SEQ ID NO: 38434 - DNA, 663 bp, Artificial Sequence
  Description of Artificial Sequence: Synthetic coding sequence
atgcacaccacagagagcaagaatgagcacctggaggatgagaacttccagaccagcaccaccccccagagcctgattgaccccaacaacacagcccaggaggagaccaagacagtgctgagtgacacagaggagatcaagccccagaccaagaaggagacctacatcagctgccccctgcggggcgtgctgaatgtcatcatcaccaacggggtcatcctgtttgtgatctggtgcatgacctggagcatcctgggcagcgaggccctgcccggcggcaacctgtttggcctcttcatcatcttctacagcgccatcattggaggcaagatcctgcagctgatccgcatccccctggtgccccccctgccccccctgctgggcatgctgctggccggcttcaccatcagaaatgtgcccttcatcaatgaacatgtgcacgtgcccaacacctggagcagcatcctgcggagcatcgccctgaccatcatcctgatccgggccggcctgggcctggacccccaggccctgcggcacctgaaggtggtgtgcttccggctggccgtgggcccctgcctgatggaggccagcgctgctgctgtgttcagccacttcatcatgaagttcccctggcagtgggccttcctgctgggcctcttctag

SEQ ID NO: 38435 - DNA, 153 bp, Artificial Sequence
  Description of Artificial Sequence: Synthetic coding sequence
atgcacaccacagagagcaagaatgagcacctggaggatgagaacttccagaccagcaccaccccccagagcctgattgaccccaacaacacagcccaggaggagaccaagacagtgctgagtgacacagaggagatcaagccccagacctag

SEQ ID NO: 38436 - DNA, 1365 bp, Artificial Sequence
  Description of Artificial Sequence: Synthetic coding sequence
atgggagatgaggacaagaggatcacctatgaagattctgagcccagcacaggcatgaactacacccccagcatgcaccaggaggcccaggaggagaccgtgatgaagctgaagggcattgatgccaatgagcccacagagggcagcatcctgctgaagagcagcgagaagaagctgcaggagacccccacagaggccaaccacgtgcagaggctgcggcagatgctggcctgcccccctcatggcctgctggacagagtcatcaccaacgtgaccatcatcgtgctgctgtgggccgtggtgtggagcatcactggaagtgagtgcctgcccggcggcaacctgtttggcatcatcatcctcttctactgtgccatcattggaggcaagctgctgggcctcatcaagctgcccaccctgccccccctgcccagcctgctgggcatgctgctggccggcttcctgatccggaacatccctgtgatcaatgacaacgtgcagatcaagcacaagtggagcagcagcctgcggagcatcgccctgagcatcatcctggtgcgggccggcctgggcctggacagcaaggccctgaagaagctgaagggcgtgtgtgtgcggctgtccatgggcccctgcatcgtggaggcctgcaccagcgccctgctggcccactacctgctgggcctgccctggcagtggggcttcatcctgggctttgtgctgggcgctgtgtccccagctgtggtggtgcccagcatgctgctgctgcagggcggcggctatggagtggagaagggcgtgcccaccctgctgatggccgccggcagctttgatgacatcctggccatcaccggcttcaacacctgcctgggcatcgccttcagcacaggcagcacagtgttcaacgtgctgcggggcgtgctggaggtggtgattggagtggccaccggctctgtgctgggcttcttcatccagtacttccccagccgggaccaggacaagctggtgtgcaagaggaccttcctggtgctgggcctgtctgtgctggccgtgttcagctctgtgcacttcggcttccctggcagcggcggcctgtgcaccctggtgatggccttcctggccggcatgggctggaccagcgagaaggccgaggtggagaagatcatcgctgtggcctgggacatcttccagcccctgctgtttggcctcatcggggctgaggtgtccatcgccagcctgcggcctgagaccgtgggcagcgctgacagcatcactggaaactttggaacagagcggcccaagctgctgggcccccccagcacccagctgcgcttccacttcttccacatccagctgagcacctag

SEQ ID NO: 38437 - DNA, 1614 bp, Artificial Sequence
  Description of Artificial Sequence: Synthetic coding sequence
atgggagatgaggacaagaggatcacctatgaagattctgagcccagcacaggcatgaactacacccccagcatgcaccaggaggcccaggaggagaccgtgatgaagctgaagggcattgatgccaatgagcccacagagggcagcatcctgctgaagagcagcgagaagaagctgcaggagacccccacagaggccaaccacgtgcagaggctgcggcagatgctggcctgcccccctcatggcctgctggacagagtcatcaccaacgtgaccatcatcgtgctgctgtgggccgtggtgtggagcatcactggaagtgagtgcctgcccggcggcaacctgtttggcatcatcatcctcttctactgtgccatcattggaggcaagctgctgggcctcatcaagctgcccaccctgccccccctgcccagcctgctgggcatgctgctggccggcttcctgatccggaacatccctgtgatcaatgacaacgtgcagatcaagcacaagtggagcagcagcctgcggagcatcgccctgagcatcatcctggtgcgggccggcctgggcctggacagcaaggccctgaagaagctgaagggcgtgtgtgtgcggctgtccatgggcccctgcatcgtggaggcctgcaccagcgccctgctggcccactacctgctgggcctgccctggcagtggggcttcatcctgggctttgtgctgggcgctgtgtccccagctgtggtggtgcccagcatgctgctgctgcagggcggcggctatggagtggagaagggcgtgcccaccctgctgatggccgccggcagctttgatgacatcctggccatcaccggcttcaacacctgcctgggcatcgccttcagcacaggcagcacagtgttcaacgtgctgcggggcgtgctggaggtggtgattggagtggccaccggctctgtgctgggcttcttcatccagtacttccccagccgggaccaggacaagctggtgtgcaagaggaccttcctggtgctgggcctgtctgtgctggccgtgttcagctctgtgcacttcggcttccctggcagcggcggcctgtgcaccctggtgatggccttcctggccggcatgggctggaccagcgagaaggccgaggtggagaagatcatcgctgtggcctgggacatcttccagcccctgctgtttggcctcatcggggctgaggtgtccatcgccagcctgcggcctgagaccgtgggcctgtgtgtggccaccgtgggcattgctgtgctgatccgcatcctgaccaccttcctgatggtgtgctttgctggcttcaacctgaaggagaagatcttcatcagctttgcctggctgcccaaggccaccgtgcaggccgccatcggctctgtggccctggacacagcccggagccacggggagaagcagctggaggactatggcatggatgtgctgactgtggccttcctgagcatcctgatcacagcccccatcggcagcctgctgattggcctgctgggcccccggctgctgcagaaggtggagcaccagaacaaggatgaggaggtgcagggcgagacctctgtgcaggtgtag

SEQ ID NO: 38438 - DNA, 1614 bp, Artificial Sequence; identical to SEQ ID NO: 38437
  Description of Artificial Sequence: Synthetic coding sequence

SEQ ID NO: 38439 - DNA, 1254 bp, Artificial Sequence
  Description of Artificial Sequence: Synthetic coding sequence
atgggagatgaggacaagaggatcacctatgaagattctgagcccagcacaggcatgaactacacccccagcatgcaccaggaggcccaggaggagaccgtgatgaagctgaagggcattgatgccaatgagcccacagagggcagcatcctgctgaagagcagcgagaagaagctgcaggagacccccacagaggccaaccacgtgcagaggctgcggcagatgctggcctgcccccctcatggcctgctggacagagtcatcaccaacggcatgctgctggccggcttcctgatccggaacatccctgtgatcaatgacaacgtgcagatcaagcacaagtggagcagcagcctgcggagcatcgccctgagcatcatcctggtgcgggccggcctgggcctggacagcaaggccctgaagaagctgaagggcgtgtgtgtgcggctgtccatgggcccctgcatcgtggaggcctgcaccagcgccctgctggcccactacctgctgggcctgccctggcagtggggcttcatcctgggctttgtgctgggcgctgtgtccccagctgtggtggtgcccagcatgctgctgctgcagggcggcggctacggcgtggagaagggcgtgcccaccctgctgatggctgctggcagctttgatgacatcctggccatcaccggcttcaacacctgcctgggcatcgccttcagcacaggcagcaccgtcttcaacgtgctgcggggcgtgctggaggtggtgattggagtggccactggatctgtgctgggcttcttcatccagtacttccccagccgggaccaggacaagctggtgtgcaagaggaccttcctggtgctgggcctgtctgtgctggccgtgttcagctctgtgcacttcggcttccctggcagcggcggcctgtgcaccctggtgatggccttcctggccggcatgggctggaccagcgagaaggccgaggtggagaagatcatcgctgtggcctgggacatcttccagcccctgctgtttggcctgattggagctgaggtgtccatcgccagcctgcggcctgagaccgtgggctgcaaccgcatctgtggcttcggccacagcaaggtgacctggagggagaccatccggcggctgtggaatggctgtgtggacagcggcatctttgtgcacccccaccacagccccaactggaagagcgcctactggttcaccggcccccaggccagcgctgagagctag

SEQ ID NO: 38440 - DNA, 1443 bp, Artificial Sequence
  Description of Artificial Sequence: Synthetic coding sequence
atgggagatgaggacaagaggatcacctatgaagattctgagcccagcacaggcatgaactacacccccagcatgcaccaggaggcccaggaggagaccgtgatgaagctgaagggcattgatgccaatgagcccacagagggcagcatcctgctgaagagcagcgagaagaagctgcaggagacccccacagaggccaaccacgtgcagaggctgcggcagatgctggcctgcccccctcatggcctgctggacagagtcatcaccaacggcatgctgctggccggcttcctgatccggaacatccctgtgatcaatgacaacgtgcagatcaagcacaagtggagcagcagcctgcggagcatcgccctgagcatcatcctggtgcgggccggcctgggcctggacagcaaggccctgaagaagctgaagggcgtgtgtgtgcggctgtccatgggcccctgcatcgtggaggcctgcaccagcgccctgctggcccactacctgctgggcctgccctggcagtggggcttcatcctgggctttgtgctgggcgctgtgtccccagctgtggtggtgcccagcatgctgctgctgcagggcggcggctacggcgtggagaagggcgtgcccaccctgctgatggctgctggcagctttgatgacatcctggccatcaccggcttcaacacctgcctgggcatcgccttcagcacaggcagcaccgtcttcaacgtgctgcggggcgtgctggaggtggtgattggagtggccactggatctgtgctgggcttcttcatccagtacttccccagccgggaccaggacaagctggtgtgcaagaggaccttcctggtgctgggcctgtctgtgctggccgtgttcagctctgtgcacttcggcttccctggcagcggcggcctgtgcaccctggtgatggccttcctggccggcatgggctggaccagcgagaaggccgaggtggagaagatcatcgctgtggcctgggacatcttccagcccctgctgtttggcctgattggagctgaggtgtccatcgccagcctgcggcctgagaccgtgggcctgtgtgtggccaccgtgggcattgctgtgctgatccgcatcctgaccaccttcctgatggtgtgctttgctggcttcaacctgaaggagaagatcttcatcagctttgcctggctgcccaaggccaccgtgcaggccgccatcggctctgtggccctggacacagcccggagccatggagagaagcagctggaggactatggcatggatgtgctgactgtggccttcctgagcatcctgatcacagcccccatcggcagcctgctgattggcctgctgggcccccggctgctgcagaaggtggagcaccagaacaaggatgaggaggtgcagggcgagacctctgtgcaggtgtag

SEQ ID NO: 38441 - DNA, 432 bp, Artificial Sequence
  Description of Artificial Sequence: Synthetic coding sequence
atgggagatgaggacaagaggatcacctatgaagattctgagcccagcacaggcatgaactacacccccagcatgcaccaggaggcccaggaggagaccgtgatgaagctgaagggcattgatgccaatgagcccacagagggcagcatcctgctgaagagcagcgagaagaagctgcaggagacccccacagaggccaaccacgtgcagaggctgcggcagatgctggcctgcccccctcatggcctgctggacagagtcatcaccaacgtgaccatcatcgtgctgctgtgggccgtggtgtggagcatcactggaagtgagtgcctgcccggcggcaacctgtttggcatcatcatcctcttctactgtgccatcattggaggcaagctgctgggcctcatcaagctgcccaccctgccccccctgtag

SEQ ID NO: 38442 - DNA, 2064 bp, Artificial Sequence
  Description of Artificial Sequence: Synthetic coding sequence
atggatgagggcaccggcctgcagcctggagctggggagcagctggaggccccagccacagctgaggccgtgcaggagcgctgtgagcctgagaccctgcggagcaagagcctgcctgtgctgagcagcgccagctgccggcccagcctgagccccaccagcggagatgccaacccagccttcggctgtgtggacagcagcggccaccaggagctgaagcagggccccaaccccctggcccccagccccagcgcccccagcaccagcgctggcctgggggactgcaaccaccgggtggacctgagcaagaccttctctgtgtcctctgccctggccatgctgcaggagcggcgctgcctgtatgtggtgctgacagacagccgctgcttcctggtgtgcatgtgcttcctgaccttcatccaggccctgatggtgtctggctacctgagcagcgtcatcaccaccatcgagcggcgctacagcctgaagagcagcgagagcggcctgctggtgtcctgctttgacatcggcaacctggtggtggtggtgtttgtgtcctactttggaggccggggcagaagacccctgtggctggccgtgggcggcctgctgattgcctttggagctgccctgtttgccctgccccacttcatcagccccccctaccagatccaggagctgaatgccagcgccccaaatgatggcctgtgccagggcggcaacagcacagccaccctggagcccccagcctgccccaaggacagcggcggcaacaaccactgggtgtatgtggccctcttcatctgtgcccagatcctgattggcatgggcagcacccccatctacaccctgggccccacctacctggatgacaacgtgaagaaggagaacagcagcctgtacctggccatcatgtatgtgatgggcgccctgggccctgctgtgggctacctgctgggcggcctgctgattggcttctacgtggaccccagaaatcctgtgcacctggaccagaatgacccccgcttcatcggcaactggtggagcggcttcctgctgtgtgccatcgccatgttcctggtgatcttccccatgttcaccttccccaagaagctgcccccaagacacaagaagaagaagaagaagaagttctctgtggatgctgtgtctgatgatgatgtgctgaaggagaagagcaacaacagcgagcaggccgacaagaaggtgtcctccatgggctttgggaaggatgtgcgggacctgcccagggctgctgtgcgcatcctgagcaacatgaccttcctgtttgtgtccctgagctacacagctgagagcgccatcgtgacagccttcatcaccttcatccccaagttcatcgagagccagtttggcatcccagccagcaatgccagcatctacacaggagtcatcatcgtgcccagcgctggggtgggcatcgtgctgggcggctacatcatcaagaagctgaagctgggcgcccgggagagcgccaagctggccatgatctgcagcggcgtgtccctgctgtgcttcagcaccctcttcatcgtgggctgtgagagcatcaacctgggcggcatcaacatcccctacaccaccggccccagcctgaccatgccccacaggaacctgaccggcagctgcaatgtgaactgtggctgcaagatccacgagtatgagcctgtgtgtggcagtgatggcatcacctacttcaacccctgcctggccggctgtgtgaacagcggcaacctgagcacaggcatccggaactacacagagtgcacctgtgtgcagagccggcaggtgatcaccccacccaccgtgggccagaggagccagctgcgggtggtgattgtgaagacctacctgaatgaaaatggctatgctgtgtctgggaagtgcaagaggacctgcaacaccctcatccccttcctggtgttcctgttcatcgtgaccttcatcacagcctgtgcccagcccagcgccatcatcgtgaccctgagcatccacagctacagcaacctgctgtggagcagccactag

SEQ ID NO: 38443 - DNA, 2013 bp, Artificial Sequence
  Description of Artificial Sequence: Synthetic coding sequence
atgggagaaacagagaagagaattgagacccaccgcatccgctgcctgagcaagctgaagatgttcctgctggccatcacctgtgcctttgtgtccaagaccctgagcggcagctacatgaacagcatgctgacccagatcgagcggcagttcaacatccccaccagcctggtgggcttcatcaatggcagctttgaaattggcaacctgctgctgatcatctttgtgtcctacttcggcaccaagctgcaccggcccatcatgattggaattggctgtgtggtgatgggcctgggctgcttcctgaagagcctgccccacttcctgatgaaccagtatgaatatgagagcacagtgtctgtgtctggcaacctgagcagcaacagcttcctgtgcatggagaatggcacccagatcctgcggcccacccaggaccccagcgagtgcaccaaggaggtgaagagcctgatgtgggtgtatgtgctggtgggcaacatcgtgcggggcatgggagagacccccatcctgcccctgggcatctcctacatcgaggactttgccaagtttgagaacagccccctgtacatcggcctggtggagactggagccatcatcggccccctgattggcctgctgctggccagcttctgtgccaacgtgtatgtggacaccggctttgtgaacacagatgacctgatcatcacccccacagacacccgctgggtgggcgcctggtggtttggcttcctgatctgtgccggcgtgaatgtgctgacagccatccccttcttcttcctgcccaacaccctgcccaaggagggcctggagaccaatgctgacatcatcaagaatgaaaatgaagacaagcagaaggaggaggtgaagaaggagaagtatggcatcaccaaggacttcctgcccttcatgaagagcctgagctgcaaccccatctacatgctgttcatcctggtgtctgtcatccagttcaatgcctttgtgaacatgatctccttcatgcccaagtacctggagcagcagtatggcatcagcagcagtgatgccatcttcctgatgggcatctacaacctgccccccatctgcatcggctacatcatcggcggcctcatcatgaagaagttcaagatcaccgtgaagcaggccgcccacatcggctgctggctgagcctgctggagtacctgctgtacttcctgtccttcctgatgacctgtgagaacagctctgtggtgggcatcaacaccagctatgagggcatcccccaggacctgtatgtggagaatgacatctttgctgactgcaatgtggactgcaactgccccagcaagatctgggaccctgtgtgtggcaacaacggcctgagctacctgagcgcctgcctggccggctgtgagaccagcattggaacaggcatcaacatggtgttccagaactgcagctgcatccagaccagcggcaacagcagcgctgtgctgggcctgtgtgacaagggccctgactgcagcctgatgctgcagtacttcctgatcctgagcgccatgagcagcttcatctacagcctggccgccatccctggctacatggtgctgctgcgctgcatgaagtctgaggagaagagcctgggcgtgggcctgcacaccttctgcaccagggtgtttgctggcatcccagcccccatctactttggagccctgatggacagcacctgcctgcactggggcaccctgaagtgtggggagagcggggcctgccgcatctatgacagcaccaccttccgctacatctacctgggcctgcctgctgccctgcggggcagcagctttgtgcctgccctgatcatcctgatcctgctgaggaagtgccacctgcctggagaaaatgccagcagcggcacagagctgattgagaccaaggtgaagggcaaggaaaatgaatgcaaggacatctaccagaagagcacagtgctgaaggatgatgagctgaagaccaagctgtag

SEQ ID NO: 38444 - DNA, 1740 bp, Artificial Sequence
  Description of Artificial Sequence: Synthetic coding sequence
atgttcctgaccaagaactgcaagcaggagcaggagcgggtggagagcgccaagatgttcctgctggccatcacctgtgcctttgtgtccaagaccctgagcggcagctacatgaacagcatgctgacccagatcgagcggcagttcaacatccccaccagcctggtgggcttcatcaatggcagctttgaaattggcaacctgctgctgatcatctttgtgtcctacttcggcaccaagctgcaccggcccatcatgattggaattggctgtgtggtgatgggcctgggctgcttcctgaagagcctgccccacttcctgatgaaccagtatgaatatgagagcacagtgtctgtgtctggcaacctgagcagcaacagcttcctgtgcatggagaatggcacccagatcctgcggcccacccaggaccccagcgagtgcaccaaggaggtgaagagcctgatgtgggtgtatgtgctggtgggcaacatcgtgcggggcatgggagagacccccatcctgcccctgggcatctcctacatcgaggactttgccaagtttgagaacagccccctgtacatcggcctggtggagactggagccatcatcggccccctgattggcctgctgctggccagcttctgtgccaacgtgtatgtggacaccggctttgtgaacacagatgacctgatcatcacccccacagacacccgctgggtgggcgcctggtggtttggcttcctgatctgtgccggcgtgaatgtgctgacagccatccccttcttcttcctgcccaacaccctgcccaaggagggcctggagaccaatgctgacatcatcaagaatgaaaatgaagacaagcagaaggaggaggtgaagaaggagaagtatggcatcaccaaggacttcctgcccttcatgaagagcctgagctgcaaccccatctacatgctgttcatcctggtgtctgtcatccagttcaatgcctttgtgaacatgatctccttcatgcccaagtacctggagcagcagtatggcatcagcagcagtgatgccatcttcctgatgggcatctacaacctgccccccatctgcatcggctacatcatcggcggcctcatcatgaagaagttcaagatcaccgtgaagcaggccgcccacatcggctgctggctgagcctgctggagtacctgctgtacttcctgtccttcctgatgacctgtgagaacagctctgtggtgggcatcaacaccagctatgagggcatcccccaggacctgtatgtggagaatgacatctttgctgactgcaatgtggactgcaactgccccagcaagatctgggaccctgtgtgtggcaacaacggcctgagctacctgagcgcctgcctggccggctgtgagaccagcattggaacaggcatcaacatggtgttccagaactgcagctgcatccagaccagcggcaacagcagcgctgtgctgggcctgtgtgacaagggccctgactgcagcctgatgctgcagtacttcctgatcctgagcgccatgagcagcttcatctacagcctggccgccatccctggctacatggtgctgctgcgctgcatgaagtctgaggagaagagcctgggcgtgggcctgcacaccttctgcaccagggtgtttgggaagaacagctacttcttcccccaccccatccgcaccatcctgctgctgctcttcttcatcaccctgtag

SEQ ID NO: 38445 - DNA, 42 bp, Artificial Sequence
  Description of Artificial Sequence: Synthetic coding sequence
atgggagaaacagagaagagaattgagacccaccgcatctag

SEQ ID NO: 38446 - DNA, 156 bp, Artificial Sequence
  Description of Artificial Sequence: Synthetic coding sequence
atgggagaaacagagaagagaattgagacccaccgcatccgctgcctgagcaagctgaagatgttcctgctggccatcacctgtgcctttgtgtccaagaccctgagcggcagctacatgaacagcatgctgacccagatcgagcggcagttctag

SEQ ID NO: 38447 - DNA, 300 bp, Artificial Sequence
  Description of Artificial Sequence: Synthetic coding sequence
atgggagaaacagagaagagaattgagacccaccgcatccgctgcctgagcaagctgaagatgttcctgctggccatcacctgtgcctttgtgtccaagaccctgagcggcagctacatgaacagcatgctgacccagatcgagcggcagttcaacatccccaccagcctggtgggcttcatcaatggcagctttgaaattggcaacctgctgctgatcatctttgtgtcctacttcggcaccaagctgcaccggcccatcatgattggaattggctgtgtggtgatgggcctgggctag

SEQ ID NO: 38448 - DNA, 444 bp, Artificial Sequence
  Description of Artificial Sequence: Synthetic coding sequence
atgggagaaacagagaagagaattgagacccaccgcatccgctgcctgagcaagctgaagatgttcctgctggccatcacctgtgcctttgtgtccaagaccctgagcggcagctacatgaacagcatgctgacccagatcgagcggcagttcaacatccccaccagcctggtgggcttcatcaatggcagctttgaaattggcaacctgctgctgatcatctttgtgtcctacttcggcaccaagctgcaccggcccatcatgattggaattggctgtgtggtgatgggcctgggctgcttcctgaagagcctgccccacttcctgatgaaccagtatgaatatgagagcacagtgtctgtgtctggcaacctgagcagcaacagcttcctgtgcatggagaatggcacccagatcctgcggcccacccaggaccccagctag

SEQ ID NO: 38449 - DNA, 9 bp, Artificial Sequence
  Description of Artificial Sequence: Synthetic coding sequence
atgggctag

SEQ ID NO: 38450 - DNA, 267 bp, Artificial Sequence
  Description of Artificial Sequence: Synthetic coding sequence
atgggagaaacagagaagagaattgagacccaccgcatccgctgcctgagcaagctgaagatgttcctgctggccatcacctgtgcctttgtgtccaagaccctgagcggcagctacatgaacagcatgctgacccagatcgagcggcagttcaacatccccaccagcctggtgggcttcatcaatggcagctttgaaattggcaacctgctgctgatcatctttgtgtcctacttcggcaccaagctgcaccggcccatcatgtag

SEQ ID NO: 38451 - DNA, 276 bp, Artificial Sequence
  Description of Artificial Sequence: Synthetic coding sequence
atgggagaaacagagaagagaattgagacccaccgcatccgctgcctgagcaagctgaagatgttcctgctggccatcacctgtgcctttgtgtccaagaccctgagcggcagctacatgaacagcatgctgacccagatcgagcggcagttcaacatccccaccagcctggtgggcttcatcaatggcagctttgaaattggcaacctgctgctgatcatctttgtgtcctacttcggcaccaagctgcaccggcccatcatgattggcatctag

SEQ ID NO: 38452 - DNA, 2013 bp, Artificial Sequence; identical to SEQ ID NO: 38443
  Description of Artificial Sequence: Synthetic coding sequence

SEQ ID NO: 38453 - DNA, 414 bp, Artificial Sequence
  Description of Artificial Sequence: Synthetic coding sequence
atgggagaaacagagaagagaattgagacccaccgcatccgctgcctgagcaagctgaagatgttcctgctggccatcacctgtgcctttgtgtccaagaccctgagcggcagctacatgaacagcatgctgacccagatcgagcggcagttcaacatccccaccagcctggtgggcttcatcaatggcagctttgaaattggcaacctgctgctgatcatctttgtgtcctacttcggcaccaagctgcaccggcccatcatgattggaattggctgtgtggtgatgggcctgggctgcttcctgaagagcctgccccacttcctgatgaaccagtatgaatatgagagcacagtgtctgtgtctggcaacctgagcagcaacagcttcctgtgcatggagaatggcacctag

SEQ ID NO: 38454 - DNA, 1617 bp, Artificial Sequence
  Description of Artificial Sequence: Synthetic coding sequence
atggagaatggcacccagatcctgcggcccacccaggaccccagcgagtgcaccaaggaggtgaagagcctgatgtgggtgtatgtgctggtgggcaacatcgtgcggggcatgggagagacccccatcctgcccctgggcatctcctacatcgaggactttgccaagtttgagaacagccccctgtacatcggcctggtggagactggagccatcatcggccccctgattggcctgctgctggccagcttctgtgccaacgtgtatgtggacaccggctttgtgaacacagatgacctgatcatcacccccacagacacccgctgggtgggcgcctggtggtttggcttcctgatctgtgccggcgtgaatgtgctgacagccatccccttcttcttcctgcccaacaccctgcccaaggagggcctggagaccaatgctgacatcatcaagaatgaaaatgaagacaagcagaaggaggaggtgaagaaggagaagtatggcatcaccaaggacttcctgcccttcatgaagagcctgagctgcaaccccatctacatgctgttcatcctggtgtctgtcatccagttcaatgcctttgtgaacatgatctccttcatgcccaagtacctggagcagcagtatggcatcagcagcagtgatgccatcttcctgatgggcatctacaacctgccccccatctgcatcggctacatcatcggcggcctcatcatgaagaagttcaagatcaccgtgaagcaggccgcccacatcggctgctggctgagcctgctggagtacctgctgtacttcctgtccttcctgatgacctgtgagaacagctctgtggtgggcatcaacaccagctatgagggcatcccccaggacctgtatgtggagaatgacatctttgctgactgcaatgtggactgcaactgccccagcaagatctgggaccctgtgtgtggcaacaacggcctgagctacctgagcgcctgcctggccggctgtgagaccagcattggaacaggcatcaacatggtgttccagaactgcagctgcatccagaccagcggcaacagcagcgctgtgctgggcctgtgtgacaagggccctgactgcagcctgatgctgcagtacttcctgatcctgagcgccatgagcagcttcatctacagcctggccgccatccctggctacatggtgctgctgcgctgcatgaagtctgaggagaagagcctgggcgtgggcctgcacaccttctgcaccagggtgtttgctggcatcccagcccccatctactttggagccctgatggacagcacctgcctgcactggggcaccctgaagtgtggggagagcggggcctgccgcatctatgacagcaccaccttccgctacatctacctgggcctgcctgctgccctgcggggcagcagctttgtgcctgccctgatcatcctgatcctgctgaggaagtgccacctgcctggagaaaatgccagcagcggcacagagctgattgagaccaaggtgaagggcaaggaaaatgaatgcaaggacatctaccagaagagcacagtgctgaaggatgatgagctgaagaccaagctgtag

SEQ ID NO: 38455 - DNA, 1617 bp, Artificial Sequence; identical to SEQ ID NO: 38454
  Description of Artificial Sequence: Synthetic coding sequence

SEQ ID NO: 38456 - DNA, 1704 bp, Artificial Sequence
  Description of Artificial Sequence: Synthetic coding sequence
atgggcctgctgcccaagctgggcgccagccagggcagtgacaccagcaccagccgggccggccgctgtgcccggtctgtgtttggaaacatcaaggtgtttgtgctgtgccagggcctgctgcagctgtgccagctgctgtacagcgcctacttcaagagcagcctgaccaccatcgagaagagatttggcctgagcagcagcagcagcggcctcatcagcagcctgaatgagatcagcaatgccatcctgatcatctttgtgtcctacttcggcagccgggtgcaccggccccggctgattggaattggaggcctcttcctggccgccggggccttcatcctgaccctgccccacttcctgtctgagccctaccagtacaccctggccagcacagccatcctgtttgccatctctgtgtttggacctgccttcggctacctgctgggctctgtgatgctgcagatctttgtggactatggccgggtgaacacagctgctgtgaacctggtgcctggggacccccgctggattggagcctggtggctgggcctgctgatcagcagcgccctgctggtgctgaccagcttccccttcttcttcttcccccgggccatgcccatcggggccaagagggccccagccacagcagatgaggccaggaagctggaggaggccaagagccggggcagcctggtggacttcatcaagcgcttcccctgcatcttcctgcggctgctgatgaacagcctgtttgtgctggtggtgctggcccagtgcaccttcagctctgtgattgctggcctgagcaccttcctgaacaagttcctggagaagcagtatggcaccagcgctgcctatgccaacttcctgattggagctgtgaacctgcctgctgctgccctgggcatgctgtttggaggcatcctgatgaagagatttgtgttcagcctgcaggccatcccccgcatcgccaccaccatcatcaccatctccatgatcctgtgtgtgcccctcttcttcatgggctgcagcacccccaccgtggccgaggtgtacccacccagcaccagcagcagcatccacccccagagccctgcctgcagaagagactgcagctgcccagacagcatcttccaccctgtgtgtggggacaatggcatcgagtacctgagcccctgccacgccggctgcagcaacatcaacatgagcagcgccaccagcaagcagctgatctacctgaactgcagctgtgtgactggaggcagcgccagcgccaagacaggcagctgccctgtgccctgtgcccacttcctgctgcctgccatcttcctgatcagctttgtgtccctcatcgcctgcatcagccacaaccccctgtacatgatggtgctgcgggtggtgaaccaggaggagaagagctttgccatcggcgtgcagttcctgctgatgaggctgctggcctggctgcccagccctgccctgtatggcctgaccatcgaccacagctgcatccgctggaacagcctgtgcctgggccggcggggggcctgtgcctactatgacaatgatgccctgcgggaccgctacctgggcctgcagatgggctacaaggccctgggcatgctgctgctgtgcttcatctcctggagggtgaagaagaacaaggagtacaacgtgcagaaggccgccggcctcatctag

SEQ ID NO: 38457 - DNA, 2130 bp, Artificial Sequence
  Description of Artificial Sequence: Synthetic coding sequence
atgggccccagaattggccctgctggggaggtgccccaggtgcctgacaaggagaccaaggccaccatgggcacagagaacaccccaggcggcaaggccagcccagacccccaggatgtgcggcccagcgtcttccacaacatcaagctgtttgtgctgtgccacagcctgctgcagctggcccagctgatgatcagcggctacctgaagagcagcatcagcacagtggagaagcgcttcggcctgagcagccagaccagcggcctgctggccagcttcaatgaggtgggcaacacagccctgattgtgtttgtgtcctacttcggcagccgggtgcaccggcccaggatgattggctacggggccatcctggtggccctggccggcctgctgatgaccctgccccacttcatcagcgagccctaccgctatgacaacaccagccctgaggacatgccccaggacttcaaggccagcctgtgcctgcccaccaccagcgccccagccagcgcccccagcaatggaaactgcagcagctacacagagacccagcacctgtctgtggtgggcatcatgtttgtggcccagaccctgctgggcgtgggcggcgtgcccatccagcccttcggcatctcctacattgatgactttgcccacaacagcaacagccccctgtacctgggcatcctgtttgctgtgaccatgatgggccctggcctggccttcggcctgggcagcctgatgctgcggctgtatgtggacatcaaccagatgcctgagggcggcatcagcctgaccatcaaggacccccgctgggtgggcgcctggtggctgggcttcctgattgctgctggagctgtggccctggccgccatcccctacttcttcttccccaaggagatgcccaaggagaagcgggagctgcagttccggaggaaggtgctggccgtgacagacagccctgccaggaagggcaaggacagccccagcaagcagagccctggagagagcaccaagaagcaggacggcctggtgcagatcgcccccaacctgaccgtcatccagttcatcaaggtgttcccccgggtgctgctgcagaccctgcggcaccccatcttcctgctggtggtgctgagccaggtgtgcctgagctccatggccgccggcatggccatcttcctgcccaagttcctggagcggcagttcagcatcacagccagctatgccaacctgctgattggctgcctgtccttccccagcgtcatcgtgggcatcgtggtgggcggcgtgctggtgaagaggctgcacctgggccctgtgggctgtggggccctgtgcctgctgggcatgctgctgtgcctcttcttcagcctgcccctcttcttcatcggctgcagcagccaccagattgctggcatcacccaccagaccagcgcccaccctggcctggagctgagccccagctgcatggaggcctgcagctgccccctggatggcttcaaccctgtgtgtgaccccagcaccagggtggagtacatcaccccctgccacgccggctgcagctcctgggtggtgcaggatgccctggacaacagccaggtgttctacaccaactgcagctgtgtggtggagggcaaccctgtgctggccggcagctgtgacagcacctgcagccacctggtggtgcccttcctgctgctggtgtccctgggcagcgccctggcctgcctgacccacacccccagcttcatgctgatcctgcggggcgtgaagaaggaggacaagaccctggccgtgggcatccagttcatgttcctgcgcatcctggcctggatgcccagccctgtgatccacggcagcgccatcgacaccacctgtgtgcactgggccctgagctgtggcagaagagctgtgtgccgctactacaacaatgacctgctgaggaaccgcttcatcggcctgcagttcttcttcaagacaggcagcgtcatctgctttgccctggtgctggccgtgctgcggcagcaggacaaggaggcccggaccaaggagagccgcagcagccctgctgtggagcagcagctgctggtgtctggccctgggaagaagccagaggacagccgggtgtag

SEQ ID NO: 38458 - DNA, 1449 bp, Artificial Sequence
  Description of Artificial Sequence: Synthetic coding sequence
atgattggctacggggccatcctggtggccctggccggcctgctgatgaccctgccccacttcatcagcgagccctaccgctatgacaacaccagccctgggggcatcagcctgaccatcaaggacccccgctgggtgggcgcctggtggctgggcttcctgattgctgctggagctgtggccctggccgccatcccctacttcttcttccccaaggagatgcccaaggagaagcgggagctgcagttccggaggaaggtgctggccgtgacagacagccctgccaggaagggcaaggacagccccagcaagcagagccctggagagagcaccaagaagcaggacggcctggtgcagatcgcccccaacctgaccgtcatccagttcatcaaggtgttcccccgggtgctgctgcagaccctgcggcaccccatcttcctgctggtggtgctgagccaggtgtgcctgagctccatggctgctggcatggccatcttcctgcccaagttcctggagcggcagttcagcatcacagccagctatgccaacctgctgattggctgcctgtccttccccagcgtgattgtgggcatcgtggtgggcggcgtgctggtgaagaggctgcacctgggccctgtgggctgtggggccctgtgcctgctgggcatgctgctgtgcctcttcttcagcctgcccctcttcttcatcggctgcagcagccaccagattgctggcatcacccaccagaccagcgcccaccctggcctggagctgagccccagctgcatggaggcctgcagctgccccctggatggcttcaaccctgtgtgtgaccccagcaccagggtggagtacatcaccccctgccacgccggctgcagctcctgggtggtgcaggatgccctggacaacagccaggtgttctacaccaactgcagctgtgtggtggagggcaaccctgtgctggccggcagctgtgacagcacctgcagccacctggtggtgcccttcctgctgctggtgtccctgggcagcgccctggcctgcctgacccacacccccagcttcatgctgatcctgcggggcgtgaagaaggaggacaagaccctggccgtgggcatccagttcatgttcctgcgcatcctggcctggatgcccagccctgtgattcatggcagcgccatcgacaccacctgtgtgcactgggccctgagctgtggccggcgggctgtgtgccgctactacaacaatgacctgctgaggaaccgcttcatcggcctgcagttcttcttcaagacaggcagcgtcatctgctttgccctggtgctggccgtgctgcggcagcaggacaaggaggcccggaccaaggagagccgcagcagccctgctgtggagcagcagctgctggtgtctggccctgggaagaagccagaggacagccgggtgtag

SEQ ID NO: 38459 - DNA, 2064 bp, Artificial Sequence
  Description of Artificial Sequence: Synthetic coding sequence
atgggcacagagaacaccccaggcggcaaggccagcccagacccccaggatgtgcggcccagcgtcttccacaacatcaagctgtttgtgctgtgccacagcctgctgcagctggcccagctgatgatcagcggctacctgaagagcagcatcagcacagtggagaagcgcttcggcctgagcagccagaccagcggcctgctggccagcttcaatgaggtgggcaacacagccctgattgtgtttgtgtcctacttcggcagccgggtgcaccggcccaggatgattggctacggggccatcctggtggccctggccggcctgctgatgaccctgccccacttcatcagcgagccctaccgctatgacaacaccagccctgaggacatgccccaggacttcaaggccagcctgtgcctgcccaccaccagcgccccagccagcgcccccagcaatggaaactgcagcagctacacagagacccagcacctgtctgtggtgggcatcatgtttgtggcccagaccctgctgggcgtgggcggcgtgcccatccagcccttcggcatctcctacattgatgactttgcccacaacagcaacagccccctgtacctgggcatcctgtttgctgtgaccatgatgggccctggcctggccttcggcctgggcagcctgatgctgcggctgtatgtggacatcaaccagatgcctgagggcggcatcagcctgaccatcaaggacccccgctgggtgggcgcctggtggctgggcttcctgattgctgctggagctgtggccctggccgccatcccctacttcttcttccccaaggagatgcccaaggagaagcgggagctgcagttccggaggaaggtgctggccgtgacagacagccctgccaggaagggcaaggacagccccagcaagcagagccctggagagagcaccaagaagcaggacggcctggtgcagatcgcccccaacctgaccgtcatccagttcatcaaggtgttcccccgggtgctgctgcagaccctgcggcaccccatcttcctgctggtggtgctgagccaggtgtgcctgagctccatggccgccggcatggccatcttcctgcccaagttcctggagcggcagttcagcatcacagccagctatgccaacctgctgattggctgcctgtccttccccagcgtcatcgtgggcatcgtggtgggcggcgtgctggtgaagaggctgcacctgggccctgtgggctgtggggccctgtgcctgctgggcatgctgctgtgcctcttcttcagcctgcccctcttcttcatcggctgcagcagccaccagattgctggcatcacccaccagaccagcgcccaccctggcctggagctgagccccagctgcatggaggcctgcagctgccccctggatggcttcaaccctgtgtgtgaccccagcaccagggtggagtacatcaccccctgccacgccggctgcagctcctgggtggtgcaggatgccctggacaacagccaggtgttctacaccaactgcagctgtgtggtggagggcaaccctgtgctggccggcagctgtgacagcacctgcagccacctggtggtgcccttcctgctgctggtgtccctgggcagcgccctggcctgcctgacccacacccccagcttcatgctgatcctgcggggcgtgaagaaggaggacaagaccctggccgtgggcatccagttcatgttcctgcgcatcctggcctggatgcccagccctgtgatccacggcagcgccatcgacaccacctgtgtgcactgggccctgagctgtggcagaagagctgtgtgccgctactacaacaatgacctgctgaggaaccgcttcatcggcctgcagttcttcttcaagacaggcagcgtcatctgctttgccctggtgctggccgtgctgcggcagcaggacaaggaggcccggaccaaggagagccgcagcagccctgctgtggagcagcagctgctggtgtctggccctgggaagaagccagaggacagccgggtgtag

SEQ ID NO: 38460 - DNA, 1449 bp, Artificial Sequence; identical to SEQ ID NO: 38458
  Description of Artificial Sequence: Synthetic coding sequence

SEQ ID NO: 38461 - DNA, 1698 bp, Artificial Sequence
  Description of Artificial Sequence: Synthetic coding sequence
atgggccccagaattgaggacatgccccaggacttcaaggccagcctgtgcctgcccaccaccagcgccccagccagcgcccccagcaatggaaactgcagcagctacacagagacccagcacctgtctgtggtgggcatcatgtttgtggcccagaccctgctgggcgtgggcggcgtgcccatccagcccttcggcatctcctacattgatgactttgcccacaacagcaacagccccctgtacctgggcatcctgtttgctgtgaccatgatgggccctggcctggccttcggcctgggcagcctgatgctgcggctgtatgtggacatcaaccagatgcctgagggcggcatcagcctgaccatcaaggacccccgctgggtgggcgcctggtggctgggcttcctgattgctgctggagctgtggccctggccgccatcccctacttcttcttccccaaggagatgcccaaggagaagcgggagctgcagttccggaggaaggtgctggccgtgacagacagccctgccaggaagggcaaggacagccccagcaagcagagccctggagagagcaccaagaagcaggacggcctggtgcagatcgcccccaacctgaccgtcatccagttcatcaaggtgttcccccgggtgctgctgcagaccctgcggcaccccatcttcctgctggtggtgctgagccaggtgtgcctgagctccatggccgccggcatggccatcttcctgcccaagttcctggagcggcagttcagcatcacagccagctatgccaacctgctgattggctgcctgtccttccccagcgtcatcgtgggcatcgtggtgggcggcgtgctggtgaagaggctgcacctgggccctgtgggctgtggggccctgtgcctgctgggcatgctgctgtgcctcttcttcagcctgcccctcttcttcatcggctgcagcagccaccagattgctggcatcacccaccagaccagcgcccaccctggcctggagctgagccccagctgcatggaggcctgcagctgccccctggatggcttcaaccctgtgtgtgaccccagcaccagggtggagtacatcaccccctgccacgccggctgcagctcctgggtggtgcaggatgccctggacaacagccaggtgttctacaccaactgcagctgtgtggtggagggcaaccctgtgctggccggcagctgtgacagcacctgcagccacctggtggtgcccttcctgctgctggtgtccctgggcagcgccctggcctgcctgacccacacccccagcttcatgctgatcctgcggggcgtgaagaaggaggacaagaccctggccgtgggcatccagttcatgttcctgcgcatcctggcctggatgcccagccctgtgatccacggcagcgccatcgacaccacctgtgtgcactgggccctgagctgtggcagaagagctgtgtgccgctactacaacaatgacctgctgaggaaccgcttcatcggcctgcagttcttcttcaagacaggcagcgtcatctgctttgccctggtgctggccgtgctgcggcagcaggacaaggaggcccggaccaaggagagccgcagcagccctgctgtggagcagcagctgctggtgtctggccctgggaagaagccagaggacagccgggtgtag

SEQ ID NO: 38462 - DNA, 135 bp, Artificial Sequence
  Description of Artificial Sequence: Synthetic coding sequence
atgggcacagagaacaccccaggcggcaaggccagcccagacccccaggatgtgcggcccagcgtcttccacaacatcaagctgtttgtgctgtgccacagcctgctgcagctggcccagctgatgatctcctag

SEQ ID NO: 38463 - DNA, 453 bp, Artificial Sequence
  Description of Artificial Sequence: Synthetic coding sequence
atgggcacagagaacaccccaggcggcaaggccagcccagacccccaggatgtgcggcccagcgtcttccacaacatcaagctgtttgtgctgtgccacagcctgctgcagctggcccagctgatgatcagcggctacctgaagagcagcatcagcacagtggagaagcgcttcggcctgagcagccagaccagcggcctgctggccagcttcaatgaggtgggcaacacagccctgattgtgtttgtgtcctacttcggcagccgggtgcaccggcccaggatgattggctacggggccatcctggtggccctggccggcctgctgatgaccctgccccacttcatcagcgagccctaccgctatgacaacaccagccctgaggacatgccccaggacttcaaggccagcctgtgcctgcccaccaccagcgccccagccagcgccccctag

SEQ ID NO: 38464 - DNA, 135 bp, Artificial Sequence; identical to SEQ ID NO: 38462
  Description of Artificial Sequence: Synthetic coding sequence

SEQ ID NO: 38465 - DNA, 264 bp, Artificial Sequence
  Description of Artificial Sequence: Synthetic coding sequence
atgggcacagagaacaccccaggcggcaaggccagcccagacccccaggatgtgcggcccagcgtcttccacaacatcaagctgtttgtgctgtgccacagcctgctgcagctggcccagctgatgatcagcggctacctgaagagcagcatcagcacagtggagaagcgcttcggcctgagcagccagaccagcggcctgctggccagcttcaatgaggtgggcaacacagccctgattgtgtttgtgtcctacttcggctag

SEQ ID NO: 38466 - DNA, 1782 bp, Artificial Sequence
  Description of Artificial Sequence: Synthetic coding sequence
atgattggctacggggccatcctggtggccctggccggcctgctgatgaccctgccccacttcatcagcgagccctaccgctatgacaacaccagccctgaggacatgccccaggacttcaaggccagcctgtgcctgcccaccaccagcgccccagccagcgcccccagcaatggaaactgcagcagctacacagagacccagcacctgtctgtggtgggcatcatgtttgtggcccagaccctgctgggcgtgggcggcgtgcccatccagcccttcggcatctcctacattgatgactttgcccacaacagcaacagccccctgtacctgggcatcctgtttgctgtgaccatgatgggccctggcctggccttcggcctgggcagcctgatgctgcggctgtatgtggacatcaaccagatgcctgagggcggcatcagcctgaccatcaaggacccccgctgggtgggcgcctggtggctgggcttcctgattgctgctggagctgtggccctggccgccatcccctacttcttcttccccaaggagatgcccaaggagaagcgggagctgcagttccggaggaaggtgctggccgtgacagacagccctgccaggaagggcaaggacagccccagcaagcagagccctggagagagcaccaagaagcaggacggcctggtgcagatcgcccccaacctgaccgtcatccagttcatcaaggtgttcccccgggtgctgctgcagaccctgcggcaccccatcttcctgctggtggtgctgagccaggtgtgcctgagctccatggccgccggcatggccatcttcctgcccaagttcctggagcggcagttcagcatcacagccagctatgccaacctgctgattggctgcctgtccttccccagcgtcatcgtgggcatcgtggtgggcggcgtgctggtgaagaggctgcacctgggccctgtgggctgtggggccctgtgcctgctgggcatgctgctgtgcctcttcttcagcctgcccctcttcttcatcggctgcagcagccaccagattgctggcatcacccaccagaccagcgcccaccctggcctggagctgagccccagctgcatggaggcctgcagctgccccctggatggcttcaaccctgtgtgtgaccccagcaccagggtggagtacatcaccccctgccacgccggctgcagctcctgggtggtgcaggatgccctggacaacagccaggtgttctacaccaactgcagctgtgtggtggagggcaaccctgtgctggccggcagctgtgacagcacctgcagccacctggtggtgcccttcctgctgctggtgtccctgggcagcgccctggcctgcctgacccacacccccagcttcatgctgatcctgcggggcgtgaagaaggaggacaagaccctggccgtgggcatccagttcatgttcctgcgcatcctggcctggatgcccagccctgtgatccacggcagcgccatcgacaccacctgtgtgcactgggccctgagctgtggcagaagagctgtgtgccgctactacaacaatgacctgctgaggaaccgcttcatcggcctgcagttcttcttcaagacaggcagcgtcatctgctttgccctggtgctggccgtgctgcggcagcaggacaaggaggcccggaccaaggagagccgcagcagccctgctgtggagcagcagctgctggtgtctggccctgggaagaagccagaggacagccgggtgtag

SEQ ID NO: 38467 - DNA, 135 bp, Artificial Sequence; identical to SEQ ID NO: 38462
  Description of Artificial Sequence: Synthetic coding sequence

SEQ ID NO: 38468 - DNA, 384 bp, Artificial Sequence
  Description of Artificial Sequence: Synthetic coding sequence
atgggcacagagaacaccccaggcggcaaggccagcccagacccccaggatgtgcggcccagcgtcttccacaacatcaagctgtttgtgctgtgccacagcctgctgcagctggcccagctgatgatcagcggctacctgaagagcagcatcagcacagtggagaagcgcttcggcctgagcagccagaccagcggcctgctggccagcttcaatgaggtgggcaacacagccctgattgtgtttgtgtcctacttcggcagccgggtgcaccggcccaggatgattggctacggggccatcctggtggccctggccggcctgctgatgaccctgccccacttcatcagcgagccctaccgctatgacaacaccagcccctag

SEQ ID NO: 38469 - DNA, 2175 bp, Artificial Sequence
  Description of Artificial Sequence: Synthetic coding sequence
atgaagagcgccaagggcatcgagaacctggcctttgtgcccagcagcccagacatcctgcggcggctgagcgccagccccagccagatcgaggtgtctgccctgagcagtgacccccagcgggagaacagccagccccaggagctgcagaagccccaggagccccagaagagccctgagcccagcctgcccagcgcccccccaaatgtgtctgaggagaagctgcggagcctgagcctgtctgaatttgaggagggcagctatggctggaggaacttccacccccagtgcctgcagcgctgcaacacccctgggggcttcctgctgcactactgcctgctggccgtgacccagggcatcgtggtgaatggcctggtgaacatcagcatcagcacagtggagaagagatatgagatgaagagcagcctgaccggcctcatcagcagcagctatgacatctccttctgcctgctgagcctgtttgtgtccttctttggagagcggggccacaagccccgctggctggcctttgctgccttcatgattggcctgggcgccctggtgttcagcctgccccagttcttcagcggggagtacaagctgggcagcctgtttgaggacacctgtgtgaccaccaggaacagcaccagctgcaccagcagcaccagcagcctgagcaactacctgtatgtgttcatcctgggccagctgctgctgggcgccggcggcacccccctgtacaccctgggcacagccttcctggatgattctgtgcccacccacaagagcagcctgtacatcggcaccggctacgccatgagcatcctgggccctgccatcggctacgtgctgggcggccagctgctgaccatctacattgatgtggccatgggagagagcacagatgtgacagaagatgacccccgctggctgggcgcctggtggattggcttcctgctgtcctggatctttgcctggagcctcatcatccccttcagctgcttccccaagcacctgcccggcacagctgagatccaggccggcaagaccagccaggcccaccagagcaacagcaatgctgatgtgaagtttgggaagagcatcaaggacttccctgctgccctgaagaacctgatgaagaatgctgtgttcatgtgcctggtgctgagcaccagcagcgaggccctgatcaccactggatttgccaccttcctgcccaagttcatcgagaaccagtttggcctgaccagcagctttgctgccaccctgggcggcgctgtgctgatccctggggccgccctgggccagatcctgggcggcttcctggtgtccaagttcaggatgacctgcaagaacaccatgaagtttgccctcttcaccagcggcgtggccctgaccctgagctttgtgttcatgtatgccaagtgtgaaaatgagccctttgctggggtgtctgagagctacaatggaactggagagctgggcaacctgattgccccctgcaatgccaactgcaactgcagccgcagctactactaccctgtgtgtggagatggagtgcagtacttcagcccctgctttgctggctgcagcaaccctgtggcccacaggaagcccaaggtgtactacaactgcagctgcatcgagaggaagacagagatcaccagcacagctgagacctttggatttgaggccaaggccgggaaatgtgagacccactgtgccaagctgcccatcttcctgtgcatcttcttcatcgtcatcatcttcaccttcatggccggcacccccatcaccgtgtccatcctgcgctgtgtgaaccaccggcagaggagcctggccctgggcatccagttcatggtgctgcggctgctgggcaccatccctggccccatcatcttcggcttcaccatcgacagcacctgcatcctgtgggacatcaatgactgtggcatcaagggggcctgctggatctatgacaacatcaagatggcccacatgctggtggccatctctgtgacctgcaaggtgatcaccatgttcttcaatggatttgccatcttcctgtacaagcccccaccttctgccacagatgtgtccttccacaaggaaaatgctgtggtgaccaacgtgctggccgagcaggacctgaacaagatcgtgaaggagggctag

SEQ ID NO: 38470 - DNA, 2547 bp, Artificial Sequence
  Description of Artificial Sequence: Synthetic coding sequence
atggatgagggcaccggcctgcagcctggagctggggagcagctggaggccccagccacagctgaggccgtgcaggagcgctgtgagcctgagaccctgcggagcaagagcctgcctgtgctgagcagcgccagctgccggcccagcctgagccccaccagcggagatgccaacccagccttcggctgtgtggacagcagcggccaccaggagctgaagcagggccccaaccccctggcccccagccccagcgcccccagcaccagcgctggcctgggggactgcaaccaccgggtggacctgagcaagaccttctctgtgtcctctgccctggccatgctgcaggagcggcgctgcctgtatgtggtgctgacagacagccgctgcttcctggtgtgcatgtgcttcctgaccttcatccaggccctgatggtgtctggctacctgagcagcgtcatcaccaccatcgagcggcgctacagcctgaagagcagcgagagcggcctgctggtgtcctgctttgacatcggcaacctggtggtggtggtgtttgtgtcctactttggaggccggggcagaagacccctgtggctggccgtgggcggcctgctgattgcctttggagctgccctgtttgccctgccccacttcatcagccccccctaccagatccaggagctgaatgccagcgccccaaatgatggcctgtgccagggcggcaacagcacagccaccctggagcccccagcctgccccaaggacagcggcggcaacaaccactgggtgtatgtggccctcttcatctgtgcccagatcctgattggcatgggcagcacccccatctacaccctgggccccacctacctggatgacaacgtgaagaaggagaacagcagcctgtacctggccatcatgtatgtgatgggcgccctgggccctgctgtgggctacctgctgggcggcctgctgattggcttctacgtggaccccagaaatcctgtgcacctggaccagaatgacccccgcttcatcggcaactggtggagcggcttcctgctgtgtgccatcgccatgttcctggtgatcttccccatgttcaccttccccaagaagctgcccccaagacacaagaagaagaagaagaagaagttctctgtggatgctgtgtctgatgatgatgtgctgaaggagaagagcaacaacagcgagcaggccgacaagaaggtgtcctccatgggctttgggaaggatgtgcgggacctgcccagggctgctgtgcgcatcctgagcaacatgaccttcctgtttgtgtccctgagctacacagctgagagcgccatcgtgacagccttcatcaccttcatccccaagttcatcgagagccagtttggcatcccagccagcaatgccagcatctacacaggagtcatcatcgtgcccagcgctggggtgggcatcgtgctgggcggctacatcatcaagaagctgaagctgggcgcccgggagagcgccaagctggccatgatctgcagcggcgtgtccctgctgtgcttcagcaccctcttcatcgtgggctgtgagagcatcaacctgggcggcatcaacatcccctacaccaccggccccagcctgaccatgccccacaggaacctgaccggcagctgcaatgtgaactgtggctgcaagatccacgagtatgagcctgtgtgtggcagtgatggcatcacctacttcaacccctgcctggccggctgtgtgaacagcggcaacctgagcacaggcatccggaactacacagagtgcacctgtgtgcagagccggcaggtgatcaccccacccaccgtgggccagaggagccagctgcgggtggtgattgtgaagacctacctgaatgaaaatggctatgctgtgtctgggaagtgcaagaggacctgcaacaccctcatccccttcctggtgttcctgttcatcgtgaccttcatcacagcctgtgcccagcccagcgccatcatcgtgaccctgcggtctgtggaggatgaggagcggccctttgccctgggcatgcagtttgtgctgctgcggaccctggcctacatccccacccccatctactttggagctgtgattgacaccacctgcatgctgtggcagcaggagtgtggggtgcagggcagctgctgggagtacaacgtgaccagcttccgctttgtgtacttcggcctggccgccggcctgaagtttgtgggcttcatcttcatcttcctggcctggtacagcatcaagtacaaggaggatggcctgcagaggcggcggcagcgggagttccccctgagcacagtgtctgagcgggtgggccacccagacaatgcccggaccaggagctgcccagccttcagcacccagggcgagttccacgaggagaccggcctgcagaagggcatccagtgtgccgcccagacctacccaggccccttccctgaggccatcagcagcagcgctgaccccggcctggaggagagccctgctgccctggagccccccagctag

SEQ ID NO: 38471 - DNA, 2382 bp, Artificial Sequence
  Description of Artificial Sequence: Synthetic coding sequence
atggatgagggcaccggcctgcagcctggagctggggagcagctggaggccccagccacagctgaggccgtgcaggagcgctgtgagcctgagaccctgcggagcaagagcctgcctgtgctgagcagcgccagctgccggcccagcctgagccccaccagcggagatgccaacccagccttcggctgtgtggacagcagcggccaccaggagctgaagcagggccccaaccccctggcccccagccccagcgcccccagcaccagcgctggcctgggggactgcaaccaccgggtggacctgagcaagaccttctctgtgtcctctgccctggccatgctgcaggagcggcgctgcctgtatgtggtgctgacagacagccgctgcttcctggtgtgcatgtgcttcctgaccttcatccaggccctgatggtgtctggctacctgagcagcgtcatcaccaccatcgagcggcgctacagcctgaagagcagcgagagcggcctgctggtgtcctgctttgacatcggcaacctggtggtggtggtgtttgtgtcctactttggaggccggggcagaagacccctgtggctggccgtgggcggcctgctgattgcctttggagctgccctgtttgccctgccccacttcatcagccccccctaccagatccaggagctgaatgccagcgccccaaatgatggcctgtgccagggcggcaacagcacagccaccctggagcccccagcctgccccaaggacagcggcggcaacaaccactgggtgtatgtggccctcttcatctgtgcccagatcctgattggcatgggcagcacccccatctacaccctgggccccacctacctggatgacaacgtgaagaaggagaacagcagcctgtacctggccatcatgtatgtgatgggcgccctgggccctgctgtgggctacctgctgggcggcctgctgattggcttctacgtggaccccagaaatcctgtgcacctggaccagaatgacccccgcttcatcggcaactggtggagcggcttcctgctgtgtgccatcgccatgttcctggtgatcttccccatgttcaccttccccaagaagctgcccccaagacacaagaagaagaagaagaagaagttctctgtggatgctgtgtctgatgatgatgtgctgaaggagaagagcaacaacagcgagcaggccgacaagaaggtgtcctccatgggctttgggaaggatgtgcggggcgtcatcatcgtgcccagcgctggggtgggcatcgtgctgggcggctacatcatcaagaagctgaagctgggcgcccgggagagcgccaagctggccatgatctgcagcggcgtgtccctgctgtgcttcagcaccctcttcatcgtgggctgtgagagcatcaacctgggcggcatcaacatcccctacaccaccggccccagcctgaccatgccccacaggaacctgaccggcagctgcaatgtgaactgtggctgcaagatccatgaatatgagcctgtgtgtggcagtgatggcatcacctacttcaacccctgcctggccggctgtgtgaacagcggcaacctgagcacaggcatccggaactacacagaatgtacctgtgtgcagagccggcaggtgatcaccccacccaccgtgggccagaggagccagctgcgggtggtgattgtgaagacctacctgaatgaaaatggctatgctgtgtctgggaagtgcaagaggacctgcaacaccctcatccccttcctggtgttcctgttcatcgtgaccttcatcacagcctgtgcccagcccagcgccatcatcgtgaccctgcggtctgtggaggatgaggagcggccctttgccctgggcatgcagtttgtgctgctgcggaccctggcctacatccccacccccatctactttggagctgtgattgacaccacctgcatgctgtggcagcaggagtgtggggtgcagggcagctgctgggagtacaacgtgaccagcttccgctttgtgtacttcggcctggccgccggcctgaagtttgtgggcttcatcttcatcttcctggcctggtacagcatcaagtacaaggaggatggcctgcagaggcggcggcagcgggagttccccctgagcacagtgtctgagcgggtgggccacccagacaatgcccggaccaggagctgcccagccttcagcacccagggcgagttccacgaggagaccggcctgcagaagggcatccagtgtgccgcccagacctacccaggccccttccctgaggccatcagcagcagcgctgaccccggcctggaggagagccctgctgccctggagccccccagctag

SEQ ID NO: 38472 - DNA, 606 bp, Artificial Sequence
  Description of Artificial Sequence: Synthetic coding sequence
atgtttcctgagcagcagaaggaggagtttgtgtctgtgtgggtgcgggacccccgcatccagaaggaggacttctggcacagctacatcgactatgagatctgcatccacaccaacagcatgtgcttcaccatgaagaccagctgtgtgagaagacgctaccgggagtttgtgtggctgcggcagaggctgcagagcaatgccctgctggtgcagctgcctgagctgcccagcaagaacctcttcttcaacatgaacaaccggcagcacgtggaccagaggcggcagggcctggaggacttcctgaggaaggtgctgcagaatgccctgctgctgagtgacagcagcctgcacctgttcctgcagagccacctgaacagcgaggacatcgaggcctgtgtgtctggccagaccaagtacagcgtggaggaggccatccacaagtttgccctgatgaacagacgcttcccagaagaagatgaggagggcaagaaggaaaatgacattgattatgattctgagagcagcagcagcggcctgggccacagcagtgatgacagcagcagccacggctgcaaggtgaacacagccccccaggagagctag

SEQ ID NO: 38473 - DNA, 606 bp, Artificial Sequence; identical to SEQ ID NO: 38472
  Description of Artificial Sequence: Synthetic coding sequence

SEQ ID NO: 38474 - DNA, 684 bp, Artificial Sequence
  Description of Artificial Sequence: Synthetic coding sequence
atgatcctgatggagggcatcggctgcatgaggcacagcagcctgacccggcagcccaagctgccctaccgcagcctggccagcgcccggggcggcctgcaggagtttgtgtctgtgtgggtgcgggacccccgcatccagaaggaggacttctggcacagctacatcgactatgagatctgcatccacaccaacagcatgtgcttcaccatgaagaccagctgtgtgagaagacgctaccgggagtttgtgtggctgcggcagaggctgcagagcaatgccctgctggtgcagctgcctgagctgcccagcaagaacctcttcttcaacatgaacaaccggcagcacgtggaccagaggcggcagggcctggaggacttcctgaggaaggtgctgcagaatgccctgctgctgagtgacagcagcctgcacctgttcctgcagagccacctgaacagcgaggacatcgaggcctgtgtgtctggccagaccaagtacagcgtggaggaggccatccacaagtttgccctgatgaacagacgcttcccagaagaagatgaggagggcaagaaggaaaatgacattgattatgattctgagagcagcagcagcggcctgggccacagcagtgatgacagcagcagccacggctgcaaggtgaacacagccccccaggagagctag

SEQ ID NO: 38475 - DNA, 354 bp, Artificial Sequence
  Description of Artificial Sequence: Synthetic coding sequence
atgaacaaccggcagcacgtggaccagaggcggcagggcctggaggacttcctgaggaaggtgctgcagaatgccctgctgctgagtgacagcagcctgcacctgttcctgcagagccacctgaacagcgaggacatcgaggcctgtgtgtctggccagaccaagtacagcgtggaggaggccatccacaagtttgccctgatgaacagacgcttcccagaagaagatgaggagggcaagaaggaaaatgacattgattatgattctgagagcagcagcagcggcctgggccacagcagtgatgacagcagcagccacggctgcaaggtgaacacagccccccaggagagctag

SEQ ID NO: 38476 - DNA, 2841 bp, Artificial Sequence
  Description of Artificial Sequence: Synthetic coding sequence
atggtgccctgggtgaggaccatgggccagaagctgaagcagaggctgcggctggatgtgggccgggagatctgccggcagtaccccctcttctgcttcctgctgctgtgcctgtctgctgccagcctgctgctgaaccgctacatccacatcctgatgatcttctggagctttgtggccggcgtggtgaccttctactgcagcctgggccctgacagcctgctgcccaacatcttcttcaccatcaagtacaagcccaagcagctgggcctgcaggagctgttcccccagggccacagctgtgctgtgtgtgggaaggtgaagtgcaagaggcaccggcccagcctgctgctggagaactaccagccctggctggacctgaagatcagcagcaaggtggatgccagcctgtctgaggtgctggagctggtgctggagaactttgtgtacccctggtacagagatgtgacagatgatgagagctttgtggatgagctgcgcatcaccctgcgcttctttgcctctgtgctgatccgccgcatccacaaggtggacatccccagcatcatcaccaagaagctgctgaaggccgccatgaagcacatcgaggtgattgtgaaggcccggcagaaggtgaagaacacagagttcctgcagcaggccgccctggaggagtatggccctgagctgcacgtggccctgcggagcagaagagatgagctgcactacctgaggaagctgacagagctgctcttcccctacatcctgccccccaaggccacagactgccgcagcctgaccctgctgatccgggagatcctgagcggctctgtgttcctgcccagcctggacttcctggccgaccctgacacagtgaaccacctgctgatcatcttcattgatgacagccccccagagaaggccacagagcccgccagccccctggtgcccttcctgcagaagtttgctgagcccaggaacaagaagcccagcgtgctgaagctggagctgaagcagatccgggagcagcaggacctgctcttccgcttcatgaacttcctgaagcaggagggcgctgtgcacgtgctgcagttctgcctgactgtggaggagttcaatgaccgcatcctgcggcctgagctgagcaatgatgagatgctgagcctgcacgaggagctgcagaagatctacaagacctactgcctggatgagagcattgacaagatccgctttgaccccttcatcgtggaggagatccagagaattgctgagggcccctacattgatgtggtgaagctgcagaccatgcgctgcctgtttgaggcctatgaacatgtgctgagcctgctggagaatgtgttcacccccatgttctgccacagtgatgagtacttccggcagctgctgcggggagctgagagccccaccaggaacagcaagctgaacagaggcagcctgagcctggatgacttcaggaacacccagaagagaggagagagctttggcatcagccgcatcggcagcaagatcaagggcgtcttcaagagcaccaccatggagggcgccatgctgcccaactatggagtggccgagggagaagatgacttcatcgaggagggcatcgtggtgatggaggatgacagccctgtggaggccgtgtccacccccaacacccccaggaacctggccgcctggaagatcagcatcccctacgtggacttctttgaggaccccagcagcgagaggaaggagaagaaggagcgcatccctgtgttctgcattgatgtggagagaaatgacagaagagctgtgggccacgagcctgagcactggagcgtgtaccgccgctacctggagttctacgtgctggagagcaagctgacagagttccatggagccttcccagatgcccagctgcccagcaagaggatcatcggccccaagaactatgagttcctgaagagcaagcgggaggagttccaggagtacctgcagaagctgctgcagcaccctgagctgagcaacagccagctgctggccgacttcctgagccccaacggcggggagacccagttcctggacaagatcctgcctgatgtgaacctgggcaagatcatcaagtctgtgcctgggaagctgatgaaggagaagggccagcacctggagcccttcatcatgaacttcatcaacagctgtgagagccccaagcccaagcccagcaggcctgagctgaccatcctgagccccaccagcgagaacaacaagaagctgttcaatgacctcttcaagaacaatgccaacagagctgagaacacagagaggaagcagaaccagaactacttcatggaggtgatgacagtggagggcgtgtatgactacctgatgtatgtgggccgggtggtgttccaggtgcctgactggctgcaccacctgctgatgggcacccgcatcctcttcaagaacaccctggagatgtacacagactactacctgcagtgcaagctggagcagctgttccaggagcaccggctggtgtccctcatcaccctgctgagagatgccatcttctgtgagaacacagagcccaggagcctgcaggacaagcagaagggggccaagcagacctttgaggagatgatgaactacatcccagacctgctggtgaagtgcattggagaggagaccaagtatgagagcatccggctgctgtttgatggcctgcagcagcctgtgctgaacaagcagctgacctacgtgctgctggacatcgtcatccaggagctgtttcctgagctgaacaaggtgcagaaggaggtgacctctgtgacctcctggatgtag

SEQ ID NO: 38477 - DNA, 2682 bp, Artificial Sequence
  Description of Artificial Sequence: Synthetic coding sequence
atggtgccctgggtgaggaccatgggccagaagctgaagcagaggctgcggctggatgtgggccgggagatctgccggcagtaccccctcttctgcttcctgctgctgtgcctgtctgctgccagcctgctgctgaaccgctacatccacatcctgatgatcttctggagctttgtggccggcgtggtgaccttctactgcagcctgggccctgacagcctgctgcccaacatcttcttcaccatcaagtacaagcccaagcagctgggcctgcaggagctgttcccccagggccacagctgtgctgtgtgtgggaaggtgaagtgcaagaggcaccggcccagcctgctgctggagaactaccagccctggctggacctgaagatcagcagcaaggtggatgccagcctgtctgaggtggacatccccagcatcatcaccaagaagctgctgaaggccgccatgaagcacatcgaggtgattgtgaaggcccggcagaaggtgaagaacacagagttcctgcagcaggccgccctggaggagtatggccctgagctgcacgtggccctgcggagcagaagagatgagctgcactacctgaggaagctgacagagctgctcttcccctacatcctgccccccaaggccacagactgccgcagcctgaccctgctgatccgggagatcctgagcggctctgtgttcctgcccagcctggacttcctggccgaccctgacacagtgaaccacctgctgatcatcttcattgatgacagccccccagagaaggccacagagcccgccagccccctggtgcccttcctgcagaagtttgctgagcccaggaacaagaagcccagcgtgctgaagctggagctgaagcagatccgggagcagcaggacctgctcttccgcttcatgaacttcctgaagcaggagggcgctgtgcacgtgctgcagttctgcctgactgtggaggagttcaatgaccgcatcctgcggcctgagctgagcaatgatgagatgctgagcctgcacgaggagctgcagaagatctacaagacctactgcctggatgagagcattgacaagatccgctttgaccccttcatcgtggaggagatccagagaattgctgagggcccctacattgatgtggtgaagctgcagaccatgcgctgcctgtttgaggcctatgaacatgtgctgagcctgctggagaatgtgttcacccccatgttctgccacagtgatgagtacttccggcagctgctgcggggagctgagagccccaccaggaacagcaagctgaacagaaacacccagaagagaggagagagctttggcatcagcagaattggcagcaagatcaagggcgtcttcaagagcaccaccatggagggcgccatgctgcccaactacggcgtggccgagggggaggatgacttcatcgaggagggcatcgtggtgatggaggatgacagccctgtggaggccgtgtccacccccaacaccccaagaaacctggccgcctggaagatcagcatcccctacgtggacttctttgaggaccccagcagcgagaggaaggagaagaaggagcgcatccctgtgttctgcattgatgtggagagaaatgaccggcgggctgtgggccacgagcctgagcactggagcgtgtaccgccgctacctggagttctacgtgctggagagcaagctgacagagttccacggggccttcccagatgcccagctgcccagcaagaggatcatcggccccaagaactatgagttcctgaagagcaagcgggaggagttccaggagtacctgcagaagctgctgcagcaccctgagctgagcaacagccagctgctggccgacttcctgagccccaatggaggagagacccagttcctggacaagatcctgcctgatgtgaacctgggcaagatcatcaagtctgtgcctgggaagctgatgaaggagaagggccagcacctggagcccttcatcatgaacttcatcaacagctgtgagagccccaagcccaagcccagcaggcctgagctgaccatcctgagccccaccagcgagaacaacaagaagctgttcaatgacctcttcaagaacaatgccaacagagcagaaaatacagagaggaagcagaaccagaactacttcatggaggtgatgacagtggagggcgtgtatgactacctgatgtatgtgggccgggtggtgttccaggtgcctgactggctgcaccacctgctgatgggcacccgcatcctcttcaagaacaccctggagatgtacacagactactacctgcagtgcaagctggagcagctgttccaggagcaccggctggtgtccctcatcaccctgctgagagatgccatcttctgtgaaaatacagagcccaggagcctgcaggacaagcagaagggggccaagcagacctttgaggagatgatgaactacatcccagacctgctggtgaagtgcatcggggaggagaccaagtatgagagcatccggctgctgtttgatggcctgcagcagcctgtgctgaacaagcagctgacctacgtgctgctggacatcgtcatccaggagctgtttcctgagctgaacaaggtgcagaaggaggtgacctctgtgacctcctggatgtag

SEQ ID NO: 38478 - DNA, 2814 bp, Artificial Sequence
  Description of Artificial Sequence: Synthetic coding sequence
atggtgccctgggtgaggaccatgggccagaagctgaagcagaggctgcggctggatgtgggccgggagatctgccggcagtaccccctcttctgcttcctgctgctgtgcctgtctgctgccagcctgctgctgaaccgctacatccacatcctgatgatcttctggagctttgtggccggcgtggtgaccttctactgcagcctgggccctgacagcctgctgcccaacatcttcttcaccatcaagtacaagcccaagcagctgggcctgcaggagctgttcccccagggccacagctgtgctgtgtgtgggaaggtgaagtgcaagaggcaccggcccagcctgctgctggagaactaccagccctggctggacctgaagatcagcagcaaggtggatgccagcctgtctgaggtgctggagctggtgctggagaactttgtgtacccctggtacagagatgtgacagatgatgagagctttgtggatgagctgcgcatcaccctgcgcttctttgcctctgtgctgatccgccgcatccacaaggtggacatccccagcatcatcaccaagaagctgctgaaggccgccatgaagcacatcgaggtgattgtgaaggcccggcagaaggtgaagaacacagagttcctgcagcaggccgccctggaggagtatggccctgagctgcacgtggccctgcggagcagaagagatgagctgcactacctgaggaagctgacagagctgctcttcccctacatcctgccccccaaggccacagactgccgcagcctgaccctgctgatccgggagatcctgagcggctctgtgttcctgcccagcctggacttcctggccgaccctgacacagtgaaccacctgctgatcatcttcattgatgacagccccccagagaaggccacagagcccgccagccccctggtgcccttcctgcagaagtttgctgagcccaggaacaagaagcccagcgtgctgaagctggagctgaagcagatccgggagcagcaggacctgctcttccgcttcatgaacttcctgaagcaggagggcgctgtgcacgtgctgcagttctgcctgactgtggaggagttcaatgaccgcatcctgcggcctgagctgagcaatgatgagatgctgagcctgcacgaggagctgcagaagatctacaagacctactgcctggatgagagcattgacaagatccgctttgaccccttcatcgtggaggagatccagagaattgctgagggcccctacattgatgtggtgaagctgcagaccatgcgctgcctgtttgaggcctatgaacatgtgctgagcctgctggagaatgtgttcacccccatgttctgccacagtgatgagtacttccggcagctgctgcggggagctgagagccccaccaggaacagcaagctgaacagaaacacccagaagagaggagagagctttggcatcagcagaattggcagcaagatcaagggcgtcttcaagagcaccaccatggagggcgccatgctgcccaactacggcgtggccgagggggaggatgacttcatcgaggagggcatcgtggtgatggaggatgacagccctgtggaggccgtgtccacccccaacaccccaagaaacctggccgcctggaagatcagcatcccctacgtggacttctttgaggaccccagcagcgagaggaaggagaagaaggagcgcatccctgtgttctgcattgatgtggagagaaatgaccggcgggctgtgggccacgagcctgagcactggagcgtgtaccgccgctacctggagttctacgtgctggagagcaagctgacagagttccacggggccttcccagatgcccagctgcccagcaagaggatcatcggccccaagaactatgagttcctgaagagcaagcgggaggagttccaggagtacctgcagaagctgctgcagcaccctgagctgagcaacagccagctgctggccgacttcctgagccccaatggaggagagacccagttcctggacaagatcctgcctgatgtgaacctgggcaagatcatcaagtctgtgcctgggaagctgatgaaggagaagggccagcacctggagcccttcatcatgaacttcatcaacagctgtgagagccccaagcccaagcccagcaggcctgagctgaccatcctgagccccaccagcgagaacaacaagaagctgttcaatgacctcttcaagaacaatgccaacagagcagaaaatacagagaggaagcagaaccagaactacttcatggaggtgatgacagtggagggcgtgtatgactacctgatgtatgtgggccgggtggtgttccaggtgcctgactggctgcaccacctgctgatgggcacccgcatcctcttcaagaacaccctggagatgtacacagactactacctgcagtgcaagctggagcagctgttccaggagcaccggctggtgtccctcatcaccctgctgagagatgccatcttctgtgaaaatacagagcccaggagcctgcaggacaagcagaagggggccaagcagacctttgaggagatgatgaactacatcccagacctgctggtgaagtgcatcggggaggagaccaagtatgagagcatccggctgctgtttgatggcctgcagcagcctgtgctgaacaagcagctgacctacgtgctgctggacatcgtcatccaggagctgtttcctgagctgaacaaggtgcagaaggaggtgacctctgtgacctcctggatgtag

SEQ ID NO: 38479 - DNA, 1047 bp, Artificial Sequence
  Description of Artificial Sequence: Synthetic coding sequence
atggaggatgacagccctgtggaggccgtgtccacccccaacaccccaagaaacctggccgcctggaagatcagcatcccctacgtggacttctttgaggaccccagcagcgagaggaaggagaagaaggagcgcatccctgtgttctgcattgatgtggagagaaatgaccggcgggctgtgggccacgagcctgagcactggagcgtgtaccgccgctacctggagttctacgtgctggagagcaagctgacagagttccacggggccttcccagatgcccagctgcccagcaagaggatcatcggccccaagaactatgagttcctgaagagcaagcgggaggagttccaggagtacctgcagaagctgctgcagcaccctgagctgagcaacagccagctgctggccgacttcctgagccccaatggaggagagacccagttcctggacaagatcctgcctgatgtgaacctgggcaagatcatcaagtctgtgcctgggaagctgatgaaggagaagggccagcacctggagcccttcatcatgaacttcatcaacagctgtgagagccccaagcccaagcccagcaggcctgagctgaccatcctgagccccaccagcgagaacaacaagaagctgttcaatgacctcttcaagaacaatgccaacagagcagaaaatacagagaggaagcagaaccagaactacttcatggaggtgatgacagtggagggcgtgtatgactacctgatgtatgtggatgccatcttctgtgagaacacagagcccaggagcctgcaggacaagcagaagggggccaagcagacctttgaggagatgatgaactacatcccagacctgctggtgaagtgcattggagaggagaccaagtatgagagcatccggctgctgtttgatggcctgcagcagcctgtgctgaacaagcagctgacctacgtgctgctggacatcgtcatccaggagctgtttcctgagctgaacaaggtgcagaaggaggtgacctctgtgacctcctggatgtag

SEQ ID NO: 38480 - DNA, 2685 bp, Artificial Sequence
  Description of Artificial Sequence: Synthetic coding sequence
atgatcttctggagctttgtggccggcgtggtgaccttctactgcagcctgggccctgacagcctgctgcccaacatcttcttcaccatcaagtacaagcccaagcagctgggcctgcaggagctgttcccccagggccacagctgtgctgtgtgtgggaaggtgaagtgcaagaggcaccggcccagcctgctgctggagaactaccagccctggctggacctgaagatcagcagcaaggtggatgccagcctgtctgaggtgctggagctggtgctggagaactttgtgtacccctggtacagagatgtgacagatgatgagagctttgtggatgagctgcgcatcaccctgcgcttctttgcctctgtgctgatccgccgcatccacaaggtggacatccccagcatcatcaccaagaagctgctgaaggccgccatgaagcacatcgaggtgattgtgaaggcccggcagaaggtgaagaacacagagttcctgcagcaggccgccctggaggagtatggccctgagctgcacgtggccctgcggagcagaagagatgagctgcactacctgaggaagctgacagagctgctcttcccctacatcctgccccccaaggccacagactgccgcagcctgaccctgctgatccgggagatcctgagcggctctgtgttcctgcccagcctggacttcctggccgaccctgacacagtgaaccacctgctgatcatcttcattgatgacagccccccagagaaggccacagagcccgccagccccctggtgcccttcctgcagaagtttgctgagcccaggaacaagaagcccagcgtgctgaagctggagctgaagcagatccgggagcagcaggacctgctcttccgcttcatgaacttcctgaagcaggagggcgctgtgcacgtgctgcagttctgcctgactgtggaggagttcaatgaccgcatcctgcggcctgagctgagcaatgatgagatgctgagcctgcacgaggagctgcagaagatctacaagacctactgcctggatgagagcattgacaagatccgctttgaccccttcatcgtggaggagatccagagaattgctgagggcccctacattgatgtggtgaagctgcagaccatgcgctgcctgtttgaggcctatgaacatgtgctgagcctgctggagaatgtgttcacccccatgttctgccacagtgatgagtacttccggcagctgctgcggggagctgagagccccaccaggaacagcaagctgaacagaggcagcctgagcctggatgacttcaggaacacccagaagagaggagagagctttggcatcagccgcatcggcagcaagatcaagggcgtcttcaagagcaccaccatggagggcgccatgctgcccaactatggagtggccgagggagaagatgacttcatcgaggagggcatcgtggtgatggaggatgacagccctgtggaggccgtgtccacccccaacacccccaggaacctggccgcctggaagatcagcatcccctacgtggacttctttgaggaccccagcagcgagaggaaggagaagaaggagcgcatccctgtgttctgcattgatgtggagagaaatgacagaagagctgtgggccacgagcctgagcactggagcgtgtaccgccgctacctggagttctacgtgctggagagcaagctgacagagttccatggagccttcccagatgcccagctgcccagcaagaggatcatcggccccaagaactatgagttcctgaagagcaagcgggaggagttccaggagtacctgcagaagctgctgcagcaccctgagctgagcaacagccagctgctggccgacttcctgagccccaacggcggggagacccagttcctggacaagatcctgcctgatgtgaacctgggcaagatcatcaagtctgtgcctgggaagctgatgaaggagaagggccagcacctggagcccttcatcatgaacttcatcaacagctgtgagagccccaagcccaagcccagcaggcctgagctgaccatcctgagccccaccagcgagaacaacaagaagctgttcaatgacctcttcaagaacaatgccaacagagctgagaacacagagaggaagcagaaccagaactacttcatggaggtgatgacagtggagggcgtgtatgactacctgatgtatgtgggccgggtggtgttccaggtgcctgactggctgcaccacctgctgatgggcacccgcatcctcttcaagaacaccctggagatgtacacagactactacctgcagtgcaagctggagcagctgttccaggagcaccggctggtgtccctcatcaccctgctgagagatgccatcttctgtgagaacacagagcccaggagcctgcaggacaagcagaagggggccaagcagacctttgaggagatgatgaactacatcccagacctgctggtgaagtgcattggagaggagaccaagtatgagagcatccggctgctgtttgatggcctgcagcagcctgtgctgaacaagcagctgacctacgtgctgctggacatcgtcatccaggagctgtttcctgagctgaacaaggtgcagaaggaggtgacctctgtgacctcctggatgtag

SEQ ID NO: 38481 - DNA, 1035 bp, Artificial Sequence
  Description of Artificial Sequence: Synthetic coding sequence
atggccaccccctacgtgcctgtgcccatgcccatcggcaacagcgccagcagcttcaccaccaacagaaaccagaggagcagcagctttggatctgtgtccaccagcagcaacagcagcaagggccagctggaggacagcaacatgggcaacttcaagcagacctctgtgcctgaccagatggacaacaccagctctgtgtgcagcagccccctcatccgcaccaagttcaccggcacagccagcagcattgagtacagcacccggccccgggacacagaggagcagaaccctgagaccgtgaactgggaggaccggcccagcacccccaccatcctgggctatgaggtgatggaggagcgggccaagttcaccgtgtacaagatcctggtgaagaagaccccagaggagagctgggtggtgttccgccgctacacagacttcagccggctgaatgacaagctgaaggagatgtttcctggcttccggctggccctgccccccaagcgctggttcaaggacaactacaatgctgacttcctggaggaccggcagctgggcctgcaggccttcctgcagaacctggtggcccacaaggacatcgccaactgcctggccgtgcgggagttcctgtgcctggatgaccccccaggcccctttgacagcctggaggagagccgggccttctgtgagaccctggaggagaccaactaccgcctgcagaaggagctgctggagaagcagaaggagatggagagcctgaagaagctgctgtctgagaagcagctgcacatcgacaccctggagaaccgcatccgcaccctgagcctggagcctgaggagagcctggatgtgtctgaaacagaaggagagcagatcctgaaggtggagagcagcgccctggaggtggaccaggatgtgctggatgaggagagcagagctgacaacaagccctgcctgtccttcagcgagccagaaaatgctgtgtctgaaattgaggtggccgaggtggcctatgatgctgaagaagattag

SEQ ID NO: 38482 - DNA, 948 bp, Artificial Sequence
  Description of Artificial Sequence: Synthetic coding sequence
atggccaccccctacgtgcctgtgcccatgcccatcggcaacagcgccagcagcttcaccaccaacagaaaccagaggagcagcagctttggatctgtgtccaccagcagcaacagcagcaagggccagctggaggacagcaacatgggcaacttcaagcagacctctgtgcctgaccagatggacaacaccagctctgtgtgcagcagccccctcatccgcaccaagttcaccggcacagccagcagcattgagtacagcacccggccccgggacacagaggagcagaaccctgagaccgtgaactgggaggaccggcccagcacccccaccatcctgggctatgaggtgatggaggagcgggccaagttcaccctgaaggagatgtttcctggcttccggctggccctgccccccaagcgctggttcaaggacaactacaatgctgacttcctggaggaccggcagctgggcctgcaggccttcctgcagaacctggtggcccacaaggacatcgccaactgcctggccgtgcgggagttcctgtgcctggatgatcctcctggcccctttgacagcctggaggagagccgggccttctgtgagaccctggaggagaccaactaccgcctgcagaaggagctgctggagaagcagaaggagatggagagcctgaagaagctgctgtctgagaagcagctgcacatcgacaccctggagaaccgcatccgcaccctgagcctggagcctgaggagagcctggatgtgtctgaaacagaaggagagcagatcctgaaggtggagagcagcgccctggaggtggaccaggatgtgctggatgaggagagcagagctgacaacaagccctgcctgtccttcagcgagccagaaaatgctgtgtctgaaattgaggtggccgaggtggcctatgatgctgaggaggactag

SEQ ID NO: 38483 - DNA, 1035 bp, Artificial Sequence; identical to SEQ ID NO: 38481
  Description of Artificial Sequence: Synthetic coding sequence

SEQ ID NO: 38484 - DNA, 255 bp, Artificial Sequence
  Description of Artificial Sequence: Synthetic coding sequence
atggccaccccctacgtgcctgtgcccatgcccatcggcaacagcgccagcagcttcaccaccaacagaaaccagaggagcagcagctttggatctgtgtccaccagcagcaacagcagcaagggccagctggaggacagcaacatgggcaacttcaagcagacctctgtgcctgaccagatggacaacaccagctctgtgtgcagcagccccctcatccgcaccaagttcaccggcacagccagcagcatctag

SEQ ID NO: 38485 - DNA, 279 bp, Artificial Sequence
  Description of Artificial Sequence: Synthetic coding sequence
atggccaccccctacgtgcctgtgcccatgcccatcggcaacagcgccagcagcttcaccaccaacagaaaccagaggagcagcagctttggatctgtgtccaccagcagcaacagcagcaagggccagctggaggacagcaacatgggcaacttcaagcagacctctgtgcctgaccagatggacaacaccagctctgtgtgcagcagccccctcatccgcaccaagttcaccggcacagccagcagcattgagtacagcacccggccccgggactag

SEQ ID NO: 38486 - DNA, 111 bp, Artificial Sequence
  Description of Artificial Sequence: Synthetic coding sequence
atggccaccccctacgtgcctgtgcccatgcccatcggcaacagcgccagcagcttcaccaccaacagaaaccagaggagcagcagctttggatctgtgtccaccagctag

SEQ ID NO: 38487 - DNA, 612 bp, Artificial Sequence
  Description of Artificial Sequence: Synthetic coding sequence
atggccaccccctacgtgcctgtgcccatgcccatcggcaacagcgccagcagcttcaccaccaacagaaaccagaggagcagcagctttggatctgtgtccaccagcagcaacagcagcaagggccagctggaggacagcaacatgggcaacttcaagcagacctctgtgcctgaccagatggacaacaccagctctgtgtgcagcagccccctcatccgcaccaagttcaccggcacagccagcagcattgagtacagcacccggccccgggacacagaggagcagaaccctgagaccgtgaactgggaggaccggcccagcacccccaccatcctgggctatgaggtgatggaggagcgggccaagttcaccgtgtacaagatcctggtgaagaagaccccagaggagagctgggtggtgttccgccgctacacagacttcagccggctgaatgacaagctgaaggagatgtttcctggcttccggctggccctgccccccaagcgctggttcaaggacaactacaatgctgacttcctggaggaccggcagctgggcctgcaggccttcctgcagaacctggtggcccacaaggacatcgccaactag

SEQ ID NO: 38488 - DNA, 1887 bp, Artificial Sequence
  Description of Artificial Sequence: Synthetic coding sequence
atggccctgcgggcccgggccctgtatgacttccgctctgagaaccctggagagatcagcctgcgggagcacgaggtgctgagcctgtgcagcgagcaggacatcgagggctggctggagggcgtgaacagcagaggagaccggggcctcttccctgccagctatgtgcaggtgatccgggcccctgagcccggccctgctggagatggcggccctggggccccagcccgctatgccaacgtgcccccaggcggctttgagcccctgcctgtggcccccccagccagcttcaagcccccaccagatgccttccaggccctgctgcagccccagcaggcccccccacccagcaccttccagcccccaggggccggcttcccctacggcggcggggccctgcagcccagcccccagcagctgtatggaggctaccaggccagccagggcagtgatgatgactgggatgatgagtgggatgacagcagcacagtggctgatgagcccggggccctgggcagcggggcctacccagacctggatggcagcagcagcgctggggtgggcgccgccggccgctaccgcctgagcaccaggagtgacctgagcctgggcagcagaggaggctctgtgcccccccagcaccaccccagcggccccaagagcagcgccaccgtgtccaggaacctgaaccgcttcagcacctttgtgaagagcggcggggaggcctttgtgctgggggaggccagcggctttgtgaaggatggagacaagctgtgtgtggtgctgggcccctacggccctgagtggcaggagaacccctaccccttccagtgcaccattgatgaccccaccaagcagaccaagttcaagggcatgaagagctacatctcctacaagctggtgcccacccacacccaggtgcctgtgcaccggcgctacaagcactttgactggctgtatgcccggctggccgagaagtttcctgtgatctctgtgccccacctgcctgagaagcaggccaccggccgctttgaggaggacttcatcagcaagaggaggaagggcctcatctggtggatgaaccacatggccagccaccctgtgctggcccagtgtgatgtgttccagcacttcctgacctgccccagcagcacagatgagaaggcctggaagcagggcaagaggaaggccgagaaggatgagatggtgggcgccaacttcttcctgaccctgagcaccccacctgctgctgccctggacctgcaggaggtggagagcaagattgatggcttcaagtgcttcaccaagaagatggatgattctgccctgcagctgaaccacacagccaatgaatttgccaggaagcaggtgacaggcttcaagaaggagtaccagaaggtgggccagagcttccggggcctgagccaggcctttgagctggaccagcaggccttctctgtgggcctgaaccaggccatcgccttcaccggagatgcctatgatgccatcggggagctgtttgctgagcagccccggcaggacctggaccctgtgatggacctgctggccctgtaccagggccacctggccaacttcccagacatcatccacgtgcagaagggcaaggcctggcccctggagcaggtgatctggagcgtgctgtgccgcctgaagggggccaccctgacagctgtgcccctgtgggtgtctgagagctacagcactggagaggaggccagcagagatgtggatgcctgggtgttcagcctggagtgcaagctggactgcagcacaggcagcttcctgctggagtacctggccctgggcaatgagtacagcttcagcaaggtgcagagggtgcccctgatgacagtgctgtccttctag

SEQ ID NO: 38489 - DNA, 1776 bp, Artificial Sequence
  Description of Artificial Sequence: Synthetic coding sequence
atggccctgcgggcccgggccctgtatgacttccgctctgagaaccctggagagatcagcctgcgggagcacgaggtgctgagcctgtgcagcgagcaggacatcgagggctggctggagggcgtgaacagcagaggagaccggggcctcttccctgccagctatgtgcaggtgatccgggcccctgagcccggccctgctggagatggcggccctggggccccagcccgctatgccaacgtgcccccaggcggctttgagcccctgcctgtggcccccccagccagcttcaagcccccaccagatgccttccaggccctgctgcagccccagcaggcccccccacccagcaccttccagcccccaggggccggcttcccctacggcggcggggccctgcagcccagcccccagcagctgtatggaggctaccaggccagccagggcagtgatgatgactgggatgatgagtgggatgacagcagcacagtggctgatgagcccggggccctgggcagcggggcctacccagacctggatggcagcagcagcgctggggtgggcgccgccggccgctaccgcctgagcaccaggagtgacctgagcctgggcagcagaggaggctctgtgcccccccagcaccaccccagcggccccaagagcagcgccaccgtgtccaggaacctgaaccgcttcagcacctttgtgaagagcggcggggaggcctttgtgctgggggaggccagcggctttgtgaaggatggagacaagctgtgtgtggtgctgggcccctacggccctgagtggcaggagaacccctaccccttccagtgcaccattgatgaccccaccaagcagaccaagttcaagggcatgaagagctacatctcctacaagctggtgcccacccacacccaggtgcctgtgcaccggcgctacaagcactttgactggctgtatgcccggctggccgagaagtttcctgtgatctctgtgccccacctgcctgagaagcaggccaccggccgctttgaggaggacttcatcagcaagaggaggaagggcctcatctggtggatgaaccacatggccagccaccctgtgctggcccagtgtgatgtgttccagcacttcctgacctgccccagcagcacagatgagaaggcctggaagcagggcaagaggaaggccgagaaggatgagatggtgggcgccaacttcttcctgaccctgagcaccccacctgctgctgccctggacctgcaggaggtggagagcaagattgatggcttcaagtgcttcaccaagaagatggatgattctgccctgcagctgaaccacacagccaatgaatttgccaggaagcaggtgacaggcttcaagaaggagtaccagaaggtgggccagagcttccggggcctgagccaggcctttgagctggaccagcaggccttctctgtgggcctgaaccaggccatcgccttcaccggagatgcctatgatgccatcggggagctgtttgctgagcagccccggcaggacctggaccctgtgatggacctgctggccctgtaccagggccacctggccaacttcccagacatcatccacgtgcagaagggcaaggcctggcccctggagcaggtgatctggagcgtgctgtgccgcctgaagggggccaccctgacagctgtgcccctgtgggtgtctgagagctacagcactggagaggaggccagcagagatgtggatgcctgggtgttcagcctggagtag

SEQ ID NO: 38490 - DNA, 1875 bp, Artificial Sequence
  Description of Artificial Sequence: Synthetic coding sequence
atggccctgcgggcccgggccctgtatgacttccgctctgagaaccctggagagatcagcctgcgggagcacgaggtgctgagcctgtgcagcgagcaggacatcgagggctggctggagggcgtgaacagcagaggagaccggggcctcttccctgccagctatgtgcaggtgatccgggcccctgagcccggccctgctggagatggcggccctggggccccagcccgctatgccaacgtgcccccaggcggctttgagcccctgcctgtggcccccccagccagcttcaagcccccaccagatgccttccaggccctgctgcagccccagcaggcccccccacccagcaccttccagcccccaggggccggcttcccctacggcggcggggccctgcagcccagcccccagcagctgtatggaggctaccaggccagccagggcagtgatgatgactgggatgatgagtgggatgacagcagcacagtggctgatgagcccggggccctgggcagcggggcctacccagacctggatggcagcagcagcgctggggtgggcgccgccggccgctaccgcctgagcaccaggagtgacctgagcctgggcagcagaggaggctctgtgcccccccagcaccaccccagcggccccaagagcagcgccaccgtgtccaggaacctgaaccgcttcagcacctttgtgaagagcggcggggaggcctttgtgctgggggaggccagcggctttgtgaaggatggagacaagctgtgtgtggtgctgggcccctacggccctgagtggcaggagaacccctaccccttccagtgcaccattgatgaccccaccaagcagaccaagttcaagggcatgaagagctacatctcctacaagctggtgcccacccacacccaggtgcctgtgcaccggcgctacaagcactttgactggctgtatgcccggctggccgagaagtttcctgtgatctctgtgccccacctgcctgagaagcaggccaccggccgctttgaggaggacttcatcagcaagaggaggaagggcctcatctggtggatgaaccacatggccagccaccctgtgctggcccagtgtgatgtgttccagcacttcctgacctgccccagcagcacagatgagaaggcctggaagcagggcaagaggaaggccgagaaggatgagatggtgggcgccaacttcttcctgaccctgagcaccccacctgctgctgccctggacctgcaggaggtggagagcaagattgatggcttcaagtgcttcaccaagaagatggatgattctgccctgcagctgaaccacacagccaatgaatttgccaggaagcaggtgacaggcttcaagaaggagtaccagaaggtgggccagagcttccggggcctgagccaggcctttgagctggaccagcaggccttctctgtgggcctgaaccaggccatcgccttcaccggagatgcctatgatgccatcggggagctgtttgctgagcagccccggcaggacctggaccctgtgatggacctgctggccctgtaccagggccacctggccaacttcccagacatcatccacgtgcagaagggggccctgaccaaggtgaaggagagccgccgccacgtggaggagggcaagatggaggtgcagaaggcagatggcatccaggaccgctgcaacaccatcagctttgccaccctggccgagatccaccacttccaccagatccgggtgcgggacttcaagagccagatgcagcacttcctgcagcagcagatcatcttcttccagaaggtgacccagaagctggaggaggccctgcacaagtatgattctgtgtag

SEQ ID NO: 38491 - DNA, 2979 bp, Artificial Sequence
  Description of Artificial Sequence: Synthetic coding sequence
atgaagacagaaacagtgccccccttccaggagaccccagctggcagcagctgccacctgaacaacctgctgagcagcaggaagctgatggctgtgggcgtgctgctgggctggctgctggtgatccacctgctggtgaatgtgtggctgctgtgcctgctgagcgccctgctggtggtgctgggcggctggctgggcagcagcctggccggcgtggccagcggccgcctgcacctggagcgcttcatccccctggccacctgccccccctgcccagaggccgagcggcagctggagcgggagatcaacagaaccatccagatgatcatccgggactttgtgctgtcctggtacagatctgtgtcccaggagcccgcctttgaggaggagatggaggccgccatgaagggcctggtgcaggagctgcggcggaggatgtctgtgatggacagccatgctgtggcccagagcgtgctgaccctgtgtggctgccacctgcagagctacatccaggccaaggaggccacagctgggaagaatggacctgtggagcccagccacctgtgggaggcctactgccgggccacagccccccaccctgctgtgcacagccccagcgctgaggtgacctacacccggggcgtggtgaacctgctgctgcagggcctggtgcccaagccccacctggagaccaggacaggccgccacgtggtggtggagctgatcacctgcaacgtcatcctgcccctcatcagccggctgagtgaccctgactggatccacctggtgctggtgggcatcttcagcaaggcccgggaccctgccccctgcccagccagcgcccctgagcagcccagcgtgcccaccagcctgcccctgattgctgaggtggagcagctgcctgagggccgggccagccctgtggccgcccctgtgttcctgagctacagcgagcctgagggcagcgctggccccagccctgaggtggaggagggccatgaagctgtggagggggacctgggcggcatgtgtgaggagaggaaggtgggcaacaacagcagccacttcctgcagcccaacgtgcggggccccctcttcctgtgtgaagattctgagctggagagccccctgtctgagctgggcaaggagaccatcatgctgatgaccccaggcagcttcctgagtgaccgcatccaggatgccctgtgtgccctggagagcagccaggccctggagcccaaggatggagaggccagcgagggcgctgaggccgaggagggccctggaacagaaacagagaccggcctgcctgtgtccaccctgaacagctgcccagagatccacatcgacacagctgacaaggagattgagcagggagatgtgacagcctctgtgacagccctgctggagggccctgagaagacctgccccagccggcccagctgcctggagaaggacctgaccaatgatgtgagcagcctggaccccaccctgccccctgtgctgctgagcagcagccccccaggccccctgagcagcgccaccttctcctttgagcccctgagcagcccagatggccctgtgatcatccagaacctgcgcatcaccggcaccatcacagcccgggagcacagcggcaccggcttccacccctacaccctgtacacagtgaagtatgaaacagccctggatggagagaacagcagcggcctgcagcagctggcctaccacacagtgaacagacgctaccgggagttcctgaacctgcagacccggctggaggagaagccagacctgaggaagttcatcaagaatgtgaagggccccaagaagctgttcccagacctgcccctgggcaacatggacagcgacagagtggaggccaggaagagcctgctggagagcttcctgaagcagctgtgtgccatccctgagatcgccaacagcgaggaggtgcaggagttcctggccctgaacacagatgcccgcatcgcctttgtgaagaagcccttcatggtgtccagaattgacaagatggtggtgtctgccatcgtggacaccctgaagacagccttccccaggtctgagccccagagccccacagaggagctgtctgaggccgagacagagagcaagccccagacagagggcaagaaggccagcaagagccggctgcgcttcagcagcagcaagatcagccctgccctgtctgtgacagaggcccaggacaagatcctgtactgcctgcaggagggcaatgtggagagcgagaccctgtccatgtctgccatggagagcttcatcgagaagcagaccaagctgctggagatgcagcccaccaaggcccctgagaaggaccctgagcagccccccaagggccgggtggacagctgtgtgtctgatgctgctgtgcctgcccaggaccccagcaacagcgaccccggcacagaaacagagctggccgacacagccctggacctgctgctgctgctgctgacagagcagtggaagtggctgtgcacagagaacatgcagaagttcctgcggctcatcttcggcaccctggtgcagcgctggctggaggtgcaggtggccaacctgaccagcccccagcgctgggtgcagtacctgctgctgctgcaggagagcatctggccaggcggcgtgctgcccaagttccccaggcctgtgaggacccaggagcagaagctggccgctgagaagcaggccctgcagagcctgatgggcgtgctgcctgacctggtggtggagatcctgggcgtgaacaagtgccgcctgtcctggggcctggtgctggagagcctgcagcagcccctcatcaacagacacctgatctactgcctgggggacatcatcctggagttcctggacctgagcgcctctgtggaggagagcgctgccaccaccagcgccagtgacaccccaggcaacagcaagaggatgggcgtgagcagctag

SEQ ID NO: 38492 - DNA, 1308 bp, Artificial Sequence
  Description of Artificial Sequence: Synthetic coding sequence
atgtatgaaacagccctggatggagagaacagcagcggcctgcagcagctggcctaccacacagtgaacagacgctaccgggagttcctgaacctgcagacccggctggaggagaagccagacctgaggaagttcatcaagaatgtgaagggccccaagaagctgttcccagacctgcccctgggcaacatggacagcgacagagtggaggccaggaagagcctgctggagagcttcctgaagcagctgtgtgccatccctgagatcgccaacagcgaggaggtgcaggagttcctggccctgaacacagatgccagaattgcctttgtgaagaagcccttcatggtgtccagaattgacaagatggtggtgtctgccatcgtggacaccctgaagacagccttccccaggtctgagccccagagccccacagaggagctgtctgaggccgagacagagagcaagccccagacagagggcaagaaggccagcaagagccggctgcgcttcagcagcagcaagatcagccctgccctgtctgtgacagaggcccaggacaagatcctgtactgcctgcaggagggcaatgtggagagcgagaccctgtccatgtctgccatggagagcttcatcgagaagcagaccaagctgctggagatgcagcccaccaaggcccctgagaaggaccctgagcagccccccaagggccgggtggacagctgtgtgtctgatgctgctgtgcctgcccaggaccccagcaacagcgaccctggaacagaaacagagctggccgacacagccctggacctgctgctgctgctgctgacagagcagtggaagtggctgtgcacagagaacatgcagaagttcctgcggctcatcttcggcaccctggtgcagcgctggctggaggtgcaggtggccaacctgaccagcccccagcgctgggtgcagtacctgctgctgctgcaggagagcatctggccaggaggagtgctgcccaagttccccaggcctgtgaggacccaggagcagaagctggccgctgagaagcaggccctgcagagcctgatgggcgtgctgcctgacctggtggtggagatcctgggcgtgaacaagtgccgcctgtcctggggcctggtgctggagagcctgcagcagcccctcatcaacagacacctgatctactgcctgggggacatcatcctggagttcctggacctgagcgcctctgtggaggagagcgctgccaccaccagcgccagtgacaccccaggcaacagcaagaggatgggcgtgagcagctag

SEQ ID NO: 38493 - DNA, 699 bp, Artificial Sequence
  Description of Artificial Sequence: Synthetic coding sequence
atgtctgccatggagagcttcatcgagaagcagaccaagctgctggagatgcagcccaccaaggcccctgagaaggaccctgagcagccccccaagggccgggtggacagctgtgtgtctgatgctgctgtgcctgcccaggaccccagcaacagcgaccccggcacagaaacagagctggccgacacagccctggacctgctgctgctgctgctgacagagcagtggaagtggctgtgcacagagaacatgcagaagttcctgcggctcatcttcggcaccctggtgcagcgctggctggaggtgcaggtggccaacctgaccagcccccagcgctgggtgcagtacctgctgctgctgcaggagagcatctggccaggcggcgtgctgcccaagttccccaggcctgtgaggacccaggagcagaagctggccgctgagaagcaggccctgcagagcctgatgggcgtgctgcctgacctggtggtggagatcctgggcgtgaacaagtgccgcctgtcctggggcctggtgctggagagcctgcagcagcccctcatcaacagacacctgatctactgcctgggggacatcatcctggagttcctggacctgagcgcctctgtggaggagagcgctgccaccaccagcgccagtgacaccccaggcaacagcaagaggatgggcgtgagcagctag

SEQ ID NO: 38494 - DNA, 582 bp, Artificial Sequence
  Description of Artificial Sequence: Synthetic coding sequence
atgctggaggtgcacatccccagcgtgggccctgaggccgagggcccccggcagagccctgagaagagccacatggtgttccgggtggaggtgctgtgcagcggccgccgccacacagtgccccggcgctacagcgagttccacgccctgcacaagaggatcaagaagctgtacaaggtgcctgacttccccagcaagaggctgcccaactggaggacccggggcctggagcagaggcggcagggcctggaggcctacatccagggcatcctgtacctgaaccaggaggtgcccaaggagctgctggagttcctgcggctgcggcacttccccacagaccccaaggccagcaactggggcaccctgcgggagttcctgcccggggacagcagcagccagcagcaccagaggcctgtgctgtccttccacgtggacccctacgtgtgcaaccccagccctgagagcctgcccaacgtggtggtgaatggagtgctgcagggcctgtacagcttcagcatcagcccagacaaggcccagcccaaggccgcctgccacccagcccccctgccccccatgccctag

SEQ ID NO: 38495 - DNA, 525 bp, Artificial Sequence
  Description of Artificial Sequence: Synthetic coding sequence
atgctggaggtgcacatccccagcgtgggccctgaggccgagggcccccggcagagccctgagaagagccacatgatcaagaagctgtacaaggtgcctgacttccccagcaagaggctgcccaactggaggacccggggcctggagcagaggcggcagggcctggaggcctacatccagggcatcctgtacctgaaccaggaggtgcccaaggagctgctggagttcctgcggctgcggcacttccccacagaccccaaggccagcaactggggcaccctgcgggagttcctgcccggggacagcagcagccagcagcaccagaggcctgtgctgtccttccacgtggacccctacgtgtgcaaccccagccctggagaggaggtgccccgctacggggccaccggcctgggctgcggcctgtgcatcagccggctgctgggccccagcgacagcatctccttcctgctgcccaccagcggggccaccaccagctgcagctgccccctggagcccgccctgtag

SEQ ID NO: 38496 - DNA, 510 bp, Artificial Sequence
  Description of Artificial Sequence: Synthetic coding sequence
atggaggtgtacatccccagcttccgctatgaggagagtgacctggagcggggctacaccgtcttcaagattgaggtgctgatgaatggaaggaagcactttgtggagaagcgctacagcgagttccacgccctgcacaagaagctgaagaagtgcatcaagaccccagagatccccagcaagcacgtgaggaactgggtgcccaaggtgctggagcagaggcggcagggcctggagacctacctgcaggccgtcatcctggagaatgaggagctgcccaagctgttcctggacttcctgaatgtgcgccacctgcccagcctgcccaaggccgagagctgtggcagctttgatgaaacagagagcgaggagagcagcaagctgagccaccagcctgtgctgctcttcctgcgggacccctacgtgctgcctgctgccagtgacttccccaacgtggtgattgagggcgtgctgcacggcatcttctacccccacctgcagcccaggtag

SEQ ID NO: 38497 - DNA, 480 bp, Artificial Sequence
  Description of Artificial Sequence: Synthetic coding sequence
atggaggtgtacatccccagcttccgctatgaggagagtgacctggagcggggctacaccgtcttcaagattgaggtgctgatgaatggaaggaagcactttgtggagaagcgctacagcgagttccacgccctgcacaagaagctgaagaagtgcatcaagaccccagagatccccagcaagcacgtgaggaactgggtgcccaaggtgctggagcagaggcggcagggcctggagacctacctgcaggccgtcatcctggagaatgaggagctgcccaagctgttcctggacttcctgaatgtgcgccacctgcccagcctgcccaaggccgagagctgtggcagctttgatgaaacagagagcgaggagagcagcaagctgagccaccagcctgtgctgctcttcctgcgggacccctacgtgctgcctgctgccagcggcaaccagacctgccacctgctgacagccctgtactag

SEQ ID NO: 38498 - DNA, 480 bp, Artificial Sequence; identical to SEQ ID NO: 38497
  Description of Artificial Sequence: Synthetic coding sequence

SEQ ID NO: 38499 - DNA, 1086 bp, Artificial Sequence
  Description of Artificial Sequence: Synthetic coding sequence
atgaggaacctgaacatcaaggatgtgtccaagctgaaggatgagatcatcctgattgagaaggagaggacagacctgcagctgcacatggccaggacagactggtggtgtgagaacctgggcatgtggaaggccagcatcaccagcggggaggtgacagaagaaaatggagagcagctgccctgctactttgtgatggtgtccctgcaggaggtgggcggcgtggagaccaagaactggacagtgccccggcggctgtctgagttccagaacctgcacaggaagctgtctgaatgtgtgcccagcctgaagaaggtgcagctgcccagcctgagcaagctgcccttcaagagcattgaccagaagttcatggagaagagcaagaaccagctgaacaagttcctgcagaacctgctgagtgatgagcggctgtgccagagcgaggccctgtatgccttcctgagccccagcccagactacctgaaggtgattgatgtgcagggcaagaagaacagcttcagcctgagcagcttcctggagcggctgccccgggacttcttcagccaccaggaggaggagacagaggaggacagcgacctgagtgactatggagatgatgtggatggcaggaaggatgccctggccgagccctgcttcatgctgattggagagatctttgagctgcggggcatgttcaagtgggtgcggaggaccctcatcgccctggtgcaggtgacctttggaagaaccatcaacaagcagatccgggacacagtgtcctggatcttcagcgagcagatgctggtgtactacatcaacatcttcagagatgccttctggcccaacgggaagctggccccacccaccaccatccgcagcaaggagcagagccaggagaccaagcagagggcccagcagaagctgctggagaacatcccagacatgctgcagagcctggtgggccagcagaatgcccggcacggcatcatcaagatcttcaatgccctgcaggagacccgggccaacaagcacctgctgtatggcaccagcaccaacaccctgctgagcccccgggaccatgactag

SEQ ID NO: 38500 - DNA, 2523 bp, Artificial Sequence
  Description of Artificial Sequence: Synthetic coding sequence
atggacaaggccctgaaggaggtgtttgactacagctacagagactacatcctgtcctggtacggcaacctgagcagagatgagggccagctgtaccacctgctgctggaggacttctgggagatcgcccggcagctgcaccaccggctgagccacgtggatgtggtgaaggtggtgtgcaatgatgtggtgaggaccctgctgacccacttctgtgacctgaaggccgccaatgcccggcatgaggagcagccccggccctttgtgctgcacgcctgcctgaggaacagtgatgatgaggtgcgcttcctgcagacctgcagccgggtgctggtgttctgcctgctgcccagcaaggatgtgcagagcctgagcctgcgcatcatgctggccgagatcctgaccaccaaggtgctgaagcctgtggtggagctgctgagcaacccagactacatcaaccagatgctgctggcccagctggcctaccgggagcagatgaatgagcaccacaagagggcctacacctacgcccccagctatgaggacttcatcaagctgatcaacagcaacagtgatgtggagttcctgaagcagctgcgctaccagatcgtggtggagatcatccaggccaccaccatcagcagcttcccccagctgaagaggcacaagggcaaggagacagctgccatgaaggctgacctgctgcgggccaggaacatgaagcgctacatcaaccagctgactgtggccaagaagcagtgtgagaagaggatccgcatcctgggcggccctgcctatgaccagcaggaggatggagccctggatgaaggagagggcccccagagccagaagatcctgcagtttgaggacatcctggccaacaccttctaccgggagcacttcggcatgtacatggagaggatggacaagagggccctgatctccttctgggagagcgtggagcacctgaagaatgccaacaagaatgagatcccccagctggtgggggagatctaccagaacttctttgtggagagcaaggagatctctgtggagaagagcctgtacaaggagatccagcagtgcctggtgggcaacaagggcatcgaggtgttctacaagatccaggaggatgtgtatgagaccctgaaggaccgctactaccccagcttcatcgtgtctgacctgtatgagaagctgctgatcaaggaggaggagaagcacgccagccagatgatcagcaacaaggatgagatgggccccagagatgaagctggggaggaggccgtggatgatggcaccaaccagatcaatgagcaggccagctttgctgtgaacaagctgcgggagctgaatgagaagctggagtacaagaggcaggccctgaacagcatccagaatgcccccaagccagacaagaagatcgtgtccaagctgaaggatgagatcatcctgattgagaaggagaggacagacctgcagctgcacatggccaggacagactggtggtgtgagaacctgggcatgtggaaggccagcatcaccagcggggaggtgacagaggagaatggagagcagctgccctgctactttgtgatggtgtccctgcaggaggtgggcggcgtggagaccaagaactggacagtgccccggcggctgtctgagttccagaacctgcacaggaagctgtctgaatgtgtgcccagcctgaagaaggtgcagctgcccagcctgagcaagctgcccttcaagagcattgaccagaagttcatggagaagagcaagaaccagctgaacaagttcctgcagaacctgctgagtgatgagcggctgtgccagagcgaggccctgtatgccttcctgagccccagcccagactacctgaaggtgattgatgtgcagggcaagaagaacagcttcagcctgagcagcttcctggagcggctgccccgggacttcttcagccaccaggaggaggagacagaagaagattctgacctgagtgactatggagatgatgtggatggcaggaaggatgccctggccgagccctgcttcatgctgattggagagatctttgagctgcggggcatgttcaagtgggtgcggaggaccctgattgccctggtgcaggtgaccttcggccgcaccatcaacaagcagatccgggacacagtgtcctggatcttcagcgagcagatgctggtgtactacatcaacatcttcagagatgccttctggcccaacgggaagctggccccacccaccaccatccgcagcaaggagcagagccaggagaccaagcagagggcccagcagaagctgctggagaacatcccagacatgctgcagagcctggtgggccagcagaatgcccggcacggcatcatcaagatcttcaatgccctgcaggagacccgggccaacaagcacctgctgtatgccctgatggagctgctgctgattgagctgtgcccagagctgcgggtgcacctggaccagctgaaggccggccaggtgtag

SEQ ID NO: 38501 - DNA, 2523 bp, Artificial Sequence; identical to SEQ ID NO: 38500
  Description of Artificial Sequence: Synthetic coding sequence

SEQ ID NO: 38502 - DNA, 1356 bp, Artificial Sequence
  Description of Artificial Sequence: Synthetic coding sequence
atggagggggagcggcgggccagccaggcccccagcagcggcctgcctgctggaggagccaatggagagagccctgggggcggggcccccttccctggcagcagcggcagcagcgccctgctgcaggccgaggtgctggacctggatgaagatgaagatgacctggaggtgttcagcaaggatgccagcctgatggacatgaacagcttcagccccatgatgcccaccagccccctgtccatgatcaaccagatcaagtttgaagatgagccagacctgaaggacctcttcatcaccgtggatgagcctgagagccacgtgaccaccatcgagaccttcatcacctaccgcatcatcaccaagaccagcagaggagaatttgacagcagcgagtttgaggtgagaagacgctaccaggacttcctgtggctgaagggcaagctggaggaggcccaccccaccctcatcatcccccccctgcctgagaagttcatcgtgaagggcatggtggagcgcttcaatgatgacttcatcgagaccaggaggaaggccctgcacaagttcctgaacagaattgctgaccaccccaccctgaccttcaatgaagacttcaagatcttcctgacagcccaggcctgggagctgagcagccacaagaagcagggccctggcctgctgagcaggatgggccagacagtgcgggctgtggccagctccatgaggggcgtgaagaacagacctgaggagttcatggagatgaacaacttcatcgagctgttcagccagaagatcaacctgattgacaagatcagccagaggatctacaaggaggagcgggagtactttgatgagatgaaggagtatggccccatccacatcctgtggagcgccagcgaggaggacctggtggacaccctgaaggatgtggccagctgcatcgaccgctgctgcaaggccacagagaagaggatgagcggcctgtctgaggccctgctgcctgtggtgcatgaatatgtgctgtacagcgagatgctgatgggcgtgatgaagagaagagaccagatccaggccgagctggacagcaaggtggaggtgctgacctacaagaaggctgacacagacctgctgcctgaggagatcggcaagctggaggacaaggtggagtgtgccaacaatgccctgaaggctgactgggagcgctggaagcagaacatgcagaatgacatcaagctggccttcacagacatggccgaggagaacatccactactatgagcagtgcctggccacctgggagagcttcctgaccagccagaccaacctgcacctggaggaggccagcgaggacaagccctag

SEQ ID NO: 38503 - DNA, 1011 bp, Artificial Sequence
  Description of Artificial Sequence: Synthetic coding sequence
atggacatgaacagcttcagccccatgatgcccaccagccccctgtccatgatcaaccagatcaagtttgaagatgagccagacctgaaggacctcttcatcaccgtggatgagcctgagagccacgtgaccaccatcgagaccttcatcacctaccgcatcatcaccaagaccagcagaggagaatttgacagcagcgagtttgaggtgagaagacgctaccaggacttcctgtggctgaagggcaagctggaggaggcccaccccaccctcatcatcccccccctgcctgagaagttcatcgtgaagggcatggtggagcgcttcaatgatgacttcatcgagaccaggaggaaggccctgcacaagttcctgaacagaattgctgaccaccccaccctgaccttcaatgaagacttcaagatcttcctgacagcccaggcctgggagctgagcagccacaagaagcagggccctggcctgctgagcaggatgggccagacagtgcgggctgtggccagctccatgaggggcgtgaagaacagacctgaggagttcatggagatgaacaacttcatcgagctgttcagccagaagatcaacctgattgacaagatcagccagaggatctacaaggaggagcgggagtactttgatgagatgaaggagtatggccccatccacatcctgtggagcgccagcgaggaggacctggtggacaccctgaaggatgtggccagctgcatcgaccgctgctgcaaggccacagagaagaggatgagcggcctgtctgaggccctgctgcctgtggtgcatgaatatgtgctgtacagcgagatgctgatgggcgtgatgaagagaagagaccagatccaggccgagctggacagcaaggtggaggtgctgacctacaagaaggctgacacagacctgtgcctggccacctgggagagcttcctgaccagccagaccaacctgcacctggaggaggccagcgaggacaagccctag

SEQ ID NO: 38504 - DNA, 1191 bp, Artificial Sequence
  Description of Artificial Sequence: Synthetic coding sequence
atggagggggagcggcgggccagccaggcccccagcagcggcctgcctgctggaggagccaatggagagagccctgggggcggggcccccttccctggcagcagcggcagcagcgccctgctgcaggccgaggtgctggacctggatgaagatgaagatgacctggaggtgttcagcaaggatgccagcctgatggacatgaacagcttcagccccatgatgcccaccagccccctgtccatgatcaaccagatcaagtttgaagatgagccagacctgaaggacctcttcatcaccgtggatgagcctgagagccacgtgaccaccatcgagaccttcatcacctaccgcatcatcaccaagaccagcagaggagaatttgacagcagcgagtttgaggtgagaagacgctaccaggacttcctgtggctgaagggcaagctggaggaggcccaccccaccctcatcatccctgagctgagcagccacaagaagcagggccctggcctgctgagcaggatgggccagacagtgcgggctgtggccagctccatgagaggagtgaagaacagacctgaggagttcatggagatgaacaacttcatcgagctgttcagccagaagatcaacctgattgacaagatcagccagaggatctacaaggaggagcgggagtactttgatgagatgaaggagtatggccccatccacatcctgtggagcgccagcgaggaggacctggtggacaccctgaaggatgtggccagctgcatcgaccgctgctgcaaggccacagagaagaggatgagcggcctgtctgaggccctgctgcctgtggtgcatgaatatgtgctgtacagcgagatgctgatgggcgtgatgaagaggcgggaccagatccaggccgagctggacagcaaggtggaggtgctgacctacaagaaggctgacacagacctgctgcctgaggagatcggcaagctggaggacaaggtggagtgtgccaacaatgccctgaaggctgactgggagcgctggaagcagaacatgcagaatgacatcaagctggccttcacagacatggccgaggagaacatccactactatgagcagtgcctggccacctgggagagcttcctgaccagccagaccaacctgcacctggaggaggccagcgaggacaagccctag

SEQ ID NO: 38505 - DNA, 1509 bp, Artificial Sequence
  Description of Artificial Sequence: Synthetic coding sequence
atggacctgatccccaacctggccgtggagacctggctgctgctggccgtgtccctggtgctgctgtacctgtatggcaccaggacccacggcctcttcaagaggctgggcatccctggccccacccccctgcccctgctgggcaatgtgctgagctaccggcagggcctgtggaagtttgacacagagtgctacaagaagtatggcaagatgtggggcacctatgagggccagctgcctgtgctggccatcacagatcctgatgtgatcagaacagtgctggtgaaggagtgctacagcgtcttcaccaacagaagaagcctgggccctgtgggcttcatgaagagcgccatcagcctggccgaggatgaggagtggaagaggatccgcagcctgctgagccccaccttcaccagcggcaagctgaaggagatgttccccatcatcgcccagtatggagatgtgctggtgaggaacctgcggcgggaggccgagaagggcaagcctgtgaccctgaaggacatctttggagcctacagcatggatgtgatcaccggcaccagctttggagtgaacatcgacagcctgaacaacccccaggacccctttgtggagagcaccaagaagttcctgaagtttggcttcctggaccccctcttcctgagcatcatcctcttccccttcctgacccctgtgtttgaggccctgaatgtgtccctcttccccaaggacaccatcaacttcctgagcaagtctgtgaacaggatgaagaagagccggctgaatgacaagcagaagcaccggctggacttcctgcagctgatgattgacagccagaacagcaaggagacagagagccacaaggccctgagtgacctggagctggccgcccagagcatcatcttcatctttgctggctatgagaccaccagctctgtgctgtccttcaccctgtatgagctggccacccacccagatgtgcagcagaagctgcagaaggagattgatgctgtgctgcccaacaaggccccacccacctatgatgctgtggtgcagatggagtacctggacatggtggtgaatgagaccctgcggctcttccctgtggccatccggctggagaggacctgcaagaaggatgtggagatcaacggggtcttcatccccaagggctccatggtggtgatccccacctacgccctgcaccacgaccccaagtactggacagagcctgaggagttccggcctgagcgcttcagcaagaagaaggacagcattgacccctacatctacacccccttcggcaccggccccaggaactgcatcggcatgagatttgccctgatgaacatgaagctggccctgatccgggtgctgcagaacttctccttcaagccctgcaaggagacccagatccccctgaagctggacacccagggcctgctgcagcctgagaagcccatcgtgctgaaggtggacagcagagatggcaccctgagcggggagtag

SEQ ID NO: 38506 - DNA, 129 bp, Artificial Sequence
  Description of Artificial Sequence: Synthetic coding sequence
atgcagatgccccagggcaaccccctgctgctgagccacaccctgcaggagctgctggcccgggacacagtgcaggtggagctgatccctgagaagaagggcctcttcctgaagcacgtggagtactag

SEQ ID NO: 38507 - DNA, 531 bp, Artificial Sequence
  Description of Artificial Sequence: Synthetic coding sequence
atgcagatgccccagggcaaccccctgctgctgagccacaccctgcaggagctgctggcccgggacacagtgcaggtggagctgatccctgagaagaagggcctcttcctgaagcacgtggagtatgaggtgagcagccagcgcttcaagagctctgtgtaccgccgctacaatgactttgtggtgttccaggagatgctgctgcacaagttcccctacaggatggtgcctgccctgccccccaagaggatgctgggcgctgaccgggagttcatcgaggcccggcggcgggccctgaagagatttgtgaacctggtggcccggcaccccctcttctctgaagatgtggtgctgaagctgttcctgtccttcagcggcagtgatgtgcagaacaagctgaaggagagcgcccagtgtgtgggagatgagttcctgaactgcaagctggccacccgggccaaggacttcctgcctgctgacatccaggcccagtttgccatcagccgggagctgatccggaacatctactag

SEQ ID NO: 38508 - DNA, 600 bp, Artificial Sequence
  Description of Artificial Sequence: Synthetic coding sequence
atgcaccggggcacccaggagggcgccatggccagccggctgctgcaccggctgcggcatgccctggccggagatggccctggagaggccgccgccagccctgaggccgagcagtttcctgagagcagcgagctggaggatgatgatgctgagggcctgagcagccggctgagcggcaccctgtccttcaccagcgcagaagatgatgaagatgatgaagatgaagatgatgaggaggccggccctgaccagctgcccctgggagatggcaccagcggggaggatgctgagaggagccccccaccagatggccagtggggcagccagctgctggcccggcagctgcaggacttctggaagaagagcaggaacaccctggccccccagaggctgctgtttgaggtgaccagcgccaacgtggtgaaggacccccccagcaaatatgtgctgtacaccctggccgtcatcggccctggccccccagactgccagcctgcccagatcagccgccgctacagcgactttgagcggctgcacaggaacctgcagaggcagttccggggccccatggccgccatctccttcccccagagccactag

SEQ ID NO: 38509 - DNA, 453 bp, Artificial Sequence
  Description of Artificial Sequence: Synthetic coding sequence
atggccagccggctgctgcaccggctgcggcatgccctggccggagatggccctggagaggccgccgccagccctgaggccgagcagtttcctgagagcagcgagctggaggatgatgatgctgagggcctgagcagccggctgagcggcaccctgtccttcaccagcgcagaagatgatgaagatgatgaagatgaagatgatgaggaggccggccctgaccagctgcccctgggagatggcaccagcggagaagatgctgagaggagccccccaccagatggccagtggggcagccagctgctggcccggcagctgcaggacttctggaagaagagcaggaacaccctggccccccagaggctgctgtttgaggtgaccagcgccaacgtggtgaaggacccccccagcaaatatgtgacccccaccctgagcagcacccccagcccctag

SEQ ID NO: 38510 - DNA, 477 bp, Artificial Sequence
  Description of Artificial Sequence: Synthetic coding sequence
atgcaccggggcacccaggagggcgccatggccagccggctgctgcaccggctgcggcatgccctggccggagatggccctggagaggccgccgccagccctgaggccgagcagtttcctgagagcagcgagctggaggatgatgatgctgagggcctgagcagccggctgagcggcaccctgtccttcaccagcgcagaagatgatgaagatgatgaagatgaagatgatgaggaggccggccctgaccagctgcccctgggagatggcaccagcggggaggatgctgagaggagccccccaccagatggccagtggggcagccagctgctggcccggcagctgcaggacttctggaagaagagcaggaacaccctggccccccagaggctgctgtttgaggtgaccagcgccaacgtggtgaaggacccccccagcaaatatgtgaccaacctgagcagcacccccagcccctag

SEQ ID NO: 38511 - DNA, 1122 bp, Artificial Sequence
  Description of Artificial Sequence: Synthetic coding sequence
atgcaccggggcacccaggagggcgccatggccagccggctgctgcaccggctgcggcatgccctggccggagatggccctggagaggccgccgccagccctgaggccgagcagtttcctgagagcagcgagctggaggatgatgatgctgagggcctgagcagccggctgagcggcaccctgtccttcaccagcgcagaagatgatgaagatgatgaagatgaagatgatgaggaggccggccctgaccagctgcccctgggagatggcaccagcggggaggatgctgagaggagccccccaccagatggccagtggggcagccagctgctggcccggcagctgcaggacttctggaagaagagcaggaacaccctggccccccagaggctgctgtttgaggtgaccagcgccaacgtggtgaaggacccccccagcaaatatgtgctgtacaccctggccgtcatcggccctggccccccagactgccagcctgcccagatcagccgccgctacagcgactttgagcggctgcacaggaacctgcagaggcagttccggggccccatggccgccatctccttccccaggaagaggctgcggaggaacttcaccgctgagaccatcgcccggcgcagccgggcctttgagcagttcctgggccacctgcaggccgtgcctgagctgcggcatgccccagacctgcaggacttctttgtgctgcctgagctgcggcgggcccagagcctgacctgcaccggcctgtaccgggaggccctggccctgtgggccaatgcctggcagctgcaggcccagctgggcaccccatctggccctgaccggcccctgctgaccctggccggcctggccgtgtgccaccaggagctggaggaccctggagaggcccgggcctgctgtgagaaggccctgcagctgctgggggacaagagcctgcaccccctgctggcccccttcctggaggcccacgtgcggctgtcctggaggctgggcctggacaagaggcagagcgaggcccggctgcaggccctgcaggaggccggcctgacccccaccccaccacccagcctgaaggagctgctgatcaaggaggtgctggactag

SEQ ID NO: 38512 - DNA, 294 bp, Artificial Sequence
  Description of Artificial Sequence: Synthetic coding sequence
atggacaagcagagcagcgctggaggagtgaagaggtctgtgccctgtgacagcaatgaggccaatgagatgatgcctgagaccagcagcggctacagcgacccccagcctgcccccaagaagctgaagaccagcgagagcagcaccatcctggtggtgcgctacagaagaaacttcaagaggaccagccctgaggagctggtgaatgaccacgccaggaagaaccgcatcaaccccctgcagatggaggaggaggagttcatggagatcatggtggagatcccagccaagtag

SEQ ID NO: 38513 - DNA, 3771 bp, Artificial Sequence
  Description of Artificial Sequence: Synthetic coding sequence
atggaccggcccctgagcagcagcgctgaggccgaggaggagctggagtggcaggtggccagcagaagaaggaaggcctgggccaagtgccgcagctcctggcaggccagcgagacagaggacctgagcacagaggccaccacccaggatgaggaggaggatgaggaggaggacctgcccggggcccagctgcctgctgctgggggcagaggaaatgtgcccaatgagaagatcgccatctggctgaaggactgcaggacccccctgggcgccagcctggatgagcagagcagcagcaccctgaagggcgtgctggtgagaaatggaggcagctttgaagatgacctgagcctgggcgctgaggccaaccacctgcacgagagtgatgcccagatcgagaactgcaacaacatcctggccaaggagcggcggctgcagttccaccagaagggccgctccatgaacagcactggaagtggcaagagcagcggcaccgtgtcctctgtgtctgagctgctggagctgtatgaggaggaccctgaggagatcctgtacaacctgggcttcggcagagatgagccagacatcgccagcaagatccccagccgcttcttcaacagcagcagctttgccaagggcatcgacatcaaggtgttcctgagcgcccagatgcagaggatggaggtggagaaccccaactatgccctgaccagccgcttccggcagatcgaggtgctgaccaccgtggccaatgccttcagcagcctgtacagccaggtgtctggcacccccctgcagagaattggctccatgagctctgtgaccagcaacaaggagacagaccccccaccacccctgaccaggagcaacacagccaaccggctgatgaagaccctgagcaagctgaacctgtgtgtggacaagacagagaagggggagagcagcagccccagccccagcgctgagaagggcaagatcctgaatgtgtctgtcatcgaggagagcggcaacaagaatgaccagaagagccagaagatcatgaagaagaaggagagcagctccatgctggccaccgtgaaggaggaggtgtctggcagcagcgctgctgtgacagaaaatgctgacagcgaccgcatcagtgatgaggccaacagcaacttcaaccagggcacagaaaatgagcagagcaaggagacccagagccatgagagcaagctgggggaggagagcggcatcgtggagagcaagctggacagcgacttcaacatcagcagccacagcgagctggagaacagcagcgagctgaagtctgtgcacatcagcaccccagagaaggagccctgtgcccccctgaccatccccagcatccggaacatcatgacccagcagaaggacagctttgagatggaggaggtgcagagcacagaaggagaggcccctcatgtgcctgccacctaccagctgggcctgaccaagagcaagagggaccacctgctgaggacagccagccagcacagcgacagcagcggctttgctgaggacagcacagactgcctgagcctgaaccacctgcaggtgcaggagagcctgcaggccatgggcagcagcgctgacagctgtgacagcgagaccaccgtgaccagcctgggggaggacctggccacccccacagcccaggaccagccctacttcaatgaaagtgaggaggagagcctggtgcccctgcagaagggcctggagaaggctgctgctgtggccgacaagaggaagagcggcagccaggacttcccccagtgcaacaccattgaaaatacaggcaccaagcagagcacctgcagccctggggaccacatcatcgagatcacagaggtggaggaggacctcttccctgctgagaccgtggagctgctgcgggaggccagcgctgagagtgatgtgggcaagagcagcgagagcgagttcacccagtacaccacccaccacatcctgaagagcctggccagcattgaggccaagtgcagcgacatgagcagcgagaacaccaccggcccccccagctccatggacagagtgaacacagccctgcagagggcccagatgaaggtgtgcagcctgagcaaccagaggatgggccgcagcctgctgaagagcaaggacctgctgaagcagcgctacctgtttgccaaggccggctaccccctgcggcgcagccagagcctgcccaccaccctgctgagccctgtgcgggtggtgtcctctgtgaatgtgcggctgagccctgggaaggagacccgctgcagcccccccagcttcacctacaagtacaccccagaggaggagcaggagctggagaagagggtgatggagcatgatggccagagcctggtgaagagcaccatcttcatcagccccagctctgtgaagaaggaggaggccccccagagcgaggccccccgggtggaggagtgccaccacggccgcacccccacctgcagccggctggcccccccacccatgagccagagcacctgcagcctgcacagcatccacagcgagtggcaggagcggcccctgtgtgagcacaccaggaccctgagcacccacagcgtgcccaacatcagcggggccacctgcagcgcctttgccagccccttcggctgcccctacagccacagacatgccacctacccctacagagtgtgcagcgtgaaccccccatctgccatcgagatgcagctgcggcgggtgctgcatgacatccggaacagcctgcagaacctgagccagtaccccatgatgaggggccctgaccctgctgctgccccctacagcacccagaagagctctgtgctgcccctgtatgagaacaccttccaggagctgcaggtgatgagaagaagcctgaacctcttccgcacccagatgatggacctggagctggccatgctgcggcagcagaccatggtgtaccaccacatgacagaggaggagagatttgaggtggaccagctgcagggcctgaggaacagcgtgaggatggagctgcaggacctggagctgcagctggaggagcggctgctgggcctggaggagcagctgcgggctgtgaggatgcccagccccttccgcagcagcgccctgatgggcatgtgtggcagccgctctgctgacaacctgagctgccccagccccctgaatgtgatggagcctgtgacagagctgatgcaggagcagagctacctgaagtctgagctgggcctgggcctgggggagatgggctttgagatccccccaggagagagcagcgagagcgtcttcagccaggccaccagcgagagcagctctgtgtgcagcggccccagccacgccaacagaagaactggagtgcccagcacagcctctgtgggcaagagcaagacccccctggtggccaggaagaaggtgttccgggcctctgtggccctgacccccacagcccccagcaggactggatctgtgcagaccccaccagacctggagagcagcgaggaggtggatgctgctgagggcgcccctgaggtggtgggccccaagtctgaggtggaggagggccacggcaagctgcccagcatgcctgctgctgaggagatgcacaagaatgtggagcaggatgagctgcagcaggtgatccgggaggtgggcatggaccccatcagctgtgtgatcctggagctgtccatgatctgcacaggaggcggcgtcatctgtgccctggaggacacctgctgctag

SEQ ID NO: 38514 - DNA, 3255 bp, Artificial Sequence
  Description of Artificial Sequence: Synthetic coding sequence
atgaacagcacaggcagcggcaagagcagcggcaccgtgtcctctgtgtctgagctgctggagctgtatgaagaagatcctgaggagatcctgtacaacctgggcttcggcagagatgagccagacatcgccagcaagatccccagccgcttcttcaacagcagcagctttgccaagggcatcgacatcaaggtgttcctgagcgcccagatgcagaggatggaggtggagaaccccaactatgccctgaccagccgcttccggcagatcgaggtgctgaccaccgtggccaatgccttcagcagcctgtacagccaggtgtctggcacccccctgcagagaattggctccatgagctctgtgaccagcaacaaggagacagatcctcctccacccctgaccaggagcaacacagccaaccggctgatgaagaccctgagcaagctgaacctgtgtgtggacaagacagagaagggggagagcagcagccccagccccagcgctgagaagggcaagatcctgaatgtgtctgtgattgaggagagcggcaacaagaatgaccagaagagccagaagatcatgaagaagaaggagagcagctccatgctggccaccgtgaaggaggaggtgtctggcagcagcgctgctgtgacagaaaatgctgacagcgaccgcatcagtgatgaggccaacagcaacttcaaccagggcacagaaaatgagcagagcaaggagacccagagccatgagagcaagctgggggaggagagcggcatcgtggagagcaagctggacagcgacttcaacatcagcagccacagcgagctggagaacagcagcgagctgaagtctgtgcacatcagcaccccagagaaggagccctgtgcccccctgaccatccccagcatccggaacatcatgacccagcagaaggacagctttgagatggaggaggtgcagagcacagaaggagaggccccccacgtgcctgccacctaccagctgggcctgaccaagagcaagagggaccacctgctgaggacagccagccagcacagcgacagcagcggctttgctgaggacagcacagactgcctgagcctgaaccacctgcaggtgcaggagagcctgcaggccatgggcagcagcgctgacagctgtgacagcgagaccaccgtgaccagcctgggggaggacctggccacccccacagcccaggaccagccctacttcaatgaaagtgaggaggagagcctggtgcccctgcagaagggcctggagaaggctgctgctgtggccgacaagaggaagagcggcagccaggacttcccccagtgcaacaccatcgagaacacaggcaccaagcagagcacctgcagccctggggaccacatcatcgagatcacagaggtggaggaggacctcttccctgctgagaccgtggagctgctgcgggaggccagcgctgagagtgatgtgggcaagagcagcgagagcgagttcacccagtacaccacccaccacatcctgaagagcctggccagcattgaggccaagtgcagcgacatgagcagcgagaacaccactggaccacccagctccatggacagagtgaacacagccctgcagagggcccagatgaaggtgtgcagcctgagcaaccagaggatgggccgcagcctgctgaagagcaaggacctgctgaagcagcgctacctgtttgccaaggccggctaccccctgcggcgcagccagagcctgcccaccaccctgctgagccctgtgcgggtggtgtcctctgtgaatgtgcggctgagccctgggaaggagacccgctgcagccccccatccttcacctacaagtacaccccagaggaggagcaggagctggagaagagggtgatggagcatgatggccagagcctggtgaagagcaccatcttcatcagccccagctctgtgaagaaggaggaggccccccagagcgaggccccccgggtggaggagtgccaccacggccgcacccccacctgcagccggctggcccccccacccatgagccagagcacctgcagcctgcacagcatccacagcgagtggcaggagcggcccctgtgtgagcacaccaggaccctgagcacccacagcgtgcccaacatcagcggggccacctgcagcgcctttgccagccccttcggctgcccctacagccacagacatgccacctacccctacagagtgtgcagcgtgaacccccccagcgccatcgagatgcagctgcggcgggtgctgcatgacatccggaacagcctgcagaacctgagccagtaccccatgatgaggggccctgaccctgctgctgccccctacagcacccagaagagctctgtgctgcccctgtatgagaacaccttccaggagctgcaggtgatgaggaggagcctgaacctcttccgcacccagatgatggacctggagctggccatgctgcggcagcagaccatggtgtaccaccacatgacagaggaggagagatttgaggtggaccagctgcagggcctgagaaattctgtgaggatggagctgcaggacctggagctgcagctggaggagcggctgctgggcctggaggagcagctgcgggctgtgaggatgcccagccccttccgcagcagcgccctgatggtgacagagctgatgcaggagcagagctacctgaagtctgagctgggcctgggcctgggggagatgggctttgagatccccccaggagagagcagcgagagcgtcttcagccaggccaccagcgagagcagctctgtgtgcagcggccccagccacgccaacagaagaactggagtgcccagcacagcctctgtgggcaagagcaagacccccctggtggccaggaagaaggtgttccgggcctctgtggccctgacccccacagcccccagcaggacaggctctgtgcagaccccaccagacctggagagcagcgaggaggtggatgctgctgagggcgcccctgaggtggtgggccccaagtctgaggtggaggagggccacggcaagctgcccagcatgcctgctgctgaggagatgcacaagaatgtggagcaggatgagctgcagcaggtgatccgggagatcaaggagagcatcgtgggggagatccggcgggagatcgtgtctggcctgctggccgctgtgagcagcagcaaggccagcaacagcaagcaggactaccactag

SEQ ID NO: 38515 - DNA, 3780 bp, Artificial Sequence
  Description of Artificial Sequence: Synthetic coding sequence
atggaccggcccctgagcagcagcgctgaggccgaggaggagctggagtggcaggtggccagcagaagaaggaaggcctgggccaagtgccgcagctcctggcaggccagcgagacagaggacctgagcacagaggccaccacccaggatgaggaggaggatgaggaggaggacctgcccggggcccagctgcctgctgctgggggcagaggaaatgtgcccaatgagaagatcgccatctggctgaaggactgcaggacccccctgggcgccagcctggatgagcagagcagcagcaccctgaagggcgtgctggtgagaaatggaggcagctttgaagatgacctgagcctgggcgctgaggccaaccacctgcacgagagtgatgcccagatcgagaactgcaacaacatcctggccaaggagcggcggctgcagttccaccagaagggccgctccatgaacagcactggaagtggcaagagcagcggcaccgtgtcctctgtgtctgagctgctggagctgtatgaggaggaccctgaggagatcctgtacaacctgggcttcggcagagatgagccagacatcgccagcaagatccccagccgcttcttcaacagcagcagctttgccaagggcatcgacatcaaggtgttcctgagcgcccagatgcagaggatggaggtggagaaccccaactatgccctgaccagccgcttccggcagatcgaggtgctgaccaccgtggccaatgccttcagcagcctgtacagccaggtgtctggcacccccctgcagagaattggctccatgagctctgtgaccagcaacaaggagacagaccccccaccacccctgaccaggagcaacacagccaaccggctgatgaagaccctgagcaagctgaacctgtgtgtggacaagacagagaagggggagagcagcagccccagccccagcgctgagaagggcaagatcctgaatgtgtctgtcatcgaggagagcggcaacaagaatgaccagaagagccagaagatcatgaagaagaaggagagcagctccatgctggccaccgtgaaggaggaggtgtctggcagcagcgctgctgtgacagaaaatgctgacagcgaccgcatcagtgatgaggccaacagcaacttcaaccagggcacagaaaatgagcagagcaaggagacccagagccatgagagcaagctgggggaggagagcggcatcgtggagagcaagctggacagcgacttcaacatcagcagccacagcgagctggagaacagcagcgagctgaagtctgtgcacatcagcaccccagagaaggagccctgtgcccccctgaccatccccagcatccggaacatcatgacccagcagaaggacagctttgagatggaggaggtgcagagcacagaaggagaggcccctcatgtgcctgccacctaccagctgggcctgaccaagagcaagagggaccacctgctgaggacagccagccagcacagcgacagcagcggctttgctgaggacagcacagactgcctgagcctgaaccacctgcaggtgcaggagagcctgcaggccatgggcagcagcgctgacagctgtgacagcgagaccaccgtgaccagcctgggggaggacctggccacccccacagcccaggaccagccctacttcaatgaaagtgaggaggagagcctggtgcccctgcagaagggcctggagaaggctgctgctgtggccgacaagaggaagagcggcagccaggacttcccccagtgcaacaccattgaaaatacaggcaccaagcagagcacctgcagccctggggaccacatcatcgagatcacagaggtggaggaggacctcttccctgctgagaccgtggagctgctgcgggaggccagcgctgagagtgatgtgggcaagagcagcgagagcgagttcacccagtacaccacccaccacatcctgaagagcctggccagcattgaggccaagtgcagcgacatgagcagcgagaacaccaccggcccccccagctccatggacagagtgaacacagccctgcagagggcccagatgaaggtgtgcagcctgagcaaccagaggatgggccgcagcctgctgaagagcaaggacctgctgaagcagcgctacctgtttgccaaggccggctaccccctgcggcgcagccagagcctgcccaccaccctgctgagccctgtgcgggtggtgtcctctgtgaatgtgcggctgagccctgggaaggagacccgctgcagcccccccagcttcacctacaagtacaccccagaggaggagcaggagctggagaagagggtgatggagcatgatggccagagcctggtgaagagcaccatcttcatcagccccagctctgtgaagaaggaggaggccccccagagcgaggccccccgggtggaggagtgccaccacggccgcacccccacctgcagccggctggcccccccacccatgagccagagcacctgcagcctgcacagcatccacagcgagtggcaggagcggcccctgtgtgagcacaccaggaccctgagcacccacagcgtgcccaacatcagcggggccacctgcagcgcctttgccagccccttcggctgcccctacagccacagacatgccacctacccctacagagtgtgcagcgtgaaccccccatctgccatcgagatgcagctgcggcgggtgctgcatgacatccggaacagcctgcagaacctgagccagtaccccatgatgaggggccctgaccctgctgctgccccctacagcacccagaagagctctgtgctgcccctgtatgagaacaccttccaggagctgcaggtgatgagaagaagcctgaacctcttccgcacccagatgatggacctggagctggccatgctgcggcagcagaccatggtgtaccaccacatgacagaggaggagagatttgaggtggaccagctgcagggcctgaggaacagcgtgaggatggagctgcaggacctggagctgcagctggaggagcggctgctgggcctggaggagcagctgcgggctgtgaggatgcccagccccttccgcagcagcgccctgatgggcatgtgtggcagccgctctgctgacaacctgagctgccccagccccctgaatgtgatggagcctgtgacagagctgatgcaggagcagagctacctgaagtctgagctgggcctgggcctgggggagatgggctttgagatccccccaggagagagcagcgagagcgtcttcagccaggccaccagcgagagcagctctgtgtgcagcggccccagccacgccaacagaagaactggagtgcccagcacagcctctgtgggcaagagcaagacccccctggtggccaggaagaaggtgttccgggcctctgtggccctgacccccacagcccccagcaggactggatctgtgcagaccccaccagacctggagagcagcgaggaggtggatgctgctgagggcgcccctgaggtggtgggccccaagtctgaggtggaggagggccacggcaagctgcccagcatgcctgctgctgaggagatgcacaagaatgtggagcaggatgagctgcagcaggtgatccgggagatcaaggagagcatcgtgggggagatcagaagagagatcgtgtctggcctgctggccgctgtgagcagcagcaaggccagcaacagcaagcaggactaccactag

SEQ ID NO: 38516 - DNA, 519 bp, Artificial Sequence
  Description of Artificial Sequence: Synthetic coding sequence
atgcctgtgggcgccggcctgcccaccagcctgaccagcccccccagcacagaggcccccaagagcagcctgctgaggaagcagacccagccccccaagaagcagagcagccctgctgtgcacctgcgctgcaccatggaccctgtgatgatgacagtgtccccacctccagcccaccgccacagaagaagaggcagccccacccgctgtgcccactgccctgtggcctgggccccagacacagatgatgagaagccccaccagtacccagccatctgcagctaccactgggatgtgcctgaggactgggagggcttccagcacacccagggcacctgggtgccctggagccaggatgcccctgagagccccccccagaccatccgcttccagcccggccggcagagcgagacccccagcaagaagaagaagaagaagaagaagaagaggaacatcggggcccccctgaagcgctacctgactgtgaccagccagctgtctgtgaccagcctgctgtag

SEQ ID NO: 38517 - DNA, 930 bp, Artificial Sequence
  Description of Artificial Sequence: Synthetic coding sequence
atggccatggtggagcggcccaggcctgagtgggccagctaccacaactgcaacagcaacagctgccaggacctgggcaacagcgtgctgctgctgctgggcctcatcatctgcatcaacatcagcatcaacatcgtgaccctgctgtggagccgcttccggggcgtgctgtaccaggtgttccatgacaccatctgtgagaaggaggcccccaagagcagcctgctgaggaagcagacccagccccccaagaagcagagcagccctgctgtgcacctgcgctgcaccatggaccctgtgatgatgacagtgagccccccaccagcccaccgccacagaagaagaggcagccccacccgctgtgcccactgccctgtggcctgggccccagacacagatgatgagaagccccaccagtacccagccatctgcagctaccactgggatgtgcctgaggactgggagggcttccagcacacccagggcacctgggtgccctggagccaggatgcccctgagagccccccccagaccatccgcttccagcccaccgtggaggagcggcccctgaagacaggcatctggagcgagctgggcctgcgggcctacgtgtaccctgtgaaccccccaccacccagccctgaggcccccagccacaagaatggaggagagggcgctgtgcctgaggccgaggccgcccagtaccagcctgtgcctgcccccaccctgggccctgctgtgattcctgagttcagccgccacaggagcagcggccgcatcgtgtatgatgcccgggacatgagaagaaggctgcgggagctgacccgggaggtggaggccctgagcggctgctaccccctggccagcggcagcagcacagctgaggagaccagcaagaactgggtgtaccgcagcctgactggaagatag

SEQ ID NO: 38518 - DNA, 987 bp, Artificial Sequence
  Description of Artificial Sequence: Synthetic coding sequence
atggccagccgctgcagcgagccctacccagaggtgagccgcatccccaccgtgcggggctgcaatggcagcctgagcggggccctgagctgctgtgaagattctgcccggggcagcggcccccccaaggcccccaccgtggccgagggccccagcagctgcctgcggagaaatgtcatcagcgagcgggagaggaggaagaggatgagcctgagctgtgagcggctgcgggccctgctgccccagtttgatggccggcgggaggacatggcctctgtgctggagatgtctgtgcagttcctgcggctggccagcgccctgggccccagccaggagcagcacgccatcctggccagcagcaaggagatgtggcacagcctgcaggaggatgtgctgcagctgaccctgagcagccagatccaggccggcgtgcctgaccccggcactggagccagcagcggcaccaggaccccagatgtgaaggccttcctggagagcccctggagcctggaccctgccagcgccagccctgagcctgtgccccacatcctggccagcagccggcagtgggaccctgccagctgcaccagcctgggcacagacaagtgtgaggccctgctgggcctgtgccaggtgcggggcggcctgccccccttcagcgagcccagcagcctggtgccctggcccccaggccgcagcctgcccaaggctgtgcggccccccctgtcctggccacccttcagccagcagcagaccctgcctgtgatgtctggagaggccctgggctggctgggccaggccggccccctggccatgggcgccgcccccctgggggagcccgccaaggaggaccccatgctggcccaggaggccggcagcgccctgggcagtgatgtggatgatggcaccagcttcctgctgacagctggccccagctcctggccaggagagtggggccctggcttccgggccggccccccagcctag

SEQ ID NO: 38519 - DNA, 1164 bp, Artificial Sequence
  Description of Artificial Sequence: Synthetic coding sequence
atggccagccgctgcagcgagccctacccagaggtgagccgcatccccaccgtgcggggctgcaatggcagcctgagcggggccctgagctgctgtgaagattctgcccggggcagcggcccccccaaggcccccaccgtggccgagggccccagcagctgcctgcggagaaatgtcatcagcgagcgggagaggaggaagaggatgagcctgagctgtgagcggctgcgggccctgctgccccagtttgatggccggcgggaggacatggcctctgtgctggagatgtctgtgcagttcctgcggctggccagcgccctgggccccagccaggagcagcacgccatcctggccagcagcaaggagatgtggcacagcctgcaggaggatgtgctgcagctgaccctgagcagccagatccaggccggcgtgcctgaccccggcactggagccagcagcggcaccaggaccccagatgtgaaggccttcctggagagcccctggagcctggaccctgccagcgccagccctgagcctgtgccccacatcctggccagcagccggcagtgggaccctgccagctgcaccagcctgggcacagacaagtgtgaggccctgctgggcctgtgccaggtgcggggcggcctgccccccttcagcgagcccagcagcctggtgccctggcccccaggccgcagcctgcccaaggctgtgcggccccccctgtcctggccacccttcagccagcagcagaccctgcctgtgatgtctggagaggccctgggctggctgggccaggccggccccctggccatgggcgccgcccccctgggggagcccgccaaggaggaccccatgctggcccaggaggccggcagcgccctgggcagtgatgtggatgatggcaccagcttcctgctgacagctggccccagctcctggccaggcagcctggagggccggggcggcagcggccctgcctgggccccagctgagagcagccccctggatgtgggggagcccggcttcctgggggaccctgagctgggcagccaggagctgcaggacagccccctggagccctggggcctggatgtggactgtgccggcctggccctgaaggatgaggtggagagcatcttcccagacttctttgcctgctag

SEQ ID NO: 38520 - DNA, 684 bp, Artificial Sequence
  Description of Artificial Sequence: Synthetic coding sequence
atgagctacttccgcaccccccagacccaccctggccccctgcccagcggccagggcggggccgccagccctggcctgagcctgggcctgtgcagccctgtggagcctgtggtggtggccagcggcggcaccggccccctgagccagaaggccgagcaggtggccccagctgcccaggcctggggccctgccctggccatgccccaggcccggggctgccctgggggcacctcctgggagaccctgaggaaggagtacagcaggaactgccacaagttcccccacgtgcggcagctggagagcctgggctgggacaatggctacagccgcagccgggccccagacctgggcggccccagccggccccggcccctgatgctgtgtggcctgagcccccgggtgctgcctgtgcccagcgaggccgtgggcaaggaggccagcagccagcctgacatctgcatcctgaccctggccatgatgattgctggcatccccaccgtgcctgtgcctggggtgcgggaggaggacctgatctgggccgcccaggccttcatgatggcccaccctgagcctgagggcgctgtggagggcgcccgctgggagcaggcccacgcccacacagccagcggcaagatgcccctggtgcgcagcaagaggggccagcccccaggcagctgcctgtag

SEQ ID NO: 38521 - DNA, 765 bp, Artificial Sequence
  Description of Artificial Sequence: Synthetic coding sequence
atgcccatcaagcctgtgggctggatctgtggccaggtgctgaagaacttcagcggcagaattgagggcatccagaaggccatcatggacctggtggatgagttcaaggatgagttccccaccatcctgcggctgagccagagcaaccagaagcgggagcccgcccagaagaccagcaagatccgcatggccatcgccctggccaagatcaacagagccaccctcatccggggcctgaacagcatcagccgcagcagcaagtctgtggccaagctgctgcacccccagctggcctgccgcctgctggagctgcgggacatcagcggccgcctgctgcgggaggtgaatgccccccggcagcccctgtacaacatccaggtgaggaagggcagcctgtttgagatcatctccttccctgccaagacagccctgaccagcatcatctatgccagctatgctgccctgatctacctggccgtgtgtgtgaatgctgtgctgaagaaggtgaagaacatcttccaggaggaggagagcatccggcagaaccgggaggagagcgagaactgcaggaaggccttcagcgagcctgtgctgtctgagcccatgtttgctgagggggagatcaaggccaagccctaccgcagcctgcctgagaagccagacatcagtgactaccccaagctgctggccaacaagcagagcaacaacatccaggtgctgcacagcgtgtttgaccagagcgctgagatgaatgagcagatctag

SEQ ID NO: 38522 - DNA, 765 bp, Artificial Sequence; identical to SEQ ID NO: 38521
  Description of Artificial Sequence: Synthetic coding sequence

SEQ ID NO: 38523 - DNA, 408 bp, Artificial Sequence
  Description of Artificial Sequence: Synthetic coding sequence
atgcccatcaagcctgtgggctggatctgtggccaggtgctgaagaacttcagcggcagaattgagggcatccagaaggccatcatggacctggtggatgagttcaaggatgagttccccaccatcctgcggctgagccagagcaaccagaagcgggagcccgcccagaagaccagcaagatccgcatggccatcgccctggccaagatcaacagagccaccctcatccggggcctgaacagcatcagccgcagcagcaagtctgtggccaagctgctgcacccccagctggcctgccgcctgctggagctgcgggacatcagcggccgcctgctgcgggaggtgaatgccccccggcagcccctgtacaacatccaggagaagaagatgggcctgcagctgtcctag

SEQ ID NO: 38524 - DNA, 1272 bp, Artificial Sequence
  Description of Artificial Sequence: Synthetic coding sequence
atgaagcccaacttcagcctgcggctgcgcatcttcaacctgaactgctggggcatcccctacctgagcaagcacagagctgacaggatgaggcggctgggggacttcctgaaccaggagagctttgacctggccctgctggaggaggtgtggagcgagcaggacttccagtacctgcggcagaagctgagccccacctacccagctgcccaccacttccgcagcggcatcatcggcagcggcctgtgtgtgttcagcaagcaccccatccaggagctgacccagcacatctacaccctgaatggctacccctacatgatccaccacggggactggttcagcggcaaggctgtgggcctgctggtgctgcacctgagcggcatggtgctgaatgcctacgtgacccacctgcatgctgagtacaaccggcagaaggacatctacctggcccaccgggtggcccaggcctgggagctggcccagttcatccaccacaccagcaagaaggcagatgtggtgctgctgtgtggggacctgaacatgcaccctgaggacctgggctgctgcctgctgaaggagtggacaggcctgcatgatgcctacctggagacccgggacttcaagggcagcgaggagggcaacaccatggtgcccaagaactgctacgtgtcccagcaggagctgaagcccttcccctttggagtgagaattgattatgtgctgtacaaggctgtgtctggcttctacatcagctgcaagagctttgagaccaccactggatttgacccccaccggggcacccccctgagtgaccacgaggccctgatggccaccctgtttgtgcgccacagccccccccagcagaaccccagcagcacccacggccctgctgagaggagccccctgatgtgtgtgctgaaggaggcctggacagagctgggcctgggcatggcccaggcccgctggtgggccacctttgccagctatgtgattggcctgggcctgctgctgctggccctgctgtgtgtgctggccgccggcggcggggccggggaggccgccatcctgctgtggaccccatctgtgggcctggtgctgtgggccggggccttctacctgttccacgtgcaggaggtgaatggcctgtaccgggcccaggccgagctgcagcacgtgctgggccgggcccgggaggcccaggacctgggccctgagccccagcctgccctgctgctgggccagcaggagggggacaggaccaaggagcagtag

SEQ ID NO: 38525 - DNA, 846 bp, Artificial Sequence
  Description of Artificial Sequence: Synthetic coding sequence
atgcctgtgcagctgaccacagccctgcgggtggtgggcaccagcctgtttgccctggccgtgctgggcggcatcctggccgcctacgtgacaggctaccagttcatccacacagagaagcactacctgagctttggcctgtatggagccatcctgggcctgcacctgctgatccagagcctgtttgccttcctggagcacaggaggatgagaagagctggccaggccctgaagctgcccagcccccggcggggctctgtggccctgtgcatcgccgcctaccaggaggaccctgactacctgaggaagtgcctgcggagcgcccagaggatctccttcccagacctgaaggtggtgatggtggtggatggcaaccggcaggaggatgcctacatgctggacatcttccacgaggtgctgggcggcacagagcaggccggcttctttgtgtggaggagcaacttccacgaggccggggagggggagacagaggccagcctgcaggagggcatggacagagtgagagatgtggtgcgggccagcaccttcagctgcatcatgcagaagtggggcggcaagcgggaggtgatgtacacagccttcaaggccctgggggacagcgtggactacatccaggtgtgtgacagcgacacagtgctggaccctgcctgcaccatcgagatgctgcgggtgctggaggaggacccccaggtgggcggcgtgggcggagatgtgcagcccccaggcaagggcatggctgtggaggatgaccaggtgcaggccgcccaggtgcgggccacagaggcctggagcgtgcaccagagacatgtgtcccgggagcagtag

SEQ ID NO: 38526 - DNA, 2175 bp, Artificial Sequence
  Description of Artificial Sequence: Synthetic coding sequence
atggccggcaggaagcacttctggcagccccgctggtgcccccgctggctggagccccccctgctgactggagcccgggagagctgtggggtgcagcacagagatggcatcagccggccctggggccctgtgaaggccagcatccaggagtgcatcctgcctgacagccccctgtaccacaacaaggtgcagttcacccccaccggcggcctgggcctgaacctggccctgaacccctttgagtactacatcttcttctttgccctgagcctcatcacccagaagcccctgcctgtgtccctgcacgtgaggaccagtgactgtgcctacttcatcctggtggaccgctacctgtcctggttcctgcccacagagggctctgtgcccccacccctgagcagcagccctgggggcaccagccccagccccccacccaggaccccagccatcccctttgccagctatggcctgcaccacaccagcctgctgaagaggcacatcagccaccagacctctgtgaatgctgaccctgccagccatgagatctggaggtctgagaccctgctgcaggtgtttgtggagatgtggctgcaccactacagcctggagatgtaccagaagatgcagagcccccacgccaaggagagcttcacccccacagaggagcacgtgctggtggtgcggctgctgctgaagcacctgcacgcctttgccaacagcctgaagccagagcaggccagccccagcgcccacagccacgccaccagccccctggaggagttcaagagagctgctgtgcccaggtttgtgcagcagaagctgtacctgttcctgcagcactgcttcggccactggcccctggatgccagcttccgggctgtgctggagatgtggctgagctacctgcagccctggaggtatgccccagacaagcaggcccctggcagtgacagccagccccgctgtgtgtctgagaagtgggccccctttgtgcaggagaacctgctgatgtacaccaagctgtttgtgggcttcctgaacagagccctgaggacagacctggtgagccccaagcacgccctgatggtgttccgggtggccaaggtgtttgcccagcccaacctggccgagatgatccagaagggggagcagctgttcctggagcctgagctggtgatcccccaccggcagcacaggctcttcaccgcccccaccttcaccggcagcttcctgagcccctggcccccagctgtgacagatgccagcttcaaggtgaagagccacgtgtacagcctggagggccaggactgcaagtacacccccatgtttggacctgaggcccggaccctggtgctgcggctggcccagctgatcacccaggccaagcacacagccaagagcatcagtgaccagtgtgccgagagccctgctggccacagcttcctgtcctggctgggcttcagctccatggacaccaacggcagctacacagccaatgacctggatgagatgggccaggacagcgtgaggaagacagatgagtacctggagaaggccctggagtacctgcggcagatcttccggctgtctgaggcccagctgcggcagttcaccctggccctgggcaccacccaggatgaaaatggcaagaagcagctgcctgactgcatcgtgggggaggatggcctcatcctgacccccctgggccgctaccagatcatcaatggcctgcggagatttgaaattgagtaccagggcgaccctgagctgcagcccatccgctcctatgagatcgccagcctggtgaggaccctcttccggctgagcagcgccatcaaccacagatttgctggccagatggccgccctgtgcagcagagatgacttcctgggcagcttctgccgctaccacctgacagagcccggcctggccagccgccacctgctgagccctgtgggccggcggcaggtggccggccacacccggggcccccggctgagcctgcgcttcctgggcagctaccgcaccctggtgtccctgctgctggccttctttgtggccagcctcttctgtgtgggccccctgccctgcaccctgctgctgaccctgggctacgtgctgtatgccagcgccatgaccctgctgacagagcggggcaagctgcaccagccctag

SEQ ID NO: 38527 - DNA, 2514 bp, Artificial Sequence
  Description of Artificial Sequence: Synthetic coding sequence
atgaccaccttcggggctgtggccgagtggaggctgcccagcctgcggcgggccaccctgtggatcccccagtggtttgccaagaaggccatcttcaacagccccctggaggccgccatggccttcccccacctgcagcagcccagcttcctgctggccagcctgaaggctgacagcatcaacaagccctttgcccagcagtgccaggacctggtgaaggtgattgaggacttccctgccaaggagctgcacaccatcttcccctggctggtggagagcatcttcggcagcctggatggagtgctggtgggctggaacctgcgctgcctgcagggccgggtgaaccctgtggagtacagcatcgtgatggagttcctggaccccggcggccccatgatgaagctggtgtacaagctgcaggccgaggactacaagtttgacttccctgtgtcctacctgcccggccctgtgaaggccagcatccaggagtgcatcctgcctgacagccccctgtaccacaacaaggtgcagttcacccccactggaggcctgggcctgaacctggccctgaacccctttgagtactacatcttcttctttgccctgagcctcatcacccagaagcccctgcctgtgtccctgcacgtgaggaccagtgactgtgcctacttcatcctggtggaccgctacctgtcctggttcctgcccacagagggctctgtgcccccacccctgagcagcagccctgggggcaccagccccagccccccacccaggaccccagccatcccctttgccagctatggcctgcaccacaccagcctgctgaagaggcacatcagccaccagacctctgtgaatgctgaccctgccagccatgagatctggaggtctgagaccctgctgcaggtgtttgtggagatgtggctgcaccactacagcctggagatgtaccagaagatgcagagcccccacgccaaggagagcttcacccccacagaggagcacgtgctggtggtgcggctgctgctgaagcacctgcacgcctttgccaacagcctgaagccagagcaggccagccccagcgcccacagccacgccaccagccccctggaggagttcaagagagctgctgtgcccaggtttgtgcagcagaagctgtacctgttcctgcagcactgcttcggccactggcccctggatgccagcttccgggctgtgctggagatgtggctgagctacctgcagccctggaggtatgccccagacaagcaggcccctggcagtgacagccagccccgctgtgtgtctgagaagtgggccccctttgtgcaggagaacctgctgatgtacaccaagctgtttgtgggcttcctgaacagagccctgaggacagacctggtgagccccaagcacgccctgatggtgttccgggtggccaaggtgtttgcccagcccaacctggccgagatgatccagaagggggagcagctgttcctggagcctgagctggtgatcccccaccggcagcacaggctcttcaccgcccccaccttcaccggcagcttcctgagcccctggcccccagctgtgacagatgccagcttcaaggtgaagagccacgtgtacagcctggagggccaggactgcaagtacacccccatgtttggacctgaggcccggaccctggtgctgcggctggcccagctgatcacccaggccaagcacacagccaagagcatcagtgaccagtgtgccgagagccctgctggccacagcttcctgtcctggctgggcttcagctccatggacaccaacggcagctacacagccaatgacctggatgagatgggccaggacagcgtgaggaagacagatgagtacctggagaaggccctggagtacctgcggcagatcttccggctgtctgaggcccagctgcggcagttcaccctggccctgggcaccacccaggatgaaaatggcaagaagcagctgcctgactgcatcgtgggagaagatggcctcatcctgacccccctgggccgctaccagatcatcaatggcctgcggagatttgaaattgagtaccagggcgaccctgagctgcagcccatccgctcctatgaaattgccagcctggtgaggaccctcttccggctgagcagcgccatcaaccacagatttgctggccagatggccgccctgtgcagcagagatgacttcctgggcagcttctgccgctaccacctgacagagcccggcctggccagccgccacctgctgagccctgtgggccggcggcaggtggccggccacacccggggcccccggctgagcctgcgcttcctgggcagctaccgcaccctggtgtccctgctgctggccttctttgtggccagcctcttctgtgtgggccccctgccctgcaccctgctgctgaccctgggctacgtgctgtatgccagcgccatgaccctgctgacagagcggggcaagctgcaccagccctag

SEQ ID NO: 38528 - DNA, 2601 bp, Artificial Sequence
  Description of Artificial Sequence: Synthetic coding sequence
atgaccaccttcggggctgtggccgagtggaggctgcccagcctgcggcgggccaccctgtggatcccccagtggtttgccaagaaggccatcttcaacagccccctggaggccgccatggccttcccccacctgcagcagcccagcttcctgctggccagcctgaaggctgacagcatcaacaagccctttgcccagcagtgccaggacctggtgaaggtgattgaggacttccctgccaaggagctgcacaccatcttcccctggctggtggagagcatcttcggcagcctggatggagtgctggtgggctggaacctgcgctgcctgcagggccgggtgaaccctgtggagtacagcatcgtgatggagttcctggaccccggcggccccatgatgaagctggtgtacaagctgcaggccgaggactacaagtttgacttccctgtgtcctacctgcccggccctgtgaaggccagcatccaggagtgcatcctgcctgacagccccctgtaccacaacaaggtgcagttcacccccactggaggcctgggcctgaacctggccctgaacccctttgagtactacatcttcttctttgccctgagcctcatcacccagaagcccctgcctgtgtccctgcacgtgaggaccagtgactgtgcctacttcatcctggtggaccgctacctgtcctggttcctgcccacagagggctctgtgcccccacccctgagcagcagccctgggggcaccagccccagccccccacccaggaccccagccatcccctttgccagctatggcctgcaccacaccagcctgctgaagaggcacatcagccaccagacctctgtgaatgctgaccctgccagccatgagatctggaggtctgagaccctgctgcaggtgtttgtggagatgtggctgcaccactacagcctggagatgtaccagaagatgcagagcccccacgccaagctggaggtgctgcactaccgcctgtctgtgtcctctgccctgtacagccctgcccagcccagcctgcaggccctgcacgcctaccaggagagcttcacccccacagaggagcacgtgctggtggtgcggctgctgctgaagcacctgcacgcctttgccaacagcctgaagccagagcaggccagccccagcgcccacagccacgccaccagccccctggaggagttcaagagagctgctgtgcccaggtttgtgcagcagaagctgtacctgttcctgcagcactgcttcggccactggcccctggatgccagcttccgggctgtgctggagatgtggctgagctacctgcagccctggaggtatgccccagacaagcaggcccctggcagtgacagccagccccgctgtgtgtctgagaagtgggccccctttgtgcaggagaacctgctgatgtacaccaagctgtttgtgggcttcctgaacagagccctgaggacagacctggtgagccccaagcacgccctgatggtgttccgggtggccaaggtgtttgcccagcccaacctggccgagatgatccagaagggggagcagctgttcctggagcctgagctggtgatcccccaccggcagcacaggctcttcaccgcccccaccttcaccggcagcttcctgagcccctggcccccagctgtgacagatgccagcttcaaggtgaagagccacgtgtacagcctggagggccaggactgcaagtacacccccatgtttggacctgaggcccggaccctggtgctgcggctggcccagctgatcacccaggccaagcacacagccaagagcatcagtgaccagtgtgccgagagccctgctggccacagcttcctgtcctggctgggcttcagctccatggacaccaacggcagctacacagccaatgacctggatgagatgggccaggacagcgtgaggaagacagatgagtacctggagaaggccctggagtacctgcggcagatcttccggctgtctgaggcccagctgcggcagttcaccctggccctgggcaccacccaggatgaaaatggcaagaagcagctgcctgactgcatcgtgggggaggatggcctcatcctgacccccctgggccgctaccagatcatcaatggcctgcggagatttgaaattgagtaccagggcgaccctgagctgcagcccatccgctcctatgagatcgccagcctggtgaggaccctcttccggctgagcagcgccatcaaccacagatttgctggccagatggccgccctgtgcagcagagatgacttcctgggcagcttctgccgctaccacctgacagagcccggcctggccagccgccacctgctgagccctgtgggccggcggcaggtggccggccacacccggggcccccggctgagcctgcgcttcctgggcagctaccgcaccctggtgtccctgctgctggccttctttgtggccagcctcttctgtgtgggccccctgccctgcaccctgctgctgaccctgggctacgtgctgtatgccagcgccatgaccctgctgacagagcggggcaagctgcaccagccctag

SEQ ID NO: 38529 - DNA, 1509 bp, Artificial Sequence
  Description of Artificial Sequence: Synthetic coding sequence
atgcagaccccaccacccaccaggtctgggggccagaagctgtgcagccgcttcctgctgaagtgtggcttcatcaccatcccctggcgctgcatcaagaagtgcagccccctgatgcccagggctgctgtgcccaggtttgtgcagcagaagctgtacctgttcctgcagcactgcttcggccactggcccctggatgccagcttccgggctgtgctggagatgtggctgagctacctgcagccctggaggtatgccccagacaagcaggcccctggcagtgacagccagccccgctgtgtgtctgagaagtgggccccctttgtgcaggagaacctgctgatgtacaccaagctgtttgtgggcttcctgaacagagccctgaggacagacctggtgagccccaagcacgccctgatggtgttccgggtggccaaggtgtttgcccagcccaacctggccgagatgatccagaagggggagcagctgttcctggagcctgagctggtgatcccccaccggcagcacaggctcttcaccgcccccaccttcaccggcagcttcctgagcccctggcccccagctgtgacagatgccagcttcaaggtgaagagccacgtgtacagcctggagggccaggactgcaagtacacccccatgtttggacctgaggcccggaccctggtgctgcggctggcccagctgatcacccaggccaagcacacagccaagagcatcagtgaccagtgtgccgagagccctgctggccacagcttcctgtcctggctgggcttcagctccatggacaccaacggcagctacacagccaatgacctggatgagatgggccaggacagcgtgaggaagacagatgagtacctggagaaggccctggagtacctgcggcagatcttccggctgtctgaggcccagctgcggcagttcaccctggccctgggcaccacccaggatgaaaatggcaagaagcagctgcctgactgcatcgtgggggaggatggcctcatcctgacccccctgggccgctaccagatcatcaatggcctgcggagatttgaaattgagtaccagggcgaccctgagctgcagcccatccgctcctatgagatcgccagcctggtgaggaccctcttccggctgagcagcgccatcaaccacagatttgctggccagatggccgccctgtgcagcagagatgacttcctgggcagcttctgccgctaccacctgacagagcccggcctggccagccgccacctgctgagccctgtgggccggcggcaggtggccggccacacccggggcccccggctgagcctgcgcttcctgggcagctaccgcaccctggtgtccctgctgctggccttctttgtggccagcctcttctgtgtgggccccctgccctgcaccctgctgctgaccctgggctacgtgctgtatgccagcgccatgaccctgctgacagagcggggcaagctgcaccagccctag

SEQ ID NO: 38530 - DNA, 2295 bp, Artificial Sequence
  Description of Artificial Sequence: Synthetic coding sequence
atgaccaccttcggggctgtggccgagtggaggctgcccagcctgcggcgggccaccctgtggatcccccagtggtttgccaagaaggccatcttcaacagccccctggaggccgccatggccttcccccacctgcagcagcccagcttcctgctggccagcctgaaggctgacagcatcaacaagccctttgcccagcagtgccaggacctggtgaaggtgattgaggacttccctgccaagggccctgtgaaggccagcatccaggagtgcatcctgcctgacagccccctgtaccacaacaaggtgcagttcacccccaccggcggcctgggcctgaacctggccctgaacccctttgagtactacatcttcttctttgccctgagcctcatcacccagaagcccctgcctgtgtccctgcacgtgaggaccagtgactgtgcctacttcatcctggtggaccgctacctgtcctggttcctgcccacagagggctctgtgcccccacccctgagcagcagccctgggggcaccagccccagccccccacccaggaccccagccatcccctttgccagctatggcctgcaccacaccagcctgctgaagaggcacatcagccaccagacctctgtgaatgctgaccctgccagccatgagatctggaggtctgagaccctgctgcaggtgtttgtggagatgtggctgcaccactacagcctggagatgtaccagaagatgcagagcccccacgccaaggagagcttcacccccacagaggagcacgtgctggtggtgcggctgctgctgaagcacctgcacgcctttgccaacagcctgaagccagagcaggccagccccagcgcccacagccacgccaccagccccctggaggagttcaagagagctgctgtgcccaggtttgtgcagcagaagctgtacctgttcctgcagcactgcttcggccactggcccctggatgccagcttccgggctgtgctggagatgtggctgagctacctgcagccctggaggtatgccccagacaagcaggcccctggcagtgacagccagccccgctgtgtgtctgagaagtgggccccctttgtgcaggagaacctgctgatgtacaccaagctgtttgtgggcttcctgaacagagccctgaggacagacctggtgagccccaagcacgccctgatggtgttccgggtggccaaggtgtttgcccagcccaacctggccgagatgatccagaagggggagcagctgttcctggagcctgagctggtgatcccccaccggcagcacaggctcttcaccgcccccaccttcaccggcagcttcctgagcccctggcccccagctgtgacagatgccagcttcaaggtgaagagccacgtgtacagcctggagggccaggactgcaagtacacccccatgtttggacctgaggcccggaccctggtgctgcggctggcccagctgatcacccaggccaagcacacagccaagagcatcagtgaccagtgtgccgagagccctgctggccacagcttcctgtcctggctgggcttcagctccatggacaccaacggcagctacacagccaatgacctggatgagatgggccaggacagcgtgaggaagacagatgagtacctggagaaggccctggagtacctgcggcagatcttccggctgtctgaggcccagctgcggcagttcaccctggccctgggcaccacccaggatgaaaatggcaagaagcagctgcctgactgcatcgtgggggaggatggcctcatcctgacccccctgggccgctaccagatcatcaatggcctgcggagatttgaaattgagtaccagggcgaccctgagctgcagcccatccgctcctatgagatcgccagcctggtgaggaccctcttccggctgagcagcgccatcaaccacagatttgctggccagatggccgccctgtgcagcagagatgacttcctgggcagcttctgccgctaccacctgacagagcccggcctggccagccgccacctgctgagccctgtgggccggcggcaggtggccggccacacccggggcccccggctgagcctgcgcttcctgggcagctaccgcaccctggtgtccctgctgctggccttctttgtggccagcctcttctgtgtgggccccctgccctgcaccctgctgctgaccctgggctacgtgctgtatgccagcgccatgaccctgctgacagagcggggcaagctgcaccagccctag

SEQ ID NO: 38531 - DNA, 1593 bp, Artificial Sequence
  Description of Artificial Sequence: Synthetic coding sequence
atgtggctgcaccactacagcctggagatgtaccagaagatgcagagcccccacgccaaggagagcttcacccccacagaggagcacgtgctggtggtgcggctgctgctgaagcacctgcacgcctttgccaacagcctgaagccagagcaggccagccccagcgcccacagccacgccaccagccccctggaggagttcaagagagctgctgtgcccaggtttgtgcagcagaagctgtacctgttcctgcagcactgcttcggccactggcccctggatgccagcttccgggctgtgctggagatgtggctgagctacctgcagccctggaggtatgccccagacaagcaggcccctggcagtgacagccagccccgctgtgtgtctgagaagtgggccccctttgtgcaggagaacctgctgatgtacaccaagctgtttgtgggcttcctgaacagagccctgaggacagacctggtgagccccaagcacgccctgatggtgttccgggtggccaaggtgtttgcccagcccaacctggccgagatgatccagaagggggagcagctgttcctggagcctgagctggtgatcccccaccggcagcacaggctcttcaccgcccccaccttcaccggcagcttcctgagcccctggcccccagctgtgacagatgccagcttcaaggtgaagagccacgtgtacagcctggagggccaggactgcaagtacacccccatgtttggacctgaggcccggaccctggtgctgcggctggcccagctgatcacccaggccaagcacacagccaagagcatcagtgaccagtgtgccgagagccctgctggccacagcttcctgtcctggctgggcttcagctccatggacaccaacggcagctacacagccaatgacctggatgagatgggccaggacagcgtgaggaagacagatgagtacctggagaaggccctggagtacctgcggcagatcttccggctgtctgaggcccagctgcggcagttcaccctggccctgggcaccacccaggatgaaaatggcaagaagcagctgcctgactgcatcgtgggggaggatggcctcatcctgacccccctgggccgctaccagatcatcaatggcctgcggagatttgaaattgagtaccagggcgaccctgagctgcagcccatccgctcctatgagatcgccagcctggtgaggaccctcttccggctgagcagcgccatcaaccacagatttgctggccagatggccgccctgtgcagcagagatgacttcctgggcagcttctgccgctaccacctgacagagcccggcctggccagccgccacctgctgagccctgtgggccggcggcaggtggccggccacacccggggcccccggctgagcctgcgcttcctgggcagctaccgcaccctggtgtccctgctgctggccttctttgtggccagcctcttctgtgtgggccccctgccctgcaccctgctgctgaccctgggctacgtgctgtatgccagcgccatgaccctgctgacagagcggggcaagctgcaccagccctag

SEQ ID NO: 38532 - DNA, 1824 bp, Artificial Sequence
  Description of Artificial Sequence: Synthetic coding sequence
atgcagaccccaccacccaccaggtctgggggccagaagctgtgcagccgcttcctgctgaagtgtggcttcatcaccatcccctggcgctgcatcaagaagtgcagccccctgatgcccagctggaggttctgcaccacagattctgtgtccccagcccccagcacagccccacccaacccagccagccggcccagcacccccaccaagagcctgggcaacagaggaagtgatgcccggggcttctactgggccgagttcagcagcggctgtgtgcaggatgaggagcaggagagcttcacccccacagaggagcacgtgctggtggtgcggctgctgctgaagcacctgcacgcctttgccaacagcctgaagccagagcaggccagccccagcgcccacagccacgccaccagccccctggaggagttcaagagagctgctgtgcccaggtttgtgcagcagaagctgtacctgttcctgcagcactgcttcggccactggcccctggatgccagcttccgggctgtgctggagatgtggctgagctacctgcagccctggaggtatgccccagacaagcaggcccctggcagtgacagccagccccgctgtgtgtctgagaagtgggccccctttgtgcaggagaacctgctgatgtacaccaagctgtttgtgggcttcctgaacagagccctgaggacagacctggtgagccccaagcacgccctgatggtgttccgggtggccaaggtgtttgcccagcccaacctggccgagatgatccagaagggggagcagctgttcctggagcctgagctggtgatcccccaccggcagcacaggctcttcaccgcccccaccttcaccggcagcttcctgagcccctggcccccagctgtgacagatgccagcttcaaggtgaagagccacgtgtacagcctggagggccaggactgcaagtacacccccatgtttggacctgaggcccggaccctggtgctgcggctggcccagctgatcacccaggccaagcacacagccaagagcatcagtgaccagtgtgccgagagccctgctggccacagcttcctgtcctggctgggcttcagctccatggacaccaacggcagctacacagccaatgacctggatgagatgggccaggacagcgtgaggaagacagatgagtacctggagaaggccctggagtacctgcggcagatcttccggctgtctgaggcccagctgcggcagttcaccctggccctgggcaccacccaggatgaaaatggcaagaagcagctgcctgactgcatcgtgggagaagatggcctcatcctgacccccctgggccgctaccagatcatcaatggcctgcggagatttgaaattgagtaccagggcgaccctgagctgcagcccatccgctcctatgaaattgccagcctggtgaggaccctcttccggctgagcagcgccatcaaccacagatttgctggccagatggccgccctgtgcagcagagatgacttcctgggcagcttctgccgctaccacctgacagagcccggcctggccagccgccacctgctgagccctgtgggccggcggcaggtggccggccacacccggggcccccggctgagcctgcgcttcctgggcagctaccgcaccctggtgtccctgctgctggccttctttgtggccagcctcttctgtgtgggccccctgccctgcaccctgctgctgaccctgggctacgtgctgtatgccagcgccatgaccctgctgacagagcggggcaagctgcaccagccctag

SEQ ID NO: 38533 - DNA, 1848 bp, Artificial Sequence
  Description of Artificial Sequence: Synthetic coding sequence
atgaccaccttcggggctgtggccgagtggaggctgcccagcctgcggcgggccaccctgtggatcccccagtggtttgccaagaaggccatcttcaacagccccctggaggccgccatggccttcccccacctgcagcagcccagcttcctgctggccagcctgaaggctgacagcatcaacaagccctttgcccagcagtgccaggacctggtgaaggtgattgaggacttccctgccaaggtgtttgtggagatgtggctgcaccactacagcctggagatgtaccagaagatgcagagcccccacgccaaggagagcttcacccccacagaggagcacgtgctggtggtgcggctgctgctgaagcacctgcacgcctttgccaacagcctgaagccagagcaggccagccccagcgcccacagccacgccaccagccccctggaggagttcaagagagctgctgtgcccaggtttgtgcagcagaagctgtacctgttcctgcagcactgcttcggccactggcccctggatgccagcttccgggctgtgctggagatgtggctgagctacctgcagccctggaggtatgccccagacaagcaggcccctggcagtgacagccagccccgctgtgtgtctgagaagtgggccccctttgtgcaggagaacctgctgatgtacaccaagctgtttgtgggcttcctgaacagagccctgaggacagacctggtgagccccaagcacgccctgatggtgttccgggtggccaaggtgtttgcccagcccaacctggccgagatgatccagaagggggagcagctgttcctggagcctgagctggtgatcccccaccggcagcacaggctcttcaccgcccccaccttcaccggcagcttcctgagcccctggcccccagctgtgacagatgccagcttcaaggtgaagagccacgtgtacagcctggagggccaggactgcaagtacacccccatgtttggacctgaggcccggaccctggtgctgcggctggcccagctgatcacccaggccaagcacacagccaagagcatcagtgaccagtgtgccgagagccctgctggccacagcttcctgtcctggctgggcttcagctccatggacaccaacggcagctacacagccaatgacctggatgagatgggccaggacagcgtgaggaagacagatgagtacctggagaaggccctggagtacctgcggcagatcttccggctgtctgaggcccagctgcggcagttcaccctggccctgggcaccacccaggatgaaaatggcaagaagcagctgcctgactgcatcgtgggagaagatggcctcatcctgacccccctgggccgctaccagatcatcaatggcctgcggagatttgaaattgagtaccagggcgaccctgagctgcagcccatccgctcctatgaaattgccagcctggtgaggaccctcttccggctgagcagcgccatcaaccacagatttgctggccagatggccgccctgtgcagcagagatgacttcctgggcagcttctgccgctaccacctgacagagcccggcctggccagccgccacctgctgagccctgtgggccggcggcaggtggccggccacacccggggcccccggctgagcctgcgcttcctgggcagctaccgcaccctggtgtccctgctgctggccttctttgtggccagcctcttctgtgtgggccccctgccctgcaccctgctgctgaccctgggctacgtgctgtatgccagcgccatgaccctgctgacagagcggggcaagctgcaccagccctag

SEQ ID NO: 38534 - DNA, 609 bp, Artificial Sequence
  Description of Artificial Sequence: Synthetic coding sequence
atcctggaggtgtacagcaccaaggccaagaactacgtgaatggccactgcaccaagtatgagccctggcagctgattgcctggagcgtggtgtggaccctgctgattgtgtggggctatgaatttgtgttccagcctgagagcctgtggagccgcttcaagaagaagtgcttcaagctgaccaggaagatgcccatcattggaaggaagatccaggacaagctgaacaagaccaaggatgacatcagcaagaacatgtccttcctgaaggtggacaaggagtatgtgaaggccctgcccagccagggcctgagcagcagcgctgtgctggagaagctgaaggagtacagctccatggatgccttctggcaggagggccgggccagcggcaccgtgtacagcggggaggagaagctgacagagctgctggtgaaggcctatggagactttgcctggagcaaccccctgcacccagacatcttccctggcctgaggaagattgaagctgagatcgtgcgcatcgcctgcagcctcttcaacggcggccctgacagctgtggctgtgaggccctcttcctgttctgcttcagcaacatgctggccccctag

SEQ ID NO: 38535 - DNA, 1707 bp, Artificial Sequence
  Description of Artificial Sequence: Synthetic coding sequence
atgcccagcacagacctgctgatgctgaaggcctttgagccctacctggagatcctggaggtgtacagcaccaaggccaagaactacgtgaatggccactgcaccaagtatgagccctggcagctgattgcctggagcgtggtgtggaccctgctgattgtgtggggctatgaatttgtgttccagcctgagagcctgtggagccgcttcaagaagaagtgcttcaagctgaccaggaagatgcccatcatcggcaggaagatccaggacaagctgaacaagaccaaggatgacatcagcaagaacatgtccttcctgaaggtggacaaggagtatgtgaaggccctgcccagccagggcctgagcagcagcgctgtgctggagaagctgaaggagtacagctccatggatgccttctggcaggagggccgggccagcggcaccgtgtacagcggggaggagaagctgacagagctgctggtgaaggcctacggggactttgcctggagcaaccccctgcacccagacatcttccctggcctgaggaagattgaggccgagatcgtgagaattgcctgcagcctcttcaatggaggccctgacagctgtggctgtgtgaccagcggcggcacagagagcatcctgatggcctgcaaggcctacagagacctggcctttgagaagggcatcaagaccccagaaattgtggccccccagagcgcccatgctgccttcaacaaggccgccagctacttcggcatgaagatcgtgcgggtgcccctgaccaagatgatggaggtggatgtgcgggccatgagaagagccatcagcaggaacacagccatgctggtgtgcagcaccccccagttcccccacggcgtgattgatcctgtgcctgaggtggccaagctggccgtgaagtacaagatccccctgcacgtggatgcctgcctgggcggcttcctgattgtgttcatggagaaggccggctaccccctggagcacccctttgacttccgggtgaagggcgtgaccagcatctctgctgacacccacaagtatggctacgcccccaagggcagcagcctggtgctgtacagcgacaagaagtacagaaactaccagttctttgtggacacagactggcagggcggcatctatgccagccccaccatcgccggcagcaggcctgggggcatctctgctgcctgctgggccgccctgatgcactttggagaaaatggctacgtggaggccaccaagcagatcatcaagacagcccgcttcctgaagtctgagctggagaacatcaagggcatctttgtgtttggaaacccccagctgtctgtgattgccctgggcagccgggactttgacatctaccgcctgagcaacctgatgacagccaagggctggaacctgaaccagctgcagttcccccccagcatccacttctgcatcaccctgctgcacgccaggaagagggtggccatccagttcctgaaggacatccgggagagcgtgacccagatcatgaagaaccccaaggccaagaccaccggcatgggcgccatctacggcatggcccagaccaccgtggacaggaacatggtggccgagctgagctctgtgttcctggacagcctgtacagcacagacacagtgacccagggcagccagatgaatggcagccccaagccccactag

SEQ ID NO: 38536 - DNA, 408 bp, Artificial Sequence
  Description of Artificial Sequence: Synthetic coding sequence
tgaatccaggacaagctgaacaagaccaaggatgacatcagcaagaacatgtccttcctgaaggtggacaaggagtatgtgaaggccctgcccagccagggcctgagcagcagcgctgtgctggagaagctgaaggagtacagctccatggatgccttctggcaggagggccgggccagcggcaccgtgtacagcggggaggagaagctgacagagctgctggtgaaggcctacggggactttgcctggagcaaccccctgcacccagacatcttccctggcctgaggaagattgaggccgagatcgtgagaattgcctgcagcctcttcaatggaggccctgacagctgtggctgtgtgtccatctgcaagggccaccccatcgccctcttcttccggctgaagtag

SEQ ID NO: 38537 - DNA, 1638 bp, Artificial Sequence
  Description of Artificial Sequence: Synthetic coding sequence
atggagacagagctgtgtgccgcccacctgcccacagaaagtgatgcccccaaccactaccaggccgtgtgccgggccctgtttgctgagaccatggagctgcacaccttcctgaccaagatcaagagcgccaaggagaacctgaagaagatccaggagatggagaagagtgatgagagcagcacagacctggaggagctgaagaatgctgactgggcccgcttctgggtgcaggtgatgagggacctgagaaatggagtgaagctgaagaaggtgcaggagcggcagtacaaccccctgcccatcgagtaccagctgaccccctatgagatgctgatggatgacatccgctgcaagcgctacaccctgaggaaggtgatggtgaatggagacatccccccccggctgaagaagagcgcccacgagatcatcctggacttcatccgcagccggccccccctgaaccctgtgtctgccaggaagctgaagcccaccccaccccggcccaggagcctgcacgagcgcatcctggaggagatcaaggccgagaggaagctgcggcctgtgtccccagaggagatcagaagaagccggctggatgtgaccaccccagagagcaccaagaacctggtggagagctccatggtgaatggaggcctgaccagccagaccaaggaaaatggcctgagcaccagccagcaggtgcctgcccagaggaagaagctgctgcgggcccccaccctggccgagctggacagcagcgagagcgaggaggagaccctgcacaagagcaccagcagcagctctgtgagccccagcttccctgaggagcctgtgctggaggccgtgtccaccaggaagaagccacccaagttcctgcccatcagcagcaccccccagcctgagcggcggcagcccccccagaggaggcacagcattgagaaggagacccccaccaacgtgcggcagttcctgccccccagccggcagagcagccgcagcctggaggagttctgctaccctgtggagtgcctggccctgactgtggaggaggtgatgcacatccggcaggtgctggtgaaggccgagctggagaagtaccagcagtacaaggacatctacacagccctgaagaagggcaagctgtgcttctgctgcaggacccggcgcttctccttcttcacctggagctacacctgccagttctgcaagaggcctgtgtgcagccagtgctgcaagaagatgaggctgcccagcaagccctacagcaccctgcccatcttcagcctgggccccagcgccctgcagagaggagagagctccatgaggtctgagaagcccagcacagcccaccaccggcccctgcggagcatcgcccgcttcagcagcaagagcaagtccatggacaagagtgatgaggagctgcagttccccaaggagctgatggaggactggagcaccatggaggtgtgtgtggactgcaagaagttcatcagcgagatcatcagcagcagccgccgcagcctggtgctggccaacaagagggcccggctgaagaggaagacccagagcttctacatgagcagccctggccccagcgagtactgccccagcgagaggaccatcagcgagatctag

SEQ ID NO: 38538 - DNA, 1377 bp, Artificial Sequence
  Description of Artificial Sequence: Synthetic coding sequence
atggccaacacagtggaggctgatggcagcaatgatgagggctatgaagctgctgaggagggcctgggagatgaagatgagaagaggaagatcagcgccatccgcagctacagagatgtgatgaagctgtgtgccgcccacctgcccacagaaagtgatgcccccaaccactaccaggccgtgtgccgggccctgtttgctgagaccatggagctgcacaccttcctgaccaagatcaagagcgccaaggagaacctgaagaagatccaggagatggagaagagtgatgagagcagcacagacctggaggagctgaagaatgctgactgggcccgcttctgggtgcaggtgatgagggacctgagaaatggagtgaagctgaagaaggtgcaggagcggcagtacaaccccctgcccatcgagtaccagctgaccccctatgagatgctgatggatgacatccgctgcaagcgctacaccctgaggaaggtgatggtgaatggagacatccccccccggctgaagaagagcgcccacgagatcatcctggacttcatccgcagccggccccccctgaaccctgtgtctgccaggaagctgaagcccaccccaccccggcccaggagcctgcacgagcgcatcctggaggagatcaaggccgagaggaagctgcggcctgtgtccccagaggagatcagaagaagccggctggatgtgaccaccccagagagcaccaagaacctggtggagagctccatggtgaatggaggcctgaccagccagaccaaggaaaatggcctgagcaccagccagcaggtgcctgcccagaggaagaagctgctgcgggcccccaccctggccgagctggacagcagcgagagcgaggaggagaccctgcacaagagcaccagcagcagctctgtgagccccagcttccctgaggagcctgtgctggaggccgtgtccaccaggaagaagccacccaagttcctgcccatcagcagcaccccccagcctgagcggcggcagcccccccagaggaggcacagcattgagaaggagacccccaccaacgtgcggcagttcctgccccccagccggcagagcagccgcagcctggaggagttctgctaccctgtggagtgcctggccctgactgtggaggaggtgatgcacatccggcaggtgctggtgaaggccgagctggagaagtaccagcagtacaaggacatctacacagccctgaagaagggcaagctgtgcttctgctgcaggacccggcgcttctccttcttcacctggagctacacctgccagttctgcaagagtgactgcctcttcaacggcacagcccactgccagttctacctgggctag

SEQ ID NO: 38539 - DNA, 2271 bp, Artificial Sequence
  Description of Artificial Sequence: Synthetic coding sequence
atggcccaggccgccggccctgctgggggcggggagcccaggacagaagctgtgggcggggagggcccccgggagcccggggctgctggaggagctgctgggggcagcagagatgccctgagcctggaggagatcctgcggctgtacaaccagcccatcaatgaggagcaggcctgggccgtgtgctaccagtgctgcggcagcctgcgggccgccgcccggcggcggcagcccaggcaccgggtgcgctctgctgcccagatccgggtgtggagagatggagctgtgaccctggccccagctgctgatgatgctggggagcccccacctgtggccggcaagctgggctacagccagtgcatggagacagaggtgattgagagcctgggcatcatcatctacaaggccctggactatggcctgaaggaaaatgaggagcgggagctgagcccccccctggagcagctgattgaccacatggccaacacagtggaggctgatggcagcaatgatgagggctatgaggccgctgaggagggcctgggagatgaagatgagaagaggaagatcagcgccatccgcagctacagagatgtgatgaagctgtgtgccgcccacctgcccacagaaagtgatgcccccaaccactaccaggccgtgtgccgggccctgtttgctgagaccatggagctgcacaccttcctgaccaagatcaagagcgccaaggagaacctgaagaagatccaggagatggagaagagtgatgagagcagcacagacctggaggagctgaagaatgctgactgggcccgcttctgggtgcaggtgatgagggacctgagaaatggagtgaagctgaagaaggtgcaggagcggcagtacaaccccctgcccatcgagtaccagctgaccccctatgagatgctgatggatgacatccgctgcaagcgctacaccctgaggaaggtgatggtgaatggagacatccccccccggctgaagaagagcgcccacgagatcatcctggacttcatccgcagcaggcctcccctgaaccctgtgtctgccaggaagctgaagcccaccccaccccggcccaggagcctgcacgagcgcatcctggaggagatcaaggccgagaggaagctgcggcctgtgtccccagaggagatccgccgcagccggctggccatgaggcccctgtccatgagctacagctttgacctgagtgatgtgaccaccccagagagcaccaagaacctggtggagagctccatggtgaatggaggcctgaccagccagaccaaggaaaatggcctgagcaccagccagcaggtgcctgcccagaggaagaagctgctgcgggcccccaccctggccgagctggacagcagcgagagcgaggaggagaccctgcacaagagcaccagcagcagctctgtgagccccagcttccctgaggagcctgtgctggaggccgtgtccaccaggaagaagccacccaagttcctgcccatcagcagcaccccccagcctgagcggcggcagcccccccagaggaggcacagcattgagaaggagacccccaccaacgtgcggcagttcctgccccccagccggcagagcagccgcagcctggaggagttctgctaccctgtggagtgcctggccctgactgtggaggaggtgatgcacatccggcaggtgctggtgaaggccgagctggagaagtaccagcagtacaaggacatctacacagccctgaagaagggcaagctgtgcttctgctgcaggacccggcgcttctccttcttcacctggagctacacctgccagttctgcaagaggcctgtgtgcagccagtgctgcaagaagatgaggctgcccagcaagccctacagcaccctgcccatcttcagcctgggccccagcgccctgcagagaggagagagctccatgaggtctgagaagcccagcacagcccaccaccggcccctgcggagcatcgcccgcttcagcagcaagagcaagtccatggacaagagtgatgaggagctgcagttccccaaggagctgatggaggactggagcaccatggaggtgtgtgtggactgcaagaagttcatcagcgagatcatcagcagcagcagaagaagcctggtgctggccaacaagagggcccggctgaagaggaagacccagagcttctacatgagcagccctggccccagcgagtactgccccagcgagaggaccatcagcgagatctag

SEQ ID NO: 38540 - DNA, 2229 bp, Artificial Sequence
  Description of Artificial Sequence: Synthetic coding sequence
atggcccaggccgccggccctgctgggggcggggagcccaggacagaagctgtgggcggggagggcccccgggagcccggggctgctggaggagctgctgggggcagcagagatgccctgagcctggaggagatcctgcggctgtacaaccagcccatcaatgaggagcaggcctgggccgtgtgctaccagtgctgcggcagcctgcgggccgccgcccggcggcggcagcccaggcaccgggtgcgctctgctgcccagatccgggtgtggagagatggagctgtgaccctggccccagctgctgatgatgctggggagcccccacctgtggccggcaagctgggctacagccagtgcatggagacagaggtgattgagagcctgggcatcatcatctacaaggccctggactatggcctgaaggaaaatgaggagcgggagctgagcccccccctggagcagctgattgaccacatggccaacacagtggaggctgatggcagcaatgatgagggctatgaggccgctgaggagggcctgggagatgaagatgagaagaggaagatcagcgccatccgcagctacagagatgtgatgaagctgtgtgccgcccacctgcccacagaaagtgatgcccccaaccactaccaggccgtgtgccgggccctgtttgctgagaccatggagctgcacaccttcctgaccaagatcaagagcgccaaggagaacctgaagaagatccaggagatggagaagagtgatgagagcagcacagacctggaggagctgaagaatgctgactgggcccgcttctgggtgcaggtgatgagggacctgagaaatggagtgaagctgaagaaggtgcaggagcggcagtacaaccccctgcccatcgagtaccagctgaccccctatgagatgctgatggatgacatccgctgcaagcgctacaccctgaggaaggtgatggtgaatggagacatccccccccggctgaagaagagcgcccacgagatcatcctggacttcatccgcagcaggcctcccctgaaccctgtgtctgccaggaagctgaagcccaccccaccccggcccaggagcctgcacgagcgcatcctggaggagatcaaggccgagaggaagctgcggcctgtgtccccagaggagatccgccgcagccggctggatgtgaccaccccagagagcaccaagaacctggtggagagctccatggtgaatggaggcctgaccagccagaccaaggaaaatggcctgagcaccagccagcaggtgcctgcccagaggaagaagctgctgcgggcccccaccctggccgagctggacagcagcgagagcgaggaggagaccctgcacaagagcaccagcagcagctctgtgagccccagcttccctgaggagcctgtgctggaggccgtgtccaccaggaagaagccacccaagttcctgcccatcagcagcaccccccagcctgagcggcggcagcccccccagaggaggcacagcattgagaaggagacccccaccaacgtgcggcagttcctgccccccagccggcagagcagccgcagcctggaggagttctgctaccctgtggagtgcctggccctgactgtggaggaggtgatgcacatccggcaggtgctggtgaaggccgagctggagaagtaccagcagtacaaggacatctacacagccctgaagaagggcaagctgtgcttctgctgcaggacccggcgcttctccttcttcacctggagctacacctgccagttctgcaagaggcctgtgtgcagccagtgctgcaagaagatgaggctgcccagcaagccctacagcaccctgcccatcttcagcctgggccccagcgccctgcagagaggagagagctccatgaggtctgagaagcccagcacagcccaccaccggcccctgcggagcatcgcccgcttcagcagcaagagcaagtccatggacaagagtgatgaggagctgcagttccccaaggagctgatggaggactggagcaccatggaggtgtgtgtggactgcaagaagttcatcagcgagatcatcagcagcagcagaagaagcctggtgctggccaacaagagggcccggctgaagaggaagacccagagcttctacatgagcagccctggccccagcgagtactgccccagcgagaggaccatcagcgagatctag

SEQ ID NO: 38541 - DNA, 1869 bp, Artificial Sequence
  Description of Artificial Sequence: Synthetic coding sequence
atggagacagaggtgattgagagcctgggcatcatcatctacaaggccctggactatggcctgaaggaaaatgaggagcgggagctgagcccccccctggagcagctgattgaccacatggccaacacagtggaggctgatggcagcaatgatgagggctatgaggccgctgaggagggcctgggagatgaagatgagaagaggaagatcagcgccatccgcagctacagagatgtgatgaagctgtgtgccgcccacctgcccacagaaagtgatgcccccaaccactaccaggccgtgtgccgggccctgtttgctgagaccatggagctgcacaccttcctgaccaagatcaagagcgccaaggagaacctgaagaagatccaggagatggagaagagtgatgagagcagcacagacctggaggagctgaagaatgctgactgggcccgcttctgggtgcaggtgatgagggacctgagaaatggagtgaagctgaagaaggtgcaggagcggcagtacaaccccctgcccatcgagtaccagctgaccccctatgagatgctgatggatgacatccgctgcaagcgctacaccctgaggaaggtgatggtgaatggagacatccccccccggctgaagaagagcgcccacgagatcatcctggacttcatccgcagcaggcctcccctgaaccctgtgtctgccaggaagctgaagcccaccccaccccggcccaggagcctgcacgagcgcatcctggaggagatcaaggccgagaggaagctgcggcctgtgtccccagaggagatccgccgcagccggctggatgtgaccaccccagagagcaccaagaacctggtggagagctccatggtgaatggaggcctgaccagccagaccaaggaaaatggcctgagcaccagccagcaggtgcctgcccagaggaagaagctgctgcgggcccccaccctggccgagctggacagcagcgagagcgaggaggagaccctgcacaagagcaccagcagcagctctgtgagccccagcttccctgaggagcctgtgctggaggccgtgtccaccaggaagaagccacccaagttcctgcccatcagcagcaccccccagcctgagcggcggcagcccccccagaggaggcacagcattgagaaggagacccccaccaacgtgcggcagttcctgccccccagccggcagagcagccgcagcctggaggagttctgctaccctgtggagtgcctggccctgactgtggaggaggtgatgcacatccggcaggtgctggtgaaggccgagctggagaagtaccagcagtacaaggacatctacacagccctgaagaagggcaagctgtgcttctgctgcaggacccggcgcttctccttcttcacctggagctacacctgccagttctgcaagaggcctgtgtgcagccagtgctgcaagaagatgaggctgcccagcaagccctacagcaccctgcccatcttcagcctgggccccagcgccctgcagagaggagagagctccatgaggtctgagaagcccagcacagcccaccaccggcccctgcggagcatcgcccgcttcagcagcaagagcaagtccatggacaagagtgatgaggagctgcagttccccaaggagctgatggaggactggagcaccatggaggtgtgtgtggactgcaagaagttcatcagcgagatcatcagcagcagcagaagaagcctggtgctggccaacaagagggcccggctgaagaggaagacccagagcttctacatgagcagccctggccccagcgagtactgccccagcgagaggaccatcagcgagatctag

SEQ ID NO: 38542 - DNA, 624 bp, Artificial Sequence
  Description of Artificial Sequence: Synthetic coding sequence
atggccctgctgtttgcccggagcctgcggctgtgccgctggggcgccaagaggctgggcgtggccagcacagaggcccagaggggcgtgtccttcaagctggaggagaagacagcccacagcagcctggccctcttcagagatgacatgggcgtgaagtatggcctggtgggcctggagcccaccaaggtggccctgaatgtggagcgcttccgggagtgggccgtggtgctggccgacacagctgtgaccagcggccgccactactgggaggtgacagtgaagaggagccagcagttccgcatcggcgtggctgatgtggacatgagccgggacagctgcattggagtggatgaccgctcctgggtgttcacctacgcccagaggaagtggtacaccatgctggccaatgagaaggcccctgtggagggcatcggccagcctgagaaggtgggcctgctgctggagtatgaggcccagaagctgagcctggtggatgtgtcccaggtgtctgtggtgcacaccctgcagacagacttccggggccctgtggtgcctgcctttgccctgtgggatggagagctgctgacccacagcggcctggaggtgcctgagggcctgtag

SEQ ID NO: 38543 - DNA, 390 bp, Artificial Sequence
  Description of Artificial Sequence: Synthetic coding sequence
atgtggagcgccagcggcagcggccgccactactgggaggtgacagtgaagaggagccagcagttccgcatcggcgtggctgatgtggacatgagccgggacagctgcattggagtggatgaccgctcctgggtgttcacctacgcccagaggaagtggtacaccatgctggccaatgagaaggcccctgtggagggcatcggccagcctgagaaggtgggcctgctgctggagtatgaggcccagaagctgagcctggtggatgtgtcccaggtgtctgtggtgcacaccctgcagacagacttccggggccctgtggtgcctgcctttgccctgtgggatggagagctgctgacccacagcggcctggaggtgcctgagggcctgtag

SEQ ID NO: 38544 - DNA, 1257 bp, Artificial Sequence
  Description of Artificial Sequence: Synthetic coding sequence
atgaggaccaaggccgccggctgtgccgagcggcggcccctgcagcccaggacagaggccgccgccgccccagctggccgggccatgcccagcgagtacacctacgtgaagctgcggagtgactgcagccggcccagcctgcagtggtacacccgggcccagagcaagatgaggcggcccagcctgctgctgaaggacatcctgaagtgcaccctgctggtgtttggagtgtggatcctgtacatcctgaagctgaactacaccacagaagaatgtgacatgaagaagatgcactacgtggaccctgaccacgtgaagagggcccagaagtatgcccagcaggtgctgcagaaggaatgtcggcccaagtttgccaagacctccatggccctgctgtttgagcaccgctacagcgtggacctgctgccctttgtgcagaaggcccccaaggacagcgaggccgagagcaaatatgacccccccttcggcttcaggaagttcagcagcaaggtgcagaccctgctggagctgctgcctgagcatgacctgcctgagcacctgaaggccaagacctgcagaagatgtgtggtgattggcagcggcggcatcctgcacggcctggagctgggccacaccctgaaccagtttgatgtggtgatccggctgaacagcgcccctgtggagggctacagcgagcacgtgggcaacaagaccaccatccgcatgacctacccagagggcgcccccctgagtgacctggagtactacagcaatgacctgtttgtggccgtgctcttcaagtctgtggacttcaactggctgcaggccatggtgaagaaggagaccctgcccttctgggtgcggctcttcttctggaagcaggtggccgagaagatccccctgcagcccaagcacttccgcatcctgaaccctgtgatcatcaaggagacagcctttgacatcctgcagtacagcgagccccagagccgcttctggggccgggacaagaatgtgcccaccatcggcgtgattgctgtggtgctggccacccacctgtgtgatgaggtgtccctggccggcttcggctatgacctgaaccagcccaggacccccctgcactactttgacagccagtgcatggccgccatgaacttccagaccatgcacaacgtgaccacagagaccaagttcctgctgaagctggtgaaggagggcgtggtgaaggacctgagcggcggcatcgaccgggagttctag

SEQ ID NO: 38545 - DNA, 372 bp, Artificial Sequence
  Description of Artificial Sequence: Synthetic coding sequence
atgtatgaaattgctgcccccaacgtggccttcatgaccctgcgctccatgtgcaacaccagcaagatggtgacctgtgccaagatcttcttctacttcctggtgttcttcagcctgagccagaatgtgcccaccatcggcgtgattgctgtggtgctggccacccacctgtgtgatgaggtgtccctggccggcttcggctatgacctgaaccagcccaggacccccctgcactactttgacagccagtgcatggccgccatgaacttccagaccatgcacaacgtgaccacagagaccaagttcctgctgaagctggtgaaggagggcgtggtgaaggacctgagcggcggcatcgaccgggagttctag

SEQ ID NO: 38546 - DNA, 1173 bp, Artificial Sequence
  Description of Artificial Sequence: Synthetic coding sequence
atgcccagcgagtacacctacgtgaagctgcggagtgactgcagccggcccagcctgcagtggtacacccgggcccagagcaagatgaggcggcccagcctgctgctgaaggacatcctgaagtgcaccctgctggtgtttggagtgtggatcctgtacatcctgaagctgaactacaccacagaagaatgtgacatgaagaagatgcactacgtggaccctgaccacgtgaagagggcccagaagtatgcccagcaggtgctgcagaaggaatgtcggcccaagtttgccaagacctccatggccctgctgtttgagcaccgctacagcgtggacctgctgccctttgtgcagaaggcccccaaggacagcgaggccgagagcaaatatgacccccccttcggcttcaggaagttcagcagcaaggtgcagaccctgctggagctgctgcctgagcatgacctgcctgagcacctgaaggccaagacctgcagaagatgtgtggtgattggcagcggcggcatcctgcacggcctggagctgggccacaccctgaaccagtttgatgtggtgatccggctgaacagcgcccctgtggagggctacagcgagcacgtgggcaacaagaccaccatccgcatgacctacccagagggcgcccccctgagtgacctggagtactacagcaatgacctgtttgtggccgtgctcttcaagtctgtggacttcaactggctgcaggccatggtgaagaaggagaccctgcccttctgggtgcggctcttcttctggaagcaggtggccgagaagatccccctgcagcccaagcacttccgcatcctgaaccctgtgatcatcaaggagacagcctttgacatcctgcagtacagcgagccccagagccgcttctggggccgggacaagaatgtgcccaccatcggcgtgattgctgtggtgctggccacccacctgtgtgatgaggtgtccctggccggcttcggctatgacctgaaccagcccaggacccccctgcactactttgacagccagtgcatggccgccatgaacttccagaccatgcacaacgtgaccacagagaccaagttcctgctgaagctggtgaaggagggcgtggtgaaggacctgagcggcggcatcgaccgggagttctag

SEQ ID NO: 38547 - DNA, 1188 bp, Artificial Sequence
  Description of Artificial Sequence: Synthetic coding sequence
atggcctctgtgcccatgcccagcgagtacacctacgtgaagctgcggagtgactgcagccggcccagcctgcagtggtacacccgggcccagagcaagatgagaagacccagcctgctgctgaaggacatcctgaagtgcaccctgctggtgtttggagtgtggatcctgtacatcctgaagctgaactacaccacagaggagtgtgacatgaagaagatgcactacgtggaccctgaccacgtgaagagggcccagaagtatgcccagcaggtgctgcagaaggagtgccggcccaagtttgccaagacctccatggccctgctgtttgagcaccgctacagcgtggacctgctgccctttgtgcagaaggcccccaaggacagcgaggccgagagcaaatatgaccccccatttggcttcaggaagttcagcagcaaggtgcagaccctgctggagctgctgcctgagcatgacctgcctgagcacctgaaggccaagacctgccgccgctgtgtggtgattggcagcggcggcatcctgcacggcctggagctgggccacaccctgaaccagtttgatgtggtgatccggctgaacagcgcccctgtggagggctacagcgagcacgtgggcaacaagaccaccatccgcatgacctacccagagggcgcccccctgagtgacctggagtactacagcaatgacctgtttgtggccgtgctcttcaagtctgtggacttcaactggctgcaggccatggtgaagaaggagaccctgcccttctgggtgcggctcttcttctggaagcaggtggccgagaagatccccctgcagcccaagcacttccgcatcctgaaccctgtgatcatcaaggagacagcctttgacatcctgcagtacagcgagccccagagccgcttctggggccgggacaagaatgtgcccaccatcggcgtgattgctgtggtgctggccacccacctgtgtgatgaggtgtccctggccggcttcggctatgacctgaaccagcccaggacccccctgcactactttgacagccagtgcatggccgccatgaacttccagaccatgcacaacgtgaccacagagaccaagttcctgctgaagctggtgaaggagggcgtggtgaaggacctgagcggcggcatcgaccgggagttctag

SEQ ID NO: 38548 - DNA, 420 bp, Artificial Sequence
  Description of Artificial Sequence: Synthetic coding sequence
atgcccagcgagtacacctacgtgaagctgcggagtgactgcagccggcccagcctgcagtggtacacccgggcccagagcaagatgaggcggcccagcctgctgctgaaggacatcctgaagtgcaccctgctggtgtttggagtgtggatcctgtacatcctgaagctgaactacaccacagaagaatgtgacatgaagaagatgcactacgtggaccctgaccacgtgaagagggcccagaagtatgcccagcaggtgctgcagaaggaatgtcggcccaagtttgccaagacctccatggccctgctgtttgagcaccgctacagcgtggacctgctgccctttgtgcagaaggcccccaaggacagcgaggccgagagcaaatatgacccccccttcggcttcaggaagttctag

SEQ ID NO: 38549 - DNA, 663 bp, Artificial Sequence
  Description of Artificial Sequence: Synthetic coding sequence
atgaggaccaaggccgccggctgtgccgagcggcggcccctgcagcccaggacagaggccgccgccgccccagctggccgggccatgcccagcgagtacacctacgtgaagctgcggagtgactgcagccggcccagcctgcagtggtacacccgggcccagagcaagatgaggcggcccagcctgctgctgaaggacatcctgaagtgcaccctgctggtgtttggagtgtggatcctgtacatcctgaagctgaactacaccacagaagaatgtgacatgaagaagatgcactacgtggaccctgaccacgtgaagaccctgagcccctgtggctggcactgtgtgcagctgatcatggcccgctggacccagcccctgctgcaccggctgctgagtgacagcgctgacctgcaccgggccttcaagggcagccgggccctgcctgctgaggccttcagcgagcccaggcaccagcacctgcagacagagagcttcctgagcctggtgctgctgcctgccttccaggccttcctgggctacctgcgggcccctgagggcgccgccctggccctgcggcacttcctgctgagctgtgagctgtgggccagcagcggcggcggccgggagcagctgaagcagatgcctgtgcagctgacctag

SEQ ID NO: 38550 - DNA, 1803 bp, Artificial Sequence
  Description of Artificial Sequence: Synthetic coding sequence
atgaggagctgcctgtggcgctgccgccacctgagccagggcgtgcagtggagcctgctgctggccgtgctggtgttcttcctgtttgccctgcccagcttcatcaaggagccccagaccaagcccagccgccaccagaggacagagaacatcaaggagaggagcctgcagagcctggccaagcccaagagccaggcccccacccgggcccggaggaccaccatctatgcagagcctgtgcctgagaacaatgccctgaacacccagacccagcccaaggcccacaccactggagaccggggcaaggaggccaaccaggcccctcctgaggagcaggacaaggtgccccacacagcccagagagctgcctggaagagccctgagaaggagaagaccatggtgaacaccctgagcccccggggccaggatgctggcatggccagcggccgcacagaggcccagagctggaagagccaggacaccaagaccacccagggcaatggaggccagaccaggaagctgacagccagcaggacagtgtctgagaagcaccagggcaaggccgccaccacagccaagaccctcatccccaagagccagcacaggatgctggcccccactggagctgtgtccaccaggacccggcagaagggcgtgaccacagctgtgattcctcccaaggagaagaagccccaggccaccccacctccagcccccttccagagccccaccacccagaggaaccagaggctgaaggccgccaacttcaagtctgagccccgctgggactttgaggagaagtacagctttgagatcggcggcctgcagaccacctgcccagacagcgtgaagatcaaggccagcaagagcctgtggctgcagaagctgttcctgcccaacctgaccctcttcctggacagccgccacttcaaccagagcgagtgggaccggctggagcactttgcccccccatttggcttcatggagctgaactacagcctggtgcagaaggtggtgacccgcttcccccctgtgccccagcagcagctgctgctggccagcctgcctgctggcagcctgcgctgcatcacctgtgctgtggtgggcaatggaggcatcctgaacaacagccacatgggccaggagattgacagccatgactatgtgttccggctgagcggggccctgatcaagggctatgagcaggatgtgggcaccaggaccagcttctacggcttcaccgccttcagcctgacccagagcctgctgatcctgggcaacagaggcttcaagaatgtgcccctgggcaaggatgtgcgctacctgcacttcctggagggcacccgggactatgagtggctggaggccctgctgatgaaccagacagtgatgagcaagaacctcttctggttccgccaccggccccaggaggccttccgggaggccctgcacatggaccgctacctgctgctgcacccagacttcctgcgctacatgaagaaccgcttcctgcggagcaagaccctggatggagcccactggaggatctaccggcccaccactggagccctgctgctgctgacagccctgcagctgtgtgaccaggtgtctgcctacggcttcatcacagagggccacgagcgcttcagtgaccactactatgacacctcctggaagaggctcatcttctacatcaaccacgacttcaagctggagcgggaggtgtggaagaggctgcatgatgagggcatcatccggctgtaccagaggcctggccctggaacagccaaggccaagaactag

SEQ ID NO: 38551 - DNA, 1416 bp, Artificial Sequence
  Description of Artificial Sequence: Synthetic coding sequence
atgaggagctgcctgtggcgctgccgccacctgagccagggcgtgcagtggagcctgctgctggccgtgctggtgttcttcctgtttgccctgcccagcttcatcaaggagccccagaccaagcccagccgccaccagaggacagagaacatcaaggagaggagcctgcagagcctggccaagcccaagagccaggcccccacccgggcccggaggaccaccatctatgcagagcctgtgcctgagaacaatgccctgaacacccagacccagcccaaggcccacaccactggagaccggggcaaggaggccaaccaggcccctcctgaggagcaggacaaggtgccccacacagcccagagagctgcctggaagagccctgagaaggagaagaccatggtgaacaccctgagcccccggggccaggatgctggcatggccagcggccgcacagaggcccagagctggaagagccaggacaccaagaccacccagggcaatggaggccagaccaggaagctgacagccagcaggacagtgtctgagaagcaccagggcaaggccgccaccacagccaagaccctcatccccaagagccagcacaggatgctggcccccactggagctgtgtccaccaggacccggcagaagggcgtgaccacagctgtgattcctcccaaggagaagaagccccaggccaccccacctccagcccccttccagagccccaccacccagaggaaccagaggctgaaggccgccaacttcaagtctgagccccgctgggactttgaggagaagtacagctttgagatcggcggcctgcagaccacctgcccagacagcgtgaagatcaaggccagcaagagcctgtggctgcagaagctgttcctgcccaacctgaccctcttcctggacagccgccacttcaaccagagcgagtgggaccggctggagcactttgcccccccatttggcttcatggagctgaactacagcctggtgcagaaggtggtgacccgcttcccccctgtgccccagcagcagctgctgctggccagcctgcctgctggcagcctgcgctgcatcacctgtgctgtggtgggcaatggaggcatcctgaacaacagccacatgggccaggagattgacagccatgactatgtgttccggctgagcggggccctgatcaagggctatgagcaggatgtgggcaccaggaccagcttctacggcttcaccgccttcagcctgacccagagcctgctgatcctgggcaacagaggcttcaagaatgtgcccctgggcaaggcccagaccccaggcagcttcagcggcagccctgcccacggccaggtgcctgtggccgccccccggctgagccccatccacgaggagcaggtgtctgaggtgtag

SEQ ID NO: 38552 - DNA, 2238 bp, Artificial Sequence
  Description of Artificial Sequence: Synthetic coding sequence
atgggcgtgcccttcttcagcagcctgcgctgcatggtggacctgggcccctgctgggccggcggcctgacagctgagatgaagctgctgctggccctggccggcctgctggccatcctggccaccccccagcccagcgagggcgccgccccagctgtgctgggggaggtggacaccagcctggtgctgagctccatggaggaggccaagcagctggtggacaaggcctacaaggagcggcgggagagcatcaagcagaggctgcggagcggcagcgccagccccatggagctgctgagctacttcaagcagcctgtggccgccaccaggacagctgtgcgggctgctgactacctgcacgtggccctggacctgctggagaggaagctgcggagcctgtggaggcggcccttcaacgtgacagatgtgctgaccccagcccagctgaatgtgctgagcaagagcagcggctgtgcctaccaggatgtgggcgtgacctgcccagagcaggacaagtaccgcaccatcaccggcatgtgcaacaacagaagaagccccaccctgggcgccagcaacagagcctttgtgcgctggctgcctgcagaatatgaagatggcttcagcctgccctacggctggaccccaggagtgaagagaaatggcttccctgtggccctggcccgggctgtgtccaatgagatcgtgcgcttccccacagaccagctgaccccagaccaggagaggagcctgatgttcatgcagtggggccagctgctggaccatgacctggacttcaccccagagcctgctgcccgggccagctttgtgactggagtgaactgtgagaccagctgtgtgcagcagcccccctgcttccccctgaagatccccccaaatgacccccgcatcaagaaccaggccgactgcatccccttcttccgcagctgcccagcctgccccggcagcaacatcaccatccggaaccagatcaatgccctgaccagctttgtggatgcctccatggtgtatggcagcgaggagcccctggccaggaacctgaggaacatgagcaaccagctgggcctgctggccgtgaaccagcgcttccaggacaatggccgggccctgctgccctttgacaacctgcatgatgacccctgcctgctgaccaacagaagtgcccgcatcccctgcttcctggccggggacaccaggagcagcgagatgcctgagctgacctccatgcacaccctgctgctgcgggagcacaaccggctggccacagagctgaagagcctgaacccccgctgggatggagagcggctgtaccaggaggccaggaagatcgtgggcgccatggtgcagatcatcacctacagagactacctgcccctggtgctgggccccacagccatgaggaagtacctgcccacctaccgcagctacaatgattctgtggacccccgcatcgccaacgtgttcaccaatgccttccgctatggccacaccctcatccagcccttcatgttccggctggacaaccgctaccagcccatggagcccaacccccgggtgcccctgagcagggtcttctttgcctcctggagggtggtgctggagggcggcatcgaccccatcctgcggggcctgatggccaccccagccaagctgaaccggcagaaccagattgctgtggatgagatccgggagcggctgtttgagcaggtgatgagaattggcctggacctgcctgccctgaacatgcagaggagccgggaccacggcctgcccggctacaatgcctggaggcgcttctgtggcctgccccagcctgagaccgtgggccagctgggcaccgtgctgaggaacctgaagctggccaggaagctgatggagcagtatggcacccccaacaacatcgacatctggatgggcggcgtgtctgagcccctgaagaggaagggccgggtgggccccctgctggcctgcatcatcggcacccagttcaggaagctgagagatggagaccgcttctggtgggagaatgaaggagtcttctccatgcagcagaggcaggccctggcccagatcagcctgccccgcatcatctgtgacaacacaggcatcaccaccgtgtccaagaacaacatcttcatgagcaacagctacccccgggactttgtgaactgcagcaccctgcctgccctgaacctggcctcctggagggaggccagctag

SEQ ID NO: 38553 - DNA, 918 bp, Artificial Sequence
  Description of Artificial Sequence: Synthetic coding sequence
atggcctgcatcctgaagaggaagtctgtgattgctgtgtccttcatcgccgccttcctgttcctgctggtggtgcggctggtgaatgaggtgaacttccccctgctgctgaactgcttcggccagcccggcaccaagtggatccccttctcctacacctacagaagacccctgcggacccactacggctacatcaacgtgaagacccaggagcccctgcagctggactgtgacctgtgtgccatcgtgagcaacagcggccagatggtgggccagaaggtgggcaatgaaattgacaggagcagctgcatctggaggatgaacaatgcccccaccaagggctatgaagaagatgtgggccgcatgaccatgatccgggtggtgagccacacctctgtgcccctgctgctgaagaacccagactacttcttcaaggaggccaacaccaccatctacgtgatctggggccccttcaggaacatgaggaaggatggaaatggcatcgtgtacaacatgctgaagaagacagtgggcatctacccaaatgcccagatctacgtgaccacagagaagaggatgagctactgtgatggagtcttcaagaaggagaccgggaaggacagagtgcagagcggcagctacctgagcacaggctggttcaccttcctgctggccatggatgcctgctacggcatccacgtgtatggcatgatcaatgacacctactgcaagacagagggctacaggaaggtgccctaccactactatgagcagggcagagatgaatgtgatgagtacttcctgcatgaacatgccccctacggcggccaccgcttcatcacagagaagaaggtgtttgccaagtgggccaagaagcaccgcatcatcttcacccaccccaactggaccctgtcctag

SEQ ID NO: 38554 - DNA, 915 bp, Artificial Sequence
  Description of Artificial Sequence: Synthetic coding sequence
gtgtgcatcaggaagaggaagtctgtgattgctgtgtccttcatcgccgccttcctgttcctgctggtggtgcggctggtgaatgaggtgaacttccccctgctgctgaactgcttcggccagcccggcaccaagtggatccccttctcctacacctaccgccggcccctgcggacccactacggctacatcaacgtgaagacccaggagcccctgcagctggactgtgacctgtgtgccatcgtgagcaacagcggccagatggtgggccagaaggtgggcaatgaaattgacaggagcagctgcatctggaggatgaacaatgcccccaccaagggctatgaggaggatgtgggccgcatgaccatgatccgggtggtgagccacacctctgtgcccctgctgctgaagaacccagactacttcttcaaggaggccaacaccaccatctacgtgatctggggccccttcaggaacatgaggaaggatggaaatggaattgtgtacaacatgctgaagaagacagtgggcatctacccaaatgcccagatctacgtgaccacagagaagaggatgagctactgtgatggagtcttcaagaaggagaccgggaaggacagagtgcagagcggcagctacctgagcacaggctggttcaccttcctgctggccatggatgcctgctacggcatccacgtgtatggcatgatcaatgacacctactgcaagacagagggctacaggaaggtgccctaccactactatgagcagggcagagatgaatgtgatgagtacttcctgcacgagcacgccccctatggaggccaccgcttcatcacagagaagaaggtgtttgccaagtgggccaagaagcaccgcatcatcttcacccaccccaactggaccctgtcctag

SEQ ID NO: 38555 - DNA, 633 bp, Artificial Sequence
  Description of Artificial Sequence: Synthetic coding sequence
atggcctgcatcctgaaggtgaccacctggattgctgtgtccttcatcgccgccttcctgttcctgctggtggtgcggctggtgaatgaggtgaacttccccctgctgctgaactgcttcggccagcccggcaccaagtggatccccttctcctacacctacagaagacccctgcggacccactacggctacatcaacgtgaagacccaggagcccctgcagctggactgtgacctgtgtgccatcgtgagcaacagcggccagatggtgggccagaaggtgggcaatgaaattgacaggagcagctgcatctggaggatgaacaatgcccccaccaagggctatgaagaagatgtgggccgcatgaccatgatccgggtggtgagccacacctctgtgcccctgctgctgaagaacccagactacttcttcaaggaggccaacaccaccatctacgtgatctggggccccttcaggaacatgaggaaggatggaaatggcatcgtgtacaacatgctgaagaagacagtgggcatctacccaaatgcccagatctacgtgaccacagagaagaggatgagctactgtgatggagtcttcaagaaggagaccgggaaggacagcacagaatag

SEQ ID NO: 38556 - DNA, 612 bp, Artificial Sequence
  Description of Artificial Sequence: Synthetic coding sequence
ttcagcatcttccagcccctgcagctggactgtgacctgtgtgccatcgtgagcaacagcggccagatggtgggccagaaggtgggcaatgaaattgacaggagcagctgcatctggaggatgaacaatgcccccaccaagggctatgaagaagatgtgggccgcatgaccatgatccgggtggtgagccacacctctgtgcccctgctgctgaagaacccagactacttcttcaaggaggccaacaccaccatctacgtgatctggggccccttcaggaacatgaggaaggatggaaatggcatcgtgtacaacatgctgaagaagacagtgggcatctacccaaatgcccagatctacgtgaccacagagaagaggatgagctactgtgatggagtcttcaagaaggagaccgggaaggacagaacagagggctacaggaaggtgccctaccactactatgagcagggcagagatgaatgtgatgagtacttcctgcatgaacatgccccctacggcggccaccgcttcatcacagagaagaaggtgtttgccaagtgggccaagaagcaccgcatcatcttcacccaccccaactggaccctgtcctag

SEQ ID NO: 38557 - DNA, 909 bp, Artificial Sequence
  Description of Artificial Sequence: Synthetic coding sequence
atgaaggcccctggccgcctggtgctgatcatcctgtgcagcgtggtgttttctgctgtgtacatcctgctgtgctgctgggccggcctgcccctgtgcctggccacctgcctggaccaccacttccccaccggcagccggcccaccgtgcccggccccctgcacttcagcggctacagctctgtgcctgatggcaagcccctggtgcgggagccctgccgcagctgtgctgtggtgagcagcagcggccagatgctgggcagcggcctgggcgctgagattgacagcgcagaatgtgtgttcaggatgaaccaggcccccaccgtgggctttgaagcagatgtgggccagaggagcaccctgcgggtggtgagccacacctctgtgcccctgctgctgaggaactacagccactacttccagaaggcccgggacaccctgtacatggtgtggggccagggccgccacatggacagagtgctgggcggccgcacctaccgcaccctgctgcagctgaccaggatgtacccaggcctgcaggtgtacaccttcacagagaggatgatggcctactgtgaccagatcttccaggatgagaccgggaagaacagacggcagagcggcagcttcctgagcacaggctggttcaccatgatcctggccctggagctgtgtgaggagatcgtggtgtatggcatggtgtctgacagctactgccgggagaagagccaccccagcgtgccctaccactactttgagaagggccgcctggatgagtgccagatgtacctggcccacgagcaggcccccaggtctgcccaccgcttcatcacagagaaggctgtgttcagccgctgggccaagaagaggcccatcgtgtttgcccaccccagctggaggacagaatag

SEQ ID NO: 38558 - DNA, 657 bp, Artificial Sequence
  Description of Artificial Sequence: Synthetic coding sequence
atgctgggcagcggcctgggcgctgagattgacagcgcagaatgtgtgttcaggatgaaccaggcccccaccgtgggctttgaagcagatgtgggccagaggagcaccctgcgggtggtgagccacacctctgtgcccctgctgctgaggaactacagccactacttccagaaggcccgggacaccctgtacatggtgtggggccagggccgccacatggacagagtgctgggcggccgcacctaccgcaccctgctgcagctgaccaggatgtacccaggcctgcaggtgtacaccttcacagagaggatgatggcctactgtgaccagatcttccaggatgagaccgggaagaacagacggcagagcggcagcttcctgagcacaggctggttcaccatgatcctggccctggagctgtgtgaggagatcgtggtgtatggcatggtgtctgacagctactgccgggagaagagccaccccagcgtgccctaccactactttgagaagggccgcctggatgagtgccagatgtacctggcccacgagcaggcccccaggtctgcccaccgcttcatcacagagaaggctgtgttcagccgctgggccaagaagaggcccatcgtgtttgcccaccccagctggaggacagaatag

SEQ ID NO: 38559 - DNA, 606 bp, Artificial Sequence
  Description of Artificial Sequence: Synthetic coding sequence
atgctgggcagcggcctgggcgctgagattgacagcgcagaatgtgtgttcaggatgaaccaggcccccaccgtgggctttgaagcagatgtgggccagaggagcaccctgcgggtggtgagccacacctctgtgcccctgctgctgaggaactacagccactacttccagaaggcccgggacaccctgtacatggtgtggggccagggccgccacatggacagagtgctgggcggccgcacctaccgcaccctgctgcagctgaccaggatgtacccaggcctgcaggtgtacaccttcacagagaggatgatggcctactgtgaccagatcttccaggatgagaccgggaagaacagacggcagagcggcagcttcctgagcacaggctggttcaccatgatcctggccctggagctgtgtgaggagatcgtggtgtatggcatggtgtctgacagctactgccgggagaagagccaccccagcgtgccctaccactactttgagaagggccgcctggatgagtgccagatgtacctggcccacgagcaggcccccaggtctgcccaccgcttcatcacagagaaggctgtgttcagcaggtag

SEQ ID NO: 38560 - DNA, 657 bp, Artificial Sequence; identical to SEQ ID NO: 38558
  Description of Artificial Sequence: Synthetic coding sequence

SEQ ID NO: 38561 - DNA, 1002 bp, Artificial Sequence
  Description of Artificial Sequence: Synthetic coding sequence
atggcctgcagccggccccccagccagtgtgagcccaccagcctgcccccaggccccccagctggaagaagacacctgcccctgagcagaagaagaagagagatgagcagcaacaaggagcagaggtctgctgtgtttgtgatcctgtttgccctgatcaccatcctgatcctgtacagcagcaacagcgccaatgaggtgttccactacggcagcctgcggggccgcagccggcggcctgtgaacctgaagaagtggagcatcacagatggctacgtgcccatcctgggcaacaagaccctgcccagccgctgccaccagtgtgtgattgtgagcagcagcagccacctgctgggcaccaagctgggccctgagattgaaagagctgagtgcaccatccgcatgaatgatgcccccaccaccggctacagcgcagatgtgggcaacaagaccacctacagagtggtggcccacagcagcgtcttccgggtgctgcggcggccccaggagtttgtgaacagaacacctgagaccgtcttcatcttctggggcccccccagcaagatgcagaagccccagggcagcctggtgcgggtcatccagagagctggcctggtgttccccaacatggaggcctatgctgtgtccccaggccgcatgaggcagtttgatgacctcttccggggggagaccgggaaggaccgggagaagagccacagctggctgagcacaggctggttcaccatggtgattgctgtggagctgtgtgaccacgtgcacgtgtatggcatggtgccccccaactactgcagccagaggccccggctgcagaggatgccctaccactactatgagcccaagggcccagatgaatgtgtgacctacatccagaatgagcacagcaggaaaggaaaccaccaccgcttcatcacagagaagagggtcttcagctcctgggcccagctgtatggcatcaccttcagccaccccagctggacctag

SEQ ID NO: 38562 - DNA, 900 bp, Artificial Sequence
  Description of Artificial Sequence: Synthetic coding sequence
atgagcagcaacaaggagcagaggtctgctgtgtttgtgatcctgtttgccctgatcaccatcctgatcctgtacagcagcaacagcgccaatgaggtgttccactacggcagcctgcggggccgcagccggcggcctgtgaacctgaagaagtggagcatcacagatggctacgtgcccatcctgggcaacaagaccctgcccagccgctgccaccagtgtgtgattgtgagcagcagcagccacctgctgggcaccaagctgggccctgagattgaaagagctgagtgcaccatccgcatgaatgatgcccccaccaccggctacagcgcagatgtgggcaacaagaccacctacagagtggtggcccacagcagcgtcttccgggtgctgcggcggccccaggagtttgtgaacagaacacctgagaccgtcttcatcttctggggcccccccagcaagatgcagaagccccagggcagcctggtgcgggtcatccagagagctggcctggtgttccccaacatggaggcctatgctgtgtccccaggccgcatgaggcagtttgatgacctcttccggggggagaccgggaaggaccgggagaagagccacagctggctgagcacaggctggttcaccatggtgattgctgtggagctgtgtgaccacgtgcacgtgtatggcatggtgccccccaactactgcagccagaggccccggctgcagaggatgccctaccactactatgagcccaagggcccagatgaatgtgtgacctacatccagaatgagcacagcaggaaaggaaaccaccaccgcttcatcacagagaagagggtcttcagctcctgggcccagctgtatggcatcaccttcagccaccccagctggacctag

SEQ ID NO: 38563 - DNA, 1125 bp, Artificial Sequence
  Description of Artificial Sequence: Synthetic coding sequence
atggcctgcagccggccccccagccagtgtgagcccaccagcctgcccccaggccccccagctggaagaagacacctgcccctgagcagaagaagaagagagatgagcagcaacaaggagcagaggtctgctgtgtttgtgatcctgtttgccctgatcaccatcctgatcctgtacagcagcaacagcgccaatgaggtgttccactacggcagcctgcggggccgcagccggcggcctgtgaacctgaagaagtggagcatcacagatggctacgtgcccatcctgggcaacaagaccctgcccagccgctgccaccagtgtgtgattgtgagcagcagcagccacctgctgggcaccaagctgggccctgagattgaaagagctgagtgcaccatccgcatgaatgatgcccccaccaccggctacagcgcagatgtgggcaacaagaccacctacagagtggtggcccacagcagcgtcttccgggtgctgcggcggccccaggagtttgtgaacagaacacctgagaccgtcttcatcttctggggcccccccagcaagatgcagaagccccagggcagcctggtgcgggtcatccagagagctggcctggtgttccccaacatggaggcctatgctgtgtccccaggccgcatgaggcagtttgatgacctcttccggggggagaccgggaaggaccgggagaagagccacagctggctgagcacaggctggttcaccatggtgattgctgtggagctgtgtgaccacgtgcacgtgtatggcatggtgccccccaactactgcagcggccctgccagcagcgcctgccccaccaccaccaccagcccccggggccgcaccaacgtgagccccaccagcaggatgagcacagtggcccgggccaccaccacagccagcagccccaggaagggcagcagccaccggggccccagctgcatggccagccccagccccaccccacctggcccccggccccccagcctgtgggacctgcggcgggtgcggggggaggccgccagcgcccagcccctgggccagggccccagcagcggccagagccggctggccggcgtgagccccagccagagcggcccctag

SEQ ID NO: 38564 - DNA, 900 bp, Artificial Sequence; identical to SEQ ID NO: 38562
  Description of Artificial Sequence: Synthetic coding sequence

SEQ ID NO: 38565 - DNA, 1002 bp, Artificial Sequence; identical to SEQ ID NO: 38561
  Description of Artificial Sequence: Synthetic coding sequence

SEQ ID NO: 38566 - DNA, 603 bp, Artificial Sequence
  Description of Artificial Sequence: Synthetic coding sequence
atgagcagcaacaaggagcagaggtctgctgtgtttgtgatcctgtttgccctgatcaccatcctgatcctgtacagcagcaacagcgccaatgaggtgttccactacggcagcctgcggggccgcagccggcggcctgtgaacctgaagaagtggagcatcacagatggctacgtgcccatcctgggcaacaagaccctgcccagccgctgccaccagtgtgtgattgtgagcagcagcagccacctgctgggcaccaagctgggccctgagattgaaagagctgagtgcaccatccgcatgaatgatgcccccaccaccggctacagcgcagatgtgggcaacaagaccacctacagagtggtggcccacagcagcgtcttccgggtgctgcggcggccccaggagtttgtgaacagaacacctgagaccgtcttcatcttctggggcccccccagcaagatgcagaagccccagggcagcctggtgcgggtcatccagagagctggcctggtgttccccaacatggaggcctatgctgtgtccccaggccgcatgaggcagtttgatgacctcttccggggggagaccgggaaggactag

SEQ ID NO: 38567 - DNA, 402 bp, Artificial Sequence
  Description of Artificial Sequence: Synthetic coding sequence
atgaggagcagcatcacagccccctgtggggctgtggccgctgacctgagcaccagccgcagcggggccagcctgacagccatgagccccttcagcgccacccgggagaagagccacagctggctgagcacaggctggttcaccatggtgattgctgtggagctgtgtgaccacgtgcacgtgtatggcatggtgccccccaactactgcagccagaggccccggctgcagaggatgccctaccactactatgagcccaagggcccagatgaatgtgtgacctacatccagaatgagcacagcaggaaaggaaaccaccaccgcttcatcacagagaagagggtcttcagctcctgggcccagctgtatggcatcaccttcagccaccccagctggacctag

SEQ ID NO: 38568 - DNA, 1590 bp, Artificial Sequence
  Description of Artificial Sequence: Synthetic coding sequence
atgaagccccacctgaagcagtggaggcagaggatgctgtttggcatctttgcctggggcctgctcttcctgctgatcttcatctacttcacagacagcaacccagctgagcctgtgcccagcagcctgtccttcctggagacccggcggctgctgcctgtgcagggcaagcagagggccatcatgggcgccgcccacgagcccagccccccaggcggcctggatgcccggcaggccctgccccgggcccaccctgctggcagcttccacgccggccctggggacctgcagaagtgggcccagagccaggacggctttgagcacaaggagttcttcagcagccaggtgggcaggaagagccagagcgccttctacccagaagatgatgactacttctttgctgctggccagcccggctggcacagccacacccagggcaccctgggcttccccagccctggagagcccggcccccgggagggcgccttccctgctgcccaggtgcagaggagaagagtgaagaagaggcaccggcggcagaggaggagccacgtgctggaggagggagatgatggagaccggctgtacagctccatgagccgggccttcctgtaccgcctgtggaagggaaatgtgagcagcaagatgctgaacccccggctgcagaaggccatgaaggactacctgacagccaacaagcacggcgtgcgcttccggggcaagcgggaggccggcctgagccgggcccagctgctgtgccagctgcggagccgggcccgggtgaggaccctggatggaacagaggcccccttcagcgccctgggctggaggcggctggtgcctgctgtgcccctgagccagctgcacccccggggcctgcggagctgtgctgtggtgatgtctgctggggccatcctgaacagcagcctgggggaggagattgacagccatgatgctgtgctgcgcttcaacagcgcccccacccggggctatgagaaggatgtgggcaacaagaccaccatccgcatcatcaacagccagatcctgaccaaccccagccaccacttcatcgacagcagcctgtacaaggatgtgatcctggtggcctgggaccctgccccctacagcgccaacctgaacctgtggtacaagaagccagactacaacctcttcaccccctacatccagcaccggcagaggaaccccaaccagcccttctacatcctgcaccccaagttcatctggcagctgtgggacatcatccaggagaacaccaaggagaagatccagcccaacccccccagcagcggcttcatcggcatcctgatcatgatgtccatgtgccgggaggtgcacgtgtatgagtacatccccagcgtgcggcagacagagctgtgccactaccacgagctgtactatgatgctgcctgcaccctgggcgcctaccaccccctgctgtatgagaagctgctggtgcagaggctgaacatgggcacccagggcgacctgcacaggaagggcaaggtggtgctgcccggcttccaggccgtgcactgcccagcccccagccctgtgatcccccacagctag

SEQ ID NO: 38569 - DNA, 288 bp, Artificial Sequence
  Description of Artificial Sequence: Synthetic coding sequence
tgaagcggcttcatcggcatcctgatcatgatgtccatgtgccgggaggtgcacgtgtatgagtacatccccagcgtgcggcagacagagctgtgccactaccacgagctgtactatgatgctgcctgcaccctgggcgcctaccaccccctgctgtatgagaagctgctggtgcagaggctgaacatgggcacccagggcgacctgcacaggaagggcaaggtggtgctgcccggcttccaggccgtgcactgcccagcccccagccctgtgatcccccacagctag

SEQ ID NO: 38570 - DNA, 1401 bp, Artificial Sequence
  Description of Artificial Sequence: Synthetic coding sequence
atgaagccccacctgaagcagtggaggcagaggatgctgtttggcatctttgcctggggcctgctcttcctgctgatcttcatctacttcacagacagcaacccagctgagcctgtgcccagcagcctgtccttcctggagacccggcggctgctgcctgtgcagggcaagcagagggccatcatgggcgccgcccacgagcccagccccccaggcggcctggatgcccggcaggccctgccccgggcccaccctgctggcagcttccacgccggccctggggacctgcagaagtgggcccagagccaggacggctttgagcacaaggagttcttcagcagccaggtgggcaggaagagccagagcgccttctacccagaagatgatgactacttctttgctgctggccagcccggctggcacagccacacccagggcaccctgggcttccccagccctggagagcccggcccccgggagggcgccttccctgctgcccaggtgcagaggagaagagtgaagaagaggcaccggcggcagaggaggagccacgtgctggaggagggagatgatggagaccggctgtacagctccatgagccgggccttcctgtaccgcctgtggaagggaaatgtgagcagcaagatgctgaacccccggctgcagaaggccatgaaggactacctgacagccaacaagcacggcgtgcgcttccggggcaagcgggaggccggcctgagccgggcccagctgctgtgccagctgcggagccgggcccgggtgaggaccctggatggaacagaggcccccttcagcgccctgggctggaggcggctggtgcctgctgtgcccctgagccagctgcacccccggggcctgcggagctgtgctgtggtgatgtctgctggggccatcctgaacagcagcctgggggaggagattgacagccatgatgctgtgctgcgcttcaacagcgcccccacccggggctatgagaaggatgtgggcaacaagaccaccatccgcatcatcaacagccagatcctgaccaaccccagccaccacttcatcgacagcagcctgtacaaggatgtgatcctggtggcctgggaccctgccccctacagcgccaacctgaacctgtggtacaagaagccagactacaacctcttcaccccctacatccagcaccggcagaggaaccccaaccagcccttctacatcctgcaccccaagttcatctggcagctgtgggacatcatccaggagaacaccaaggagaagatccagcccaacccccccagcagcggcttcatcggcagctttgtgaagattggccacatccgggcctgcagcgagcccaggagccgggactgcaccccagcctggaccacagaatag

SEQ ID NO: 38571 - DNA, 1590 bp, Artificial Sequence; identical to SEQ ID NO: 38568
  Description of Artificial Sequence: Synthetic coding sequence

SEQ ID NO: 38572 - DNA, 108 bp, Artificial Sequence
  Description of Artificial Sequence: Synthetic coding sequence
atgaagccccacctgaagcagtggaggcagaggatgctgtttggcatctttgcctggggcctgctcttcctgctgatcttcatctacttcacagacagcaacccctag

SEQ ID NO: 38573 - DNA, 1071 bp, Artificial Sequence
  Description of Artificial Sequence: Synthetic coding sequence
atgagcccctgtggccgggcccggcggcagaccagcagaggagccatggctgtgctggcctggaagttccccaggacccggctgcccatgggcgccagcgccctgtgtgtggtggtgctgtgctggctgtacatcttccctgtgtaccgcctgcccaatgagaaggagatcgtgcagggcgtgctgcagcagggcacagcctggaggaggaaccagacagctgcccgggccttcaggaagcagatggaggactgctgtgaccctgcccacctgtttgccatgaccaagatgaacagccccatgggcaagtccatgtggtatgatggagagttcctgtacagcttcaccatcgacaacagcacctacagcctcttcccccaggccacccccttccagctgcccctgaagaagtgtgctgtggtgggcaatggaggcatcctgaagaagagcggctgcggccggcagattgatgaggccaactttgtgatgcgctgcaacctgccccccctgagcagcgagtacaccaaggatgtgggcagcaagagccagctggtgacagccaaccccagcatcatccggcagcgcttccagaacctgctgtggagcaggaagacctttgtggacaacatgaagatctacaaccacagctacatctacatgcctgccttctccatgaagacaggaacagagcccagcctgcgggtgtactacaccctgagtgatgtgggcgccaaccagacagtgctgtttgccaaccccaacttcctgcggagcatcggcaagttctggaagagccggggcatccacgccaagaggctgagcacaggcctcttcctggtgtctgctgccctgggcctgtgtgaggaggtggccatctacggcttctggcccttctctgtgaacatgcatgagcagcccatcagccaccactactatgacaacgtgctgcccttcagcggcttccacgccatgcctgaggagttcctgcagctgtggtacctgcacaagattggagccctgaggatgcagctggacccctgtgaggacaccagcctgcagcccaccagctag

SEQ ID NO: 38574 - DNA, 642 bp, Artificial Sequence
  Description of Artificial Sequence: Synthetic coding sequence
atgacaggcagcttctacacccacagccccctgaccatccagctgaccctgagcagccaccgctgcaacctgccccccctgagcagcgagtacaccaaggatgtgggcagcaagagccagctggtgacagccaaccccagcatcatccggcagcgcttccagaacctgctgtggagcaggaagacctttgtggacaacatgaagatctacaaccacagctacatctacatgcctgccttctccatgaagacaggaacagagcccagcctgcgggtgtactacaccctgagtgatgtgggcgccaaccagacagtgctgtttgccaaccccaacttcctgcggagcatcggcaagttctggaagagccggggcatccacgccaagaggctgagcacaggcctcttcctggtgtctgctgccctgggcctgtgtgaggaggtggccatctacggcttctggcccttctctgtgaacatgcatgagcagcccatcagccaccactactatgacaacgtgctgcccttcagcggcttccacgccatgcctgaggagttcctgcagctgtggtacctgcacaagatcggggccctgaggatgcagctggacccctgtgaggacaccagcctgcagcccaccagctag

SEQ ID NO: 38575 - DNA, 1128 bp, Artificial Sequence
  Description of Artificial Sequence: Synthetic coding sequence
atgcagctgcagttccgctcctggatgctggccgccctgaccctgctggtggtgttcctgatctttgctgacatcagcgagattgaggaggagatcggcaacagcggcggccggggcaccatccgctctgctgtgaacagcctgcacagcaagagcaacagagctgaggtggtgatcaatggcagcagcagccctgctgtggtggacaggagcaatgaaagcatcaagcacaacatccagcctgccagcagcaagtggaggcacaaccagaccctgagcctgcgcatcaggaagcagatcctgaagttcctggatgctgagaaggacatctctgtgctgaagggcaccctgaagccaggggacatcatccactacatctttgaccgggacagcaccatgaatgtgtcccagaacctgtatgagctgctgcccaggaccagccccctgaagaacaagcacttcggcacctgtgccatcgtgggcaacagcggcgtgctgctgaacagcggctgcggccaggagattgatgcccacagctttgtgatccgctgcaacctggcccctgtgcaggagtatgccagagatgtgggcctgaagacagacctggtgaccatgaaccccagcgtcatccagagggcctttgaggacctggtgaatgccacctggagggagaagctgctgcagaggctgcacagcctgaatggcagcatcctgtggatcccagccttcatggcccggggcggcaaggagcgggtggagtgggtgaatgagctgatcctgaagcaccacgtgaatgtgaggacagcctaccccagcctgcggctgctgcatgctgtgcggggctactggctgaccaacaaggtgcacatcaagaggcccaccaccggcctgctgatgtacaccctggccacccgcttctgcaagcagatctacctgtatggcttctggcccttccccctggaccagaaccagaaccctgtgaagtaccactactatgacagcctgaagtatggctacaccagccaggccagcccccacaccatgcccctggagttcaaggccctgaagagcctgcacgagcagggcgccctgaagctgactgtgggccagtgtgatggagccacctag

SEQ ID NO: 38576 - DNA, 1065 bp, Artificial Sequence
  Description of Artificial Sequence: Synthetic coding sequence
atgcagctgcagttccgctcctggatgctggccgccctgaccctgctggtggtgttcctgatctttgctgacatcagcgagattgaggaggagatcggggctgaggtggtgatcaatggcagcagcagccctgctgtggtggacaggagcaatgaaagcatcaagcacaacatccagcctgccagcagcaagtggaggcacaaccagaccctgagcctgcgcatcaggaagcagatcctgaagttcctggatgctgagaaggacatctctgtgctgaagggcaccctgaagccaggggacatcatccactacatctttgaccgggacagcaccatgaatgtgtcccagaacctgtatgagctgctgcccaggaccagccccctgaagaacaagcacttcggcacctgtgccatcgtgggcaacagcggcgtgctgctgaacagcggctgcggccaggagattgatgcccacagctttgtgatccgctgcaacctggcccctgtgcaggagtatgccagagatgtgggcctgaagacagacctggtgaccatgaaccccagcgtcatccagagggcctttgaggacctggtgaatgccacctggagggagaagctgctgcagaggctgcacagcctgaatggcagcatcctgtggatcccagccttcatggcccggggcggcaaggagcgggtggagtgggtgaatgaactcatcctgaagcaccacgtgaatgtgaggacagcctaccccagcctgcggctgctgcatgctgtgcggggctactggctgaccaacaaggtgcacatcaagaggcccaccaccggcctgctgatgtacaccctggccacccgcttctgcaagcagatctacctgtatggcttctggcccttccccctggaccagaaccagaaccctgtgaagtaccactactatgacagcctgaagtatggctacaccagccaggccagcccccacaccatgcccctggagttcaaggccctgaagagcctgcacgagcagggcgccctgaagctgactgtgggccagtgtgatggagccacctag

SEQ ID NO: 38577 - DNA, 1143 bp, Artificial Sequence
  Description of Artificial Sequence: Synthetic coding sequence
atgaggaactgcaagatggcccgggtggcctctgtgctgggcctggtgatgctgtctgtggccctgctgatcctgagcctcatctcctatgtgtccctgaagaaggagaacatcttcaccacccccaagtatgccagccctggggcccccaggatgtacatgttccacgccggcttccgcagccagtttgccctgaagttcctggaccccagctttgtgcccatcaccaacagcctgacccaggagctgcaggagaagcccagcaagtggaagttcaacagaacagccttcctgcaccagaggcaggagatcctgcagcacgtggatgtgatcaagaacttcagcctgaccaagaacagcgtgagaattggccagctgatgcactatgactacagcagccacaagtatgtgttcagcatcagcaacaacttccgcagcctgctgcctgatgtgagccccatcatgaacaagcactacaacatctgtgctgtggtgggcaacagcggcatcctgaccggcagccagtgtggccaggagattgacaagagtgactttgtgttccgctgcaactttgcccccacagaggccttccagagagatgtgggcaggaagaccaacctgaccaccttcaaccccagcatcctggagaagtactacaacaacctgctgaccatccaggacaggaacaacttcttcctgagcctgaagaagctggatggagccatcctgtggatcccagccttcttcttccacaccagcgccaccgtgaccaggaccctggtggacttctttgtggagcaccggggccagctgaaggtgcagctggcctggccaggcaacatcatgcagcacgtgaaccgctactggaagaacaagcacctgagccccaagaggctgagcacaggcatcctgatgtacaccctggccagcgccatctgtgaggagatccacctgtatggcttctggcccttcggctttgaccccaacacccgggaggacctgccctaccactactatgacaagaagggcaccaagttcaccaccaagtggcaggagagccaccagctgcctgctgagttccagctgctgtacaggatgcatggagagggcctgaccaagctgaccctgagccactgtgcctag

SEQ ID NO: 38578 - DNA, 1464 bp, Artificial Sequence
  Description of Artificial Sequence: Synthetic coding sequence
gctgggggccggggccgcacagccctgcgggcccccagcccccggcggcgggccgccccacccagcagctgcagcgcccctggccctgcccggccctgcctgcggggccctgctgccctgcggggcagctgccagccccagcccccagcccctgtggccagcccccaccccaggcctggccccccacctccaccccacgcccgggcccacacccacacccacacccacacccacacccacacccacatctacaccccagccagctgctggcccctgaatggccccatcagccctgtgtccctgaacccagcccagcccggcatgaggaactgcaagatggcccgggtggcctctgtgctgggcctggtgatgctgtctgtggccctgctgatcctgagcctcatctcctatgtgtccctgaagaaggagaacatcttcaccacccccaagtatgccagccctggggcccccaggatgtacatgtttcatgctggcttccgcagccagtttgccctgaagttcctggaccccagctttgtgcccatcaccaacagcctgacccaggagctgcaggagaagcccagcaagtggaagttcaacagaacagccttcctgcaccagaggcaggagatcctgcagcacgtggatgtgatcaagaacttcagcctgaccaagaacagcgtgcgcatcggccagctgatgcactatgactacagcagccacaagtatgtgttcagcatcagcaacaacttccgcagcctgctgcctgatgtgagccccatcatgaacaagcactacaacatctgtgctgtggtgggcaacagcggcatcctgaccggcagccagtgtggccaggagattgacaagagtgactttgtgttccgctgcaactttgcccccacagaggccttccagagagatgtgggcaggaagaccaacctgaccaccttcaaccccagcatcctggagaagtactacaacaacctgctgaccatccaggacaggaacaacttcttcctgagcctgaagaagctggatggagccatcctgtggatcccagccttcttcttccacaccagcgccaccgtgaccaggaccctggtggacttctttgtggagcaccggggccagctgaaggtgcagctggcctggccaggcaacatcatgcagcacgtgaaccgctactggaagaacaagcacctgagccccaagaggctgagcacaggcatcctgatgtacaccctggccagcgccatctgtgaggagatccacctgtatggcttctggccctttggatttgaccccaacacccgggaggacctgccctaccactactatgacaagaagggcaccaagttcaccaccaagtggcaggagagccaccagctgcctgctgagttccagctgctgtacaggatgcacggggagggcctgaccaagctgaccctgagccactgtgcctag

SEQ ID NO: 38579 - DNA, 405 bp, Artificial Sequence
  Description of Artificial Sequence: Synthetic coding sequence
atgaggatgctgctgcacctgagcctgctggccctgggcgccgcctacgtgtatgccatccccacagagatccccaccagcgccctggtgaaggagaccctggccctgctgagcacccacaggaccctgctgattgccaatgagaccctgcgcatccctgtgcctgtgcacaagaaccaccagctgtgcacagaggagatcttccagggcatcggcaccctggagagccagacagtgcagggcggcaccgtggagcggctcttcaagaacctgagcctcatcaagaagtacattgatggccagaagaagaagtgtggggaggagcggcggcgggtgaaccagttcctggactacctgcaggagttcctgggcgtgatgaacacagagtggatcatcgagagctag

SEQ ID NO: 38580 - DNA, 507 bp, Artificial Sequence
  Description of Artificial Sequence: Synthetic coding sequence
atgaggagcatcaggaagcgctggaccatctgcaccatcagcctgctgctgatcttctacaagaccaaggagatcgccaggacagaggagcaccaggagacccagctgattggagatggagagctgagcctgagccgcagcctggtgaacagcagtgacaagatcatcaggaaggccggcagcagcatcttccagcacaacgtggagggctggaagatcaacagcagcctggtgctggagatcaggaagaacatcctgcgcttcctggatgctgagagagatgtgtctgtggtgaagagcagcttcaagccaggagatgtgatccactacgtgctggacagaagaaggaccctgaacatcagccatgacctgcacagcctgctgcctgaggtgagccccatgaagaacagacgcttcaagacctgtgctgtggtgggcaacagcggcatcctgctggacagtgaatgtgggaaggagattgacagccacaactttgtgatcagatag

SEQ ID NO: 38581 - DNA, 1131 bp, Artificial Sequence
  Description of Artificial Sequence: Synthetic coding sequence
atgagatatgctgaccccagcgccaacagagacctgctgggcagcaggaccctgctcttcatcttcatctgtgcctttgccctggtgaccctgctgcagcagatcctgtatggaagaaactacatcaagcgctactttgagttctatgagggcccctttgagtacaacagcacccgctgcctggagctgcggcatgagatcctggaggtgaaggtgctgtccatggtgaagcagagcgagctgtttgaccgctggaagagcctgcagatgtgcaagtgggccatgaacatcagcgaggccaaccagttcaagagcaccctgagccgctgctgcaatgccccagccttcctgttcaccacccagaagaacacccccctgggcaccaagctgaagtatgaggtggacaccagcggcatctaccacatcaaccaggagatcttcaggatgttccccaaggacatgccctactaccgcagccagttcaagaagtgtgctgtggtgggcaatggaggcatcctgaagaacagccgctgtggccgggagatcaacagcgctgactttgtgttccgctgcaacctgccccccatcagcgagaagtacaccatggatgtgggcgtgaagacagatgtggtgacagtgaaccccagcatcatcacagagcgcttccacaagctggagaagtggaggcggcccttctacagagtgctgcaggtgtatgaaaatgcctctgtgctgctgcctgccttctacaacaccaggaacacagatgtgtccatccgggtgaagtatgtgctggatgactttgagagcccccaggccgtgtactacttccacccccagtacctggtgaatgtgagccgctactggctgagcctgggcgtgcgggccaagaggatcagcacaggcctcatcctggtgacagctgccctggagctgtgtgaggaggtgcacctgtttggcttctgggccttccccatgaaccccagcggcctgtacatcacccaccactactatgacaacgtgaagcccaggcctggcttccacgccatgcccagcgagatcttcaacttcctgcacctgcacagccggggcatcctgcgggtgcacacaggcacctgcagctgctgctag

SEQ ID NO: 38582 - DNA, 1038 bp, Artificial Sequence
  Description of Artificial Sequence: Synthetic coding sequence
atgagatatgctgaccccagcgccaacagagacctgctgggcagcaggaccctgctcttcatcttcatctgtgcctttgccctggtgaccctgctgcagcagatcctgtatggaagaaactacatcaagagggtgaagcagagcgagctgtttgaccgctggaagagcctgcagatgtgcaagtgggccatgaacatcagcgaggccaaccagttcaagagcaccctgagccgctgctgcaatgccccagccttcctgttcaccacccagaagaacacccccctgggcaccaagctgaagtatgaggtggacaccagcggcatctaccacatcaaccaggagatcttcaggatgttccccaaggacatgccctactaccgcagccagttcaagaagtgtgctgtggtgggcaatggaggcatcctgaagaacagccgctgtggccgggagatcaacagcgctgactttgtgttccgctgcaacctgccccccatcagcgagaagtacaccatggatgtgggcgtgaagacagatgtggtgacagtgaaccccagcatcatcacagagcgcttccacaagctggagaagtggaggcggcccttctacagagtgctgcaggtgtatgaaaatgcctctgtgctgctgcctgccttctacaacaccaggaacacagatgtgtccatccgggtgaagtatgtgctggatgactttgagagcccccaggccgtgtactacttccacccccagtacctggtgaatgtgagccgctactggctgagcctgggcgtgcgggccaagaggatcagcacaggcctcatcctggtgacagctgccctggagctgtgtgaggaggtgcacctgtttggcttctgggccttccccatgaaccccagcggcctgtacatcacccaccactactatgacaacgtgaagccccggcccggcttccacgccatgcccagcgagatcttcaacttcctgcacctgcacagccggggcatcctgcgggtgcacacaggcacctgcagctgctgctag

SEQ ID NO: 38583 - DNA, 1239 bp, Artificial Sequence
  Description of Artificial Sequence: Synthetic coding sequence
atgagatatgctgaccccagcgccaacagagacctgctgggcagcaggaccctgctcttcatcttcatctgtgcctttgccctggtgaccctgctgcagcagatcctgtatggaagaaactacatcaagaggggcctgcagtttggctggcagagcggggaccagctgaccaactggacaggcctcttcaacgtgacagatgatcctgctgtgcagagcggcagtgacagcagcagccgctactttgagttctatgagggcccctttgagtacaacagcacccgctgcctggagctgcggcatgagatcctggaggtgaaggtgctgtccatggtgaagcagagcgagctgtttgaccgctggaagagcctgcagatgtgcaagtgggccatgaacatcagcgaggccaaccagttcaagagcaccctgagccgctgctgcaatgccccagccttcctgttcaccacccagaagaacacccccctgggcaccaagctgaagtatgaggtggacaccagcggcatctaccacatcaaccaggagatcttcaggatgttccccaaggacatgccctactaccgcagccagttcaagaagtgtgctgtggtgggcaatggaggcatcctgaagaacagccgctgtggccgggagatcaacagcgctgactttgtgttccgctgcaacctgccccccatcagcgagaagtacaccatggatgtgggcgtgaagacagatgtggtgacagtgaaccccagcatcatcacagagcgcttccacaagctggagaagtggaggcggcccttctacagagtgctgcaggtgtatgaaaatgcctctgtgctgctgcctgccttctacaacaccaggaacacagatgtgtccatccgggtgaagtatgtgctggatgactttgagagcccccaggccgtgtactacttccacccccagtacctggtgaatgtgagccgctactggctgagcctgggcgtgcgggccaagaggatcagcacaggcctcatcctggtgacagctgccctggagctgtgtgaggaggtgcacctgtttggcttctgggccttccccatgaaccccagcggcctgtacatcacccaccactactatgacaacgtgaagcccaggcctggcttccacgccatgcccagcgagatcttcaacttcctgcacctgcacagccggggcatcctgcgggtgcacacaggcacctgcagctgctgctag

SEQ ID NO: 38584 - DNA, 1197 bp, Artificial Sequence
  Description of Artificial Sequence: Synthetic coding sequence
atgaggcctggaggagccctgctggccctgctggccagcctgctgctgctgctgctgctgcggctgctgtggtgcccagcagatgcccctggccgggcccgcatcctggtggaggagagccgggaggccacccacggcaccccagctgccctgcggaccctgcggagccctgccacagctgtgccccgggccaccaacagcacctacctgaatgagaagagcctgcagctgacagagaagtgcaagaacctgcagtatggcatcgagagcttcagcaacaagaccaagggctacagtgaaaatgactacctgcagatcatcacagacatccagagctgcccctggaagaggcaggccgaggagtatgccaacttccgggccaagctggccagctgctgtgatgctgtgcagaactttgtggtgtcccagaacaacacccctgtgggcaccaacatgtcctatgaggtggagagcaagaaggagatccccatcaagaagaacatcttccacatgtttcctgtgtcccagccctttgtggactacccctacaaccagtgtgctgtggtgggcaatggaggcatcctgaacaagagcctgtgtggcacagaaattgacaagagtgactttgtgttccgctgcaacctgccccccaccactggagatgtgtccaaggatgtgggcagcaagaccaacctggtgaccatcaaccccagcatcatcaccctgaagtatggcaacctgaaggagaagaaggccctcttcctggaggacatcgccacctatggagatgccttcttcctgctgcctgccttctccttccgggccaacacaggcaccagcttcaaggtgtactacaccctggaggagagcaaggcccggcagaaggtgctcttcttccaccccaagtacctgaaggacctggccctcttctggaggaccaagggcgtgacagcctaccgcctgagcacaggcctgatgatcacctctgtggccgtggagctgtgcaagaatgtgaagctgtatggcttctggcccttcagcaagacagtggaggacatccctgtgagccaccactactatgacaacaagctgcccaagcacggcttccaccagatgcccaaggagtacagccagatcctgcagctgcacatgaagggcatcctgaagctgcagttcagcaaatgtgaggtggcctag

SEQ ID NO: 38585 - DNA, 414 bp, Artificial Sequence
  Description of Artificial Sequence: Synthetic coding sequence
atgtttcctgtgtcccagccctttgtggactacccctacaaccagtgtgctgtggtgggcaatggaggcatcctgaacaagagcctgtgtggcacagaaattgacaagagtgactttgtgttccgctgcaacctgccccccaccactggagatgtgtccaaggatgtgggcagcaagaccaacctggtgaccatcaaccccagcatcatcaccctgaagtatggcaacctgaaggagaagaaggccctcttcctggaggacatcgccacctatggagatgccttcttcctgctgcctgccttctccttccgggccaacacaggcaccagcttcaaggtgtactacaccctggaggagagcaaggcccggcagaagtgcaagaccaagaggaagaccatcaacagcatcctgtag

SEQ ID NO: 38586 - DNA, 387 bp, Artificial Sequence
  Description of Artificial Sequence: Synthetic coding sequence
tgatacccctacaaccagtgtgctgtggtgggcaatggaggcatcctgaacaagagcctgtgtggcacagaaattgacaagagtgactttgtgttccgctgcaacctgccccccaccactggagatgtgtccaaggatgtgggcagcaagaccaacctggtgaccatcaaccccagcatcatcaccctgaagtatggcaacctgaaggagaagaaggccctcttcctggaggacatcgccacctatggagatgccttcttcctgctgcctgccttctccttccgggccaacacaggcaccagcttcaaggtgtactacaccctggaggagagcaaggcccggcagaagtgcaagaccaagaggaagaccatcaacagcatcctgtag

SEQ ID NO: 38587 - DNA, 7713 bp, Artificial Sequence
  Description of Artificial Sequence: Synthetic coding sequence
atggccggcccccggggcctgctgcccctgtgcctgctggccttctgcctggccggcttctcctttgtgcggggccaggtgctcttcaagggctgtgatgtgaagaccacctttgtgacccacgtgccctgcaccagctgtgccgccatcaagaagcagacctgccccagcggctggctgcgggagctgcctgaccagatcacccaggactgccgctatgaggtgcagctgggcggctccatggtgtccatgagcggctgcaggaggaagtgcaggaagcaggtggtgcagaaggcctgctgccccggctactggggcagccgctgccatgaatgtcctggaggagctgagaccccctgcaatggacatggcacctgcctggatggcatggacagaaatggcacctgtgtgtgccaggagaacttccggggcagcgcctgccaggagtgccaggaccccaaccgcttcggccctgactgccagagcgtgtgcagctgtgtgcacggcgtgtgcaaccacggccccagaggagatggcagctgcctgtgctttgctggctacacaggcccccactgtgaccaggagctgcctgtgtgccaggagctgcgctgcccccagaacacccagtgcagcgctgaggcccccagctgccgctgcctgcccggctacacccagcagggctctgaatgtcgggcccccaacccctgctggcccagcccctgcagcctgctggcccagtgcagcgtgagccccaagggccaggcccagtgccactgcccagagaactaccatggagatggcatggtgtgcctgcccaaggacccctgcacagacaacctgggcggctgccccagcaacagcaccctgtgtgtgtaccagaagccaggccaggccttctgcacctgccggcccggcctggtgtccatcaacagcaatgccagcgctggctgctttgccttctgcagccccttcagctgtgacagaagtgccacctgccaggtgacagcagatggcaagaccagctgtgtgtgccgggagagcgaggtgggagatggccgggcctgctacggccacctgctgcacgaggtgcagaaggccacccagacaggccgggtcttcctgcagctgcgggtggccgtggccatgatggaccagggctgccgggagatcctgaccacagctggccccttcaccgtgctggtgcccagcgtgagcagcttcagcagcaggaccatgaatgccagcctggcccagcagctgtgccggcagcacatcatcgccggccagcacatcctggaggacaccaggacccagcagacccggcgctggtggaccctggccggccaggagatcaccgtgaccttcaaccagttcaccaagtacagctacaagtacaaggaccagccccagcagaccttcaacatctacaaggccaacaacattgctgccaacggggtcttccacgtggtgacaggcctgcgctggcaggcccccagcggcacccctggggaccccaagaggaccatcggccagatcctggccagcacagaggccttcagcagatttgagaccatcctggagaactgtggcctgcccagcatcctggatggccctggccccttcaccgtgtttgcccccagcaatgaggccgtggacagcctgagagatggccgcctcatctacctgttcaccgctggcctgagcaagctgcaggagctggtgcgctaccacatctacaaccacggccagctgactgtggagaagctgatcagcaagggccgcatcctgaccatggccaaccaggtgctggccgtgaacatcagcgaggagggccgcatcctgctgggccctgagggcgtgcccctgcagagggtggatgtgatggccgccaatggagtcatccacatgctggatggcatcctgctgccccccaccatcctgcccatcctgcccaagcactgcagcgaggagcagcacaagatcgtggccggcagctgtgtggactgccaggccctgaacaccagcacctgcccccccaacagcgtgaagctggacatcttccccaaggaatgtgtgtacatccatgaccccaccggcctgaatgtgctgaagaagggctgtgccagctactgcaaccagaccatcatggagcagggctgctgcaagggcttctttggaccagactgcacccagtgccctgggggcttcagcaacccctgctatggaaaaggaaactgcagtgatggcatccagggcaatggagcctgcctgtgcttcccagactacaagggcatcgcctgccacatctgcagcaaccccaacaagcacggggagcagtgccaggaggactgtggctgtgtgcacggcctgtgtgacaacagacctggcagcggaggagtgtgccagcagggcacctgtgcccctggcttcagcggccgcttctgcaatgaatccatgggagactgtggccccaccggcctggcccagcactgccacctgcacgcccgctgtgtgtcccaggagggcgtggcccgctgccgctgcctggatggctttgaaggagatggcttcagctgcacccccagcaacccctgcagccacccagacagaggaggctgcagtgaaaatgcagaatgtgtgcccggcagcctgggcacccaccactgcacctgccacaagggctggagcggagatggccgggtgtgtgtggccattgatgaatgtgagctggacatgaggggcggctgccacacagatgccctgtgcagctatgtgggccctggccagagccgctgcacctgcaagctgggctttgctggagatggctaccagtgcagccccatcgacccctgcagagctggaaatggaggctgccacggcctggccacctgcagagctgtgggcggcggccagagggtgtgcacctgccccccaggctttggaggagatggcttcagctgctacggggacatcttccgggagctggaggccaatgcccacttcagcatcttctaccagtggctgaagtctgctggcatcaccctgcctgctgacagaagagtgacagccctggtgcccagcgaggccgctgtgcggcagctgagcccagaagatcgggccttctggctgcagcccaggaccctgcccaacctggtgcgggcccacttcctgcagggcgccctgtttgaggaggagctggcccggctgggcggccaggaggtggccaccctgaaccccaccacccgctgggagatccggaacatcagcggccgggtgtgggtgcagaatgcctctgtggatgtggccgacctgctggccaccaacggggtgctgcacatcctgagccaggtgctgctgcccccaagaggagatgtgcctgggggccagggcctgctgcagcagctggacctggtgcctgccttcagcctcttccgggagctgctgcagcaccacggcctggtgccccagattgaagctgccacagcctacaccatctttgtgcccaccaacagaagcctggaggcccagggcaacagcagccacctggatgctgacacagtgcgccaccacgtggtgctgggggaggccctgtccatggagaccctgaggaagggcggccacaggaacagcctgctgggccctgcccactggatcgtgttctacaaccacagcggccagcctgaggtgaaccacgtgcccctggagggccccatgctggaggcccctggccgcagcctgattggcctgagcggcgtgctgactgtgggcagcagccgctgcctgcacagccatgctgaggccctgcgggagaagtgtgtgaactgcacccggcgcttccgctgcacccagggcttccagctgcaggacacccccaggaagagctgtgtgtacagaagtggcttctccttcagccggggctgcagctacacctgtgccaagaagatccaggtgcctgactgctgccccggcttcttcggcaccctgtgtgagccctgccctgggggcctgggcggcgtgtgcagcggccacggccagtgccaggaccgcttcctgggcagcggggagtgccactgccacgagggcttccatggaacagcctgtgaggtgtgtgagctgggccgctatggccccaactgcaccggggtgtgtgactgtgcccacggcctgtgccaggagggcctgcagggagatggcagctgtgtgtgcaatgtgggctggcagggcctgcgctgtgaccagaagatcaccagcccccagtgccccaggaaatgtgaccccaatgccaactgtgtgcaggacagcgctggggccagcacctgtgcctgtgccgccggctacagcggaaatggcatcttctgcagcgaggtggacccctgtgcccacggccatggaggctgcagcccccacgccaactgcaccaaggtggcccctggccagaggacctgcacctgccaggacggctacatgggagatggagagctgtgccaggagatcaacagctgcctgatccaccacggcggctgccacatccacgccgagtgcatccccaccggcccccagcaggtgtcctgcagctgccgggagggctacagcggagatggcatccgcacctgtgagctgctggacccctgcagcaagaacaacggcggctgcagcccctatgccacctgcaagagcactggagatggccagaggacctgcacctgtgacacagcccacacagtgggagatggcctgacctgccgggcccgggtgggcctggagctgctgcgggacaagcacgccagcttcttcagcctgcggctgctggagtacaaggagctgaagggagatggccccttcaccatctttgtgccccatgctgacctgatgagcaacctgagccaggatgagctggcccgcatccgggcccaccggcagctggtgttccgctaccacgtggtgggctgccggcggctgcggtctgaggacctgctggagcagggctacgccacagccctgagcggccaccccctgcgcttcagcgagcgggagggcagcatctacctgaatgactttgcccgggtggtgtccagtgaccacgaggccgtgaatggcatcctgcacttcatcgacagagtgctgctgcccccagaggccctgcactgggagccagatgatgcccccatccccaggagaaatgtgacagctgctgcccagggcttcggctacaagatcttcagcggcctgctgaaggtggccggcctgctgcccctgctgcgggaggccagccaccggcccttcaccatgctgtggcccacagatgctgccttccgggccctgcccccagaccggcaggcctggctgtaccacgaggaccaccgggacaagctggccgccatcctgcggggccacatgatcagaaatgtggaggccctggccagtgacctgcccaacctgggccccctgcggaccatgcacggcacccccatctccttcagctgcagcaggaccagggctggggagctgatggtgggggaggatgatgccagaattgtgcagaggcacctgccctttgagggcggcctggcctacggcatcgaccagctgctggagcccccaggcctgggcgcccgctgtgaccactttgagacccggcccctgcggctgaacacctgcagcatctgtggcctggagcccccctgcccagagggcagccaggagcagggcagccctgaggcctgctggaggttctaccccaagttctggaccagcccccccctgcacagcctgggcctgcggtctgtgtgggtgcaccccagcctgtggggccggccccagggcctgggccggggctgccacaggaactgtgtgaccaccacctggaagcccagctgctgccccggccactacggcagcgagtgccaggcctgccctgggggccccagcagcccctgcagcgacagaggagtgtgcatggatggcatgagcggcagcggccagtgcctgtgccgcagcggctttgctggaacagcctgtgagctgtgtgcccctggggccttcggcccccactgccaggcctgccgctgcaccgtgcacggccgctgtgatgagggcctgggcggcagcggcagctgcttctgtgatgagggctggacaggcccccgctgtgaggtgcagctggagctgcagcctgtgtgcaccccaccctgtgcccctgaggccgtgtgccgggccggcaacagctgtgaatgttccctgggctatgaaggagatggccgggtgtgcaccgtggccgacctgtgccaggacggccatggaggctgcagcgagcacgccaactgcagccaggtgggcaccatggtgacctgcacctgcctgcctgactatgaaggagatggctggagctgccgggccaggaacccctgcacagatggccaccggggcggctgcagcgagcacgccaactgcctgagcacaggcctgaacacccggcgctgtgaatgtcatgctggctacgtgggagatggcctgcagtgcctggaggagagcgagccccctgtggaccgctgcctgggccagcccccaccctgccacagtgatgccatgtgcacagacctgcacttccaggagaagagagctggggtcttccacctgcaggccaccagcggcccctacggcctgaacttcagcgaggccgaggccgcctgtgaggcccagggcgctgtgctggccagcttcccccagctgtctgctgcccagcagctgggcttccacctgtgcctgatgggctggctggccaacggcagcacagcccaccctgtggtgtttcctgtggccgactgtggaaatggccgggtgggcatcgtgtccctgggcgccaggaagaacctgtctgagcgctgggatgcctactgcttccgggtgcaggatgtggcctgccgctgcagaaatggatttgtgggagatggcatcagcacctgcaatggcaagctgctggatgtgctggccgccacagccaacttcagcaccttctacggcatgctgctgggctacgccaatgccacccagaggggcctggacttcctggacttcctggatgatgagctgacctacaagaccctgtttgtgcctgtgaatgaaggatttgtggacaacatgaccctgagcggccctgacctggagctgcacgccagcaatgccaccctgctgagcgccaatgccagccagggcaagctgctgcctgcccacagcggcctgagcctcatcatcagtgatgctggccctgacaacagctcctgggcccctgtggcccctggcaccgtggtggtgagccgcatcatcgtgtgggacatcatggccttcaacggcatcatccacgccctggccagccccctgctggccccaccccagccccaggccgtgctggcccctgaggcccctcctgtggccgccggcgtgggcgctgtgctggccgccggggccctgctgggcctggtggccggggccctgtacctgcgggcccggggcaagcccatgggcttcggcttcagcgccttccaggccgaggatgatgctgatgatgacttcagcccctggcaggagggcaccaaccccaccctggtgtctgtgcccaaccctgtgtttggaagtgacaccttctgtgagccctttgatgacagcctgctggaggaggacttcccagacacccagaggatcctgactgtgaagtag

SEQ ID NO: 38588 - DNA, 3003 bp, Artificial Sequence
  Description of Artificial Sequence: Synthetic coding sequence
atgggccgccgcaccctcttcatcggctgccagcccaagtgtgtgaggacagtcatcacccgggagtgctgtgccggcttcttcggcccccagtgccagccctgccctggaaatgcccagaatgtgtgctttggaaatggcatctgcctggatggagtgaatggcaccggggtgtgtgaatgtggggagggcttcagcggcacagcctgtgagacctgcacagagggcaagtatggcatccactgtgaccaggcctgcagctgtgtgcacggccgctgcaaccagggccccctgggagatggcagctgtgactgtgatgtgggctggaggggcgtgcactgtgacaatgccaccacagaggacaactgcaatggcacctgccacaccagcgccaactgcctgaccaacagtgatggaacagccagctgcaagtgtgccgccggcttccagggcaatggcaccatctgcacagccatcaatgcctgtgagatcagcaatggaggctgcagcgccaaggctgactgcaagaggaccaccccaggccggcgggtgtgcacctgcaaggccggctacacaggagatggcatcgtgtgcctggagatcaacccctgcctggagaaccacggcggctgtgacaagaatgctgagtgcacccagacaggccccaaccaggccgcctgcaactgcctgcctgcctacacaggagatggcaaggtgtgcaccctcatcaacgtgtgcctgaccaagaatggaggctgcagcgagtttgccatctgcaaccacacaggccaggtggagaggacctgcacctgcaagcccaactacatcggagatggcttcacctgccggggcagcatctaccaggagctgcccaagaaccccaagaccagccagtacttcttccagctgcaggagcactttgtgaaggacctggtgggccctggccccttcaccgtgtttgcccccctgtctgctgcctttgatgaggaggcccgggtgaaggactgggacaagtatggcctgatgccccaggtgctgcgctaccacgtggtggcctgccaccagctgctgctggagaacctgaagctgatcagcaatgccaccagcctgcagggcgagcccatcgtcatctctgtgtcccagagcacagtgtacatcaacaacaaggccaagatcatcagcagtgacatcatcagcaccaatggaattgtgcacatcatcgacaagctgctgagccccaagaacctgctgatcacccccaaggacaacagcggccgcatcctgcagaacctgaccaccctggccaccaacaacggctacatcaagttcagcaacctgatccaggacagcggcctgctgagcgtcatcacagaccccatccacacccctgtgaccctcttctggcccacagaccaggccctgcacgccctgcctgctgagcagcaggacttcctgttcaaccaggacaacaaggacaagctgaaggagtacctgaagttccacgtgatcagagatgccaaggtgctggccgtggacctgcccaccagcacagcctggaagaccctgcagggcagcgagctgtctgtgaagtgtggggccggccgggacattggagacctcttcctgaatggccagacctgcagaattgtgcagcgggagctgctgtttgacctgggcgtggcctacggcatcgactgcctgctgattgaccccaccctgggcggccgctgtgacaccttcaccacctttgatgccagcggggagtgtggcagctgtgtgaacacccccagctgcccccgctggagcaagcccaagggcgtgaagcagaagtgcctgtacaacctgcccttcaagaggaacctggagggctgccgggagcgctgcagcctggtgatccagatcccccgctgctgcaagggctacttcggccgggactgccaggcctgccctgggggcccagatgccccctgcaacaacagaggagtgtgcctggaccagtacagcgccaccggggagtgcaagtgcaacacaggcttcaacggcacagcctgtgagatgtgctggccaggccgcttcggccctgactgcctgccctgtggctgcagcgaccacggccagtgtgatgatggcatcaccggcagcggccagtgcctgtgtgaaacaggctggacaggccccagctgtgacacccaggccgtgctgcctgctgtgtgcaccccaccctgcagcgcccacgccacctgcaaggagaacaacacctgtgagtgcaacctggactatgaaggagatggcatcacctgcaccgtggtggacttctgcaagcaggacaatggaggctgtgccaaggtggcccgctgcagccagaagggcaccaaggtgtcctgcagctgccagaagggctacaagggagatggccacagctgcacagaaattgacccctgtgctgatggcctgaatggaggctgccatgaacatgccacctgcaagatgactggacctgggaagcacaagtgtgagtgcaagagccactacgtgggagatggcctgaactgtgagcctgagcagctgcccatcgaccgctgcctgcaggacaatggccagtgccacgcagatgccaagtgtgtggacctgcacttccaggacaccaccgtgggcgtcttccacctgcggagccccctgggccagtacaagctgacctttgacaaggcccgggaggcctgtgccaatgaagctgccaccatggccacctacaaccagctgtcctatgcccagaaggccaagtaccacctgtgcagcgctggctggctggagaccggccgggtggcctaccccacagcctttgccagccagaactgtggcagcggcgtggtgggcatcgtggactatggcccccggcccaacaagtctgagatgtgggatgtgttctgctacaggatgaagggcagcgctggcctcttccagcagctgagcagccggccctgcatcagcaggaccccagactag

SEQ ID NO: 38589 - DNA, 7656 bp, Artificial Sequence
  Description of Artificial Sequence: Synthetic coding sequence
atgatgctgcagcacctggtgatcttctgcctgggcctggtggtgcagaacttctgcagccctgctgagaccaccggccaggcccggcgctgtgacaggaagagcctgctgaccatcagaacagagtgccgcagctgtgccctgaacctgggcgtgaagtgcccagatggctacaccatgatcaccagcggctctgtgggcgtgcgggactgccgctacacctttgaggtgaggacctacagcctgagcctgcccggctgccgccacatctgcaggaaggactacctgcagccccgctgctgccccggccgctggggccctgactgcattgaatgtcctggaggagctggcagcccctgcaatggccggggcagctgtgccgagggcatggagggcaatggcacctgcagctgccaggagggctttggaggaacagcctgtgagacctgtgctgatgacaacctgtttggccccagctgcagctctgtgtgcaactgtgtgcacggcgtgtgcaacagcggcctggatggagatggcacctgtgagtgctacagcgcctacacaggccccaagtgtgacaagcccatcccagaatgtgccgccctgctgtgcccagagaacagccgctgcagccccagcacagaagatgagaacaagctggagtgcaagtgcctgcccaactacagaggagatggcaagtactgtgaccccatcaacccctgcctgaggaagatctgccacccccacgcccactgcacctacctgggccccaacagacacagctgcacctgccaggagggctacagaggagatggccaggtgtgcctgcctgtggacccctgccagatcaactttggaaactgccccaccaagagcacagtgtgcaagtatgatggccctggccagagccactgtgagtgcaaggagcactaccagaactttgtgcctggggtgggctgcagcatgacagacatctgcaagagtgacaacccctgccacagaaatgccaactgcaccaccgtggcccctggccgcacagagtgcatctgccagaagggctacgtgggagatggcctgacctgctacggcaacatcatggagcggctgcgggagctgaacacagagccccggggcaagtggcagggccgcctgaccagcttcatcagcctgctggacaaggcctatgcctggcccctgagcaagctgggccccttcaccgtgctgctgcccacagacaagggcctgaagggcttcaacgtgaatgagctgctggtggacaacaaggccgcccagtactttgtgaagctgcacatcatcgccggccagatgaacatcgagtacatgaacaacacagacatgttctacaccctgaccgggaagtctggagagatcttcaacagcgacaaggacaaccagatcaagctgaagctgcacggcggcaagaagaaggtgaagatcatccagggcgacatcatcgccagcaatggcctgctgcacatcctggaccgggccatggacaagctggagcccacctttgagagcaacaatgagcagaccatcatgaccatgctgcagccccgctacagcaagttccgcagcctgctggaggagaccaacctgggccacgccctggatgaagatggagtgggcggcccctacaccatctttgtgcccaacaatgaggccctgaacaacatgaaggatggcaccctggactacctgctgagccctgagggcagcaggaagctgctggagctggtgcgctaccacatcgtgcccttcacccagctggaggtggccaccctcatcagcaccccccacatccgctccatggccaaccagctgatccagttcaacaccacagacaatggccagatcctggccaatgatgtggccatggaggagattgagatcacagccaagaatggccgcatctacaccctgactggagtgctgatcccccccagcatcgtgcccatcctgccccaccgctgtgatgagaccaagcgggagatgaagctgggcacctgtgtgtcctgcagcctggtgtactggagccgctgcccagccaacagcgagcccacagccctcttcacccaccgctgtgtgtacagcggccgcttcggcagcctgaagagcggctgtgcccgctactgcaatgccaccgtgaagatccccaagtgctgcaagggcttctacggccctgactgcaaccagtgccctgggggcttcagcaacccctgcagcggaaatggccagtgtgccgacagcctgggcggcaatggcacctgcatctgtgaggagggcttccagggcagccagtgccagttctgcagcgaccccaacaagtatggcccccgctgcaacaagaagtgcctgtgtgtgcacggcacctgcaacaacagaattgacagtgatggagcctgcctgaccggcacctgcagagatggcagcgctggccgcctgtgtgacaagcagaccagcgcctgtggcccctacgtgcagttctgccacatccacgccacctgtgagtacagcaatggaacagccagctgcatctgcaaggccggctatgaaggagatggcaccctgtgcagcgagatggacccctgcaccggcctgacccctgggggctgcagcagaaatgctgagtgcatcaagacaggcaccggcacccacacctgtgtgtgccagcagggctggacaggaaatggccgggactgcagcgagatcaacaactgcctgctgcccagcgctgggggctgccacgacaatgccagctgcctgtatgtgggccctggccagaatgaatgtgagtgcaagaagggcttcagaggaaatggaattgactgtgagcccatcaccagctgcctggagcagacaggcaagtgccaccccctggccagctgccagagcaccagcagtggagtgtggagctgtgtgtgccaggagggctatgaaggagatggcttcctgtgctatggaaatgctgctgtggagctgtccttcctgtctgaggccgccatcttcaaccgctggatcaacaatgccagcctgcagcccaccctgagcgccaccagcaacctgactgtgctggtgcccagccagcaggccacagaggacatggaccaggatgagaagagcttctggctgagccagagcaacatcccagccctgatcaagtaccacatgctgctgggcacctacagagtggccgacctgcagaccctgagcagcagtgacatgctggccaccagcctgcagggcaacttcctgcacctggccaaggtggatggcaacatcaccattgaaggagccagcatcgtggatggagacaatgctgccaccaatggagtcatccacatcatcaacaaggtgctggtgccccagaggcggctgaccggcagcctgcccaacctgctgatgaggctggagcagatgccagactacagcatcttccggggctacatcatccagtacaacctggccaatgccatcgaggccgcagatgcctacacagtgtttgcccccaacaacaatgccatcgagaactacatccgggagaagaaggtgctgagcctggaggaggatgtgctgcgctaccacgtggtgctggaggagaagctgctgaagaatgacctgcacaacggcatgcaccgggagaccatgctgggcttctcctacttcctgtccttcttcctgcacaatgaccagctgtatgtgaatgaggcccccatcaactacaccaacgtggccacagacaagggcgtcatccacggcctgggcaaggtgctggagatccagaagaacagatgtgacaacaatgacaccaccatcatccggggccgctgcaggacctgcagcagcgagctgacctgccccttcggcaccaagagcctgggcaatgagaagaggcgctgcatctacaccagctacttcatgggccgccgcaccctcttcatcggctgccagcccaagtgtgtgaggacagtcatcacccgggagtgctgtgccggcttcttcggcccccagtgccagccctgccctggaaatgcccagaatgtgtgctttggaaatggcatctgcctggatggagtgaatggaactggagtgtgtgaatgtggggagggcttctctggaacagcctgtgagacctgcacagagggcaagtatggcatccactgtgaccaggcctgcagctgtgtgcacggccgctgcaaccagggccccctgggagatggcagctgtgactgtgatgtgggctggaggggcgtgcactgtgacaatgccaccacagaggacaactgcaatggcacctgccacaccagcgccaactgcctgaccaacagtgatggaacagccagctgcaagtgtgccgccggcttccagggcaatggcaccatctgcacagccatcaatgcctgtgagatcagcaatggaggctgcagcgccaaggctgactgcaagaggaccaccccaggaagaagagtgtgcacctgcaaggccggctacacaggagatggcatcgtgtgcctggagatcaacccctgcctggagaaccacggcggctgtgacaagaatgcagaatgtacccagacaggccccaaccaggccgcctgcaactgcctgcctgcctacacaggagatggcaaggtgtgcaccctcatcaacgtgtgcctgaccaagaatggaggctgcagcgagtttgccatctgcaaccacacaggccaggtggagaggacctgcacctgcaagcccaactacatcggagatggcttcacctgccggggcagcatctaccaggagctgcccaagaaccccaagaccagccagtacttcttccagctgcaggagcactttgtgaaggacctggtgggccctggccccttcaccgtgtttgcccccctgtctgctgcctttgatgaggaggcccgggtgaaggactgggacaagtatggcctgatgccccaggtgctgcgctaccacgtggtggcctgccaccagctgctgctggagaacctgaagctgatcagcaatgccaccagcctgcagggcgagcccatcgtcatctctgtgtcccagagcacagtgtacatcaacaacaaggccaagatcatcagcagtgacatcatcagcaccaacggcatcgtgcacatcatcgacaagctgctgagccccaagaacctgctgatcacccccaaggacaacagcggccgcatcctgcagaacctgaccaccctggccaccaacaacggctacatcaagttcagcaacctgatccaggacagcggcctgctgagcgtcatcacagaccccatccacacccctgtgaccctcttctggcccacagaccaggccctgcacgccctgcctgctgagcagcaggacttcctgttcaaccaggacaacaaggacaagctgaaggagtacctgaagttccacgtgatcagagatgccaaggtgctggccgtggacctgcccaccagcacagcctggaagaccctgcagggcagcgagctgtctgtgaagtgtggggccggccgggacatcggggacctcttcctgaatggccagacctgccgcatcgtgcagcgggagctgctgtttgacctgggcgtggcctatggaattgactgcctgctgattgaccccaccctgggcggccgctgtgacaccttcaccacctttgatgccagcggagaatgtggcagctgtgtgaacacccccagctgcccccgctggagcaagcccaagggcgtgaagcagaagtgcctgtacaacctgcccttcaagaggaacctggagggctgccgggagcgctgcagcctggtgatccagatcccccgctgctgcaagggctacttcggccgggactgccaggcctgccctgggggcccagatgccccctgcaacaacagaggagtgtgcctggaccagtacagcgccactggagagtgcaagtgcaacacaggcttcaatggaacagcctgtgagatgtgctggccaggccgctttggaccagactgcctgccctgtggctgcagcgaccacggccagtgtgatgatggcatcactggaagtggccagtgcctgtgtgagaccggctggacaggccccagctgtgacacccaggccgtgctgcctgctgtgtgcaccccaccctgcagcgcccacgccacctgcaaggagaacaacacctgtgagtgcaacctggactatgaaggagatggcatcacctgcaccgtggtggacttctgcaagcaggacaatggaggctgtgccaaggtggcccgctgcagccagaagggcaccaaggtgtcctgcagctgccagaagggctacaagggagatggccacagctgcacagaaattgacccctgtgctgatggcctgaatggaggctgccacgagcacgccacctgcaagatgacaggccctgggaagcacaagtgtgagtgcaagagccactacgtgggagatggcctgaactgtgagcctgagcagctgcccatcgaccgctgcctgcaggacaatggccagtgccacgcagatgccaagtgtgtggacctgcacttccaggacaccaccgtgggcgtcttccacctgcggagccccctgggccagtacaagctgacctttgacaaggcccgggaggcctgtgccaatgaggccgccaccatggccacctacaaccagctgtcctatgcccagaaggccaagtaccacctgtgcagcgctggctggctggagaccggccgggtggcctaccccacagcctttgccagccagaactgtggcagcggcgtggtgggcatcgtggactatggcccccggcccaacaagtctgagatgtgggatgtgttctgctacaggatgaaggatgtgaactgcacctgcaaggtgggctacgtgggagatggcttcagctgcagcggcaacctgctgcaggtgctgatgtccttccccagcctgaccaacttcctgacagaggtgctggcctacagcaacagcagcgcccggggccgggccttcctggagcacctgacagacctgagcatccggggcaccctgtttgtgccccagaacagcggcctgggagaaaatgagaccctgagcggccgggacatcgagcaccacctggccaacgtgtccatgttcttctacaatgacctggtgaatggcaccaccctgcagacccggctgggcagcaagctgctgatcacagccagccaggaccccctgcagcccacagagaccaggtttgtggatggccgggccatcctgcagtgggacatctttgccagcaatggcatcatccacgtgatcagccggcccctgaaggcccccccagcccctgtgaccctgacccacacaggcctgggcgccggcatcttctttgccatcatcctggtgactggagctgtggccctggccgcctacagctacttccgcatcaacagaaggaccatcggcttccagcactttgaaagtgaggaggacatcaacgtggccgccctgggcaagcagcagcctgagaacatcagcaaccccctgtatgagagcaccaccagcgcccctcctgagcccagctatgaccccttcacagattctgaggagcggcagctggagggcaatgaccccctgcggaccctgtag

SEQ ID NO: 38590 - DNA, 1077 bp, Artificial Sequence
  Description of Artificial Sequence: Synthetic coding sequence
atgggcgctgtgtggagcgccctgctggtgggcggcggcctggccggggccctgtttgtgtggctgctgcggggcggccctggggacaccgggaaggatggagatgctgagcaggagaaggatgcccccctgggcggggccgccatccctgggggccaccagagcggcagcagcggcctgagccctggccccagcggccaggagctggtgaccaagccagagcacctgcaggagagcaatggccacctgatcagcaagaccaaggacctgggcaagctgcaggccgcctcctggaggctgcagaaccccagccgggaggtgtgtgacaacagccgggagcacgtgcccagcggccagttcccagacacagaggccccagccaccagcgagaccagcaacagccgcagctacagcgaggtgtccagaaatgaaagcctggagagccccatgggagagtggggcttccagaagggccaggagatcagcgccaaggccgccacctgctttgctgagaagctgcccagcagcaacctgctgaagaacagagccaaggaggagatgagcctgagtgacctgaacagccaggacagagtggaccacgaggagtgggagatggtgcccaggcacagctcctggggagatgtgggcgtgggcggcagcctgaaggcccctgtgctgaacctgaaccagggcatggacaatggccgcagcaccctggtggaggcccggggccagcaggtgcacggcaagatggagcgggtggccgtgatgcctgctggcagccagcaggtgtctgtgcgcttccaggtgcactacgtgaccagcacagatgtgcagttcatcgctgtgactggagaccacgagtgcctgggccgctggaacacctacatccccctgcactacaacaaggatggcttctggagccacagcatcttcctgcctgctgacacagtggtggagtggaagtttgtgctggtggagaatggaggagtgacccgctgggaggagtgcagcaaccgcttcctggagaccggccacgaggacaaggtggtgcacgcctggtggggcatccactag

SEQ ID NO: 38591 - DNA, 630 bp, Artificial Sequence
  Description of Artificial Sequence: Synthetic coding sequence
atgggagagtggggcttccagaagggccaggagatcagcgccaaggccgccacctgctttgctgagaagctgcccagcagcaacctgctgaagaacagagccaaggaggagatgagcctgagtgacctgaacagccaggacagagtggaccacgaggagtgggagatggtgcccaggcacagctcctggggagatgtgggcgtgggcggcagcctgaaggcccctgtgctgaacctgaaccagggcatggacaatggccgcagcaccctggtggaggcccggggccagcaggtgcacggcaagatggagcgggtggccgtgatgcctgctggcagccagcaggtgtctgtgcgcttccaggtgcactacgtgaccagcacagatgtgcagttcatcgctgtgactggagaccatgaatgtctgggccgctggaacacctacatccccctgcactacaacaaggatggcttctggagccacagcatcttcctgcctgctgacacagtggtggagtggaagtttgtgctggtggagaatggaggagtgacccgctgggaggagtgcagcaaccgcttcctggagactggacatgaggacaaggtggtgcacgcctggtggggcatccactag

SEQ ID NO: 38592 - DNA, 1113 bp, Artificial Sequence
  Description of Artificial Sequence: Synthetic coding sequence
atgctgccccggcggctgctggccgcctggctggccggcacccggggcggcggcctgctggccctgctggccaaccagtgccgctttgtgacaggcctgcgggtgcggcgggcccagcagatcgcccagctgtatggccgcctgtacagcgagagcagccggcgggtgctgctgggccgcctgtggaggcggctgcacggccggcccggccacgccagcgccctgatggccgccctggccggcgtgtttgtgtgggatgaggagcgcatccaggaggaggagctgcagaggagcatcaatgagatgaagaggctggaggagatgagcaacatgttccagagcagtggagtgcagcaccaccccccagagcccaaggcccagacagagggcaatgaagacagcgagggcaaggagcagcgctgggagatggtgatggacaagaagcacttcaagctgtggaggcggcccatcaccggcacccacctgtaccagtacagagtgtttggcacctacacagatgtgaccccccggcagttcttcaacgtgcagctggacacagagtacaggaagaagtgggatgccctggtgatcaagctggaggtgattgaaagagatgtggtgtctggcagcgaggtgctgcactgggtgacccacttcccctaccccatgtacagccgggactatgtgtatgtgcggcgctacagcgtggaccaggagaacaacatgatggtgctggtgtccagagctgtggagcaccccagcgtgcctgagagccctgagtttgtgcgggtgcgctcctatgagagccagatggtgatccggccccacaagagctttgatgaaaatggatttgactacctgctgacctacagcgacaacccccagaccgtcttcccccgctactgtgtgtcctggatggtgagcagcggcatgccagacttcctggagaagctgcacatggccaccctgaaggccaagaacatggagatcaaggtgaaggactacatcagcgccaagcccctggagatgagcagcgaggccaaggccaccagccagagcagcgagaggaagaatgaaggcagctgtggccctgccagaattgaatatgcctag

SEQ ID NO: 38593 - DNA, 738 bp, Artificial Sequence
  Description of Artificial Sequence: Synthetic coding sequence
atggagagcaggaaggacatcaccaaccaggaggagatctggaagatgaagcccaggaggaacctggaggacaatgactacctgcagacagcccatgctgatgaatttgactgccccagcgagctgcagcacgcccaggagctgttcccccagtggcacctgcccatcaagattgctgctgtgatggccagcctgaccttcctgtacaccctgctgcgggaggtgatccaccccctggccaccagccaccagcagtacttctacaagatccccatcctggtgatcaacaaggtgctgcccatggtgtccatcaccctgctggccctggtgtacctgcccggggtgattgctgccatcgtgcaggtgcacaacggcaccaagtacaagaagttcccccactggctggacaagtggatgctgaccaggaagcagtttggcctgctgagcctcttctttgctgtgctgcacgccatctacaccctgtcctatgccatgaggaggagctaccgctacaagctgctgaactgggcctaccagcaggtgcagcagaacaaggaggatgcctggattgaacatgatgtgtggaggatggagatctacgtgtccctgggcatcgtgggcctggccatcctggccctgctggccgtgaccagcatccccagcgtgtctgacagcctgacctggagggagttccactacatccaggtgcacggccgcatcaacttcctgaccctgtag

SEQ ID NO: 38594 - DNA, 765 bp, Artificial Sequence
  Description of Artificial Sequence: Synthetic coding sequence
atggagagcaggaaggacatcaccaaccaggaggagatctggaagatgaagcccaggaggaacctggaggacaatgactacctgcacgaggacaccggggagacctccatgctgaagaggcctgtgctgctgcacctgcagcagacagcccacgcagatgaatttgactgccccagcgagctgcagcacgcccaggagctgttcccccagtggcacctgcccatcaagattgctgctgtgatggccagcctgaccttcctgtacaccctgctgcgggaggtgatccaccccctggccaccagccaccagcagtacttctacaagatccccatcctggtgatcaacaaggtgctgcccatggtgtccatcaccctgctggccctggtgtacctgcccggggtgattgctgccatcgtgcaggtgcacaacggcaccaagtacaagaagttcccccactggctggacaagtggatgctgaccaggaagcagtttggcctgctgagcctcttctttgctgtgctgcacgccatctacaccctgtcctatgccatgagaagaagctaccgctacaagctgctgaactgggcctaccagcaggtgcagcagaacaaggaggatgcctggattgaacatgatgtgtggaggatggagatctacgtgtccctgggcatcgtgggcctggccatcctggccctgctggccgtgaccagcatccccagcgtgtctgacagcctgacctggagggagttccactacatccagtag

SEQ ID NO: 38595 - DNA, 1029 bp, Artificial Sequence
  Description of Artificial Sequence: Synthetic coding sequence
atggagagcaggaaggacatcaccaaccaggaggagatctggaagatgaagcccaggaggaacctggaggacaatgactacctgcacgaggacaccggggagacctccatgctgaagaggcctgtgctgctgcacctgcagcagacagcccacgcagatgaatttgactgccccagcgagctgcagcacgcccaggagctgttcccccagtggcacctgcccatcaagattgctgctgtgatggccagcctgaccttcctgtacaccctgctgcgggaggtgatccaccccctggccaccagccaccagcagtacttctacaagatccccatcctggtgatcaacaaggtgctgcccatggtgtccatcaccctgctggccctggtgtacctgcccggggtgattgctgccatcgtgcaggtgcacaacggcaccaagtacaagaagttcccccactggctggacaagtggatgctgaccaggaagcagtttggcctgctgagcctcttctttgctgtgctgcacgccatctacaccctgtcctatgccatgagaagaagctaccgctacaagctgctgaactgggcctaccagcaggtgcagcagaacaaggaggatgcctggattgaacatgatgtgtggaggatggagatctacgtgtccctgggcatcgtgggcctggccatcctggccctgctggccgtgaccagcatccccagcgtgtctgacagcctgacctggagggagttccactacatccaggccatcctgaccggcagcctggtggccctgtgcaacttccaggccaccaagctggccaagacccagctggtgggcacccccaacttctggcaggagcagcagtgtggcatccacttccccccacccagcaagaccaggagctacatctacttcatcctgtctgctgccagccccagcaaaggaaatgtgagcagccacatgttccagctgcacctggagaacctgaacaagaaggacaagctgctgctgatcatcttccagatctag

SEQ ID NO: 38596 - DNA, 771 bp, Artificial Sequence
  Description of Artificial Sequence: Synthetic coding sequence
atgcctggccctgccacagatgctgggaagatccccttctgtgatgccaaggaggagatccgggccggcctggagagcagcgagggcggcggcggccctgagaggcctggggcccggggccagaggcagaacatcgtgtggagaaatgtggtgctgatgagcctgctgcacctgggcgctgtgtacagcctggtgctgatccccaaggccaagcccctgaccctgctgtgggcctacttctgcttcctgctggccgccctgggcgtgacagctggggcccaccggctgtggagccacaggagctaccgggccaagctgcccctgcgcatcttcctggccgtggccaacagcatggccttccagaatgacatctttgagtggagccgggaccaccgggcccaccacaagtacagcgagacagatgctgacccccacaatgcccggcggggcttcttcttcagccacatcggctggctgtttgtgaggaagcacagagatgtgattgagaagggcaggaagctggatgtgacagacctgctggccgaccctgtggtgcgcatccagaggaacacccagcacatccagaaggagggccgggccctgaaccaggaggccgcctgtgagatgctgcgggagtggcaccagggccacatcctgaaggtgaccctgcccggcctgcacatcctggccctgctgcacacccactgcaaccacagcgagaagtgctgcctgatgctgcgggccctgtctgtgtccctggaggtgttctag

SEQ ID NO: 38597 - DNA, 399 bp, Artificial Sequence
  Description of Artificial Sequence: Synthetic coding sequence
atgcctggccctgccacagatgctgggaagatccccttctgtgatgccaaggaggagatccgggccggcctggagagcagcgagggcggcggcggccctgagaggcctggggcccggggccagaggcagaacatcgtgtggagaaatgtggtgctgatgagcctgctgcacctgggcgctgtgtacagcctggtgctgatccccaaggccaagcccctgaccctgctgtgggcctacttctgcttcctgctggccgccctgggcgtgacagctggggcccaccggctgtggagccacaggagctaccgggccaagctgcccctgcgcatcttcctggccgtggccaacagcatggccttccaggccgctgctgaggtggtgctgacccagatgccctag

SEQ ID NO: 38598 - DNA, 993 bp, Artificial Sequence
  Description of Artificial Sequence: Synthetic coding sequence
atgcctggccctgccacagatgctgggaagatccccttctgtgatgccaaggaggagatccgggccggcctggagagcagcgagggcggcggcggccctgagaggcctggggcccggggccagaggcagaacatcgtgtggagaaatgtggtgctgatgagcctgctgcacctgggcgctgtgtacagcctggtgctgatccccaaggccaagcccctgaccctgctgtgggcctacttctgcttcctgctggccgccctgggcgtgacagctggggcccaccggctgtggagccacaggagctaccgggccaagctgcccctgcgcatcttcctggccgtggccaacagcatggccttccagaatgacatctttgagtggagccgggaccaccgggcccaccacaagtacagcgagacagatgctgacccccacaatgcccggcggggcttcttcttcagccacatcggctggctgtttgtgaggaagcacagagatgtgattgagaagggcaggaagctggatgtgacagacctgctggccgaccctgtggtgcgcatccagaggaagtactacaagatctctgtggtgctgatgtgctttgtggtgcccaccctggtgccctggtacatctggggcgagagcctgtggaacagctacttcctggccagcatcctgcgctacaccatcagcctgaacatctcctggctggtgaacagcgctgcccacatgtatggcaaccggccctatgacaagcacatcagcccccggcagaaccccctggtggccctgggcgccatcggggagggcttccacaactaccaccacaccttcccctttgactacagcgccagcgagtttggcctgaacttcaaccccaccacctggttcatcgacttcatgtgctggctgggcctggccacagacaggaagagggccaccaagcccatgattgaggccaggaaggccaggactggagacagcagcgcctag

SEQ ID NO: 38599 - DNA, 867 bp, Artificial Sequence
  Description of Artificial Sequence: Synthetic coding sequence
atggccgagaagaggcacacccgggacagcgaggcccagaggctgcctgacagcttcaaggacagccccagcaagggcctgggcccctgtggctggatcctggtggccttctccttcctgttcaccgtcatcaccttccccatcagcatctggatgtgcatcaagatcatcaaggagtatgaaagagccatcatcttccggctgggccgcatcctgcagggcggggccaagggccctggcctcttcttcatcctgccctgcacagacagcttcatcaaggtggacatgaggaccatcagctttgacatccccccccaggagatcctgaccaaggacagcgtgaccatctctgtggatggagtggtgtactacagagtgcagaatgccaccctggccgtggccaacatcaccaatgctgacagcgccacccggctgctggcccagaccaccctgagaaatgtgctgggcaccaagaacctgagccagatcctgagtgaccgggaggagatcgcccacaacatgcagagcaccctggatgatgccacagatgcctggggcatcaaggtggagcgggtggagatcaaggatgtgaagctgcctgtgcagctgcagagggccatggctgctgaggccgaggccagccgggaggcccgggccaaggtgattgctgctgagggggagatgaatgccagccgggccctgaaggaggcctccatggtgatcacagagagccctgctgccctgcagctgcgctacctgcagaccctgaccaccatcgctgctgagaagaacagcaccatcgtgttccccctgcccatcgacatgctgcagggcatcatcggggccaagcacagccacctgggctag

SEQ ID NO: 38600 - DNA, 372 bp, Artificial Sequence
  Description of Artificial Sequence: Synthetic coding sequence
atggccgagaagaggcacacccgggacagcgaggcccagaggctgcctgacagcttcaaggacagccccagcaagggcctgggcccctgtggctggatcctggtggccttctccttcctgttcaccgtcatcaccttccccatcagcatctggatgtgcatcaaggtgattgctgctgagggggagatgaatgccagccgggccctgaaggaggcctccatggtgatcacagagagccctgctgccctgcagctgcgctacctgcagaccctgaccaccatcgctgctgagaagaacagcaccatcgtgttccccctgcccatcgacatgctgcagggcatcattggagccaagcacagccacctgggctag

SEQ ID NO: 38601 - DNA, 714 bp, Artificial Sequence
  Description of Artificial Sequence: Synthetic coding sequence
atgtgcatcaagatcatcaaggagtatgagcgggccatcatcttccggctgggccgcatcctgcagggcggggccaagggccctggcctcttcttcatcctgccctgcacagacagcttcatcaaggtggacatgaggaccatcagctttgacatccccccccaggagatcctgaccaaggacagcgtgaccatctctgtggatggagtggtgtactacagagtgcagaatgccaccctggccgtggccaacatcaccaatgctgacagcgccacccggctgctggcccagaccaccctgagaaatgtgctgggcaccaagaacctgagccagatcctgagtgaccgggaggagatcgcccacaacatgcagagcaccctggatgatgccacagatgcctggggcatcaaggtggagcgggtggagatcaaggatgtgaagctgcctgtgcagctgcagagggccatggctgctgaggccgaggccagccgggaggcccgggccaaggtgattgctgctgagggggagatgaatgccagccgggccctgaaggaggcctccatggtgatcacagagagccctgctgccctgcagctgcgctacctgcagaccctgaccaccatcgctgctgagaagaacagcaccatcgtgttccccctgcccatcgacatgctgcagggcatcattggagccaagcacagccacctgggctag

SEQ ID NO: 38602 - DNA, 3549 bp, Artificial Sequence
  Description of Artificial Sequence: Synthetic coding sequence
atgtgcagcaccaaccctgggaagtgggtgacctttgatgatgatcctgctgtgcagagcagccagaagagcaagaacttccccctggagaaccagggcgtgtgccggcccaacggcctgaagctgaacctgcccggcctgcgggagttccccagcggcagcagcagcaccagcagcacccccctgagcagccccatcgtggacttctacttcagccctggcccccccagcaacagccccctgagcacccccaccaaggacttccctggcttccctggcatccccaaggccggcacccacgtgctgtaccccatccctgagagcagcagtgacagccccctggccatctctggaggagagagcagcctgctgcccacccggcccacctgcctgagccacgccctgctgcccagcgaccacagctgcacccaccccacccccaaggtgggcctgcctgatgaggtgaacccccagcaggccgagagcctgggcttccagagtgatgacctgccccagttccagtacttccgggaggactgtgccttcagcagccccttctggaaggatgagggcagtgacagccacttcaccctggaccccccaggcagcaagaagatgttcagcagcaggaacaaggagatgcccatcgaccagaagagcctgaacaagtgcagcctgaactacatctgtgagaagctggagcacctgcagagcgctgagaaccaggacagcctgcggagcctgtccatgcactgcctgtgtgccgaggagaatgccagcagctttgtgccccacaccctcttccgcagccagcccaagagcggctggagcttcatgctgcgcatccctgagaagaagaacatgatgagcagccggcagtggggccccatcttcctgaaggtgctgcccggcggcatcctgcagatgtactatgagcagggcctggagaagcccttcaaggagatccagctggacccctactgccgcctgtctgagcccaaggtggagaacttctctgtggccggcaagatccacacagtgaagattgaacatgtgtcctacacagagaagaggaagtaccacagcaagacagaggtggtgcatgagccagacatcgagcagatgctgaagctgggcagcaccagctaccatgacttcctggacttcctgaccaccgtggaggaggagctgatgaagctgcctgctgtgtccaagcccaagaagaactatgaggagcaggagatcagcctggagatcgtggacaacttctggggcaaggtgaccaaggagggcaagtttgtggagagcgctgtgatcacccagatctactgcctgtgctttgtgaatggaaacctggagtgcttcctgaccctgaatgacctggagctgcccaagagagatgagagctactatgagaaggacagcgagaagaagggcatcgacatcctggactaccacttccacaagtgtgtgaatgtgcaggagtttgagcagagccgcatcatcaagtttgtgcccctggatgcctgccgctttgagctgatgaggttcaagaccctgtacaacggggacaacctgcccttcagcctgaagtctgtggtggtggtgcagggcgcctacgtggagctgcaggcctttgtgaacatggccagcctggcccagaggagcagctatgccggcagcctgcggagctgtgacaacatccgcatccacttccctgtgcccagccagtggatcaaggccctgtggaccatgaacctgcagaggcagaagagcctgaaggccaagatgaacagaagagcctgcctgggcagcctgcaggagctggagagcgagcctgtgatccaggtgacagtgggcagcgccaagtatgagagcgcctaccaggccgtggtgtggaagattgaccggctgcctgacaagaacagcagcctggaccacccccactgcctgagctacaagctggagctgggcagtgaccaggagatccccagcgactggtacccctttgccaccgtgcagttctctgtgcctgacacctgtgccagcaggacagaggtgcgcagcctgggcgtggagagtgatgtgcagccccagaagcacgtgcagcagagggcctgctacaacatccagcccaagctgtacagatctgtgattgaagatgtgattgaaggagtgaggaacctgtttgctgaggagggcatcgaggagcaggtgctgaaggacctgaagcagctgtgggagaccaaggtgctgcagagcaaggccacagaggacttcttcaggaacagcatccagagccccctcttcaccctgcagctgccccacagcctgcaccagaccctgcagagcagcacagccagcctggtgatcccagctggccgcaccctgcccagcttcaccacagctgagctgggcaccagcaacagcagcgccaacttcaccttccctggctaccccatccacgtgcctgctggggtgaccctgcagacagtgtctggccacctgtacaaggtgaatgtgcccatcatggtgacagagaccagcggccgggccggcatcctgcagcaccccatccagcaggtgttccagcagctgggccagcccagcgtcatccagacctctgtgccccagctgaacccctggagcctgcaggccaccacagagaagagccagagaattgagaccgtgctgcagcagcctgccatcctgcccagcggccctgtggacaggaagcacctggagaatgccaccagtgacatcctggtgtccccaggaaatgagcacaagatcgtgcctgaggccctgctgtgccaccaggagagcagccactacatcagcctgcccggggtggtgttcagcccccaggtgtcccagaccaacagcaatgtggagagcgtgctgagcggcagcgcctccatggcccagaacctgcatgatgagagcctgagcaccagcccccacggggccctgcaccagcacgtgacagacatccagctgcacatcctgaagaacaggatgtatggctgtgacagcgtgaagcagcccagaaatattgaggagcccagcaacatccctgtgtctgagaaggacagcaacagccaggtggacctgagcatccgggtgacagatgatgacattggagagatcatccaggtggatggcagcggggacaccagcagcaatgaggagatcggcagcaccagagatgctgatgaaaatgagttcctgggcaacattgatggaggagacctgaaggtgcctgaggaggaggccgacagcatcagcaatgaagacagcgccaccaacagcagtgacaatgaagacccccaggtgaacatcgtggaggaggaccccctgaacagcggagatgatgtgtctgagcaggatgtgcctgacctgtttgacacagacaacgtgattgtgtgccagtatgacaagatccacaggagcaagaacaagtggaagttctacctgaaggatggagtgatgtgcttcggcggccgggactatgtgtttgccaaggccatcggagatgctgagtggtag

SEQ ID NO: 38603 - DNA, 1434 bp, Artificial Sequence
  Description of Artificial Sequence: Synthetic coding sequence
gcctgcctcttcctgatccccaagctgtacagatctgtgattgaagatgtgattgagggcgtgaggaacctgtttgctgaggagggcatcgaggagcaggtgctgaaggacctgaagcagctgtgggagaccaaggtgctgcagagcaaggccacagaggacttcttcagaaattccatccagagccccctcttcaccctgcagctgccccacagcctgcaccagaccctgcagagcagcacagccagcctggtgatcccagctggccgcaccctgcccagcttcaccacagctgagctgggcaccagcaacagcagcgccaacttcaccttccctggctaccccatccacgtgcctgctggggtgaccctgcagacagtgtctggccacctgtacaaggtgaatgtgcccatcatggtgacagagaccagcggccgggccggcatcctgcagcaccccatccagcaggtgttccagcagctgggccagcccagcgtcatccagacctctgtgccccagctgaacccctggagcctgcaggccaccacagagaagagccagagaattgaaacagtgctgcagcagcctgccatcctgcccagcggccctgtggacaggaagcacctggagaatgccaccagtgacatcctggtgtccccaggaaatgagcacaagatcgtgcctgaggccctgctgtgccaccaggagagcagccactacatcagcctgcccggggtggtgttcagcccccaggtgtcccagaccaacagcaatgtggagagcgtgctgagcggcagcgcctccatggcccagaacctgcatgatgagagcctgagcaccagcccccatggagccctgcaccagcacgtgacagacatccagctgcacatcctgaagaacaggatgtatggctgtgacagcgtgaagcagcccaggaacatcgaggagcccagcaacatccctgtgtctgagaaggacagcaacagccaggtggacctgagcatccgggtgacagatgatgacatcggggagatcatccaggtggatggcagcggggacaccagcagcaatgaggagatcggcagcaccagagatgctgatgaaaatgagttcctgggcaacattgatggaggagacctgaaggtgcctgaggaggaggccgacagcatcagcaatgaagattctgccaccaacagcagtgacaatgaagacccccaggtgaacatcgtggaggaggaccccctgaacagcggagatgatgtgtctgagcaggatgtgcctgacctgtttgacacagacaacgtcatcgtgtgccagtatgacaagatccacaggagcaagaacaagtggaagttctacctgaaggatggagtgatgtgctttggaggccgggactatgtgtttgccaaggccatcggagatgctgagtggtag

SEQ ID NO: 38604 - DNA, 3408 bp, Artificial Sequence
  Description of Artificial Sequence: Synthetic coding sequence
atgtgcagcaccaaccctgggaagtgggtgacctttgatgatgatcctgctgtgcagagcagccagaagagcaagaacttccccctggagaaccagggcgtgtgccggcccaacggcctgaagctgaacctgcccggcctgcgggagttccccagcggcagcagcagcaccagcagcacccccctgagcagccccatcgtggacttctacttcagccctggcccccccagcaacagccccctgagcacccccaccaaggacttccctggcttccctggcatccccaaggccggcacccacgtgctgtaccccatccctgagagcagcagtgacagccccctggccatctctggaggagagagcagcctgctgcccacccggcccacctgcctgagccacgccctgctgcccagcgaccacagctgcacccaccccacccccaaggtgggcctgcctgatgaggtgaacccccagcaggccgagagcctgggcttccagagtgatgacctgccccagttccagtacttccgggaggactgtgccttcagcagccccttctggaaggatgagggcagtgacagccacttcaccctggaccccccaggcagcaagaagatgttcagcagcaggaacaaggagatgcccatcgaccagaagagcctgaacaagtgcagcctgaactacatctgtgagaagctggagcacctgcagagcgctgagaaccaggacagcctgcggagcctgtccatgcactgcctgtgtgccgaggagaatgccagcagctttgtgccccacaccctcttccgcagccagcccaagagcggctggagcttcatgctgcgcatccctgagaagaagaacatgatgagcagccggcagtggggccccatcttcctgaaggtgctgcccggcggcatcctgcagatgtactatgagcagggcctggagaagcccttcaaggagatccagctggacccctactgccgcctgtctgagcccaaggtggagaacttctctgtggccggcaagatccacacagtgaagattgaacatgtgtcctacacagagaagaggaagtaccacagcaagacagaggtggtgcatgagccagacatcgagcagatgctgaagctgggcagcaccagctaccatgacttcctggacttcctgaccaccgtggaggaggagctgatgaagctgcctgctgtgtccaagcccaagaagaactatgaggagcaggagatcagcctggagatcgtggacaacttctggggcaaggtgaccaaggagggcaagtttgtggagagcgctgtgatcacccagatctactgcctgtgctttgtgaatggaaacctggagtgcttcctgaccctgaatgacctggagctgcccaagagagatgagagctactatgagaaggacagcgagaagaagggcatcgacatcctggactaccacttccacaagtgtgtgaatgtgcaggagtttgagcagagccgcatcatcaagtttgtgcccctggatgcctgccgctttgagctgatgaggttcaagaccctgtacaacggggacaacctgcccttcagcctgaagtctgtggtggtggtgcagggcgcctacgtggagctgcaggcctttgtgaacatggccagcctggcccagaggagcagctatgccggcagcctgcggagctgtgacaacatccgcatccacttccctgtgcccagccagtggatcaaggccctgtggaccatgaacctgcagaggcagaagagcctgaaggccaagatgaacagaagagcctgcctgggcagcctgcaggagctggagagcgagcctgtgatccaggtgacagtgggcagcgccaagtatgagagcgcctaccaggccgtggtgtggaagattgaccggctgcctgacaagaacagcagcctggaccacccccactgcctgagctacaagctggagctgggcagtgaccaggagatccccagcgactggtacccctttgccaccgtgcagttctctgtgcctgacacctgtgccagcaggacagaggtgcgcagcctgggcgtggagagtgatgtgcagccccagaagcacgtgcagcagagggcctgctacaacatccagcccaagctgtacagatctgtgattgaagatgtgattgaaggagtgaggaacctgtttgctgaggagggcatcgaggagcaggtgctgaaggacctgaagcagctgtgggagaccaaggtgctgcagagcaaggccacagaggacttcttcaggaacagcatccagagccccctcttcaccctgcagctgccccacagcctgcaccagaccctgcagagcagcacaggccacctgtacaaggtgaatgtgcccatcatggtgacagagaccagcggccgggccggcatcctgcagcaccccatccagcaggtgttccagcagctgggccagcccagcgtcatccagacctctgtgccccagctgaacccctggagcctgcaggccaccacagagaagagccagagaattgaaacagtgctgcagcagcctgccatcctgcccagcggccctgtggacaggaagcacctggagaatgccaccagtgacatcctggtgtccccaggaaatgagcacaagatcgtgcctgaggccctgctgtgccaccaggagagcagccactacatcagcctgcccggggtggtgttcagcccccaggtgtcccagaccaacagcaatgtggagagcgtgctgagcggcagcgcctccatggcccagaacctgcatgatgagagcctgagcaccagcccccatggagccctgcaccagcacgtgacagacatccagctgcacatcctgaagaacaggatgtatggctgtgacagcgtgaagcagcccaggaacatcgaggagcccagcaacatccctgtgtctgagaaggacagcaacagccaggtggacctgagcatccgggtgacagatgatgacatcggggagatcatccaggtggatggcagcggggacaccagcagcaatgaggagatcggcagcaccagagatgctgatgaaaatgagttcctgggcaacattgatggaggagacctgaaggtgcctgaggaggaggccgacagcatcagcaatgaagattctgccaccaacagcagtgacaatgaagacccccaggtgaacatcgtggaggaggaccccctgaacagcggagatgatgtgtctgagcaggatgtgcctgacctgtttgacacagacaacgtcatcgtgtgccagtatgacaagatccacaggagcaagaacaagtggaagttctacctgaaggatggagtgatgtgctttggaggccgggactatgtgtttgccaaggccatcggagatgctgagtggtag

SEQ ID NO: 38605 - DNA, 3549 bp, Artificial Sequence; identical to SEQ ID NO: 38602
  Description of Artificial Sequence: Synthetic coding sequence

SEQ ID NO: 38606 - DNA, 3549 bp, Artificial Sequence; identical to SEQ ID NO: 38602
  Description of Artificial Sequence: Synthetic coding sequence

SEQ ID NO: 38607 - DNA, 3477 bp, Artificial Sequence
  Description of Artificial Sequence: Synthetic coding sequence
atgtgcagcaccaaccctgggaagtgggtgacctttgatgatgatcctgctgtgcagagcagccagaagagcaagaacttccccctggagaaccagggcgtgtgccggcccaacggcctgaagctgaacctgcccggcctgcgggagttccccagcggcagcagcagcaccagcagcacccccctgagcagccccatcgtggacttctacttcagccctggcccccccagcaacagccccctgagcacccccaccaaggacttccctggcttccctggcatccccaaggccggcacccacgtgctgtaccccatccctgagagcagcagtgacagccccctggccatctctggaggagagagcagcctgctgcccacccggcccacctgcctgagccacgccctgctgcccagcgaccacagctgcacccaccccacccccaaggtgggcctgcctgatgaggtgaacccccagcaggccgagagcctgggcttccagagtgatgacctgccccagttccagtacttccgggaggactgtgccttcagcagccccttctggaaggatgagggcagtgacagccacttcaccctggaccccccaggcagcaagaagatgttcagcagcaggaacaaggagatgcccatcgaccagaagagcctgaacaagtgcagcctgaactacatctgtgagaagctggagcacctgcagagcgctgagaaccaggacagcctgcggagcctgtccatgcactgcctgtgtgccgaggagaatgccagcagctttgtgccccacaccctcttccgcagccagcccaagagcggctggagcttcatgctgcgcatccctgagaagaagaacatgatgagcagccggcagtggggccccatcttcctgaaggtgctgcccggcggcatcctgcagatgtactatgagcagggcctggagaagcccttcaaggagatccagctggacccctactgccgcctgtctgagcccaaggtggagaacttctctgtggccggcaagatccacacagtgaagattgaacatgtgtcctacacagagaagaggaagtaccacagcaagacagaggtggtgcatgagccagacatcgagcagatgctgaagctgggcagcaccagctaccatgacttcctggacttcctgaccaccgtggaggaggagctgatgaagctgcctgctgtgtccaagcccaagaagaactatgaggagcaggagatcagcctggagatcgtggacaacttctggggcaaggtgaccaaggagggcaagtttgtggagagcgctgtgatcacccagatctactgcctgtgctttgtgaatggaaacctggagtgcttcctgaccctgaatgacctggagctgcccaagagagatgagagctactatgagaaggacagcgagaagaagggcatcgacatcctggactaccacttccacaagtgtgtgaatgtgcaggagtttgagcagagccgcatcatcaagtttgtgcccctggatgcctgccgctttgagctgatgaggttcaagaccctgtacaacggggacaacctgcccttcagcctgaagtctgtggtggtggtgcagggcgcctacgtggagctgcaggcctttgtgaacatggccagcctggcccagaggagcagctatgccggcagcctgcggagctgtgacaacatccgcatccacttccctgtgcccagccagtggatcaaggccctgtggaccatgaacctgcagaggcagaagagcctgaaggccaagatgaacagaagagcctgcctgggcagcctgcaggagctggagagcgagcctgtgatccaggtgacagtgggcagcgccaagtatgagagcgcctaccaggccgtggtgtggaagattgaccggctgcctgacaagaacagcagcctggaccacccccactgcctgagctacaagctggagctgggcagtgaccaggagatccccagcgactggtacccctttgccaccgtgcagttctctgtgcctgacacctgtgccagcaggacagaggtgcgcagcctgggcgtggagagtgatgtgcagccccagaagcacgtgcagcagagggcctgctacaacatccagcccaagctgtacagatctgtgattgaagatgtgattgaaggagtgaggaacctgtttgctgaggagggcatcgaggagcaggtgctgaaggacctgaagcagctgtgggagaccaaggtgctgcagagcaaggccacagaggacttcttcaggaacagcatccagagccccctcttcaccctgcagctgccccacagcctgcaccagaccctgcagagcagcacagccagcctggtgatcccagctggccgcaccctgcccagcttcaccacagctgagctgggcaccagcaacagcagcgccaacttcaccttccctggctaccccatccacgtgcctgctggggtgaccctgcagacagtgtctggccacctgtacaaggtgaatgtgcccatcatggtgacagagaccagcggccgggccggcatcctgcagcaccccatccagcaggtgttccagcagctgggccagcccagcgtcatccagacctctgtgccccagctgaacccctggagcctgcaggccaccacagagaagagccagagaattgagaccgtgctgcagcagcctgccatcctgcccagcggccctgtggacaggaagcacctggagaatgccaccagtgacatcctggtgtccccaggaaatgagcacaagatcgtgcctgaggccctgctgtgccaccaggagagcagccactacatcagcctgcccggggtggtgttcagcccccaggtgtcccagaccaacagcaatgtggagagcgtgctgagcggcagcgcctccatggcccagaacctgcatgatgagagcctgagcaccagcccccacggggccctgcaccagcacgtgacagacatccagctgcacatcctgaagaacaggatgtatggctgtgacagcgtgaagcagcccagaaatattgaggagcccagcaacatccctgtgtctgagaaggacagcaacagccaggtggacctgagcatccgggtgacagatgatgacattggagagatcatccaggtggatggcagcggggacaccagcagcaatgaggagatcggcagcaccagagatgctgatgaaaatgagttcctgggcaacattgatggaggagacctgaaggtgcctgaggaggaggccgacagcatcagcaatgaagacagcgccaccaacagcagtgacaatgaagacccccaggtgaacatcgtggaggaggaccccctgaacagcggagatgatgtgtctgagcaggatgtgcctgacctgtttgacacagacaacgtgattgtgtgccagtatgacaagcagggcgacaccagggtgagacatggccagcagtag

SEQ ID NO: 38608 - DNA, 2208 bp, Artificial Sequence
  Description of Artificial Sequence: Synthetic coding sequence
atgtgcagcaccaaccctgggaagtgggtgacctttgatgatgatcctgctgtgcagagcagccagaagagcaagaacttccccctggagaaccagggcgtgtgccggcccaacggcctgaagctgaacctgcccggcctgcgggagttccccagcggcagcagcagcaccagcagcacccccctgagcagccccatcgtggacttctacttcagccctggcccccccagcaacagccccctgagcacccccaccaaggacttccctggcttccctggcatccccaaggccggcacccacgtgctgtaccccatccctgagagcagcagtgacagccccctggccatctctggaggagagagcagcctgctgcccacccggcccacctgcctgagccacgccctgctgcccagcgaccacagctgcacccaccccacccccaaggtgggcctgcctgatgaggtgaacccccagcaggccgagagcctgggcttccagagtgatgacctgccccagttccagtacttccgggaggactgtgccttcagcagccccttctggaaggatgagggcagtgacagccacttcaccctggaccccccaggcagcaagaagatgttcagcagcaggaacaaggagatgcccatcgaccagaagagcctgaacaagtgcagcctgaactacatctgtgagaagctggagcacctgcagagcgctgagaaccaggacagcctgcggagcctgtccatgcactgcctgtgtgccgaggagaatgccagcagctttgtgccccacaccctcttccgcagccagcccaagagcggctggagcttcatgctgcgcatccctgagaagaagaacatgatgagcagccggcagtggggccccatcttcctgaaggtgctgcccggcggcatcctgcagatgtactatgagcagggcctggagaagcccttcaaggagatccagctggacccctactgccgcctgtctgagcccaaggtggagaacttctctgtggccggcaagatccacacagtgaagattgaacatgtgtcctacacagagaagaggaagtaccacagcaagacagaggtggtgcatgagccagacatcgagcagatgctgaagctgggcagcaccagctaccatgacttcctggacttcctgaccaccgtggaggaggagctgatgaagctgcctgctgtgtccaagcccaagaagaactatgaggagcaggagatcagcctggagatcgtggacaacttctggggcaaggtgaccaaggagggcaagtttgtggagagcgctgtgatcacccagatctactgcctgtgctttgtgaatggaaacctggagtgcttcctgaccctgaatgacctggagctgcccaagagagatgagagctactatgagaaggacagcgagaagaagggcatcgacatcctggactaccacttccacaagtgtgtgaatgtgcaggagtttgagcagagccgcatcatcaagtttgtgcccctggatgcctgccgctttgagctgatgaggttcaagaccctgtacaacggggacaacctgcccttcagcctgaagtctgtggtggtggtgcagggcgcctacgtggagctgcaggcctttgtgaacatggccagcctggcccagaggagcagctatgccggcagcctgcggagctgtgacaacatccgcatccacttccctgtgcccagccagtggatcaaggccctgtggaccatgaacctgcagaggcagaagagcctgaaggccaagatgaacagaagagcctgcctgggcagcctgcaggagctggagagcgagcctgtgatccaggtgacagtgggcagcgccaagtatgagagcgcctaccaggccgtggtgtggaagattgaccggctgcctgacaagaacagcagcctggaccacccccactgcctgagctacaagctggagctgggcagtgaccaggagatccccagcgactggtacccctttgccaccgtgcagttctctgtgcctgacacctgtgccagcaggacagaggtgcgcagcctgggcgtggagagtgatgtgcagccccagaagcacgtgcagcagagggcctgctacaacatccaggtggagattgagaagaagtggatcaagattgatggagaggaccctgacaagattggagactgcatcacccagtag

SEQ ID NO: 38609 - DNA, 2208 bp, Artificial Sequence; identical to SEQ ID NO: 38608
  Description of Artificial Sequence: Synthetic coding sequence

SEQ ID NO: 38610 - DNA, 2208 bp, Artificial Sequence; identical to SEQ ID NO: 38608
  Description of Artificial Sequence: Synthetic coding sequence

SEQ ID NO: 38611 - DNA, 2718 bp, Artificial Sequence
  Description of Artificial Sequence: Synthetic coding sequence
atgaccaccctggaccacgtgattgccacccaccagagcgagtgggtgtccttcaatgaggagccccccttccctgcccacagccagggcggcacagaggagcacctgcccggcctgagcagcagcccagaccagagcgagagcagcagcggggagaaccacgtggtggatggcggcagccaggaccacagccacagcgagcaggatgacagcagcgagaagatgggcctcatcagcgaggccgccagccccccaggcagccctgagcagcccccaccagacctggccagcgccatcagcaactgggtgcagtttgaagatgacaccccctgggccagcaccagccccccccaccaggagacagctgagacagccctgcccctgaccatgccctgctggacctgccccagctttgacagcctgggccgctgccccctgaccagcgagagctcctggaccacccacagcgaggacaccagcagccccagctttggctgcagctacacagacctgcagctgatcaatgctgaggagcagaccagcggccaggccagcggggctgacagcacagacaacagcagcagcctgcaggaggatgaggaggtggagatggaggccatctcctggcaggccagcagccctgccatgaatggccacccagcccctcctgtgaccagcgcccgcttccccagctgggtgacctttgatgacaatgaggtgtcctgccccctgccccctgtgaccagccccctgaagcccaacaccccacccagcgccagcgtcatcccagatgtgccctacaacagcatgggcagcttcaagaagagggaccggcccaagagcaccctgatgaacttcagcaaggtgcagaagctggacatcagcagcctgaacagaacacccagcgtgacagaggccagcccctggagggccaccaaccccttcctgaatgagaccctgcaggatgtgcagcccagccccatcaaccccttcagcgccttctttgaggagcaggagcggcgcagccagaacagcagcatcagcagcaccaccgggaagagccagagggacagcctcatcgtcatctaccaggatgccatcagctttgatgacagcagcaagacccagagccacagtgatgctgtggagaagctgaagcagctgcagattgatgatcctgaccacttcggcagcgccaccctgcctgatgatgatcctgtggcctggattgagctggatgcccaccccccaggcagcgcccggagccagcccagagatggctggcccatgatgctgcgcatccctgagaagaagaacatcatgagcagccgccactggggccccatctttgtgaagctgacagacaccggctacctgcagctgtactatgagcagggcctggagaagcccttccgggagttcaagctggagatctgccacgagatcagcgagccccggctgcagaactatgatgaaaatggccgcatccacagcctgagaattgacagagtgacctacaaggagaagaagaagtaccagcccaagccagctgtggcccacacagctgagcgggagcaggtgatcaagctgggcaccaccaactatgatgacttcctgtccttcatccatgctgtgcaggaccggctgatggacctgcctgtgctgtccatggacctgagcacagtgggcctgaactacctggaggaggagatcaccgtggatgtgagagatgagttcagcggcatcgtgtccaaaggagacaaccagatcctgcagcaccacgtgctgacccgcatccacatcctgtccttcctgagcggcctggccgagtgccgcctgggcctgaatgacatcctggtgaagggaaatgaaattgtgctgcggcaggacatcatgcccaccaccaccaccaagtggatcaagctgcacgagtgccgcttccacggctgtgtggatgaagatgtgttccacaacagcagggtcatcctcttcaaccccctggatgcctgccgctttgagctgatgaggttcagaacagtgtttgctgagaagaccctgcccttcaccctgaggacagccacctctgtgaatggagctgaggtggaggtgcagagctggctgaggatgagcacaggcttcagcgccaacagagaccccctgacccaggtgccctgtgaaaatgtgatgatccgctaccctgtgcccagcgagtgggtgaagaacttcagaagagagagcgtgctgggggagaagagcctgaaggccaaggtgaacagaggagccagctttggcagcacctctgtgtctggcagcgagcctgtgatgagggtgaccctgggcacagccaagtatgagcacgccttcaacagcatcgtgtggaggatcaaccggctgcctgacaagaacagcgccagcggccacccccactgcttcttctgccacctggagctgggcagtgaccgggaggtgcccagcagatttgccaaccacgtgaatgtggagttctccatgcccaccaccagcgccagcaaggcctctgtgcgcagcatctctgtggaggacaagacagatgtgaggaagtgggtgaactacagcgcccactacagctaccaggtggccctgggcagcatctggctgatgctgcccaccccatttgtgcaccccaccaccctgcccctgctcttcctgctggccatgctgaccatgtttgcctggtag

SEQ ID NO: 38612 - DNA, 2799 bp, Artificial Sequence
  Description of Artificial Sequence: Synthetic coding sequence
ggccagcagtgtgaagatgaccagtgcctcttctccatgaccaccctggaccacgtgattgccacccaccagagcgagtgggtgtccttcaatgaggagccccccttccctgcccacagccagggcggcacagaggagcacctgcccggcctgagcagcagcccagaccagagcgagagcagcagcggggagaaccacgtggtggatggcggcagccaggaccacagccacagcgagcaggatgacagcagcgagaagatgggcctcatcagcgaggccgccagccccccaggcagccctgagcagcccccaccagacctggccagcgccatcagcaactgggtgcagtttgaagatgacaccccctgggccagcaccagccccccccaccaggagacagctgagacagccctgcccctgaccatgccctgctggacctgccccagctttgacagcctgggccgctgccccctgaccagcgagagctcctggaccacccacagcgaggacaccagcagccccagctttggctgcagctacacagacctgcagctgatcaatgctgaggagcagaccagcggccaggccagcggggctgacagcacagacaacagcagcagcctgcaggaggatgaggaggtggagatggaggccatctcctggcaggccagcagccctgccatgaatggccacccagcccctcctgtgaccagcgcccgcttccccagctgggtgacctttgatgacaatgaggtgtcctgccccctgccccctgtgaccagccccctgaagcccaacaccccacccagcgccagcgtcatcccagatgtgccctacaacagcatgggcagcttcaagaagagggaccggcccaagagcaccctgatgaacttcagcaaggtgcagaagctggacatcagcagcctgaacagaacacccagcgtgacagaggccagcccctggagggccaccaaccccttcctgaatgagaccctgcaggatgtgcagcccagccccatcaaccccttcagcgccttctttgaggagcaggagcggcgcagccagaacagcagcatcagcagcaccaccgggaagagccagagggacagcctcatcgtcatctaccaggatgccatcagctttgatgacagcagcaagacccagagccacagtgatgctgtggagaagctgaagcagctgcagattgatgatcctgaccacttcggcagcgccaccctgcctgatgatgatcctgtggcctggattgagctggatgcccaccccccaggcagcgcccggagccagcccagagatggctggcccatgatgctgcgcatccctgagaagaagaacatcatgagcagccgccactggggccccatctttgtgaagctgacagacaccggctacctgcagctgtactatgagcagggcctggagaagcccttccgggagttcaagctggagatctgccacgagatcagcgagccccggctgcagaactatgatgaaaatggccgcatccacagcctgagaattgacagagtgacctacaaggagaagaagaagtaccagcccaagccagctgtggcccacacagctgagcgggagcaggtgatcaagctgggcaccaccaactatgatgacttcctgtccttcatccatgctgtgcaggaccggctgatggacctgcctgtgctgtccatggacctgagcacagtgggcctgaactacctggaggaggagatcaccgtggatgtgagagatgagttcagcggcatcgtgtccaaaggagacaaccagatcctgcagcaccacgtgctgacccgcatccacatcctgtccttcctgagcggcctggccgagtgccgcctgggcctgaatgacatcctggtgaagggaaatgaaattgtgctgcggcaggacatcatgcccaccaccaccaccaagtggatcaagctgcacgagtgccgcttccacggctgtgtggatgaagatgtgttccacaacagcagggtcatcctcttcaaccccctggatgcctgccgctttgagctgatgaggttcagaacagtgtttgctgagaagaccctgcccttcaccctgaggacagccacctctgtgaatggagctgaggtggaggtgcagagctggctgaggatgagcacaggcttcagcgccaacagagaccccctgacccaggtgccctgtgaaaatgtgatgatccgctaccctgtgcccagcgagtgggtgaagaacttcagaagagagagcgtgctgggggagaagagcctgaaggccaaggtgaacagaggagccagctttggcagcacctctgtgtctggcagcgagcctgtgatgagggtgaccctgggcacagccaagtatgagcacgccttcaacagcatcgtgtggaggatcaaccggctgcctgacaagaacagcgccagcggccacccccactgcttcttctgccacctggagctgggcagtgaccgggaggtgcccagcagatttgccaaccacgtgaatgtggagttctccatgcccaccaccagcgccagcaaggcctctgtgcgcagcatctctgtggaggacaagacagatgtgaggaagtgggtgaactacagcgcccactacagctaccagaccacagaaacagacaacctgcccaaccccctgtactgcagctgcctgccccacacagacctgaagaggggcagcaagagggtggtgaagatccgctggaatgccagcctggaggtgcccctggccagcagcatccgcaccatggtgtag

SEQ ID NO: 38613 - DNA, 12 bp, Artificial Sequence
  Description of Artificial Sequence: Synthetic coding sequence
atgaccacctag

SEQ ID NO: 38614 - DNA, 153 bp, Artificial Sequence
  Description of Artificial Sequence: Synthetic coding sequence
atgaccaccctggaccacgtgattgccacccaccagagcgagtgggtgtccttcaatgaggagccccccttccctgcccacagccagggcggcacagaggagcacctgcccggcctgagcagcagcccagaccagagcgagagcagcagctag

SEQ ID NO: 38615 - DNA, 2763 bp, Artificial Sequence
  Description of Artificial Sequence: Synthetic coding sequence
atgaccaccctggaccacgtgattgccacccaccagagcgagtgggtgtccttcaatgaggagccccccttccctgcccacagccagggcggcacagaggagcacctgcccggcctgagcagcagcccagaccagagcgagagcagcagcggggagaaccacgtggtggatggcggcagccaggaccacagccacagcgagcaggatgacagcagcgagaagatgggcctcatcagcgaggccgccagccccccaggcagccctgagcagcccccaccagacctggccagcgccatcagcaactgggtgcagtttgaagatgacaccccctgggccagcaccagccccccccaccaggagacagctgagacagccctgcccctgaccatgccctgctggacctgccccagctttgacagcctgggccgctgccccctgaccagcgagagctcctggaccacccacagcgaggacaccagcagccccagctttggctgcagctacacagacctgcagctgatcaatgctgaggagcagaccagcggccaggccagcggggctgacagcacagacaacagcagcagcctgcaggaggatgaggaggtggagatggaggccatctcctggcaggccagcagccctgccatgaatggccacccagcccctcctgtgaccagcgcccgcttccccagctgggtgacctttgatgacaatgaggtgtcctgccccctgccccctgtgaccagccccctgaagcccaacaccccacccagcgccagcgtcatcccagatgtgccctacaacagcatgggcagcttcaagaagagggaccggcccaagagcaccctgatgaacttcagcaaggtgcagaagctggacatcagcagcctgaacagaacacccagcgtgacagaggccagcccctggagggccaccaaccccttcctgaatgagaccctgcaggatgtgcagcccagccccatcaaccccttcagcgccttctttgaggagcaggagcggcgcagccagaacagcagcatcagcagcaccaccgggaagagccagagggacagcctcatcgtcatctaccaggatgccatcagctttgatgacagcagcaagacccagagccacagtgatgctgtggagaagctgaagcagctgcagattgatgatcctgaccacttcggcagcgccaccctgcctgatgatgatcctgtggcctggattgagctggatgcccaccccccaggcagcgcccggagccagcccagagatggctggcccatgatgctgcgcatccctgagaagaagaacatcatgagcagccgccactggggccccatctttgtgaagctgacagacaccggctacctgcagctgtactatgagcagggcctggagaagcccttccgggagttcaagctggagatctgccacgagatcagcgagccccggctgcagaactatgatgaaaatggccgcatccacagcctgagaattgacagagtgacctacaaggagaagaagaagtaccagcccaagccagctgtggcccacacagctgagcgggagcaggtgatcaagctgggcaccaccaactatgatgacttcctgtccttcatccatgctgtgcaggaccggctgatggacctgcctgtgctgtccatggacctgagcacagtgggcctgaactacctggaggaggagatcaccgtggatgtgagagatgagttcagcggcatcgtgtccaaaggagacaaccagatcctgcagcaccacgtgctgacccgcatccacatcctgtccttcctgagcggcctggccgagtgccgcctgggcctgaatgacatcctggtgaagggaaatgaaattgtgctgcggcaggacatcatgcccaccaccaccaccaagtggatcaagctgcacgagtgccgcttccacggctgtgtggatgaagatgtgttccacaacagcagggtcatcctcttcaaccccctggatgcctgccgctttgagctgatgaggttcagaacagtgtttgctgagaagaccctgcccttcaccctgaggacagccacctctgtgaatggagctgaggtggaggtgcagagctggctgaggatgagcacaggcttcagcgccaacagagaccccctgacccaggtgccctgtgaaaatgtgatgatccgctaccctgtgcccagcgagtgggtgaagaacttcagaagagagagcgtgctgggggagaagagcctgaaggccaaggtgaacagaggagccagctttggcagcacctctgtgtctggcagcgagcctgtgatgagggtgaccctgggcacagccaagtatgagcacgccttcaacagcatcgtgtggaggatcaaccggctgcctgacaagaacagcgccagcggccacccccactgcttcttctgccacctggagctgggcagtgaccgggaggtgcccagcagatttgccaaccacgtgaatgtggagttctccatgcccaccaccagcgccagcaaggcctctgtgcgcagcatctctgtggaggacaagacagatgtgaggaagtgggtgaactacagcgcccactacagctaccagaccacagaaacagacaacctgcccaaccccctgtactgcagctgcctgccccacacagacctgaagaggggcagcaagagggtggtgaagatccgctggaatgccagcctggaggtgcccctggccagcagcatccgcaccatggtgtag

SEQ ID NO: 38616 - DNA, 441 bp, Artificial Sequence
  Description of Artificial Sequence: Synthetic coding sequence
atgtggccagccccctgcagcgtgggccgcctgctgatcttcttcatgtgcagcagcagcggctacgtggtgcagggctgcggccccagccctggggcccggaccaccctgggcagccccctgagcctgtggagcatcaagacccccagccacatcttctgcacccggcgggccatcaacctgggcttccccagcccccccctggtgcagctgatcttctggagcctgaatgccggcctggacctgtacctgtgcctgatcagcagctgtggcttcagccaggtgttctggcctgtggaggccttctgcagcttcagcctgtccttctttgccctggccctgagccacaagtttgtgatctgccgcctggaccagcacatcttcagcggcttcaccaagagcctgaagaacctgcccccctgccacaggacagacatctag

SEQ ID NO: 38617 - DNA, 201 bp, Artificial Sequence
  Description of Artificial Sequence: Synthetic coding sequence
atggtggccaagcagaggatccgcatggccaatgagaagcacagcaagaacatcacccagagaggaaatgtggccaagaccagcagaaatgcccctgaggagaaggcctctgtgggcccctggctgctggccctcttcatctttgtggtgtgtggcagcgccatcttccagatcatccagagcatccgcatgggcatgtag

SEQ ID NO: 38618 - DNA, 201 bp, Artificial Sequence; identical to SEQ ID NO: 38617
  Description of Artificial Sequence: Synthetic coding sequence

SEQ ID NO: 38619 - DNA, 198 bp, Artificial Sequence
  Description of Artificial Sequence: Synthetic coding sequence
atggtggccaagcagaggatccgcatggccaatgagaagcacagcaagaacatcacccagagaggaaatgtggccaagaccctgcggccccaggaggagaagtaccctgtgggcccctggctgctggccctgtttgtgtttgtggtgtgtggcagcgccatcttccagatcatccagagcatccgcatgggcatgtag

SEQ ID NO: 38620 - DNA, 2343 bp, Artificial Sequence
  Description of Artificial Sequence: Synthetic coding sequence
atggatgagcaggccggccctggggtcttcttcagcaacaaccaccctggggccggcggggccaagggcctgggccccctggccgaggccgctgctgctggagatggagctgctgctgctggggccgcccgggcccagtacagcctgcccggcatcctgcacttcctgcagcacgagtgggccaggtttgaggtggagcgggcccagtgggaggtggagagagctgagctgcaggcccagatcgccttcctgcagggcgagaggaagggccaggagaacctgaagaaggacctggtgcggcgcatcaagatgctggagtatgccctgaagcaggagcgggccaagtaccacaagctgaagtatggaacagagctgaaccagggcgacatgaagccacccagctatgacagtgatgagggcaatgaaacagaggtgcagccccagcagaacagccagctgatgtggaagcagggccggcagctgctgcggcagtacctgcaggaggtgggctacacagacaccatcctggatgtgaagagcaagagggtgcgggccctgctgggcttcagcagtgatgtgacagacagagaagatgacaagaaccaggacagcgtggtgaatggaacagaagctgaggtgaaggagacagccatgattgccaagtctgagctgacagattctgcctctgtgctggacaacttcaagttcctggagagcgctgctgctgacttcagtgatgaagatgaagatgatgatgtggatggccgggagaagtctgtgattgacaccagcaccatcgtgaggaagaaggccctgcctgattctggagaagatcgggacaccaaggaggccctgaaggagtttgacttcctggtgaccagcgaggagggggacaatgaaagccgctctgctggagatggaacagactgggagaaggaggaccagtgcctgatgcctgaggcctggaatgtggaccagggcgtcatcaccaagctgaaggagcagtacaagaaggagaggaagggcaagaagggcgtgaagaggcccaacagaagcaagctgcaggacatgctggccaacctgagagatgtggatgagctgcccagcctgcagcccagcgtgggcagccccagccggcccagcagcagccggctgcctgagcacgagatcaacagagcagatgaggtggaggccctgaccttcccccccagcagcggcaagagcttcatcatgggcgcagatgaggccctggagagcgagctgggcctgggggagctggccggcctgactgtggccaatgaagctgacagcctgacctatgacatcgccaacaacaaggatgccctgaggaagacctggaaccccaagttcaccctgcggagccactttgatggcatccgggccctggccttccaccccatcgagcctgtgctgatcacagccagcgaggaccacaccctgaagatgtggaacctgcagaagacagccccagccaagaagagcaccagcctggatgtggagcccatctacaccttccgggcccacaagggccctgtgctgtgtgtggtgatgagcagcaatggagagcagtgctacagcggcggcacagatggcctcatccagggctggaacaccaccaaccccaacatcgacccctatgacagctatgaccccagcgtgctgcggggccccctgctgggccacacagatgctgtgtggggcctggcctacagcgctgcccaccagaggctgctgagctgcagcgcagatggcaccctgcggctgtggaacaccacagaggtggccccagccctgagcgtcttcaatgacaccaaggagctgggcatcccagcctctgtggacctggtgtccagtgaccccagccacatggtggccagcttcagcaagggctacaccagcatcttcaacatggagacccagcagaggatcctgaccctggagagcaatgtggacaccacagccaacagcagctgccagatcaacagagtcatcagccaccccaccctgcccatcagcatcacagcccacgaggacagacacatcaagttctatgacaacaacacaggcaagctgatccacagcatggtggcccacctggaggccgtgaccagcctggccgtggaccccaacggcctgtacctgatgagcggcagccatgactgcagcatccggctgtggaacctggagagcaagacctgcatccaggagttcaccgcccacaggaagaagtttgaggagagcatccatgatgtggccttccaccccagcaagtgctacatcgccagcgctggagcagatgccctggccaaggtgtttgtgtag

SEQ ID NO: 38621 - DNA, 2196 bp, Artificial Sequence
  Description of Artificial Sequence: Synthetic coding sequence
atggatgagcaggccggccctggggtcttcttcagcaacaaccaccctggggccggcggggccaagggcctgggccccctggccggggccgcccgggcccagtacagcctgcccggcatcctgcacttcctgcagcacgagtgggccaggtttgaggtggagcgggcccagtgggaggtggagagagctgagctgcaggcccagatcgccttcctgcagggcgagaggaagggccaggagaacctgaagaaggacctggtgcggcgcatcaagatgctggagtatgccctgaagcaggagcgggccaagtaccacaagctgaagtatggaacagagctgaaccagggcgacatgaagccacccagctatgacagtgatgagggcaatgaaacagaggtgcagccccagcagaacagccagctgatgtggaagcagggccggcagctgctgcggcagtacctgcaggaggtgggctacacagacaccatcctggatgtgaagagcaagagggtgcgggccctgctgggcttcagcagtgatgtgacagacagagaagatgacaagaaccaggacagcgtggtgaatggaacagaagctgaggtgaaggagacagccatgattgccaagtctgagctgacagattctgcctctgtgctggacaacttcaagttcctggagagcgctgctgctgacttcagtgatgaagatgaagatgatgatgtggatggccgggagaagtctgtgattgacaccagcaccatcgtgaggaagaaggccctgcctgattctggagaagatcgggacaccaaggaggccctgaaggagtttgacttcctggtgaccagcgaggagggggacaatgaaagccgctctgctggagatggaacagactggggccccaacagaagcaagctgcaggacatgctggccaacctgagagatgtggatgagctgcccagcctgcagcccagcgtgggcagccccagccggcccagcagcagccggctgcctgagcacgagatcaacagagcagatgaggtggaggccctgaccttcccccccagcagcggcaagagcttcatcatgggcgcagatgaggccctggagagcgagctgggcctgggggagctggccggcctgactgtggccaatgaggccgacagcctgacctatgacatcgccaacaacaaggatgccctgaggaagacctggaaccccaagttcaccctgcggagccactttgatggcatccgggccctggccttccaccccatcgagcctgtgctgatcacagccagcgaggaccacaccctgaagatgtggaacctgcagaagacagccccagccaagaagagcaccagcctggatgtggagcccatctacaccttccgggcccacaagggccctgtgctgtgtgtggtgatgagcagcaatggagagcagtgctacagcggcggcacagatggcctcatccagggctggaacaccaccaaccccaacatcgacccctatgacagctatgaccccagcgtgctgcggggccccctgctgggccacacagatgctgtgtggggcctggcctacagcgctgcccaccagaggctgctgagctgcagcgcagatggcaccctgcggctgtggaacaccacagaggtggccccagccctgtctgtgttcaatgacaccaaggagctgggcatcccagcctctgtggacctggtgtccagtgaccccagccacatggtggccagcttcagcaagggctacaccagcatcttcaacatggagacccagcagaggatcctgaccctggagagcaatgtggacaccacagccaacagcagctgccagatcaacagagtcatcagccaccccaccctgcccatcagcatcacagcccatgaagatagacacatcaagttctatgacaacaacacaggcaagctgatccacagcatggtggcccacctggaggccgtgaccagcctggccgtggaccccaacggcctgtacctgatgagcggcagccatgactgcagcatccggctgtggaacctggagagcaagacctgcatccaggagttcaccgcccacaggaagaagtttgaggagagcatccatgatgtggccttccaccccagcaagtgctacatcgccagcgctggagcagatgccctggccaaggtgtttgtgtag

SEQ ID NO: 38622 - DNA, 2268 bp, Artificial Sequence
  Description of Artificial Sequence: Synthetic coding sequence
cggcccccctggaccagcagaagagtgcctgccagcagcagcgccaccaccacccgggcccagtacagcctgcccggcatcctgcacttcctgcagcacgagtgggccaggtttgaggtggagcgggcccagtgggaggtggagcgggcagagctgcaggcccagatcgccttcctgcagggcgagaggaagggccaggagaacctgaagaaggacctggtgcggcgcatcaagatgctggagtatgccctgaagcaggagcgggccaagtaccacaagctgaagtatggaacagagctgaaccagggcgacatgaagcccccatcctatgacagtgatgagggcaatgaaacagaggtgcagccccagcagaacagccagctgatgtggaagcagggccggcagctgctgcggcagtacctgcaggaggtgggctacacagacaccatcctggatgtgaagagcaagagggtgcgggccctgctgggcttcagcagtgatgtgacagaccgggaggatgacaagaaccaggacagcgtggtgaatggaacagaggccgaggtgaaggagacagccatgattgccaagtctgagctgacagacagcgcctctgtgctggacaacttcaagttcctggagagcgctgctgctgacttcagtgatgaagatgaagatgatgatgtggatggccgggagaagagcgtcatcgacaccagcaccatcgtgaggaagaaggccctgcctgacagcggggaggaccgggacaccaaggaggccctgaaggagtttgacttcctggtgaccagcgaggagggggacaatgaaagccgctctgctggagatggaacagactgggagaaggaggaccagtgcctgatgcctgaggcctggaatgtggaccagggcgtcatcaccaagctgaaggagcagtacaagaaggagaggaagggcaagaagggcgtgaagaggcccaacagaagcaagctgcaggacatgctggccaacctgagagatgtggatgagctgcccagcctgcagcccagcgtgggcagccccagccggcccagcagcagccggctgcctgagcacgagatcaacagagcagatgaggtggaggccctgaccttcccccccagcagcggcaagagcttcatcatgggcgcagatgaggccctggagagcgagctgggcctgggggagctggccggcctgactgtggccaatgaggccgacagcctgacctatgacatcgccaacaacaaggatgccctgaggaagacctggaaccccaagttcaccctgcggagccactttgatggcatccgggccctggccttccaccccatcgagcctgtgctgatcacagccagcgaggaccacaccctgaagatgtggaacctgcagaagacagccccagccaagaagagcaccagcctggatgtggagcccatctacaccttccgggcccacaagggccctgtgctgtgtgtggtgatgagcagcaatggagagcagtgctacagcggcggcacagatggcctcatccagggctggaacaccaccaaccccaacatcgacccctatgacagctatgaccccagcgtgctgcggggccccctgctgggccacacagatgctgtgtggggcctggcctacagcgctgcccaccagaggctgctgagctgcagcgcagatggcaccctgcggctgtggaacaccacagaggtggccccagccctgtctgtgttcaatgacaccaaggagctgggcatcccagcctctgtggacctggtgtccagtgaccccagccacatggtggccagcttcagcaagggctacaccagcatcttcaacatggagacccagcagaggatcctgaccctggagagcaatgtggacaccacagccaacagcagctgccagatcaacagagtcatcagccaccccaccctgcccatcagcatcacagcccatgaagatagacacatcaagttctatgacaacaacacaggcaagctgatccacagcatggtggcccacctggaggccgtgaccagcctggccgtggaccccaacggcctgtacctgatgagcggcagccatgactgcagcatccggctgtggaacctggagagcaagacctgcatccaggagttcaccgcccacaggaagaagtttgaggagagcatccatgatgtggccttccaccccagcaagtgctacatcgccagcgctggagcagatgccctggccaaggtgtttgtgtag

SEQ ID NO: 38623 - DNA, 2142 bp, Artificial Sequence
  Description of Artificial Sequence: Synthetic coding sequence
atggatgagctggccggcggcggcggcggcggccctggcatggccgccccaccccggcagcagcagggccctgggggcaacctgggcctgagccctggaggaaatggagctgctgggggcggcggccccccagccagcgagggcgccggccctgctgctggccctgagctgagccggccccagcagtacaccatccctggcatcctgcactacatccagcacgagtgggccaggtttgagatggagcgggcccactgggaggtggagagagctgagctgcaggccagaattgccttcctgcagggcgagaggaagggccaggagaacctgaagaaggacctggtgcggcgcatcaagatgctggagtatgccctgaagcaggagcgggccaagtaccacaagctgaagtatggaacagagctgaaccagggcgacctgaagatgcccacctttgaaagtgaggagaccaaggacacagaggcccccacagccccccagaacagccagctgacctggaagcagggccggcagctgctgcggcagtacctgcaggaggtgggctacacagacaccatcctggatgtgcgcagccagagggtgcgcagcctgctgggcctgagcaacagcgagcccaacggctctgtggagaccaagaacctggagcagatcctgaatggaggagagagccccaagcagaagggccaggagatcaagaggagcagtggagatgtgctggagaccttcaacttcctggagaatgctgatgacagtgatgaagatgaggagaatgacatgattgagggcatccctgagggcaaggacaagcacaggatgaacaagcacaagattggaaatgaaggcctggccgctgacctgacagatgatcctgacacagaggaggccctgaaggagtttgacttcctggtgacagcagaagatggagagggcgctggggaggcccggagcagtggagatggaacagagtgggccgagcccatcaccttccccagcggcggcggcaagagcttcatcatgggcagtgatgatgtgctgctgtctgtgctgggcctgggggacctggccgacctgactgtgaccaatgatgctgactacagctatgacctgcctgccaacaaggatgccttcaggaagacctggaaccccaagtacaccctgcggagccactttgatggagtgcgggccctggccttccaccctgtggagcctgtgctggtgacagccagcgaggaccacaccctgaagctgtggaacctgcagaagacagtgcctgccaagaagagcgccagcctggatgtggagcccatctacaccttccgggcccacatcggccctgtgctgagcctggccatcagcagcaatggagagcagtgcttcagcggcggcattgatgccaccatccagtggtggaacatgcccagccccagcgtggacccctatgacacctatgagcccaacgtgctggccggcaccctggtgggccacacagatgctgtgtggggcctggcctacagcggcatcaagaaccagctgctgagctgcagcgcagatggcaccgtgcggctgtggaacccccaggagaagctgccctgcatctgcacctacaacggggacaagaagcacggcatccccacctctgtggacttcatcggctgtgaccctgcccacatggtgaccagcttcaacacaggcagcgctgtgatctatgacctggagaccagccagagcctggtgatcctgagcagccaggtggacagcggcctgcagagcaacaaccacatcaacagagtggtgagccaccccaccctgcctgtgaccatcacagcccatgaagatagacacatcaagttctttgacaacaagacaggcaagatgatccacagcatggtggcccacctggatgctgtgaccagcctggccgtggaccccaacggcatctacctgatgagcggcagccatgactgcagcatccggctgtggaacctggacagcaagacctgtgtgcaggagatcacagcccacaggaagaagctggatgagagcatctatgatgtggccttccacagcagcaaggcctacatcgccagcgctggagcagatgccctggccaaggtgtttgtgtag

SEQ ID NO: 38624 - DNA, 2394 bp, Artificial Sequence
  Description of Artificial Sequence: Synthetic coding sequence
atggatgagctggccggcggcggcggcggcggccctggcatggccgccccaccccggcagcagcagggccctgggggcaacctgggcctgagccctggaggaaatggagctgctgggggcggcggccccccagccagcgagggcgccggccctgctgctggccctgagctgagccggccccagcagtacaccatccctggcatcctgcactacatccagcacgagtgggccaggtttgagatggagcgggcccactgggaggtggagagagctgagctgcaggccagaattgccttcctgcagggcgagaggaagggccaggagaacctgaagaaggacctggtgcggcgcatcaagatgctggagtatgccctgaagcaggagcgggccaagtaccacaagctgaagtatggaacagagctgaaccagggcgacctgaagatgcccacctttgaaagtgaggagaccaaggacacagaggcccccacagccccccagaacagccagctgacctggaagcagggccggcagctgctgcggcagtacctgcaggaggtgggctacacagacaccatcctggatgtgcgcagccagagggtgcgcagcctgctgggcctgagcaacagcgagcccaacggctctgtggagaccaagaacctggagcagatcctgaatggaggagagagccccaagcagaagggccaggagatcaagaggagcagtggagatgtgctggagaccttcaacttcctggagaatgctgatgacagtgatgaagatgaggagaatgacatgattgagggcatccctgagggcaaggacaagcacaggatgaacaagcacaagattggaaatgaaggcctggccgctgacctgacagatgatcctgacacagaggaggccctgaaggagtttgacttcctggtgacagcagaagatggagagggcgctggggaggcccggagcagtggagatggaacagagtgggacaaggatgacctgagccccacagctgaggtgtgggatgtggaccagggcctcatcagcaagctgaaggagcagtacaagaaggagaggaagggcaagaagggcgtgaagagggccaacagaaccaagctgtatgacatgattgctgacctgggagatgatgagctgccccacatccccagcggcatcatcaaccagagccgcagcgccagcaccaggatgacagaccacgagggcgcccgggcagaggaggccgagcccatcaccttccccagcggcggcggcaagagcttcatcatgggcagtgatgatgtgctgctgtctgtgctgggcctgggggacctggccgacctgactgtgaccaatgatgctgactacagctatgacctgcctgccaacaaggatgccttcaggaagacctggaaccccaagtacaccctgcggagccactttgatggagtgcgggccctggccttccaccctgtggagcctgtgctggtgacagccagcgaggaccacaccctgaagctgtggaacctgcagaagacagtgcctgccaagaagagcgccagcctggatgtggagcccatctacaccttccgggcccacatcggccctgtgctgagcctggccatcagcagcaatggagagcagtgcttcagcggcggcattgatgccaccatccagtggtggaacatgcccagccccagcgtggacccctatgacacctatgagcccaacgtgctggccggcaccctggtgggccacacagatgctgtgtggggcctggcctacagcggcatcaagaaccagctgctgagctgcagcgcagatggcaccgtgcggctgtggaacccccaggagaagctgccctgcatctgcacctacaacggggacaagaagcacggcatccccacctctgtggacttcatcggctgtgaccctgcccacatggtgaccagcttcaacacaggcagcgctgtgatctatgacctggagaccagccagagcctggtgatcctgagcagccaggtggacagcggcctgcagagcaacaaccacatcaacagagtggtgagccaccccaccctgcctgtgaccatcacagcccatgaagatagacacatcaagttctttgacaacaagacaggcaagatgatccacagcatggtggcccacctggatgctgtgaccagcctggccgtggaccccaacggcatctacctgatgagcggcagccatgactgcagcatccggctgtggaacctggacagcaagacctgtgtgcaggagatcacagcccacaggaagaagctggatgagagcatctatgatgtggccttccacagcagcaaggcctacatcgccagcgctggagcagatgccctggccaaggtgtttgtgtag

SEQ ID NO: 38625 - DNA, 2118 bp, Artificial Sequence
  Description of Artificial Sequence: Synthetic coding sequence
atgaccaagtttggcttcctgcggctgtcctatgagaagcaggacaccctgctgaagctgctgatcctgtccatggctgctgtgctgtccttcagcacccggctgtttgctgtgctgcgctttgaatctgtcatccacgagtttgacccctacttcaactaccgcaccacccgcttcctggccgaggagggcttctacaagttccacaactggtttgatgaccgggcctggtaccccctgggccgcatcatcggcggcaccatctacccaggcctgatgatcaccagcgctgccatctaccacgtgctgcacttcttccacatcaccatcgacatcagaaatgtgtgtgtgttcctggcccccctcttcagcagcttcaccaccatcgtgacctaccacctgaccaaggagctgaaggatgctggagctggcctgctggccgccgccatgattgctgtggtgcccggctacatcagccgctctgtggccggcagctatgacaatgaaggaattgccatcttctgcatgctgctgacctactacatgtggatcaaggctgtgaagacaggcagcatctgctgggccgccaagtgtgccctggcctacttctacatggtgtcctcctggggcggctacgtgttcctgatcaacctgatccccctgcacgtgctggtgctgatgctgaccggccgcttcagccaccgcatctacgtggcctactgcaccgtgtactgcctgggcaccatcctgtccatgcagatcagctttgtgggcttccagcctgtgctgagcagcgagcacatggccgcctttggagtgtttggcctgtgccagatccacgcctttgtggactacctgcggagcaagctgaacccccagcagtttgaggtgctcttccgcagcgtcatcagcctggtgggctttgtgctgctgactgtgggcgccctgctgatgctgaccgggaagatcagcccctggacaggccgcttctacagcctgctggaccccagctatgccaagaacaacatccccatcatcgcctctgtgtctgagcaccagcccaccacctggagcagctactactttgacctgcagctgctggtgttcatgtttcctgtgggcctgtactactgcttcagcaacctgagtgatgcccgcatcttcatcatcatgtatggagtgacctccatgtacttctctgctgtgatggtgcggctgatgctggtgctggcccctgtgatgtgcatcctgagcggcatcggcgtgtcccaggtgctgagcacctacatgaagaacctggacatcagcaggccagacaagaagagcaagaagcagcaggacagcacctaccccatcaagaatgaggtggccagcggcatgatcctggtgatggccttcttcctgatcacctacaccttccacagcacctgggtgaccagcgaggcctacagcagccccagcatcgtgctgagcgcccggggaggagatggcagccgcatcatctttgatgacttccgggaggcctactactggctgcggcacaacaccccagaagatgccaaggtgatgtcctggtgggactatggctaccagatcacagccatggccaacagaaccatcctggtggacaacaacacctggaacaacacccacatcagccgggtgggccaggccatggccagcacagaggagaaggcctatgagatcatgagggagctggatgtgtcctatgtgctggtgatctttggaggcctgaccggctacagcagtgatgacatcaacaagttcctgtggatggtgcgcatcggcggcagcacagacaccgggaagcacatcaaggaaaatgactactacacccccactggagagttccgggtggaccgggagggcagccctgtgctgctgaactgcctgatgtacaagatgtgctactacagatttggccaggtgtacacagaggccaagaggcctcctggctttgacagagtgagaaatgctgagatcggcaacaaggactttgagctggatgtgctggaggaggcctacaccacagagcactggctggtgcgcatctacaaggtgaaggacctggacaacagaggcctgagcaggacatag

SEQ ID NO: 38626 - DNA, 2118 bp, Artificial Sequence; identical to SEQ ID NO: 38625
  Description of Artificial Sequence: Synthetic coding sequence

SEQ ID NO: 38627 - DNA, 2481 bp, Artificial Sequence
  Description of Artificial Sequence: Synthetic coding sequence
atggccgagcccagcgcccctgagagcaagcacaagagcagcctgaacagcagcccctggagcggcctgatggccctgggcaacagcagacatggccaccacggccctggggcccagtgtgcccacaaggctgctggaggagctgccccacccaagccagccccagctggcctgagcggcggcctgagccagcctgctggctggcagagcctgctgtccttcaccatcctcttcctggcctggctggccggcttcagcagccggctgtttgctgtgatccgctttgagagcatcatccacgagtttgacccctggttcaactaccgcagcacccaccacctggccagccacggcttctatgagttcctgaactggtttgatgagcgggcctggtaccccctgggcagaattgtgggcggcaccgtgtacccaggcctgatgatcacagctggcctcatccactggatcctgaacaccctgaacatcaccgtgcacatcagagatgtgtgtgtgttcctggcccccaccttcagcggcctgaccagcatcagcaccttcctgctgacccgggagctgtggaaccagggcgccggcctgctggccgcctgcttcatcgccatcgtgcccggctacatcagccgctctgtggccggcagctttgacaatgaaggaattgccatctttgccctgcagttcacctactacctgtgggtgaagtctgtgaagacaggctctgtgttctggaccatgtgctgctgcctgagctacttctacatggtgtctgcctggggcggctacgtgttcatcatcaacctgatccccctgcacgtgtttgtgctgctgctgatgcagcgctacagcaagagggtgtacatcgcctacagcaccttctacatcgtgggcctcatcctgtccatgcagatcccctttgtgggcttccagcccatccgcaccagcgagcacatggctgctgctggggtgtttgccctgctgcaggcctatgccttcctgcagtacctgcgggaccggctgaccaagcaggagttccagaccctcttcttcctgggcgtgtccctggccgccggggctgtgttcctgagcgtcatctacctgacctacacaggctacatcgccccctggagcggccgcttctacagcctgtgggacaccggctacgccaagatccacatccccatcatcgcctctgtgtctgagcaccagcccaccacctgggtgtccttcttctttgacctgcacatcctggtgtgcaccttccctgctggcctgtggttctgcatcaagaacatcaatgatgagcgggtgtttgtggccctgtatgccatctctgctgtgtactttgctggggtgatggtgcggctgatgctgaccctgacccctgtggtgtgcatgctgagcgccatcgccttcagcaatgtgtttgagcactacctgggagatgacatgaagagagaaaatcctcctgtggaggacagcagtgatgaagatgacaagaggaaccagggcaacctgtatgacaaggccggcaaggtgaggaagcacgccacagagcaggagaagacagaggagggcctgggccccaacatcaagagcatcgtgaccatgctgatgctgatgctgctgatgatgtttgctgtgcactgcacctgggtgaccagcaatgcctacagcagccccagcgtggtgctggccagctacaaccatgatggcaccaggaacatcctggatgacttccgggaggcctacttctggctgcggcagaacacagatgagcacgcccgggtgatgtcctggtgggactatggctaccagattgctggcatggccaacagaaccaccctggtggacaacaacacctggaacaacagccacatcgccctggtgggcaaggccatgagcagcaatgaaacagctgcctacaagatcatgaggaccctggatgtggactatgtgctggtgatctttggaggagtgattggctacagcggagatgacatcaacaagttcctgtggatggtgagaattgctgagggggagcaccccaaggacatccgggagagtgactacttcaccccccagggcgagttccgggtggacaaggccggcagccccaccctgctgaactgcctgatgtacaagatgagctactacagatttggagagatgcagctggacttccgcaccccacctggctttgacaggaccagaaatgctgagatcggcaacaaggacatcaagttcaagcacctggaggaggccttcaccagcgagcactggctggtgcgcatctacaaggtgaaggccccagacaaccgggagaccctggaccacaagccccgggtgaccaacatcttccccaagcagaagtacctgagcaagaagaccaccaagaggaagaggggctacatcaagaacaagctggtgttcaagaagggcaagaagatcagcaagaagacagtgtag

SEQ ID NO: 38628 - DNA, 1005 bp, Artificial Sequence
  Description of Artificial Sequence: Synthetic coding sequence
atgctgggcatcatggcctggaatgccacctgcaagaactggctggccgctgaggccgccctggagaagtactacctgagcatcttctacggcatcgagtttgtggtgggcgtgctgggcaacaccatcgtggtgtatggctacatcttcagcctgaagaactggaacagcagcaacatctacctgttcaacctgtctgtgtctgacctggccttcctgtgcaccctgcccatgctgatccgctcctatgccaatggaaactggatctatggagatgtgctgtgcatcagcaaccgctacgtgctgcacgccaacctgtacaccagcatcctcttcctgaccttcatcagcattgaccgctacctgatcatcaagtaccccttccgggagcacctgctgcagaagaaggagtttgccatcctgatcagcctggccatctgggtgctggtgaccctggagctgctgcccatcctgcccctcatcaaccctgtgatcacagacaatggcaccacctgcaatgactttgccagcagcggggaccccaactacaacctgatctacagcatgtgcctgaccctgctgggcttcctgatccccctgtttgtgatgtgcttcttctactacaagatcgccctcttcctgaagcagaggaaccggcaggtggccacagccctgcccctggagaagcccctgaacctggtgatcatggctgtggtgatcttctctgtgctcttcaccccctaccacgtgatgagaaatgtgcgcatcgccagccggctgggctcctggaagcagtaccagtgcacccaggtggtgatcaacagcttctacatcgtgacccggcccctggccttcctgaacagcgtcatcaaccctgtgttctacttcctgctgggggaccacttccgggacatgctgatgaaccagctgcggcacaacttcaagagcctgaccagcttcagccgctgggcccacgagctgctgctgtccttccgggagaagtag

SEQ ID NO: 38629 - DNA, 1323 bp, Artificial Sequence
  Description of Artificial Sequence: Synthetic coding sequence
atggccagccctgtggccgcccaggccggcaagctgctgcgggccctggccctgcggccccgcttcctggccgccggcagccaggccgtgcagctgaccagccgccgctggctgaacctgcaggagtaccagagcaagaagctgatgtctgacaacggggtgcgggtgcagcgcttctttgtggccgacacagccaatgaggccctggaggccgccaagaggctgaatgccaaggagatcgtgctgaaggcccagatcctggccggcggccggggcaaaggagtcttcaacagcggcctgaagggcggcgtgcacctgaccaaggaccccaacgtggtgggccagctggccaagcagatgattggctacaacctggccaccaagcagacccccaaggagggcgtgaaggtgaacaaggtgatggtggccgaggccctggacatcagccgggagacctacctggccatcctgatggacaggagctgcaatggacctgtgctggtgggcagcccccagggcggcgtggacatcgaggaggtggccgccagcaaccctgagctgatcttcaaggagcagattgacatctttgagggcatcaaggacagccaggcccagaggatggccgagaacctgggctttgtgggccccctgaagagccaggccgctgaccagatcaccaagctgtacaacctcttcctgaagattgatgccacccaggtggaggtgaacccctttggagagaccccagagggccaggtggtgtgctttgatgccaagatcaactttgatgacaatgctgagttccggcagaaggacatctttgccatggatgacaagtcagaaaatgagcccattgaaaatgaagctgccaagtatgacctgaagtacatcggcctggatggcaacatcgcctgctttgtgaatggagctggcctggccatggccacctgtgacatcatcttcctgaatggaggcaagccagccaacttcctggacctgggcggcggcgtgaaggaggcccaggtgtaccaggccttcaagctgctgacagctgaccccaaggtggaggccatcctggtgaacatctttggaggcatcgtgaactgtgccatcatcgccaacggcatcaccaaggcctgccgggagctggagctgaaggtgcccctggtggtgcggctggagggcaccttcatggagaagaagggcagctacatgcacatcaagcaggagactggaaacagcaatgaaaacatcaccggcatccaggagaatgtggcccaccagaacctgagcaaatgtgccatcagcatcttcctgtgctag

SEQ ID NO: 38630 - DNA, 1299 bp, Artificial Sequence
  Description of Artificial Sequence: Synthetic coding sequence
atggccagccctgtggccgcccaggccggcaagctgctgcgggccctggccctgcggccccgcttcctggccgccggcagccaggccgtgcagctgaccagccgccgctggctgaacctgcaggagtaccagagcaagaagctgatgtctgacaacggggtgcgggtgcagcgcttctttgtggccgacacagccaatgaggccctggaggccgccaagaggctgaatgccaaggagatcgtgctgaaggcccagatcctggccggcggccggggcaaaggagtcttcaacagcggcctgaagggcggcgtgcacctgaccaaggaccccaacgtggtgggccagctggccaagcagatgattggctacaacctggccaccaagcagacccccaaggagggcgtgaaggtgaacaaggtgatggtggccgaggccctggacatcagccgggagacctacctggccatcctgatggacaggagctgcaatggacctgtgctggtgggcagcccccagggcggcgtggacatcgaggaggtggccgccagcaaccctgagctgatcttcaaggagcagattgacatctttgagggcatcaaggacagccaggcccagaggatggccgagaacctgggctttgtgggccccctgaagagccaggccgctgaccagatcaccaagctgtacaacctcttcctgaagattgatgccacccaggtggaggtgaacccctttggagagaccccagagggccaggtggtgtgctttgatgccaagatcaactttgatgacaatgctgagttccggcagaaggacatctttgccatggatgacaagtcagaaaatgagcccattgaaaatgaagctgccaagtatgacctgaagtacatcggcctggatggcaacatcgcctgctttgtgaatggagctggcctggccatggccacctgtgacatcatcttcctgaatggaggcaagccagccaacttcctggacctgggcggcggcgtgaaggaggcccaggtgtaccaggccttcaagctgctgacagctgaccccaaggtggaggccatcctggtgaacatctttggaggcatcgtgaactgtgccatcatcgccaacggcatcaccaaggcctgccgggagctggagctgaaggtgcccctggtggtgcggctggagggcaccaacgtgcaggaggcccagaagatcctgaacaacagcggcctgcccatcaccagcgccatcgacctggaggatgctgccaagaaggctgtggcctctgtggccaagaagtag

SEQ ID NO: 38631 - DNA, 753 bp, Artificial Sequence
  Description of Artificial Sequence: Synthetic coding sequence
atgtctgacaacggggtgcgggtgcagcgcttctttgtggccgacacagccaatgaggccctggaggccgccaagaggctgaatgccaaggagatcgtgctgaaggcccagatcctggccggcggccggggcaaaggagtcttcaacagcggcctgaagggcggcgtgcacctgaccaaggaccccaacgtggtgggccagctggccaagcagatgattggctacaacctggccaccaagcagacccccaaggagggcgtgaaggtgaacaaggtgatggtggccgaggccctggacatcagccgggagacctacctggccatcctgatggacaggagctgcaatggacctgtgctggtgggcagcccccagggcggcgtggacatcgaggaggtggccgccagcaaccctgagctgatcttcaaggagcagattgacatctttgagggcatcaaggacagccaggcccagaggatggccgagaacctgggctttgtgggccccctgaagagccaggtggaggccatcctggtgaacatctttggaggcatcgtgaactgtgccatcatcgccaacggcatcaccaaggcctgccgggagctggagctgaaggtgcccctggtggtgcggctggagggcaccaacgtgcaggaggcccagaagatcctgaacaacagcggcctgcccatcaccagcgccatcgacctggaggatgctgccaagaaggctgtggcctctgtggccaagaagtag

SEQ ID NO: 38632 - DNA, 642 bp, Artificial Sequence
  Description of Artificial Sequence: Synthetic coding sequence
atgtttggctggagctttgtgtttgaagattttgtgtctgatgagctgaggaacaaggccacccagcccatgaagtctgtgctgtggtggctgcctgtggagaaggccttctggaggcagcctgctggccctggcagcggcatccgggagcggctggagcaccctgtgctgcacgtgtcctggaatgatgcccgggcctactgtgcctggaggggcaagaggctgcccacagaggaggagtgggagtttgctgcccggggcggcctgaagggccaggtgtacccctggggcaactggttccagcccaacagaaccaacctgtggcagggcaagttccccaagggggacaaggcagaagatggcttccatggagtgtcccctgtgaatgccttccctgcccagaacaactacggcctgtatgacctgctgggcaatgtgtgggagtggacagccagcccctaccaggccgctgagcaggacatgagggtgctgcggggggcctcctggattgacacagcagatggcagcgccaaccaccgggcccgggtgaccaccaggatgggcaacaccccagattctgccagtgacaacctgggcttccgctgtgccgcagatgctggccggcccccaggagagctgtag

SEQ ID NO: 38633 - DNA, 1077 bp, Artificial Sequence
  Description of Artificial Sequence: Synthetic coding sequence
atgagggcccacgcccagaggggccggggctgcaccaggagatctgctgctgtgctgatggcccggcacggcctgcccctgctgcccctgctgagcctgctggtgggcgcctggctgaagctgggcaatggccaggccacctccatggtgcagctgcagggcggccgcttcctgatgggcaccaacagcccagacagcagagatggagatggccctgtgcgggaggccaccgtgaagccctttgccatcgacatcttccctgtgaccaacaaggacttccgggactttgtgcgggagaagaagtacagaacagaggccgagatgtttggctggagctttgtgtttgaggactttgtgtctgatgagctgaggaacaaggccacccagcccatgaagtctgtgctgtggtggctgcctgtggagaaggccttctggaggcagcctgctggccctggcagcggcatccgggagcggctggagcaccctgtgctgcacgtgtcctggaatgatgcccgggcctactgtgcctggaggggcaagaggctgcccacagaggaggagtgggagtttgctgcccggggcggcctgaagggccaggtgtacccctggggcaactggttccagcccaacagaaccaacctgtggcagggcaagttccccaagggggacaaggccgaggatggcttccacggcgtgtcccctgtgaatgccttccctgcccagaacaactacggctgggccaccctgcagatccagccccagaccacctctgtgtctgctgtgctgcagacccaggccggccggcagggcagctgcaagcagcctggaggagacaaggagaagagcctgctgggcagcctgtccttccctggccacgtggccaacagcgccatccccagcagccgggccagcgccagcggcaagaacttccccttccctgtgagccaccccagcgtggccggggccagccaccagggcagaagaggcctgagcctgctgtgctttggagagggcgcccagtgtgtgctgaccatggccggcggccaggtgttcctgctggaggccaagtactactag

SEQ ID NO: 38634 - DNA, 711 bp, Artificial Sequence
  Description of Artificial Sequence: Synthetic coding sequence
atgagggcccacgcccagaggggccggggctgcaccaggagatctgctgctgtgctgatggcccggcacggcctgcccctgctgcccctgctgagcctgctggtgggcgcctggctgaagctgggcaatggccaggccacctccatggtgcagctgcagggcggccgcttcctgatgggcaccaacagcccagacagcagagatggagatggccctgtgcgggaggccaccgtgaagccctttgccatcgacatcttccctgtgaccaacaaggacttccgggactttgtgcgggagaagaagtacagaacagaggccgagatgtttggctggagctttgtgtttgaggactttgtgtctgatgagctgaggaacaaggccacccagcccatgaagggcaagttccccaagggggacaaggccgaggatggcttccacggcgtgtcccctgtgaatgccttccctgcccagaacaactacggcctgtatgacctgctgggcaatgtgtgggagtggacagccagcccctaccaggccgctgagcaggacatgagggtgctgcggggggcctcctggattgacacagcagatggcagcgccaaccaccgggcccgggtgaccaccaggatgggcaacaccccagacagcgccagtgacaacctgggcttccgctgtgccgcagatgctggccggcccccaggagagctgtag

SEQ ID NO: 38635 - DNA, 918 bp, Artificial Sequence
  Description of Artificial Sequence: Synthetic coding sequence
atgagggcccacgcccagaggggccggggctgcaccaggagatctgctgctgtgctgatggcccggcacggcctgcccctgctgcccctgctgagcctgctggtgggcgcctggctgaagctgggcaatggccaggccacctccatggtgcagctgcagggcggccgcttcctgatgggcaccaacagcccagacagcagagatggagatggccctgtgcgggaggccaccgtgaagccctttgccatcgacatcttccctgtgaccaacaaggacttccgggactttgtgcgggagaagaagtacagaacagaggccgagatgtttggctggagctttgtgtttgaggactttgtgtctgatgagctgaggaacaaggccacccagcccatgaagccagctggccctggcagcggcatccgggagcggctggagcaccctgtgctgcacgtgtcctggaatgatgcccgggcctactgtgcctggaggggcaagaggctgcccacagaggaggagtgggagtttgctgcccggggcggcctgaagggccaggtgtacccctggggcaactggttccagcccaacagaaccaacctgtggcagggcaagttccccaagggggacaaggcagaagatggcttccatggagtgtcccctgtgaatgccttccctgcccagaacaactacggcctgtatgacctgctgggcaatgtgtgggagtggacagccagcccctaccaggccgctgagcaggacatgagggtgctgcggggggcctcctggattgacacagcagatggcagcgccaaccaccgggcccgggtgaccaccaggatgggcaacaccccagattctgccagtgacaacctgggcttccgctgtgccgcagatgctggccggcccccaggagagctgtag

SEQ ID NO: 38636 - DNA, 885 bp, Artificial Sequence
  Description of Artificial Sequence: Synthetic coding sequence
atgagggcccacgcccagaggggccggggctgcaccaggagatctgctgctgtgctgatggcccggcacggcctgcccctgctgcccctgctgagcctgctggtgggcgcctggctgaagctgggcaatggccaggccacctccatggtgcagctgcagggcggccgcttcctgatgggcaccaacagcccagacagcagagatggagatggccctgtgcgggaggccaccgtgaagccctttgccatcgacatcttccctgtgaccaacaaggacttccgctacatccgggactttgtgcgggagaagaagtacagaacagaagctgagatgtttggctggagctttgtgtttgaagattttgtgtctgatgagctgaggaacaaggccacccagcccatgaagtctgtgctgtggtggctgcctgtggagaaggccttctggaggcagcctgctggccctggcagcggcatccgggagcggctggagcaccctgtgctgcacgtgtcctggaatgatgcccgggcctactgtgcctggaggggcaagaggctgcccacagaggaggagtgggagtttgctgcccggggcggcctgaagggccaggtgtacccctggggcaactggttccagcccaacagaaccaacctgtggcagggcaagttccccaagggggacaaggcagaagatggcttccatggagtgtcccctgtgaatgccttccctgcccagaacaactacggcctgtatgacctgctgggcaatgtgtgggagtggacagccagcccctaccaggccgctgagcaggacatgagggtgctgcggggggcctcctggattgacacagcagatggcagcgccaaccaccgggcccgggtgacctag

SEQ ID NO: 38637 - DNA, 963 bp, Artificial Sequence
  Description of Artificial Sequence: Synthetic coding sequence
atgagggcccacgcccagaggggccggggctgcaccaggagatctgctgctgtgctgatggcccggcacggcctgcccctgctgcccctgctgagcctgctggtgggcgcctggctgaagctgggcaatggccaggccacctccatggtgcagctgcagggcggccgcttcctgatgggcaccaacagcccagacagcagagatggagatggccctgtgcgggaggccaccgtgaagccctttgccatcgacatcttccctgtgaccaacaaggacttccgggactttgtgcgggagaagaagtacagaacagaggccgagatgtttggctggagctttgtgtttgaggactttgtgtctgatgagctgaggaacaaggccacccagcccatgaagtctgtgctgtggtggctgcctgtggagaaggccttctggaggcagcctgctggccctggcagcggcatccgggagcggctggagcaccctgtgctgcacgtgtcctggaatgatgcccgggcctactgtgcctggaggggcaagaggctgcccacagaggaggagtgggagtttgctgcccggggcggcctgaagggccaggtgtacccctggggcaactggttccagcccaacagaaccaacctgtggcagggcaagttccccaagggggacaaggccgaggatggcttccacggcgtgtcccctgtgaatgccttccctgcccagaacaactacggcctgtatgacctgctgggcaatgtgtgggagtggacagccagcccctaccaggccgctgagcaggacatgagggtgctgcggggggcctcctggattgacacagcagatggcagcgccaaccaccgggcccgggtgaccaccaggatgggcaacaccccagacagcgccagtgacaacctgggcttccgctgtgccgcagatgctggccggcccccaggagagctgtag

SEQ ID NO: 38638 - DNA, 1821 bp, Artificial Sequence
  Description of Artificial Sequence: Synthetic coding sequence
atggtgcggggggcccggcagccccagcagcccaggagccggctggccccccggctgaccggcaccgtggagaagccacccaggaagaggaggagcaggacagaatttgccctgaaggagatcatgagcagcggcggcgcagaagatgacatcccccagggcgagaggaagacagtgacagacttctgctacctgctggacaagagcaagcagctgttcaacggcctgcgggacctgccccagtatggccagaagcagtggcagagctactttggaagaacatttgatgtgtacaccaagctgtggaagttccagcagcagcaccggcaggtgctggacaacagatatggcctgaagcgctggcagattggagagatcgccagcaagattggccagctgtactaccactactacctgcggaccagcgagaccagctacctgaatgaggccttctccttctacagcgccatccggcagaggagctactacagccaggtgaacaaggaggacaggcctgagctggtggtgaagaagctgcgctactatgcccgcttcatcgtggtgtgcctgctgctgaacaagatggatgtggtgaaggacctggtgaaggagctgagtgatgaaattgaggactacacccaccgcttcaacacagaggaccaggtggagtggaacctggtgctgcaggaggtggccgccttcattgaagctgaccctgtgatggtgctgaatgatgacaacaccatcgtcatcaccagcaaccggctggccgagactggagcccccctgctggagcagggcatgattgtgggccagctgagcctggctgatgccctgatcatcggcaactgcaacaaccaggtgaagttcagcgagctgactgtggacatgttcaggatgctgcaggccctggagcgggagcccatgaacctggccagccagatgaacaagccaggcatgcaggagagcgctgacaagcccacccggcgggagaacccccacaagtacctgctgtacaagcccaccttcagccagctgtacaccttcctggccgccagcttcaaggagctgcctgccaacagcgtgctgctgatctacctgagcgccaccggggtcttccccaccggccgcagtgacagcgagggcccctatgactttggaggagtgctgaccaacagcaacagagacatcatcaatggagatgccatccacaagaggaaccagagccacaaggagatgcactgcctgcaccctggggacctgtaccccttcaccaggaagcccctcttcatcatcgtggacagcagcaacagcgtggcctacaagaacttcaccaacctgtttggccagcccctggtgtgcctgctgagccccacagcctaccccaaggccctgcaggaccagagccagaggggcagcctcttcaccctcttcctgaacaaccccctgatggccttcctgtttgtgtctggcctgagctccatgaggcggggcctgtgggagaagtgccaggagtacctgaggaagatcaacagagacatcgcccagctgctgacccacagccgcagcattgaccaggccttcctgcagttctttggagatgagttcctgcggctgctgctgacccgcttcatcttctgcagcgccaccatgaggatgcacaagatcttccgggagaccaggaactacccagagagctacccccagctgcccagagatgaaacagtggagaacccccacctgcagaagcacatcctggagctggccagcatcctggatgtgagaaatgtgttctttgagaacaccattgatgactactag

SEQ ID NO: 38639 - DNA, 1890 bp, Artificial Sequence
  Description of Artificial Sequence: Synthetic coding sequence
atggtgcggggggcccggcagccccagcagcccaggagccggctggccccccggctgaccggcaccgtggagaagccacccaggaagaggaggagcagcatccggggcagcggggacagcagccacagccagagccagggcgagcgctaccagcacttcacagagaagacagaatttgccctgaaggagatcatgagcagtggaggagcagaagatgacatcccccagggcgagaggaagacagtgacagacttctgctacctgctggacaagagcaagcagctgttcaacggcctgcgggacctgccccagtatggccagaagcagtggcagagctacttcggccgcacctttgatgtgtacaccaagctgtggaagttccagcagcagcaccggcaggtgctggacaacagatatggcctgaagcgctggcagatcggggagatcgccagcaagattggccagctgtactaccactactacctgcggaccagcgagaccagctacctgaatgaggccttctccttctacagcgccatccggcagaggagctactacagccaggtgaacaaggaggacaggcctgagctggtggtgaagaagctgcgctactatgcccgcttcatcgtggtgtgcctgctgctgaacaagatggatgtggtgaaggacctggtgaaggagctgagtgatgaaattgaggactacacccaccgcttcaacacagaggaccaggtggagtggaacctggtgctgcaggaggtggccgccttcatcgaggccgaccctgtgatggtgctgaatgatgacaacaccatcgtcatcaccagcaaccggctggccgagaccggggcccccctgctggagcagggcatgattgtgggccagctgagcctggctgatgccctgatcatcggcaactgcaacaaccaggtgaagttcagcgagctgactgtggacatgttcaggatgctgcaggccctggagcgggagcccatgaacctggccagccagatgaacaagccaggcatgcaggagagcgctgacaagcccacccggcgggagaacccccacaagtacctgctgtacaagcccaccttcagccagctgtacaccttcctggccgccagcttcaaggagctgcctgccaacagcgtgctgctgatctacctgagcgccactggagtcttccccaccggccgcagtgacagcgagggcccctatgactttggaggagtgctgaccaacagcaacagagacatcatcaatggagatgccatccacaagaggaaccagagccacaaggagatgcactgcctgcaccctggggacctgtaccccttcaccaggaagcccctcttcatcatcgtggacagcagcaacagcgtggcctacaagaacttcaccaacctgtttggccagcccctggtgtgcctgctgagccccacagcctaccccaaggccctgcaggaccagagccagaggggcagcctcttcaccctcttcctgaacaaccccctgatggccttcctgtttgtgtctggcctgagctccatgagaagaggcctgtgggagaagtgccaggagtacctgaggaagatcaacagagacatcgcccagctgctgacccacagccgcagcattgaccaggccttcctgcagttctttggagatgagttcctgcggctgctgctgacccgcttcatcttctgcagcgccaccatgaggatgcacaagatcttccgggagaccaggaactacccagagagctacccccagctgcccagagatgagaccgtggagaacccccacctgcagaagcacatcctggagctggccagcatcctggatgtgagaaatgtgttctttgagaacaccattgatgactactag

SEQ ID NO: 38640 - DNA, 1746 bp, Artificial Sequence
  Description of Artificial Sequence: Synthetic coding sequence
atggtgttcagaaatgtgggccggcccccagaggaggaggatgtggaggccgcccctgagcccggccccagcgagctgctgtgccccaggcaccgctgtgccctggaccccaaggccctgcccccaggcctggccctggagaggacctggggccctgctgctggcctggaggcccagctggccgccctgggcctgggccagcctgctggccctggggtgaagacagtgggcggcggctgctgcccctgcccctgccccccccagcccccaccaccccagccccagcccccagctgctgccccccaggccggggaggaccccacagagaccagtgatgccctgctggtgctggagggcctggagagcgaggccgagagcctggagaccaacagctgcagcgaggaggagctgagcagccctggccggggcggcggcggcggcggccgcctgctgctgcagcccccaggccctgagctgccccctgtgcccttccccctgcaggacctggtgcccctgggccgcctgagcagaggagagcagcagcagcagcagcagcagcagcccccacctcctcctcctcctcctggccccctgcggcccctggccggccccagcaggaagggcagcttcaagatccggctgagccgcctcttccgcaccaagagctgcaatggaggcagcggcggcggagatggcaccgggaagaggcccagcggggagctggccgccagcgctgccagcctgacagacatgggcggcagcgctggccgggagctggatgctggcaggaagcccaagctgaccaggacccagagcgccttcagccctgtgtccttcagccccctcttcaccggggagaccgtgtccctggtggatgtggacatcagccagaggggcctgaccagcccccacccccccaccccacctcctcctccaagaagaagcctgagcctgctggatgacatcagcggcaccctgcccacctctgtgctggtggcccccatgggcagcagcctgcagagcttccccctgcccccacctcctcctcctcatgccccagatgccttccccagaattgcccccatccgggctgctgagagcctgcacagccagcccccccagcacctgcagtgccccctgtacagaccagacagcagcagctttgctgccagcctgcgggagctggagaagtgtggctggtactggggccccatgaactgggaggatgctgagatgaagctgaagggcaagccagatggcagcttcctggtgcgggacagcagtgacccccgctacatcctgagcctgtccttccgcagccagggcatcacccaccacaccaggatggagcactaccggggcaccttcagcctgtggtgccaccccaagtttgaagatcgctgccagagcgtggtggagttcatcaagagggccatcatgcacagcaagaatggcaagttcctgtacttcctgcggagccgggtgcccggcctgccccccacccctgtgcagctgctgtaccctgtgagccgcttcagcaatgtgaagagcctgcagcacctgtgccgcttccgcatccggcagctggtgagaattgaccacatcccagacctgcccctgcccaagcccctcatctcctacatcaggaagttctactactatgacccccaggaggaggtgtacctgagcctgaaggaggcccagctgatcagcaagcagaagcaggaggtggagcccagcacctag

SEQ ID NO: 38641 - DNA, 1746 bp, Artificial Sequence; identical to SEQ ID NO: 38640
  Description of Artificial Sequence: Synthetic coding sequence

SEQ ID NO: 38642 - DNA, 2169 bp, Artificial Sequence
  Description of Artificial Sequence: Synthetic coding sequence
atgggccggggcccctgggatgctggccccagccggcggctgctgcccctgctgctgctgctgggcctggcccggggagctgctggggcccctggcccagatggcctggatgtgtgtgccacctgccatgaacatgccacctgccagcagcgggagggcaagaagatctgcatctgcaactacggctttgtgggcaatggccgcacccagtgtgtggacaagaatgaatgccagtttggagccaccctggtgtgtggcaaccacaccagctgccacaacaccccaggcggcttctactgcatctgcctggagggctaccgggccaccaacaacaacaagaccttcatccccaatgatggcaccttctgcacagacattgatgaatgtgaggtgtctggcctgtgcagacatggaggccgctgtgtgaacacccacggcagctttgagtgctactgcatggatggctacctgcccagaaatggacctgagcccttccaccccaccacagatgccaccagctgcacagaaattgactgtggcaccccacctgaggtgcctgatggctacatcatcggcaactacaccagcagcctgggcagccaggtgcgctatgcctgccgggagggcttcttctctgtgcctgaagatactgtgagcagctgcaccggcctgggcacctgggagagccccaagctgcactgccaggagatcaactgtggcaaccccccagagatgagacatgccatcctggtgggcaaccacagcagccggctgggcggcgtggcccgctacgtgtgccaggagggctttgagagccctgggggcaagatcacctctgtgtgcacagagaagggcacctggagggagagcaccctgacctgcacagagatcctgaccaagatcaatgatgtgtccctcttcaatgacacctgtgtgcgctggcagatcaacagccgccgcatcaaccccaagatctcctatgtgatcagcatcaagggccagaggctggaccccatggagagcgtgcgggaggagaccgtgaacctgaccacagacagcaggaccccagaggtgtgcctggccctgtacccaggcaccaactacacagtgaacatcagcacagccccaccccggcgctccatgcctgctgtgattggcttccagacagctgaggtggacctgctggaggatgatggcagcttcaacatcagcatcttcaatgagacctgcctgaagctgaacagaagaagcaggaaggtgggcagcgagcacatgtaccagttcaccgtgctgggccagcgctggtacctggccaacttcagccacgccaccagcttcaacttcaccacccgggagcaggtgcctgtggtgtgcctggacctgtaccccaccacagactacacagtgaatgtgaccctgctgcggagccccaagaggcacagcgtgcagatcaccatcgccaccccacctgctgtgaagcagaccatcagcaacatcagcggcttcaatgagacctgcctgcgctggaggagcatcaagacagctgacatggaggagatgtacctgttccacatctggggccagcgctggtaccagaaggagtttgcccaggagatgaccttcaacatcagcagcagcagccgggaccctgaggtgtgcctggacctgcggcccggcaccaactacaacgtgtccctgcgggccctgagcagcgagctgcctgtggtgatcagcctgaccacccagatcacagagccccccctgcctgaggtggagttcttcaccgtgcaccggggccccctgccccggctgcggctgaggaaggccaaggagaagaatggccccatcagcagctaccaggtgctggtgctgcccctggccctgcagagcaccttcagctgtgacagcgagggcgccagcagcttcttcagcaatgccagtgatgctgatggctacgtggccgctgagctgctggccaaggatgtgcctgatgatgccatggagatccccatcggggaccggctgtactatggagagtactacaatgcccccctgaagaggggcagtgactactgcatcatcctgcgcatcaccagcgagtggaacaagatccgccacagctgctgctgccgctggagggtgctggactgggtgccctggctgctgtag

SEQ ID NO: 38643 - DNA, 2274 bp, Artificial Sequence
  Description of Artificial Sequence: Synthetic coding sequence
atgggccggggcccctgggatgctggccccagccggcggctgctgcccctgctgctgctgctgggcctggcccggggagctgctggggcccctggcccagatggcctggatgtgtgtgccacctgccatgaacatgccacctgccagcagcgggagggcaagaagatctgcatctgcaactacggctttgtgggcaatggccgcacccagtgtgtggacaagaatgaatgccagtttggagccaccctggtgtgtggcaaccacaccagctgccacaacaccccaggcggcttctactgcatctgcctggagggctaccgggccaccaacaacaacaagaccttcatccccaatgatggcaccttctgcacagacattgatgaatgtgaggtgtctggcctgtgcagacatggaggccgctgtgtgaacacccacggcagctttgagtgctactgcatggatggctacctgcccagaaatggacctgagcccttccaccccaccacagatgccaccagctgcacagaaattgactgtggcaccccacctgaggtgcctgatggctacatcatcggcaactacaccagcagcctgggcagccaggtgcgctatgcctgccgggagggcttcttctctgtgcctgaagatactgtgagcagctgcaccggcctgggcacctgggagagccccaagctgcactgccaggagatcaactgtggcaaccccccagagatgagacatgccatcctggtgggcaaccacagcagccggctgggcggcgtggcccgctacgtgtgccaggagggctttgagagccctgggggcaagatcacctctgtgtgcacagagaagggcacctggagggagagcaccctgacctgcacagagatcctgaccaagatcaatgatgtgtccctcttcaatgacacctgtgtgcgctggcagatcaacagccgccgcatcaaccccaagatctcctatgtgatcagcatcaagggccagaggctggaccccatggagagcgtgcgggaggagaccgtgaacctgaccacagacagcaggaccccagaggtgtgcctggccctgtacccaggcaccaactacacagtgaacatcagcacagccccaccccggcgctccatgcctgctgtgattggcttccagacagctgaggtggacctgctggaggatgatggcagcttcaacatcagcatcttcaatgagacctgcctgaagctgaacagaagaagcaggaaggtgggcagcgagcacatgtaccagttcaccgtgctgggccagcgctggtacctggccaacttcagccacgccaccagcttcaacttcaccacccgggagcaggtgcctgtggtgtgcctggacctgtaccccaccacagactacacagtgaatgtgaccctgctgcggagccccaagaggcacagcgtgcagatcaccatcgccaccccacctgctgtgaagcagaccatcagcaacatcagcggcttcaatgagacctgcctgcgctggaggagcatcaagacagctgacatggaggagatgtacctgttccacatctggggccagcgctggtaccagaaggagtttgcccaggagatgaccttcaacatcagcagcagcagccgggaccctgaggtgtgcctggacctgcggcccggcaccaactacaacgtgtccctgcgggccctgagcagcgagctgcctgtggtgatcagcctgaccacccagatcacagagccccccctgcctgaggtggagttcttcaccgtgcaccggggccccctgccccggctgcggctgaggaaggccaaggagaagaatggccccatcagcagctaccaggtgctggtgctgcccctggccctgcagagcaccttcagctgtgacagcgagggcgccagcagcttcttcagcaatgccagtgatgctgatggctacgtggccgctgagctgctggccaaggatgtgcctgatgatgccatggagatccccatcggggaccggctgtactatggagagtactacaatgcccccctgaagaggggcagtgactactgcatcatcctgcgcatcaccagcgagtggaacaaggtgagaagacacagctgtgctgtgtgggcccaggtgaaggagatcccctgcaactgcaacttcctgcggctgcacatccaccgggccaacagcggggacacccagatccgccacagctgctgctgccgctggagggtgctggactgggtgccctggctgctgtag

SEQ ID NO: 38644 - DNA, 2244 bp, Artificial Sequence
  Description of Artificial Sequence: Synthetic coding sequence
atgggccggggcccctgggatgctggccccagccggcggctgctgcccctgctgctgctgctgggcctggcccggggagctgctggggcccctggcccagatggcctggatgtgtgtgccacctgccatgaacatgccacctgccagcagcgggagggcaagaagatctgcatctgcaactacggctttgtgggcaatggccgcacccagtgtgtggacaagaatgaatgccagtttggagccaccctggtgtgtggcaaccacaccagctgccacaacaccccaggcggcttctactgcatctgcctggagggctaccgggccaccaacaacaacaagaccttcatccccaatgatggcaccttctgcacagacattgatgaatgtgaggtgtctggcctgtgcagacatggaggccgctgtgtgaacacccacggcagctttgagtgctactgcatggatggctacctgcccagaaatggacctgagcccttccaccccaccacagatgccaccagctgcacagaaattgactgtggcaccccacctgaggtgcctgatggctacatcatcggcaactacaccagcagcctgggcagccaggtgcgctatgcctgccgggagggcttcttctctgtgcctgaagatactgtgagcagctgcaccggcctgggcacctgggagagccccaagctgcactgccaggagatcaactgtggcaaccccccagagatgagacatgccatcctggtgggcaaccacagcagccggctgggcggcgtggcccgctacgtgtgccaggagggctttgagagccctgggggcaagatcacctctgtgtgcacagagaagggcacctggagggagagcaccctgacctgcacagagatcctgaccaagatcaatgatgtgtccctcttcaatgacacctgtgtgcgctggcagatcaacagccgccgcatcaaccccaagatctcctatgtgatcagcatcaagggccagaggctggaccccatggagagcgtgcgggaggagaccgtgaacctgaccacagacagcaggaccccagaggtgtgcctggccctgtacccaggcaccaactacacagtgaacatcagcacagccccaccccggcgctccatgcctgctgtgattggcttccagacagctgaggtggacctgctggaggatgatggcagcttcaacatcagcatcttcaatgagacctgcctgaagctgaacagaagaagcaggaaggtgggcagcgagcacatgtaccagttcaccgtgctgggccagcgctggtacctggccaacttcagccacgccaccagcttcaacttcaccacccgggagcaggtgcctgtggtgtgcctggacctgtaccccaccacagactacacagtgaatgtgaccctgctgcggagccccaagaggcacagcgtgcagatcaccatcgccaccccacctgctgtgaagcagaccatcagcaacatcagcggcttcaatgagacctgcctgcgctggaggagcatcaagacagctgacatggaggagatgtacctgttccacatctggggccagcgctggtaccagaaggagtttgcccaggagatgaccttcaacatcagcagcagcagccgggaccctgaggtgtgcctggacctgcggcccggcaccaactacaacgtgtccctgcgggccctgagcagcgagctgcctgtggtgatcagcctgaccacccagatcacagagccccccctgcctgaggtggagttcttcaccgtgcaccggggccccctgccccggctgcggctgaggaaggccaaggagaagaatggccccatcagcagctaccaggtgctggtgctgcccctggccctgcagagcaccttcagctgtgacagcgagggcgccagcagcttcttcagcaatgccagtgatgctgatggctacgtggccgctgagctgctggccaaggatgtgcctgatgatgccatggagatccccatcggggaccggctgtactatggagagtactacaatgcccccctgaagaggggcagtgactactgcatcatcctgcgcatcaccagcgagtggaacaaggtgagaagacacagctgtgctgtgtgggcccaggtgaaggacagcagcctgatgctgctgcagatggccggcgtgggcctgggcagcctggccgtggtgatcatcctgaccttcctgtccttctctgctgtgtag

SEQ ID NO: 38645 - DNA, 2469 bp, Artificial Sequence
  Description of Artificial Sequence: Synthetic coding sequence
atgaagccagccctgctgccctgggccctgctgctgctggccacagccctgggccctggccctggccccacagcagatgcccaggagagctgcagcatgagatgtggggccctggatggcccctgcagctgccaccccacctgcagcggcctgggcacctgctgcctggacttccgggacttctgcctggagatcctgccctacagcggctccatgatgggcggcaaggactttgtggtgcgccacttcaagatgagcagccccacagatgccagcgtcatctgccgcttcaaggacagcatccagaccctgggccacgtggacagcagcggccaggtgcactgtgtgagccccctgctgtatgaaagtggccgcatccccttcaccgtgtccctggacaatggccacagcttccccagggctggcacctggctggccgtgcaccccaacaaggtgtccatgatggagaagtctgagctggtgaatgagacccgctggcagtactatggaacagccaacaccagcggcaacctgagcctgacctggcacgtgaagagcctgcccacccagaccatcaccatcgagctgtggggctatgaggagaccggcatgccctacagccaggagtggacagccaagtggagctacctgtaccccctggccacccacatccccaacagcggcagcttcaccttcacccccaagccagccccacccagctaccagcgctggagggtgggcgccctgcgcatcatcgacagcaagaactatgccggccagaaggatgtgcaggccctgtggaccaatgaccacgccctggcctggcacctgagtgatgacttcagagaagatcctgtggcctgggcccggacccagtgccaggcctgggaggagctggaggaccagctgcccaacttcctggaggagctgcctgactgcccctgcaccctgacccaggcccgggctgacagcggccgcttcttcacagattatggctgtgacatggagcagggctctgtgtgcacctaccaccctggagctgtgcactgtgtgcgctctgtgcaggccagcctgcgctatggcagcggccagcagtgctgctacacagcagatggcacccagctgctgacagctgacagcagcggcggcagcaccccagaccggggccatgactggggcgccccacccttccgcaccccaccccgggtgcccagcatgagccactggctgtatgatgtgctgtccttctactactgctgcctgtgggccccagactgcccccgctacatgcagaggcggcccagcaatgactgcaggaactacagaccaccccggctggccagcgccttcggggacccccactttgtgacctttgatggcaccaacttcaccttcaacggccgcggggagtatgtgctgctggaggccgccctgacagacctgcgggtgcaggcccgggcccagcccggcaccatgagcaatggaacagagacccggggcaccggcctgacagctgtggccgtgcaggagggcaacagtgatgtggtggaggtgcggctggccaacagaactggaggcctggaggtgctgctgaaccaggaggtgctgtccttcacagagcagagctggatggacctgaagggcatgttcctgtctgtggccgccggggacagagtgtccatcatgctggccagcggggccggcctggaggtgtctgtgcagggccccttcctgtctgtgtctgtgctgctgcctgagaagttcctgacccacacccacggcctgctgggcaccctgaacaatgaccccacagatgacttcaccctgcacagcggccgggtgctgcccccaggcaccagcccccaggagctgttcctgtttggagccaactggacagtgcacaatgccagcagcctgctgacctatgacagctggttcctggtgcacaacttcctgtaccagcccaagcatgaccccacctttgagcccctcttccccagcgagaccaccctgaaccccagcctggcccaggaggccgccaagctgtgtggagatgaccacttctgcaactttgatgtggccgccaccggcagcctgagcactggaacagccaccagggtggcccaccagctgcaccagaggaggatgcagagcctgcagcctgtggtgtcctgtggctggctggcccctcctccaaatggccagaaggagggcaaccgctacctggccggcagcaccatctacttccactgtgacaatggctacagcctggccggggctgagaccagcacctgccaggctgatggcacctggagcagccccacccccaagtgccagcccggccgctcctatgctgtgctgctgggcatcatctttggaggcctggccgtggtggccgctgtggccctggtgtatgtgctgctgcggcggaggaagggcaacacccacgtgtggggcgcccagccctag

SEQ ID NO: 38646 - DNA, 729 bp, Artificial Sequence
  Description of Artificial Sequence: Synthetic coding sequence
atgaagaacatcggcctggtgatggagtgggagatccctgagatcatctgcacctgtgccaagctgcggctgcccccccaggccaccttccaggtgctgcggggaaatggagcctctgtgggcaccgtgctgatgttccgctgccccagcaaccaccagatggtgggcagcggcctgctgacctgcacctggaagggcagcattgctgagtggagcagcggcagccctgtgtgcaagctggtgccccctcatgagaccttcggcttcaaggtggccgtcatcgccagcatcgtgtcctgtgccatcatcctgctgatgtccatggccttcctgacctgctgcctgctgaagtgtgtgaagaagagcaagagaagaagaagcaacagaagtgcccagctgtggagccagctgaaggatgaggacctggagaccgtgcaggccgcctacctgggcctgaagcacttcaacaagcctgtgtctggccccagccaggcccatgacaaccacagcttcaccacagaccatggagagagcaccagcaagctggcctctgtgaccaggtctgtggacaaggaccccggcatcccccgggccctgagcctgagcggcagcagcagcagcccccaggcccaggtgatggtgcacatggccaacccccggcagcccctgcctgccagcggcctggccaccggcatgccccagcagcctgctgcctatgccctgggctag

SEQ ID NO: 38647 - DNA, 768 bp, Artificial Sequence
  Description of Artificial Sequence: Synthetic coding sequence
atgcgctgggccgccgccaccctgcggggcaaggcccggccccggggccgggccggcgtgaccaccccagcccctggcaacagaacaggcacctgtgccaagctgcggctgcccccccaggccaccttccaggtgctgcggggaaatggagcctctgtgggcaccgtgctgatgttccgctgccccagcaaccaccagatggtgggcagcggcctgctgacctgcacctggaagggcagcattgctgagtggagcagcggcagccctgtgtgcaagctggtgccccctcatgagaccttcggcttcaaggtggccgtgattgccagcatcgtgtcctgtgccatcatcctgctgatgtccatggccttcctgacctgctgcctgctgaagtgtgtgaagaagagcaagagaagaagaagcaacagaagtgcccagctgtggagccagctgaaggatgaggacctggagaccgtgcaggccgcctacctgggcctgaagcacttcaacaagcctgtgtctggccccagccaggcccatgacaaccacagcttcaccacagaccacggggagagcaccagcaagctggcctctgtgaccaggtctgtggacaaggaccccggcatcccccgggccctgagcctgagcggcagcagcagcagcccccaggcccaggtgatggtgcacatggccaacccccggcagcccctgcctgccagcggcctggccaccggcatgccccagcagcctgctgcctatgccctgggctag

SEQ ID NO: 38648 - DNA, 711 bp, Artificial Sequence
  Description of Artificial Sequence: Synthetic coding sequence
atgtaccacggcatgaaccccagcaatggagatggcttcctggagcagcagcagcagcagcagcagccccagagcccccagaggctgctggccgtcatcctgtggttccagctggccctgtgcttcggccctgcccagctgaccggcggctttgatgacctgcaggtgtgtgccgaccccggcatcccagaaaatggcttccgcaccccatctggaggagtcttctttgagggctctgtggcccgcttccactgccaggacggcttcaagctgaagggggccaccaagaggctgtgcctgaagcacttcaacggcaccctgggctggatccccagcgacaacagcatctgtgtgcaggaggactgccgcatcccccagattgaagatgctgagatccacaacaagacctacagacatggagagaagctgatcatcacctgccacgagggcttcaagatccgctacccagacctgcacaacatggtgtccctgtgcagagatgatggcacctggaacaacctgcccatctgccagggctgcctgcggcccctggccccccagcacaccccagcccagggcaccaggacccaggcccagggcagccagaagcctgtgacagccagccaggccctgctgagctgcagcaaggtgtgcatccacctgcccggggccaagagggcccccaccctgctgcggaccaccctgacctag

SEQ ID NO: 38649 - DNA, 321 bp, Artificial Sequence
  Description of Artificial Sequence: Synthetic coding sequence
atgtaccacggcatgaaccccagcaatggagatggcttcctggagcagcagcagcagcagcagcagccccagagcccccagaggctgctggccgtcatcctgtggttccagctggccctgtgcttcggccctgcccagctgactggagtgcacctgacccgggacctgctgggctttgagggctgcccagagtgccccccacctcctggcttcaaggaggagagccaggagtttgcccagcaggtgacccccctgcggagcctgacccacgccaacccctggagcagcggccccctgtgcatccccaagtcctggagctag

SEQ ID NO: 38650 - DNA, 1473 bp, Artificial Sequence
  Description of Artificial Sequence: Synthetic coding sequence
atgtaccacggcatgaaccccagcaatggagatggcttcctggagcagcagcagcagcagcagcagccccagagcccccagaggctgctggccgtcatcctgtggttccagctggccctgtgcttcggccctgcccagctgaccggcggctttgatgacctgcaggtgtgtgccgaccccggcatcccagaaaatggcttccgcaccccatctggaggagtcttctttgagggctctgtggcccgcttccactgccaggacggcttcaagctgaagggggccaccaagaggctgtgcctgaagcacttcaacggcaccctgggctggatccccagcgacaacagcatctgtgtgcaggaggactgccgcatcccccagattgaagatgctgagatccacaacaagacctacagacatggagagaagctgatcatcacctgccacgagggcttcaagatccgctacccagacctgcacaacatggtgtccctgtgcagagatgatggcacctggaacaacctgcccatctgccagggctgcctgcggcccctggccagcagcaatggctacgtgaacatcagcgagctgcagaccagcttccctgtgggcaccgtcatctcctaccgctgcttccctggcttcaagctggatggcagcgcctacctggagtgcctgcagaacctgatctggagcagcagccccccacgctgcctggccctggaggtgtgccccctgccccccatggtgtcccatggagactttgtgtgccacccccggccctgtgagcgctacaaccacggcaccgtggtggagttctactgtgaccccggctacagcctgaccagtgactacaagtacatcacctgccagtatggagagtggttccccagctaccaggtgtactgcatcaagtctgagcagacctggcccagcacccatgagaccctgctgaccacctggaagatcgtggccttcaccgccacctctgtgctgctggtgctgctgctggtgatcctggccaggatgttccagaccaagttcaaggcccacttccccccccggggcccccccaggagcagcagcagtgaccctgactttgtggtggtggatggagtgcctgtgatgctgcccagctatgatgaggccgtgtctgggggcctgagcgccctgggccctggctacatggcctctgtgggccagggctgccccctgcctgtggatgaccagagccccccagcctacccaggcagcggggacacagacaccggccctggagagagcgagacctgtgacagcgtgtctggcagcagcgagctgctgcagagcctgtacagccccccacgctgccaggagagcacccacccagccagtgacaacccagacatcatcgccagcacagctgaggaggtggccagcaccagccctggcattgatattgctgatgagatccccctgatggaggaggacccctag

SEQ ID NO: 38651 - DNA, 873 bp, Artificial Sequence
  Description of Artificial Sequence: Synthetic coding sequence
atgtaccacggcatgaaccccagcaatggagatggcttcctggagcagcagcagcagcagcagcagccccagagcccccagaggctgctggccgtcatcctgtggttccagctggccctgtgcttcggccctgcccagctgaccggcggctttgatgacctgcaggtgtgtgccgaccccggcatcccagaaaatggcttccgcaccccatctggaggagtcttctttgagggctctgtggcccgcttccactgccaggacggcttcaagctgaagggggccaccaagaggctgtgcctgaagcacttcaacggcaccctgggctggatccccagcgacaacagcatctgtgtgcaggaggactgccgcatcccccagattgaagatgctgagatccacaacaagacctacagacatggagagaagctgatcatcacctgccacgagggcttcaagatccgctacccagacctgcacaacatggtgtccctgtgcagagatgatggcacctggaacaacctgcccatctgccagggctgcctgcggcccctggccagcagcaatggctacgtgaacatcagcgagctgcagaccagcttccctgtgggcaccgtcatctcctaccgctgcttccctggcttcaagctggatggcagcgcctacctggagtgcctgcagaacctgatctggagcagcagccccccacgctgcctggccctggagggcggccggcctgagcacctgtttcctgtgctgtacttcccccacatccggctggccgctgctgtgctgtacttctgccctgtgctgaagagcagccccaccccagcccccacctgcagcagcaccagcaccaccaccagcctcttctag

SEQ ID NO: 38652 - DNA, 321 bp, Artificial Sequence; identical to SEQ ID NO: 38649
  Description of Artificial Sequence: Synthetic coding sequence

SEQ ID NO: 38653 - DNA, 1473 bp, Artificial Sequence; identical to SEQ ID NO: 38650
  Description of Artificial Sequence: Synthetic coding sequence

SEQ ID NO: 38654 - DNA, 993 bp, Artificial Sequence
  Description of Artificial Sequence: Synthetic coding sequence
atggtgtccctgtgcagagatgatggcacctggaacaacctgcccatctgccagggctgcctgcggcccctggccagcagcaatggctacgtgaacatcagcgagctgcagaccagcttccctgtgggcaccgtcatctcctaccgctgcttccctggcttcaagctggatggcagcgcctacctggagtgcctgcagaacctgatctggagcagcagccccccacgctgcctggccctggaggtgtgccccctgccccccatggtgtcccatggagactttgtgtgccacccccggccctgtgagcgctacaaccacggcaccgtggtggagttctactgtgaccccggctacagcctgaccagtgactacaagtacatcacctgccagtatggagagtggttccccagctaccaggtgtactgcatcaagtctgagcagacctggcccagcacccatgagaccctgctgaccacctggaagatcgtggccttcaccgccacctctgtgctgctggtgctgctgctggtgatcctggccaggatgttccagaccaagttcaaggcccacttccccccccggggcccccccaggagcagcagcagtgaccctgactttgtggtggtggatggagtgcctgtgatgctgcccagctatgatgaggccgtgtctgggggcctgagcgccctgggccctggctacatggcctctgtgggccagggctgccccctgcctgtggatgaccagagccccccagcctacccaggcagcggggacacagacaccggccctggagagagcgagacctgtgacagcgtgtctggcagcagcgagctgctgcagagcctgtacagccccccacgctgccaggagagcacccacccagccagtgacaacccagacatcatcgccagcacagctgaggaggtggccagcaccagccctggcattgatattgctgatgagatccccctgatggaggaggacccctag

SEQ ID NO: 38655 - DNA, 1266 bp, Artificial Sequence
  Description of Artificial Sequence: Synthetic coding sequence
atgtaccacggcatgaaccccagcaatggagatggcttcctggagcagcagcagcagcagcagcagccccagagcccccagaggctgctggccgtcatcctgtggttccagctggccctgtgcttcggccctgcccagctgaccggggactgccgcatcccccagattgaagatgctgagatccacaacaagacctaccgccacggggagaagctgatcatcacctgccacgagggcttcaagatccgctacccagacctgcacaacatggtgtccctgtgcagagatgatggcacctggaacaacctgcccatctgccagggctgcctgcggcccctggccagcagcaatggctacgtgaacatcagcgagctgcagaccagcttccctgtgggcaccgtcatctcctaccgctgcttccctggcttcaagctggatggcagcgcctacctggagtgcctgcagaacctgatctggagcagcagccccccacgctgcctggccctggaggcccaggtgtgccccctgccccccatggtgagccacggggactttgtgtgccacccccggccctgtgagcgctacaaccacggcaccgtggtggagttctactgtgaccccggctacagcctgaccagtgactacaagtacatcacctgccagtacggggagtggttccccagctaccaggtgtactgcatcaagtctgagcagacctggcccagcacccatgagaccctgctgaccacctggaagatcgtggccttcaccgccacctctgtgctgctggtgctgctgctggtgatcctggccaggatgttccagaccaagttcaaggcccacttccccccccggggccccccaagaagcagcagcagtgaccctgactttgtggtggtggatggagtgcctgtgatgctgcccagctatgatgaagctgtgtctgggggcctgagcgccctgggccctggctacatggcctctgtgggccagggctgccccctgcctgtggatgaccagagccccccagcctacccaggcagcggggacacagacaccggccctggagagagcgagacctgtgacagcgtgtctggcagcagcgagctgctgcagagcctgtacagccccccacgctgccaggagagcacccacccagccagtgacaacccagacatcatcgccagcacagctgaggaggtggccagcaccagccctggcatcgacattgctgatgagatccccctgatggaggaggacccctag

SEQ ID NO: 38656 - DNA, 1890 bp, Artificial Sequence
  Description of Artificial Sequence: Synthetic coding sequence
atgacagctgagggccccagccccccagcccgctggcaccggcggctgcccggcctgtgggccgccgccctgctgctgctgggcctgccccggctgtctgtgcgggcagatggcaagttctttgtgctggagagccagaatggcagccagggcctgcagctggaggccgcccggctgagctgcaagagcagaggagcccacctggccagcgcagatgagctgcggcgggtggtgcaggactgcagctttgctgtgtgcaccaccggctggctggctgatggcaccctgggcaccaccgtgtgcagcaaaggaagtggagagcagcagatcatgagagctgtggatgtgcgcatcgagagcaaccctgtgcctgggggcacctacagcgccctgtgcatcaaggatgaggagaagccctgtggggaccccccatccttcccccacaccatcctgcagggccgcacaggcctggagatgggagatgagctgctgtatgtgtgtgcccctggccacatcatgggccaccgggagacagccttcaccctgctgtgcaacagctgtggggagtggtacggcctggtgcaggcctgtgggaaggatgaggccgaggcccacatcgactatgaggacaacttcccagatgacagatctgtgtccttccgggagctgatggaggacagcaggacagaagcagatgaagatcggggccagggcgacagcagcgaggaggcccccaagcaggaccggctggtgtccatctctgtgggccgggagaacatcgcccgggacaaggtgtttgtgcccaccaccggcctgcctggagctggcagctctgtgcctgctgacagccctggcagccggctgctgcagaagcacctgttctggttccctgctgaggccttccacaagccaggcctggagaaggaggtggatgatgacaccaagaagcagttctctgctggggacaaccacagcggcgtgaagctggtgcctggagagcctgagaccaaggtgatctacggcaacacagatggccccagcggcccctttgtgggcaagaatgacagcaaggccggggaccctgtggtgagcagcagtgatgagagctggctggatggctaccctgtgacagaaggagcctggaggaagacagaggccgaggaggaggaggatggagacagaggagatggctctgtgggcctggatgaaaatgtgctggtgaccccagaccagcccatcctggtggaggtgaagaagcccaagagcagcaccctgacccccagcgagggcatgacccacagctctgtgctgcccagccagatgctggatgtggaggccctggccctgcggcctgtgaatgccagcgagacagagggcattggagatggagacctgaccaagtaccagagcaccctgccctggaggttcatcacagaggagagccccatggccaccctgtcctatgagctgaccagcagcaccctggagatcctgactgtgaacacagtgaagcagacccccaaccacatccccagcaccatcatggccaccacccagccccctgtggagaccaccgtgcctgagatccaggacagcttcccctacctgctgtctgaggacttcttcggccaggagggccctggccctggggccagcgaggagctgcaccccaccctggagagctgtgtgggagatggctgccccggcctgagccggggccctgtgattgccaccatcgtgacagtgctgtgcctgctgctgctgctggccggcgtgggcatggtgtggggctacaggaagtgccagcacaagagctctgtgtacaagctgaatgtgggccagaggcaggcccggcactaccaccagcagatcgagatggagaaggtgtag

SEQ ID NO: 38657 - DNA, 3825 bp, Artificial Sequence
  Description of Artificial Sequence: Synthetic coding sequence
atggccagcggcagcggggacagcgtgaccaggagatctgtggccagccagttcttcacccaggaggagggccctggcattgatggcatgaccaccagcgagcgggtggtggacctgctgaaccaggccgccctgatcaccaatgacagcaagatcaccgtgctgaagcaggtgcaggagctgatcatcaacaaggaccccaccctgctggacaacttcctggatgagatcatcgccttccaggccgacaagagcattgaggtgaggaagtttgtgattggcttcatcgaggaggcctgcaagagggacatcgagctgctgctgaagctgattgccaacctgaacatgctgctgagagatgaaaatgtgaatgtggtgaagaaggccatcctgaccatgacccagctgtacaaggtggccctgcagtggatggtgaagagcagggtcatcagcgagctgcaggaggcctgctgggacatggtgtctgccatggccggggacatcatcctgctgctggacagcgacaatgatggcatccgcacccacgccatcaagtttgtggagggcctgattgtgaccctgagccccaggatggctgacagcgagatcccccggcggcaggagcatgacatcagcctggaccgcatcccccgggaccacccctacatccagtacaacgtgctgtgggaggagggcaaggccgccctggagcagctgctgaagttcatggtgcacccagccatcagcagcatcaacctgaccacagccctgggcagcctggccaacatcgcccggcagaggcccatgttcatgtctgaggtgatccaggcctatgagaccctgcacgccaacctgccccccaccctggccaagagccaggtgtcctctgtgaggaagaacctgaagctgcacctgctgtctgtgctgaagcacccagccagcctggagttccaggcccagatcaccaccctgctggtggacctgggcaccccccaggccgagatcgccaggaacatgcccagcagcaaggacaccaggaagaggcccagagatgacagcgacagcaccctgaagaagatgaagctggagcccaacctgggggaggatgatgaggacaaggacctggagcccggccccagcggcaccagcaaggccagcgcccagatcagcggccagagcgacacagacatcacagctgagttcctgcagcccctgctgaccccagacaacgtggccaacctggtgctgatctccatggtgtacctgcctgaggccatgcctgccagcttccaggccatctacacccctgtggagagcgctggaacagaggcccagatcaagcacctggcccggctgatggccacccagatgacagctgctggcctgggccctggggtggagcagaccaagcagtgcaaggaggagcccaaggaggagaaggtggtgaagacagagagcgtgctgatcaagaggcggctgagcgcccagggccaggccatctctgtggtgggcagcctgagctccatgagccccctggaggaggaggccccccaggccaagagaagacctgagcccatcatccctgtgacccagccccggctggccggggccggcggcaggaagaagatcttccggctgagtgatgtgctgaagcccctgacagatgcccaggtggaggccatgaagctgggcgctgtgaagaggatcctgcgggcagagaaggctgtggcctgcagcggggccgcccaggtgcgcatcaagatcctggccagcctggtgacccagttcaacagcggcctgaaggccgaggtgctgtccttcatcctggaggatgtgcgggcccggctggacctggcctttgcctggctgtaccaggagtacaatgcctacctggccgccggggccagcggcagcctggacaagtatgaggactgcctgatccggctgctgagcggcctgcaggagaagccagaccagaaggatggcatcttcaccaaggtggtgctggaggcccccctcatcacagaaagtgccctggaggtggtgaggaagtactgtgaagatgagagcaggacctacctgggcatgagcaccctgcgggacctgatcttcaagaggcccagccggcagttccagtacctgcacgtgctgctggacctgagcagccatgagaaggacaaggtgcgcagccaggccctgctcttcatcaagaggatgtatgagaaggagcagctgcgggagtatgtggagaagtttgccctgaactacctgcagctgctggtgcaccccaaccccccatctgtgctgtttggagctgacaaggacacagaggtggccgccccctggacagaggagaccgtgaagcagtgcctgtacctgtacctggccctgctgccccagaaccacaagctgatccacgagctggccgctgtgtacacagaggccatcgctgacatcaagaggacagtgctgcgggtgattgagcagcccatccggggcatgggcatgaacagccctgagctgctgctgctggtggagaactgccccaagggagctgagaccctggtgacccgctgcctgcacagcctgacagacaaggtgccccccagccctgagctggtgaagagggtgcgggacctgtaccacaagaggctgcctgatgtgcgcttcctgatccctgtgctgaatggcctggagaagaaggaggtgatccaggccctgcccaagctgatcaagctgaaccccatcgtggtgaaggaggtgttcaaccggctgctgggcacccagcacggggagggcaacagcgccctgagccccctgaaccctggagagctgctgattgccctgcacaacatcgacagcgtgaagtgtgacatgaagagcatcatcaaggccaccaacctgtgctttgctgagagaaatgtgtacaccagcgaggtgctggccgtggtgatgcagcagctgatggagcagagccccctgcccatgctgctgatgaggacagtcatccagagcctgaccatgtacccccggctgggcggctttgtgatgaacatcctgagccgcctcatcatgaagcaggtgtggaagtaccccaaggtgtgggagggcttcatcaagtgctgccagaggaccaagccccagagcttccaggtgatcctgcagctgcccccccagcagctgggcgctgtgtttgataaatgtcctgagctgcgggagcccctgctggcccacgtgcgctccttcaccccccaccagcaggcccacatccccaacagcatcatgaccatcctggaggccagcggcaagcaggagcctgaggccaaggaggccccagctggccccctggaggaggatgacctggagcccctgaccctggccccagccccagccccccggcccccccaggacctgattggcctgcggctggcccaggagaaggccctgaagaggcagctggaggaggagcagaagctgaagccaggaggagtgggcgcccccagcagcagcagccccagccccagccccagcgcccggcccggccccccaccttctgaggaggccatggacttccgggaggagggcccagaatgtgagaccccaggcatcttcatctccatggatgatgattctggcctgacagaggccgccctgctggacagcagcctggagggccccctgcccaaggagacagctgctgggggcctgaccctgaaggaggagaggagcccccagaccctggcccctgtgggggaggatgccatgaagacccccagccctgctgctgaagatgcccgggagcctgaggccaagggcaacagctag

SEQ ID NO: 38658 - DNA, 465 bp, Artificial Sequence
  Description of Artificial Sequence: Synthetic coding sequence
ctgacagctgccatggccagcggcagcggggacagcgtgaccaggagatctgtggccagccagttcttcacccaggaggagggccctggcattgatggcatgaccaccagcgagcgggtggtggacctgctgaaccaggccgccctgatcaccaatgacagcaagatcaccgtgctgaagcaggtgcaggagctgatcatcaacaaggaccccaccctgctggacaacttcctggatgagatcatcgccttccaggccgacaagagcattgaggtgaggaagtttgtgattggcttcatcgaggaggcctgcaagagggacatcgagctgctgctgaagctgattgccaacctgaacatgctgctgagagatgaaaatgtgaatgtggtgaagaaggccatcctgaccatgacccagctgcctgtgcctgtgcctgcctgccccccccggccccagctgccctag

SEQ ID NO: 38659 - DNA, 3900 bp, Artificial Sequence
  Description of Artificial Sequence: Synthetic coding sequence
atgagccgcagccgggccagcatccaccggggcagcatcccagccatgtcctatgcccccttcagagatgtgcggggccccagcatgcacaggacccagtatgtgcacagcccctatgaccggcccggctggaacccccgcttctgcatcatcagcggcaaccagctgctgatgctggatgaagatgagatccaccccctgctgatccgggaccggcgctctgagagcagcaggaacaagctgctgcggaggacagtgtctgtgcctgtggagggccggccccatggagagcacgagtaccacctgggccgcagcaggaggaagtctgtgcctgggggcaagcagtacagcatggagggcgccccagctgcccccttccggcccagccagggcttcctgagccggcggctgaagagcagcatcaagaggaccaagagccagcccaagctggacaggaccagcagcttccggcagatcctgccccgcttccgctctgctgaccatgaccgggcccggctgatgcagagcttcaaggagagccacagccatgagagcctgctgagccccagcagcgctgctgaggccctggagctgaacctggatgaggacagcatcatcaagcctgtgcacagcagcatcctgggccaggagttctgctttgaggtgaccaccagcagcggcaccaagtgctttgcctgccgctctgctgctgagcgggacaagtggattgagaacctgcagagagctgtgaagcccaacaaggacaacagccggcgggtggacaacgtgctgaagctgtggatcatcgaggcccgggagctgccccccaagaagcgctactactgtgagctgtgcctggatgacatgctgtatgcccggaccaccagcaagcccaggtctgccagcggggacacagtgttctggggcgagcactttgagttcaacaacctgcctgctgtgcgggccctgcggctgcacctgtacagagacagcgacaagaagaggaagaaggacaaggccggctacgtgggcctggtgacagtgcctgtggccaccctggccggccgccacttcacagagcagtggtaccctgtgaccctgcccactggaagtggcggcagcggcggcatgggcagcggcggcggcggcggcagcggcggcggcagcggcggcaagggcaagggcggctgcccagctgtgcggctgaaggcccgctaccagaccatgagcatcctgcccatggagctgtacaaggagtttgctgaatatgtgaccaaccactacaggatgctgtgtgctgtgctggagcccgccctgaatgtgaagggcaaggaggaggtggccagcgccctggtgcacatcctgcagagcacaggcaaggccaaggacttcctgagtgacatggccatgtctgaggtggaccgcttcatggagcgggagcacctgatcttccgggagaacaccctggccaccaaggccatcgaggagtacatgaggctgattggccagaagtacctgaaggatgccatcggggagttcatccgggccctgtatgagagcgaggagaactgtgaggtggaccccatcaagtgcacagccagcagcctggccgagcaccaggccaacctgaggatgtgctgtgagctggccctgtgcaaggtggtgaacagccactgtgtgttcccccgggagctgaaggaggtgtttgcctcctggaggctgcgctgtgccgagcggggccgggaggacattgctgacaggctcatcagcgccagcctcttcctgcgcttcctgtgcccagccatcatgagccccagcctgtttggcctgatgcaggagtacccagatgagcagaccagcaggaccctgaccctcatcgccaaggtgatccagaacctggccaacttcagcaagttcaccagcaaagaagacttcctgggcttcatgaatgagttcctggagctggagtggggctccatgcagcagttcctgtatgagatcagcaacctggacaccctgaccaacagcagcagctttgagggctacatcgacctgggccgggagctgagcaccctgcacgccctgctgtgggaggtgctgccccagctgagcaaggaggccctgctgaagctgggccccctgccccggctgctgaatgacatcagcacagccctgaggaaccccaacatccagaggcagcccagccggcagagcgagcggccccggccccagcctgtggtgctgcggggccccagcgctgagatgcagggctacatgatgagggacctgaacagcagcattgacctgcagagcttcatggcccggggcctgaacagctccatggacatggcccggctgcccagccccaccaaggagaagcccccacctcctcctcctgggggcggcaaggacctcttctacgtgtccaggcctcccctggcccggagcagccctgcctactgcaccagcagcagtgacatcacagagcctgagcagaagatgctgtctgtgaacaagtctgtgtccatgctggacctgcagggagatggccctgggggccgcctgaacagcagctctgtgagcaacctggccgctgtgggggacctgctgcacagcagccaggccagcctgacagctgccctgggcctgcggcctgccccagctggccgcctgagccagggcagcggcagcagcatcacagctgctggcatgaggctgagccagatgggcgtgaccacagatggagtgcctgcccagcagctgcgcatccccctgtccttccagaaccccctcttccacatggccgcagatggccctggccccccaggcggccatggaggcggcggcggccacggcccccccagcagccaccaccaccaccaccaccaccaccaccaccggggcggggagcccccaggggacacctttgcccccttccacggctacagcaagtctgaggacctgagcagcggcgtgcccaagcccccagctgccagcatcctgcacagccacagctacagtgatgaatttggccccagcggcacagacttcacccggcggcagctgagcctgcaggacaacctgcagcacatgctgagccccccccagatcaccatcggcccccagaggcctgcccccagcggccctgggggcggcagcggcggcggcagcggcggcggcggcggcggccagcccccacccctgcagaggggcaagagccagcagctgactgtgtctgctgcccagaagccccggcccagcagcggcaacctgctgcagagccctgagcccagctatggccctgcccggccccggcagcagagcctgagcaaggagggcagcattggaggcagcggcggcagcggcggcggcggcggcggcggcctgaagcccagcatcaccaagcagcacagccagacccccagcaccctgaaccccaccatgcctgccagcgagaggacagtggcctgggtgagcaacatgccccacctgtctgctgacatcgagagcgcccacatcgagcgggaggagtacaagctgaaggagtacagcaagtccatggatgagagccggctggacagagtgaaggagtatgaggaggagatccacagcctgaaggagcggctgcacatgagcaacaggaagctggaggagtatgaaagaaggctgctgagccaggaggagcagaccagcaagatcctgatgcagtaccaggcccggctggagcagagcgagaagaggctgcggcagcagcaggccgagaaggacagccagatcaagagcatcatcggccgcctgatgctggtggaggaggagctgcggcgggaccacccagccatggccgagcccctgcctgagcccaagaagaggctgctggatgcccagctgctgatcagatag

SEQ ID NO: 38660 - DNA, 1464 bp, Artificial Sequence
  Description of Artificial Sequence: Synthetic coding sequence
gaagacttcctgggcttcatgaatgagttcctggagctggagtggggctccatgcagcagttcctgtatgagatcagcaacctggacaccctgaccaacagcagcagctttgagggctacatcgacctgggccgggagctgagcaccctgcacgccctgctgtgggaggtgctgccccagctgagcaaggaggccctgctgaagctgggccccctgccccggctgctgaatgacatcagcacagccctgaggaaccccaacatccagaggcagcccagccggcagagcgagcggccccggccccagcctgtggtgctgcggggccccagcgctgagatgcagggctacatgatgagggacctgaacagctccatggacatggcccggctgcccagccccaccaaggagaagcccccacctcctcctcctgggggcggcaaggacctcttctacgtgtccaggcctcccctggcccggagcagccctgcctactgcaccagcagcagtgacatcacagagcctgagcagaagatgctgtctgtgaacaagtctgtgtccatgctggacctgcagggagatggccctgggggccgcctgaacagcagctctgtgagcaacctggccgctgtgggggacctgctgcacagcagccaggccagcctgacagctgccctgggcctgcggcctgccccagctggccgcctgagccagggcagcggcagcagcatcacagctgctggcatgaggctgagccagatgggcgtgaccacagatggagtgcctgcccagcagctgcgcatccccctgtccttccagaaccccctcttccacatggccgcagatggccctggccccccaggcggccatggaggcggcggcggccacggcccccccagcagccaccaccaccaccaccaccaccaccaccaccggggcggggagcccccaggggacacctttgcccccttccacggctacagcaagtctgaggacctgagcagcggcgtgcccaagcccccagctgccagcatcctgcacagccacagctacagtgatgaatttggccccagcggcacagacttcacccggcggcagctgagcctgcaggacaacctgcagcacatgctgagccccccccagatcaccatcggcccccagaggcctgcccccagcggccctgggggcggcagcggcggcggcagcggcggcggcggcggcggccagcccccacccctgcagaggggcaagagccagcagctgactgtgtctgctgcccagaagccccggcccagcagcggcaacctgctgcagagccctgagcccagctatggccctgcccggccccggcagcagagcctgagcaaggagggcagcattggaggcagcggcggcagcggcggcggcggcggcggcggcctgaagcccagcatcaccaagcagcacagccagacccccagcacctag

SEQ ID NO: 38661 - DNA, 3900 bp, Artificial Sequence; identical to SEQ ID NO: 38659
  Description of Artificial Sequence: Synthetic coding sequence

SEQ ID NO: 38662 - DNA, 3855 bp, Artificial Sequence
  Description of Artificial Sequence: Synthetic coding sequence
atgggcctgcggccccccacccccagccccagcggcggcagctgcagcggcagcctgcccccacccagccgctgccagcccctgcggcggcgctgcagcagctgctgcttccctggagagtaccacctgggccgcagcaggaggaagtctgtgcctgggggcaagcagtacagcatggagggcgccccagctgcccccttccggcccagccagggcttcctgagccggcggctgaagagcagcatcaagaggaccaagagccagcccaagctggacaggaccagcagcttccggcagatcctgccccgcttccgctctgctgaccatgaccgggcccggctgatgcagagcttcaaggagagccacagccatgagagcctgctgagccccagcagcgctgctgaggccctggagctgaacctggatgaagattccatcatcaagcctgtgcacagcagcatcctgggccaggagttctgctttgaggtgaccaccagcagcggcaccaagtgctttgcctgccgctctgctgctgagcgggacaagtggattgagaacctgcagagagctgtgaagcccaacaaggacaacagcagaagagtggacaacgtgctgaagctgtggatcatcgaggcccgggagctgccccccaagaagcgctactactgtgagctgtgcctggatgacatgctgtatgcccggaccaccagcaagcccaggtctgccagcggggacaccgtcttctggggcgagcactttgagttcaacaacctgcctgctgtgcgggccctgcggctgcacctgtacagagacagcgacaagaagaggaagaaggacaaggccggctacgtgggcctggtgacagtgcctgtggccaccctggccggccgccacttcacagagcagtggtaccctgtgaccctgcccaccggcagcggcggcagcggcggcatgggcagcggcggcggcggcggcagcggcggcggcagcggcggcaaaggaaaaggaggctgcccagctgtgcggctgaaggcccgctaccagaccatgagcatcctgcccatggagctgtacaaggagtttgctgaatatgtgaccaaccactacaggatgctgtgtgctgtgctggagcccgccctgaatgtgaagggcaaggaggaggtggccagcgccctggtgcacatcctgcagagcacaggcaaggccaaggacttcctgagtgacatggccatgtctgaggtggaccgcttcatggagcgggagcacctgatcttccgggagaacaccctggccaccaaggccatcgaggagtacatgaggctcatcggccagaagtacctgaaggatgccatcggggagttcatccgggccctgtatgaaagtgaggagaactgtgaggtggaccccatcaagtgcacagccagcagcctggccgagcaccaggccaacctgaggatgtgctgtgagctggccctgtgcaaggtggtgaacagccactgtgtgttcccccgggagctgaaggaggtgtttgcctcctggaggctgcgctgtgccgagcggggcagagaagatattgctgacaggctcatcagcgccagcctcttcctgcgcttcctgtgcccagccatcatgagccccagcctgtttggcctgatgcaggagtacccagatgagcagaccagcaggaccctgaccctgattgccaaggtgatccagaacctggccaacttcagcaagttcaccagcaaggaggacttcctgggcttcatgaatgagttcctggagctggagtggggctccatgcagcagttcctgtatgagatcagcaacctggacaccctgaccaacagcagcagctttgagggctacatcgacctgggccgggagctgagcaccctgcacgccctgctgtgggaggtgctgccccagctgagcaaggaggccctgctgaagctgggccccctgccccggctgctgaatgacatcagcacagccctgaggaaccccaacatccagaggcagcccagccggcagagcgagcggccccggccccagcctgtggtgctgcggggccccagcgctgagatgcagggctacatgatgagggacctgaacagcagcattgacctgcagagcttcatggcccggggcctgaacagctccatggacatggcccggctgcccagccccaccaaggagaagcccccacctcctcctcctgggggcggcaaggacctcttctacgtgtcccggccccccctggcccggagcagccctgcctactgcaccagcagcagtgacatcacagagcctgagcagaagatgctgtctgtgaacaagtctgtgtccatgctggacctgcagggagatggccctgggggccgcctgaacagcagctctgtgagcaacctggccgctgtgggggacctgctgcacagcagccaggccagcctgacagctgccctgggcctgcggcctgccccagctggccgcctgagccagggcagcggcagcagcatcacagctgctggcatgaggctgagccagatgggcgtgaccacagatggagtgcctgcccagcagctgcgcatccccctgtccttccagaaccccctcttccacatggctgctgatggccctggccccccaggcggccacggcggcggcggcggccacggcccccccagcagccaccaccaccaccaccaccaccaccaccacagaggaggagagcccccaggggacacctttgcccccttccacggctacagcaagtctgaggacctgagcagtggagtgcccaagcccccagctgccagcatcctgcacagccacagctacagtgatgaatttggccccagcggcacagacttcacccggcggcagctgagcctgcaggacaacctgcagcacatgctgagccccccccagatcaccatcggcccccagaggcctgcccccagcggccctgggggcggcagcggcggcggcagcggcggcggcggcggcggccagcccccacccctgcagaggggcaagagccagcagctgactgtgtctgctgcccagaagccccggcccagcagcggcaacctgctgcagagccctgagcccagctatggccctgcccggccccggcagcagagcctgagcaaggagggcagcatcggcggcagcggcggcagcggcggcggcggcggcggcggcctgaagcccagcatcaccaagcagcacagccagacccccagcaccctgaaccccaccatgcctgccagcgagaggacagtggcctgggtgagcaacatgccccacctgtctgctgacattgaaagtgcccacatcgagcgggaggagtacaagctgaaggagtacagcaagtccatggatgagagccggctggacagagtgaaggagtatgaggaggagatccacagcctgaaggagcggctgcacatgagcaacaggaagctggaggagtatgaaagaaggctgctgagccaggaggagcagaccagcaagatcctgatgcagtaccaggcccggctggagcagagcgagaagaggctgcggcagcagcaggccgagaaggacagccagatcaagagcatcatcggccgcctgatgctggtggaggaggagctgcggcgggaccacccagccatggccgagcccctgcctgagcccaagaagaggctgctggatgcccaggagcggcagctgccccccctgggccccaccaacccccgggtgaccctggccccaccctggaatggcctggcccccccagcccctcctcctccaccccggctgcagatcacagaaaatggagagttcaggaacacagctgaccactag

SEQ ID NO: 38663 - DNA, 4032 bp, Artificial Sequence
  Description of Artificial Sequence: Synthetic coding sequence
atgagccgcagccgggccagcatccaccggggcagcatcccagccatgtcctatgcccccttcagagatgtgcggggccccagcatgcacaggacccagtatgtgcacagcccctatgaccggcccggctggaacccccgcttctgcatcatcagcggcaaccagctgctgatgctggatgaagatgagatccaccccctgctgatccgggaccggcgctctgagagcagcaggaacaagctgctgcggaggacagtgtctgtgcctgtggagggccggccccatggagagcacgagtaccacctgggccgcagcaggaggaagtctgtgcctgggggcaagcagtacagcatggagggcgccccagctgcccccttccggcccagccagggcttcctgagccggcggctgaagagcagcatcaagaggaccaagagccagcccaagctggacaggaccagcagcttccggcagatcctgccccgcttccgctctgctgaccatgaccgggcccggctgatgcagagcttcaaggagagccacagccatgagagcctgctgagccccagcagcgctgctgaggccctggagctgaacctggatgaggacagcatcatcaagcctgtgcacagcagcatcctgggccaggagttctgctttgaggtgaccaccagcagcggcaccaagtgctttgcctgccgctctgctgctgagcgggacaagtggattgagaacctgcagagagctgtgaagcccaacaaggacaacagccggcgggtggacaacgtgctgaagctgtggatcatcgaggcccgggagctgccccccaagaagcgctactactgtgagctgtgcctggatgacatgctgtatgcccggaccaccagcaagcccaggtctgccagcggggacacagtgttctggggcgagcactttgagttcaacaacctgcctgctgtgcgggccctgcggctgcacctgtacagagacagcgacaagaagaggaagaaggacaaggccggctacgtgggcctggtgacagtgcctgtggccaccctggccggccgccacttcacagagcagtggtaccctgtgaccctgcccactggaagtggcggcagcggcggcatgggcagcggcggcggcggcggcagcggcggcggcagcggcggcaagggcaagggcggctgcccagctgtgcggctgaaggcccgctaccagaccatgagcatcctgcccatggagctgtacaaggagtttgctgaatatgtgaccaaccactacaggatgctgtgtgctgtgctggagcccgccctgaatgtgaagggcaaggaggaggtggccagcgccctggtgcacatcctgcagagcacaggcaaggccaaggacttcctgagtgacatggccatgtctgaggtggaccgcttcatggagcgggagcacctgatcttccgggagaacaccctggccaccaaggccatcgaggagtacatgaggctgattggccagaagtacctgaaggatgccatcggggagttcatccgggccctgtatgagagcgaggagaactgtgaggtggaccccatcaagtgcacagccagcagcctggccgagcaccaggccaacctgaggatgtgctgtgagctggccctgtgcaaggtggtgaacagccactgtgtgttcccccgggagctgaaggaggtgtttgcctcctggaggctgcgctgtgccgagcggggccgggaggacattgctgacaggctcatcagcgccagcctcttcctgcgcttcctgtgcccagccatcatgagccccagcctgtttggcctgatgcaggagtacccagatgagcagaccagcaggaccctgaccctcatcgccaaggtgatccagaacctggccaacttcagcaagttcaccagcaaagaagacttcctgggcttcatgaatgagttcctggagctggagtggggctccatgcagcagttcctgtatgagatcagcaacctggacaccctgaccaacagcagcagctttgagggctacatcgacctgggccgggagctgagcaccctgcacgccctgctgtgggaggtgctgccccagctgagcaaggaggccctgctgaagctgggccccctgccccggctgctgaatgacatcagcacagccctgaggaaccccaacatccagaggcagcccagccggcagagcgagcggccccggccccagcctgtggtgctgcggggccccagcgctgagatgcagggctacatgatgagggacctgaacagcagcattgacctgcagagcttcatggcccggggcctgaacagctccatggacatggcccggctgcccagccccaccaaggagaagcccccacctcctcctcctgggggcggcaaggacctcttctacgtgtccaggcctcccctggcccggagcagccctgcctactgcaccagcagcagtgacatcacagagcctgagcagaagatgctgtctgtgaacaagtctgtgtccatgctggacctgcagggagatggccctgggggccgcctgaacagcagctctgtgagcaacctggccgctgtgggggacctgctgcacagcagccaggccagcctgacagctgccctgggcctgcggcctgccccagctggccgcctgagccagggcagcggcagcagcatcacagctgctggcatgaggctgagccagatgggcgtgaccacagatggagtgcctgcccagcagctgcgcatccccctgtccttccagaaccccctcttccacatggccgcagatggccctggccccccaggcggccatggaggcggcggcggccacggcccccccagcagccaccaccaccaccaccaccaccaccaccaccggggcggggagcccccaggggacacctttgcccccttccacggctacagcaagtctgaggacctgagcagcggcgtgcccaagcccccagctgccagcatcctgcacagccacagctacagtgatgaatttggccccagcggcacagacttcacccggcggcagctgagcctgcaggacaacctgcagcacatgctgagccccccccagatcaccatcggcccccagaggcctgcccccagcggccctgggggcggcagcggcggcggcagcggcggcggcggcggcggccagcccccacccctgcagaggggcaagagccagcagctgactgtgtctgctgcccagaagccccggcccagcagcggcaacctgctgcagagccctgagcccagctatggccctgcccggccccggcagcagagcctgagcaaggagggcagcattggaggcagcggcggcagcggcggcggcggcggcggcggcctgaagcccagcatcaccaagcagcacagccagacccccagcaccctgaaccccaccatgcctgccagcgagaggacagtggcctgggtgagcaacatgccccacctgtctgctgacatcgagagcgcccacatcgagcgggaggagtacaagctgaaggagtacagcaagtccatggatgagagccggctggacagagtgaaggagtatgaggaggagatccacagcctgaaggagcggctgcacatgagcaacaggaagctggaggagtatgaaagaaggctgctgagccaggaggagcagaccagcaagatcctgatgcagtaccaggcccggctggagcagagcgagaagaggctgcggcagcagcaggccgagaaggacagccagatcaagagcatcatcggccgcctgatgctggtggaggaggagctgcggcgggaccacccagccatggccgagcccctgcctgagcccaagaagaggctgctggatgcccaggagcggcagctgccccccctgggccccaccaacccccgggtgaccctggccccaccctggaatggcctggcccccccagcccctcctcctccaccccggctgcagatcacagaaaatggagagttcaggaacacagctgaccactag

SEQ ID NO: 38664 - DNA, 3879 bp, Artificial Sequence
  Description of Artificial Sequence: Synthetic coding sequence
atgagccgcagccgggccagcatccaccggggcagcatcccagccatgtcctatgcccccttcagagatgtgcggggccccagcatgcacaggacccagtatgtgcacagcccctatgaccggcccggctggaacccccgcttctgcatcatcagcggcaaccagctgctgatgctggatgaagatgagatccaccccctgctgatccgggaccggcgctctgagagcagcaggaacaagctgctgcggaggacagtgtctgtgcctgtggagggccggccccatggagagcacgagtaccacctgggccgcagcaggaggaagtctgtgcctgggggcaagcagtacagcatggagggcgccccagctgcccccttccggcccagccagggcttcctgagccggcggctgaagagcagcatcaagaggaccaagagccagcccaagctggacaggaccagcagcttccggcagatcctgccccgcttccgctctgctgaccatgaccgggcccggctgatgcagagcttcaaggagagccacagccatgagagcctgctgagccccagcagcgctgctgaggccctggagctgaacctggatgaggacagcatcatcaagcctgtgcacagcagcatcctgggccaggagttctgctttgaggtgaccaccagcagcggcaccaagtgctttgcctgccgctctgctgctgagcgggacaagtggattgagaacctgcagagagctgtgaagcccaacaaggacaacagccggcgggtggacaacgtgctgaagctgtggatcatcgaggcccgggagctgccccccaagaagcgctactactgtgagctgtgcctggatgacatgctgtatgcccggaccaccagcaagcccaggtctgccagcggggacacagtgttctggggcgagcactttgagttcaacaacctgcctgctgtgcgggccctgcggctgcacctgtacagagacagcgacaagaagaggaagaaggacaaggccggctacgtgggcctggtgacagtgcctgtggccaccctggccggccgccacttcacagagcagtggtaccctgtgaccctgcccactggaagtggcggcagcggcggcatgggcagcggcggcggcggcggcagcggcggcggcagcggcggcaagggcaagggcggctgcccagctgtgcggctgaaggcccgctaccagaccatgagcatcctgcccatggagctgtacaaggagtttgctgaatatgtgaccaaccactacaggatgctgtgtgctgtgctggagcccgccctgaatgtgaagggcaaggaggaggtggccagcgccctggtgcacatcctgcagagcacaggcaaggccaaggacttcctgagtgacatggccatgtctgaggtggaccgcttcatggagcgggagcacctgatcttccgggagaacaccctggccaccaaggccatcgaggagtacatgaggctgattggccagaagtacctgaaggatgccatcggggagttcatccgggccctgtatgagagcgaggagaactgtgaggtggaccccatcaagtgcacagccagcagcctggccgagcaccaggccaacctgaggatgtgctgtgagctggccctgtgcaaggtggtgaacagccactgtgtgttcccccgggagctgaaggaggtgtttgcctcctggaggctgcgctgtgccgagcggggccgggaggacattgctgacaggctcatcagcgccagcctcttcctgcgcttcctgtgcccagccatcatgagccccagcctgtttggcctgatgcaggagtacccagatgagcagaccagcaggaccctgaccctcatcgccaaggtgatccagaacctggccaacttcagcaagttcaccagcaaagaagacttcctgggcttcatgaatgagttcctggagctggagtggggctccatgcagcagttcctgtatgagatcagcaacctggacaccctgaccaacagcagcagctttgagggctacatcgacctgggccgggagctgagcaccctgcacgccctgctgtgggaggtgctgccccagctgagcaaggaggccctgctgaagctgggccccctgccccggctgctgaatgacatcagcacagccctgaggaaccccaacatccagaggcagcccagccggcagagcgagcggccccggccccagcctgtggtgctgcggggccccagcgctgagatgcagggctacatgatgagggacctgaacagctccatggacatggcccggctgcccagccccaccaaggagaagcccccacctcctcctcctgggggcggcaaggacctcttctacgtgtccaggcctcccctggcccggagcagccctgcctactgcaccagcagcagtgacatcacagagcctgagcagaagatgctgtctgtgaacaagtctgtgtccatgctggacctgcagggagatggccctgggggccgcctgaacagcagctctgtgagcaacctggccgctgtgggggacctgctgcacagcagccaggccagcctgacagctgccctgggcctgcggcctgccccagctggccgcctgagccagggcagcggcagcagcatcacagctgctggcatgaggctgagccagatgggcgtgaccacagatggagtgcctgcccagcagctgcgcatccccctgtccttccagaaccccctcttccacatggccgcagatggccctggccccccaggcggccatggaggcggcggcggccacggcccccccagcagccaccaccaccaccaccaccaccaccaccaccggggcggggagcccccaggggacacctttgcccccttccacggctacagcaagtctgaggacctgagcagcggcgtgcccaagcccccagctgccagcatcctgcacagccacagctacagtgatgaatttggccccagcggcacagacttcacccggcggcagctgagcctgcaggacaacctgcagcacatgctgagccccccccagatcaccatcggcccccagaggcctgcccccagcggccctgggggcggcagcggcggcggcagcggcggcggcggcggcggccagcccccacccctgcagaggggcaagagccagcagctgactgtgtctgctgcccagaagccccggcccagcagcggcaacctgctgcagagccctgagcccagctatggccctgcccggccccggcagcagagcctgagcaaggagggcagcattggaggcagcggcggcagcggcggcggcggcggcggcggcctgaagcccagcatcaccaagcagcacagccagacccccagcaccctgaaccccaccatgcctgccagcgagaggacagtggcctgggtgagcaacatgccccacctgtctgctgacatcgagagcgcccacatcgagcgggaggagtacaagctgaaggagtacagcaagtccatggatgagagccggctggaccgggagtatgaggaggagatccacagcctgaaggagcggctgcacatgagcaacaggaagctggaggagtatgaaagaaggctgctgagccaggaggagcagaccagcaagatcctgatgcagtaccaggcccggctggagcagagcgagaagaggctgcggcagcagcaggccgagaaggacagccagatcaagagcatcatcggccgcctgatgctggtggaggaggagctgcggcgggaccacccagccatggccgagcccctgcctgagcccaagaagaggctgctggatgcccagaggggcagcttccccccctgggtgcagcagaccagggtgtag

SEQ ID NO: 38665 - DNA, 4032 bp, Artificial Sequence; identical to SEQ ID NO: 38663
  Description of Artificial Sequence: Synthetic coding sequence

SEQ ID NO: 38666 - DNA, 3900 bp, Artificial Sequence; identical to SEQ ID NO: 38659
  Description of Artificial Sequence: Synthetic coding sequence

SEQ ID NO: 38667 - DNA, 2049 bp, Artificial Sequence
  Description of Artificial Sequence: Synthetic coding sequence
atggaggagggcttccgggacagagctgccttcatccggggggccaaggacatcgccaaggaggtgaagaagcacgccgccaagaaggtggtgaagggcctggacagagtgcaggatgagtacagcagaagaagctacagcagatttgaggaggaggatgatgatgatgacttccctgcccccagtgatggctactacagaggagagggcacccaggatgaggaggagggcggggccagcagtgatgccacagagggccatgatgaagatgatgagatctatgaaggagagtaccagggcatccccagggctgagagcggcggcaaaggagagaggatggctgatggagcccccctggccggcgtgcggggcggcctgagtgatggagagggccccccaggcggccgcggggaggcccagaggaggaaggagcgggaggagctggcccagcagtatgaggccatcctgcgggagtgtggccacggccgcttccagtggaccctgtactttgtgctgggcctggccctgatggctgatggagtggaggtgtttgtggtgggctttgtgctgcccagcgctgagaaggacatgtgcctgagtgacagcaacaagggcatgctgggcctcatcgtgtacctgggcatgatggtgggcgccttcctgtggggcggcctggccgaccggctgggccggcggcagtgcctgctgatcagcctgtctgtgaacagcgtgtttgccttcttcagcagctttgtgcagggctacggcaccttcctgttctgccgcctgctgtctggagtgggcattggaggcagcatccccatcgtgttctcctacttcagcgagttcctggcccaggagaagagaggagagcacctgtcctggctgtgcatgttctggatgattggaggagtgtatgctgctgccatggcctgggccatcatcccccactacggctggagcttccagatgggcagcgcctaccagttccacagctggagggtgtttgtgctggtgtgtgccttccccagcgtgtttgccatcggggccctgaccacccagcctgagagcccccgcttcttcctggagaatggcaagcatgatgaggcctggatggtgctgaagcaggtgcatgacaccaacatgagggccaagggccaccctgagagggtcttctctgtgacccacatcaagaccatccaccaggaggatgagctgattgagatccagagcgacaccggcacctggtaccagcgctggggcgtgcgggccctgagcctgggcggccaggtgtggggcaacttcctgagctgctttggacctgagtaccgccgcatcaccctgatgatgatgggcgtgtggttcaccatgtccttctcctactacggcctgactgtgtggttcccagacatgatccgccacctgcaggccgtggactatgccagcaggaccaaggtgtttcctggagagcgggtggagcacgtgaccttcaacttcaccctggagaaccagatccaccggggcggccagtacttcaatgacaagttcatcggcctgcggctgaagtctgtgtcctttgaggacagcctgtttgaggagtgctactttgaagatgtgaccagcagcaacaccttcttcaggaactgcaccttcatcaacacagtgttctacaacacagacctgtttgagtacaagtttgtgaacagccgcctcatcaacagcaccttcctgcacaacaaggagggctgccccctggatgtgacaggcaccggggagggcgcctacatggtgtactttgtgtccttcctgggcaccctggccgtgctgcccggcaacatcgtgtctgccctgctgatggacaagattggccgcctgaggatgctggccggcagctctgtgatgagctgtgtgtcctgcttcttcctgagctttggaaattctgagagcgccatgattgccctgctgtgcctgtttggaggagtgtccatcgcctcctggaatgccctggatgtgctgactgtggagctgtaccccagcgacaagaggtag

SEQ ID NO: 38668 - DNA, 2229 bp, Artificial Sequence
  Description of Artificial Sequence: Synthetic coding sequence
atggaggagggcttccgggacagagctgccttcatccggggggccaaggacatcgccaaggaggtgaagaagcacgccgccaagaaggtggtgaagggcctggacagagtgcaggatgagtacagcagaagaagctacagcagatttgaggaggaggatgatgatgatgacttccctgcccccagtgatggctactacagaggagagggcacccaggatgaggaggagggcggggccagcagtgatgccacagagggccatgatgaagatgatgagatctatgaaggagagtaccagggcatccccagggctgagagcggcggcaaaggagagaggatggctgatggagcccccctggccggcgtgcggggcggcctgagtgatggagagggccccccaggcggccgcggggaggcccagaggaggaaggagcgggaggagctggcccagcagtatgaggccatcctgcgggagtgtggccacggccgcttccagtggaccctgtactttgtgctgggcctggccctgatggctgatggagtggaggtgtttgtggtgggctttgtgctgcccagcgctgagaaggacatgtgcctgagtgacagcaacaagggcatgctgggcctcatcgtgtacctgggcatgatggtgggcgccttcctgtggggcggcctggccgaccggctgggccggcggcagtgcctgctgatcagcctgtctgtgaacagcgtgtttgccttcttcagcagctttgtgcagggctacggcaccttcctgttctgccgcctgctgtctggagtgggcattggaggcagcatccccatcgtgttctcctacttcagcgagttcctggcccaggagaagagaggagagcacctgtcctggctgtgcatgttctggatgattggaggagtgtatgctgctgccatggcctgggccatcatcccccactacggctggagcttccagatgggcagcgcctaccagttccacagctggagggtgtttgtgctggtgtgtgccttccccagcgtgtttgccatcggggccctgaccacccagcctgagagcccccgcttcttcctggagaatggcaagcatgatgaggcctggatggtgctgaagcaggtgcatgacaccaacatgagggccaagggccaccctgagagggtcttctctgtgacccacatcaagaccatccaccaggaggatgagctgattgagatccagagcgacaccggcacctggtaccagcgctggggcgtgcgggccctgagcctgggcggccaggtgtggggcaacttcctgagctgctttggacctgagtaccgccgcatcaccctgatgatgatgggcgtgtggttcaccatgtccttctcctactacggcctgactgtgtggttcccagacatgatccgccacctgcaggccgtggactatgccagcaggaccaaggtgtttcctggagagcgggtggagcacgtgaccttcaacttcaccctggagaaccagatccaccggggcggccagtacttcaatgacaagttcatcggcctgcggctgaagtctgtgtcctttgaggacagcctgtttgaggagtgctactttgaagatgtgaccagcagcaacaccttcttcaggaactgcaccttcatcaacacagtgttctacaacacagacctgtttgagtacaagtttgtgaacagccgcctcatcaacagcaccttcctgcacaacaaggagggctgccccctggatgtgacaggcaccggggagggcgcctacatggtgtactttgtgtccttcctgggcaccctggccgtgctgcccggcaacatcgtgtctgccctgctgatggacaagattggccgcctgaggatgctggccggcagctctgtgatgagctgtgtgtcctgcttcttcctgagctttggaaattctgagagcgccatgattgccctgctgtgcctgtttggaggagtgtccatcgcctcctggaatgccctggatgtgctgactgtggagctgtaccccagcgacaagaggaccacagccttcggcttcctgaatgccctgtgcaagctggccgctgtgctgggcatcagcatcttcaccagctttgtgggcatcaccaaggccgcccccatcctgtttgccagcgctgccctggccctgggcagcagcctggccctgaagctgcctgagacccggggccaggtgctgcagtag

SEQ ID NO: 38669 - DNA, 2052 bp, Artificial Sequence
  Description of Artificial Sequence: Synthetic coding sequence
atggatgactacaagtaccaggacaactacggcggctacgcccccagtgatggctactacagaggaaatgaaagcaacccagaagaagatgcccagagtgatgtgacagagggccatgatgaggaggatgagatctatgaaggagagtaccagggcatcccccacccagatgatgtgaaggccaagcaggccaagatggcccccagcaggatggacagcctgcggggccagacagacctgatggccgagcggctggaggatgaggagcagctggcccaccagtatgagaccatcatggatgaatgtggccacggccgcttccagtggatcctcttctttgtgctgggcctggccctgatggctgatggagtggaggtgtttgtggtgtcctttgccctgcccagcgctgagaaggacatgtgcctgagcagcagcaagaagggcatgctgggcatgattgtgtacctgggcatgatggccggggccttcatcctgggcggcctggccgacaagctgggcaggaagagggtgctgtccatgagcctggccgtgaatgccagctttgccagcctgagcagctttgtgcagggctacggggccttcctgttctgccgcctcatcagcggcatcggcatcggcggggccctgcccatcgtgtttgcctacttcagcgagttcctgagccgggagaagagaggagagcacctgtcctggctgggcatcttctggatgactggaggcctgtatgccagcgccatggcctggagcatcatcccccactacggctggggcttctccatgggcaccaactaccacttccacagctggagggtgtttgtgattgtgtgtgccctgccctgcaccgtgtccatggtggccctgaagttcatgcctgagagcccccgcttcctgctggagatgggcaagcatgatgaggcctggatgatcctgaagcaggtgcatgacaccaacatgagggccaagggcaccccagagaaggtgttcaccgtgagcaacatcaagacccccaagcagatggatgagttcatcgagatccagagcagcacaggcacctggtaccagcgctggctggtgcgcttcaagaccatcttcaagcaggtgtgggacaatgccctgtactgtgtgatgggcccctacaggatgaacaccctcatcctggccgtggtgtggtttgccatggccttctcctactacggcctgactgtgtggttcccagacatgatccgctacttccaggatgaggagtacaagagcaagatgaaggtgttctttggagagcacgtgtatggagccaccatcaacttcaccatggagaaccagatccaccagcacggcaagctggtgaatgacaagttcaccaggatgtacttcaagcacgtgctgtttgaggacaccttctttgatgagtgctactttgaagatgtgaccagcacagacacctacttcaagaactgcaccatcgagagcaccatcttctacaacacagacctgtatgagcacaagttcatcaactgccgcttcatcaacagcaccttcctggagcagaaggagggctgccacatggacctggagcaggacaatgacttcctgatctacctggtgtccttcctgggcagcctgtctgtgctgcccggcaacatcatcagcgccctgctgatggacagaattggccgcctgaagatgattggaggctccatgctgatctctgctgtgtgctgcttcttcctgttctttggaaacagcgagagcgccatgattggctggcagtgcctcttctgtggcaccagcattgctgcctggaatgccctggatgtgatcaccgtggagctgtaccccaccaaccagagggccacagccttcggcatcctgaatggcctgtgcaagtttggagccatcctgggcaacaccatctttgccagctttgtgggcatcaccaaggtggtgcccatcctgctggccgccgccagcctggtgggcggcggcctcatcgccctgcggctgcctgagacccgggagcaggtgctgatgtag

SEQ ID NO: 38670 - DNA, 2052 bp, Artificial Sequence; identical to SEQ ID NO: 38669
  Description of Artificial Sequence: Synthetic coding sequence

SEQ ID NO: 38671 - DNA, 1599 bp, Artificial Sequence
  Description of Artificial Sequence: Synthetic coding sequence
atgattgtgtacctgggcatgatggccggggccttcatcctgggcggcctggccgacaagctgggcaggaagagggtgctgtccatgagcctggccgtgaatgccagctttgccagcctgagcagctttgtgcagggctatggagccttcctgttctgccgcctcatctctggaattggaattggaggagccctgcccatcgtgtttgcctacttcagcgagttcctgagccgggagaagagaggagagcacctgtcctggctgggcatcttctggatgactggaggcctgtatgccagcgccatggcctggagcatcatcccccactacggctggggcttctccatgggcaccaactaccacttccacagctggagggtgtttgtgattgtgtgtgccctgccctgcaccgtgtccatggtggccctgaagttcatgcctgagagcccccgcttcctgctggagatgggcaagcatgatgaggcctggatgatcctgaagcaggtgcatgacaccaacatgagggccaagggcaccccagagaaggtgttcaccgtgagcaacatcaagacccccaagcagatggatgagttcatcgagatccagagcagcacaggcacctggtaccagcgctggctggtgcgcttcaagaccatcttcaagcaggtgtgggacaatgccctgtactgtgtgatgggcccctacaggatgaacaccctcatcctggccgtggtgtggtttgccatggccttctcctactacggcctgactgtgtggttcccagacatgatccgctacttccaggatgaggagtacaagagcaagatgaaggtgttcttcggggagcacgtgtatggagccaccatcaacttcaccatggagaaccagatccaccagcacggcaagctggtgaatgacaagttcaccaggatgtacttcaagcacgtgctgtttgaggacaccttctttgatgagtgctactttgaagatgtgaccagcacagacacctacttcaagaactgcaccatcgagagcaccatcttctacaacacagacctgtatgagcacaagttcatcaactgccgcttcatcaacagcaccttcctggagcagaaggagggctgccacatggacctggagcaggacaatgacttcctgatctacctggtgtccttcctgggcagcctgtctgtgctgcccggcaacatcatcagcgccctgctgatggaccgcatcggccgcctgaagatgattggaggctccatgctgatctctgctgtgtgctgcttcttcctgttcttcggcaacagcgagagcgccatgattggctggcagtgcctcttctgtggcaccagcattgctgcctggaatgccctggatgtgatcaccgtggagctgtaccccaccaaccagagggccacagccttcggcatcctgaatggcctgtgcaagtttggagccatcctgggcaacaccatctttgccagctttgtgggcatcaccaaggtggtgcccatcctgctggccgccgccagcctggtgggcggcggcctgattgccctgcggctgcctgagacccgggagcaggtgctgatgtag

SEQ ID NO: 38672 - DNA, 2052 bp, Artificial Sequence; identical to SEQ ID NO: 38669
  Description of Artificial Sequence: Synthetic coding sequence

SEQ ID NO: 38673 - DNA, 2031 bp, Artificial Sequence
  Description of Artificial Sequence: Synthetic coding sequence
atggaggacagctacaaggacaggaccagcctgatgaagggggccaaggacatcgcccgggaggtgaagaagcagacagtgaagaaggtgaaccaggccgtggaccgggcccaggatgagtacacccagaggagctacagccgcttccaggatgaagaagatgatgatgactactacccagctggggagacctacaacggggaggccaatgatgatgagggcagcagcgaggccacagagggccatgatgaagatgatgagatctatgaaggagagtaccagggcatccccagcatgaaccaggccaaggacagcatcgtgtctgtgggccagcccaagggagatgagtacaaggaccggcgggagctggagagcgagaggagagcagatgaggaggagctggcccagcagtatgagctgatcatccaggagtgtggccacggccgcttccagtgggccctcttctttgtgctgggcatggccctgatggctgatggagtggaggtgtttgtggtgggctttgtgctgcccagcgctgagacagacctgtgcatccccaacagcggcagcggctggctgggcagcatcgtgtacctgggcatgatggtgggcgccttcttctggggcggcctggccgacaaggtgggcaggaagcagagcctgctgatctgcatgtctgtgaatggcttctttgccttcctgagcagctttgtgcagggctacggcttcttcctgttctgccgcctgctgagcggctttggaattggaggagccatccccaccgtcttctcctactttgctgaggtgctggcccgggagaagagaggagagcacctgtcctggctgtgcatgttctggatgattggaggcatctatgccagcgccatggcctgggccatcatcccccactacggctggagcttctccatgggcagcgcctaccagttccacagctggagggtgtttgtgattgtgtgtgccctgccctgtgtgtcctctgtggtggccctgaccttcatgcctgagagcccccgcttcctgctggaggtgggcaagcatgatgaggcctggatgatcctgaagctgattcatgacaccaacatgagggcccggggccagcctgagaaggtgttcaccgtgaacaagatcaagacccccaagcagattgatgagctgattgaaattgaaagtgacaccggcacctggtaccgccgctgctttgtgcgcatcagaacagagctgtatggcatctggctgaccttcatgcgctgcttcaactaccctgtgcgggacaacaccatcaagctgaccatcgtgtggttcaccctgagctttggctactacggcctgtctgtgtggttcccagatgtgatcaagcccctgcagagtgatgaatatgccctgctgaccagaaatgtggagcgggacaagtatgccaacttcaccatcaacttcaccatggagaaccagatccacacaggcatggagtatgacaatggccgcttcatcggcgtgaagttcaagtctgtgaccttcaaggacagcgtcttcaagagctgcacctttgaagatgtgacctctgtgaacacctacttcaagaactgcaccttcatcgacacagtgtttgacaacacagactttgagccctacaagttcattgattctgagttcaagaactgcagcttcttccacaacaagacaggctgccagatcacctttgatgatgactacagcgcctactggatctactttgtgaacttcctgggcaccctggccgtgctgcccggcaacatcgtgtctgccctgctgatggacagaattggccgcctgaccatgctgggcggctccatggtgctgagcggcatcagctgcttcttcctgtggtttggcaccagcgagagcatgatgattggcatgctgtgcctgtacaacggcctgaccatcagcgcctggaacagcctggatgtggtgacagtggagctgtaccccacagacagaagaagaagagtgctgccctgctgccctggatag

SEQ ID NO: 38674 - DNA, 2184 bp, Artificial Sequence
  Description of Artificial Sequence: Synthetic coding sequence
atggaggacagctacaaggacaggaccagcctgatgaagggggccaaggacatcgcccgggaggtgaagaagcagacagtgaagaaggtgaaccaggccgtggaccgggcccaggatgagtacacccagaggagctacagccgcttccaggatgaagaagatgatgatgactactacccagctggggagacctacaacggggaggccaatgatgatgagggcagcagcgaggccacagagggccatgatgaagatgatgagatctatgaaggagagtaccagggcatccccagcatgaaccaggccaaggacagcatcgtgtctgtgggccagcccaagggagatgagtacaaggaccggcgggagctggagagcgagaggagagcagatgaggaggagctggcccagcagtatgagctgatcatccaggagtgtggccacggccgcttccagtgggccctcttctttgtgctgggcatggccctgatggctgatggagtggaggtgtttgtggtgggctttgtgctgcccagcgctgagacagacctgtgcatccccaacagcggcagcggctggctgggcagcatcgtgtacctgggcatgatggtgggcgccttcttctggggcggcctggccgacaaggtgggcaggaagcagagcctgctgatctgcatgtctgtgaatggcttctttgccttcctgagcagctttgtgcagggctacggcttcttcctgttctgccgcctgctgagcggctttggaattggaggagccatccccaccgtcttctcctactttgctgaggtgctggcccgggagaagagaggagagcacctgtcctggctgtgcatgttctggatgattggaggcatctatgccagcgccatggcctgggccatcatcccccactacggctggagcttctccatgggcagcgcctaccagttccacagctggagggtgtttgtgattgtgtgtgccctgccctgtgtgtcctctgtggtggccctgaccttcatgcctgagagcccccgcttcctgctggaggtgggcaagcatgatgaggcctggatgatcctgaagctgattcatgacaccaacatgagggcccggggccagcctgagaaggtgttcaccgtgaacaagatcaagacccccaagcagattgatgagctgattgaaattgaaagtgacaccggcacctggtaccgccgctgctttgtgcgcatcagaacagagctgtatggcatctggctgaccttcatgcgctgcttcaactaccctgtgcgggacaacaccatcaagctgaccatcgtgtggttcaccctgagctttggctactacggcctgtctgtgtggttcccagatgtgatcaagcccctgcagagtgatgaatatgccctgctgaccagaaatgtggagcgggacaagtatgccaacttcaccatcaacttcaccatggagaaccagatccacacaggcatggagtatgacaatggccgcttcatcggcgtgaagttcaagtctgtgaccttcaaggacagcgtcttcaagagctgcacctttgaagatgtgacctctgtgaacacctacttcaagaactgcaccttcatcgacacagtgtttgacaacacagactttgagccctacaagttcattgattctgagttcaagaactgcagcttcttccacaacaagacaggctgccagatcacctttgatgatgactacagcgcctactggatctactttgtgaacttcctgggcaccctggccgtgctgcccggcaacatcgtgtctgccctgctgatggacagaattggccgcctgaccatgctgggcggctccatggtgctgagcggcatcagctgcttcttcctgtggtttggcaccagcgagagcatgatgattggcatgctgtgcctgtacaacggcctgaccatcagcgcctggaacagcctggatgtggtgacagtggagctgtaccccacagaccggcgggccactggatttggcttcctgaatgccctgtgcaaggctgctgctgtgctgggcaacctgatcttcggcagcctggtgtccatcaccaagagcatccccatcctgctggccagcacagtgctggtgtgtggcggcctggtgggcctgtgcctgcctgacaccaggacccaggtgctgatgtag

SEQ ID NO: 38675 - DNA, 780 bp, Artificial Sequence
  Description of Artificial Sequence: Synthetic coding sequence
atggcccccaacatctacctggtgcggcagaggatcagccggctgggccagaggatgagcggcttccagatcaacctgaaccccctgaaggagcccctgggcttcatcaaggtgctggagtggatcgccagcatctttgcctttgccacctgtggcggcttcaagggccagacagagatccaggtgaactgccccccagctgtgacagagaacaagacagtgacagccaccttcggctaccccttccggctgaatgaggccagcttccagcccccacctggggtgaacatctgtgatgtgaactggaaggactatgtgctgattggagactacagcagcagcgcccagttctacgtgacctttgctgtgtttgtgttcctgtactgcatcgccgccctgctgctgtatgtgggctacaccagcctgtacctggacagcaggaagctgcccatgattgactttgtggtgaccctggtggccaccttcctgtggctggtgtccaccagcgcctgggccaaggccctgacagacatcaagatcgccaccggccacaacatcattgatgagctgcccccctgcaagaagaaggctgtgctgtgctacttcggctctgtgacctccatgggcagcctgaatgtgtctgtcatcttcggcttcctgaacatgatcctgtggggcggcaatgcctggtttgtgtacaaggagaccagcctgcacagccccagcaacaccagcgccccccacagccagggcggcatccccccacccaccggcatctag

SEQ ID NO: 38676 - DNA, 726 bp, Artificial Sequence
  Description of Artificial Sequence: Synthetic coding sequence
atgagcggcttccagatcaacctgaaccccctgaaggagcccctgggcttcatcaaggtgctggagtggatcgccagcatctttgcctttgccacctgtggcggcttcaagggccagacagagatccaggtgaactgccccccagctgtgacagagaacaagacagtgacagccaccttcggctaccccttccggctgaatgaggccagcttccagcccccacctggggtgaacatctgtgatgtgaactggaaggactatgtgctgattggagactacagcagcagcgcccagttctacgtgacctttgctgtgtttgtgttcctgtactgcatcgccgccctgctgctgtatgtgggctacaccagcctgtacctggacagcaggaagctgcccatgattgactttgtggtgaccctggtggccaccttcctgtggctggtgtccaccagcgcctgggccaaggccctgacagacatcaagatcgccaccggccacaacatcattgatgagctgcccccctgcaagaagaaggctgtgctgtgctacttcggctctgtgacctccatgggcagcctgaatgtgtctgtcatcttcggcttcctgaacatgatcctgtggggcggcaatgcctggtttgtgtacaaggagaccagcctgcacagccccagcaacaccagcgccccccacagccagggcggcatccccccacccaccggcatctag

SEQ ID NO: 38677 - DNA, 819 bp, Artificial Sequence
  Description of Artificial Sequence: Synthetic coding sequence
atgagcagcacagagagcgctggccgcacagctgacaagagcccccggcagcaggtggaccggctgctggtgggcctgcgctggaggcggctggaggagcccctgggcttcatcaaggtgctgcagtggctgtttgccatctttgccttcggcagctgtggcagctacagcggggagaccggggccatggtgcgctgcaacaatgaggccaaggatgtgagcagcatcatcgtggccttcggctaccccttccggctgcaccgcatccagtatgagatgcccctgtgtgatgaggagagcagcagcaagaccatgcacctgatgggagacttcagcgccccagctgagttctttgtgaccctgggcatcttctccttcttctacaccatggccgccctggtgatctacctgcgcttccacaacctgtacacagagaacaagcgcttccccctggtggacttctgtgtgacagtgtccttcaccttcttctggctggtggccgctgctgcctggggcaagggcctgacagatgtgaagggggccacccggcccagcagcctgacagctgccatgtctgtgtgccacggggaggaggccgtgtgcagcgctggggccacccccagcatgggcctggccaacatctctgtgctgtttggcttcatcaacttcttcctgtgggccggcaactgctggtttgtgttcaaggagaccccctggcacggccagggccagggccaggaccaggaccaggaccaggaccagggccagggccccagccaggagagcgctgctgagcagggcgctgtggagaagcagtag

SEQ ID NO: 38678 - DNA, 627 bp, Artificial Sequence
  Description of Artificial Sequence: Synthetic coding sequence
atgagcagcacagagagcgctggccgcacagctgacaagagcccccggcagcaggtggaccggctgctggtgggcctgcgctggaggcggctggaggagcccctgggcttcatcaaggtgctgcagtggctgtttgccatctttgccttcggcagctgtggcagctacagcggggagaccggggccatggtgcgctgcaacaatgaggccaaggatgtgagcagcatcatcgtggccttcggctaccccttccggctgcaccgcatccagtatgagatgcccctgtgtgatgaggagagcagcagcaagaccatgcacctgatgggagacttcagcgccccagctgagttctttgtgaccctgggcatcttctccttcttctacaccatggccgccctggtgatctacctgcgcttccacaacctgtacacagagaacaagcgcttccccctggtgctgtttggcttcatcaacttcttcctgtgggccggcaactgctggtttgtgttcaaggagaccccctggcacggccagggccagggccaggaccaggaccaggaccaggaccagggccagggccccagccaggagagcgctgctgagcagggcgctgtggagaagcagtag

SEQ ID NO: 38679 - DNA, 798 bp, Artificial Sequence
  Description of Artificial Sequence: Synthetic coding sequence
atgtgcatggtgatctttgcccccctgtttgccatctttgcctttgccacctgtggcggctacagcggcggcctgcggctgtctgtggactgtgtgaacaagacagagagcaacctgagcattgatattgcctttgcctaccccttccggctgcaccaggtgacctttgaggtgcccacctgtgagggcaaggagcggcagaagctggccctgattggagacagcagcagcagcgctgagttctttgtgacagtggccgtgtttgccttcctgtacagcctggccgccaccgtggtgtacatcttcttccagaacaagtaccgggagaacaacagaggccccctgattgacttcatcgtgacagtggtgttctccttcctgtggctggtgggcagcagcgcctgggccaagggcctgagtgatgtgaaggtggccacagaccccaaggaggtgctgctgctgatgtctgcctgcaagcagcccagcaacaagtgcatggccatccacagccctgtgatgagcagcctgaacacctctgtggtgtttggcttcctgaacttcatcctgtgggccggcaacatctggtttgtgttcaaggagaccggctggcacagcagcggccagcgctacctgagtgaccccatggagaagcacagcagcagctacaaccagggcggctacaaccaggacagctatggcagcagcagcggctacagccagcaggccagcctgggccccaccagtgatgaatttggccagcagcccaccggccccaccagcttcaccaaccagatctag

SEQ ID NO: 38680 - DNA, 831 bp, Artificial Sequence
  Description of Artificial Sequence: Synthetic coding sequence
atgtgcatggtgatctttgccccccacaatgaggagtgcaagagccacttccacctgctgtttgccatctttgcctttgccacctgtggcggctacagcggcggcctgcggctgtctgtggactgtgtgaacaagacagagagcaacctgagcattgacatcgcctttgcctaccccttccggctgcaccaggtgacctttgaggtgcccacctgtgagggcaaggagcggcagaagctggccctgattggagacagcagcagcagcgctgagttctttgtgacagtggccgtgtttgccttcctgtacagcctggccgccaccgtggtgtacatcttcttccagaacaagtaccgggagaacaacagaggccccctgattgacttcatcgtgacagtggtgttctccttcctgtggctggtgggcagcagcgcctgggccaagggcctgagtgatgtgaaggtggccacagaccccaaggaggtgctgctgctgatgtctgcctgcaagcagcccagcaacaagtgcatggccatccacagccctgtgatgagcagcctgaacacctctgtggtgtttggcttcctgaacttcatcctgtgggccggcaacatctggtttgtgttcaaggagaccggctggcacagcagcggccagcgctacctgagtgaccccatggagaagcacagcagcagctacaaccagggcggctacaaccaggacagctatggcagcagcagcggctacagccagcaggccagcctgggccccaccagtgatgaatttggccagcagcccaccggccccaccagcttcaccaaccagatctag

SEQ ID NO: 38681 - DNA, 858 bp, Artificial Sequence
  Description of Artificial Sequence: Synthetic coding sequence
atggaccctgtgtcccagctggccagcgctggcaccttccgggtgctgaaggagcccctggccttcctgcgggccctggagctgctgtttgccatctttgcctttgccacctgtggcggctacagcggcggcctgcggctgtctgtggactgtgtgaacaagacagagagcaacctgagcattgatattgcctttgcctaccccttccggctgcaccaggtgacctttgaggtgcccacctgtgagggcaaggagcggcagaagctggccctgattggagacagcagcagcagcgctgagttctttgtgacagtggccgtgtttgccttcctgtacagcctggccgccaccgtggtgtacatcttcttccagaacaagtaccgggagaacaacagaggccccctgattgacttcatcgtgacagtggtgttctccttcctgtggctggtgggcagcagcgcctgggccaagggcctgagtgatgtgaaggtggccacagaccccaaggaggtgctgctgctgatgtctgcctgcaagcagcccagcaacaagtgcatggccatccacagccctgtgatgagcagcctgaacacctctgtggtgtttggcttcctgaacttcatcctgtgggccggcaacatctggtttgtgttcaaggagaccggctggcacagcagcggccagcgctacctgagtgaccccatggagaagcacagcagcagctacaaccagggcggctacaaccaggacagctatggcagcagcagcggctacagccagcaggccagcctgggccccaccagtgatgaatttggccagcagcccaccggccccaccagcttcaccaaccagatctag

SEQ ID NO: 38682 - DNA, 177 bp, Artificial Sequence
  Description of Artificial Sequence: Synthetic coding sequence
atgagcggccagaccctgacagacagaattgctgctgcccagtacagcgtgacaggcagcgctgtggcccgggctgtgtgcaaggccaccacccatgaggtgatgggccccaagaagaagcacctggactacctgcagaccttcttccagcaggtgctgcccaactttgagatctag

SEQ ID NO: 38683 - DNA, 2634 bp, Artificial Sequence
  Description of Artificial Sequence: Synthetic coding sequence
atgagcggccagaccctgacagacagaattgctgctgcccagtacagcgtgacaggcagcgctgtggcccgggctgtgtgcaaggccaccacccatgaggtgatgggccccaagaagaagcacctggactacctgatccaggccaccaatgagaccaacgtgaacatcccccagatggctgacaccctgtttgagcgggccaccaacagctcctgggtggtggtgttcaaggccctggtgaccacccaccacctgatggtgcacggcaatgaacgcttcatccagtacctggccagcaggaacaccctcttcaacctgagcaacttcctggacaagagcggcagccacggctatgacatgagcaccttcatccgccgctacagccgctacctgaatgagaaggccttctcctaccggcagatggcctttgattttgcccgggtgaagaagggagcagatggagtgatgaggaccatggcccctgagaagctgctgaagtccatgcccatcctgcagggccagattgatgccctgctggagtttgatgtgcaccccaatgagctgaccaacggggtcatcaatgctgccttcatgctgctcttcaaggacctgatcaagctgtttgcctgctacaatgatggagtcatcaacctgctggagaagttctttgagatgaagaagggccagtgcaaggatgccctggagatctacaagcgcttcctgaccaggatgaccagggtgtctgagttcctgaaggtggccgagcaggtgggcatcgacaagggggacatcccagacctgacccaggcccccagcagcctgatggagaccctggagcagcacctgaacaccctggagggcaagaagccaggcaacaagagcggggcccccagccccctgagcaagagcagccctgccaccaccgtgaccagccccaacagcaccccagccaagaccatcgacaccagcccccctgtggacctgtttgccacagccagcgctgctgtgcctgtgtccaccagcaagcccagcagtgacctgctggacctgcagcctgacttcagcagcggcggcgctgctgctgctgctgccccagcccctcctcctcctgctggaggagccacagcctggggagacctgctgggggaggacagcctggccgccctgagctctgtgcccagcgaggcccagatcagtgacccctttgcccctgagcccaccccacccaccaccacagctgagatcgccacagccagcgccagcgccagcaccaccaccaccgtgacagctgtgacagctgaggtggacctgtttggagatgcctttgctgccagccctggagaggccccagctgccagcgagggcgctgctgccccagccacccccacccctgtggccgccgccctggatgcctgcagcggaaatgacccctttgcccccagcgagggcagcgctgaggccgcccctgagctggacctgtttgccatgaagcccccagagacctctgtgcctgtggtgacccccacagccagcacagcccctcctgtgcctgccacagcccccagccctgccccagctgtggccgctgctgctgctgccaccacagctgccacagctgctgccaccaccaccaccaccaccagcgctgccacagccaccacagcccccccagccctggacatctttggagacctgtttgagagcaccccagaggtggccgccgcccccaagccagatgctgcccccagcattgacctcttcagcacagatgccttcagcagccccccccagggcgccagccctgtgcctgagagcagcctgacagctgacctgctgagtgatgccttcggcagcagcgccagcgagccccagcctgccagccaggccgccagcagcagcagcgccagcgctgacctgctggccggctttggaggcagcttcatggcccccagccccagccctgtgaccccagcccagaacaacctgctgcagcccaactttgaagctgccttcggcaccacccccagcaccagcagcagcagcagctttgaccccagcgtgtttgatggcctgggggacctgctgatgcccaccatggccccagctggccagcctgcccctgtgtccatggtgccccccagccctgccatggccgccagcaaggccctgggcagtgacctggacagcagcctggccagcctggtgggcaacctgggcatcagcggcaccaccaccaagaagggggacctgcagtggaatgctggggagaagaagctgaccggcggggccaactggcagcccaaggtggccccagccacctggagcgctggggtgcccccatctgcccccctgcagggcgctgtgccccccaccagctctgtgccccctgtggccggggcccccagcgtgggccagcccggggccggcttcggcatgcctcctgctggcaccggcatgcccatgatgccccagcagcctgtgatgtttgcccagcccatgatgaggcccccatttggagctgctgctgtgcccggcacccagctgagccccagccccaccccagccagccagagccccaagaagcccccagccaaggaccccctggccgacctgaacatcaaggacttcctgtag

SEQ ID NO: 38684 - DNA, 2709 bp, Artificial Sequence
  Description of Artificial Sequence: Synthetic coding sequence
atgagcggccagaccctgacagacagaattgctgctgcccagtacagcgtgacaggcagcgctgtggcccgggctgtgtgcaaggccaccacccatgaggtgatgggccccaagaagaagcacctggactacctgatccaggccaccaatgagaccaacgtgaacatcccccagatggctgacaccctgtttgagcgggccaccaacagctcctgggtggtggtgttcaaggccctggtgaccacccaccacctgatggtgcacggcaatgaacgcttcatccagtacctggccagcaggaacaccctcttcaacctgagcaacttcctggacaagagcggcagccacggctatgacatgagcaccttcatccgccgctacagccgctacctgaatgagaaggccttctcctaccggcagatggcctttgattttgcccgggtgaagaagggagcagatggagtgatgaggaccatggcccctgagaagctgctgaagtccatgcccatcctgcagggccagattgatgccctgctggagtttgatgtgcaccccaatgagctgaccaacggggtcatcaatgctgccttcatgctgctcttcaaggacctgatcaagctgtttgcctgctacaatgatggagtcatcaacctgctggagaagttctttgagatgaagaagggccagtgcaaggatgccctggagatctacaagcgcttcctgaccaggatgaccagggtgtctgagttcctgaaggtggccgagcaggtgggcatcgacaagggggacatcccagacctgacccaggcccccagcagcctgatggagaccctggagcagcacctgaacaccctggagggcaagaagccaggcaacaatgaaggcagcggggcccccagccccctgagcaagagcagccctgccaccaccgtgaccagccccaacagcaccccagccaagaccatcgacaccagcccccctgtggacctgtttgccacagccagcgctgctgtgcctgtgtccaccagcaagcccagcagtgacctgctggacctgcagcctgacttcagcagcggcggcgctgctgctgctgctgccccagcccctcctcctcctgctggaggagccacagcctggggagacctgctgggggaggacagcctggccgccctgagctctgtgcccagcgaggcccagatcagtgacccctttgcccctgagcccaccccacccaccaccacagctgagatcgccacagccagcgccagcgccagcaccaccaccaccgtgacagctgtgacagctgaggtggacctgtttggagatgcctttgctgccagccctggagaggccccagctgccagcgagggcgctgctgccccagccacccccacccctgtggccgccgccctggatgcctgcagcggaaatgacccctttgcccccagcgagggcagcgctgaggccgcccctgagctggacctgtttgccatgaagcccccagagacctctgtgcctgtggtgacccccacagccagcacagcccctcctgtgcctgccacagcccccagccctgccccagctgtggccgctgctgctgctgccaccacagctgccacagctgctgccaccaccaccaccaccaccagcgctgccacagccaccacagcccccccagccctggacatctttggagacctgtttgagagcaccccagaggtggccgccgcccccaagccagatgctgcccccagcattgacctcttcagcacagatgccttcagcagccccccccagggcgccagccctgtgcctgagagcagcctgacagctgacctgctgtctgtggatgcctttgctgcccccagccctgccaccacagccagccctgccaaggtggacagcagcggcgtgattgacctgtttggagatgccttcggcagcagcgccagcgagccccagcctgccagccaggccgccagcagcagcagcgccagcgctgacctgctggccggctttggaggcagcttcatggcccccagccccagccctgtgaccccagcccagaacaacctgctgcagcccaactttgaagctgccttcggcaccacccccagcaccagcagcagcagcagctttgaccccagcggggacctgctgatgcccaccatggccccagctggccagcctgcccctgtgtccatggtgccccccagccctgccatggccgccagcaaggccctgggcagtgacctggacagcagcctggccagcctggtgggcaacctgggcatcagcggcaccaccaccaagaagggggacctgcagtggaatgctggggagaagaagctgactggaggagccaactggcagcccaaggtggccccagccacctggagcgctggggtgccccccagcgcccccctgcagggcgctgtgccccccaccagctctgtgccccctgtggccggggcccccagcgtgggccagcctggagctggcttcggcatgcccccagctggcaccggcatgcccatgatgccccagcagcctgtgatgtttgcccagcccatgatgaggcccccatttggagctgctgctgtgcccggcacccagctgagccccagccccaccccagccagccagagccccaagaagcccccagccaaggaccccctggccgacctgaacatcaaggacttcctgtag

SEQ ID NO: 38685 - DNA, 450 bp, Artificial Sequence
  Description of Artificial Sequence: Synthetic coding sequence
atgagcggccagaccctgacagacagaattgctgctgcccagtacagcgtgacaggcagcgctgtggcccgggctgtgtgcaaggccaccacccatgaggtgatgggccccaagaagaagcacctggactacctgatccaggccaccaatgagaccaacgtgaacatcccccagatggctgacaccctgtttgagcgggccaccaacagctcctgggtggtggtgttcaaggccctggtgaccacccaccacctgatggtgcacggcaatgaacgcttcatccagtacctggccagcaggaacaccctcttcaacctgagcaacttcctggacaagagcggcagccacggctatgacatgagcaccttcatccgccgctacagccgctacctgaatgagaaggccttctcctaccggcagatggcctttgattttgcccgggtgaagtag

SEQ ID NO: 38686 - DNA, 2724 bp, Artificial Sequence
  Description of Artificial Sequence: Synthetic coding sequence
atgagcggccagaccctgacagacagaattgctgctgcccagtacagcgtgacaggcagcgctgtggcccgggctgtgtgcaaggccaccacccatgaggtgatgggccccaagaagaagcacctggactacctgatccaggccaccaatgagaccaacgtgaacatcccccagatggctgacaccctgtttgagcgggccaccaacagctcctgggtggtggtgttcaaggccctggtgaccacccaccacctgatggtgcacggcaatgaacgcttcatccagtacctggccagcaggaacaccctcttcaacctgagcaacttcctggacaagagcggcagccacggctatgacatgagcaccttcatccgccgctacagccgctacctgaatgagaaggccttctcctaccggcagatggcctttgattttgcccgggtgaagaagggagcagatggagtgatgaggaccatggcccctgagaagctgctgaagtccatgcccatcctgcagggccagattgatgccctgctggagtttgatgtgcaccccaatgagctgaccaacggggtcatcaatgctgccttcatgctgctcttcaaggacctgatcaagctgtttgcctgctacaatgatggagtcatcaacctgctggagaagttctttgagatgaagaagggccagtgcaaggatgccctggagatctacaagcgcttcctgaccaggatgaccagggtgtctgagttcctgaaggtggccgagcaggtgggcatcgacaagggggacatcccagacctgacccaggcccccagcagcctgatggagaccctggagcagcacctgaacaccctggagggcaagaagccaggcaacaatgaaggcagcggggcccccagccccctgagcaagagcagccctgccaccaccgtgaccagccccaacagcaccccagccaagaccatcgacaccagcccccctgtggacctgtttgccacagccagcgctgctgtgcctgtgtccaccagcaagcccagcagtgacctgctggacctgcagcctgacttcagcagcggcggcgctgctgctgctgctgccccagcccctcctcctcctgctggaggagccacagcctggggagacctgctgggggaggacagcctggccgccctgagctctgtgcccagcgaggcccagatcagtgacccctttgcccctgagcccaccccacccaccaccacagctgagatcgccacagccagcgccagcgccagcaccaccaccaccgtgacagctgtgacagctgaggtggacctgtttggagatgcctttgctgccagccctggagaggccccagctgccagcgagggcgctgctgccccagccacccccacccctgtggccgccgccctggatgcctgcagcggaaatgacccctttgcccccagcgagggcagcgctgaggccgcccctgagctggacctgtttgccatgaagcccccagagacctctgtgcctgtggtgacccccacagccagcacagcccctcctgtgcctgccacagcccccagccctgccccagctgtggccgctgctgctgctgccaccacagctgccacagctgctgccaccaccaccaccaccaccagcgctgccacagccaccacagcccccccagccctggacatctttggagacctgtttgagagcaccccagaggtggccgccgcccccaagccagatgctgcccccagcattgacctcttcagcacagatgccttcagcagccccccccagggcgccagccctgtgcctgagagcagcctgacagctgacctgctgtctgtggatgcctttgctgcccccagccctgccaccacagccagccctgccaaggtggacagcagcggcgtgattgacctgtttggagatgccttcggcagcagcgccagcgagccccagcctgccagccaggccgccagcagcagcagcgccagcgctgacctgctggccggctttggaggcagcttcatggcccccagccccagccctgtgaccccagcccagaacaacctgctgcagcccaactttgaagctgccttcggcaccacccccagcaccagcagcagcagcagctttgaccccagcgtgtttgatggcctgggggacctgctgatgcccaccatggccccagctggccagcctgcccctgtgtccatggtgccccccagccctgccatggccgccagcaaggccctgggcagtgacctggacagcagcctggccagcctggtgggcaacctgggcatcagcggcaccaccaccaagaagggggacctgcagtggaatgctggggagaagaagctgaccggcggggccaactggcagcccaaggtggccccagccacctggagcgctggggtgcccccatctgcccccctgcagggcgctgtgccccccaccagctctgtgccccctgtggccggggcccccagcgtgggccagcccggggccggcttcggcatgcctcctgctggcaccggcatgcccatgatgccccagcagcctgtgatgtttgcccagcccatgatgaggcccccatttggagctgctgctgtgcccggcacccagctgagccccagccccaccccagccagccagagccccaagaagcccccagccaaggaccccctggccgacctgaacatcaaggacttcctgtag

SEQ ID NO: 38687 - DNA, 2724 bp, Artificial Sequence
  Description of Artificial Sequence: Synthetic coding sequence
atgagcggccagaccctgacagacagaattgctgctgcccagtacagcgtgacaggcagcgctgtggcccgggctgtgtgcaaggccaccacccatgaggtgatgggccccaagaagaagcacctggactacctgatccaggccaccaatgagaccaacgtgaacatcccccagatggctgacaccctgtttgagcgggccaccaacagctcctgggtggtggtgttcaaggccctggtgaccacccaccacctgatggtgcacggcaatgaacgcttcatccagtacctggccagcaggaacaccctcttcaacctgagcaacttcctggacaagagcggcagccacggctatgacatgagcaccttcatccgccgctacagccgctacctgaatgagaaggccttctcctaccggcagatggcctttgattttgcccgggtgaagaagggagcagatggagtgatgaggaccatggcccctgagaagctgctgaagtccatgcccatcctgcagggccagattgatgccctgctggagtttgatgtgcaccccaatgagctgaccaacggggtcatcaatgctgccttcatgctgctcttcaaggacctgatcaagctgtttgcctgctacaatgatggagtcatcaacctgctggagaagttctttgagatgaagaagggccagtgcaaggatgccctggagatctacaagcgcttcctgaccaggatgaccagggtgtctgagttcctgaaggtggccgagcaggtgggcatcgacaagggggacatcccagacctgacccaggcccccagcagcctgatggagaccctggagcagcacctgaacaccctggagggcaagaagccaggcaacaacaagatcagcggggcccccagccccctgagcaagagcagccctgccaccaccgtgaccagccccaacagcaccccagccaagaccatcgacaccagcccccctgtggacctgtttgccacagccagcgctgctgtgcctgtgtccaccagcaagcccagcagtgacctgctggacctgcagcctgacttcagcagcggcggcgctgctgctgctgctgccccagcccctcctcctcctgctggaggagccacagcctggggagacctgctgggggaggacagcctggccgccctgagctctgtgcccagcgaggcccagatcagtgacccctttgcccctgagcccaccccacccaccaccacagctgagatcgccacagccagcgccagcgccagcaccaccaccaccgtgacagctgtgacagctgaggtggacctgtttggagatgcctttgctgccagccctggagaggccccagctgccagcgagggcgctgctgccccagccacccccacccctgtggccgccgccctggatgcctgcagcggaaatgacccctttgcccccagcgagggcagcgctgaggccgcccctgagctggacctgtttgccatgaagcccccagagacctctgtgcctgtggtgacccccacagccagcacagcccctcctgtgcctgccacagcccccagccctgccccagctgtggccgctgctgctgctgccaccacagctgccacagctgctgccaccaccaccaccaccaccagcgctgccacagccaccacagcccccccagccctggacatctttggagacctgtttgagagcaccccagaggtggccgccgcccccaagccagatgctgcccccagcattgacctcttcagcacagatgccttcagcagccccccccagggcgccagccctgtgcctgagagcagcctgacagctgacctgctgtctgtggatgcctttgctgcccccagccctgccaccacagccagccctgccaaggtggacagcagcggcgtgattgacctgtttggagatgccttcggcagcagcgccagcgagccccagcctgccagccaggccgccagcagcagcagcgccagcgctgacctgctggccggctttggaggcagcttcatggcccccagccccagccctgtgaccccagcccagaacaacctgctgcagcccaactttgaagctgccttcggcaccacccccagcaccagcagcagcagcagctttgaccccagcgtgtttgatggcctgggggacctgctgatgcccaccatggccccagctggccagcctgcccctgtgtccatggtgccccccagccctgccatggccgccagcaaggccctgggcagtgacctggacagcagcctggccagcctggtgggcaacctgggcatcagcggcaccaccaccaagaagggggacctgcagtggaatgctggggagaagaagctgaccggcggggccaactggcagcccaaggtggccccagccacctggagcgctggggtgcccccatctgcccccctgcagggcgctgtgccccccaccagctctgtgccccctgtggccggggcccccagcgtgggccagcccggggccggcttcggcatgcctcctgctggcaccggcatgcccatgatgccccagcagcctgtgatgtttgcccagcccatgatgaggcccccatttggagctgctgctgtgcccggcacccagctgagccccagccccaccccagccagccagagccccaagaagcccccagccaaggaccccctggccgacctgaacatcaaggacttcctgtag

SEQ ID NO: 38688 - DNA, 1803 bp, Artificial Sequence
  Description of Artificial Sequence: Synthetic coding sequence
atgagcggccagaccctgacagacagaattgctgctgcccagtacagcgtgacaggcagcgctgtggcccgggctgtgtgcaaggccaccacccatgaggtgatgggccccaagaagaagcacctggactacctgatccaggccaccaatgagaccaacgtgaacatcccccagatggctgacaccctgtttgagcgggccaccaacagctcctgggtggtggtgttcaaggccctggtgaccacccaccacctgatggtgcacggcaatgaacgcttcatccagtacctggccagcaggaacaccctcttcaacctgagcaacttcctggacaagagcggcagccacggctatgacatgagcaccttcatccgccgctacagccgctacctgaatgagaaggccttctcctaccggcagatggcctttgattttgcccgggtgaagaagggagcagatggagtgatgaggaccatggcccctgagaagctgctgaagtccatgcccatcctgcagggccagattgatgccctgctggagtttgatgtgcaccccaatgagctgaccaacggggtcatcaatgctgccttcatgctgctcttcaaggacctgatcaagctgtttgcctgctacaatgatggagtcatcaacctgctggagaagttctttgagatgaagaagggccagtgcaaggatgccctggagatctacaagcgcttcctgaccaggatgaccagggtgtctgagttcctgaaggtggccgaggcccccagcagcctgatggagaccctggagcagcacctgaacaccctggagggcaagaagccaggcaacaagagcggggcccccagccccctgagcaagagcagccctgccaccaccgtgaccagccccaacagcaccccagccaagaccatcgacaccagcccccctgtggacctgtttgccacagccagcgctgctgtgcctgtgtccaccagcaagcccagcagtgacctgctggacctgcagcctgacttcagcagcggcggcgctgctgctgctgctgccccagcccctcctcctcctgctggaggagccacagcctggggcggctttggaggcagcttcatggcccccagccccagccctgtgaccccagcccagaacaacctgctgcagcccaactttgaggccgccttcggcaccacccccagcaccagcagcagcagcagctttgaccccagcgtgtttgatggcctgggggacctgctgatgcccaccatggccccagctggccagcctgcccctgtgtccatggtgccccccagccctgccatggccgccagcaaggccctgggcagtgacctggacagcagcctggccagcctggtgggcaacctgggcatcagcggcaccaccaccaagaagggggacctgcagtggaatgctggggagaagaagctgactggaggagccaactggcagcccaaggtggccccagccacctggagcgctggggtgccccccagcgcccccctgcagggcgctgtgccccccaccagctctgtgccccctgtggccggggcccccagcgtgggccagcctggagctggcttcggcatgcccccagctggcaccggcatgcccatgatgccccagcagcctgtgatgtttgcccagcccatgatgaggcccccatttggagctgctgctgtgcccggcacccagctgagccccagccccaccccagccagccagagccccaagaagcccccagccaaggaccccctggccgacctgaacatcaaggacttcctgtag

SEQ ID NO: 38689 - DNA, 2724 bp, Artificial Sequence; identical to SEQ ID NO: 38686
  Description of Artificial Sequence: Synthetic coding sequence

SEQ ID NO: 38690 - DNA, 633 bp, Artificial Sequence
  Description of Artificial Sequence: Synthetic coding sequence
atggagaccctggagcagcacctgaacaccctggagggcaagaagccaggcaacaagtatgccagcggggcccccagccccctgagcaagagcagccctgccaccaccgtgaccagccccaacagcaccccagccaagaccatcgacaccagcccccctgtggacctgtttgccacagccagcgctgctgtgcctgtgtccaccagcaagcccagcagtgacctgctggacctgcagcctgacttcagcagcggcggcgctgctgctgctgctgccccagcccctcctcctcctgctggaggagccacagcctggggagacctgctgggggaggacagcctggccgccctgagctctgtgcccagcgaggcccagatcagtgacccctttgcccctgagcccaccccacccaccaccacagctgagatcgccacagccagcgccagcgccagcaccaccaccaccgtgacagctgtgacagctgaggtggacctgtttggaggcagcgctgaggccgcccctgagctggacctgtttgccatgaagcccccagagacctctgtgcctgtggtgacccccacagccagcacagcccctcctgtgcctgccacagcccccagccctgccccctag

SEQ ID NO: 38691 - DNA, 456 bp, Artificial Sequence
  Description of Artificial Sequence: Synthetic coding sequence
atgagcggccagaccctgacagacagaattgctgctgcccagtacagcgtgacaggcagcgctgtggcccgggctgtgtgcaaggccaccacccatgaggtgatgggccccaagaagaagcacctggactacctgatccaggccaccaatgagaccaacgtgaacatcccccagatggctgacaccctgtttgagcgggccaccaacagctcctgggtggtggtgttcaaggccctggtgaccacccaccacctgatggtgcacggcaatgaacgcttcatccagtacctggccagcaggaacaccctcttcaacctgagcaacttcctggacaagagcggcagccacggctatgacatgagcaccttcatccgccgctacagccgctacctgaatgagaaggccttctcctaccggcagatggcctttgattttgcccgggtgaagaagggctag

SEQ ID NO: 38692 - DNA, 459 bp, Artificial Sequence
  Description of Artificial Sequence: Synthetic coding sequence
atgagcggccagaccctgacagacagaattgctgctgcccagtacagcgtgacaggcagcgctgtggcccgggctgtgtgcaaggccaccacccatgaggtgatgggccccaagaagaagcacctggactacctgatccaggccaccaatgagaccaacgtgaacatcccccagatggctgacaccctgtttgagcgggccaccaacagctcctgggtggtggtgttcaaggccctggtgaccacccaccacctgatggtgcacggcaatgaacgcttcatccagtacctggccagcaggaacaccctcttcaacctgagcaacttcctggacaagagcggcagccacggctatgacatgagcaccttcatccgccgctacagccgctacctgaatgagaaggccttctcctaccggcagatggcctttgattttgcccgggtgaagaagggggcctag

SEQ ID NO: 38693 - DNA, 201 bp, Artificial Sequence
  Description of Artificial Sequence: Synthetic coding sequence
atgagcggccagaccctgacagacagaattgctgctgcccagtacagcgtgacaggcagcgctgtggcccgggctgtgtgcaaggccaccacccatgaggtgatgggccccaagaagaagcacctggactacctgatccaggccaccaatgagaccaacgtgaacatcccccagatggctgacaccctgtttgagaggtag

SEQ ID NO: 38694 - DNA, 1803 bp, Artificial Sequence; identical to SEQ ID NO: 38688
  Description of Artificial Sequence: Synthetic coding sequence

SEQ ID NO: 38695 - DNA, 2709 bp, Artificial Sequence; identical to SEQ ID NO: 38684
  Description of Artificial Sequence: Synthetic coding sequence

SEQ ID NO: 38696 - DNA, 2724 bp, Artificial Sequence; identical to SEQ ID NO: 38686
  Description of Artificial Sequence: Synthetic coding sequence

SEQ ID NO: 38697 - DNA, 354 bp, Artificial Sequence
  Description of Artificial Sequence: Synthetic coding sequence
atgagcggccagaccctgacagacagaattgctgctgcccagtacagcgtgacaggcagcgctgtggcccgggctgtgtgcaaggccaccacccatgaggtgatgggccccaagaagaagcacctggactacctgatccaggccaccaatgagaccaacgtgaacatcccccagatggctgacaccctgtttgagcgggccaccaacagctcctgggtggtggtgttcaaggccctggtgaccacccaccacctgatggtgcacggcaatgaacgcttcatccagtacctggccagcaggaacaccctcttcaacctgagcaacttcctggacaagagcggcagccacggctag

SEQ ID NO: 38698 - DNA, 1689 bp, Artificial Sequence
  Description of Artificial Sequence: Synthetic coding sequence
atggccacagaacatgtgaatggaaatggaacagaggagcccatggacaccaccagcgctgtgatccacagcgagaacttccagaccctgctggatgctggcctgccccagaaggtggccgagaagctggatgagatctacgtggccggcctggtggcccacagcgacctggatgagcgggccatcgaggccctgaaggagttcaatgaagatggagccctggccgtgctgcagcagttcaaggacagcgacctgagccacgtgcagaacaagagcgccttcctgtgtggggtgatgaagacctaccggcagcgggagaagcagggcaccaaggtggccgacagcagcaaaggaccagatgaggccaagatcaaggccctgctggagaggacaggctacaccctggatgtgaccaccggccagaggaaatatggaggccccccaccagattctgtgtacagcggccagcagcccagcgtgggcacagagatctttgtgggcaagatcccccgggacctgtttgaagatgagctggtgcccctgtttgagaaggccggccccatctgggacctgcggctgatgatggaccccctgaccggcctgaacagaggctacgcctttgtgaccttctgcaccaaggaggccgcccaggaggccgtgaagctgtacaacaaccacgagatccgcagcggcaagcacatcggcgtgtgcatctctgtggccaacaacagactctttgtgggcagcatccccaagagcaagaccaaggagcagatcctggaggagttcagcaaggtgacagagggcctgacagatgtgatcctgtaccaccagccagatgacaagaagaagaacagaggcttctgcttcctggagtatgaggaccacaagacagctgcccaggcccggcggcggctgatgtctgggaaggtgaaggtgtggggcaatgtgggcaccgtggagtgggccgaccccattgaagatcctgaccctgaggtgatggccaaggtgaaggtgctgtttgtgaggaacctggccaacacagtgacagaggagatcctggagaaggccttcagccagtttgggaagctggagcgggtgaagaagctgaaggactatgccttcatccactttgatgaaagagatggagctgtgaaggccatggaggagatgaatggcaaggacctggagggagaaaatattgaaattgtgtttgccaagcccccagaccagaagaggaaggagaggaaggcccagaggcaggccgccaagaaccagatgtatgatgactactactactacggccccccccacatgcccccacccacccggggccggggccggggcggccggggcggctacggctaccccccagactactacggctatgaggactactatgactactacggctatgactaccacaactacagaggaggctatgaggacccctactacggctatgaggacttccaggtgggcgcccggggccggggcggccgcggggcccggggggccgcccccagccggggccgcggggccgccccaccccggggccgggccggctacagccagagaggaggccctggcagcgcccggggcgtgcggggggcccggggcggggcccagcagcagaggggccggggccagggcaagggcgtggaggccggccctgacctgctgcagtag

SEQ ID NO: 38699 - DNA, 1872 bp, Artificial Sequence
  Description of Artificial Sequence: Synthetic coding sequence
atggccacagaacatgtgaatggaaatggaacagaggagcccatggacaccaccagcgctgtgatccacagcgagaacttccagaccctgctggatgctggcctgccccagaaggtggccgagaagctggatgagatctacgtggccggcctggtggcccacagcgacctggatgagcgggccatcgaggccctgaaggagttcaatgaagatggagccctggccgtgctgcagcagttcaaggacagcgacctgagccacgtgcagaacaagagcgccttcctgtgtggggtgatgaagacctaccggcagcgggagaagcagggcaccaaggtggccgacagcagcaaaggaccagatgaggccaagatcaaggccctgctggagaggacaggctacaccctggatgtgaccaccggccagaggaaatatggaggccccccaccagattctgtgtacagcggccagcagcccagcgtgggcacagagatctttgtgggcaagatcccccgggacctgtttgaagatgagctggtgcccctgtttgagaaggccggccccatctgggacctgcggctgatgatggaccccctgaccggcctgaacagaggctacgcctttgtgaccttctgcaccaaggaggccgcccaggaggccgtgaagctgtacaacaaccacgagatccgcagcggcaagcacatcggcgtgtgcatctctgtggccaacaacagactctttgtgggcagcatccccaagagcaagaccaaggagcagatcctggaggagttcagcaaggtgacagagggcctgacagatgtgatcctgtaccaccagccagatgacaagaagaagaacagaggcttctgcttcctggagtatgaggaccacaagacagctgcccaggcccggcggcggctgatgtctgggaaggtgaaggtgtggggcaatgtgggcaccgtggagtgggccgaccccattgaagatcctgaccctgaggtgatggccaaggtgaaggtgctgtttgtgaggaacctggccaacacagtgacagaggagatcctggagaaggccttcagccagtttgggaagctggagcgggtgaagaagctgaaggactatgccttcatccactttgatgaaagagatggagctgtgaaggccatggaggagatgaatggcaaggacctggagggagaaaatattgaaattgtgtttgccaagcccccagaccagaagaggaaggagaggaaggcccagaggcaggccgccaagaaccagatgtatgatgactactactactacggccccccccacatgcccccacccacccggggccggggccggggcggccggggcggctacggctaccccccagactactacggctatgaggactactatgactactacggctatgactaccacaactacagaggaggctatgaggacccctactacggctatgaggacttccaggtgggcgcccggggccggggcggccgcggggcccggggggccgcccccagccggggccgcggggccgccccaccccggggccgggccggctacagccagagaggaggccctggcagcgcccggggcgtgcggggggcccggggcggggcccagcagcagaggggccggggcgtgcggggggcccggggcggccggggcggcaatgtgggcggcaagaggaaggcagatggctacaaccagcctgacagcaagaggcggcagaccaacaaccagaactggggcagccagcccatcgcccagcagcccctgcagggcggggaccacagcggcaactacggctacaagtctgagaaccaggagttctaccaggacaccttcggccagcagtggaagtag

SEQ ID NO: 38700 - DNA, 558 bp, Artificial Sequence
  Description of Artificial Sequence: Synthetic coding sequence
atggccacagaacatgtgaatggaaatggaacagaggagcccatggacaccaccagcgctgtgatccacagcgagaacttccagaccctgctggatgctggcctgccccagaaggtggccgagaagctggatgagatctacgtggccggcctggtggcccacagcgacctggatgagcgggccatcgaggccctgaaggagttcaatgaagatggagccctggccgtgctgcagcagttcaaggacagcgacctgagccacgtgcagaacaagagcgccttcctgtgtggggtgatgaagacctaccggcagcgggagaagcagggcaccaaggtggccgacagcagcaaaggaccagatgaggccaagatcaaggccctgctggagaggacaggctacaccctggatgtgaccaccggccagaggaaatatggaggccccccaccagattctgtgtacagcggccagcagcccagcgtgggcacagagatctttgtgggcaagatcccccgggacctgtttgaagatgagctggtgcccctgtttgagaaggcctag

SEQ ID NO: 38701 - DNA, 1260 bp, Artificial Sequence
  Description of Artificial Sequence: Synthetic coding sequence
atgaggaacatcttcaagaggaaccaggagcccatcgtggccccagccaccaccacagccaccatgcccatcggccctgtggacaacagcacagaaagtggaggagctggggagagccaggaggacatgtttgccaagctgaaggagaagctgttcaatgagatcaacaagatccccctgcccccctgggccctgattgccatcgctgtggtggccggcctgctgctgctgacctgctgcttctgcatctgcaagaagtgctgctgcaagaagaagaagaacaagaaggagaagggcaagggcatgaagaatgccatgaacatgaaggacatgaagggcggccaggatgatgatgatgctgagaccggcctgacagaaggagagggggagggggaggaggagaaggagcctgagaacctgggcaagctgcagttcagcctggactatgacttccaggccaaccagctgactgtgggcgtgctgcaggccgctgagctgcctgccctggacatgggcggcaccagtgacccctacgtgaaggtgttcctgctgcctgacaagaagaagaagtatgagaccaaggtgcacaggaagaccctgaacccagccttcaatgagaccttcaccttcaaggtgccctaccaggagctgggcggcaagaccctggtgatggccatctatgactttgaccgcttcagcaagcatgacatcatcggggaggtgaaggtgcccatgaacacagtggacctgggccagcccatcgaggagtggagggacctgcagggcggggagaaggaggagcctgagaagctgggggacatctgcaccagcctgcgctacgtgcccacagctgggaagctgactgtgtgcatcctggaggccaagaacctgaagaagatggatgtgggcggcctgagtgacccctacgtgaagatccacctgatgcagaatggcaagaggctgaagaagaagaagaccaccgtgaagaagaagaccctgaacccctacttcaatgaaagcttctcctttgagatcccctttgagcagatccagaaggtgcaggtggtggtgacagtgctggactatgacaagctgggcaagaatgaggccatcggcaagatctttgtgggcagcaatgccactggaacagagctgcggcactggagcgacatgctggccaacccccggcggcccatcgcccagtggcacagcctgaagccagaggaggaggtggatgccctgctgggcaagaacaagtag

SEQ ID NO: 38702 - DNA, 1260 bp, Artificial Sequence; identical to SEQ ID NO: 38701
  Description of Artificial Sequence: Synthetic coding sequence

SEQ ID NO: 38703 - DNA, 1206 bp, Artificial Sequence
  Description of Artificial Sequence: Synthetic coding sequence
atgctgcacctgcacggctggcagaccatgcagggcaggaagatgggccacccccctgtgagccccagcgccccagccccagctggcaccacagccatccctggcctcatcccagacctggtggccggcaccccctggccccgctgggccctgattgctggggccctggccgccggcgtgctgctggtgtcctgcctgctgtgtgccgcctgctgctgctgcagaagacacaggaagaagccccgggacaaggagagcgtgggcctgggcagcgcccggggcaccaccaccacccacctggtgcagccagatgtggatggcctggagagcagccctggagatgcccagcagtggggctgcctgcagctgagcctggagtttgattttggcagccaggagatccgggtgggcctgcggcaggccgctgacctgcggcctgggggcaccgtggacccctatgcccgggtgtctgtgtccacccaggccggccacagacatgagaccaaggtgcaccggggcaccctgtgccctgtgtttgatgagacctgctgcttccacatcccccaggccgagctgcccggggccaccctgcaggtgcagctgttcaacttcaagcgcttcagcggccacgagcccctgggggagctgcggctgcccctgggcaccgtggacctgcagcacgtgctggagcactggtacctgctgggccccccagctgccacccagcctgagcaggtgggggagctgtgcttcagcctgcgctacgtgcccagcagcggccgcctgactgtggtggtgctggaggcccggggcctgcggcccggcctggccgagccctacgtgaaggtgcagctgatgctgaaccagaggaagtggaagaagaggaagacagccaccaagaagggcacagctgccccctacttcaatgaggccttcaccttcctggtgcccttcagccaggtgcagaatgtggacctggtgctggccgtgtgggacaggagcctgcccctgaggacagagcctgtgggcaaggtgcacctgggcgcccgggccagcggccagcccctgcagcactgggccgacatgctggcccacgcccggcggcccatcgcccagaggcaccccctgcggcctgcccgggaggtggacaggatgctggccctgcagccccggctgcggctgcggctgcccctgccccacagctag

SEQ ID NO: 38704 - DNA, 477 bp, Artificial Sequence
  Description of Artificial Sequence: Synthetic coding sequence
atgggccacccccctgtgagccccagcgccccagccccagctggcaccacagccatccctggcctcatcccagacctggtggccggcaccccctggccccgctgggccctgattgctggggccctggccgccggcgtgctgctggtgtcctgcctgctgtgtgccgcctgctgctgctgcagaagacacaggaagaagccccgggacaaggagagcgtgggcctgggcagcgcccggggcaccaccaccacccacctggtgcagccagatgtggatggcctggagagcagccctggagatgcccagcagtggggctgcctgcagctgagcctggagtttgattttggcagccaggaggtgaagggccctgctgcccaggaccagcgcttctgtgagttccctgagcgggtgactggagagggccagaccccctgccccggctggtggggcgctgaccgggccggggccctgggctag

SEQ ID NO: 38705 - DNA, 933 bp, Artificial Sequence
  Description of Artificial Sequence: Synthetic coding sequence
atgcccagcagcaagccaggcagccctgccccccaggaccccagccccagctgcaggacctgcagcaaccaggtgcagcccggccacctgctgctgcccctgaccaaggccagcctgaccggccccagccccccaccagccaagctgggccgggcccagggcgcccccagccccaagggccccctggagatcggctggagcccagatgcccagcccctgcggctgggggagaccttcctgcccaagggcgtggcccagctgagccgggccagcagcagcggccacaaggtgggcttcctgcagccctggccaccccaccccctgctgccccaggagcgggtgcccaggcaccagaggcagtgctgccccagggctggccctgccttcggctgcctgcggggccggcctgggggctggccagccaccggcagcggcggccggcagcagggcaggaagatgggccacccccctgtgagccccagcgccccagccccagctggcaccacagccatccctggcctcatcccagacctggtggccggcaccccctggccccgctgggccctgattgctggggccctggccgccggcgtgctgctggtgtcctgcctgctgtgtgccgcctgctgctgctgcagaagacacaggaagaagccccgggacaaggagagcgtgggcctgggcagcgcccggggcaccaccaccacccacctggtgcagccagatgtggatggcctggagagcagccctggagatgcccagcagtggggctgcctgcagctgagcctggagtttgattttggcagccaggaggtgaagggccctgctgcccaggaccagcgcttctgtgagttccctgagcgggtgactggagagggccagaccccctgccccggctggtggggcgctgaccgggccggggccctgggctag

SEQ ID NO: 38706 - DNA, 570 bp, Artificial Sequence
  Description of Artificial Sequence: Synthetic coding sequence
atgctgggcagcagagctgtgatgctgctgctgctgctgccctggacagcccagggccgggctgtgcctgggggcagcagccctgcctggacccagtgccagcagctgagccagaagctgtgcaccctggcctggagcgcccaccccctggtgggccacatggacctgcgggaggagggagatgaggagaccaccaatgatgtgccccacatccagtgtggagatggctgtgacccccagggcctgcgggacaacagccagttctgcctgcagaggatccaccagggcctcatcttctatgagaagctgctgggcagtgacatcttcaccggggagcccagcctgctgcctgacagccctgtgggccagctgcacgccagcctgctgggcctgagccagctgctgcagcctgagggccaccactgggagacccagcagatccccagcctgagccccagccagccctggcagaggctgctgctgcgcttcaagatcctgcggagcctgcaggcctttgtggccgtggccgcccgggtgtttgcccacggggccgccaccctgagcccctag

SEQ ID NO: 38707 - DNA, 1029 bp, Artificial Sequence
  Description of Artificial Sequence: Synthetic coding sequence
atgcaggtgtcctctgtggacttctccatgggcacagagcctgtgctgcagagaggagagaccaccaccagcatcggccgcatcaagccagagctgtacaagcagaagtctgtggacagcgagggcaaccagaatgaagatgtgaagatctgtgggaagctgaacttcaccctgcagtatgactatgaaaatgagctgctggtggtgaagatcatcaaggccctggacctgcctgccaaggacttcaccggcaccagtgacccctacgtgaagatgtacctgctgcctgacaggaagaagaagttccagaccagggtgcacaggaagaccctgaaccccctgtttgatgagaccttccagtttcctgtggcctatgaccagctgagcaacaggaagctgcacttctctgtgtatgactttgaccgcttcagcagacatgacatgattggagaggtgatcctggacaacctgtttgaggtgtctgacctgagccgggaggccaccgtgtggaaggacatccactgtgccaccacagagagcattgacctgggggagatcatgttcagcctgtgctacctgcccacagctggccgcatgaccctgaccgtcatcaagtgcaggaacctgaaggccatggacatcaccggcagcagtgacccctacgtgaaggtgtccctgatgtgtgagggccgccgcctgaagaagaggaagaccaccaccaagaagaacaccctgaaccctgtgtacaatgaggccatcatctttgacatccccccagaaaatgtggaccaggtgtccctgagcattgctgtgatggactatgacagagtgggccacaatgaggtgattggagtgtgcaggacaggcctggatgctgagggcctgggccgggaccactggaatgagatgctggcctaccacaggaagcccatcacccactggcaccccctgctggagctgcccggccgggccaccagctttgacagccagggcagctgccccagccccaagccacccagcaccccctag

SEQ ID NO: 38708 - DNA, 1296 bp, Artificial Sequence
  Description of Artificial Sequence: Synthetic coding sequence
atggccgagatcaccaacatccggcccagctttgatgtgtcccctgtggtggccggcctgattggagcctctgtgctggtggtgtgtgtgtctgtgacagtgtttgtgtggagctgctgccaccagcaggccgagaagaagcagaagaaccccccctacaagttcatccacatgctgaagggcatcagcatctacccagagaccctgagcaacaagaagaagatcatcaaggtgagaagagacaaggatggccctggccgggagggcggcagaagaaacctgctggtggatgctgctgaggccggcctgctgagccgggacaaggacccccggggccccagcagcggcagctgcatcgaccagctgcccatcaagatggactatggagaggagctgcggagccccatcaccagcctgaccccaggagagagcaagaccaccagccccagcagccctgaggaggatgtgatgctgggcagcctgaccttctctgtggactacaacttccccaagaaggccctggtggtgaccatccaggaggcccacggcctgcctgtgatggatgaccagacccagggcagtgacccctacatcaagatgaccatcctgcctgacaagaggcaccgggtgaagaccagggtgctgaggaagaccctggaccctgtgtttgatgagaccttcaccttctacggcatcccctacagccagctgcaggacctggtgctgcacttcctggtgctgagctttgaccgcttcagcagagatgatgtgattggagaggtgatggtgcccctggccggcgtggaccccagcacaggcaaggtgcagctgacccgggacatcatcaagaggaacatccagaagtgcatcagcagaggagagctgcaggtgtccctgagctaccagcctgtggcccagaggatgacagtggtggtgctgaaggcccggcacctgcccaagatggacatcaccggcctgagcggcaacccctacgtgaaggtgaatgtgtactacggcaggaagagaattgccaagaagaagacccacgtgaagaagtgcaccctgaaccccatcttcaatgaaagcttcatctatgacatccccacagacctgctgcctgacatcagcattgagttcctggtgattgactttgacaggaccaccaagaatgaggtggtgggccgcctcatcctgggcgcccacagcgtgacagccagcggggctgagcactggagggaggtgtgtgagagccccaggaagcctgtggccaagtggcacagcctgtctgagtactag

SEQ ID NO: 38709 - DNA, 375 bp, Artificial Sequence
  Description of Artificial Sequence: Synthetic coding sequence
atgacagtggtggtgctgaaggcccggcacctgcccaagatggacatcaccggcctgagcggcaacccctacgtgaaggtgaatgtgtactacggcaggaagagaattgccaagaagaagacccacgtgaagaagtgcaccctgaaccccatcttcaatgaaagcttcatctatgacatccccacagacctgctgcctgacatcagcattgagttcctggtgattgactttgacaggaccaccaagaatgaggtggtgggccgcctcatcctgggcgcccacagcgtgacagccagcggggctgagcactggagggaggtgtgtgagagccccaggaagcctgtggccaagtggcacagcctgtctgagtactag

SEQ ID NO: 38710 - DNA, 1425 bp, Artificial Sequence
  Description of Artificial Sequence: Synthetic coding sequence
atggcctacatccagctggagcccctgaatgaaggcttcctgagccgcatcagcggcctgctgctgtgccgctggacctgccgccactgctgccagaagtgctatgagagcagctgctgccagagcagtgaagatgaggtggagatcctgggccccttccctgcccagaccccaccctggctgatggccagccgcagcagtgacaaggatggagacagcgtgcacacagccagcgaggtgcccctgacccccaggaccaacagcccagatggccgccgcagcagcagtgacaccagcaagagcacctacagcctgacccggcgcatcagcagcctggagagcagaagacccagcagccccctgattgacatcaagcccattgaatttggagtgctgagcgccaagaaggagcccatccagcccagcgtgctgcggaggacctacaacccagatgactacttcaggaagtttgagccccacctgtacagcctggacagcaacagtgatgatgtggacagcctgacagatgaggagatcctgagcaagtaccagctgggcatgctgcacttcagcacccagtatgacctgctgcacaaccacctgactgtgcgggtcatcgaggcccgggacctgcccccacccatcagccatgatggcagccggcaggacatggcccacagcaacccctacgtgaagatctgcctgctgcctgaccagaagaacagcaagcagacaggagtgaagaggaagacccagaagcctgtgtttgaggagcgctacacctttgagatccccttcctggaggcccagaggaggaccctgctgctgactgtggtggactttgacaagttcagccgccactgcgtcatcggcaaggtgtctgtgcccctgtgtgaggtggacctggtgaagggcggccactggtggaaggccctgatccccagcagccagaatgaggtggagctgggggagctgctgctgagcctgaactacctgcccagcgctggccgcctgaatgtggatgtgatccgggccaagcagctgctgcagacagatgtgtcccagggcagtgacccctttgtgaagatccagctggtgcacggcctgaagctggtgaagaccaagaagaccagcttcctgcggggcaccatcgaccccttctacaatgaaagcttctccttcaaggtgccccaggaggagctggagaatgccagcctggtgttcaccgtgtttggccacaacatgaagagcagcaatgacttcatcggcagaattgtgattggccagtacagcagcggccccagcgagaccaaccactggaggaggatgctgaacacccacaggacagctgtggagcagtggcacagcctgcggagcagagcagaatgtgacagagtgtccccagccagcctggaggtgacctag

SEQ ID NO: 38711 - DNA, 1431 bp, Artificial Sequence
  Description of Artificial Sequence: Synthetic coding sequence
atggccagccctgagcccaggagaggaggagatggagctgcccaggccgccaggaagaccagggtggaggccaacagccccctgcccaagaacagcggcagcctgaatgaggccgaggccctgaaccctgaggtgaccctgagcagcgagggcagcctgaacctggaggacatcctgtacctggaggacaccggggacctggatgagaccctgtatgtgcaggagacagagaaggccgaggaggccctgtacatcgaggaggccatgcagccagatgaggccctgcacgtggaggagcccggcaaccctgaggagaccgtgtgtgtggaggagaccacagagccagaccgcatccagtttgtggagggccctgtggagcccgggaagcccaccagccctgagcacgtggtgtatgaaggagagaccgtgaccagggctgagaagagcaaccctgaggagagcctgcgggcagagcagagccccagcatggaggagaacctgagcattgaggacctggagctgctggagggccgcttccagcagtgtgtgcaggccgtggcccagctggaggaggagcgggaccagctgatccacgagctggtgctgctgcgggagcccgccctgcaggaggtgcagcaggtgcaccaggacatcctggccgcctacaagctgcacgcccaggccgagctggagagagatggcctgcgggaggagatccggctggtgaagcagaagctgttcaaggtgaccaaggaatgtgtggcctaccagtaccagctggagtgccggcagcaggatgtggcccagtttgctgacttccgggaggtgctgaccacccgggccacccagctgtctgaggagctggcccagctgagagatgcctaccagaagcagaaggagcagctgcggcagcagctggaggccccacccagccagagagatggccacttcctgcaggagagccggcggctgagcgcccagtttgagaacctgatggccgagagccggcaggacctggaggaggagtatgagccccagttcctgcggctgctggagaggaaggaggccggcaccaaggccctgcagaggacccaggccgagatccaggagatgaaggaggccctgcggcccctgcaggccgaggcccggcagctgcggctgcagaacagaaacctggaggaccagatcgccctggtgcggcagaagagagatgaggaggtgcagcagtaccgggagcagctggaggagatggaggagcggcagaggcagctgagaaatggagtgcagctgcagcagcagaagaacaaggagatggagcagctgcggctgagcctggccgaggagctgagcacctacaagggctgcctggagatctacggccagatctgcaaccctgagacagccaagaacttcctggccaaggaccactag

SEQ ID NO: 38712 - DNA, 1449 bp, Artificial Sequence
  Description of Artificial Sequence: Synthetic coding sequence
atggccagccctgagcccaggagaggaggagatggagctgcccaggccgccaggaagaccagggtggaggccaacagccccctgcccaagaacagcggcagcctgaatgaggccgaggccctgaaccctgaggtgaccctgagcagcgagggcagcctgaacctggaggacatcctgtacctggaggacaccggggacctggatgagaccctgtatgtgcaggagacagagaaggccgaggaggccctgtacatcgaggaggccatgcagccagatgaggccctgcacgtggaggagcccggcaaccctgaggagaccgtgtgtgtggaggagaccacagagccagaccgcatccagtttgtggagggccctgtggagcccgggaagcccaccagccctgagcacgtggtgtatgaaggagagaccgtgaccagggctgagaagagcaaccctgaggagagcctgcgggcagagcagagccccagcatggaggagaacctgagcattgaggacctggagctgctggagggccgcttccagcagtgtgtgcaggccgtggcccagctggaggaggagcgggaccagctgatccacgagctggtgctgctgcgggagcccgccctgcaggaggtgcagcaggtgcaccaggacatcctggccgcctacaagctgcacgcccaggccgagctggagagagatggcctgcgggaggagatccggctggtgaagcagaagctgttcaaggtgaccaaggaatgtgtggcctaccagtaccagctggagtgccggcagcaggatgtggcccagtttgctgacttccgggaggtgctgaccacccgggccacccagctgtctgaggagctggcccagctgagagatgcctaccagaagcagaaggagcagctgcggcagcagctggaggccccacccagccagagagatggccacttcctgcaggagagccggcggctgagcgcccagtttgagaacctgatggccgagagccggcaggacctggaggaggagtatgagccccagttcctgcggctgctggagaggaaggaggccggcaccaaggccctgcagaggacccaggccgagatccaggagatgaaggaggccctgcggcccctgcaggccgaggcccggcagctgcggctgcagaacagaaacctggaggaccagatcgccctggtgcggcagaagagagatgaggaggtgcagcagtaccgggagcagctggaggagatggaggagcggcagaggcagctgagaaatggagtgcagctgcagcagcagaagaacaaggagatggagcagctgcggctgagcctggccgaggagctgagcacctacaaggccatgctgctgcccaagagcctggagcaggctgatgcccccaccagccaggccggcggcatggagacccagagccagggcgctgtgtag

SEQ ID NO: 38713 - DNA, 273 bp, Artificial Sequence
  Description of Artificial Sequence: Synthetic coding sequence
atgcagccagatgaggccctgcacgtggaggagcccggcaaccctgaggagaccgtgtgtgtggaggagaccacagagccagaccgcatccagtttgtggagggccctgtggagcccgggaagcccaccagccctgagcacgtggtgtatgaaggagagaccgtgaccagggctgagaagagcaaccctgaggagagcctgcgggcagagcagagccccagcatggaggagaacctgagcattgaggacctggagctgctggagggccgctag

SEQ ID NO: 38714 - DNA, 213 bp, Artificial Sequence
  Description of Artificial Sequence: Synthetic coding sequence
atgcagccagatgaggccctgcacgtggaggagcccggcaaccctgaggagaccgtgtgtgtggaggagaccacagagccagaccgcatccagtttgtggagggccctgtggagcccgggaagcccaccagccctgagcacgtggtgtatgaaggagagaccgtgaccagggctgagaagagcaaccctgaggagagcctgcgggcagagtag

SEQ ID NO: 38715 - DNA, 405 bp, Artificial Sequence
  Description of Artificial Sequence: Synthetic coding sequence
atgagccccctgcggcccctgctgctggccctggccctggcctctgtgccctgtgcccagggcgcctgcccagccagcgctgacctgaagcacagtgatggcaccaggacctgtgccaagctgtatgacaagagtgacccctactatgagaactgctgcggcggcgctgagctgagcctggagagcggggctgacctgccctacctgcccagcaactgggccaacacagccagcagcctggtggtggccccccgctgtgagctgactgtgtggagccggcagggcaaggccggcaagacccacaagttctctgctggcacctacccccggctggaggagtacagaagaggcatcctgggggactggagcaatgccatcagcgccctgtactgccgctgcagctag

SEQ ID NO: 38716 - DNA, 897 bp, Artificial Sequence
  Description of Artificial Sequence: Synthetic coding sequence
atgagcctgtaccccagcctggaggacctgaaggtggacaaggtgatccaggcccagacagccttcagcgccaacccagccaacccagccatcctgtctgaggccagcgcccccatcccccatgatggcaacctgtacccccggctgtacccagagctgagccagtacatgggcctgagcctgaatgaggaggagatccgggccaacgtggccgtggtgtctggggcccccctgcagggccagctggtggcccggcccagcagcatcaactacatggtggcccctgtgactggaaatgatgtgggcatccggcgggcagagatcaagcagggcatccgggaggtgatcctgtgcaaggaccaggacggcaagattggcctgcggctgaagagcattgacaatggcatctttgtgcagctggtgcaggccaacagccctgccagcctggtgggcctgcgctttggagaccaggtgctgcagatcaacggggagaactgtgccggctggagcagtgacaaggcccacaaggtgctgaagcaggccttcggggagaagatcaccatgaccatccgggaccggccctttgagaggaccatcaccatgcacaaggacagcacaggccacgtgggcttcatcttcaagaatggcaagatcaccagcatcgtgaaggacagcagcgctgccagaaatggcctgctgacagagcacaacatctgtgagatcaatggccagaatgtgattggcctgaaggacagccagattgctgacatcctgagcaccagcggcaccgtggtgaccatcaccatcatgcctgccttcatctttgagcacatcatcaagaggatggcccccagcatcatgaagagcctgatggaccacaccatccctgaggtgtag

SEQ ID NO: 38717 - DNA, 897 bp, Artificial Sequence; identical to SEQ ID NO: 38716
  Description of Artificial Sequence: Synthetic coding sequence

SEQ ID NO: 38718 - DNA, 894 bp, Artificial Sequence
  Description of Artificial Sequence: Synthetic coding sequence
atgagcctgtaccccagcctggaggacctgaaggtggacaaggtgatccaggcccagacagccttcagcgccaacccagccaacccagccatcctgtctgaggccagcgcccccatcccccatgatggcaacctgtacccccggctgtacccagagctgagccagtacatgggcctgagcctgaatgaggaggagatccgggccaacgtggccgtggtgtctggggcccccctgcagggcctggtggcccggcccagcagcatcaactacatggtggcccctgtgactggaaatgatgtgggcatcagaagagctgagatcaagcagggcatccgggaggtgatcctgtgcaaggaccaggacggcaagattggcctgcggctgaagagcattgacaatggcatctttgtgcagctggtgcaggccaacagccctgccagcctggtgggcctgcgctttggagaccaggtgctgcagatcaatggagagaactgtgccggctggagcagtgacaaggcccacaaggtgctgaagcaggcctttggagagaagatcaccatgaccatccgggaccggccctttgagaggaccatcaccatgcacaaggacagcactggacatgtgggcttcatcttcaagaatggcaagatcaccagcatcgtgaaggacagcagcgctgccagaaatggcctgctgacagagcacaacatctgtgagatcaatggccagaatgtcatcggcctgaaggacagccagattgctgacatcctgagcaccagcggcaccgtggtgaccatcaccatcatgcctgccttcatctttgagcacatcatcaagaggatggcccccagcatcatgaagagcctgatggaccacaccatccctgaggtgtag

SEQ ID NO: 38719 - DNA, 879 bp, Artificial Sequence
  Description of Artificial Sequence: Synthetic coding sequence
atgagcctgtaccccagcctggaggacctgaaggcccagacagccttcagcgccaacccagccaacccagccatcctgtctgaggccagcgcccccatcccccatgatggcaacctgtacccccggctgtacccagagctgagccagtacatgggcctgagcctgaatgaggaggagatccgggccaacgtggccgtggtgtctggggcccccctgcagggccagctggtggcccggcccagcagcatcaactacatggtggcccctgtgactggaaatgatgtgggcatccggcgggcagagatcaagcagggcatccgggaggtgatcctgtgcaaggaccaggacggcaagattggcctgcggctgaagagcattgacaatggcatctttgtgcagctggtgcaggccaacagccctgccagcctggtgggcctgcgctttggagaccaggtgctgcagatcaacggggagaactgtgccggctggagcagtgacaaggcccacaaggtgctgaagcaggccttcggggagaagatcaccatgaccatccgggaccggccctttgagaggaccatcaccatgcacaaggacagcacaggccacgtgggcttcatcttcaagaatggcaagatcaccagcatcgtgaaggacagcagcgctgccagaaatggcctgctgacagagcacaacatctgtgagatcaatggccagaatgtgattggcctgaaggacagccagattgctgacatcctgagcaccagcggcaccgtggtgaccatcaccatcatgcctgccttcatctttgagcacatcatcaagaggatggcccccagcatcatgaagagcctgatggaccacaccatccctgaggtgtag

SEQ ID NO: 38720 - DNA, 894 bp, Artificial Sequence; identical to SEQ ID NO: 38718
  Description of Artificial Sequence: Synthetic coding sequence

SEQ ID NO: 38721 - DNA, 879 bp, Artificial Sequence
  Description of Artificial Sequence: Synthetic coding sequence
atgagcagcctgtaccccagcctggaggacctgaaggtggaccaggccatccaggcccaggtgcgggccagccccaagatgcctgccctgcctgtgcaggccacagccatcagccccccacctgtgctgtaccccaacctggccgagctggagaactacatgggcctgagcctgagcagccaggaggtgcaggagagcctgctgcagatccctgagggggacagcacagctgtgtctggccctggccctggccagatggtggcccctgtgacaggctacagcctgggcgtgcggcgggcagagatcaagccaggagtgcgggagatccacctgtgcaaggatgagcggggcaagacaggcctgcggctgaggaaggtggaccagggcctgtttgtgcagctggtgcaggccaacaccccagccagcctggtgggcctgcgctttggagaccagctgctgcagattgatggccgggactgtgccggctggagcagccacaaggcccaccaggtggtgaagaaggccagcggggacaagatcgtggtggtggtgcgggaccggcccttccagaggacagtgaccatgcacaaggacagcatgggccacgtgggctttgtgatcaagaagggcaagatcgtgtccctggtgaagggcagcagcgctgccagaaatggcctgctgaccaaccactacgtgtgtgaggtggatggccagaatgtgattggcctgaaggacaagaagatcatggagatcctggccacagctggaaatgtggtgaccctgaccatcatccccagcgtcatctatgagcacatggtgaagaagctgccccctgtgctgctgcaccacaccatggaccacagcatcccagatgcctag

SEQ ID NO: 38722 - DNA, 879 bp, Artificial Sequence; identical to SEQ ID NO: 38721
  Description of Artificial Sequence: Synthetic coding sequence

SEQ ID NO: 38723 - DNA, 624 bp, Artificial Sequence
  Description of Artificial Sequence: Synthetic coding sequence
atggtggcccctgtgacaggctacagcctgggcgtgagaagagctgagatcaagccaggagtgcgggagatccacctgtgcaaggatgagcggggcaagacaggcctgcggctgaggaaggtggaccagggcctgtttgtgcagctggtgcaggccaacaccccagccagcctggtgggcctgcgctttggagaccagctgctgcagattgatggccgggactgtgccggctggagcagccacaaggcccaccaggtggtgaagaaggccagcggggacaagatcgtggtggtggtgcgggaccggcccttccagaggacagtgaccatgcacaaggacagcatgggccacgtgggcttcgtcatcaagaagggcaagatcgtgtccctggtgaagggcagcagcgctgccagaaatggcctgctgaccaaccactacgtgtgtgaggtggatggccagaatgtcatcggcctgaaggacaagaagatcatggagatcctggccacagctggaaatgtggtgaccctgaccatcatccccagcgtcatctatgagcacatggtgaagaagctgccccctgtgctgctgcaccacaccatggaccacagcatcccagatgcctag

SEQ ID NO: 38724 - DNA, 879 bp, Artificial Sequence; identical to SEQ ID NO: 38721
  Description of Artificial Sequence: Synthetic coding sequence

SEQ ID NO: 38725 - DNA, 750 bp, Artificial Sequence
  Description of Artificial Sequence: Synthetic coding sequence
atgagcctggaggaccccttctttgtggtgcggggggaggtgcagaaggctgtgaacacagcccggggcctgtaccagcgctggtgtgagctgctgcaggagagcgctgctgtgggccgggaggagctggactggaccaccaatgagctgagaaatggcctgcggagcattgagtgggacctggaggacctggaggagaccatcggcatcgtggaggccaaccctgggaagttcaagctgcctgctggggacctgcaggagaggaaggtgtttgtggagaggatgagggaggccgtgcaggagatgaaggaccacatggtgagccccacagctgtggccttcctggagaggaacaaccgggagatcctggccggcaagccagctgcccagaagagccccagcgacctgctggatgccagcgctgtgtctgccaccagccgctacatcgaggagcagcaggccacccagcagctgatcatggatgagcaggaccagcagctggagatggtgtctggcagcatccaggtgctgaagcacatgagcggccgggtgggggaggagctggatgagcagggcatcatgctggatgcctttgcccaggagatggaccacacccagagcaggatggatggagtgctgaggaagctggccaaggtgagccacatgaccagtgaccggcggcagtggtgtgccatcgctgtgctggtgggcgtgctgctgctggtgctgatcctgctcttcagcctgtag

SEQ ID NO: 38726 - DNA, 603 bp, Artificial Sequence
  Description of Artificial Sequence: Synthetic coding sequence
atgagcctggaggaccccttctttgtggtgcggggggaggtgcagaaggctgtgaacacagcccggggcctgtaccagcgctggtgtgagctgctgcaggagagcgctgctgtgggccgggaggagctggactggaccaccaatgagctgagaaatggcctgcggagcattgagtgggacctggaggacctggaggagaccatcggcatcgtggaggccaaccctgggaagccagctgcccagaagagccccagcgacctgctggatgccagcgctgtgtctgccaccagccgctacatcgaggagcagcaggccacccagcagctgatcatggatgagcaggaccagcagctggagatggtgtctggcagcatccaggtgctgaagcacatgagcggccgggtgggggaggagctggatgagcagggcatcatgctggatgcctttgcccaggagatggaccacacccagagcaggatggatggagtgctgaggaagctggccaaggtgagccacatgaccagtgaccggcggcagtggtgtgccatcgctgtgctggtgggcgtgctgctgctggtgctgatcctgctcttcagcctgtag

SEQ ID NO: 38727 - DNA, 741 bp, Artificial Sequence
  Description of Artificial Sequence: Synthetic coding sequence
atgagcctggaggaccccttctttgtggtgcggggggaggtgcagaaggctgtgaacacagcccggggcctgtaccagcgctggtgtgagctgctgcaggagagcgctgctgtgggccgggaggagctggactggaccaccaatgagctgagaaatggcctgcggagcattgagtgggacctggaggacctggaggagaccatcggcatcgtggaggccaaccctgggaagttcaagctgcctgctggggacctgcaggagaggaaggtgtttgtggagaggatgagggaggccgtgcaggagatgaaggaccacatggtgagccccacagctgtggccttcctggagaggaacaaccgggagatcctggccggcaagccagctgcccagaagagccccagcgacctgctggatgccagcgctgtgtctgccaccagccgctacatcgaggagcagcaggccacccagcagctgatcatggatgagcaggaccagcagctggagatggtgtctggcagcatccaggtgctgaagcacatgagcggccgggtgggggaggagctggatgagcagggcatcatgctggatgcctttgcccaggagatggaccacacccagagcaggatggatggagtgctgaggaagctggccaaggtgagccacatgaccagcggggagagcccccagggccggggccagagctggtggggccaggtggtgggcggcaccctgagcccctag

SEQ ID NO: 38728 - DNA, 750 bp, Artificial Sequence; identical to SEQ ID NO: 38725
  Description of Artificial Sequence: Synthetic coding sequence

SEQ ID NO: 38729 - DNA, 741 bp, Artificial Sequence; identical to SEQ ID NO: 38727
  Description of Artificial Sequence: Synthetic coding sequence

SEQ ID NO: 38730 - DNA, 831 bp, Artificial Sequence
  Description of Artificial Sequence: Synthetic coding sequence
atgtcctatggccccctggacatgtacagaaatcctggccccagcggcccccagctgcgggacttcagcagcatcatccagacctgcagcggcaacatccagaggatcagccaggccacagcccagatcaagaacctgatgagccagctgggcaccaagcaggacagcagcaagctgcaggagaacctgcagcagctgcagcacagcaccaaccagctggccaaggagaccaatgagctgctgaaggagctgggcagcctgcccctgcccctgagcaccagcgagcagaggcagcagaggctgcagaaggagcggctgatgaatgacttctctgctgccctgaacaacttccaggccgtgcagaggagagtgtctgagaaggagaaggagagcatcgcccgggcccgggccggcagccggctgtctgctgaggagcggcagcgggaggagcagctggtgtcctttgacagccatgaggagtggaaccagatgcagagccaggaggatgaggtggccatcacagagcaggacctggagctgatcaaggagcgggagacagccatccggcagctggaggccgacatcctggatgtgaaccagatcttcaaggacctggccatgatgattcatgaccagggcgacctgattgacagcattgaggccaacgtggagagcagcgaggtgcacgtggagcgggccacagagcagctgcagagagctgcctactaccagaagaagagcaggaagaagatgtgcatcctggtgctggtgctgagcgtcatcatcctgatcctgggcctcatcatctggctggtgtacaagaccaagtag

SEQ ID NO: 38731 - DNA, 705 bp, Artificial Sequence
  Description of Artificial Sequence: Synthetic coding sequence
atgtcctatggccccctggacatgtacagaaatcctggccccagcggcccccagctgcgggacttcagcagcatcatccagacctgcagcggcaacatccagaggatcagccaggccacagcccagatcaagaacctgatgagccagctgggcaccaagcaggacagcagcaagctgcaggagaacctgcagcagctgcagcacagcaccaaccagctggccaaggagaccaatgagctgctgaaggagctgggcagcctgcccctgcccctgagcaccagcgagcagaggcagcagaggctgcagaaggagcggctgatgaatgacttctctgctgccctgaacaacttccaggccgtgcagaggagagtgtctgagaaggagaaggagagcatcgcccgggcccgggccggcagccggctgtctgctgaggagcggcagcgggaggagcagctggtgtcctttgacagcagcctgctgctggacatgaagaatgtggccctgcaggacttcatcgacagccggggcctggagccctgccacgaggagtggaaccagatgcagagccaggaggatgaggtggccatcacagagcaggacctggagctgatcaaggagcgggagacagccatccggcagctggaggccgacatcctggatgtgaaccagatcttcaaggacctggccatgatgattcatgactag

SEQ ID NO: 38732 - DNA, 1008 bp, Artificial Sequence
  Description of Artificial Sequence: Synthetic coding sequence
atggctgtggacatcaccctgctcttccgggcctctgtgaagacagtgaagaccaggaacaaggccctgggcgtggccgtgggcggcggcgtggatggcagcagagatgagctgttccgccgcagcccccggcccaagggggacttcagcagccgggcccgggaggtgatcagccacatcggcaagctgcgggacttcctgctggagcacaggaaggactacatcaatgcctacagccacaccatgtctgaatatggccgcatgacagacacagagcgggaccagattgaccaggatgcccagatcttcatgaggacctgcagcgaggccatccagcagctgaggacagaggcccacaaggagatccacagccagcaggtgaaggagcacaggacagctgtgctggacttcatcgaggactacctgaagagggtgtgcaagctgtacagcgagcagagggccatccgggtgaagagggtggtggacaagaagaggctgagcaagctggagcctgagcccaacaccaagacccgggagagcaccagcagcgagaaggtgtcccagagccccagcaaggacagcgaggagaacccagccacagaggagaggcctgagaagatcctggccgagacccagcctgagctgggcacctggggagatggcaagggggaggatgagctgagccctgaggagatccagatgtttgagcaggagaaccagaggctgattggagagatgaacagcctgtttgatgaggtgcggcagatcgagggccgggtggtggagatcagccggctgcaggagatcttcacagagaaggtgctgcagcaggaggccgagattgacagcatccaccagctggtggtgggcgccacagagaacatcaaggagggcaatgaagacatccgggaggccatcaagaacaatgccggcttccgggtgtggatcctcttcttcctggtgatgtgcagcttcagcctgctcttcctggactggtatgacagctag

SEQ ID NO: 38733 - DNA, 768 bp, Artificial Sequence
  Description of Artificial Sequence: Synthetic coding sequence
atgtccatggaggaccccttctttgtggtgaagggggaggtgcagaaggctgtgaacacagcccagggcctcttccagcgctggacagagctgctgcaggaccccagcacagccacccgggaggagattgactggaccaccaatgagctgaggaacaacctgcggagcattgagtgggacctggaggacctggatgagaccatcagcatcgtggaggccaaccccaggaagttcaacctggatgccacagagctgagcatcaggaaggccttcatcaccagcacccggcaggtggtgcgggacatgaaggaccagatgagcaccagctctgtgcaggccctggccgagaggaagaaccggcaggccctgctgggggacagcggcagccagaactggagcacaggcaccacagacaagtatggccgcctggaccgggagctgcagagggccaacagccacttcatcgaggagcagcaggcccagcagcagctgattgtggagcagcaggatgagcagctggagctggtgtctggcagcattggagtgctgaagaacatgagccagagaattggaggagagctggaggagcaggccgtgatgctggaggacttcagccatgagctggagagcacccagagccggctggacaacgtgatgaagaagctggccaaggtgagccacatgaccagtgaccggcggcagtggtgtgccatcgccatcctgtttgctgtgctgctggtggtgctgatcctcttcctggtgctgtag

SEQ ID NO: 38734 - DNA, 465 bp, Artificial Sequence
  Description of Artificial Sequence: Synthetic coding sequence
atgaaggaccagatgagcaccagctctgtgcaggccctggccgagaggaagaaccggcaggccctgctgggggacagcggcagccagaactggagcacaggcaccacagacaagtatggccgcctggaccgggagctgcagagggccaacagccacttcatcgaggagcagcaggcccagcagcagctgattgtggagcagcaggatgagcagctggagctggtgtctggcagcattggagtgctgaagaacatgagccagagaattggaggagagctggaggagcaggccgtgatgctggaggacttcagccatgagctggagagcacccagagccggctggacaacgtgatgaagaagctggccaaggtgagccacatgaccagtgaccggcggcagtggtgtgccatcgccatcctgtttgctgtgctgctggtggtgctgatcctcttcctggtgctgtag

SEQ ID NO: 38735 - DNA, 1779 bp, Artificial Sequence
  Description of Artificial Sequence: Synthetic coding sequence
atggcccctcctgtggccgagcggggcctgaagtctgtggtgtggcagaagatcaaggccaccgtgtttgatgactgcaagaaggagggggagtggaagatcatgctgctggatgagttcaccaccaagctgctggccagctgctgcaagatgacagacctgctggaggagggcatcaccgtggtggagaacatctacaagaaccgggagcctgtgcggcagatgaaggccctgtacttcatcacccccaccagcaagtctgtggactgcttcctgcatgactttgccagcaagtctgagaacaagtacaaggccgcctacatctacttcacagacttctgcccagacaacctcttcaacaagatcaaggccagctgcagcaagagcatccgccgctgcaaggagatcaacatctccttcatcccccatgagagccaggtgtacaccctggatgtgcctgatgccttctactactgctacagcccagaccctggaaatgccaagggcaaggatgccatcatggagaccatggctgaccagatcgtgacagtgtgtgccaccctggatgagaaccctggggtgcgctacaagagcaagcccctggacaatgccagcaagctggcccagctggtggagaagaagctggaggactactacaagattgatgagaagagcctcatcaagggcaagacccacagccagctgctgatcatcgaccggggctttgatcctgtgtccacagtgctgcacgagctgaccttccaggccatggcctatgacctgctgcccattgaaaatgacacctacaagtacaagacagatggcaaggagaaggaggccatcctggaggaggaggatgacctgtgggtgcgcatccgccaccgccacatcgctgtggtgctggaggagatccccaagctgatgaaggagatcagcagcaccaagaaggccacagagggcaagaccagcctgagcgccctgacccagctgatgaagaagatgccccacttcaggaagcagatcaccaagcaggtggtgcacctgaacctggccgaggactgcatgaacaagttcaagctgaacatcgagaagctgtgcaagacagagcaggacctggccctgggcacagatgctgagggccagaaggtgaaggacagcatgagggtgctgctgcctgtgctgctgaacaagaaccacgacaactgtgacaagatccgggccatcctgctgtacatcttcagcatcaatggcaccacagaggagaacctggacaggctcatccagaatgtgaagattgaaaatgaaagtgacatgatccggaactggagctacctgggcgtgcccatcgtgccccagagccagcagggcaagcccctgaggaaggacagatctgctgaggagaccttccagctgagccgctggacccccttcatcaaggacatcatggaggatgccatcgacaaccggctggacagcaaggagtggccctactgcagccagtgcccagctgtgtggaatggcagcggggctgtgtctgcccggcagaagccccgggccaactacctggaggacaggaagaatggcagcaagctgattgtgtttgtgattggaggcatcacctacagcgaggtgcgctgtgcctatgaggtgtcccaggcccacaagagctgtgaggtgatcatcggcagcacccacgtgctgacccccaagaagctgctggatgacatcaagatgctgaacaagcccaaggacaaggtgtccctcatcaaggatgaatag

SEQ ID NO: 38736 - DNA, 2616 bp, Artificial Sequence
  Description of Artificial Sequence: Synthetic coding sequence
cgcatctgcagccaggaggaggtggtgatcccctgtgcctatgacagcgacagcgagagcgtggacctggagctgagcaacctggagatcatcaagaagggcagcagcagcattgagctgacagacctggacatcccagacatccctggcctgcactgtgagcccctgagccacagccccaggcacctgacccagcaggaccccctgtctgaggccatcgtggagaagctgatccagagcatccagaaggtgttcaacggggagctgaagggggagctggagaagctgaagttcctgggggacctgagcagcctgagccaggccctgccctatgatgaaacagccaagagcttcatccacagccacatcgctgacatcgtgcacaccctgaatgtgctggtgcaggaggagcggccccacagcctgagcagctccatgaggcaggaggtgtttgtgaccatcgctgacctgagctaccaggatgtgcacctgctgctgggctctgaagatagagctgagctgttcagcctgaccatcaagagcatcatcaccctgcccagcgtgaggaccctgacccagatccaggagatcatgcccaacggcacctgcaacacagagtgcctgtaccggcagaccttccaggccttcagcgagatgctgcagagcctggtggtgaaggacccccacctggagaacctggacaccatcatcaagctgcccctgcgcttccagaggctgggccacctggtggccctgatggccctgctgtgtggggacccccaggagaaggtggccgaggaggccgctgagggcatccacagcctgctgcacatcaccctgcggctgaagtacatcacccatgacaagaaggaccagcagaacctgaagagggccctgaccaagtgccgggagttcctggagctgcacagcagcgctgccaagtgcttctacaactgccccttcagaattgcccaggtgcctgagatcatgggcgtcatctgtgcccagctgagcatcatcagccagccccgggtgcggcagcagatcatcaacacagtgtccctcttcatcagccggcccaagtacacagacatcgtgctgtccttcctgctgtgccaccctgtgccctacaacagacacctggccgaggtgtggaggatgctgtctgtggagctgcccagcaccacctggatcctgtggaggctgctgaggaagctgcagaagtgccacaatgaaccagcccaggagaagatggcctacgtggccgtggccgccacagatgccctgtatgaggtgttcctgggcaaccggctgcgggccgccaccttccgcctcttcccccagctgctgatgaccctgctgatccagatccaccacagcatcggcctgaccatgtctgatgtggacatccccagcggcctgtacacagagcaggaggtgcccagcgaggtgacccccctgtgctttgccatgcaggccaccaagaccctgctgctgcggacctgctgcctgcaggagttcaacatcatggagaagaacaagggctgggccctgctgggcggcaaggatggccacctgcagggcctcttcctgctggccaatgccctgctggagaggaaccagctgctggcccagaaggtgatgtacctgctggtgcccctgctgaacagaggaaatgacaagcacaagctgaccagcgctggcttctttgtggagctgctgcggagccctgtggccaagaggctgcccagcatctacagcgtggcccgcttcaaggactggctgcaggacggcaaccacctgttccgcatcctgggcctgcggggcctgtacaacctggtgggccaccaggagatgagggaggacatcaagagcctgctgccctacatcgtggacagcctgcgggagacagatgagaagatcgtgctgagcgccatccagatcctgctgcagctggtgaggaccatggacttcaccaccctggccgccatgatgaggaccctcttcagcctgtttggagatgtgcggagtgatgtgcaccgcttctctgtgaccctgtttggagctgccatcaagtctgtgaagaacccagacaagaagagcattgagaaccaggtgctggacagcctggtgcccctgctgctgtacagccaggatgaaaatgatgctgtggccgaggagagccggcaggtgctgaccatctgtgcccagttcctgaagtggaagctgccccaggaggtgtacagcaaggacccctggcacatcaagcccacagaggccggcaccatctgccgcttctttgagaagaagtgcaagggcaagatcaacatcctggagcagaccctgatgtacagcaagaaccccaagctgcccatcagaagatctgctgtgctgtttgtgggcctgctgagcaagtacatggaccacaatgagctgcggaggatgggcacagactggattgaagatgacctgcgggacctgctgtgtgaccctgagcccagcctgtgcatcatcgccagccagaccctgctgctggtgcagatggcccgggcagagcccaagcccaagcagagggtgaactggctgcagaagctgatgggccgcagcagcgcctag

SEQ ID NO: 38737 - DNA, 1620 bp, Artificial Sequence
  Description of Artificial Sequence: Synthetic coding sequence
atgggcacagagggccccccacctcctgctgccagccggggccggcagggctgcctgctggtgcctgcccggaccaagaccaccatcgccctgctgtatgatgaggagagtgaaaatgcctatgacatccggctgaagctgaccaaggaggtgctgaccatccagaagcaggatgtggtgtgtgtgggcggcagccaccagggcaggaacagaagaacagtgaccctgcggcggcagcctgtgggcggcctgggcctgagcatcaagggcggcagcgagcacaacgtgcctgtggtgatcagcaagatctttgaggaccaggccgctgaccagacaggcatgctgtttgtgggagatgctgtgctgcaggtgaatggcatccacgtggagaatgccacccatgaggaggtggtgcacctgctgagaaatgctggagatgaggtgaccatcaccgtggagtacctgcgggaggccccagccttcctgaagctgcccctgggcagccctggccccagcagtgaccacagcagcggggccagcagccccctgtttgacagcggcctgcacctgaatggaaacagcagcaccacagcccccagcagccccagcagccccatcgccaaggaccccaggtatgagaagcgctggctggacaccctgtctgtgcccctgtccatggcccgcatcagccgctacaaggccggcacagagaagctgcgctggaatgcctttgaggtgctggccctggatggagtgagcagcggcatcctgcgcttctacacagcccaggacggcacagactggctgcgggctgtgtctgccaacatccgggagctgaccctgcagaacatgaagatggccaacaagtgctgcagccccagcgaccaggtggtgcacatgggctgggtgaatgagaagctgcagggcgctgacagcagccagaccttccggcccaagttcctggccctgaagggccccagcttctacgtgttcagcaccccacctgtgtccacctttgactgggtgcgggcagagaggacctaccacctgtgtgaggtgctcttcaaggtgcacaagttctggctgacagaggactgctggctgcaggccaacctgtacctgggcctgcaggactttgattttgaggaccagaggccctactgcttcagcatcgtggccggccacggcaagagccacgtgttcaacgtggagctgggcagcgagctggccatgtgggagaagagcttccagagggccaccttcatggaggtgcagaggacaggcagcaggacctacatgtgctcctggcagggcgagatgctgtgcttcaccgtggactttgccctgggcttcacctgctttgagagcaagaccaagaatgtgctgtggaggttcaagttcagccagctgaagggcagcagtgatgatggcaagaccagggtgaagctgctcttccagaacctggacaccaagcagatcgagaccaaggagctggagttccaggacctgcgggctgtgctgcactgcatccacagcttcatcgccgccaaggtggcctctgtggaccccggcttcatggacagccagagcctggccaggaagtacatgtacagcagctag

SEQ ID NO: 38738 - DNA, 540 bp, Artificial Sequence
  Description of Artificial Sequence: Synthetic coding sequence
tgagacctgaagaatgtgttccccccagaggtggccgtgtttgagcccagcgaggccgagatcagccacacccagaaggccaccctggtgtgcctggccaccggcttctacccagaccacgtggagctgtcctggtgggtgaatggcaaggaggtgcacagcggcgtgtccacagacccccagcccctgaaggagcagcctgccctgaatgacagccgctactgcctgagcagccggctgcgggtgtctgccaccttctggcagaaccccaggaaccacttccgctgccaggtgcagttctacggcctgtctgaaaatgatgagtggacccaggaccgggccaagcctgtgacccagatcgtgtctgctgaggcctggggccgggctgactgtggcttcaccagcgagagctaccagcagggcgtgctgagcgccaccatcctgtatgagatcctgctgggcaaggccaccctgtatgctgtgctggtgtctgccctggtgctgatggccatggtgaagaggaaggacagccggggctag

SEQ ID NO: 38739 - DNA, 465 bp, Artificial Sequence
  Description of Artificial Sequence: Synthetic coding sequence
tgaagccagccccacaccaagcccagcgtgtttgtgatgaagaatggcaccaacgtggcctgcctggtgaaggagttctaccccaaggacatccgcatcaacctggtgagcagcaagaagatcacagaatttgatcctgccatcgtcatcagccccagcggcaagtacaatgctgtgaagctgggcaagtatgaggacagcaacagcgtgacctgcagcgtgcagcacgacaacaagacagtgcacagcacagactttgaggtgaagacagacagcacagaccacgtgaagcccaaggagacagagaacaccaagcagcccagcaagagctgccacaagcccaaggccatcgtgcacacagagaaggtgaacatgatgagcctgactgtgctgggcctgaggatgctgtttgccaagacagtggccgtgaacttcctgctgacagccaagctgttcttcctgtag

SEQ ID NO: 38740 - DNA, 357 bp, Artificial Sequence
  Description of Artificial Sequence: Synthetic coding sequence
atgcgctgggccctgctggtgctgctggccttcctgagccctgccagccagaagagcagcaacctggagggccgcaccaagtctgtgacccggcagacaggcagcagcgctgagatcacctgtgacctgactgtgaccaacaccttctacatccactggtacctgcaccaggagggcaaggccccccagaggctgctgtactatgatgtgtccacagccagagatgtgctggagagcggcctgagccctgggaagtactacacccacaccccccggcgctggagctggatcctgcggctgcagaacctgattgaaaatgacagcggcgtgtactactgtgccacctgggacagatag

SEQ ID NO: 38741 - DNA, 816 bp, Artificial Sequence
  Description of Artificial Sequence: Synthetic coding sequence
atgatccccaagctgctgagcctgctgtgcttccggctgtgtgtgggccagggcgacaccagaggagatggcagcctgcccaagcccagcctgagcgcctggcccagctctgtggtgcctgccaacagcaatgtgaccctgcgctgctggaccccagcccggggcgtgtcctttgtgctgaggaagggcggcatcatcctggagagccccaagcccctggacagcacagagggcgctgctgagttccacctgaacaacctgaaggtgagaaatgctggggagtacacctgtgagtactacaggaaggccagcccccacatcctgagccagaggagtgatgtgctgctgctgctggtgacaggccacctgagcaagcccttcctgcggacctaccagaggggcaccgtgacagctgggggccgggtgaccctgcagtgccagaagagggaccagctgtttgtgcccatcatgtttgccctgctgaaggccggcacccccagccccatccagctgcagagccctgctgggaaggagattgacttcagcctggtggatgtgacagctggagatgctggcaactacagctgcatgtactaccagaccaagagccccttctgggccagcgagcccagcgaccagctggagatcctggtgacagtgcccccaggcaccaccagcagcaactacagcctgggcaactttgtgcggctgggcctggccgctgtgattgtggtgatcatgggcgccttcctggtggaggcctggtacagcagaaatgtgtccccaggagagagcgaggccttcaagccagagtag

SEQ ID NO: 38742 - DNA, 840 bp, Artificial Sequence
  Description of Artificial Sequence: Synthetic coding sequence
atgaaggagaggaagaagaaggagaggaaggagaggaagaggaagaaggagagaaatggcctgtgtgtgggccagggcgacaccagaggagatggcagcctgcccaagcccagcctgagcgcctggcccagctctgtggtgcctgccaacagcaatgtgaccctgcgctgctggaccccagcccggggcgtgtcctttgtgctgaggaagggcggcatcatcctggagagccccaagcccctggacagcacagagggcgctgctgagttccacctgaacaacctgaaggtgagaaatgctggggagtacacctgtgagtactacaggaaggccagcccccacatcctgagccagaggagtgatgtgctgctgctgctggtgacaggccacctgagcaagcccttcctgcggacctaccagaggggcaccgtgacagctgggggccgggtgaccctgcagtgccagaagagggaccagctgtttgtgcccatcatgtttgccctgctgaaggccggcacccccagccccatccagctgcagagccctgctgggaaggagattgacttcagcctggtggatgtgacagctggagatgctggcaactacagctgcatgtactaccagaccaagagccccttctgggccagcgagcccagcgaccagctggagatcctggtgacagtgcccccaggcaccaccagcagcaactacagcctgggcaactttgtgcggctgggcctggccgctgtgattgtggtgatcatgggcgccttcctggtggaggcctggtacagcagaaatgtgtccccaggagagagcgaggccttcaagccagagtag

SEQ ID NO: 38743 - DNA, 951 bp, Artificial Sequence
  Description of Artificial Sequence: Synthetic coding sequence
atggccctgcagaccctgcagagctcctgggtgaccttcaggaagatcctgagccacttccctgaggagctgagcctggcctttgtgtatggcagcggcgtgtaccggcaggccggccccagcagtgaccagaagaatgccatgctggactttgtgttcaccgtggatgatcctgtggcctggcacagcaagaacctgaagaagaactggagccactacagcttcctgaaggtgctgggccccaagatcatcaccagcatccagaacaactatggagctggggtgtactacaacagcctcatcatgtgcaatggccgcctcatcaagtatggagtcatcagcaccaacgtgctgattgaggacctgctgaactggaacaacctgtacatcgccggccgcctgcagaagcctgtgaagatcatctctgtgaatgaagatgtgaccctgcggagcgccctggacaggaacctgaagtctgctgtgacagctgccttcctgatgctgcctgagagcttctctgaagaagatctcttcattgaaattgctggcctgagctacagcggggacttcaggatggtggtgggggaggacaagaccaaggtgctgaacatcgtgaagcccaacatcgcccacttccgggagctgtatggcagcatcctgcaggagaacccccaggtggtgtacaagagccagcagggctggctggagattgacaagagccctgagggccagttcacccagctgatgaccctgcccaagaccctgcagcagcagatcaaccacatcatggaccccccaggcaagaacagagatgtggaggagaccctcttccaggtggcccatgaccctgactgtggagatgtggtgcggctgggcctgaagaagagcgtcatctacagcagcctgaagctgcacaagatgtggaagggctggctgaggaagaccagctag

SEQ ID NO: 38744 - DNA, 2190 bp, Artificial Sequence
  Description of Artificial Sequence: Synthetic coding sequence
atgcagagcaccagcaaccacctgtggctgctgagtgacatcctgggccagggcgccacagccaacgtgttccggggccgccacaagaagacaggagacctgtttgccatcaaggtgttcaacaacatctccttcctgcggcctgtggatgtgcagatgagggagtttgaggtgctgaagaagctgaaccacaagaacatcgtgaagctgtttgccatcgaggaggagaccaccaccaggcacaaggtgctgatcatggagttctgcccctgtggcagcctgtacacagtgctggaggagcccagcaatgcctacggcctgcctgagagcgagttcctgattgtgctgagagatgtggtgggcggcatgaaccacctgcgggagaatggaattgtgcaccgggacatcaagccaggcaacatcatgagggtgattggagaagatggccagagcgtgtacaagctgacagactttggagctgcccgggagctggaggatgatgagcagtttgtgtccctgtatggaacagaggagtacctgcacccagacatgtatgaaagagctgtgctgaggaaggaccaccagaagaagtacggggccaccgtggacctgtggagcattggagtgaccttctaccacgccgccaccggcagcctgcccttccggccctttgagggccccaggaggaacaaggaggtgatgtacaagatcatcaccgggaagcccagcggggccatctctggagtgcagaaggcagaaaatggccccatcgactggagcggggacatgcctgtgtcctgcagcctgagccggggcctgcaggtgctgctgacccctgtgctggccaacatcctggaggccgaccaggagaagtgctggggctttgaccagttctttgctgagaccagtgacatcctgcacaggatggtgatccacgtgttcagcctgcagcagatgacagcccacaagatctacatccacagctacaacacagccaccatcttccacgagctggtgtacaagcagaccaagatcatcagcagcaaccaggagctgatctatgagggccgccgcctggtgctggagcccggccgcctggcccagcacttccccaagaccacagaggagaaccccatctttgtggtgtcccgggagcccctgaacaccatcggcctcatctatgagaagatcagcctgcccaaggtgcaccccaggtatgacctggatggagatgcctccatggccaaggccatcactggagtggtgtgctacgcctgccgcatcgccagcaccctgctgctgtaccaggagctgatgaggaagggcatccgctggctgattgagctgatcaaggatgactacaatgaaacagtgcacaagaagacagaggtggtgatcaccctggacttctgcatcagaaatattgagaagacagtgaaggtgtatgagaagctgatgaagatcaacctggaggccgctgagctgggggagatcagtgacatccacaccaagctgctgcggctgagcagcagccagggcaccatcgagaccagcctgcaggacatcgacagccggctgagccctgggggcagcctggctgatgcctgggcccaccaggagggcacccaccccaaggacagaaatgtggagaagctgcaggtgctgctgaactgcatgacagagatctactaccagttcaagaaggacaaggccgagcggcggctggcctacaatgaggagcagatccacaagtttgacaagcagaagctgtactaccacgccaccaaggccatgacccacttcacagatgaatgtgtgaagaagtatgaggccttcctgaacaagtctgaggagtggatcaggaagatgctgcacctgaggaagcagctgctgagcctgaccaaccagtgctttgacatcgaggaggaggtgtccaagtaccaggagtacaccaatgagctgcaggagaccctgccccagaagatgttcaccgccagcagcggcatcaagcacaccatgacccccatctaccccagcagcaacaccctggtggagatgaccctgggcatgaagaagctgaaggaggagatggagggcgtggtgaaggagctggccgagaacaaccacatcctggagcgcttcggcagcctgaccatggatggcggcctgagaaatgtggactgcctgtag

SEQ ID NO: 38745 - DNA, 312 bp, Artificial Sequence
  Description of Artificial Sequence: Synthetic coding sequence
atgcagagcaccagcaaccacctgtggctgctgagtgacatcctgggccagggcgccacagccaacgtgttccggggccgccacaagaagacaggagacctgtttgccatcaaggtgttcaacaacatctccttcctgcggcctgtggatgtgcagatgagggagtttgaggtgctgaagaagctgaaccacaagaacatcgtgaagctgtttgccatcgaggaggagaccaccaccaggcacaaggtgctgatcatggagttctgcccctgtggcagcctgtacacagtgctggaggagcccagcaactag

SEQ ID NO: 38746 - DNA, 297 bp, Artificial Sequence
  Description of Artificial Sequence: Synthetic coding sequence
atgcagagcaccagcaaccacctgtggctgctgagtgacatcctgggccagggcgccacagccaacgtgttccggggccgccacaagaagacaggagacctgtttgccatcaaggtgttcaacaacatctccttcctgcggcctgtggatgtgcagatgagggagtttgaggtgctgaagaagctgaaccacaagaacatcgtgaagctgtttgccatcgaggaggagaccaccaccaggcacaaggtgctgatcatggagttctgcccctgtggcagcctgtacacagtgctgtag

SEQ ID NO: 38747 - DNA, 924 bp, Artificial Sequence
  Description of Artificial Sequence: Synthetic coding sequence
atgcatgatgatgagagcaccatcaacagcagcagctctgtggtgcacaagaaggaccacgtgttcatcagagatgaagctggccatggagaccccaggcctgagccccggcccacccagagcgtgcagagccaggccctgcactacagaaaccgggagagatttgccaccatcaagagcgccagcctggtgacccggcagatccatgaacatgagcaggagaatgagctgcgggagcagatgagcggctacaagaggatgaggcggcagcaccagaagcagctgattgccctggagaacaagctgaaggccgagatggatgagcaccggctgaagctgcagaaggaggtggagacccacgccaacaacagcagcattgagctggagaagctggccaagaagcaggtggccatcatcgagaaggaggccaaggtggccgctgctgatgagaagaagttccagcagcagatcctggcccagcagaagaaggacctgaccaccttcctggagagccagaagaagcagtacaagatctgcaaggagaagatcaaggaggagatgaatgaagaccacagcacccccaagaaggagaagcaggagcgcatcagcaagcacaaggagaacctgcagcacacccaggccgaggaggaggcccacctgctgacccagcagaggctgtactatgacaagaactgccgcttcttcaagaggaagatcatgatcaagagacatgaggtggagcagcagaacatccgggaggagctgaacaagaagaggacagaaggagatggagcctgccacgccaacccagatgagagcacccgggagctggagtaccggcagctgcacaccctgcagaagctgcacggcagtgaccccttcaccgccccagatggcaccgggaagccagctggggtgcagtag

SEQ ID NO: 38748 - DNA, 2697 bp, Artificial Sequence
  Description of Artificial Sequence: Synthetic coding sequence
atgaggaaaggagtgctgaaggaccctgagattgctgacctcttctacaaggatgatcctgaggagctgttcatcggcctgcacgagatcggccacggcagctttggagctgtgtactttgccaccaatgcccacaccagcgaggtggtggccatcaagaagatgagctacagcggcaagcagacccatgagaagtggcaggacatcctgaaggaggtgaagttcctgcggcagctgaagcaccccaacaccatcgagtacaagggctgctacctgaaggagcacacagcctggctggtgatggagtactgcctgggcagcgccagtgacctgctggaggtgcacaagaagcccctgcaggaggtggagattgctgccatcacccatggagccctgcacggcctggcctacctgcacagccacgccctgatccaccgggacatcaaggccggcaacatcctgctgacagagcccggccaggtgaagctggccgactttggcagcgcctccatggccagccctgccaacagctttgtgggcaccccctactggatggcccctgaggtgatcctggccatggatgagggccagtatgatggcaaggtggacatctggagcctgggcatcacctgcatcgagctggccgagaggaagcccccactcttcaacatgaatgccatgtctgccctgtaccacatcgcccagaatgacagccccaccctgcagagcaatgagtggacagacagcttcagaagatttgtggactactgcctgcagaagatcccccaggagcggcccaccagcgctgagctgctgcggcatgactttgtgcggcgggaccggcccctgcgggtgctgattgacctgatccagaggaccaaggatgctgtgcgggagctggacaacctgcagtacaggaagatgaagaagatcctcttccaggagaccagaaatggccccctgaatgaaagccaggaggatgaagaagattctgaacatggcaccagcctgaaccgggagatggacagcctgggcagcaaccacagcatccccagcatgtctgtgtccacaggcagccagagcagctctgtgaacagcatgcaggaggtgatggatgagagcagcagcgagctggtgatgatgcatgatgatgagagcaccatcaacagcagcagctctgtggtgcacaagaaggaccacgtgttcatcagagatgaagctggccatggagaccccaggcctgagccccggcccacccagagcgtgcagagccaggccctgcactacagaaaccgggagagatttgccaccatcaagagcgccagcctggtgacccggcagatccatgaacatgagcaggagaatgagctgcgggagcagatgagcggctacaagaggatgaggcggcagcaccagaagcagctgattgccctggagaacaagctgaaggccgagatggatgagcaccggctgaagctgcagaaggaggtggagacccacgccaacaacagcagcattgagctggagaagctggccaagaagcaggtggccatcatcgagaaggaggccaaggtggccgctgctgatgagaagaagttccagcagcagatcctggcccagcagaagaaggacctgaccaccttcctggagagccagaagaagcagtacaagatctgcaaggagaagatcaaggaggagatgaatgaagaccacagcacccccaagaaggagaagcaggagcgcatcagcaagcacaaggagaacctgcagcacacccaggccgaggaggaggcccacctgctgacccagcagaggctgtactatgacaagaactgccgcttcttcaagaggaagatcatgatcaagagacatgaggtggagcagcagaacatccgggaggagctgaacaagaagaggacccagaaggagatggagcacgccatgctgatcagacatgatgagagcacccgggagctggagtaccggcagctgcacaccctgcagaagctgaggatggacctgatccggctgcagcaccagacagagctggagaaccagctggagtacaacaagaggcgggagcgggagctgcacaggaagcacgtgatggagctgcggcagcagcccaagaacctgaaggccatggagatgcagatcaagaagcagttccaggacacctgcaaggtgcagaccaagcagtacaaggccctgaagaaccaccagctggaggtgacccccaagaatgagcacaagaccatcctgaagaccctgaaggatgagcagaccaggaagctggccatcctggccgagcagtatgagcagagcatcaatgagatgatggccagccaggccctgcggctggatgaggcccaggaggccgagtgccaggccctgcggctgcagctgcagcaggagatggagctgctgaatgcctaccagagcaagatcaagatgcagacagaggcccagcacgagcgggagctgcagaagctggagcagagggtgtccctgcggcgggcccacctggagcagaagattgaggaggagctggccgccctgcagaaggagaggtctgagcgcatcaagaacctgctggagcggcaggagcgggagattgagacctttgacatggagagcctgaggatgggcttcggcaacctggtgaccctggacttccccaaggaggactacagatag

SEQ ID NO: 38749 - DNA, 2697 bp, Artificial Sequence; identical to SEQ ID NO: 38748
  Description of Artificial Sequence: Synthetic coding sequence

SEQ ID NO: 38750 - DNA, 411 bp, Artificial Sequence
  Description of Artificial Sequence: Synthetic coding sequence
atgaggaaaggagtgctgaaggaccctgagattgctgacctcttctacaaggatgatcctgaggagctgttcatcggcctgcacgagatcggccacggcagctttggagctgtgtactttgccaccaatgcccacaccagcgaggtggtggccatcaagaagatgagctacagcggcaagcagacccatgagaagtggcaggacatcctgaaggaggtgaagttcctgcggcagctgaagcaccccaacaccatcgagtacaagggctgctacctgaaggagcacacagcctggctggtgatggagtactgcctgggcagcgccagtgacctgctggaggtgcacaagaagcccctgcaggaggtggagattgctgccatcacccatggagccctgcacggcctggcctag

SEQ ID NO: 38751 - DNA, 57 bp, Artificial Sequence
  Description of Artificial Sequence: Synthetic coding sequence
atgaggaaaggagtgctgaaggaccctgagattgctgacctcttctacaaggactag

SEQ ID NO: 38752 - DNA, 282 bp, Artificial Sequence
  Description of Artificial Sequence: Synthetic coding sequence
atgaggaaaggagtgctgaaggaccctgagattgctgacctcttctacaaggatgatcctgaggagctgttcatcggcctgcacgagatcggccacggcagctttggagctgtgtactttgccaccaatgcccacaccagcgaggtggtggccatcaagaagatgagctacagcggcaagcagacccatgagaagtggcaggacatcctgaaggaggtgaagttcctgcggcagctgaagcaccccaacaccatcgagtacaagggctgctacctgaagtag

SEQ ID NO: 38753 - DNA, 66 bp, Artificial Sequence
  Description of Artificial Sequence: Synthetic coding sequence
atgaggaaaggagtgctgaaggaccctgagattgctgacctcttctacaaggatgatcctgagtag

SEQ ID NO: 38754 - DNA, 189 bp, Artificial Sequence
  Description of Artificial Sequence: Synthetic coding sequence
atgaggaaaggagtgctgaaggaccctgagattgctgacctcttctacaaggatgatcctgaggagctgttcatcggcctgcacgagatcggccacggcagctttggagctgtgtactttgccaccaatgcccacaccagcgaggtggtggccatcaagaagatgagctacagcggcaagcagacctag

SEQ ID NO: 38755 - DNA, 111 bp, Artificial Sequence
  Description of Artificial Sequence: Synthetic coding sequence
atgaggaaaggagtgctgaaggaccctgagattgctgacctcttctacaaggatgatcctgaggagctgttcatcggcctgcacgagatcggccacggcagctttggatag

SEQ ID NO: 38756 - DNA, 174 bp, Artificial Sequence
  Description of Artificial Sequence: Synthetic coding sequence
atgaggaaaggagtgctgaaggaccctgagattgctgacctcttctacaaggatgatcctgaggagctgttcatcggcctgcacgagatcggccacggcagctttggagctgtgtactttgccaccaatgcccacaccagcgaggtggtggccatcaagaagatgagctactag

SEQ ID NO: 38757 - DNA, 1407 bp, Artificial Sequence
  Description of Artificial Sequence: Synthetic coding sequence
atgggcacccaggagggctggtgcctgctgctgtgcctggccctgagcggggctgctgagaccaagccccaccctgctgagggccagtggagggctgtggatgtggtgctggactgcttcctggccaaggatggagcccacagaggagccctggccagcagtgaagatcgggcccgggccagcctggtgctgaagcaggtgcctgtgctggatgatggcagcctggaggacttcacagacttccagggcggcaccctggcccaggatgatcctcccatcatctttgaggcctctgtggacctggtgcagatcccccaggccgaggccctgctgcatgctgactgcagcggcaaggaggtgacctgtgagatcagccgctacttcctgcagatgacagagaccaccgtgaagacagctgcctggttcatggccaacatgcaggtgtctgggggcggccccagcatcagcctggtgatgaagaccccccgggtgaccaagaatgaggccctgtggcaccccaccctgaacctgcccctgagcccccagggcaccgtgaggacagctgtggagttccaggtgatgacccagacccagagcctgtccttcctgctgggcagcagcgccagcctggactgtggcttctccatggcccctggcctggacctgatctctgtggagtggaggctgcagcacaagggccggggccagctggtgtacagctggacagctggccagggccaggccgtgaggaaaggagccaccctggagcccgcccagctgggcatggccagagatgccagcctgaccctgcccggcctgaccatccaggatgagggcacctacatctgccagatcaccaccagcctgtaccgggcccagcagatcatccagctgaacatccaggccagccccaaggtgcggctgagcctggccaatgaggccctgctgcccaccctcatctgtgacattgctggctactaccccctggatgtggtggtgacctggacccgggaggagctgggcggcagccctgcccaggtgtctggggccagcttcagcagcctgcggcagagcgtggccggcacctacagcatcagcagcagcctgacagctgagcccggcagcgctggggccacctacacctgccaggtgacccacatcagcctggaggagcccctgggcgccagcacccaggtggtgcccccagagaggagaacagccctgggcgtcatctttgccagcagcctcttcctgctggccctgatgttcctgggcctgcagaggcggcaggcccccaccggcctgggcctgctgcaggccgagcgctgggagaccaccagctgtgccgacacccagagcagccacctgcacgaggacagaacagcccgggtgtcccagcccagctag

SEQ ID NO: 38758 - DNA, 1200 bp, Artificial Sequence
  Description of Artificial Sequence: Synthetic coding sequence
atgtgtgtgcagaactgtggccccagcttccagagcctcatcgtgaagaaggagtttgtgaaggagaacctggtgaagctgctgaacccccgctacaacctgcccctggacatccagaaccgcatcctgaacttcatcaagacctggagccagggcttccctgggggcgtggatgtgtctgaggtgaaggaggtgtacctggacctggtgaagaagggcgtgcagtttcctccttctgaggccgaggccgagacagcccggcaggagacagcccagatcagcagcaacccccccacctctgtgcccacagccccagccctgagctctgtgattgcccccaagaacagcacagtgaccctggtgcctgagcagatcggcaagctgcacagcgagctggacatggtgaagatgaatgtgcgggtgatgtctgccatcctgatggagaacaccccaggcagcgagaaccatgaagatattgagctgctgcagaagctgtacaagacaggccgggagatgcaggagcgcatcatggacctgctggtggtggtggagaatgaagatgtgacagtggagctgatccaggtgaatgaagacctgaacaatgccatcctgggctatgagcgcttcaccaggaaccagcagaggatcctggagcagaacaagaaccagaaggaggccaccaacaccaccagcgagcccagcgcccccagccaggacctgctggacctgagccccagccccaggatgccccgggccaccctgggggagctgaacaccatgaacaaccagctgagcggcctgaacttcagcctgcccagcagtgatgtgaccaacaacctgaagcccagcctgcacccccagatgaacctgctggccctggagaacacagagatccccccatttgcccagaggaccagccagaacctgaccagcagccacgcctatgacaacttcctggagcacagcaacagcgtcttcctgcagcctgtgtccctgcagaccatcgctgctgcccccagcaaccagagcctgccccccctgcccagcaaccacccagccatgaccaagagtgacctgcagccccccaactactatgaggtgatggagtttgaccccctggccccagctgtgaccacagaggccatctatgaggagattgatgcccaccagcacaagggggcccagaatgatggagactag

SEQ ID NO: 38759 - DNA, 1431 bp, Artificial Sequence
  Description of Artificial Sequence: Synthetic coding sequence
atggccttcggcaagagccaccgggacccctatgccacctctgtgggccacctgattgagaaggccacctttgctggggtgcagacagaggactggggccagttcatgcacatctgtgacatcatcaacaccacccaggacggccccaaggatgctgtgaaggccctgaagaagaggatcagcaagaactacaaccacaaggagatccagctgaccctgagcctgattgacatgtgtgtgcagaactgtggccccagcttccagagcctgattgtgaagaaggagtttgtgaaggagaacctggtgaagctgctgaacccccgctacaacctgcccctggacatccagaaccgcatcctgaacttcatcaagacctggagccagggcttccctggaggagtggatgtgtctgaggtgaaggaggtgtacctggacctggtgaagaagggcgtgcagttcccccccagcgaggccgaggccgagacagcccggcaggagacagcccagatcagcagcaacccccccacctctgtgcccacagccccagccctgagcagcgtcatcgcccccaagaacagcacagtgaccctggtgcctgagcagatcggcaagctgcacagcgagctggacatggtgaagatgaatgtgcgggtgatgtctgccatcctgatggagaacaccccaggctctgaaaatcatgaggacatcgagctgctgcagaagctgtacaagacaggccgggagatgcaggagcgcatcatggacctgctggtggtggtggagaatgaagatgtgacagtggagctgatccaggtgaatgaagacctgaacaatgccatcctgggctatgagcgcttcaccaggaaccagcagaggatcctggagcagaacaagaaccagaaggaggccaccaacaccaccagcgagcccagcgcccccagccaggacctgctggacctgagccccagccccaggatgccccgggccaccctgggggagctgaacaccatgaacaaccagctgagcggcctgaacttcagcctgcccagcagtgatgtgaccaacaacctgaagcccagcctgcacccccagatgaacctgctggccctggagaacacagagatccccccatttgcccagaggaccagccagaacctgaccagcagccacgcctatgacaacttcctggagcacagcaacagcgtcttcctgcagcctgtgtccctgcagaccatcgccgccgcccccagcaaccagagcctgccccccctgcccagcaaccacccagccatgaccaagagtgacctgcagccccccaactactatgaggtgatggagtttgaccccctggccccagctgtgaccacagaggccatctatgaggagattgatgcccaccagcacaagggggcccagaatgatggagactag

SEQ ID NO: 38760 - DNA, 1200 bp, Artificial Sequence; identical to SEQ ID NO: 38758
  Description of Artificial Sequence: Synthetic coding sequence

SEQ ID NO: 38761 - DNA, 1095 bp, Artificial Sequence
  Description of Artificial Sequence: Synthetic coding sequence
atgtgtgtgcagaactgtggccccagcttccagagcctcatcgtgaagaaggagtttgtgaaggagaacctggtgaagctgctgaacccccgctacaacctgcccctggacatccagaaccgcatcctgaacttcatcaagacctggagccagggcttccctgggggcgtggatgtgtctgaggtgaaggaggtgtacctggacctggtgaagaagggcgtgcagtttcctccttctgaggccgaggccgagacagcccggcaggagatcggcaagctgcacagcgagctggacatggtgaagatgaatgtgcgggtgatgtctgccatcctgatggagaacaccccaggctctgaaaatcatgaggacatcgagctgctgcagaagctgtacaagacaggccgggagatgcaggagcgcatcatggacctgctggtggtggtggagaatgaagatgtgacagtggagctgatccaggtgaatgaagacctgaacaatgccatcctgggctatgagcgcttcaccaggaaccagcagaggatcctggagcagaacaagaaccagaaggaggccaccaacaccaccagcgagcccagcgcccccagccaggacctgctggacctgagccccagccccaggatgccccgggccaccctgggggagctgaacaccatgaacaaccagctgagcggcctgaacttcagcctgcccagcagtgatgtgaccaacaacctgaagcccagcctgcacccccagatgaacctgctggccctggagaacacagagatccccccatttgcccagaggaccagccagaacctgaccagcagccacgcctatgacaacttcctggagcacagcaacagcgtcttcctgcagcctgtgtccctgcagaccatcgccgccgcccccagcaaccagagcctgccccccctgcccagcaaccacccagccatgaccaagagtgacctgcagccccccaactactatgaggtgatggagtttgaccccctggccccagctgtgaccacagaggccatctatgaggagattgatgcccaccagcacaagggggcccagaatgatggagactag

SEQ ID NO: 38762 - DNA, 1431 bp, Artificial Sequence; identical to SEQ ID NO: 38759
  Description of Artificial Sequence: Synthetic coding sequence

SEQ ID NO: 38763 - DNA, 900 bp, Artificial Sequence
  Description of Artificial Sequence: Synthetic coding sequence
atgctggagagccacctgatcatctacttcctgctggccgtcatccagttcctgctgggcatcttcaccaacggcatcatcgtggtggtgaatggaattgacctgatcaagcacaggaagatggcccccctggacctgctgctgagctgcctggccgtgagccgcatcttcctgcagctgttcatcttctacgtgaatgtcatcgtcatcttcttcatcgagttcatcatgtgcagcgccaactgtgccatcctgctcttcatcaatgagctggagctgtggctggccacctggctgggcgtcttctactgtgccaaggtggcctctgtgcgccaccccctcttcatctggctgaagatgaggatcagcaagctggtgccctggatgatcctgggcagcctgctgtatgtgtccatgatctgtgtgttccacagcaaatatgccggcttcatggtgccctacttcctgaggaagttcttcagccagaatgccaccatccagaaggaggacaccctggccatccagatcttctcctttgtggccgagttctctgtgcccctgctgatcttcctgtttgctgtgctgctgctgatcttcagcctgggccgccacacccggcagatgaggaacacagtggccggcagccgggtgcccggccgcggggcccccatcagcgccctgctgagcatcctgtccttcctgatcctgtacttcagccactgcatgatcaaggtgttcctgagcagcctgaagttccacatccgccgcttcatcttcctgttcttcatcctggtgattggcatctaccccagcggccacagcctcatcctgatcctgggcaaccccaagctgaagcagaatgccaagaagttcctgctgcacagcaagtgctgccagtag

SEQ ID NO: 38764 - DNA, 924 bp, Artificial Sequence
  Description of Artificial Sequence: Synthetic coding sequence
atgctgcgggtggtggagggcatcttcatctttgtggtggtgtctgagagcgtgtttggagtgctgggcaatggcttcatcggcctggtgaactgcatcgactgtgccaagaacaagctgagcaccatcggcttcatcctgaccggcctggccatcagccgcatcttcctgatctggatcatcatcacagatggcttcatccagatcttcagccccaacatctatgccagcggcaacctgattgagtacatctcctacttctgggtgattggcaaccagagctccatgtggtttgccaccagcctgagcatcttctacttcctgaagatcgccaacttcagcaactacatcttcctgtggctgaagagcaggaccaacatggtgctgcccttcatgattgtgttcctgctgatcagcagcctgctgaactttgcctacatcgccaagatcctgaatgactacaagaccaagaatgacacagtgtgggacctgaacatgtacaagtctgagtacttcatcaagcagatcctgctgaacctgggcgtcatcttcttcttcaccctgagcctcatcacctgcatcttcctgatcatcagcctgtggaggcacaaccggcagatgcagagcaatgtgacaggcctgcgggacagcaacacagaggcccacgtgaaggccatgaaggtgctgatctccttcatcatcctcttcatcctgtacttcatcggcatggccatcgagatcagctgcttcaccgtgcgggagaacaagctgctgctgatgtttggcatgaccaccacagccatctacccctggggccacagcttcatcctgatcctgggcaacagcaagctgaagcaggccagcctgcgggtgctgcagcagctgaagtgctgtgagaagaggaagaacctgcgggtgacctag

SEQ ID NO: 38765 - DNA, 912 bp, Artificial Sequence
  Description of Artificial Sequence: Synthetic coding sequence
atggagagcgccctgcccagcatcttcaccctggtgatcatcgccgagttcatcatcggcaacctgagcaatggcttcatcgtgctgatcaactgcatcgactgggtgtccaagcgggagctgagctctgtggacaagctgctgatcatcctggccatcagccgcatcggcctcatctgggagatcctggtgtcctggttcctggccctgcactacctggccatctttgtgtctggcaccggcctgcgcatcatgatcttctcctggatcgtgagcaaccacttcaacctgtggctggccaccatcttcagcatcttctacctgctgaagatcgccagcttcagcagccctgccttcctgtacctgaagtggagggtgaacaaggtgatcctgatgatcctgctgggcaccctggtgttcctgttcctgaacctgatccagatcaacatgcacatcaaggactggctggacagatatgaaagaaacaccacctggaacttctccatgtctgactttgagaccttctctgtgtctgtgaagttcaccatgaccatgttcagcctgacccccttcaccgtggccttcatctccttcctgctgctgatcttcagcctgcagaagcacctgcagaagatgcagctgaactacaagggccaccgggaccccaggaccaaggtgcacaccaatgccctgaagatcgtcatctccttcctgctcttctacgccagcttcttcctgtgtgtgctgatctcctggatcagcgagctgtaccagaacacagtcatctacatgctgtgtgagaccatcggggtcttcagccccagcagccacagcttcctgctgatcctgggcaatgccaagctgcggcaggccttcctgctggtggccgccaaggtgtgggccaagaggtag

SEQ ID NO: 38766 - DNA, 954 bp, Artificial Sequence
  Description of Artificial Sequence: Synthetic coding sequence
atgggcggcgtcatcaagagcatcttcacctttgtgctgattgtggagttcatcatcggcaacctgggcaacagcttcatcgccctggtgaactgcatcgactgggtgaagggcaggaagatcagctctgtggaccgcatcctgacagccctggccatcagccgcatcagcctggtgtggctgatcttcggctcctggtgtgtgtctgtgttcttccctgccctgtttgccacagagaagatgttcaggatgctgaccaacatctggacagtcatcaaccacttctctgtgtggctggccaccggcctgggcaccttctacttcctgaagatcgccaacttcagcaacagcatcttcctgtacctgaagtggagggtgaagaaggtggtgctggtgctgctgctggtgaccagcgtcttcctgttcctgaacatcgccctgatcaacatccacatcaatgccagcatcaatggctacagaagaaacaagacctgcagcagtgacagcagcaacttcacccgcttcagcagcctgattgtgctgaccagcaccgtcttcatcttcatccccttcaccctgagcctggccatgttcctgctgctgatcttctccatgtggaagcacaggaagaagatgcagcacacagtgaagatctctggagatgccagcaccaaggcccacagaggagtgaagagcgtcatcaccttcttcctgctgtatgccatcttcagcctgtccttcttcatctctgtgtggaccagcgagcggctggaggagaacctgatcatcctgagccaggtgatgggcatggcctaccccagctgccacagctgtgtgctgatcctgggcaacaagaagctgcggcaggccagcctgtctgtgctgctgtggctgcgctacatgttcaaggatggagagcccagcggccacaaggagttccgggagagcagctag

SEQ ID NO: 38767 - DNA, 1017 bp, Artificial Sequence
  Description of Artificial Sequence: Synthetic coding sequence
atgctgggccgctgcttccccccagacaccaaggagaagcagcagctgaggatgaccaagctgtgtgaccctgctgagagcgagctgagccccttcctgatcaccctcatcctggccgtgctgctggccgagtacctgattggcatcatcgccaacggcttcatcatggccatccacgccgctgagtgggtgcagaacaaggctgtgtccaccagcggccgcatcctggtgttcctgtctgtgagccgcatcgccctgcagagcctgatgatgctggagatcaccatcagcagcaccagcctgtccttctacagtgaagatgctgtgtactatgccttcaagatctccttcatcttcctgaacttctgcagcctgtggtttgctgcctggctgtccttcttctactttgtgaagatcgccaacttctcctaccccctcttcctgaagctgcgctggaggatcaccggcctcatcccctggctgctgtggctgtctgtgttcatctccttcagccacagcatgttctgcatcaacatctgcaccgtgtactgcaacaacagcttccccatccacagcagcaacagcaccaagaagacctacctgtctgagatcaacgtggtgggcctggccttcttcttcaacctgggcatcgtgacccccctcatcatgttcatcctgacagccaccctgctgatcctgagcctgaagaggcacaccctgcacatgggcagcaatgccaccggcagcaatgaccccagcatggaggcccacatgggcgccatcaaggccatctcctacttcctgatcctgtacatcttcaatgctgtggccctcttcatctacctgagcaacatgtttgacatcaacagcctgtggaacaacctgtgccagatcatcatggccgcctacccagccagccacagcatcctgctgatccaggacaaccctggcctgcggcgggcctggaagaggctgcagctgcggctgcacctgtaccccaaggagtggaccctgtag

SEQ ID NO: 38768 - DNA, 957 bp, Artificial Sequence
  Description of Artificial Sequence: Synthetic coding sequence
atggctgacaaggtgcagaccaccctgctcttcctggccgtgggggagttctctgtgggcatcctgggcaatgccttcatcggcctggtgaactgcatggactgggtgaagaagaggaagatcgccagcattgacctgatcctgaccagcctggccatcagccgcatctgcctgctgtgtgtgatcctgctggactgcttcatcctggtgctgtacccagatgtgtatgccaccgggaaggagatgaggatcatcgacttcttctggaccctgaccaaccacctgagcatctggtttgccacctgcctgagcatctactacttcttcaagattggcaacttcttccaccccctcttcctgtggatgaagtggagaattgacagagtcatctcctggatcctgctgggctgtgtggtgctgtctgtgttcatcagcctgcctgccacagagaacctgaatgctgacttccgcttctgtgtgaaggccaagaggaagaccaacctgacctggagctgccgggtgaacaagacccagcacgccagcaccaagctgttcctgaacctggccaccctgctgcccttctgtgtgtgcctgatgtccttcttcctgctgatcctgagcctgcggcggcacatccggaggatgcagctgagcgccaccggctgccgggaccccagcacagaggcccacgtgcgggccctgaaggccgtcatctccttcctgctgctcttcatcgcctactacctgtccttcctgattgccaccagcagctacttcatgcctgagacagagctggccgtcatctttggagagagcatcgccctgatctaccccagcagccacagcttcatcctgatcctgggcaacaacaagctgcggcatgccagcctgaaggtgatctggaaggtgatgagcatcctgaagggcaggaagttccagcagcacaagcagatctag

SEQ ID NO: 38769 - DNA, 930 bp, Artificial Sequence
  Description of Artificial Sequence: Synthetic coding sequence
atgttcagccctgctgacaacatcttcatcatcctgatcaccggggagttcatcctgggcatcctgggcaatggctacatcgccctggtgaactggattgactggatcaagaagaagaagatcagcacagtggactacatcctgaccaacctggtgattgcccgcatctgcctgatctctgtgatggtggtgaatggaattgtgattgtgctgaacccagatgtgtacaccaagaacaagcagcagatcgtcatcttcaccttctggacctttgccaactacctgaacatgtggatcaccacctgcctgaatgtgttctacttcctgaagatcgccagcagcagccaccccctcttcctgtggctgaagtggaagattgacatggtggtgcactggatcctgctgggctgctttgccatcagcctgctggtgtccctgattgctgccatcgtgctgagctgtgactaccgcttccacgccatcgccaagcacaagaggaacatcacagagatgtttcatgtgtccaagatcccctactttgagcccctgaccctcttcaacctgtttgccatcgtgcccttcatcgtgtccctcatctccttcttcctgctggtgcgcagcctgtggaggcacaccaagcagatcaagctgtatgccaccggcagccgggaccccagcacagaggtgcacgtgcgggccatcaagaccatgaccagcttcatcttcttcttcttcctgtactacatcagcagcatcctgatgaccttctcctacctgatgaccaagtacaagctggccgtggagtttggagaaattgctgccatcctgtaccccctgggccacagcctcatcctgattgtgctgaacaacaagctgcggcagacctttgtgaggatgctgacctgcaggaagatcgcctgcatgatctag

SEQ ID NO: 38770 - DNA, 939 bp, Artificial Sequence
  Description of Artificial Sequence: Synthetic coding sequence
atgcccagcgccatcgaggccatctacatcatcctgattgctggggagctgaccatcggcatctggggcaatggcttcatcgtgctggtgaactgcatcgactggctgaagaggcgggacatcagcctgattgacatcatcctgatcagcctggccatcagccgcatctgcctgctgtgtgtgatcagcctggatggcttcttcatgctgctcttccctggcacctacggcaacagcgtgctggtgtccatcgtgaatgtggtgtggacctttgccaacaacagcagcctgtggttcaccagctgcctgagcatcttctacctgctgaagatcgccaacatcagccaccccttcttcttctggctgaagctgaagatcaacaaggtgatgctggccatcctgctgggcagcttcctgatcagcctcatcatctctgtgcccaagaatgatgacatgtggtaccacctgttcaaggtgtcccatgaggagaacatcacctggaagttcaaggtgtccaagatccctggcaccttcaagcagctgaccctgaacctgggcgtgatggtgcccttcatcctgtgcctgatctccttcttcctgctgctcttcagcctggtgcgccacaccaagcagatccggctgcacgccaccggcttccgggaccccagcacagaggcccacatgagggccatcaaggctgtgatcatcttcctgctgctgctgattgtgtactaccctgtgttcctggtgatgaccagcagcgccctgatcccccagggcaagctggtgctgatgattggagacatcgtgaccgtcatcttccccagcagccacagcttcatcctgatcatgggcaacagcaagctgcgggaggccttcctgaagatgctgcgctttgtgaagtgcttcctgcggcggaggaagccctttgtgccctag

SEQ ID NO: 38771 - DNA, 3702 bp, Artificial Sequence
  Description of Artificial Sequence: Synthetic coding sequence
atgtggctgagccctgaggaggtgctggtggccaatgccctgtgggtgacagagcgggccaaccccttctttgtgctgcagaggagaagaggccacggccggggcggcggcctgaccggcctgctggtgggcaccctggatgtggtgctggacagcagcgcccgggtggccccctaccgcatcctgcaccagacccaggacagccaggtgtactggacagtggcctgtggcagcagcaggaaggagatcaccaagcactgggagtggctggagaacaacctgctgcagaccctgagcatctttgattctgaggaggacatcaccacctttgtgaagggcaagatccacggcatcatcgccgaggagaacaagaacctgcagccccagggagatgaggaccccgggaagttcaaggaggccgagctgaagatgaggaagcagtttggcatgcctgagggggagaagctggtgaactactacagctgcagctactggaagggccgggtgccccggcagggctggctgtacctgactgtgaaccacctgtgcttctacagcttcctgctgggcaaggaggtgtccctggtggtgcagtgggtggacatcacccggctggagaagaatgccaccctgctcttccctgagagcatccgggtggacacccgggaccaggagctgttcttctccatgttcctgaacatcggggagaccttcaagctgatggagcagctggccaacctggccatgaggcagctgctggacagcgagggcttcctggaggacaaggccctgccccggcccatccggccccacaggaacatcagcgccctgaagagggacctggatgcccgggccaagaatgaatgctaccgggccaccttccggctgcccagagatgagcggctggatggccacaccagctgcaccctgtggacccccttcaacaagctgcacatccctggccagatgttcatcagcaacaactacatctgctttgccagcaaggaggaggatgcctgccacctgatcatccccctgcgggaggtgaccatcgtggagaaggctgacagcagctctgtgctgcccagccccctgagcatcagcaccaagagcaagatgaccttcctgtttgccaacctgaaggaccgggacttcctggtgcagaggatcagtgacttcctgcagaagacccccagcaagcagcccggcagcatcggcagcaggaaggcctctgtggtggaccccagcacagagagcagccctgccccccaggagggcagcgagcagcctgccagccctgccagccccctgagcagccggcagagcttctgtgcccaggaggcccccacagccagccagggcctgctgaagctgttccagaagaacagccccatggaggacctgggcgccaagggggccaaggagaagatgaaggaggagagctggcacatccacttctttgaatatggccggggcgtgtgcatgtacagaacagccaagacccgggccctggtgctgaagggcatccctgagagcctgcggggggagctgtggctgctcttcagcggggcctggaatgagatggtgacccaccctggctactatgcagagctggtggagaagagcacaggcaagtacagcctggccacagaggagattgagcgggacctgcaccgctccatgcctgagcacccagccttccagaatgagctgggcattgctgccctgcggcgggtgctgacagcctatgccttcaggaaccccaccatcggctactgccaggccatgaacatcgtgacctctgtgctgctgctgtatggcagcgaggaggaggccttctggctgctggtggccctgtgtgagaggatgctgcctgactactacaacaccagggtggtgggcgccctggtggaccagggcatctttgaggagctgacccgggacttcctgccccagctgtctgagaagatgcaggacctgggcgtcatcagcagcatcagcctgtcctggttcctgaccctcttcctgtctgtgatgccctttgaatctgctgtggtgattgtggactgcttcttctatgagggcatcaaggtgatcctgcaggtggccctggccgtgctggatgccaacatggagcagctgctgggctgcagtgatgaaggagaggccatgaccatgctgggccgctacctggacaacgtggtgaacaagcagagcgtgagcccccccatcccccacctgcgggccctgctgagcagcagtgatgatcctcctgctgaggtggacatctttgagctgctgaaggtgtcctatgagaagttcagcagcctgcgggcagaggacatcgagcagatgaggttcaagcagaggctgaaggtgatccagagcctggaggacacagccaagaggtctgtggtgcgggccatccctgtggacatcggcttcagcattgaggagctggaggacctgtacatggtgttcaaggccaagcacctggccagccagtactggggctgcagcaggaccatggccggccggcgggaccccagcctgccctacctggagcagtacagaattgatgccagccagttccgggagctgtttgccagcctgaccccctgggcctgtggcagccacacccccctgctggccggccgcatgttccggctgctggatgagaacaaggacagcctcatcaacttcaaggagtttgtgacaggcatgagcggcatgtaccatggagacctgacagagaagctgaaggtgctgtacaagctgcacctgcccccagccctgagccctgaggaggccgagagcgccctggaggccgcccactacttcacagaggacagcagcagcgaggaggccctgccccaggaggagcaggagggcagcggcagcgaggagcggggggaggagaagggcaccagcagcccagactaccgccactacctgaggatgtgggccaaggagaaggaggcccagaaggagaccatcaaggacctgcccaagatgaaccaggagcagttcatcgagctgtgcaagaccctgtacaacatgttttctgaggaccccatggagcaggacctgtaccacgccatcgccaccgtggccagcctgctgctgcgcatcggggaggtgggcaagaagttcagcgccaggactggaaggaagccccgggactgtgccacagaggaggatgagcccccagcccctgagctgcaccaggatgctgcccgggagctgcagcccccagctgctggggacccccaggccaaggccggcggggacacccacctgggcaaggccccccaggagagccaggtggtggtggagggcggcagcggggagggccagggcagccccagccagctgctgagtgatgatgagaccaaggatgacatgtccatgagcagctacagcgtggtgtccacaggcagcctgcagtgtgaggacctggctgatgacacagtgctggtgggcggggaggcctgcagccccacagccagaattggaggcaccgtggacacagactggtgcatcagctttgagcagatcctggccagcatcctgacagagagcgtgctggtgaacttctttgagaagagggtggacatcggcctgaagatcaaggaccagaagaaggtggagcggcagttcagcacagccagtgaccacgagcagcccggggtgtctggatag

SEQ ID NO: 38772 - DNA, 3753 bp, Artificial Sequence
  Description of Artificial Sequence: Synthetic coding sequence
atgtggctgagccctgaggaggtgctggtggccaatgccctgtgggtgacagagcgggccaaccccttctttgtgctgcagaggagaagaggccacggccggggcggcggcctgaccggcctgctggtgggcaccctggatgtggtgctggacagcagcgcccgggtggccccctaccgcatcctgcaccagacccaggacagccaggtgtactggacagtggcctgtggcagcagcaggaaggagatcaccaagcactgggagtggctggagaacaacctgctgcagaccctgagcatctttgattctgaggaggacatcaccacctttgtgaagggcaagatccacggcatcatcgccgaggagaacaagaacctgcagccccagggagatgaggaccccgggaagttcaaggaggccgagctgaagatgaggaagcagtttggcatgcctgagggggagaagctggtgaactactacagctgcagctactggaagggccgggtgccccggcagggctggctgtacctgactgtgaaccacctgtgcttctacagcttcctgctgggcaaggaggtgtccctggtggtgcagtgggtggacatcacccggctggagaagaatgccaccctgctcttccctgagagcatccgggtggacacccgggaccaggagctgttcttctccatgttcctgaacatcggggagaccttcaagctgatggagcagctggccaacctggccatgaggcagctgctggacagcgagggcttcctggaggacaaggccctgccccggcccatccggccccacaggaacatcagcgccctgaagagggacctggatgcccgggccaagaatgaatgctaccgggccaccttccggctgcccagagatgagcggctggatggccacaccagctgcaccctgtggacccccttcaacaagctgcacatccctggccagatgttcatcagcaacaactacatctgctttgccagcaaggaggaggatgcctgccacctgatcatccccctgcgggaggtgaccatcgtggagaaggctgacagcagctctgtgctgcccagccccctgagcatcagcaccaagagcaagatgaccttcctgtttgccaacctgaaggaccgggacttcctggtgcagaggatcagtgacttcctgcagaagacccccagcaagcagcccggcagcatcggcagcaggaaggcctctgtggtggaccccagcacagagagcagccctgccccccaggagggcagcgagcagcctgccagccctgccagccccctgagcagccggcagagcttctgtgcccaggaggcccccacagccagccagggcctgctgaagctgttccagaagaacagccccatggaggacctgggcgccaagggggccaaggagaagatgaaggaggagagctggcacatccacttctttgaatatggccggggcgtgtgcatgtacagaacagccaagacccgggccctggtgctgaagggcatccctgagagcctgcggggggagctgtggctgctcttcagcggggcctggaatgagatggtgacccaccctggctactatgcagagctggtggagaagagcacaggcaagtacagcctggccacagaggagattgagcgggacctgcaccgctccatgcctgagcacccagccttccagaatgagctgggcattgctgccctgcggcgggtgctgacagcctatgccttcaggaaccccaccatcggctactgccaggccatgaacatcgtgacctctgtgctgctgctgtatggcagcgaggaggaggccttctggctgctggtggccctgtgtgagaggatgctgcctgactactacaacaccagggtggtgggcgccctggtggaccagggcatctttgaggagctgacccgggacttcctgccccagctgtctgagaagatgcaggacctgggcgtcatcagcagcatcagcctgtcctggttcctgaccctcttcctgtctgtgatgccctttgaatctgctgtggtgattgtggactgcttcttctatgagggcatcaaggtgatcctgcaggtggccctggccgtgctggatgccaacatggagcagctgctgggctgcagtgatgaaggagaggccatgaccatgctgggccgctacctggacaacgtggtgaacaagcagagcgtgagcccccccatcccccacctgcgggccctgctgagcagcagtgatgatcctcctgctgaggtggacatctttgagctgctgaaggtgtcctatgagaagttcagcagcctgcgggcagaggacatcgagcagatgaggttcaagcagaggctgaaggtgatccagagcctggaggacacagccaagaggtctgtggtgcgggccatccctgtggacatcggcttcagcattgaggagctggaggacctgtacatggtgttcaaggccaagcacctggccagccagtactggggctgcagcaggaccatggccggccggcgggaccccagcctgccctacctggagcagtacagaattgatgccagccagttccgggagctgtttgccagcctgaccccctgggcctgtggcagccacacccccctgctggccggccgcatgttccggctgctggatgagaacaaggacagcctcatcaacttcaaggagtttgtgacaggcatgagcggcatgtaccatggagacctgacagagaagctgaaggtgctgtacaagctgcacctgcccccagccctgagccctgaggaggccgagagcgccctggaggccgcccactacttcacagaggacagcagcagcgaggccagccccctggccagtgacctggacctcttcctgccctgggaggcccaggaggccctgccccaggaggagcaggagggcagcggcagcgaggagcggggggaggagaagggcaccagcagcccagactaccgccactacctgaggatgtgggccaaggagaaggaggcccagaaggagaccatcaaggacctgcccaagatgaaccaggagcagttcatcgagctgtgcaagaccctgtacaacatgttttctgaggaccccatggagcaggacctgtaccacgccatcgccaccgtggccagcctgctgctgagaattggagaggtgggcaagaagttcagcgccaggacaggcaggaagccccgggactgtgccacagaagaagatgagcccccagcccctgagctgcaccaggatgctgcccgggagctgcagcccccagctgctggggacccccaggccaaggccggcggggacacccacctgggcaaggccccccaggagagccaggtggtggtggagggcggcagcggggagggccagggcagccccagccagctgctgagtgatgatgagaccaaggatgacatgtccatgagcagctacagcgtggtgtccacaggcagcctgcagtgtgaggacctggctgatgacacagtgctggtgggcggggaggcctgcagccccacagcccgcatcggcggcaccgtggacacagactggtgcatcagctttgagcagatcctggccagcatcctgacagaatctgtgctggtgaacttctttgagaagagggtggacatcggcctgaagatcaaggaccagaagaaggtggagcggcagttcagcacagccagtgaccacgagcagcccggggtgtctggatag

SEQ ID NO: 38773 - DNA, 1176 bp, Artificial Sequence
  Description of Artificial Sequence: Synthetic coding sequence
atggccggccggcgggaccccagcctgccctacctggagcagtacagaattgatgccagccagttccgggagctgtttgccagcctgaccccctgggcctgtggcagccacacccccctgctggccggccgcatgttccggctgctggatgagaacaaggacagcctcatcaacttcaaggagtttgtgacaggcatgagcggcatgtaccatggagacctgacagagaagctgaaggtgctgtacaagctgcacctgcccccagccctgagccctgaggaggccgagagcgccctggaggccgcccactacttcacagaggacagcagcagcgaggaggccctgccccaggaggagcaggagggcagcggcagcgaggagcggggggaggagaagggcaccagcagcccagactaccgccactacctgaggatgtgggccaaggagaaggaggcccagaaggagaccatcaaggacctgcccaagatgaaccaggagcagttcatcgagctgtgcaagaccctgtacaacatgttttctgaggaccccatggagcaggacctgtaccacgccatcgccaccgtggccagcctgctgctgcgcatcggggaggtgggcaagaagttcagcgccaggactggaaggaagccccgggactgtgccacagaggaggatgagcccccagcccctgagctgcaccaggatgctgcccgggagctgcagcccccagctgctggggacccccaggccaaggccggcggggacacccacctgggcaaggccccccaggagagccaggtggtggtggagggcggcagcggggagggccagggcagccccagccagctgctgagtgatgatgagaccaaggatgacatgtccatgagcagctacagcgtggtgtccacaggcagcctgcagtgtgaggacctggctgatgacacagtgctggtgggcggggaggcctgcagccccacagccagaattggaggcaccgtggacacagactggtgcatcagctttgagcagatcctggccagcatcctgacagagagcgtgctggtgaacttctttgagaagagggtggacatcggcctgaagatcaaggaccagaagaaggtggagcggcagttcagcacagccagtgaccacgagcagcccggggtgtctggatag

SEQ ID NO: 38774 - DNA, 975 bp, Artificial Sequence
  Description of Artificial Sequence: Synthetic coding sequence
atgggagacctgctgccccgggcctggccaggggccggctgcacagagacccagaccaccagccagggcccccaggagctggccgtgcccacagctgagtgctacagctgcagcttctacttctgtgtgtgcccagaggccctgccccaggaggagcaggagggcagcggcagcgaggagcggggggaggagaagggcaccagcagcccagactaccgccactacctgaggatgtgggccaaggagaaggaggcccagaaggagaccatcaaggacctgcccaagatgaaccaggagcagttcatcgagctgtgcaagaccctgtacaacatgttttctgaggaccccatggagcaggacctgtaccacgccatcgccaccgtggccagcctgctgctgagaattggagaggtgggcaagaagttcagcgccaggacaggcaggaagccccgggactgtgccacagaagaagatgagcccccagcccctgagctgcaccaggatgctgcccgggagctgcagcccccagctgctggggacccccaggccaaggccggcggggacacccacctgggcaaggccccccaggagagccaggtggtggtggagggcggcagcggggagggccagggcagccccagccagctgctgagtgatgatgagaccaaggatgacatgtccatgagcagctacagcgtggtgtccacaggcagcctgcagtgtgaggacctggctgatgacacagtgctggtgggcggggaggcctgcagccccacagcccgcatcggcggcaccgtggacacagactggtgcatcagctttgagcagatcctggccagcatcctgacagaatctgtgctggtgaacttctttgagaagagggtggacatcggcctgaagatcaaggaccagaagaaggtggagcggcagttcagcacagccagtgaccacgagcagcccggggtgtctggatag

SEQ ID NO: 38775 - DNA, 1137 bp, Artificial Sequence
  Description of Artificial Sequence: Synthetic coding sequence
atgagcaaggagcccctcatcctgtggctgatgattgagttctggtggctgtacctgacccctgtgaccagcgagaccgtggtgacagaggtgctgggccaccgggtgaccctgccctgcctgtacagctcctggagccacaacagcaacagcatgtgctggggcaaggaccagtgcccctacagcggctgcaaggaggccctgatcagaacagatggcatgagggtgaccagcaggaagagcgccaagtaccgcctgcagggcaccatccccagaggagatgtgtccctgaccatcctgaaccccagcgagagtgacagcggcgtgtactgctgccgcatcgaggtgcccggctggttcaatgatgtgaagatcaacgtgcggctgaacctgcagagggccagcaccaccacccacaggacagccaccaccaccaccaggaggaccaccaccaccagccccaccaccacccggcagatgaccaccaccccagctgccctgcccaccaccgtggtgaccaccccagacctgaccaccggcacccccctgcagatgaccaccatcgctgtgttcaccacagccaacacctgcctgagcctgacccccagcaccctgcctgaggaggccaccggcctgctgaccccagagcccagcaaggagggccccatcctgacagctgagagcgagaccgtgctgcccagcgacagctggagctctgtggagagcaccagcgctgacacagtgctgctgaccagcaaggagagcaaggtgtgggacctgcccagcaccagccacgtgtccatgtggaagaccagtgacagcgtgagcagcccccagcccggggccagtgacacagctgtgcctgagcagaacaagaccaccaagacaggccagatggatggcatccccatgtccatgaagaatgagatgcccatcagccagctgctgatgatcatcgcccccagcctgggctttgtgctgtttgccctgtttgtggccttcctgctgcggggcaagctgatggagacctactgcagccagaagcacacccggctggactacatcggggacagcaagaatgtgctgaatgatgtgcagcacggccgggaggatgaagatggcctcttcaccctgtag

SEQ ID NO: 38776 - DNA, 1053 bp, Artificial Sequence
  Description of Artificial Sequence: Synthetic coding sequence
atgagcaaggagcccctcatcctgtggctgatgattgagttctggtggctgtacctgacccctgtgaccagcgagaccgtggtgacagaggtgctgggccaccgggtgaccctgccctgcctgtacagctcctggagccacaacagcaacagcatgtgctggggcaaggaccagtgcccctacagcggctgcaaggaggccctgatcagaacagatggcatgagggtgaccagcaggaagagcgccaagtaccgcctgcagggcaccatccccagaggagatgtgtccctgaccatcctgaaccccagcgagagtgacagcggcgtgtactgctgccgcatcgaggtgcccggctggttcaatgatgtgaagatcaacgtgcggctgaacctgcagagggccagcaccaccacccacaggacagccaccaccaccaccaggaggaccaccaccaccagccccaccaccacccggcagatgaccaccaccccagctgccctgcccaccaccgtggtgaccaccccagacctgaccaccggcacccccctgcagatgaccaccatcgctgtgttcaccacagccaacacctgcctgagcctgacccccagcaccctgcctgaggaggccaccggcctgctgaccccagagcccagcaaggagggccccatcctgacagctgagagcgagaccgtgctgcccagcgacagctggagctctgtggagagcaccagcgctgacacagtgctgctgaccagcaaggccagtgacacagctgtgcctgagcagaacaagaccaccaagacaggccagatggatggcatccccatgtccatgaagaatgagatgcccatcagccagctgctgatgatcatcgcccccagcctgggctttgtgctgtttgccctgtttgtggccttcctgctgcggggcaagctgatggagacctactgcagccagaagcacacccggctggactacatcggggacagcaagaatgtgctgaatgatgtgcagcacggccgggaggatgaagatggcctcttcaccctgtag

SEQ ID NO: 38777 - DNA, 3504 bp, Artificial Sequence
  Description of Artificial Sequence: Synthetic coding sequence
atgcccaacagcgtgctgtgggccgtggacctgtttggccgggtgtacaccctgagcacagctggccagtactgggagatgtgcaaggacagccagctggagttcaagagggtgtctgccaccacccagtgctgctggggcatcgcctgtgacaaccaggtgtatgtgtatgtgtgtgccagtgatgtgcccatcagaagaagagaggaggcctatgagaaccagcgctggaaccccatgggcggcttctgtgagaagctgctgctgagtgaccgctggggctggagcgatgtgtctggcctgcagcaccggcccctggacagagtggccctgcccagcccccactgggagtgggagagtgactggtacgtggatgagaactttggaggagagcccacagagaagggcggctggacctacgccatcgacttccctgccacctacaccaaggacaagaagtggaacagctgtgtgagaagaaggaagtggatccgctaccgccgctacaagagccgggacatctgggccaagatccccagcaaggatgaccccaaggagctgcctgaccccttcaatgacctgtctgtgggcggctgggagatcacagaggagcctgtgggccgcctgtctgtgtgggccgtgtccctgcagggcaaggtgtggtaccgggaggatgtgagccacagcaaccctgagggcagctcctggagcctgctggacaccccaggagaggtggtgcagatcagctgtggcccccatgacctgctgtgggccaccctgtgggagggccaggccctggtgcgggagggcatcaacagaagcaaccccaagggcagctcctggagcatcgtggagcccccaggctctgaaaatggagtgatgcacatctctgtgggcgtgtctgtggtgtgggccgtgaccaaggactggaaggtgtggttcagaagaggagtgaacagccacaacccctgtggcacctcctggattgagatggtgggggagatgaccatggtgaatgtgggcatgaatgaccaggtgtggggcatcggctgtgaggacagagctgtgtacttccggcagggcgtgaccccatctgagctgagcggcaagacctggaaggccatcatcgccgcccgggagtgtgacaggagccacagcggcagcagcagcagcctgctgtctgctggctgcttctttggagatgaggtgcggggcagcggggagagcgcccccagcgacacagatgccagcagcgaggtggagaggcctggccctggccagatcctgcctgctgagcccctggatgacagcaagaatgccactggaaacagcgccagcggcctgggcgccggccgcacagcagaagatactgtggaggatgcctgcccagctgagggcagccgggaggcccggcccaacacccaccctggccctgcccccaccccagctgagctgccctggaccaacatcgacctgaaggaggccaagaaggtgcccagccacagcgctgctggcttccctgagaccaccagcctgagcagcctgggcctgctgcccctgggcctggaggagccctacggcgtggatgaccaccccctgtgggcctgggtgtctgggggcggctgtgtggtggaggcctgtgccatgccccgctggttcaccgtgcaggccgccggcctgagcagctctgtgcacatgctgagcctgagcatcaccccagcccagacagctgcctggaggaagcagatcttccagcagctgacagagaggaccaagcgggagctggagaacttccgccactatgagcaggccgtggagcagagcgtgtgggtgaagacaggagccctgcagtggtggtgtgactggaagccccacaagtgggtggatgtgcggctggccctggagcagttcaccggccatgatggagtgcgggacagcatcctcttcatctactacgtggtgcatgaggagaagaagtacatccacatcttcctgaatgaggtggtggccctggtgcctgtgctgaatgagaccaagcacagctttgccctgtacaccccagagaggacccggcagcgctggcctgtgcggctggccgccgccacagagcaggacatgaatgactggctggccctgctgagcctgagctgctgtgagagcaggaaggtgcagggccggcccagcccccaggccatctggagcatcacctgcaagggggacatctttgtgtctgagcccagcccagacctggaggcccacgagcaccccctgccctgtgaccagatgttctggaggcagatgggcggccacctgaggatggtggaggccaacagccggggcgtggtgtggggcatcggctatgaccacacagcctgggtgtacacaggaggctacggcggcggctgcttccagggcctggccagcagcaccagcaacatctacacccagagtgatgtgaagtgtgtgcacatctatgagaaccagcgctggaaccctgtgacaggctacaccagcagccggggcctgcccacagaccgctacatgtggagcgatgccagcggcctgcaggagtgcaccaaggccggcaccaagccacccagcctgcagtgggcctgggtgtctgactggtttgtggacttctctgtgcctgggggcacagaccaggagggctggcagtatgccagtgacttccctgccagctaccacggcagcaagaccatgaaggactttgtgagaagacgctgctgggccaggaagtgcaagctggtgaccagcggcccctggctggaggtgccccccatcgccctgagagatgtgtccatcatccctgagagccctggagctgagggcagcggccacagcatcgccctgtgggccgtgtctgacaagggagatgtgctgtgccgcctgggcgtgtctgagctgaacccagctggcagctcctggctgcacgtgggcacagaccagccctttgccagcatcagcatcggggcctgctaccaggtgtgggccgtggccagagatggcagcgccttctaccggggctctgtgtaccccagccagcctgctggggactgctggtaccacatccccagccccccccggcagaggctgaagcaggtgtctgctggccagacctctgtgtatgccctggatgaaaatggaaacctgtggtaccggcagggcatcacccccagctacccccagggcagctcctgggagcacgtgagcaacaacgtgtgccgggtgtctgtgggccccctggaccaggtgtgggtgattgccaacaaggtgcagggcagccacagcctgagccggggcaccgtgtgccacaggactggagtgcagccccatgagcccaagggccacggctgggactatggaattggaggcggctgggaccacatctctgtgcgggccaatgccacccgggcccccaggagcagcagccaggagcaggagcccagcgcccctcctgaggcccacggccctgtgtgctgctag

SEQ ID NO: 38778 - DNA, 306 bp, Artificial Sequence
  Description of Artificial Sequence: Synthetic coding sequence
atgcccaacagcgtgctgtgggccgtggacctgtttggccgggtgtacaccctgagcacagctggccagtactgggagatgtgcaaggacagccagctggagttcaagagggtgtctgccaccacccagtgctgctggggcatcgcctgtgacaaccaggtgtatgtgtatgtgtgtgccagtgatgtgcccatcagaagaagagaggaggcctatgagaaccagcgctggaaccccatgggcggcttctgtgagaagctgctgctgagtgaccgctggggctggagcgatgtgtctggcctgtag

SEQ ID NO: 38779 - DNA, 3498 bp, Artificial Sequence
  Description of Artificial Sequence: Synthetic coding sequence
atgcccaacagcgtgctgtgggccgtggacctgtttggccgggtgtacaccctgagcacagctggccagtactgggagatgtgcaaggacagccagctggagttcaagagggtgtctgccaccacccagtgctgctggggcatcgcctgtgacaaccaggtgtatgtgtatgtgtgtgccagtgatgtgcccatcagaagaagagaggaggcctatgagaaccagcgctggaaccccatgggcggcttctgtgagaagctgctgctgagtgaccgctggggctggagcgatgtgtctggcctgcagcaccggcccctggacagagtggccctgcccagcccccactgggagtgggagagtgactggtacgtggatgagaactttggaggagagcccacagagaagggcggctggacctacgccatcgacttccctgccacctacaccaaggacaagaagtggaacagctgtgtgagaagaaggaagtggatccgctaccgccgctacaagagccgggacatctgggccaagatccccagcaaggatgaccccaaggagctgcctgaccccttcaatgacctgtctgtgggcggctgggagatcacagaggagcctgtgggccgcctgtctgtgtgggccgtgtccctgcagggcaaggtgtggtaccgggaggatgtgagccacagcaaccctgagggcagctcctggagcctgctggacaccccaggagaggtggtgcagatcagctgtggcccccatgacctgctgtgggccaccctgtgggagggccaggccctggtgcgggagggcatcaacagaagcaaccccaagggcagctcctggagcatcgtggagcccccaggctctgaaaatggagtgatgcacatctctgtgggcgtgtctgtggtgtgggccgtgaccaaggactggaaggtgtggttcagaagaggagtgaacagccacaacccctgtggcacctcctggattgagatggtgggggagatgaccatggtgaatgtgggcatgaatgaccaggtgtggggcatcggctgtgaggacagagctgtgtacttccggcagggcgtgaccccatctgagctgagcggcaagacctggaaggccatcatcgccgcccgggagtgtgacaggagccacagcggcagcagcagcagcctgctgtctgctggctgcttctttggagatgaggtgcggggcagcggggagagcgcccccagcgacacagatgccagcagcgaggtggagaggcctggccctggccagatcctgcctgctgagcccctggatgacagcaagaatgccactggaaacagcgccagcggcctgggcgccggccgcacagcagaagatactgtggaggatgcctgcccagctgagggcagccgggaggcccggcccaacacccaccctggccctgcccccaccccagctgagctgccctggaccaacatcgacctgaaggaggccaagaaggtgcccagccacagcgctgctggcttccctgagaccaccagcctgagcagcctgggcctgctgcccctgggcctggaggagccctacggcgtggatgaccaccccctgtgggcctgggtgtctgggggcggctgtgtggtggaggcctgtgccatgccccgctggttcaccgtgcaggccggcctgagcagctctgtgcacatgctgagcctgagcatcaccccagcccagacagctgcctggaggaagcagatcttccagcagctgacagagaggaccaagcgggagctggagaacttccgccactatgagcaggccgtggagcagagcgtgtgggtgaagacaggagccctgcagtggtggtgtgactggaagccccacaagtgggtggatgtgcggctggccctggagcagttcaccggccatgatggagtgcgggacagcatcctcttcatctactacgtggtgcatgaggagaagaagtacatccacatcttcctgaatgaggtggtggccctggtgcctgtgctgaatgagaccaagcacagctttgccctgtacaccccagagaggacccggcagcgctggcctgtgcggctggccgccgccacagagcaggacatgaatgactggctggccctgctgagcctgagctgctgtgagagcaggaaggtgcagggccggcccagcccccaggccatctggagcatcacctgcaagggggacatctttgtgtctgagcccagcccagacctggaggcccacgagcaccccctgccctgtgaccagatgttctggaggcagatgggcggccacctgaggatggtggaggccaacagcagaggagtggtgtggggcatcggctatgaccacacagcctgggtgtacacaggaggctatggaggcggctgcttccagggcctggccagcagcaccagcaacatctacacccagagtgatgtgaagtgtgtgcacatctatgagaaccagcgctggaaccctgtgacaggctacaccagccggggcctgcccacagaccgctacatgtggagcgatgccagcggcctgcaggagtgcaccaaggccggcaccaagccacccagcctgcagtgggcctgggtgtctgactggtttgtggacttctctgtgcctgggggcacagaccaggagggctggcagtatgccagtgacttccctgccagctaccacggcagcaagaccatgaaggactttgtgagaagacgctgctgggccaggaagtgcaagctggtgaccagcggcccctggctggaggtgccccccatcgccctgagagatgtgtccatcatccctgagagccctggagctgagggcagcggccacagcatcgccctgtgggccgtgtctgacaagggagatgtgctgtgccgcctgggcgtgtctgagctgaacccagctggcagctcctggctgcacgtgggcacagaccagccctttgccagcatcagcatcggggcctgctaccaggtgtgggccgtggccagagatggcagcgccttctaccggggctctgtgtaccccagccagcctgctggggactgctggtaccacatccccagccccccccggcagaggctgaagcaggtgtctgctggccagacctctgtgtatgccctggatgaaaatggaaacctgtggtaccggcagggcatcacccccagctacccccagggcagctcctgggagcacgtgagcaacaacgtgtgccgggtgtctgtgggccccctggaccaggtgtgggtgattgccaacaaggtgcagggcagccacagcctgagccggggcaccgtgtgccacaggactggagtgcagccccatgagcccaagggccacggctgggactatggaattggaggcggctgggaccacatctctgtgcgggccaatgccacccgggcccccaggagcagcagccaggagcaggagcccagcgcccctcctgaggcccacggccctgtgtgctgctag

SEQ ID NO: 38780 - DNA, 2331 bp, Artificial Sequence
  Description of Artificial Sequence: Synthetic coding sequence
atgggcggcttctgtgagaagctgctgctgagtgaccgctggggctggagcgatgtgtctggcctgcagcaccggcccctggacagagtggccctgcccagcccccactgggagtgggagagtgactggtacgtggatgaaaattttggaggagagcccacagagaagggcggctggacctacgccatcgacttccctgccacctacaccaaggacaagaagtggaacagctgtgtgagaagaaggaagtggatccgctaccgccgctacaagagccgggacatctgggccaagatccccagcaaggatgaccccaaggagctgcctgaccccttcaatgacctgtctgtgggcggctgggagatcacagaggagcctgtgggccgcctgtctgtgtgggccgtgtccctgcagggcaaggtgctgtgcccctgcctggccagccaggtgtggtaccgggaggatgtgagccacagcaaccctgagggcagctcctggagcctgctggacaccccaggagaggtggtgcagatcagctgtggcccccatgacctgctgtgggccaccctgtgggagggccaggccctggtgcgggagggcatcaacagaagcaaccccaagggcagctcctggagcatcgtggagcccccaggctctgaaaatggagtgatgcacatctctgtgggcgtgtctgtggtgtgggccgtgaccaaggactggaaggtgtggttcagaagaggagtgaacagccacaacccctgtggcacctcctggattgagatggtgggggagatgaccatggtgaatgtgggcatgaatgaccaggtgtggggcatcggctgtgaggacagagctgtgtacttccggcagggcgtgaccccatctgagctgagcggcaagacctggaaggccatcatcgccgcccgggagtgtgacaggagccacagcggcagcagcagcagcctgctgtctgctggctgcttctttggagatgaggtgcggggcagcggggagagcgcccccagcgacacagatgccagcagcgaggtggagaggcctggccctggccagatcctgcctgctgagcccctggatgacagcaagaatgccactggaaacagcgccagcggcctgggcgccggccgcacagcagaagatactgtggaggatgcctgcccagctgagggcagccgggaggcccggcccaacacccaccctggccctgcccccaccccagctgagctgccctggaccaacatcgacctgaaggaggccaagaaggtgcccagccacagcgctgctggcttccctgagaccaccagcctgagcagcctgggcctgctgcccctgggcctggaggagccctacggcgtggatgaccaccccctgtgggcctgggtgtctgggggcggctgtgtggtggaggcctgtgccatgccccgctggttcaccgtgcaggccggcctgagcagctctgtgcacatgctgagcctgagcatcaccccagcccagacagctgcctggaggaagcagatcttccagcagctgacagagaggaccaagcgggagctggagaacttccgccactatgagcaggccgtggagcagagcgtgtgggtgaagacaggagccctgcagtggtggtgtgactggaagccccacaagtgggtggatgtgcggctggccctggagcagttcaccggccatgatggagtgcgggacagcatcctcttcatctactacgtggtgcatgaggagaagaagtacatccacatcttcctgaatgaggtggtggccctggtgcctgtgctgaatgagaccaagcacagctttgccctgtacaccccagagaggacccggcagcgctggcctgtgcggctggccgccgccacagagcaggacatgaatgactggctggccctgctgagcctgagctgctgtgagagcaggaaggtgcagggccggcccagcccccaggccatctggagcatcacctgcaagggggacatctttgtgtctgagcccagcccagacctggaggcccacgagcaccccctgccctgtgaccagatgttctggaggcagatgggcggccacctgaggatggtggaggccaacagcagaggagtggtgtggggcatcggctatgaccacacagcctgggtgtacacaggaggctatggaggcggctgcttccagggcctggccagcagcaccagcaacatctacacccagagtgatgtgaagtgtgtgcacatctatgagaaccagcgctggaaccctgtgacaggctacaccagcagccgggaccgcatcagcccctgctggtag

SEQ ID NO: 38781 - DNA, 627 bp, Artificial Sequence
  Description of Artificial Sequence: Synthetic coding sequence
atgccacccaagaaggatgtgcctgtgaagaagccagctggccccagcatcagcaagccagctgccaagccagctgctgctggggcccccccagccaagaccaaggccgagcctgctgtgccccaggccccccagaagacccaggagccccctgtggacctgagcaaggtggtgattgagttcaacaaggaccagctggaggagttcaaggaggcctttgagctgtttgacagagtgggagatggcaagatcctgtacagccagtgtggagatgtgatgagggccctgggccagaaccccaccaatgctgaggtgctgaaggtgctgggcaaccccaagagtgatgagctgaagagccggcgggtggactttgagaccttcctgcccatgctgcaggccgtggccaagaacagaggccagggcacctatgaggactacctggagggcttccgggtgtttgacaaggagggcaatggcaaggtgatgggcgctgagctgcggcacgtgctgaccaccctgggggagaagatgacagaggaggaggtggagaccgtgctggccggccacgaggacagcaatggctgcatcaactatgaggccttcctgaagcacatcctgtctgtgtag

SEQ ID NO: 38782 - DNA, 2790 bp, Artificial Sequence
  Description of Artificial Sequence: Synthetic coding sequence
atgaccaagaagaggaagaggcagcacgacttccagaaggtgaagctgaaggtgggcaagaagaagcccaagctgcagaatgccacccccaccaacttcaagaccaagaccatccacctgcctgagcagctgaaggaggatggcaccctgcccaccaacaacaggaagctgaacatcaaggacctgctgagccagatgcaccactacaatgccggcgtgaagcagagcgccctgctgggcctgaaggacctgctgagccagtaccccttcatcattgatgcccacctgagcaacatcctgtctgaggtgacagctgtgttcacagacaaggatgccaacgtgcggctggccgctgtgcagctgctgcagttcctggcccccaagatccgggcagagcagatcagccccttcttccccctggtgtctgcccacctgagcagcgccatgacccacatcacagagggcatccaggaggacagcctgaaggtgctggacatcctgctggagcagtacccagccctgatcaccggccgcagcagcatcctgctgaagaactttgtggagctgatcagccaccagcagctgagcaagggcctcatcaacagagacaggagccagagctggatcctgtctgtgaaccccaacagaaggctgaccagccagcagtggaggctgaaggtgctggtgcggctgagcaagttcctgcaggccctggctgatggcagcagccggctgcgggagagcgagggcctgcaggagcagaaggagaacccccacgccaccagcaacagcatcttcatcaactggaaggagcacgccaatgaccagcagcacatccaggtgtatgaaaatggaggcagccagcccaacgtgagcagccagttccggctgcgctacctggtgggcggcctgtctggagtggatgagggcctgagcagcacagagaacctgaagggcttcatcgagatcatcatccccctgctgattgagtgctgggtggaggccgtgcccccccagctggccacccctgtgggcaatggcatcgagcgggagcccctgcaggtgatgcagcaggtgctgaacatcatcagcctgctgtggaagctgagcaagcagcaggatgagacccacaagctggagagctggctgaggaagaactacctgattgacttcaagcaccacttcatgagccgcttcccctacgtgctgaaggagatcaccaagcacaagaggaaggagcccaacaagagcatcaagcactgcaccgtgctgagcaacaacatcgaccacctgctgctgaacctgaccctgagtgacatcatggtgtccctggccaatgccagcaccctgcagaaggactgctcctggattgagatgatcaggaagtttgtgacagagaccctggaggatggcagccggctgaacagcaagcagctgaaccggctgctgggcgtgtcctggaggctgatgcagatccagcccaaccgggaggacacagagaccctcatcaaggctgtgtacaccctgtaccagcagaggggcctcatcctgcctgtgaggaccctgctgctgaagttcttcagcaagatctaccagacagaggagctgcggagctgccgcttccgctaccgcagcaaggtgctgagccgctggctggccggcctgcccctgcagctggcccacctgggcagcagaaatcctgagctgagcacccagctgattgacatcatccacacagctgctgcccgggccaacaaggagctgctgaagagcctgcaggccacagccctgcgcatctatgacccccaggagggcgctgtggtggtgctgcctgctgacagccagcagaggctggtgcagctggtgtacttcctgcccagcctgcctgctgacctgctgagccggctgagccgctgctgcatcatgggccgcctgagcagcagcctggccgccatgctgattggcatcctgcacatgaggagcagcttcagcggctggaagtacagcgccaaggactggctgatgtctgatgtggactacttctccttcctgttcagcaccctgaccggcttcagcaaggaggagctgacctggctgcagagcctgcggggcgtgccccacgtgatccagacccagctgagccctgtgctgctgtacctgacagacctggaccagttcctgcaccactgggatgtgacagaagctgtgttccacagcctgctggtgatcccagcccggagccagaactttgacatcctgcagagcgccatcagcaagcacctggtgggcctgaccgtcatcccagacagcacagctggctgtgtgtttggagtcatctgcaagctgctggaccacacctgtgtggtgtctgagaccctgctgcccttcctggccagctgctgctacagcctgctgtacttcctgctgaccattgaaaaaggagaggccgagcacctgaggaagagggacaagctgtggggcgtgtgtgtgtccatcctggccctgctgccccgggtgctgcggctgatgctgcagagcctgcgggtgaacagagtgggccctgaggagctgcctgtggtgggccagctgctgcggctgctgctgcagcacgcccccctgcggacccacatgctgaccaatgccatcctggtgcagcagatcatcaagaacatcaccaccctgaagagcggctctgtgcaggagcagtggctgacagacctgcactactgcttcaacgtgtacatcaccggccacccccagggccccagcgccctggccaccgtgtactag

SEQ ID NO: 38783 - DNA, 516 bp, Artificial Sequence
  Description of Artificial Sequence: Synthetic coding sequence
atgcagcaggtgctgaacatcatcagcctgctgtggaagctgagcaagcagcaggatgagacccacaagctggagagctggctgaggaagaactacctgattgacttcaagcaccacttcatgagccgcttcccctacgtgctgaaggagatcaccaagcacaagaggaaggagcccaacaagagcatcaagcactgcaccgtgctgagcaacaacatcgaccacctgctgctgaacctgaccctgagtgacatcatggtgtccctggccaatgccagcaccctgcagaaggactgctcctggattgagatgatcaggaagtttgtgacagagaccctggaggatggcagccggctgaacagcaagcagctgaaccggctgctgggcgtgtcctggaggctgatgcagatccagcccaaccgggaggacacagagaccctcatcaaggctgtgtacaccctgtaccagcagaggggcctcatcctgcctgtgaggaccctgctgctgaagttctag

SEQ ID NO: 38784 - DNA, 2394 bp, Artificial Sequence
  Description of Artificial Sequence: Synthetic coding sequence
atgaccaagaagaggaagaggcagcacgacttccagaaggtgaagctgaaggtgggcaagaagaagcccaagctgcagaatgccacccccaccaacttcaagaccaagaccatccacctgcctgagcagctgaaggaggatggcaccctgcccaccaacaacaggaagctgaacatcaaggacctgctgagccagatgcaccactacaatgccggcgtgaagcagagcgccctgctgggcctgaaggacctgctgagccagttcctggcccccaagatccgggcagagcagatcagccccttcttccccctggccctggctgatggcagcagccggctgcgggagagcgagggcctgcaggagcagaaggagaacccccacgccaccagcaacagcatcttcatcaactggaaggagcacgccaatgaccagcagcacatccaggtgtatgaaaatggaggcagccagcccaacgtgagcagccagttccggctgcgctacctggtgggcggcctgtctggagtggatgagggcctgagcagcacagagaacctgaagggcttcatcgagatcatcatccccctgctgattgagtgctgggtggaggccgtgcccccccagctggccacccctgtgggcaatggcatcgagcgggagcccctgcaggtgatgcagcaggtgctgaacatcatcagcctgctgtggaagctgagcaagcagcaggatgagacccacaagctggagagctggctgaggaagaactacctgattgacttcaagcaccacttcatgagccgcttcccctacgtgctgaaggagatcaccaagcacaagaggaaggagcccaacaagagcatcaagcactgcaccgtgctgagcaacaacatcgaccacctgctgctgaacctgaccctgagtgacatcatggtgtccctggccaatgccagcaccctgcagaaggactgctcctggattgagatgatcaggaagtttgtgacagagaccctggaggatggcagccggctgaacagcaagcagctgaaccggctgctgggcgtgtcctggaggctgatgcagatccagcccaaccgggaggacacagagaccctcatcaaggctgtgtacaccctgtaccagcagaggggcctcatcctgcctgtgaggaccctgctgctgaagttcttcagcaagatctaccagacagaggagctgcggagctgccgcttccgctaccgcagcaaggtgctgagccgctggctggccggcctgcccctgcagctggcccacctgggcagcagaaatcctgagctgagcacccagctgattgacatcatccacacagctgctgcccgggccaacaaggagctgctgaagagcctgcaggccacagccctgcgcatctatgacccccaggagggcgctgtggtggtgctgcctgctgacagccagcagaggctggtgcagctggtgtacttcctgcccagcctgcctgctgacctgctgagccggctgagccgctgctgcatcatgggccgcctgagcagcagcctggccgccatgctgattggcatcctgcacatgaggagcagcttcagcggctggaagtacagcgccaaggactggctgatgtctgatgtggactacttctccttcctgttcagcaccctgaccggcttcagcaaggaggagctgacctggctgcagagcctgcggggcgtgccccacgtgatccagacccagctgagccctgtgctgctgtacctgacagacctggaccagttcctgcaccactgggatgtgacagaagctgtgttccacagcctgctggtgatcccagcccggagccagaactttgacatcctgcagagcgccatcagcaagcacctggtgggcctgaccgtcatcccagacagcacagctggctgtgtgtttggagtcatctgcaagctgctggaccacacctgtgtggtgtctgagaccctgctgcccttcctggccagctgctgctacagcctgctgtacttcctgctgaccattgaaaaaggagaggccgagcacctgaggaagagggacaagctgtggggcgtgtgtgtgtccatcctggccctgctgccccgggtgctgcggctgatgctgcagagcctgcgggtgaacagagtgggccctgaggagctgcctgtggtgggccagctgctgcggctgctgctgcagcacgcccccctgcggacccacatgctgaccaatgccatcctggtgcagcagatcatcaagaacatcaccaccctgaagagcggctctgtgcaggagcagtggctgacagacctgcactactgcttcaacgtgtacatcaccggccacccccagggccccagcgccctggccaccgtgtactag

SEQ ID NO: 38785 - DNA, 2742 bp, Artificial Sequence
  Description of Artificial Sequence: Synthetic coding sequence
atgagcaggatgaccaagaagaggaagaggcagcacgacttccagaaggtgaagctgaaggtgggcaagaagaagcccaagctgcagaatgccacccccaccaacttcaagaccaagaccatccacctgcctgagcagctgaaggaggatggcaccctgcccaccaacaacaggaagctgaacatcaaggacctgctgagccagatgcaccactacaatgctggggtgaagcagagcgccctgctgggcctgaaggacctgctgagccagtaccccttcatcattgatgcccacctgagcaacatcctgtctgaggtgacagctgtgttcacagacaaggatgccaacgtgcggctggccgctgtgcagctgctgcagttcctggcccccaagatccgggcagagcagatcagccccttcttccccctggtgtctgcccacctgagcagcgccatgacccacatcacagagggcatccaggaggacagcctgaaggtgctggacatcctgctggagcagtacccagccctgatcaccggccgcagcagcatcctgctgaagaactttgtggagctgatcagccaccagcagctgagcaagggcctcatcaacagagacaggagccagagctggatcctgtctgtgaaccccaacagaaggctgaccagccagcagtggaggctgaaggtgctggtgcggctgagcaagttcctgcaggccctggctgatggcagcagccggctgcgggagagcgagggcctgcaggagcagaaggagaacccccacgccaccagcaacagcatcttcatcaactggaaggagcacgccaatgaccagcagcacatccaggtgtatgaaaatggaggcagccagcccaacgtgagcagccagttccggctgcgctacctggtgggcggcctgagcggcgtggatgagggcctgagcagcacagagaacctgaagggcttcatcgagatcatcatccccctgctgattgagtgctgggtggaggccgtgcccccccagctggccacccctgtgggcaatggaattgagcgggagcccctgcaggtgatgcagcaggtgctgaacatcatcagcctgctgtggaagctgagcaagcagcaggatgagacccacaagctggagagctggctgaggaagaactacctgattgacttcaagcaccacttcatgagccgcttcccctacgtgctgaaggagatcaccaagcacaagaggaaggagcccaacaagagcatcaagcactgcaccgtgctgagcaacaacatcgaccacctgctgctgaacctgaccctgagtgacatcatggtgtccctggccaatgccagcaccctgcagaaggactgctcctggattgagatgatcaggaagtttgtgacagagaccctggaggatggcagccggctgaacagcaagcagctgaaccggctgctgggcgtgtcctggaggctgatgcagatccagcccaaccgggaggacacagagaccctcatcaaggctgtgtacaccctgtaccagcagaggggcctcatcctgcctgtgaggaccctgctgctgaagttcttcagcaagatctaccagacagaggagctgcggagctgccgcttccgctaccgcagcaaggtgctgagccgctggctggccggcctgcccctgcagctggcccacctgggcagcaggaaccctgagctgagcacccagctgattgacatcatccacacagctgctgcccgggccaacaaggagctgctgaagagcctgcaggccacagccctgcgcatctatgacccccaggagggcgctgtggtggtgctgcctgctgacagccagcagaggctggtgcagctggtgtacttcctgcccagcctgcctgctgacctgctgagccggctgagccgctgctgcatcatgggccgcctgagcagcagcctggccgccatgctgattggcatcctgcacatgaggagcagcttcagcggctggaagtacagcgccaaggactggctgatgtctgatgtggactacttctccttcctgttcagcaccctgaccggcttcagcaaggaggagctgacctggctgcagagcctgcggggcgtgccccacgtgatccagacccagctgagccctgtgctgctgtacctgacagacctggaccagttcctgcaccactgggatgtgacagaggccgtgttccacagcctgctggtgatcccagcccggagccagaactttgacatcctgcagagcgccatcagcaagcacctggtgggcctgaccgtcatcccagacagcacagctggctgtgtgtttggagtcatctgcaagctgctggaccacacctgtgtggtgtctgagaccctgctgcccttcctggccagctgctgctacagcctgctgtacttcctgctgaccatcgagaagggggaggccgagcacctgaggaagaggctgatgctgcagagcctgcgggtgaacagagtgggccctgaggagctgcctgtggtgggccagctgctgcggctgctgctgcagcacgcccccctgcggacccacatgctgaccaatgccatcctggtgcagcagatcatcaagaacatcaccaccctgaagagcggctctgtgcaggagcagtggctgacagacctgcactactgcttcaacgtgtacatcaccggccacccccagggccccagcgccctggccaccgtgtactag

SEQ ID NO: 38786 - DNA, 1302 bp, Artificial Sequence
  Description of Artificial Sequence: Synthetic coding sequence
atgcaccactacaatgctggggtgaagcagagcgccctgctgggcctgaaggacctgctgagccagtaccccttcatcattgatgcccacctgagcaacatcctgtctgaggtgacagctgtgttcacagacaaggatgccaacgtgcggctggccgctgtgcagctgctgcagttcctggcccccaagatccgggcagagcagatcagccccttcttccccctggtgtctgcccacctgagcagcgccatgacccacatcacagagggcatccaggaggacagcctgaaggtgctggacatcctgctggagcagtacccagccctgatcaccggccgcagcagcatcctgctgaagaactttgtggagctgatcagccaccagcagctgagcaagggcctcatcaacagagacaggagccagagctggatcctgtctgtgaaccccaacagaaggctgaccagccagcagtggaggctgaaggtgctggtgcggctgagcaagttcctgcaggccctggctgatggcagcagccggctgcgggagagcgagggcctgcaggagcagaaggagaacccccacgccaccagcaacagcatcttcatcaactggaaggagcacgccaatgaccagcagcacatccaggtgtatgaaaatggaggcagccagcccaacgtgagcagccagttccggctgcgctacctggtgggcggcctgagcggcgtggatgagggcctgagcagcacagagaacctgaagggcttcatcgagatcatcatccccctgctgattgagtgctgggtggaggccgtgcccccccagctggccacccctgtgggcaatggaattgagcgggagcccctgcaggtgatgcagcaggtgctgaacatcatcagcctgctgtggaagctgagcaagcagcaggatgagacccacaagctggagagctggctgaggaagaactacctgattgacttcaagcaccacttcatgagccgcttcccctacgtgctgaaggagatcaccaagcacaagaggaaggagcccaacaagagcatcaagcactgcaccgtgctgagcaacaacatcgaccacctgctgctgaacctgaccctgagtgacatcatggtgtccctggccaatgccagcaccctgcagaaggactgctcctggattgagatgatcaggaagtttgtgacagagaccctggaggatggcagccggctgaacagcaagcagctgaaccggctgctgggcgtgtcctggaggctgatgcagatccagcccaacagaggaagatag

SEQ ID NO: 38787 - DNA, 3405 bp, Artificial Sequence
  Description of Artificial Sequence: Synthetic coding sequence
atgaccagcctgtatggaagacatgctgagaagaccacagacatgcccaagcccagcgcccccaaggtgcacgtgcagaggtctgtgtcccgggacaccatcgccatccacttcagcgccagcggggaggaggaggaggaggaggaggaggagttccgggagtactttgaggagggcctggatgaccagagcatcgtgacaggcctggaggccaaggaggacctgtacctggagccccaggtgggccatgaccctgctggccctgctgccagccctgtgctggctgatggcctgtctgtgtcccaggccccagccatcctgcctgtgtccaagaacacagtgaagctgctggagagccctgtgcctgctgcccaggtgctgagcacagtgcccctggccgtgtccccaggcagcagcagcagcggccccctggccagcagccccagcgtgagcagcctgtctgagcagaagaccagcagcagcagccccctgagcagccccagcaagagccccatcctgagcagcagcgccagcaccagcaccctgagcagcgccaagcccttcatgagcctggtgaagagcctgagcacagaggtggagcccaaggagagcccccacccagcccggcaccgccacctgatgaagaccctggtgaagagcctgagcacagacaccagccggcaggagagtgacacagtgtcctacaagcccccagacagcaagctgaacctgcacctgttcaagcagttcacccagcccaggaacacaggaggagacagcaagacagcccccagcagccccctgaccagccccagcgacaccaggagcttcttcaaggtgcctgagatggaggccaagattgaggacaccaagaggcggctgtctgaggtgatctatgagcccttccagctgctgagcaagatcattggagaggagagcggcagccaccggcccaaggccctgagcagcagcgccagcgagctgagcaacctgagcagcctgaatggccacctggagagcaacaacaactacagcatcaaggaggaggagtgtgacagtgaaggagatggctacggcagtgacagcaacatccccaggagtgaccaccccaagagcactggagagcccacccgggagattgagctgaagagcagccagggcagcagcctgaaggacctgggcctgaagaccagcagcctggtgctggagaagtgcagcctgagcgccctggtgtccaaggaggatgaggagttctgtgagctgtacacagaggactttgacctggagacagaaggagagagcaaggtggacaagctgagtgacatccccctgaagccagaggtgctggctgaagatggagtggtgctggacagtgaagatgaggtggacagcgctgtgcagcaccctgagctgcctgtgaagaccctgggcttcttcatcatgtgtgtgtatgtgtacctgatcctgcccctgccccactacgtgtctggcctcttcctgggcatcggcctgggcttcatgacagctgtgtgtgtgatctggttcttcaccccacccagcgcccacaagtaccacaagctgcacaagaacctgcggcactggaacaccaggagcctggacatcaaggagcctgagatcctgaagggctggatgaatgagatctacaactatgaccctgagacctaccacgccaccctgacccacagcgtgtttgtgcggctggagggcggcaccctgcggctgagcaagcccaacaagaacatcagccggcgggccagctacaatgagcccaagccagaggtgacctacatcagccagaagatctatgacctgagtgacagcaagatctacctggtgcccaagaccctggccaggaagaggatctggaacaagaagtaccccatctgcatcgagctgggccagcaggatgacttcatgagcaaggcccagacagacaaggagaccagcgaggagaagcccccagctgagggcagcgaggaccccaagaagccaccccggccccaggagggcaccaggagcagccagagggaccagatcctgtacctgtttggccgcacaggccgggagaaggaggagtggttccgccgcttcatcctggccagcaagctgaagtctgagatcaagaagagcagcggcgtgtctgggggcaagccagcccctgtgttcctggcccctggcctgctgcctgcccacagccgccacaacagccccagcggccacctgacccacagccgcagcagcagcaagggctctgtggaggagatcatgagccagcccaagcagaaggagctggccggctctgtgcggcagaagatgctgctggactacagcgtgtacatgggccgctgtgtgccccaggagagccgcagcccccagaggagccccctgcagagcgctgagagcagccccacagctgggaagaagctgcctgaggtgccccccagcgaggaggaggagcaggaggcctgggtgaatgccctgctgggccgcatcttctgggacttcctgggggagaagtactggagcgacctggtgtccaagaagatccagatgaagctgagcaagatcaagctgccctacttcatgaatgagctgaccctgacagagctggacatgggcgtggccgtgcccaagatcctgcaggccttcaagccctacgtggaccaccagggcctgtggattgacctggagatgagctacaacggcagcttcctgatgaccctggagaccaagatgaacctgaccaagctgggcaaggagcccctggtggaggccctgaaggtgggggagatcggcaaggagggctgccggccccgggccttctgcctggccgacagtgatgaggagagcagcagcgctggcagcagtgaagaagatgatgcccctgagcccagcggcggggacaagcagctgctgcccggggctgagggctacgtgggcggccacaggaccagcaagatcatgagatttgtggacaagatcaccaagagcaagtacttccagaaggccacagaaacagagttcatcaagaagaagattgaggaggtgagcaacacccccctgctgctgactgtggaggtgcaggagtgccggggcaccctggccgtgaacatccccccaccacccacagacagagtgtggtacggcttcaggaagccaccccacgtggagctgaaggcccggcccaagctgggggagcgggaggtgaccctggtgcacgtgacagactggattgagaagaagctggagcaggagttccagaaggtgtttgtgatgcccaacatggatgatgtgtacatcaccatcatgcacagcgccatggaccccaggagcaccagctgcctgctgaaggacccccctgtggaggccgctgaccagccctag

SEQ ID NO: 38788 - DNA, 591 bp, Artificial Sequence
  Description of Artificial Sequence: Synthetic coding sequence
atgtggttcatgtacctgctgtcctggctgagcctcttcatccaggtggccttcatcaccctggccgtggccgccggcctgtactacctggccgagctgattgaggagtacacagtggccaccagccgcatcatcaagtacatgatctggttcagcacagctgtgctgattggcctgtatgtgtttgagcgcttccccacctccatgattggagtgggcctcttcaccaacctggtgtacttcggcctgctgcagaccttccccttcatcatgctgaccagccccaacttcatcctgagctgtggcctggtggtggtgaaccactacctggccttccagttctttgctgaggagtactaccccttcagcgaggtgctggcctacttcaccttctgcctgtggatcatcccctttgccttctttgtgtccctgtctgctggggagaatgtgctgcccagcaccatgcagcctggagatgatgtggtgagcaactacttcaccaagggcaagaggggcaagaggctgggcatcctggtggtgttctccttcatcaaggaggccatcctgcccagccggcagaagatctactag

SEQ ID NO: 38789 - DNA, 1233 bp, Artificial Sequence
  Description of Artificial Sequence: Synthetic coding sequence
atggtgctgaaggccgagcacaccaggagccccagcgccaccctgcccagcaatgtgcccagctgccgcagcctgagcagcagtgaagatggccccagcggccccagcagcctggctgatggcggcctggcccacaacctgcaggacagcgtgcgccaccgcatcctgtacctgtctgagcagctgcgggtggagaaggccagcagagatggcaacacagtgtcctacctgaagctggtgtccaaggctgacagacaccaggtgccccacatccagcaggcctttgagaaggtgaaccagagggccagcgccaccatcgcccagatcgagcaccggctgcaccagtgccaccagcagctgcaggagctggaggagggctgcaggcctgagggcctgctgctgatggccgagagtgaccctgccaactgtgagcccccatctgagaaggccctgctgtctgagcccccagagcctggaggagaagatggccctgtgaacctgccccacgccagccggcccttcatcctggagagccgcttccagagcctgcagcagggcacctgcctggagacagaagatgtggcccagcagcagaacctgctgctgcagaaggtgaaggccgagctggaggaggccaagcgcttccacatcagcctgcaggagagctaccacagcctgaaggagaggagcctgacagacctgcagctgctgctggagagcctgcaggaggagaagtgccggcaggccctgatggaggagcaggtgaatggccgcctgcagggccagctgaatgagatctacaacctgaagcacaacctggcctgcagcgaggagaggatggcctacctgtcctatgagcgggccaaggagatctgggagatcacagagaccttcaagagccgcatcagcaagctggagatgctgcagcaggtgacccagctggaggccgctgagcacctgcagagccggcccccccagatgctgttcaagttcctgagcccccggctgagcctggccaccgtgctgctggtgtttgtgtccaccctgtgtgcctgccccagcagcctcatcagcagccggctgtgcacctgcaccatgctgatgctgattggcctgggcgtgctggcctggcagcgctggagggccatcccagccacagactggcaggagtgggtgcccagccgctgccgcctgtacagcaaggacagcggccccccagcagatggcccctag

SEQ ID NO: 38790 - DNA, 1233 bp, Artificial Sequence; identical to SEQ ID NO: 38789
  Description of Artificial Sequence: Synthetic coding sequence

SEQ ID NO: 38791 - DNA, 1068 bp, Artificial Sequence
  Description of Artificial Sequence: Synthetic coding sequence
atggaggagggggagaggagccccctgctgagccaggagacagctggccagaagcccctgtctgtgcacaggcctcccaccagcggctgcctgggccctgtgccccgggaggaccaggccgaggcctggggctgcagctgctgccccccagagaccaagcaccaggccctgagcggcacccccaagaagggccctgcccccagcctgagccctggcagcagctgtgtgaagtacctgatcttcctgagcaacttccccttcagcctgctgggcctgctggccctggccatcggcctgtggggcctggccgtgaagggcagcctgggcagtgacctgggcggccccctgcctgctgaccccatgctgggcctggccctgggcggcctggtggtgtctgctgtgtccctggccggctacctgggcgccctgtgtgagaacacctgcctgctgcggggcttcagcggcggcatcctggccttcctggtgctggaggccgtggccggggccctggtggtggccctgtggggccccctgcaggacagcctggagcacaccctgcgggtggccatcgcccactaccaggatgatcctgacctgcgcttcctgctggaccaggtgcagctgggcctgcgctgctgcggggccgccagctaccaggactggcagcagaacctgtacttcaactgcagcagccctggggtgcaggcctgcagcctgcctgccagctgctgcatcgaccccagagaagatggagcctctgtgaatgaccagtgtggcttcggcgtgctgcggctggatgctgatgctgcccagagggtggtgtacctggagggctgcggcccccccctgcggcgctggctgcgggccaacctggccgccagcggcggctacgccatcgctgtggtgctgctgcagggcgctgagctgctgctggccgcccggctgctgggcgccctggccgccaggagaggagctgcctacggccctggggcccggggggaggacagagctggcccccagagccccagccctggggcccctcctgctgccaagccagcccggggctag

SEQ ID NO: 38792 - DNA, 708 bp, Artificial Sequence
  Description of Artificial Sequence: Synthetic coding sequence
atggaggagggggagaggagccccctgctgagccaggagacagctggccagaagcccctgtctgtgcacaggcctcccaccagcggctgcctgggccctgtgccccgggaggaccaggccgaggcctggggctgcagctgctgccccccagagaccaagcaccaggccctgagcggcacccccaagaagggccctgcccccagcctgagccctggcagcagctgtgtgaagtacctgatcttcctgagcaacttccccttcagcctgctgggcctgctggccctggccatcggcctgtggggcctggccgtgaagggcagcctgggcagtgacctgggcggccccctgcctgctgaccccatgctgggcctggccctgggcggcctggtggtgtctgctgtgtccctggccggctacctgggcgccctgtgtgagaacacctgcctgctgcggggcttcagcggcggcatcctggccttcctggtgctggaggccgtggccggggccctggtggtggccctgtggggccccctgcaggacagcctggagcacaccctgcgggtggccatcgcccactaccaggatgatcctgacctgcgcttcctgctggaccaggtgcagctgggcctgcgctgctgcggggccgccagctaccaggactggcagcagaacctgtactgcctgagcagcccctgcagcagccagtag

SEQ ID NO: 38793 - DNA, 762 bp, Artificial Sequence
  Description of Artificial Sequence: Synthetic coding sequence
atggcccactacaagacagagcaggatgactggctgatcatctacctgaagtacctgctgtttgtgttcaacttcttcttctgggtgggcggcgctgctgtgctggccgtgggcatctggaccctggtggagaagagcggctacctgtctgtgctggccagcagcacctttgctgccagcgcctacatcctgatctttgctggggtgctggtgatggtgacaggcttcctgggctttggagccatcctgtgggagaggaagggctgcctgagcacctacttctgcctgctgctggtgatcttcctggtggagctggtggccggcgtgctggcccacgtgtactaccagaggctgagtgatgagctgaagcagcacctgaacagaaccctggccgagaactacggccagcccggggccacccagatcacagcctctgtggaccggctgcagcaggacttcaagtgctgcggcagcaacagcagcgctgactggcagcacagcacctacatcctgctgcgggaggccgagggccggcaggtgcctgacagctgctgcaagacagtggtggtgcgctgtggccagagggcccaccccagcaacatctacaaggtggagggcggctgcctgaccaagctggagcagttcctggccgaccacctgctgctgatgggcgctgtgggcatcggcgtggcctgcctgcagatctgtggcatggtgctgacctgctgcctgcaccagaggctgcagaggcacttctactag

SEQ ID NO: 38794 - DNA, 732 bp, Artificial Sequence
  Description of Artificial Sequence: Synthetic coding sequence
atgaggtctgggggcggcagaaatgcctgggacaccaggggggcctgtgagcaggtgggcggcgctgctgtgctggccgtgggcatctggaccctggtggagaagagcggctacctgtctgtgctggccagcagcacctttgctgccagcgcctacatcctgatctttgctggggtgctggtgatggtgacaggcttcctgggctttggagccatcctgtgggagaggaagggctgcctgagcacctacttctgcctgctgctggtgatcttcctggtggagctggtggccggcgtgctggcccacgtgtactaccagaggctgagtgatgagctgaagcagcacctgaacagaaccctggccgagaactacggccagcccggggccacccagatcacagcctctgtggaccggctgcagcaggacttcaagtgctgcggcagcaacagcagcgctgactggcagcacagcacctacatcctgctgcgggaggccgagggccggcaggtgcctgacagctgctgcaagacagtggtggtgcgctgtggccagagggcccaccccagcaacatctacaaggtggagggcggctgcctgaccaagctggagcagttcctggccgaccacctgctgctgatgggcgctgtgggcatcggcgtggcctgcctgcagatctgtggcatggtgctgacctgctgcctgcaccagaggctgcagaggcacttctactag

SEQ ID NO: 38795 - DNA, 762 bp, Artificial Sequence; identical to SEQ ID NO: 38793
  Description of Artificial Sequence: Synthetic coding sequence

SEQ ID NO: 38796 - DNA, 642 bp, Artificial Sequence
  Description of Artificial Sequence: Synthetic coding sequence
atgcactactaccgctacagcaatgccaaggtgtcctgctggtacaagtacctgctcttctcctacaacatcatcttctggctggccggcgtggtgttcctgggcgtgggcctgtgggcctggagcgagaagggcgtgctgagtgacctgaccaaggtgaccaggatgcatggaattgatcctgtggtgctggtgctgatggtgggcgtggtgatgttcaccctgggctttgctggctgtgtgggcgccctgcgggagaacatctgcctgctgaacttcaaccagtgctgcggggcctacggccctgaggactgggacctgaatgtgtacttcaactgcagcggggccagctacagccgggagaagtgtggggtgcccttcagctgctgcgtgcctgaccctgcccagaaggtggtgaacacccagtgtggctatgatgtgcgcatccagctgaagagcaagtgggatgagagcatcttcaccaagggctgcatccaggccctggagagctggctgcccaggaacatctacatcgtggccggggtcttcatcgccatcagcctgctgcagatcttcggcatcttcctggcccggaccctcatcagtgacatcgaggccgtgaaggccggccaccacttctag

SEQ ID NO: 38797 - DNA, 813 bp, Artificial Sequence
  Description of Artificial Sequence: Synthetic coding sequence
atgcactactaccgctacagcaatgccaaggtgtcctgctggtacaagtacctgctcttctcctacaacatcatcttctggctggccggcgtggtgttcctgggcgtgggcctgtgggcctggagcgagaagggcgtgctgagtgacctgaccaaggtgaccaggatgcatggaattgatcctgtggtgctggtgctgatggtgggcgtggtgatgttcaccctgggctttgctggctgtgtgggcgccctgcgggagaacatctgcctgctgaacttcttctgtggcaccatcgtgctgatcttcttcctggagctggccgtggccgtgctggccttcctgttccaggactgggtgcgggaccgcttccgggagttctttgagagcaacatcaagagctacagagatgacatcgacctgcagaacctgattgacagcctgcagaaggccaaccagtgctgcggggcctacggccctgaggactgggacctgaatgtgtacttcaactgcagcggggccagctacagccgggagaagtgtggggtgcccttcagctgctgcgtgcctgaccctgcccagaaggtggtgaacacccagtgtggctatgatgtgcgcatccagctgaagagcaagtgggatgagagcatcttcaccaagggctgcatccaggccctggagagctggctgcccaggaacatctacatcgtggccggggtcttcatcgccatcagcctgctgcagatcttcggcatcttcctggcccggaccctcatcagtgacattgaagctgtgaaggccggccaccacttctag

SEQ ID NO: 38798 - DNA, 672 bp, Artificial Sequence
  Description of Artificial Sequence: Synthetic coding sequence
atggagaggaaggtgctgccctgcttcctgtgcctcttccagggcgtgctgagtgacctgaccaaggtgaccaggatgcatggaattgatcctgtggtgctggtgctgatggtgggcgtggtgatgttcaccctgggctttgctggctgtgtgggcgccctgcgggagaacatctgcctgctgaacttcttctgtggcaccatcgtgctgatcttcttcctggagctggccgtggccgtgctggccttcctgttccaggactgggtgcgggaccgcttccgggagttctttgagagcaacatcaagagctacagagatgacatcgacctgcagaacctgattgacagcctgcagaaggccaaccagtgctgcggggcctacggccctgaggactgggacctgaatgtgtacttcaactgcagcggggccagctacagccgggagaagtgtggggtgcccttcagctgctgcgtgcctgaccctgcccagaaggtggtgaacacccagtgtggctatgatgtgcgcatccagctgaagagcaagtgggatgagagcatcttcaccaagggctgcatccaggccctggagagctggctgcccaggaacatctacatcgtggccggggtcttcatcgccatcagcctgctgcagatcttcggcatcttcctgtag

SEQ ID NO: 38799 - DNA, 813 bp, Artificial Sequence; identical to SEQ ID NO: 38797
  Description of Artificial Sequence: Synthetic coding sequence

SEQ ID NO: 38800 - DNA, 450 bp, Artificial Sequence
  Description of Artificial Sequence: Synthetic coding sequence
atgcactactaccgctacagcaatgccaaggtgtcctgctggtacaagtacctgctcttctcctacaacatcatcttctggctggccggcgtggtgttcctgggcgtgggcctgtgggcctggagcgagaagggcgtgctgagtgacctgaccaaggtgaccaggatgcatggaattgatcctgtggtgctggtgcaccccctgagcggcagctgccagcgctacttcagctgccctgtgttcctgagcctggccttcctgagccaccccaagaacctgccccggccctacggcagcctgcccttcttcccccggcagctgctgatctgggccgtgtgcacccccagctttgccccacccaccatgccccacgtggccgagagctgcctgagccagctgagcaccctggccttcttcagcctgtgcagcaccaggcactgcaccagctag

SEQ ID NO: 38801 - DNA, 762 bp, Artificial Sequence
  Description of Artificial Sequence: Synthetic coding sequence
atgcactactaccgctacagcaatgccaaggtgtcctgctggtacaagtacctgctcttctcctacaacatcatcttctggggcgtgctgagtgacctgaccaaggtgaccaggatgcacggcatcgaccctgtggtgctggtgctgatggtgggcgtggtgatgttcaccctgggctttgctggctgtgtgggcgccctgcgggagaacatctgcctgctgaacttcttctgtggcaccatcgtgctgatcttcttcctggagctggccgtggccgtgctggccttcctgttccaggactgggtgcgggaccgcttccgggagttctttgagagcaacatcaagagctacagagatgacatcgacctgcagaacctgattgacagcctgcagaaggccaaccagtgctgcggggcctacggccctgaggactgggacctgaatgtgtacttcaactgcagcggggccagctacagccgggagaagtgtggggtgcccttcagctgctgcgtgcctgaccctgcccagaaggtggtgaacacccagtgtggctatgatgtgcgcatccagctgaagagcaagtgggatgagagcatcttcaccaagggctgcatccaggccctggagagctggctgcccaggaacatctacatcgtggccggggtcttcatcgccatcagcctgctgcagatcttcggcatcttcctggcccggaccctcatcagtgacatcgaggccgtgaaggccggccaccacttctag

SEQ ID NO: 38802 - DNA, 813 bp, Artificial Sequence; identical to SEQ ID NO: 38797
  Description of Artificial Sequence: Synthetic coding sequence

SEQ ID NO: 38803 - DNA, 444 bp, Artificial Sequence
  Description of Artificial Sequence: Synthetic coding sequence
atgcactactaccgctacagcaatgccaaggtgtcctgctggtacaagtacctgctcttctcctacaacatcatcttctggaaccagtgctgcggggcctacggccctgaggactgggacctgaatgtgtacttcaactgcagcggggccagctacagccgggagaagtgtggggtgcccttcagctgctgcgtgcctgaccctgcccagaaggtggtgaacacccagtgtggctatgatgtgcgcatccagctgaagagcaagtgggatgagagcatcttcaccaagggctgcatccaggccctggagagctggctgcccaggaacatctacatcgtggccggggtcttcatcgccatcagcctgctgcagatcttcggcatcttcctggcccggaccctcatcagtgacatcgaggccgtgaaggccggccaccacttctag

SEQ ID NO: 38804 - DNA, 738 bp, Artificial Sequence
  Description of Artificial Sequence: Synthetic coding sequence
atggccgagatccacaccccctacagcagcctgaagaagctgctgagcctgctgaatggatttgtggccgtgtctggcatcatcctggtgggcctgggcatcggcggcaaatgtggcggggccagcctgaccaacgtgctgggcctgagcagcgcctacctgctgcacgtgggcaacctgtgcctggtgatgggctgcatcaccgtgctgctgggctgtgccggctggtatggagccaccaaggagagccggggcaccctgctcttctgcatcctgtccatggtgattgtgctgatcatggaggtgacagctgccaccgtggtgctgctcttcttccccatcgtgggagatgtggccctggagcacacctttgtgaccctgaggaagaactaccggggctacaatgaaccagatgactacagcacccagtggaacctggtgatggagaagctgaagtgctgcggcgtgaacaactacacagacttcagcggcagcagctttgagatgaccaccggccacacctaccccaggagctgctgcaagagcatcggctctgtgtcctgtgatggaagagatgtgagccccaacgtcatccaccagaagggctgcttccacaagctgctgaagatcaccaagacccagagcttcaccctgagcggcagcagcctgggcgccgccgtcatccagcgctggggcagccgctacgtggcccaggccggcctggagctgctggcctag

SEQ ID NO: 38805 - DNA, 483 bp, Artificial Sequence
  Description of Artificial Sequence: Synthetic coding sequence
atggccgagatccacaccccctacagcagcctgaagaagctgctgagcctgctgaatggatttgtggccgtgtctggcatcatcctggtgggcctgggcatcggcggcaaatgtggcggggccagcctgaccaacgtgctgggcctgagcagcgcctacctgctgcacgtgggcaacctgtgcctggtgatgggctgcatcaccgtgctgctgggctgtgccggctggtatggagccaccaaggagagccggggcaccctgctcttctgcatcctgtccatggtgattgtgctgatcatggaggtgacagctgccaccgtggtgctgctcttcttccccatcgtgggagatgtggccctggagcacacctttgtgaccctgaggaagaactaccggggctacaatgaaccagatgactacagcacccagtggaacctggtgatggagaagggcctgagcaagtacttcttcagcagcctgtag

SEQ ID NO: 38806 - DNA, 999 bp, Artificial Sequence
  Description of Artificial Sequence: Synthetic coding sequence
atgcctgggaagcaccagcacttccaggagcctgaggtgggctgctgcggcaagtacttcctgtttggcttcaacatcgtgttctgggtgctgggcgccctcttcctggccatcggcctgtgggcctggggcgagaagggcgtgctgagcaacatcagcgccctgacagacctgggcggcctggaccctgtgtggctgtttgtggtggtgggcggcgtgatgtctgtgctgggctttgctggctgcattggagccctgcgggagaacaccttcctgctgaagttcttctctgtgttcctgggcctcatcttcttcctggagctggccaccggcatcctggcctttgtgttcaaggactggatccgggaccagctgaacctcttcatcaacaacaacgtgaaggcctacagagatgacatcgacctgcagaacctgattgactttgcccaggagtactggagctgctgcggggcccggggccccaatgactggaacctgaacatctacttcaactgcacagacctgaaccccagccgggagcgctgtggggtgcccttcagctgctgcgtgcgggaccctgcagaagatgtgctgaacacccagtgtggctatgatgtgcggctgaagctggtgcggggggagctggagcagcagggcttcatccacaccaagggctgtgtgggccagtttgagaagtggctgcaggacaacctgattgtggtggccggggtcttcatgggcatcgccctgctgcagatcttcggcatctgcctggcccagaacctggtgtctgacatcaaggctgtgaaggccaactggagcaagtggaatgatgactttgagaaccactggctgacccccaccatcagcgaggtgctgagcacagctggcccccagcagaacagcctgaccggggcccctggccctgccccacccagcagacatgtgttcttcggcctgggcggcctgtacccagagcccaccttcaagaactggtag

SEQ ID NO: 38807 - DNA, 801 bp, Artificial Sequence
  Description of Artificial Sequence: Synthetic coding sequence
atgcctgggaagcaccagcacttccaggagcctgaggtgggctgctgcggcaagtacttcctgtttggcttcaacatcgtgttctgggtgctgggcgccctcttcctggccatcggcctgtgggcctggggcgagaagggcgtgctgagcaacatcagcgccctgacagacctgggcggcctggaccctgtgtggctgtttgtggtggtgggcggcgtgatgtctgtgctgggctttgctggctgcattggagccctgcgggagaacaccttcctgctgaagttcttctctgtgttcctgggcctcatcttcttcctggagctggccaccggcatcctggcctttgtgttcaaggactggatccgggaccagctgaacctcttcatcaacaacaacgtgaaggcctacagagatgacatcgacctgcagaacctgattgactttgcccaggagtactggagctgctgcggggcccggggccccaatgactggaacctgaacatctacttcaactgcacagacctgaaccccagccgggagcgctgtggggtgcccttcagctgctgcgtgcgggaccctgcagaagatgtgctgaacacccagtgtggctatgatgtgcggctgaagctggtgcggggggagctggagcagcagggcttcatccacaccaagggctgtgtgggccagtttgagaagtggctgcaggacaacctgattgtggtggccggggtcttcatgggcatcgccctgctgcagatcttcggcatctgcctggcccagaacctggagcagatggagtag

SEQ ID NO: 38808 - DNA, 990 bp, Artificial Sequence
  Description of Artificial Sequence: Synthetic coding sequence
atgcctgggaagcaccagcacttccaggagcctgaggtgggctgctgcggcaagtacttcctgtttggcttcaacatcgtgttctgggtgctgggcgccctcttcctggccatcggcctgtgggcctggggcgagaagggcgtgctgagcaacatcagcgccctgacagacctgggcggcctggaccctgtgtggctgtttgtggtggtgggcggcgtgatgtctgtgctgggctttgctggctgcattggagccctgcgggagaacaccttcctgctgaagttcttctctgtgttcctgggcctcatcttcttcctggagctggccaccggcatcctggcctttgtgttcaaggactggatccgggaccagctgaacctcttcatcaacaacaacgtgaaggcctacagagatgacatcgacctgcagaacctgattgactttgcccaggagtactggagctgctgcggggcccggggccccaatgactggaacctgaacatctacttcaactgcacagacctgaaccccagccgggagcgctgtggggtgcccttcagctgctgcgtgcgggaccctgcagaagatgtgctgaacacccagtgtggctatgatgtgcggctgaagctggagctggagcagcagggcttcatccacaccaagggctgtgtgggccagtttgagaagtggctgcaggacaacctgattgtggtggccggggtcttcatgggcatcgccctgctgcagatcttcggcatctgcctggcccagaacctggtgtctgacatcaaggctgtgaaggccaactggagcaagtggaatgatgactttgagaaccactggctgacccccaccatcagcgaggtgctgagcacagctggcccccagcagaacagcctgactggagcccctggccctgccccacccagccgccacgtgttcttcggcctgggcggcctgtacccagagcccaccttcaagaactggtag

SEQ ID NO: 38809 - DNA, 792 bp, Artificial Sequence
  Description of Artificial Sequence: Synthetic coding sequence
atgcctgggaagcaccagcacttccaggagcctgaggtgggctgctgcggcaagtacttcctgtttggcttcaacatcgtgttctgggtgctgggcgccctcttcctggccatcggcctgtgggcctggggcgagaagggcgtgctgagcaacatcagcgccctgacagacctgggcggcctggaccctgtgtggctgtttgtggtggtgggcggcgtgatgtctgtgctgggctttgctggctgcattggagccctgcgggagaacaccttcctgctgaagttcttctctgtgttcctgggcctcatcttcttcctggagctggccaccggcatcctggcctttgtgttcaaggactggatccgggaccagctgaacctcttcatcaacaacaacgtgaaggcctacagagatgacatcgacctgcagaacctgattgactttgcccaggagtactggagctgctgcggggcccggggccccaatgactggaacctgaacatctacttcaactgcacagacctgaaccccagccgggagcgctgtggggtgcccttcagctgctgcgtgcgggaccctgcagaagatgtgctgaacacccagtgtggctatgatgtgcggctgaagctggagctggagcagcagggcttcatccacaccaagggctgtgtgggccagtttgagaagtggctgcaggacaacctgattgtggtggccggggtcttcatgggcatcgccctgctgcagatcttcggcatctgcctggcccagaacctggagcagatggagtag

SEQ ID NO: 38810 - DNA, 747 bp, Artificial Sequence
  Description of Artificial Sequence: Synthetic coding sequence
atggagggggactgcctgagctgcatgaagtacctgatgtttgtgttcaacttcttcatcttcctgggcggggcctgcctgctggccatcggcatctgggtgatggtggaccccaccggcttccgggagatcgtggccgccaaccccctgctgctgactggagcctacatcctgctggccatgggcggcctgctcttcctgctgggcttcctgggctgctgcggggctgtgcgggagaacaagtgcctgctgctcttcttcttcctgttcatcctgatcatcttcctggccgagctgtctgctgccatcctggccttcatcttccgggagaacctgacccgggagttcttcaccaaggagctgaccaagcactaccagggcaacaatgacacagatgtgttttctgccacctggaacagcgtgatgatcaccttcggctgctgcggcgtgaatggacctgaggacttcaagtttgccagcgtcttccggctgctgaccctggacagcgaggaggtgcctgaggcctgctgccggcgggagccccagagcagagatggagtgctgctgagccgggaggagtgcctgctgggccgcagcctcttcctgaacaagcagggctgctacaccgtcatcctgaacacctttgagacctacgtgtacctggccggggccctggccatcggcgtgctggccatcgagctgtttgccatgatctttgccatgtgcctcttccggggcatccagtag

SEQ ID NO: 38811 - DNA, 816 bp, Artificial Sequence
  Description of Artificial Sequence: Synthetic coding sequence
tgatggagcaccatggagggggactgcctgagctgcatgaagtacctgatgtttgtgttcaacttcttcatcttcctgggcggggcctgcctgctggccatcggcatctgggtgatggtggaccccaccggcttccgggagatcgtggccgccaaccccctgctgctgactggagcctacatcctgctggccatgggcggcctgctcttcctgctgggcttcctgggctgctgcggggctgtgcgggagaacaagtgcctgctgctcttcttcttcctgttcatcctgatcatcttcctggccgagctgtctgctgccatcctggccttcatcttccgggagaacctgacccgggagttcttcaccaaggagctgaccaagcactaccagggcaacaatgacacagatgtgttttctgccacctggaacagcgtgatgatcaccttcggctgctgcggcgtgaatggacctgaggacttcaagtttgccagcgtcttccggctgctgaccctggacagcgaggaggtgcctgaggcctgctgccggcgggagccccagagcagagatggagtgctgctgagccgggaggagtgcctgctgggccgcagcctcttcctgaacaagcagggctgctacaccgtcatcctgaacacctttgagacctacgtgtacctggccggggccctggccatcggcgtgctggccatcgaggaggagcgggcccacagcgtgtcccaggccaccggcatcctgtaccagctgcctgccagcccccaggccttccagagccctggcaccctgggcgccacagcctag

SEQ ID NO: 38812 - DNA, 747 bp, Artificial Sequence; identical to SEQ ID NO: 38810
  Description of Artificial Sequence: Synthetic coding sequence

SEQ ID NO: 38813 - DNA, 240 bp, Artificial Sequence
  Description of Artificial Sequence: Synthetic coding sequence
atggagggggactgcctgagctgcatgaagtacctgatgtttgtgttcaacttcttcatcttcctgggcggggcctgcctgctggccatcggcatctgggtgatggtggaccccaccggcttccgggagatcgtggccgccaaccccctgctgctgactggagcctacatcctgctggccatgggcggcctgctcttcctgctgggcttcctgggctgctgcggggctgtgcgggagtag

SEQ ID NO: 38814 - DNA, 441 bp, Artificial Sequence
  Description of Artificial Sequence: Synthetic coding sequence
atggagggggactgcctgagctgcatgaagtacctgatgtttgtgttcaacttcttcatcttcctgggcggggcctgcctgctggccatcggcatctgggtgatggtggaccccaccggcttccgggagatcgtggccgccaaccccctgctgctgactggagcctacatcctgctggccatgggcggcctgctcttcctgctgggcttcctgggctgctgcggggctgtgcgggagaacaagtgcctgctgctcttcttcttcctgttcatcctgatcatcttcctggccgagctgtctgctgccatcctggccttcatcttccgggagaacctgacccgggagttcttcaccaaggagctgaccaagcactaccagggcaacaatgacacagatgtgttttctgccacctggaacagcgtgatgatcaccgtgtcctag

SEQ ID NO: 38815 - DNA, 852 bp, Artificial Sequence
  Description of Artificial Sequence: Synthetic coding sequence
atggcccggcggccccgggccccagctgccagcggggaggagttctcctttgtgagccccctggtgaagtacctgctcttcttcttcaacatgctgttctgggtgatctccatggtgatggtggccgtgggcgtgtatgcccggctgatgaagcatgctgaggccgccctggcctgcctggccgtggaccctgccatcctgctgattgtggtgggcgtgctgatgttcctgctgaccttctgtggctgcatcggcagcctgcgggagaacatctgcctgctgcagaccttcagcctgtgcctgacagctgtgttcctgctgcagctggccgccggcatcctgggctttgtgttcagtgacaaggcccggggcaaggtgtctgagatcatcaacaatgccatcgtgcactacagagatgacctggacctgcagaacctgattgactttggccagaagaagttcagctgctgcggcggcatctcctacaaggactggagccagaacatgtacttcaactgcagcgaggacaaccccagccgggagcgctgcagcgtgccctacagctgctgcctgcccaccccagaccaggccgtcatcaacaccatgtgtggccagggcatgcaggcctttgactacctggaggccagcaaggtgatctacaccaacggctgcatcgacaagctggtgaactggatccacagcaacctcttcctgctgggcggcgtggccctgggcctggccatcccccagctggtgggcatcctgctgagccagatcctggtgaaccagatcaaggaccagatcaagctgcagctgtacaaccagcagcacagagctgacccctggtactag

SEQ ID NO: 38816 - DNA, 1338 bp, Artificial Sequence
  Description of Artificial Sequence: Synthetic coding sequence
atggccgagtatgacctgaccacccgcatcgcccacttcctggacagacacctggtgttccccctgctggagttcctgtctgtgaaggagatctacaatgagaaggagctgctgcagggcaagctggacctgctgagtgacaccaacatggtggactttgccatggatgtgtacaagaacctgtacagtgatgacatcccccacgccctgcgggagaagaggaccaccgtggtggcccagctgaagcagctgcaggccgagacagagcccatcgtgaagatgtttgaggaccctgagaccacccggcagatgcagagcaccagagatggccgcatgctgtttgactacctggccgacaagcacggcttccggcaggagtacctggacaccctgtaccgctatgccaagttccagtatgaatgtggcaactacagcggggctgctgagtacctgtacttcttccgggtgctggtgcctgccacagacagaaatgccctgagcagcctgtggggcaagctggccagcgagatcctgatgcagaactgggatgctgccatggaggacctgacccggctgaaggagaccatcgacaacaacagcgtgagcagccccctgcagagcctgcagcagaggacctggctgatccactggagcctgtttgtgttcttcaaccaccccaagggccgggacaacatcatcgacctcttcctgtaccagccccagtacctgaatgccatccagaccatgtgcccccacatcctgcgctacctgaccacagctgtgatcaccaacaaggatgtgaggaagaggcggcaggtgctgaaggacctggtgaaggtgatccagcaggagagctacacctacaaggaccccatcacagaatttgtggagtgcctgtatgtgaactttgattttgatggagcccagaagaagctgcgggagtgtgagagcgtgctggtgaatgacttcttcctggtggcctgcctggaggacttcattgaaaatgcccggctcttcatctttgagaccttctgccgcatccaccagtgcatcagcatcaacatgctggccgacaagctgaacatgaccccagaggaggccgagcgctggatcgtgaacctgatcagaaatgcccggctggatgccaagattgacagcaagctgggccacgtggtgatgggcaacaatgctgtgagcccctaccagcaggtgattgagaagaccaagagcctgtccttccgcagccagatgctggccatgaacatcgagaagaagctgaaccagaacagccgctctgaggcccccaactgggccacccaggacagcggcttctactag

SEQ ID NO: 38817 - DNA, 5586 bp, Artificial Sequence
  Description of Artificial Sequence: Synthetic coding sequence
atgctgaaggctgtgctgaagaagagccgggagggcggcaagggcggcaagaaggaggccggcagtgactttggacctgagaccagccctgtgctgcacctggaccacagcgctgacagccctgtgagcagcctgcccacagctgaggacacctacagagtgtccctggccaagggcgtgtccatgagcctgcccagcagccccctgctgccccggcagagccacctggtgcagagccgggtgaacaagaagagccctggccctgtgaggaagcccaagtatgtggagagcccccgggtgcctggagatgctgtgatcatgcccttccgggaggtggccaagcccacagagccagatgaacatgaggccaaggctgacaatgagcccagctgcagccctgctgcccaggagctgctgacccggctgggcttcctgctgggggagggcatccccagcgccacccacatcaccatcgaggacaagaatgagaccatgtgcacagccctgagccagggcatcagcccctgcagcaccctgaccagcagcacagccagccccagcacagacagcccctgcagcaccctgaacagctgtgtgtccaagacagctgccaacaagagcccctgtgagaccatcagcagccccagcagcaccctggagagcaaggacagcggcatcatcgccaccatcaccagcagcagtgaaaatgatgacaggagcggcagcagcctggagtggaacaaggatggcaacctgcggctgggcgtgcagaagggcgtgctgcatgaccggcgggctgacaactgcagccctgtggccgaggaggagaccaccggcagcgctgagagcaccctgcccaaggccgagagcagcgctggagatggccctgtgccctacagccagggcagcagcagcctcatcatgccccggcccaacagcgtggccgccaccagcagcaccaagctggaggacctgagctacctggatggccagagaaatgcccccctgcggaccagcatccggctgccctggcacaacacagctgggggccgggcccaggaggtgaaggccaggtttgccccctacaagccccaggacatcctgctgaagcccctgctgtttgaggtgcccagcatcaccacagattctgtgtttgtgggccgggactggctgttccaccagatcgaggagaacctgaggaacacagagctggccgagaacagaggagctgtggtggtgggcaatgtgggctttgggaagacagccatcatcagcaagctggtggccctgagctgccacggcagcaggatgaggcagatcgccagcaacagccctggcagcagccccaagaccagtgaccccacccaggacctgcacttcacccccctgctgagccccagcagcagcaccagcgccagcagcacagccaagacccccctgggcagcatctctgctgagaaccagaggccccgggaggatgctgtgaagtacctggccagcaaggtggtggcctaccactactgccaggccgacaacacctacacctgcctggtgcctgagtttgtgcacagcattgctgccctgctgtgccgcagccaccagctggccgcctacagagacctgctgatcaaggagccccagctgcagagcatgctgagcctgcggagctgtgtgcaggaccctgtggccgccttcaagaggggcgtgctggagcccctgaccaacctgagaaatgagcagaagatccctgaggaggagtacatcatcctgattgatggcctgaatgaagctgagttccacaagccagactatggagacaccctgagcagcttcatcaccaagatcatcagcaagtttcctgcctggctgaagctgattgtgacagtgcgggccaacttccaggagatcatcagcgccctgccctttgtgaagctgagcctggatgacttcccagacaacaaggacatccacagcgacctgcacgcctacgtgcagcaccgggtgcacagcagccaggacatcctgagcaacatcagcctgaatggcaaggcagatgccaccctgattggcaaggtgagcagccacctggtgctgcggagcctgggcagctacctgtacctgaagctgaccctggacctcttccagaggggccacctggtgatcaagagcgccagctacaaggtggtgcctgtgtccctgtctgagctgtacctgctgcagtgcaacatgaagttcatgacccagagcgcctttgagcgggccctgcccatcctgaatgtggccctggccagcctgcaccccatgacagatgagcagatcttccaggccatcaatgccggccacatccagggcgagcagggctgggaggacttccagcagaggatggatgccctgagctgcttcctgatcaagagaagagacaagaccaggatgttctgccaccccagcttccgggagtggctggtgtggagggcagatggagagaacacagccttcctgtgtgagcccagaaatggccacgccctgctggccttcatgttcagccggcaggagggcaagctgaaccggcagcagaccatggagctgggccaccacatcctgaaggcccacatcttcaagggcctgagcaagaagacaggcatcagcagcagccacctgcaggccctgtggattggctacagcacagagggcctgtctgctgccctggccagcctgaggaacctgtacacccccaacgtgaaggtgtcccggctgctgatcctgggcggggccaacgtgaactacagaacagaggtgctgaacaatgcccccatcctgtgtgtgcagagccacctgggccacgaggaggtggtgaccctgctgctggagtttggagcctgcctggatggcaccagtgaaaatggcatgacagccctgtgctatgctgctgctgctggccacatgaagctggtgtgcctgctgaccaagaagggcgtgcgggtggaccacctggacaagaagggccagtgtgccctggtgcacagcgccctgcggggccatggagacatcctgcagtacctgctgacctgtgagtggagccctggccccccccagcccggcaccctgaggaagagccacgccctgcagcaggccctgacagctgctgcctccatgggccacagctctgtggtgcagtgcctgctgggcatggagaaggagcacgaggtggaggtgaatggaacagacaccctgtggggcgagacagccctgacagctgctgctggccggggcaagctggaggtgtgtgagctgctgctgggccatggagctgctgtgtccaggaccaacagaagaggagtgcccccactcttctgtgccgcccggcagggccactggcagatcgtgcggctgctgctggagcggggctgtgatgtgaacctgagtgacaagcagggccgcacccccctgatggtggccgcctgtgagggccacctgagcacagtggagttcctgctgagcaaaggagctgccctgagcagcctggacaaggagggcctgagcgccctgtcctgggcctgcctgaagggccacagagctgtggtgcagtacctggtggaggagggcgccgccatcgaccagacagacaagaatggccgcacccccctggacctggccgccttctatggagatgctgagaccgtgctgtacctggtggagaagggagctgtgattgaacatgtggaccacagcggcatgaggcccctggaccgggccatcggctgcaggaacacctctgtggtggtggccctgctgaggaagggggccaagctgggcaatgctgcctgggccatggccaccagcaagccagacatcctgatcatcctgctgcagaagctgatggaggagggcaatgtgatgtacaagaagggcaagatgaaggaggccgcccagcgctaccagtatgccctgaggaagttcccccgggagggctttggagaggacatgaggcccttcaatgagctgcgggtgtccctgtacctgaacctgagccgctgcaggaggaagaccaatgactttggcatggccgaggagtttgccagcaaggccctggagctgaagcccaagagctatgaggccttctacgcccgggcccgggccaagaggaacagccggcagtttgtggccgccctggccgacctgcaggaggccgtgaagctgtgccccaccaaccaggaggtgaagaggctgctggcccgggtggaggaggagtgcaagcagctgcagaggagccagcagcagaagcagcagggccccctgcctgcccccctgaatgattctgaaaatgaggaggacacccccaccccaggcctgagtgaccacttccacagcgaggagacagaggaggaggagaccagcccccaggaggagagcgtgagccccacccccaggagccagcccagcagctctgtgcccagcagctacatccggaacctgcaggagggcctgcagagcaagggccggcctgtgagcccccagagccgggccggcatcggcaagagcctgcgggagcctgtggcccagcccggcctgctgctgcagcccagcaagcaggcccagatcgtgaagaccagccagcacctgggcagcggccagagcgctgtgagaaatggctccatgaaggtgcagatcagcagccagaaccccccacccagccccatgcctggaagaattgctgccaccccagctggcagcaggacccagcacctggagggcaccggcaccttcaccacccgggccggctgcggccactttggagaccggctgggccccagccagaatgtgcggctgcagtgtggagaaaatggacctgcccaccccctgcccagcaagaccaagaccacagagcggctgctgagccacagctctgtggccgtggatgctgccccacccaaccagggcggcctggccacctgcagtgatgtgcgccacccagccagcctgaccagcagcggcagcagcggcagccccagcagcagcatcaagatgagcagcagcaccagcagcctgaccagcagcagcagcttcagtgatggcttcaaggtgcagggccctgacacccgcatcaaggacaaggtggtgacccacgtgcagagcggcacagctgagcaccggcccaggaacacccccttcatgggcatcatggacaagacagcccgcttccagcagcagagcaacccccccagccgctcctggcactgcccagcccctgagggcctgctgaccaacaccagcagcgctgctggcctgcagagcgccaacacagagaagcccagcctgatgcaggtgggcggctacaacaaccaggccaagacctgcagcgtgtccaccctgagcgcctctgtgcacaacggggcccaggtgaaggagctggaggagagcaagtgccagatccctgtgcacagccaggagaaccgcatcaccaagacagtgagccacctgtaccaggagagcatcagcaagcagcagccccacatcagcaatgaggcccacaggagccacctgacagctgccaagcccaagaggagcttcatcgagagcaatgtgtag

SEQ ID NO: 38818 - DNA, 5268 bp, Artificial Sequence
  Description of Artificial Sequence: Synthetic coding sequence
atgctgaaggctgtgctgaagaagagccgggagggcggcaagggcggcaagaaggaggccggcagtgactttggacctgagaccagccctgtgctgcacctggaccacagcgctgacagccctgtgagcagcctgcccacagctgaggacacctacagagtgtccctggccaagggcgtgtccatgagcctgcccagcagccccctgctgccccggcagagccacctggtgcagagccgggtgaacaagaagagccctggccctgtgaggaagcccaagtatgtggagagcccccgggtgcctggagatgctgtgatcatgcccttccgggaggtggccaagcccacagagccagatgaacatgccaccatcaccagcagcagtgaaaatgatgacaggagcggcagcagcctggagtggaacaaggatggcaacctgcggctgggcgtgcagaagggcgtgctgcatgaccggcgggctgacaactgcagccctgtggccgaggaggagaccaccggcagcgctgagagcaccctgcccaaggccgagagcagcgctggagatggccctgtgccctacagccagggcagcagcagcctcatcatgccccggcccaacagcgtggccgccaccagcagcaccaagctggaggacctgagctacctggatggccagagaaatgcccccctgcggaccagcatccggctgccctggcacaacacagctgggggccgggcccaggaggtgaaggccaggtttgccccctacaagccccaggacatcctgctgaagcccctgctgtttgaggtgcccagcatcaccacagattctgtgtttgtgggccgggactggctgttccaccagatcgaggagaacctgaggaacacagagctggccgagaacagaggagctgtggtggtgggcaatgtgggctttgggaagacagccatcatcagcaagctggtggccctgagctgccacggcagcaggatgaggcagatcgccagcaacagccctggcagcagccccaagaccagtgaccccacccaggacctgcacttcacccccctgctgagccccagcagcagcaccagcgccagcagcacagccaagacccccctgggcagcatctctgctgagaaccagaggccccgggaggatgctgtgaagtacctggccagcaaggtggtggcctaccactactgccaggccgacaacacctacacctgcctggtgcctgagtttgtgcacagcattgctgccctgctgtgccgcagccaccagctggccgcctacagagacctgctgatcaaggagccccagctgcagagcatgctgagcctgcggagctgtgtgcaggaccctgtggccgccttcaagaggggcgtgctggagcccctgaccaacctgagaaatgagcagaagatccctgaggaggagtacatcatcctgattgatggcctgaatgaagctgagttccacaagccagactatggagacaccctgagcagcttcatcaccaagatcatcagcaagtttcctgcctggctgaagctgattgtgacagtgcgggccaacttccaggagatcatcagcgccctgccctttgtgaagctgagcctggatgacttcccagacaacaaggacatccacagcgacctgcacgcctacgtgcagcaccgggtgcacagcagccaggacatcctgagcaacatcagcctgaatggcaaggcagatgccaccctgattggcaaggtgagcagccacctggtgctgcggagcctgggcagctacctgtacctgaagctgaccctggacctcttccagaggggccacctggtgatcaagagcgccagctacaaggtggtgcctgtgtccctgtctgagctgtacctgctgcagtgcaacatgaagttcatgacccagagcgcctttgagcgggccctgcccatcctgaatgtggccctggccagcctgcaccccatgacagatgagcagatcttccaggccatcaatgccggccacatccagggcgagcagggctgggaggacttccagcagaggatggatgccctgagctgcttcctgatcaagagaagagacaagaccaggatgttctgccaccccagcttccgggagtggctggtgtggagggcagatggagagaacacagccttcctgtgtgagcccagaaatggccacgccctgctggccttcatgttcagccggcaggagggcaagctgaaccggcagcagaccatggagctgggccaccacatcctgaaggcccacatcttcaagggcctgagcaagaagacaggcatcagcagcagccacctgcaggccctgtggattggctacagcacagagggcctgtctgctgccctggccagcctgaggaacctgtacacccccaacgtgaaggtgtcccggctgctgatcctgggcggggccaacgtgaactacagaacagaggtgctgaacaatgcccccatcctgtgtgtgcagagccacctgggccacgaggaggtggtgaccctgctgctggagtttggagcctgcctggatggcaccagtgaaaatggcatgacagccctgtgctatgctgctgctgctggccacatgaagctggtgtgcctgctgaccaagaagggcgtgcgggtggaccacctggacaagaagggccagtgtgccctggtgcacagcgccctgcggggccatggagacatcctgcagtacctgctgacctgtgagtggagccctggccccccccagcccggcaccctgaggaagagccacgccctgcagcaggccctgacagctgctgcctccatgggccacagctctgtggtgcagtgcctgctgggcatggagaaggagcacgaggtggaggtgaatggaacagacaccctgtggggcgagacagccctgacagctgctgctggccggggcaagctggaggtgtgtgagctgctgctgggccatggagctgctgtgtccaggaccaacagaagaggagtgcccccactcttctgtgccgcccggcagggccactggcagatcgtgcggctgctgctggagcggggctgtgatgtgaacctgagtgacaagcagggccgcacccccctgatggtggccgcctgtgagggccacctgagcacagtggagttcctgctgagcaaaggagctgccctgagcagcctggacaaggagggcctgagcgccctgtcctgggcctgcctgaagggccacagagctgtggtgcagtacctggtggaggagggcgccgccatcgaccagacagacaagaatggccgcacccccctggacctggccgccttctatggagatgctgagaccgtgctgtacctggtggagaagggagctgtgattgaacatgtggaccacagcggcatgaggcccctggaccgggccatcggctgcaggaacacctctgtggtggtggccctgctgaggaagggggccaagctgggcaatgctgcctgggccatggccaccagcaagccagacatcctgatcatcctgctgcagaagctgatggaggagggcaatgtgatgtacaagaagggcaagatgaaggaggccgcccagcgctaccagtatgccctgaggaagttcccccgggagggctttggagaggacatgaggcccttcaatgagctgcgggtgtccctgtacctgaacctgagccgctgcaggaggaagaccaatgactttggcatggccgaggagtttgccagcaaggccctggagctgaagcccaagagctatgaggccttctacgcccgggcccgggccaagaggaacagccggcagtttgtggccgccctggccgacctgcaggaggccgtgaagctgtgccccaccaaccaggaggtgaagaggctgctggcccgggtggaggaggagtgcaagcagctgcagaggagccagcagcagaagcagcagggccccctgcctgcccccctgaatgattctgaaaatgaggaggacacccccaccccaggcctgagtgaccacttccacagcgaggagacagaggaggaggagaccagcccccaggaggagagcgtgagccccacccccaggagccagcccagcagctctgtgcccagcagctacatccggaacctgcaggagggcctgcagagcaagggccggcctgtgagcccccagagccgggccggcatcggcaagagcctgcgggagcctgtggcccagcccggcctgctgctgcagcccagcaagcaggcccagatcgtgaagaccagccagcacctgggcagcggccagagcgctgtgagaaatggctccatgaaggtgcagatcagcagccagaaccccccacccagccccatgcctggaagaattgctgccaccccagctggcagcaggacccagcacctggagggcaccggcaccttcaccacccgggccggctgcggccactttggagaccggctgggccccagccagaatgtgcggctgcagtgtggagaaaatggacctgcccaccccctgcccagcaagaccaagaccacagagcggctgctgagccacagctctgtggccgtggatgctgccccacccaaccagggcggcctggccacctgcagtgatgtgcgccacccagccagcctgaccagcagcggcagcagcggcagccccagcagcagcatcaagatgagcagcagcaccagcagcctgaccagcagcagcagcttcagtgatggcttcaaggtgcagggccctgacacccgcatcaaggacaaggtggtgacccacgtgcagagcggcacagctgagcaccggcccaggaacacccccttcatgggcatcatggacaagacagcccgcttccagcagcagagcaacccccccagccgctcctggcactgcccagcccctgagggcctgctgaccaacaccagcagcgctgctggcctgcagagcgccaacacagagaagcccagcctgatgcaggtgggcggctacaacaaccaggccaagacctgcagcgtgtccaccctgagcgcctctgtgcacaacggggcccaggtgaaggagctggaggagagcaagtgccagatccctgtgcacagccaggagaaccgcatcaccaagacagtgagccacctgtaccaggagagcatcagcaagcagcagccccacatcagcaatgaggcccacaggagccacctgacagctgccaagcccaagaggagcttcatcgagagcaatgtgtag

SEQ ID NO: 38819 - DNA, 2139 bp, Artificial Sequence
  Description of Artificial Sequence: Synthetic coding sequence
atggcccagagcagcccccagctggacatccaggtgctgcatgacctgcggcagcgcttccctgagatccctgagggcgtggtgtcccagtgcatgctgcagaacaacaacaacctggaggcctgctgccgggccctgagccaggagagcagcaagtacctgtacatggagtaccacagcccagatgacaacaggatgaacagaaaccggctgctgcacatcaacctgggcatccacagccccagcagctaccaccctggagatggagcccagctgaatggaggccgcaccctggtgcacagcagcagtgatggccacatcgacccccagcacgccgccggcaagcagctgatctgcctggtgcaggagccccacagcgccccagctgtggtggccgccacccccaactacaaccccttcttcatgaatgagcagaacagatctgctgccaccccacccagccagcccccccagcagcccagctccatgcagacaggcatgaaccccagcgccatgcagggccccagccccccacctcctcctccttcctacatgcacatcccccgctacagcaccaaccccatcaccgtgacagtgtcccagaacctgcccagcggccagacagtgccccgggccctgcagatcctgccccagatccccagcaacctgtatggcagccctggcagcatctacatccggcagaccagccagagcagcagcggccggcagaccccccagagcaccccctggcagagcagcccccagggccctgtgccccactacagccagaggcccctgcctgtgtacccccaccagcagaactaccagcccagccagtacagccccaagcagcagcagatcccccagagcgcctaccacagccccccacccagccagtgccccagccccttcagcagcccccagcaccaggtgcagcccagccagctgggccacatcttcatgccacccagccccagcaccaccccaccccacccctaccagcagggccccccatcctaccagaagcagggcagccacagcgtggcctacctgccctacacagccagcagcctgagcaagggctccatgaagaagattgagatcaccgtggagcccagccagaggcctggaacagccatcaacagaagccccagccccatcagcaaccagcccagcccctggaaccagcacagcctgtacacagccaccaccccacccagcagcagccccagccggggcatcagcagccagcccaagccacccttctctgtgaaccctgtgtacatcacctacacccagcccaccggccccagctgcacccccagccccagccccagggtcatccccaaccccaccaccgtcttcaagatcaccgtgggccgggccaccacagagaacctgctgaacctggtggaccaggaggagaggtctgctgcccctgagcccatccagcccatcagcgtcatccctggcagcggcggggagaagggcagccacaagtaccagaggagcagcagcagcggcagtgatgattatgcctacacccaggccctgctgctgcaccagagggccaggatggagcggctggccaagcagctgaagctggagaaggaggagctggagcggctgaagtctgaggtgaatggcatggagcatgacctgatgcagaggcggctgcggcgggtgtcctgcaccacagccatccccaccccagaggagatgacccggctgcgctccatgaaccggcagctgcagatcaacgtggactgcaccctgaaggaggtggacctgctgcagagccggggcaactttgaccccaaggccatgaacaacttctatgacaacatcgagcccggccctgtggtgccccccaagcccagcaagaaggacagcagtgacccctgcaccattgaaaggaaggcccggcgcatctctgtgaccagcaaggtgcaggccgacatccatgacacccaggccgctgctgctgatgagcacaggacaggcagcacccagagccccaggacccagcccagagatgaggactatgagggcgccccctggaactgtgacagctgcaccttcctgaaccacccagccctgaacagatgtgagcagtgtgagatgccccgctacacctag

SEQ ID NO: 38820 - DNA, 252 bp, Artificial Sequence
  Description of Artificial Sequence: Synthetic coding sequence
atggagcatgacctgatgcagaggcggctgcggcgggtgtcctgcaccacagccatccccaccccagaggagatgacccggctgcgctccatgaaccggcagctgcagatcaacgtggactgcaccctgaaggaggtggacctgctgcagagccgggaggtgtactacagccgcagcagcctgaagctgtccttcacccagctgacccggctggagatggtgttcatcttctgtgggaagtacacagactag

SEQ ID NO: 38821 - DNA, 2139 bp, Artificial Sequence; identical to SEQ ID NO: 38819
  Description of Artificial Sequence: Synthetic coding sequence

SEQ ID NO: 38822 - DNA, 2055 bp, Artificial Sequence
  Description of Artificial Sequence: Synthetic coding sequence
atggcccagagcagcccccagctggacatccaggtgctgcatgacctgcggcagcgcttccctgagatccctgagggcgtggtgtcccagtgcatgctgcagaacaacaacaacctggaggcctgctgccgggccctgagccaggagagcagcaagtacctgtacatggagtaccacagcccagatgacaacaggatgaacagaaaccggctgctgcacatcaacctgggcatccacagccccagcagctaccaccctggagatggagcccagctgaatggaggccgcaccctggtgcacagcagcagtgatggccacatcgacccccagcacgccgccggcaagcagctgatctgcctggtgcaggagccccacagcgccccagctgtggtggccgccacccccaactacaaccccttcttcatgaatgagcagaacagatctgctgccaccccacccagccagcccccccagcagcccagctccatgcagacaggcatgaaccccagcgccatgcagggccccagccccccacctcctcctccttcctacatgcacatcccccgctacagcaccaaccccatcaccgtgacagtgtcccagaacctgcccagcggccagacagtgccccgggccctgcagatcctgccccagatccccagcaacctgtatggcagccctggcagcatctacatccggcagaccagccagagcagcagcggccggcagaccccccagagcaccccctggcagagcagcccccagggccctgtgccccactacagccagaggcccctgcctgtgtacccccaccagcagaactaccagcccagccagtacagccccaagcagcagcagatcccccagagcgcctaccacagccccccacccagccagtgccccagccccttcagcagcccccagcaccaggtgcagcccagccagctgggccacatcttcatgccacccagccccagcaccaccccaccccacccctaccagcagggccccccatcctaccagaagcagggcagccacagcgtggcctacctgccctacacagccagcagcctgagcaagggctccatgaagaagattgagatcaccgtggagcccagccagaggcctggaacagccatcaacagaagccccagccccatcagcaaccagcccagcccctggaaccagcacagcctgtacacagccaccaccccacccagcagcagccccagccggggcatcagcagccagcccaagccacccttctctgtgaaccctgtgtacatcacctacacccagcccaccggccccagctgcacccccagccccagccccagggtcatccccaaccccaccaccgtcttcaagatcaccgtgggccgggccaccacagagaacctgctgaacctggtggaccaggaggagaggtctgctgcccctgagcccatccagcccatcagcgtcatccctggcagcggcggggagaagggcagccacaagtaccagaggagcagcagcagcggcagtgatgattatgcctacacccaggccctgctgctgcaccagagggccaggatggagcggctggccaagcagctgaagctggagaaggaggagctggagcggctgaagtctgaggtgaatggcatggagcatgacctgatgcagaggcggctgcggcgggtgtcctgcaccacagccatccccaccccagaggagatgacccggctgcgctccatgaaccggcagctgcagatcaacgtggactgcaccctgaaggaggtggacctgctgcagagccgggacagcagtgacccctgcaccattgaaaggaaggcccggcgcatctctgtgaccagcaaggtgcaggccgacatccatgacacccaggccgctgctgctgatgagcacaggacaggcagcacccagagccccaggacccagcccagagatgaggactatgagggcgccccctggaactgtgacagctgcaccttcctgaaccacccagccctgaacagatgtgagcagtgtgagatgccccgctacacctag

SEQ ID NO: 38823 - DNA, 2139 bp, Artificial Sequence; identical to SEQ ID NO: 38819
  Description of Artificial Sequence: Synthetic coding sequence

SEQ ID NO: 38824 - DNA, 723 bp, Artificial Sequence
  Description of Artificial Sequence: Synthetic coding sequence
atgctgcggagctgtgccgcccggctgcggaccctgggcgccctgtgcctgccccctgtgggccggcggctgcccggcagcgagcccaggcctgagctgcgctccttcagcagcgaggaggtgatcctgaaggactgcagcgtgcccaaccccagctggaacaaggacctgcggctgctgtttgaccagttcatgaagaagtgtgaagatggctcctggaagaggctgcccagctacaagaggacccccacagagtggatccaggacttcaagacccacttcctggaccccaagctgatgaaggaggagcagatgagccaggcccagctgttcaccaggagctttgatgatggcctgggctttgaatatgtgatgttctacaatgacatcgagaagaggatggtgtgcctcttccagggcggcccctacctggagggccccccaggcttcatccacggcggggccatcgccaccatgattgatgccaccgtgggcatgtgtgccatgatggccggcggcatcgtgatgacagccaacctgaacatcaactacaagaggcccatccccctgtgcagcgtggtgatgatcaacagccagctggacaaggtggagggcaggaagttctttgtgtcctgcaatgtgcagagcgtggatgagaagaccctgtacagcgaggccaccagcctcttcatcaagctgaacccagccaagagcctgacctag

SEQ ID NO: 38825 - DNA, 744 bp, Artificial Sequence
  Description of Artificial Sequence: Synthetic coding sequence
atgatccgccgctgcttccaggtggccgcccggctgggccaccaccggggcctgctggaggccccccgcatcctgccccggctgaacccagccagcgccttcggcagcagcacagacagcatgttcagccgcttcctgcctgagaagacagacctgaaggactatgccctgcccaatgcctcctggtgcagcgacatgctgagcctgtaccaggagttcctggagaagaccaagagcagcggctggatcaagctgcccagcttcaagagcaacagagaccacatccggggcctgaagctgcccagcggcctggccgtgtccagtgacaagggggactgccgcatcttcacccgctgcatccaggtggagggccagggctttgaatatgtgatcttcttccagcccacccagaagaagtctgtgtgcctcttccagcccggcagctacctggagggccccccaggctttgcccacggcggcagcctggccgccatgatggatgagaccttcagcaagacagccttcctggccggggagggcctcttcaccctgagcctgaacatccgcttcaagaacctgatccctgtggacagcctggtggtgatggatgtggagctggacaagattgaggaccagaagctgtacatgagctgcatcgcccacagccgggaccagcagacagtgtatgccaagagcagtggagtcttcctgcagctgcagctggaggaggagagcccccagtag

SEQ ID NO: 38826 - DNA, 5883 bp, Artificial Sequence
  Description of Artificial Sequence: Synthetic coding sequence
atggcccagcaggccgctgacaagtacctgtatgtggacaagaacttcatcaacaaccccctggcccaggccgactgggccgccaagaagctggtgtgggtgcccagcgacaagagcggctttgagcccgccagcctgaaggaggaggtgggggaggaggccatcgtggagctggtggagaatggcaagaaggtgaaggtgaacaaggatgacatccagaagatgaacccccccaagttcagcaaggtggaggacatggccgagctgacctgcctgaatgaggcctctgtgctgcacaacctgaaggagcgctactacagcggcctcatctacacctacagcggcctcttctgtgtggtgatcaacccctacaagaacctgcccatctacagcgaggagatcgtggagatgtacaagggcaagaagagacatgagatgccaccccacatctatgccatcacagacacagcctaccgctccatgatgcaggaccgggaggaccagagcatcctgtgcacaggagagagcggggccggcaagacagagaacaccaagaaggtgatccagtacctggcctacgtggccagcagccacaagagcaagaaggaccagggcgagctggagcggcagctgctgcaggccaaccccatcctggaggcctttggaaatgccaagacagtgaagaatgacaacagcagcagatttgggaagttcatccgcatcaactttgatgtgaatggctacatcgtgggcgccaacatcgagacctacctgctggagaagagccgggccatccggcaggccaaggaggagaggaccttccacatcttctactacctgctgagcggggccggggagcacctgaagacagacctgctgctggagccctacaacaagtaccgcttcctgagcaatggacatgtgaccatccctggccagcaggacaaggacatgttccaggagaccatggaggccatgaggatcatgggcatccctgaggaggagcagatgggcctgctgcgggtcatcagcggcgtgctgcagctgggcaacatcgtgttcaagaaggagaggaacacagaccaggcctccatgccagacaacacagctgcccagaaggtgagccacctgctgggcatcaacgtgacagacttcacccggggcatcctgaccccccgcatcaaggtgggccgggactatgtgcagaaggcccagaccaaggagcaggccgactttgccatcgaggccctggccaaggccacctatgaaagaatgttccgctggctggtgctgcgcatcaacaaggccctggacaagaccaagaggcagggcgccagcttcatcggcatcctggacattgctggctttgagatctttgacctgaacagctttgagcagctgtgcatcaactacaccaatgagaagctgcagcagctgttcaaccacaccatgttcatcctggagcaggaggagtaccagcgggagggcatcgagtggaacttcatcgactttggcctggacctgcagccctgcatcgacctgattgagaagccagctggccccccaggcatcctggccctgctggatgaggagtgctggttccccaaggccacagacaagagctttgtggagaaggtgatgcaggagcagggcacccaccccaagttccagaagcccaagcagctgaaggacaaggctgacttctgcatcatccactacgccggcaaggtggactacaaggcagatgagtggctgatgaagaacatggaccccctgaatgacaacatcgccaccctgctgcaccagagcagtgacaagtttgtgtctgagctgtggaaggatgtggaccgcatcatcggcctggaccaggtggccggcatgtctgaaacagccctgcccggggccttcaagaccaggaagggcatgttcagaacagtgggccagctgtacaaggagcagctggccaagctgatggccaccctgaggaacaccaaccccaactttgtgcgctgcatcatccccaaccacgagaagaaggccggcaagctggacccccacctggtgctggaccagctgcgctgcaatggagtgctggagggcatccgcatctgccggcagggcttccccaacagagtggtgttccaggagttccggcagagatatgagatcctgacccccaacagcatccccaagggcttcatggatggcaagcaggcctgtgtgctgatgatcaaggccctggagctggacagcaacctgtaccgcatcggccagagcaaggtgttcttccgggccggcgtgctggcccacctggaggaggagcgggacctgaagatcacagatgtgatcatcggcttccaggcctgctgccggggctacctggccaggaaggcctttgccaagaggcagcagcagctgacagccatgaaggtgctgcagaggaactgtgccgcctacctgaagctgaggaactggcagtggtggaggctcttcaccaaggtgaagcccctgctgcaggtgtcccggcaggaggaggagatgatggccaaggaggaggagctggtgaaggtgcgggagaagcagctggccgcagaaaatcggctgacagagatggagaccctgcagagccagctgatggccgagaagctgcagctgcaggagcagctgcaggccgagacagagctgtgtgccgaggccgaggagctgcgggcccggctgacagccaagaagcaggagctggaggagatctgccacgacctggaggcccgggtggaggaggaggaggagcgctgccagcacctgcaggccgagaagaagaagatgcagcagaacatccaggagctggaggagcagctggaggaggaggagagcgcccggcagaagctgcagctggagaaggtgaccacagaggccaagctgaagaagctggaggaggagcagatcatcctggaggaccagaactgcaagctggccaaggagaagaagctgctggaggacagaattgctgagttcaccaccaacctgacagaggaggaggagaagagcaagagcctggccaagctgaagaacaagcatgaggccatgatcacagacctggaggagcggctgcggcgggaggagaagcagaggcaggagctggagaagaccaggaggaagctggagggggacagcacagacctgagtgaccagattgctgagctgcaggcccagattgctgagctgaagatgcagctggccaagaaggaggaggagctgcaggccgccctggcccgggtggaggaggaggccgcccagaagaacatggccctgaagaagatccgggagctggagagccagatcagcgagctgcaggaggacctggagagcgagcgggccagcaggaacaaggccgagaagcagaagagggacctgggggaggagctggaggccctgaagacagagctggaggacaccctggacagcacagctgcccagcaggagctgcggagcaagcgggagcaggaggtgaacatcctgaagaagaccctggaggaggaggccaagacccatgaggcccagatccaggagatgaggcagaagcacagccaggccgtggaggagctggccgagcagctggagcagaccaagagggtgaaggccaacctggagaaggccaagcagaccctggagaatgaaagaggagagctggccaatgaggtgaaggtgctgctgcagggcaagggggacagcgagcacaagaggaagaaggtggaggcccagctgcaggagctgcaggtgaagttcaatgaaggagagcgggtgaggacagagctggccgacaaggtgaccaagctgcaggtggagctggacaacgtgacaggcctgctgagccagagcgacagcaagagcagcaagctgaccaaggacttcagcgccctggagagccagctgcaggacacccaggagctgctgcaggaggagaaccggcagaagctgagcctgagcaccaagctgaagcaggtggaggatgagaagaacagcttccgggagcagctggaggaggaggaggaggccaagcacaacctggagaagcagatcgccaccctgcacgcccaggtggccgacatgaagaagaagatggaggacagcgtgggctgcctggagacagctgaggaggtgaagaggaagctgcagaaggacctggagggcctgagccagagacatgaggagaaggtggccgcctatgacaagctggagaagaccaagacccggctgcagcaggagctggatgacctgctggtggacctggaccaccagaggcagagcgcctgcaacctggagaagaagcagaagaagtttgaccagctgctggccgaggagaagaccatcagcgccaagtatgcagaggagcgggacagagctgaggccgaggcccgggagaaggagaccaaggccctgagcctggcccgggccctggaggaggccatggagcagaaggccgagctggagcggctgaacaagcagttcagaacagagatggaggacctgatgagcagcaaggatgatgtgggcaagtctgtgcatgagctggagaagagcaagagggccctggagcagcaggtggaggagatgaagacccagctggaggagctggaggatgagctgcaggccacagaagatgccaagctgcggctggaggtgaacctgcaggccatgaaggcccagtttgagcgggacctgcagggcagagatgagcagagcgaggagaagaagaagcagctggtgcggcaggtgcgggagatggaggccgagctggaggatgagaggaagcagaggtccatggctgtggccgccaggaagaagctggagatggacctgaaggacctggaggcccacatcgacagcgccaacaagaacagagatgaggccatcaagcagctgaggaagctgcaggcccagatgaaggactgcatgagggagctggatgacacccgggccagccgggaggagatcctggcccaggccaaggaaaatgagaagaagctgaagtccatggaggccgagatgatccagctgcaggaggagctggccgctgctgagcgggccaagaggcaggcccagcaggagagagatgagctggctgatgagatcgccaacagcagcggcaagggggccctggccctggaggagaagaggcggctggaggccagaattgcccagctggaggaggagctggaggaggagcagggcaacacagagctgatcaatgaccggctgaagaaggccaacctgcagattgaccagatcaacacagacctgaacctggagaggagccacgcccagaagaatgaaaatgcccggcagcagctggagcggcagaacaaggagctgaaggtgaagctgcaggagatggagggcaccgtgaagagcaagtacaaggccagcatcacagccctggaggccaagatcgcccagctggaggagcagctggacaatgagaccaaggagcggcaggccgcctgcaagcaggtgcggaggacagagaagaagctgaaggatgtgctgctgcaggtggatgatgaaagaagaaatgctgagcagtacaaggaccaggccgacaaggccagcacccggctgaagcagctgaagaggcagctggaggaggccgaggaggaggcccagagggccaatgccagcaggaggaagctgcagcgggagctggaggatgccacagaaacagcagatgccatgaaccgggaggtgagcagcctgaagaacaagctgcggcggggggacctgccctttgtggtgcccaggaggatggccaggaaaggagctggagatggcagtgatgaggaggtggatggcaaggcagatggagctgaggccaagccagctgagtag

SEQ ID NO: 38827 - DNA, 501 bp, Artificial Sequence
  Description of Artificial Sequence: Synthetic coding sequence
atggcccagaggctgctgctgcggcgcttcctggccagcgtcatcagcaggaagcccagccagggccagtggccacccctgaccagccgggccctgcagaccccccagtgcagccctgggggcctgactgtgacccccaacccagcccggaccatctacaccacccgcatcagcctgaccaccttcaacatccaggacggccctgacttccaggacagagtggtgaacagcgagacccctgtggtggtggacttccacgcccagtggtgtggcccctgcaagatcctgggcccccggctggagaagatggtggccaagcagcacggcaaggtggtgatggccaaggtggacattgatgaccacacagacctggccatcgagtatgaggtgtctgctgtgcccaccgtgctggccatgaagaatggagatgtggtggacaagtttgtgggcatcaaggatgaggaccagctggaggccttcctgaagaagctgattggatag

SEQ ID NO: 38828 - DNA, 2877 bp, Artificial Sequence
  Description of Artificial Sequence: Synthetic coding sequence
atgtctgaatgtggcggccggggcggcggcagcagcagcagtgaagatgctgaagatgaaggaggcggcggcggcggccctgctggcagtgactgcctgagcagcagccccaccctggccacagccagcagcgctggccgcctgcggcggggcctgcggggggccttcctgatggcccggcagaggcctgagctgctgtgtggggctgtggccctgggctgtgccctgctgctggccctgaagttcacctgcagccgggccaaggatgtgatcatcccagccaagccccctgtgtccttcttcagcctgcggagccctgtgctggacctcttccagggccagctggactatgcagaatatgtgcggcgggacagcgaggtggtgctgctcttcttctacgccccctggtgtggccagagcattgctgcccgggcagaaattgagcaggccgccagccggctgagtgaccaggtgctgtttgtggccatcaactgctggtggaaccagggcaaatgtaggaagcagaagcacttcttctacttccctgtgatctacctgtaccacaggagctttggccccatcgagtacaagggccccatgtctgctgtgtacatcgagaagtttgtgcggcgggtgatgaagcccctgctgtacatccccagccagagcgagctgctggacttcctgagcaactatgagcccggggtgctgggctactttgagttcagcggcagcccccagcccccaggctacctgaccttcttcaccagcgccctgcacagcctgaagaaggactacctgggcaccgtgcgctttggagtcatcaccaacaagcacctggccaagctggtgtccctggtgcacagcggctctgtgtacctgcaccgccacttcaacaccagcctggtgttcccccgggaggtgctgaactacacagctgagaacatctgcaagtgggccctggagaaccaggagaccctcttccgctggctgcggccccacggcggcaagagcctgctgctgaacaatgagctgaagaagggccctgccctcttcctgttcatccccttcaaccccctggccgagagccaccccctgattgatgagatcacagaggtggccctggagtacaacaactgccacggggaccaggtggtggagcggctgctgcagcacctgcggcgggtggatgcccctgtgctggagagcctggccctggaggtgcctgcccagctgcctgacccccccaccatcacagccagcccctgctgcaacacagtggtgctgccccagtggcacagcttcagcaggacccacaacgtgtgtgagctgtgtgtgaaccagaccagcggcggcatgaagcccagctctgtgtctgtgccccagtgcagcttctttgagatggccgccgccctggacagcttctacctgaaggagcagaccttctaccacgtggccagtgacagcattgaatgtagcaacttcctgaccagctacagccccttctcctactacacagcctgctgcaggaccatcagcagaggagtgtctggcttcatcgacagcgagcagggcgtgtttgaggcccccaccgtggccttcagcagcctggagaagaagtgtgaggtggatgcccccagctctgtgccccacatcgaggagaaccgctacctgtttcctgaggtggacatgaccagcaccaacttcaccggcctgagctgcaggaccaacaagaccctgaacatctacctgctggacagcaacctcttctggctgtatgcagagcggctgggcgcccccagcagcacccaggtgaaggagtttgctgccatcgtggatgtgaaggaggagagccactacatcctggaccccaagcaggccctgatgaagctgaccctggagagcttcatccagaacttctctgtgctgtacagccccctgaagaggcacctgattggcagcggcagcgcccagttccccagccagcacctgatcacagaggtgaccacagacaccttctgggaggtggtgctgcagaagcaggatgtgctgctgctgtactatgccccctggtgtggcttctgccccagcctgaaccacatcttcatccagctggccaggaacctgcccatggacaccttcaccgtggccagaattgatgtgtcccagaatgacctgccctgggagttcatggtggaccggctgcccaccgtgctcttcttcccctgcaacaggaaggacctgtctgtgaagtacccagaagatgtgcccatcaccctgcccaacctgctgcgcttcatcctgcaccacagcgaccctgccagcagcccccagaatgtggccaacagccccaccaaggaatgtctgcagagcgaggccgtgctgcagaggggccacatcagccacctggagcgggagatccagaagctgcgggcagagatcagcagcctgcagagggcccaggtgcaggtggagagccagctgagcagcgccaggagagatgagcaccggctgcggcagcagcagagggccctggaggagcagcacagcctgctgcacgcccacagcgagcagctgcaggccctgtatgagcagaagacccgggagctgcaggagctggccaggaagctgcaggagctggctgatgccagcgagaacctgctgacagagaacacctggctgaagatcctggtggccaccatggagaggaagctggagggcagagatggagctgagagcctggccgcccagcgggaggtgcaccccaagcagcctgagcccagcgccaccccccagctgcccggcagcagccccccaccagccaacgtgtctgccaccctggtgtctgaaagaaacaaggagaacagaacagactag

SEQ ID NO: 38829 - DNA, 2958 bp, Artificial Sequence
  Description of Artificial Sequence: Synthetic coding sequence
atgtctgaatgtggcggccggggcggcggcagcagcagcagtgaagatgctgaagatgaaggaggcggcggcggcggccctgctggcagtgactgcctgagcagcagccccaccctggccacagccagcagcgctggccgcctgcggcggggcctgcggggggccttcctgatggcccggcagaggcctgagctgctgtgtggggctgtggccctgggctgtgccctgctgctggccctgaagttcacctgcagccgggccaaggatgtgatcatcccagccaagccccctgtgtccttcttcagcctgcggagccctgtgctggacctcttccagggccagctggactatgcagaatatgtgcggcgggacagcgaggtggtgctgctcttcttctacgccccctggtgtggccagagcattgctgcccgggcagaaattgagcaggccgccagccggctgagtgaccaggtgctgtttgtggccatcaactgctggtggaaccagggcaaatgtaggaagcagaagcacttcttctacttccctgtgatctacctgtaccacaggagctttggccccatcgagtacaagggccccatgtctgctgtgtacatcgagaagtttgtgcggcgggtgatgaagcccctgctgtacatccccagccagagcgagctgctggacttcctgagcaactatgagcccggggtgctgggctactttgagttcagcggcagcccccagcccccaggctacctgaccttcttcaccagcgccctgcacagcctgaagaaggccctggagagcaccagcagcccccgggccctggtgtccttcaccggggagtggcacctggagaccaagatctacgtgctggactacctgggcaccgtgcgctttggagtcatcaccaacaagcacctggccaagctggtgtccctggtgcacagcggctctgtgtacctgcaccgccacttcaacaccagcctggtgttcccccgggaggtgctgaactacacagctgagaacatctgcaagtgggccctggagaaccaggagaccctcttccgctggctgcggccccatggaggcaagagcctgctgctgaacaatgagctgaagaagggccctgccctcttcctgttcatccccttcaaccccctggccgagagccaccccctgattgatgagatcacagaggtggccctggagtacaacaactgccacggggaccaggtggtggagcggctgctgcagcacctgcggcgggtggatgcccctgtgctggagagcctggccctggaggtgcctgcccagctgcctgacccccccaccatcacagccagcccctgctgcaacacagtggtgctgccccagtggcacagcttcagcaggacccacaacgtgtgtgagctgtgtgtgaaccagaccagcggcggcatgaagcccagctctgtgtctgtgccccagtgcagcttctttgagatggctgctgccctggacagcttctacctgaaggagcagaccttctaccacgtggccagtgacagcattgagtgcagcaacttcctgaccagctacagccccttctcctactacacagcctgctgcaggaccatcagccggggcgtgtctggcttcattgattctgagcagggcgtgtttgaggcccccaccgtggccttcagcagcctggagaagaagtgtgaggtggatgcccccagctctgtgccccacattgaagaaaatcgctacctgtttcctgaggtggacatgaccagcaccaacttcaccggcctgagctgcaggaccaacaagaccctgaacatctacctgctggacagcaacctcttctggctgtatgcagagcggctgggcgcccccagcagcacccaggtgaaggagtttgctgccatcgtggatgtgaaggaggagagccactacatcctggaccccaagcaggccctgatgaagctgaccctggagagcttcatccagaacttctctgtgctgtacagccccctgaagaggcacctgattggcagcggcagcgcccagttccccagccagcacctgatcacagaggtgaccacagacaccttctgggaggtggtgctgcagaagcaggatgtgctgctgctgtactatgccccctggtgtggcttctgccccagcctgaaccacatcttcatccagctggccaggaacctgcccatggacaccttcaccgtggccagaattgatgtgtcccagaatgacctgccctgggagttcatggtggaccggctgcccaccgtgctcttcttcccctgcaacaggaaggacctgtctgtgaagtacccagaagatgtgcccatcaccctgcccaacctgctgcgcttcatcctgcaccacagcgaccctgccagcagcccccagaatgtggccaacagccccaccaaggagtgcctgcagagcgaggccgtgctgcagaggggccacatcagccacctggagcgggagatccagaagctgcgggcagagatcagcagcctgcagagggcccaggtgcaggtggagagccagctgagcagcgccaggagagatgagcaccggctgcggcagcagcagagggccctggaggagcagcacagcctgctgcacgcccacagcgagcagctgcaggccctgtatgagcagaagacccgggagctgcaggagctggccaggaagctgcaggagctggctgatgccagcgagaacctgctgacagagaacacctggctgaagatcctggtggccaccatggagaggaagctggagggcagagatggagctgagagcctggccgcccagcgggaggtgcaccccaagcagcctgagcccagcgccaccccccagctgcccggcagcagccccccaccagccaacgtgtctgccaccctggtgtctgagaggaacaaggaaaatagaacagactag

SEQ ID NO: 38830 - DNA, 666 bp, Artificial Sequence
  Description of Artificial Sequence: Synthetic coding sequence
atggcccggcagaggcctgagctgctgtgtggggctgtggccctgggctgtgccctgctgctggccctgaagttcacctgcagccgggccaaggatgtgatcatcccagccaagccccctgtgtccttcttcagcctgcggagccctgtgctggacctcttccagggccagctggactatgcagaatatgtgagaagagacagcgaggtggtgctgctcttcttctacgccccctggtgtggccagagcattgctgcccgggcagaaattgagcaggccgccagccggctgagtgaccaggtgctgtttgtggccatcaactgctggtggaaccagggcaagtgcaggaagcagaagcacttcttctacttccctgtgatctacctgtaccacaggagctttggccccatcgagtacaagggccccatgtctgctgtgtacatcgagaagtttgtgagaagagtgatgaagcccctgctgtacatccccagccagagcgagctgctggacttcctgagcaactatgagcccggggtgctgggctactttgagttcagcggcagcccccagcccccaggctacctgaccttcttcaccagcgccctgcacagcctgaagaaggatggagtgagcccctgcaggcctggctggagcgctgtggcctag

SEQ ID NO: 38831 - DNA, 1083 bp, Artificial Sequence
  Description of Artificial Sequence: Synthetic coding sequence
atggtgcctgctgctggaagaagaccaccccgggtgatgaggctgctgggctggtggcaggtgctgctgtgggtgctgggcctgcctgtgcggggcgtggaggtggccgaggagagcggccgcctgtggagcgaggagcagcctgcccaccccctgcaggtgggcgctgtgtacctgggggaggaggagctgctgcatgaccccatgggccaggacagagctgctgaggaggccaatgctgtgctgggcctggacacccagggcgaccacatggtgatgctgagcgtcatccctggagaggccgaggacaaggtgtcctctgagcccagcggcgtgacctgtggggccggcggcgctgaggacagccgctgcaatgtgcgggagagcctcttcagcctggatggagctggggcccacttcccagaccgggaggaggagtactacacagagcctgaggtggccgagagtgatgctgcccccacagaggacagcaacaacacagagagcctgaagagccccaaggtgaactgtgaggagaggaacatcaccggcctggagaacttcaccctgaagatcctgaacatgagccaggacctgatggacttcctgaaccccaacggcagtgactgcaccctggtgctcttctacaccccctggtgccgcttcagcgccagcctggccccccacttcaacagcctgccccgggccttccctgccctgcacttcctggccctggatgccagccagcacagcagcctgagcaccaggtttggaacagtggccgtgcccaacatcctgctcttccagggcgccaagcccatggcccgcttcaaccacacagacaggaccctggagaccctgaagatcttcatcttcaaccagacaggaattgaggccaagaagaatgtggtggtgacccaggccgaccagatcggccccctgcccagcaccctcatcaagtctgtggactggctgctggtgttcagcctcttcttcctgatctccttcatcatgtatgccaccatcagaacagagagcatccgctggctgatccctggccaggagcaggagcacgtggagtag

SEQ ID NO: 38832 - DNA, 1035 bp, Artificial Sequence
  Description of Artificial Sequence: Synthetic coding sequence
atggtgcctgctgctggaagaagaccaccccgggtgatgaggctgctgggctggtggcaggtgctgctgtgggtgctgggcctgcctgtgcggggcgtggaggtggccgaggagagcggccgcctgtggagcgaggaggagctgctgcatgaccccatgggccaggacagagctgctgaggaggccaatgctgtgctgggcctggacacccagggcgaccacatggtgatgctgagcgtcatccctggagaggccgaggacaaggtgtcctctgagcccagcggcgtgacctgtggggccggcggcgctgaggacagccgctgcaatgtgcgggagagcctcttcagcctggatggagctggggcccacttcccagaccgggaggaggagtactacacagagcctgaggtggccgagagtgatgctgcccccacagaggacagcaacaacacagagagcctgaagagccccaaggtgaactgtgaggagaggaacatcaccggcctggagaacttcaccctgaagatcctgaacatgagccaggacctgatggacttcctgaaccccaacggcagtgactgcaccctggtgctcttctacaccccctggtgccgcttcagcgccagcctggccccccacttcaacagcctgccccgggccttccctgccctgcacttcctggccctggatgccagccagcacagcagcctgagcaccaggtttggaacagtggccgtgcccaacatcctgctcttccagggcgccaagcccatggcccgcttcaaccacacagacaggaccctggagaccctgaagatcttcatcttcaaccagacaggaattgaggccaagaagaatgtggtggtgacccaggccgaccagatcggccccctgcccagcaccctcatcaagtctgtggactggctgctggtgttcagcctcttcttcctgatctccttcatcatgtatgccaccatcagaacagagagcatccgctggctgatccctggccaggagcaggagcacgtggagtag

SEQ ID NO: 38833 - DNA, 1014 bp, Artificial Sequence
  Description of Artificial Sequence: Synthetic coding sequence
atggaggccggccagcagagggtggtggagaaggtggccgaggagagcggccgcctgtggagcgaggagcagcctgcccaccccctgcaggtgggcgctgtgtacctgggggaggaggagctgctgcatgaccccatgggccaggacagagctgctgaggaggccaatgctgtgctgggcctggacacccagggcgaccacatggtgatgctgagcgtcatccctggagaggccgaggacaaggtgagcagcgagcccagcggcgtgacctgtggggccggcggcgctgaggacagccgctgcaatgtgcgggagagcctcttcagcctggatggagctggggcccacttcccagaccgggaggaggagtactacacagagcctgaggtggccgagagtgatgctgcccccacagaggacagcaacaacacagagagcctgaagagccccaaggtgaactgtgaggagaggaacatcaccggcctggagaacttcaccctgaagatcctgaacatgagccaggacctgatggacttcctgaaccccaatggaagtgactgcaccctggtgctcttctacaccccctggtgccgcttcagcgccagcctggccccccacttcaacagcctgccccgggccttccctgccctgcacttcctggccctggatgccagccagcacagcagcctgagcacccgcttcggcaccgtggccgtgcccaacatcctgctcttccagggcgccaagcccatggcccgcttcaaccacacagacaggaccctggagaccctgaagatcttcatcttcaaccagacaggcatcgaggccaagaagaatgtggtggtgacccaggccgaccagatcggccccctgcccagcaccctcatcaagtctgtggactggctgctggtgttcagcctcttcttcctgatctccttcatcatgtatgccaccatcagaacagagagcatccgctggctgatccctggccaggagcaggagcacgtggagtag

SEQ ID NO: 38834 - DNA, 1299 bp, Artificial Sequence
  Description of Artificial Sequence: Synthetic coding sequence
atgcctgcccggcccggccgcctgctgcccctgctggcccggcctgctgccctgacagccctgctgctgctgctgctgggccacggcggcggcggccgctggggcgcccgggcccaggaggccgctgctgctgctgctgatggccccccagctgctgatggagaagatggccaggacccccacagcaagcacctgtacacagctgacatgttcacccacggcatccagagcgctgcccactttgtgatgttctttgccccctggtgtggccactgccagaggctgcagcccacctggaatgacctgggggacaagtacaacagcatggaggatgccaaggtgtatgtggccaaggtggactgcacagcccacagtgatgtgtgcagcgcccagggcgtgcggggctaccccaccctgaagctgttcaagccaggccaggaggccgtgaagtaccagggcccccgggacttccagaccctggagaactggatgctgcagaccctgaatgaggagcctgtgaccccagagcctgaggtggagcccccatctgcccctgagctgaagcagggcctgtatgagctgagcgccagcaactttgagctgcacgtggcccagggcgaccacttcatcaagttctttgccccctggtgtggccactgcaaggccctggcccccacctgggagcagctggccctgggcctggagcacagcgagaccgtgaagattggcaaggtggactgcacccagcactatgagctgtgcagcggcaaccaggtgcggggctaccccaccctgctgtggttcagagatggcaagaaggtggaccagtacaagggcaagagggacctggagagcctgcgggagtatgtggagagccagctgcagaggacagaaacaggagccacagagaccgtgacccccagcgaggcccctgtgctggccgctgagcctgaggccgacaagggcaccgtgctggccctgacagagaacaactttgatgacaccatcgccgagggcatcaccttcatcaagttctacgccccctggtgtggccactgcaagaccctggcccccacctgggaggagctgagcaagaaggagttccctggcctggccggcgtgaagattgctgaggtggactgcacagctgagaggaacatctgcagcaagtacagcgtgcggggctaccccaccctgctgctcttccggggcggcaagaaggtgtctgagcacagcggcggccgggacctggacagcctgcacagatttgtgctgagccaggccaaggatgagctgtag

SEQ ID NO: 38835 - DNA, 975 bp, Artificial Sequence
  Description of Artificial Sequence: Synthetic coding sequence
atggaggatgccaaggtgtatgtggccaaggtggactgcacagcccacagtgatgtgtgcagcgcccagggcgtgcggggctaccccaccctgaagctgttcaagccaggccaggaggccgtgaagtaccagggcccccgggacttccagaccctggagaactggatgctgcagaccctgaatgaggagcctgtgaccccagagcctgaggtggagcccccatctgcccctgagctgaagcagggcctgtatgagctgagcgccagcaactttgagctgcacgtggcccagggcgaccacttcatcaagttctttgccccctggtgtggccactgcaaggccctggcccccacctgggagcagctggccctgggcctggagcacagcgagaccgtgaagattggcaaggtggactgcacccagcactatgagctgtgcagcggcaaccaggtgcggggctaccccaccctgctgtggttcagagatggcaagaaggtggaccagtacaagggcaagagggacctggagagcctgcgggagtatgtggagagccagctgcagaggacagaaacaggagccacagagaccgtgacccccagcgaggcccctgtgctggccgctgagcctgaggccgacaagggcaccgtgctggccctgacagagaacaactttgatgacaccatcgccgagggcatcaccttcatcaagttctacgccccctggtgtggccactgcaagaccctggcccccacctgggaggagctgagcaagaaggagttccctggcctggccggcgtgaagattgctgaggtggactgcacagctgagaggaacatctgcagcaagtacagcgtgcggggctaccccaccctgctgctcttccggggcggcaagaaggtgtctgagcacagcggcggccgggacctggacagcctgcacagatttgtgctgagccaggccaaggatgagctgtag

SEQ ID NO: 38836 - DNA, 1083 bp, Artificial Sequence
  Description of Artificial Sequence: Synthetic coding sequence
atgacccagagcgtggacagcaacagaggcaacagaaatgagaagagatgtggccactgccagaggctgcagcccacctggaatgacctgggggacaagtacaacagcatggaggatgccaaggtgtatgtggccaaggtggactgcacagcccacagtgatgtgtgcagcgcccagggcgtgcggggctaccccaccctgaagctgttcaagccaggccaggaggccgtgaagtaccagggcccccgggacttccagaccctggagaactggatgctgcagaccctgaatgaggagcctgtgaccccagagcctgaggtggagcccccatctgcccctgagctgaagcagggcctgtatgagctgagcgccagcaactttgagctgcacgtggcccagggcgaccacttcatcaagttctttgccccctggtgtggccactgcaaggccctggcccccacctgggagcagctggccctgggcctggagcacagcgagaccgtgaagattggcaaggtggactgcacccagcactatgagctgtgcagcggcaaccaggtgcggggctaccccaccctgctgtggttcagagatggcaagaaggtggaccagtacaagggcaagagggacctggagagcctgcgggagtatgtggagagccagctgcagaggacagaaacaggagccacagagaccgtgacccccagcgaggcccctgtgctggccgctgagcctgaggccgacaagggcaccgtgctggccctgacagagaacaactttgatgacaccatcgccgagggcatcaccttcatcaagttctacgccccctggtgtggccactgcaagaccctggcccccacctgggaggagctgagcaagaaggagttccctggcctggccggcgtgaagattgctgaggtggactgcacagctgagaggaacatctgcagcaagtacagcgtgcggggctaccccaccctgctgctcttccggggcggcaagaaggtgtctgagcacagcggcggccgggacctggacagcctgcacagatttgtgctgagccaggccaaggatgagctgtag

SEQ ID NO: 38837 - DNA, 843 bp, Artificial Sequence
  Description of Artificial Sequence: Synthetic coding sequence
atggcccccagcggcagcctggccgtgcccctggccgtgctggtgctgctgctgtggggcgccccctggacccatggaagaagaagcaatgtgcgggtcatcacagatgagaactggagggagctgctggagggggactggatgattgagttctacgccccctggtgcccagcctgccagaacctgcagcctgagtgggagagctttgctgagtggggcgaggacctggaggtgaacatcgccaaggtggatgtgacagagcagcccggcctgagcggccgcttcatcatcacagccctgcccaccatctaccactgcaaggatggagagttccgccgctaccagggccccaggaccaagaaggacttcatcaacttcatcagtgacaaggagtggaagagcattgagcctgtgtcctcctggtttggacctggctctgtgctgatgagctccatgtctgccctcttccagctgtccatgtggatccgcacctgccacaactacttcatcgaggacctgggcctgcctgtgtggggcagctacacagtgtttgccctggccaccctcttcagcggcctgctgctgggcctgtgcatgatctttgtggccgactgcctgtgccccagcaagagaagaagaccccagccctacccctaccccagcaagaagctgctgtctgagagcgcccagcccctgaagaaggtggaggaggagcaggaggctgatgaggaggatgtgtctgaggaggaggccgagagcaaggagggcaccaacaaggacttcccccagaatgccatccggcagaggagcctgggccccagcctggccacagacaagagctag

SEQ ID NO: 38838 - DNA, 891 bp, Artificial Sequence
  Description of Artificial Sequence: Synthetic coding sequence
atggctgtgctggcccccctcatcgccctggtgtacagcgtgccccggctgagccgctggctggcccagccctactacctgctgagcgccctgctgtctgctgccttcctgctggtgaggaagctgccccccctgtgccacggcctgcccacccagcgggaggatggcaacccctgtgactttgactggagggaggtggagatcctgatgttcctgagcgccatcgtgatgatgaagaacagaagaagcatcaccgtggagcagcacatcggcaacatcttcatgttcagcaaggtggccaacaccatcctcttcttccggctggacatccgcatgggcctgctgtacatcaccctgtgcatcgtgttcctgatgacctgcaagccacccctgtacatgggccctgagtacatcaagtacttcaatgacaagaccattgatgaggagctggagcgggacaagagggtgacctggatcgtggagttctttgccaactggagcaatgactgccagagctttgcccccatctatgctgacctgagcctgaagtacaactgcaccggcctgaactttgggaaggtggatgtgggccgctacacagatgtgtccacccgctacaaggtgtccaccagccccctgaccaagcagctgcccaccctcatcctcttccagggcggcaaggaggccatgagaagaccccagattgacaagaagggccgggctgtgtcctggaccttctctgaagaaaatgtcatccgggagttcaacctgaatgagctgtaccagagggccaagaagctgagcaaggccggggacaacatccctgaggagcagcctgtggccagcacccccaccaccgtgtctgatggagagaacaagaaggacaagtag

SEQ ID NO: 38839 - DNA, 777 bp, Artificial Sequence
  Description of Artificial Sequence: Synthetic coding sequence
atggctgtgctggcccccctcatcgccctggtgtacagcgtgccccggctgagccgctggctggcccagccctactacctgctgagcgccctgctgtctgctgccttcctgctggtgaggaagctgccccccctgtgccacggcctgcccacccagcgggaggatggcaacccctgtgactttgactggagggaggtggagatcctgatgttcctgagcgccatcgtgatgatgaagaacagaagatccatgttcctgatgacctgcaagccacccctgtacatgggccctgagtacatcaagtacttcaatgacaagaccattgatgaggagctggagcgggacaagagggtgacctggatcgtggagttctttgccaactggagcaatgactgccagagctttgcccccatctatgctgacctgagcctgaagtacaactgcaccggcctgaactttgggaaggtggatgtgggccgctacacagatgtgtccacccgctacaaggtgtccaccagccccctgaccaagcagctgcccaccctcatcctcttccagggcggcaaggaggccatgagaagaccccagattgacaagaagggccgggctgtgtcctggaccttctctgaagaaaatgtcatccgggagttcaacctgaatgagctgtaccagagggccaagaagctgagcaaggccggggacaacatccctgaggagcagcctgtggccagcacccccaccaccgtgtctgatggagagaacaagaaggacaagtag

SEQ ID NO: 38840 - DNA, 1365 bp, Artificial Sequence
  Description of Artificial Sequence: Synthetic coding sequence
atggccgcctggaagtcctggacagccctgcggctgtgtgccaccgtggtggtgctggacatggtggtgtgcaagggctttgtggaggacctggatgagagcttcaaggaaaatagaaatgatgacatctggctggtggacttctacgccccctggtgtggccactgcaagaagctggagcccatctggaatgaggtgggcctggagatgaagagcatcggcagccctgtgaaggtgggcaagatggatgccaccagctacagcagcatcgccagcgagtttggagtgcggggctaccccaccatcaagctgctgaagggggacctggcctacaactaccggggccccaggaccaaggatgacatcattgaatttgcccaccgggtgtctggggccctgatccggcccctgcccagccagcagatgtttgagcacatgcagaagaggcacagggtcttctttgtgtatgtgggcggggagagccccctgaaggagaagtacattgatgctgccagcgagctgattgtgtacacctacttcttcagcgccagcgaggaggtggtgcctgaatatgtgaccctgaaggagatgcctgctgtgctggtgttcaaggatgagacctactttgtgtatgatgaatatgaagatggagacctgagctcctggatcaaccgggagcgcttccagaactacctggccatggatggcttcctgctgtatgagctgggggacaccgggaagctggtggccctggccgtgattgatgagaagaacacctctgtggagcacacccggctgaagagcatcatccaggaggtggcccgggactacagagacctcttccaccgggacttccagtttggccacatggatggaaatgactacatcaacaccctgctgatggatgagctgactgtgcccaccgtggtggtgctgaacaccagcaaccagcagtacttcctgctggaccggcagatcaagaatgtggaggacatggtgcagttcatcaacaacatcctggatggcaccgtggaggcccagggcggggacagcatcctgcagaggctgaagagaattgtgtttgatgccaagagcaccatcgtgtccatcttcaagagcagccccctgatgggctgcttcctgtttggcctgcccctgggcgtcatcagcatcatgtgctacggcatctacacagctgacacagatggcggctacatcgaggagagatatgaggtgtccaagtcagaaaatgaaaaccaggagcagatcgaggagagcaaggagcagcaggagcccagcagcggcggctctgtggtgcccaccgtgcaggagcccaaggatgtgctggagaagaagaaggactag

SEQ ID NO: 38841 - DNA, 594 bp, Artificial Sequence
  Description of Artificial Sequence: Synthetic coding sequence
atggccgcctggaagtcctggacagccctgcggctgtgtgccaccgtggtggtgctggacatggtggtgtgcaagggctttgtggaggacctggatgagagcttcaaggaaaatagaaatgatgacatctggctggtggacttctacgccccctggtgtggccactgcaagaagctggagcccatctggaatgaggtgggcctggagatgaagagcatcggcagccctgtgaaggtgggcaagatggatgccaccagctacagcagcatcgccagcgagtttggagtgcggggctaccccaccatcaagctggccctgatccggcccctgcccagccagcagatgtttgagcacatgcagaagaggcacagggtcttctttgtgtatgtgggcggggagagccccctgaaggagaagtacattgatgctgccagcgagctgattgtgtacacctacttcttcagcgccagcgaggaggtggtgcctgaatatgtgaccctgaaggagatgcctgctgtgctggtgttcaaggatgagacctactttgtgtatgatggcaagttccagatcttcaacagctgcaagaccttctag

SEQ ID NO: 38842 - DNA, 1257 bp, Artificial Sequence
  Description of Artificial Sequence: Synthetic coding sequence
atggccgcctggaagtcctggacagccctgcggctgtgtgccaccgtggtggtgctggacatggtggtgtgcaagggctttgtggaggacctggatgagagcttcaaggaaaatagaaatgatgacatctggctggtggacttctacgccccctggtgtggccactgcaagaagctggagcccatctggaatgaggtgggcctggagatgaagagcatcggcagccctgtgaaggtgggcaagatggatgccaccagctacagcagcatcgccagcgagtttggagtgcggggctaccccaccatcaagctgctgaagggggacctggcctacaactaccggggccccaggaccaaggatgacatcattgaatttgcccaccgggtgtctggggccctgatccggcccctgcccagccagcagatgtttgagcacatgcagaagaggcacagggtcttctttgtgtatgtgggcggggagagccccctgaaggagaagtacattgatgctgccagcgagctgattgtgtacacctacttcttcagcgccagcgaggaggtggtgcctgaatatgtgaccctgaaggagatgcctgctgtgctggtgttcaaggatgagacctactttgtgtatgatgaatatgaagatggagacctgagctcctggatcaaccgggagcgcttccagaactacctggccatggatggcttcctgctgtatgagctgggggacaccgggaagctggtggccctggccgtgattgatgagaagaacacctctgtggagcacacccggctgaagagcatcatccaggaggtggcccgggactacagagacctcttccaccgggacttccagtttggccacatggatggaaatgactacatcaacaccctgctgatggatgagctgactgtgcccaccgtggtggtgctgaacaccagcaaccagcagtacttcctgctggaccggcagatcaagaatgtggaggacatggtgcagttcatcaacaacatcctggatggcaccgtggaggcccagggcggggacagcatcctgcagaggctgaagagaattgtgtttgatgccaagagcaccatcgtgtccatcttcaagagcagccccctgatgggctgcttcctgtttggcctgcccctgggcgtcatcagcatcatgtgctacggcatctacacagctgacacagatggcggctacatcgaggagagatatgaggtgtccaagaagaagaagaagtag

SEQ ID NO: 38843 - DNA, 1050 bp, Artificial Sequence
  Description of Artificial Sequence: Synthetic coding sequence
atggccggcggccgctgtggcccccagctgacagccctgctggccgcctggattgctgctgtggccgccacagctggccctgaggaggccgccctgcccccagagcagagccgggtgcagcccatgacagccagcaactggaccctggtgatggagggggagtggatgctgaagttctacgccccctggtgccccagctgccagcagacagacagcgagtgggaggcctttgccaagaatggagagatcctgcagatctctgtgggcaaggtggatgtgatccaggagcccggcctgagcggccgcttctttgtgaccaccctgcctgccttcttccacgccaaggatggcatcttccgccgctaccggggccctggcatctttgaggacctgcagaactacatcctggagaagaagtggcagagcgtggagcccctgaccggctggaagagccctgccagcctgaccatgagcggcatggccggcctcttcagcatcagcggcaagatctggcacctgcacaactacttcaccgtgaccctgggcatcccagcctggtgcagctatgtgttcttcgtcatcgccaccctggtgtttggcctcttcatgggcctggtgctggtggtgatcagcgagtgcttctacgtgcccctgcccaggcacctgtctgagaggtctgagcagaacagaagaagtgaggaggcccacagagctgagcagctgcaggatgctgaggaggagaaggatgacagcaatgaggaggagaacaaggacagcctggtggatgatgaggaggagaaggaggacctgggagatgaagatgaggccgaggaggaggaggaggaggacaacctggccgccggcgtggatgaggagaggtctgaggccaatgaccagggccccccaggagaagatggagtgacccgggaggaggtggagcctgaggaggccgaggagggcatcagcgagcagccctgcccagctgacacagaggtggtggaggacagcctgcggcagaggaagagccagcacgccgacaagggcctgtag

SEQ ID NO: 38844 - DNA, 1806 bp, Artificial Sequence
  Description of Artificial Sequence: Synthetic coding sequence
atggactggggcacagagctgtgggaccagtttgaggtgctggagcggcacacccagtggggcctggacctgctggaccgctacgtgaagtttgtgaaggagaggacagaggtggagcaggcctatgccaagcagctgcggagcctggtgaagaagtacctgcccaagaggcctgccaaggatgatcctgagagcaagttcagccagcagcagagctttgtgcagatcctgcaggaggtgaatgactttgctggccagcgggagctggtggccgagaacctgtctgtgcgggtgtgcctggagctgaccaagtacagccaggagatgaagcaggagaggaagatgcacttccaggagggcagaagagcccagcagcagctggagaatggcttcaagcagctggagaacagcaagaggaagtttgagcgggactgccgggaggccgagaaggccgcccagacagctgagcggctggaccaggacatcaatgccaccaaggcagatgtggagaaggccaagcagcaggcccacctgcggagccacatggccgaggagagcaagaatgaatatgctgcccagctgcagcgcttcaacagagaccaggcccacttctacttcagccagatgccccagatctttgacaagctgcaggacatggatgagcggcgggccacccggctgggcgccggctacggcctgctgtctgaggccgagctggaggtggtgcccatcatcgccaagtgcctggagggcatgaaggtggccgccaatgctgtggaccccaagaatgacagccacgtgctgattgagctgcacaagagcggctttgcccggcctggagatgtggagtttgaggacttcagccagcccatgaacagagcccccagcgacagcagcctgggcacccccagtgatggccggcctgagctgcggggccctggccgcagcaggaccaagcgctggccctttgggaagaagaacaagccccggcccccacccctgagccccctgggcggccctgtgcccagcgccctgcccaatggaccacccagccccaggagcggccgggaccccctggccatcctgtctgagatcagcaagtctgtgaagccccggctggccagcttccgcagcctgcggggcagccggggcaccgtggtgacagaggacttcagccacctgcccccagagcagcagaggaagaggctgcagcagcagctggaggagaggagccgggagctgcagaaggaggtggaccagcgggaggccctgaagaagatgaaggatgtgtatgagaagaccccccagatgggagaccctgccagcctggagccccagattgctgagaccctgagcaacatcgagcggctgaagctggaggtgcagaagtatgaggcctggctggccgaggccgagagccgggtgctgagcaacagaggagacagcctgagcagacatgcccggcccccagaccccccagccagcgcccccccagacagcagcagcaacagcgccagccaggacaccaaggagagcagcgaggagccccccagcgaggagagccaggacacccccatctacacagaatttgatgaggactttgaggaggagcccaccagccccatcggccactgtgtggccatctaccactttgagggcagcagcgagggcaccatctccatggccgagggggaggacctgagcctgatggaggaggacaagggagatggctggaccagggtgcggaggaaggagggcggggagggctacgtgcccaccagctacctgcgggtgaccctgaactag

SEQ ID NO: 38845 - DNA, 1638 bp, Artificial Sequence
  Description of Artificial Sequence: Synthetic coding sequence
atggactggggcacagagctgtgggaccagtttgaggtgctggagcggcacacccagtggggcctggacctgctggaccgctacgtgaagtttgtgaaggagaggacagaggtggagcaggcctatgccaagcagctgcggagcctggtgaagaagtacctgcccaagaggcctgccaaggatgatcctgagagcaagttcagccagcagcagagctttgtgcagatcctgcaggaggtgaatgactttgctggccagcgggagctggtggccgagaacctgtctgtgcgggtgtgcctggagctgaccaagtacagccaggagatgaagcaggagaggaagatgcacttccaggagggcagaagagcccagcagcagctggagaatggcttcaagcagctggagaacagcaagaggaagtttgagcgggactgccgggaggccgagaaggccgcccagacagctgagcggctggaccaggacatcaatgccaccaaggcagatgtggagaaggccaagcagcaggcccacctgcggagccacatggccgaggagagcaagaatgaatatgctgcccagctgcagcgcttcaacagagaccaggcccacttctacttcagccagatgccccagatctttgacaagctgcaggacatggatgagcggcgggccacccggctgggcgccggctacggcctgctgtctgaggccgagctggaggtggtgcccatcatcgccaagtgcctggagggcatgaaggtggccgccaatgctgtggaccccaagaatgacagccacgtgctgattgagctgcacaagagcggctttgcccggcctggagatgtggagtttgaggacttcagccagcccatgaacagagcccccagcgacagcagcctgggcacccccagtgatggccggcctgagctgcggggccctggccgcagcaggaccaagcgctggccctttgggaagaagaacaagacagtggtgacagaggacttcagccacctgcccccagagcagcagaggaagaggctgcagcagcagctggaggagaggagccgggagctgcagaaggaggtggaccagcgggaggccctgaagaagatgaaggatgtgtatgagaagaccccccagatgggagaccctgccagcctggagccccagattgctgagaccctgagcaacatcgagcggctgaagctggaggtgcagaagtatgaggcctggctggccgaggccgagagccgggtgctgagcaacagaggagacagcctgagcagacatgcccggcccccagaccccccagccagcgcccccccagacagcagcagcaacagcgccagccaggacaccaaggagagcagcgaggagccccccagcgaggagagccaggacacccccatctacacagaatttgatgaggactttgaggaggagcccaccagccccatcggccactgtgtggccatctaccactttgagggcagcagcgagggcaccatctccatggccgagggggaggacctgagcctgatggaggaggacaagggagatggctggaccagggtgcggaggaaggagggcggggagggctacgtgcccaccagctacctgcgggtgaccctgaactag

SEQ ID NO: 38846 - DNA, 1782 bp, Artificial Sequence
  Description of Artificial Sequence: Synthetic coding sequence
atggactggggcacagagctgtgggaccagtttgaggtgctggagcggcacacccagtggggcctggacctgctggaccgctacgtgaagtttgtgaaggagaggacagaggtggagcaggcctatgccaagcagctgcggagcctggtgaagaagtacctgcccaagaggcctgccaaggatgatcctgagagcaagttcagccagcagcagagctttgtgcagatcctgcaggaggtgaatgactttgctggccagcgggagctggtggccgagaacctgtctgtgcgggtgtgcctggagctgaccaagtacagccaggagatgaagcaggagaggaagatgcacttccaggagggcagaagagcccagcagcagctggagaatggcttcaagcagctggagaacagcaagaggaagtttgagcgggactgccgggaggccgagaaggccgcccagacagctgagcggctggaccaggacatcaatgccaccaaggcagatgtggagaaggccaagcagcaggcccacctgcggagccacatggccgaggagagcaagaatgaatatgctgcccagctgcagcgcttcaacagagaccaggcccacttctacttcagccagatgccccagatctttgacaagctgcaggacatggatgagcggcgggccacccggctgggcgccggctacggcctgctgtctgaggccgagctggaggtggtgcccatcatcgccaagtgcctggagggcatgaaggtggccgccaatgctgtggaccccaagaatgacagccacgtgctgattgagctgcacaagagcggctttgcccggcctggagatgtggagtttgaggacttcagccagcccatgaacagagcccccagcgacagcagcctgggcacccccagtgatggccggcctgagctgcggggccctggccgcagcaggaccaagcgctggccctttgggaagaagaacaagacagtggtgacagaggacttcagccacctgcccccagagcagcagaggaagaggctgcagcagcagctggaggagaggagccgggagctgcagaaggaggtggaccagcgggaggccctgaagaagatgaaggatgtgtatgagaagaccccccagatgggagaccctgccagcctggagccccagattgctgagaccctgagcaacatcgagcggctgaagctggaggtgcagaagtatgaggcctggctggccgaggccgagagccgggtgctgagcaacagaggagacagcctgagcagacatgcccggcccccagaccccccagccagcgcccccccagacagcagcagcaacagcgccagccaggacaccaaggagagcagcgaggagccccccagcgaggagagccaggacacccccatctacacagaatttgatgaggactttgaggaggagcccaccagccccatcggccactgtgtggccatctaccactttgaggacctgggccccccacctccacccagccagggccctgcccgggccctgagcctgtggccccgggtgaagacctctgtgctgtggaagaagaccaagggcacagctggccctggcagcggcggcaagcgggaggcccgggccacctgccccccacccaccagcgagagccgcagcattgagccctgccagaggcgggaggagggcggctgccgcctgctgctgctgggccatggagagccccaggacctgtgcaccctcttcctgaccccctggctgcggctgcggcctgtgtag

SEQ ID NO: 38847 - DNA, 1299 bp, Artificial Sequence
  Description of Artificial Sequence: Synthetic coding sequence
atggatgaggccgtgggggacctgaagcaggccctgccctgtgtggccgagagccccaccgtgcacgtggaggtgcaccagaggggcagcagcacagccaagaaggaggacatcaacctgtctgtgaggaagctgctgaacagacacaacatcgtgtttggagactacacctggacagaatttgatgagcccttcctgaccagaaatgtgcagagcgtgtccatcatcgacacagagctgaaggtgaaggacagccagcccatcgacctgagcgcctgcaccgtggccctgcacatcttccagctgaatgaagatggccccagcagcgagaacctggaggaggagacagagaacatcatcgccgccaaccactgggtgctgcctgctgctgagttccacggcctgtgggacagcctggtgtatgatgtggaggtgaagagccacctgctggactatgtgatgaccaccctgctcttcagtgacaagaatgtgaacagcaacctgatcacctggaacagagtggtgctgctgcacggccccccaggcaccgggaagaccagcctgtgcaaggccctggcccagaagctgaccatccggctgagcagccgctaccgctatggccagctgattgagatcaacagccacagcctcttcagcaagtggttcagcgagagcggcaagctggtgaccaagatgttccagaagatccaggacctgattgatgacaaggatgccctggtgtttgtgctgattgatgaggtggagagcctgacagctgccagaaatgcctgccgggccggcacagagcccagtgatgccatccgggtggtgaatgctgtgctgacccagattgaccagatcaagaggcacagcaatgtggtgatcctgaccaccagcaacatcacagagaagattgatgtggcctttgtggacagagctgacatcaagcagtacatcggccccccatctgctgctgccatcttcaagatctacctgagctgcctggaggagctgatgaagtgccagatcatctacccccggcagcagctgctgaccctgcgggagctggagatgattggcttcattgaaaataatgtgtccaagctgagcctgctgctgaatgacatcagcaggaagtctgagggcctgagcggccgggtgctgaggaagctgcccttcctggcccacgccctgtatgtgcaggcccccaccgtgaccatcgagggcttcctgcaggccctgagcctggccgtggacaagcagtttgaggagaggaagaagctggccgcctacatctag

SEQ ID NO: 38848 - DNA, 591 bp, Artificial Sequence
  Description of Artificial Sequence: Synthetic coding sequence
atggatgaggccgtgggggacctgaagcaggccctgccctgtgtggccgagagccccaccgtgcacgtggaggtgcaccagaggggcagcagcacagccaagaaggaggacatcaacctgtctgtgaggaagctgctgaacagacacaacatcgtgtttggagactacacctggacagaatttgatgagcccttcctgaccagaaatgtgcagagcgtgtccatcatcgacacagagctgaaggtgaaggacagccagcccatcgacctgagcgcctgcaccgtggccctgcacatcttccagctgaatgaagatggccccagcagcgagaacctggaggaggagacagagaacatcatcgccgccaaccactgggtgctgcctgctgctgagttccacggcctgtgggacagcctggtgtatgatgtggaggtgaagagccacctgctggactatgtgatgaccaccctgctcttcagtgacaagaatgtgaacagcaacctgatcaccatcgagggcttcctgcaggccctgagcctggccgtggacaagcagtttgaggagaggaagaagctggccgcctacatctag

SEQ ID NO: 38849 - DNA, 744 bp, Artificial Sequence
  Description of Artificial Sequence: Synthetic coding sequence
atgccccggctgctgcacccagccctgcccctgctgctgggcgccaccctgaccttccgggccctgcggcgggccctgtgccgcctgcccctgcctgtgcacgtgcgggctgaccccctgcggacctggcgctggcacaacctgctggtgtcctttgcccacagcatcgtgtctggcatctgggccctgctgtgtgtgtggcagaccccagacatgctggtggagattgaaacagcctggagcctgagcggctacctgctggtgtgcttctctgctggctacttcatccatgacacagtggacatcgtggccagcggccagacccgggcctcctgggagtacctggtgcaccacgtgatggccatgggcgccttcttcagcggcatcttctggagcagctttgtgggcggcggcgtgctgaccctgctggtggaggtgagcaacatcttcctgaccatccgcatgatgatgaagatcagcaatgcccaggaccacctgctgtacagagtgaacaagtatgtgaacctggtgatgtacttcctgttccggctggccccccaggcctacctgacccacttcttcctgcgctacgtgaaccagaggaccctgggcaccttcctgctgggcatcctgctgatgctggatgtgatgatcatcatctacttcagccggctgctgcggagtgacttctgcccagagcacgtgcccaagaagcagcacaaggacaagttcctgacagaatag

SEQ ID NO: 38850 - DNA, 603 bp, Artificial Sequence
  Description of Artificial Sequence: Synthetic coding sequence
atgggctacagcgctgtgcccaagtgccccccccggggccggggccgggacagcgtgtggcagaccccagacatgctggtggagattgaaacagcctggagcctgagcggctacctgctggtgtgcttctctgctggctacttcatccatgacacagtggacatcgtggccagcggccagacccgggcctcctgggagtacctggtgcaccacgtgatggccatgggcgccttcttcagcggcatcttctggagcagctttgtgggcggcggcgtgctgaccctgctggtggaggtgagcaacatcttcctgaccatccgcatgatgatgaagatcagcaatgcccaggaccacctgctgtacagagtgaacaagtatgtgaacctggtgatgtacttcctgttccggctggccccccaggcctacctgacccacttcttcctgcgctacgtgaaccagaggaccctgggcaccttcctgctgggcatcctgctgatgctggatgtgatgatcatcatctacttcagccggctgctgcggagtgacttctgcccagagcacgtgcccaagaagcagcacaaggacaagttcctgacagaatag

SEQ ID NO: 38851 - DNA, 624 bp, Artificial Sequence
  Description of Artificial Sequence: Synthetic coding sequence
atggctgctgcctggcccagcggccccagcgcccctgaggccgtgacagcccggctggtgggcgtgctgtggtttgtgtctgtgaccaccggcccctggggcgctgtggccaccagcgctggaggagaggagagcctgaagtgtgaggacctgaaggtgggccagtacatctgcaaggaccccaagatcaatgatgccacccaggagcctgtgaactgcaccaactacacagcccacgtgtcctgcttccctgcccccaacatcacctgcaaggacagcagtggaaatgagacccacttcaccggaaatgaggtgggcttcttcaagcccatcagctgcagaaatgtgaatggctacagctacaaggtggccgtggccctgagcctcttcctgggctggctgggcgctgaccgcttctacctgggctacccagccctgggcctgctgaagttctgcaccgtgggcttctgtggcatcggcagcctgattgacttcatcctgatctccatgcagatcgtgggccccagtgatggcagcagctacatcatcgactactacggcacccggctgacccggctgagcatcaccaatgagaccttcaggaagacccagctgtacccctag

SEQ ID NO: 38852 - DNA, 561 bp, Artificial Sequence
  Description of Artificial Sequence: Synthetic coding sequence
atggctgctgcctggcccagcggccccagcgcccctgaggccgtgacagcccggctggtgggcgtgctgtggtttgtgtctgtgaccaccggcccctggggcgctgtggccaccagcgctggaggagaggagagcctgaagtgtgaggacctgaaggtgggccagtacatctgcaaggaccccaagatcaatgatgccacccaggagcctgtgaactgcaccaactacacagcccacgtgtcctgcttccctgcccccaacatcacctgcaaggacagcagtggaaatgagacccacttcaccggaaatgaggtgggcttcttcaagcccatcagctgcagaaatgtgaatggctacagctacaaggtggccgtggccctgagcctcttcctgggctggctgggcgctgaccgcttctacctgggctacccagccctgggcaaggagaccgtgacccgggaggtgaagggcttcacagagagccggggcttccccctcttctgtgacatctttgtggtgatcatctttgtgctgtggattggcaagctgagccgggactag

SEQ ID NO: 38853 - DNA, 531 bp, Artificial Sequence
  Description of Artificial Sequence: Synthetic coding sequence
atggctgctgcctggcccagcggccccagcgcccctgaggccgtgacagcccggctggtgggcgtgctgtggtttgtgtctgtgaccaccggcccctggggcgctgtggccaccagcgctggaggagaggagagcctgaagtgtgaggacctgaaggtgggccagtacatctgcaaggaccccaagatcaatgatgccacccaggagcctgtgaactgcaccaactacacagcccacgtgtcctgcttccctgcccccaacatcacctgcaaggacagcagtggaaatgagacccacttcaccggaaatgaggtgggcttcttcaagcccatcagctgcagaaatgtgaatggctacagctacaaggtggccgtggccctgagcctcttcctgggctggctgggcgctgaccgcttctacctgggctacccagccctgggcctgctgaagttctgcaccgtgggcttctgtggcatcggcagcctgattgacttcatcctgatctccatgcaggtgtccttcagcatctag

SEQ ID NO: 38854 - DNA, 810 bp, Artificial Sequence
  Description of Artificial Sequence: Synthetic coding sequence
atgcacatcctgaagggcagccccaacgtcatcccccgggcccacggccagaagaacaccaggagagatggcaccggcctgtaccccatgaggggccccttcaagaacctggccctgctgcccttcagcctgcccctgctgggcggcggcggcagcggcagcggggagaaggtgtctgtgtccaagatggctgctgcctggcccagcggccccagcgcccctgaggccgtgacagcccggctggtgggcgtgctgtggtttgtgtctgtgaccaccggcccctggggcgctgtggccaccagcgctggaggagaggagagcctgaagtgtgaggacctgaaggtgggccagtacatctgcaaggaccccaagatcaatgatgccacccaggagcctgtgaactgcaccaactacacagcccacgtgtcctgcttccctgcccccaacatcacctgcaaggacagcagtggaaatgagacccacttcaccggaaatgaggtgggcttcttcaagcccatcagctgcagaaatgtgaatggctacagctacaaggtggccgtggccctgagcctcttcctgggctggctgggcgctgaccgcttctacctgggctacccagccctgggcctgctgaagttctgcaccgtgggcttctgtggcatcggcagcctgattgacttcatcctgatctccatgcagatcgtgggccccagtgatggcagcagctacatcatcgactactacggcacccggctgacccggctgagcatcaccaatgagaccttcaggaagacccagctgtacccctag

SEQ ID NO: 38855 - DNA, 516 bp, Artificial Sequence
  Description of Artificial Sequence: Synthetic coding sequence
atgaagaagtgcctgctgcctgtgctgatcacctgcatgcagacagccatctgcaaggacaggatgatgatgatcatgatcctgctggtgaactacagaccagatgagttcattgaatgtgaagatcctgtggaccacgtgggcaatgccacagccagccaggagctgggctacggctgcctgaagtttggaggccaggcctacagtgatgtggagcacacctctgtgcagtgccacgccctggatggcattgaatgtgccagccccaggaccttcctgcgggagaacaagccctgcatcaagtacacaggccactacttcatcaccaccctgctgtacagcttcttcctgggctgcttcggcgtggaccgcttctgcctgggccacactggaacagctgtgggcaagctgctgaccctgggcggcctgggcatctggtggtttgtggacctgatcctgctgatcaccggcggcctgatgcccagtgatggcagcaactggtgcaccgtgtactag

SEQ ID NO: 38856 - DNA, 516 bp, Artificial Sequence; identical to SEQ ID NO: 38855
  Description of Artificial Sequence: Synthetic coding sequence

SEQ ID NO: 38857 - DNA, 645 bp, Artificial Sequence
  Description of Artificial Sequence: Synthetic coding sequence
atggtgctgggcggctgccctgtgtcctacctgctgctgtgtggccaggccgccctgctgctgggcaacctgctgctgctgcactgtgtgagccgcagccacagccagaatgccacagctgagcctgagctgaccagcgctggagctgcccagcctgagggccctggaggagctgcctcctgggagtatggagacccccacagccctgtgatcctgtgcagctacctgcctgatgagttcattgaatgtgaggaccctgtggaccacgtgggcaatgccacagccagccaggagctgggctacggctgcctgaagtttggaggccaggcctacagtgatgtggagcacacctctgtgcagtgccacgccctggatggcattgaatgtgccagccccaggaccttcctgcgggagaacaagccctgcatcaagtacacaggccactacttcatcaccaccctgctgtacagcttcttcctgggctgctttggagtggaccgcttctgcctgggccacactggaacagctgtgggcaagctgctgaccctgggcggcctgggcatctggtggtttgtggacctgatcctgctgatcactggaggcctgatgcccagtgatggcagcaactggtgcaccgtgtactag

SEQ ID NO: 38858 - DNA, 516 bp, Artificial Sequence; identical to SEQ ID NO: 38855
  Description of Artificial Sequence: Synthetic coding sequence

SEQ ID NO: 38859 - DNA, 192 bp, Artificial Sequence
  Description of Artificial Sequence: Synthetic coding sequence
atgaagaagtgcctgctgcctgtgctgatcacctgcatgcagacagccatctgcaaggacaggatgatgatgatcatgatcctgctggtgaactacagaccagatgagttcattgaatgtgaagatcctgtggaccacgtgggcaatgccacagccagccaggagctgggctacggctgcctgaaggtgtag

SEQ ID NO: 38860 - DNA, 138 bp, Artificial Sequence
  Description of Artificial Sequence: Synthetic coding sequence
atgaagaagtgcctgctgcctgtgctgatcacctgcatgcagacagccatctgcaaggacaggatgatgatgatcatgatcctgctggtgaactacagaccagatgagttcattgaatgtgaagatcctgtggactag

SEQ ID NO: 38861 - DNA, 366 bp, Artificial Sequence
  Description of Artificial Sequence: Synthetic coding sequence
atgaagaagtgcctgctgcctgtgctgatcacctgcatgcagacagccatctgcaaggacaggatgatgatgatcatgatcctgctggtgaactacagaccagatgagttcattgaatgtgaagatcctgtggaccacgtgggcaatgccacagccagccaggagctgggctacggctgcctgaagtttggaggccaggcctacagtgatgtggagcacacctctgtgcagtgccacgccctggatggcattgaatgtgccagccccaggaccttcctgcgggagaacaagccctgcatcaagtacacaggccactacttcatcaccaccctgctgtacagcttcttcctgggctgcttcggctag

SEQ ID NO: 38862 - DNA, 1215 bp, Artificial Sequence
  Description of Artificial Sequence: Synthetic coding sequence
atgccccggcccggcagcgcccagcgctgggccgctgtggccggccgctggggctgccgcctgctggccctgctgctgctggtgcccggccctggaggagccagcgagatcacctttgagctgcctgacaatgccaagcagtgcttctatgaagatattgcccagggcaccaagtgcaccctggagttccaggtgatcactggaggccactatgatgtggactgccgcctggaggaccctgatggcaaggtgctgtacaaggagatgaagaagcagtatgacagcttcaccttcaccgccagcaagaatggcacctacaagttctgcttcagcaatgagttcagcaccttcacccacaagacagtgtactttgacttccaggtgggggaggaccccccactcttccccagcgagaacagagtgtctgccctgacccagatggagagcgcctgtgtgtccatccacgaggccctgaagagcgtcatcgactaccagacccacttccggctgcgggaggcccagggccgcagcagagctgaggacctgaacaccagggtggcctactggcacagcgtggacaccagccctggctaccatgaaagtgacagcaagaagtctgaggacctgagcctgtgcaatgtggccgagcacagcaacaccacagagggccccaccgggaagcaggagggcgcccagagcgtggaggagatgtttgaggaggaggccgaggaggaggtgttcctgaagtttgtgatcctgcatgctgaagatgacacagatgaggccctgcgggtgcagaacctgctgcaggatgactttggcatcaagccaggcatcatctttgctgagatgccctgtggccggcagcacctgcagaacctggatgatgctgtgaatggaagtgcctggaccatcctgctgctgacagagaacttcctgcgggacacctggtgcaacttccagttctacaccagcctgatgaacagcgtgaaccggcagcacaagtacaacagcgtcatccccatgaggcccctgaacaaccccctgccccgggagaggaccccatttgccctgcagaccatcaatgccctggaggaggagagccggggcttccccacccaggtggagcgcatcttccaggagagcgtgtacaagacccagcagaccatctggaaggagaccaggaacatggtgcagaggcagttcatcgcctag

SEQ ID NO: 38863 - DNA, 567 bp, Artificial Sequence
  Description of Artificial Sequence: Synthetic coding sequence
atgccccggcccggcagcgcccagcgctgggccgctgtggccggccgctggggctgccgcctgctggccctgctgctgctggtgcccggccctggaggagccagcgagatcacctttgagctgcctgacaatgccaagcagtgcttctatgaagatattgcccagggcaccaagtgcaccctggagttccaggtgatcactggaggccactatgatgtggactgccgcctggaggaccctgatggcaaggtgctgtacaaggagatgaagaagcagtatgacagcttcaccttcaccgccagcaagaatggcacctacaagttctgcttcagcaatgagttcagcaccttcacccacaagacagtgtactttgacttccaggtgggggaggaccccccactcttccccagcgagaacagagtgtctgccctgacccagatggagagcgcctgtgtgtccatccacgaggccctgaagagcgtcatcgactaccagacccacttccggctgcgggaggcccagggccgcagcagagctgaggacctgaacaccagggtggcctactag

SEQ ID NO: 38864 - DNA, 375 bp, Artificial Sequence
  Description of Artificial Sequence: Synthetic coding sequence
atgcctgtgcggggcccagatgtggaggcctactgcctgcgctgtgagtgcaagtatgaggagaggagctctgtgaccatcaaggtgaccatcatcatctacctgagcatcctgggcctgctgctgctgtacatggtgtacctgaccctggtggagcccatcctgaagagaagactctttggccacgcccagctgatccagagtgatgatgacatcggggaccaccagccctttgccaatgcccatgatgtgctggcccggagccgcagccgggccaacgtgctgaacaaggtggagtatgcccagcagcgctggaagctgcaggtgcaggagcagaggaagtctgtgtttgacagacatgtggtgctgtcctag

SEQ ID NO: 38865 - DNA, 375 bp, Artificial Sequence; identical to SEQ ID NO: 38864
  Description of Artificial Sequence: Synthetic coding sequence

SEQ ID NO: 38866 - DNA, 597 bp, Artificial Sequence
  Description of Artificial Sequence: Synthetic coding sequence
atggccaccctgtggggcggcctgctgcggctgggcagcctgctgagcctgagctgcctggccctgtctgtgctgctgctggcccagctgagtgatgctgccaagaactttgaagatgtgcgctgcaagtgcatctgccccccctacaaggaaaattctggccacatctacaacaagaacatcagccagaaggactgtgactgcctgcacgtggtggagcccatgcctgtgcggggcccagatgtggaggcctactgcctgcgctgtgagtgcaagtatgaggagaggagctctgtgaccatcaaggtgaccatcatcatctacctgagcatcctgggcctgctgctgctgtacatggtgtacctgaccctggtggagcccatcctgaagagaagactctttggccacgcccagctgatccagagtgatgatgacatcggggaccaccagccctttgccaatgcccatgatgtgctggcccggagccgcagccgggccaacgtgctgaacaaggtggagtatgcccagcagcgctggaagctgcaggtgcaggagcagaggaagtctgtgtttgacagacatgtggtgctgtcctag

SEQ ID NO: 38867 - DNA, 318 bp, Artificial Sequence
  Description of Artificial Sequence: Synthetic coding sequence
atgtacagacctgtgatggccagctgcacctctgtgtccctgtggatgattgccctgctggtgtttggagtgctggccatcttcggcatcaccatcggcctgctggtgcacttcctggccgtggccaaccgcatctacttctaccagggcagcttcaagatgctggacatcccctacaacagcaactatgagcgggagaccagccctgagaacaactacctgagccagatcctggagacccgctggctgatgcacttcaaggtgctggccttcacagacaacatctccttcctgaagagcagccactggtgcaagtag

SEQ ID NO: 38868 - DNA, 1413 bp, Artificial Sequence
  Description of Artificial Sequence: Synthetic coding sequence
atgcctggctttgactacaagttcctggagaagcccaagaggcggctgctgtgccccctgtgtgggaagcccatgagggagcctgtgcaggtgtccacctgtggccaccgcttctgtgacacctgcctgcaggagttcctgtctgagggcgtcttcaagtgcccagaggaccagctgcccctggactatgccaagatctacccagaccctgagctggaggtgcaggtgctgggcctgcccatccgctgcatccacagcgaggagggctgccgctggagcggccccctgcggcacctgcagggccacctgaacacctgcagcttcaacgtcatcccctgccccaaccgctgccccatgaagctgagcagaagagacctgcctgcccacctgcagcacgactgccccaagaggcggctgaagtgtgagttctgtggctgtgacttctctggagaggcctatgagagccatgagggcatgtgcccccaggagagcgtgtactgtgagaacaagtgtggggccaggatgatgaggcggctgctggcccagcacgccaccagtgaatgtcccaagaggacccagccctgcacctactgcaccaaggagtttgtgtttgacaccatccagagccaccagtaccagtgcccccggctgcctgtggcctgccccaaccagtgtggggtgggcaccgtggcccgggaggacctgcccggccacctgaaggacagctgcaacacagccctggtgctgtgccccttcaaggacagcggctgcaagcaccgctgccccaagctggccatggcccggcacgtggaggagagcgtgaagccccacctggccatgatgtgtgccctggtgtcccggcagaggcaggagctgcaggagctgcggcgggagctggaggagctgtctgtgggcagtgatggagtgctgatctggaagattggcagctatggaagaaggctgcaggaggccaaggccaagcccaacctggagtgcttctccccagccttctacacccacaagtatggctacaagctgcaggtgtctgccttcctgaatggaaatggaagtggagagggcacccacctgagcctgtacatccgggtgctgcccggggcctttgacaacctgctggagtggccctttgcccggcgggtgaccttcagcctgctggaccagagcgaccccggcctggccaagccccagcacgtgacagagaccttccacccagaccccaactggaagaacttccagaagccaggcacctggaggggcagcctggatgagagcagcctgggcttcggctaccccaagttcatcagccaccaggacatcaggaagaggaactacgtgagagatgatgctgtgttcatccgggctgctgtggagctgcccaggaagatcctgtcctag

SEQ ID NO: 38869 - DNA, 588 bp, Artificial Sequence
  Description of Artificial Sequence: Synthetic coding sequence
atgcctggctttgactacaagttcctggagaagcccaagaggcggctgctgtgccccctgtgtgggaagcccatgagggagcctgtgcaggtgtccacctgtggccaccgcttctgtgacacctgcctgcaggagttcctgtctgagggcgtcttcaagtgcccagaggaccagctgcccctggactatgccaagatctacccagaccctgagctggaggtgcaggtgctgggcctgcccatccgctgcatccacagcgaggagggctgccgctggagcggccccctgcggcacctgcagggccacctgaacacctgcagcttcaacgtcatcccctgccccaaccgctgccccatgaagctgagcagaagagacctgcctgcccacctgcagcacgactgccccaagaggcggctgaagtgtgagttctgtggctgtgacttctctggagaggcctatgagagcagcctgggcttcggctaccccaagttcatcagccaccaggacatcaggaagagaaattatgtgagagatgatgctgtgttcatccgggctgctgtggagctgcccaggaagatcctgtcctag

SEQ ID NO: 38870 - DNA, 504 bp, Artificial Sequence
  Description of Artificial Sequence: Synthetic coding sequence
atgcctggctttgactacaagttcctggagaagcccaagaggcggctgctgtgccccctgtgtgggaagcccatgagggagcctgtgcaggtgtccacctgtggccaccgcttctgtgacacctgcctgcaggtgtctgccttcctgaatggaaatggcagcggggagggcacccacctgagcctgtacatccgggtgctgcccggggcctttgacaacctgctggagtggccctttgcccggcgggtgaccttcagcctgctggaccagagcgaccccggcctggccaagccccagcacgtgacagagaccttccacccagaccccaactggaagaacttccagaagccaggcacctggaggggcagcctggatgagagcagcctgggcttcggctaccccaagttcatcagccaccaggacatcaggaagagaaattatgtgagagatgatgctgtgttcatccgggctgctgtggagctgcccaggaagatcctgtcctag

SEQ ID NO: 38871 - DNA, 435 bp, Artificial Sequence
  Description of Artificial Sequence: Synthetic coding sequence
atgcctggctttgactacaagttcctggagaagcccaagaggcggctgctgtgccccctgtgtgggaagcccatgagggagcctgtgcaggtgtccacctgtggccaccgcttctgtgacacctgcctgcaggagttcctgtctgagggcgtcttcaagtggccctttgcccggcgggtgaccttcagcctgctggaccagagcgaccccggcctggccaagccccagcacgtgacagagaccttccacccagaccccaactggaagaacttccagaagccaggcacctggaggggcagcctggatgagagcagcctgggcttcggctaccccaagttcatcagccaccaggacatcaggaagaggaactacgtgagagatgatgctgtgttcatccgggctgctgtggagctgcccaggaagatcctgtcctag

SEQ ID NO: 38872 - DNA, 549 bp, Artificial Sequence
  Description of Artificial Sequence: Synthetic coding sequence
atgcctggctttgactacaagttcctggagaagcccaagaggcggctgctgtgccccctgtgtgggaagcccatgagggagcctgtgcaggtgtccacctgtggccaccgcttctgtgacacctgcctgcaggagttcctgtctgagggcgtcttcaagtgcccagaggaccagctgcccctggactatgccaagttcccccacccctacccccagatctacccagaccctgagctggaggtgcaggtgctgggcctgcccatccgctgcatccacagcgaggagggctgccgctggagcggccccctgcggcacctgcagggccacctgaacacctgcagcttcaacgtcatcccctgccccaaccgctgccccatgaagctgagccggcgggacctgcctgcccacctgcagcacgactgccccaagaggcggctgaagtgtgagttctgtggctgtgacttcagcggggaggcctatgagagccatgagggcatgtgcccccaggagagcgtgtactgtgaaaataaatgtggggccaggatgtag

SEQ ID NO: 38873 - DNA, 1179 bp, Artificial Sequence
  Description of Artificial Sequence: Synthetic coding sequence
atgcctggctttgactacaagttcctggagaagcccaagaggcggctgctgtgccccctgtgtgggaagcccatgagggagcctgtgcaggtgtccacctgtggccaccgcttctgtgacacctgcctgcaggagttcctgtctgagggcgtcttcaagtgcccagaggaccagctgcccctggactatgccaagatctacccagaccctgagctggaggtgcaggtgctgggcctgcccatccgctgcatccacagcgaggagggctgccgctggagcggccccctgcggcacctgcagggccacctgaacacctgcagcttcaacgtcatcccctgccccaaccgctgccccatgaagctgagcagaagagacctgcctgcccacctgcagcacgactgccccaagaggcggctgaagtgtgagttctgtggctgtgacttctctggagaggcctatgagagccatgagggcatgtgcccccaggagagcgtgtactgtgagaacaagtgtggggccaggatgatgaggcggctgctggcccagcacgccaccagtgaatgtcccaagaggacccagccctgcacctactgcaccaaggagtttgtgtttgacaccatccagagccaccagtaccagtgcccccggctgcctgtggcctgccccaaccagtgtggggtgggcaccgtggcccgggaggacctgcccggccacctgaaggacagctgcaacacagccctggtgctgtgccccttcaaggacagcggctgcaagcaccgctgccccaagctggccatggcccggcacgtggaggagagcgtgaagccccacctggccatgatgtgtgccctggtgtcccggcagaggcaggagctgcaggagctgcggcgggagctggaggagctgtctgtgggcagtgatggagtgctgatctggaagattggcagctatggaagaaggctgcaggaggccaaggccaagcccaacctggagtgcttctccccagccttctacacccacaagtatggctacaagctgcaggtgtctgccttcctgaatggaaatggaagtggagagggcacccacctgagcctgtacatccgggtgctgcccggggcctttgacaacctgctggagtggccctttgcccggcgggtgaccttcagcctgctgggctag

SEQ ID NO: 38874 - DNA, 597 bp, Artificial Sequence
  Description of Artificial Sequence: Synthetic coding sequence
atgcctggctttgactacaagttcctggagaagcccaagaggcggctgctgtgccccctgtgtgggaagcccatgagggagcctgtgcaggtgtccacctgtggccaccgcttctgtgacacctgcctgcaggagttcctgtctgagggcgtcttcaagtgcccagaggaccagctgcccctggactatgccaagatctacccagaccctgagctggaggtgcaggtgctgggcctgcccatccgctgcatccacagcgaggagggctgccgctggagcggccccctgcggcacctgcagggccacctgaacacctgcagcttcaacgtcatcccctgccccaaccgctgccccatgaagctgagcagaagagacctgcctgcccacctgcagcacgactgccccaagaggcggctgaagtgtgagttctgtggctgtgacttctctggagaggcctatgagagccatgagagcagcctgggcttcggctaccccaagttcatcagccaccaggacatcaggaagaggaactacgtgagagatgatgctgtgttcatccgggctgctgtggagctgcccaggaagatcctgtcctag

SEQ ID NO: 38875 - DNA, 2436 bp, Artificial Sequence
  Description of Artificial Sequence: Synthetic coding sequence
atgaggctcatccggaacatctacatcttctgcagcatcgtgatgacagcagaaggagatgcccctgagctgcctgaggagcgggagctgatgaccaactgcagcaacatgagcctgaggaaggtgcctgctgacctgaccccagccaccaccaccctggacctgagctacaacctgctcttccagctgcagagcagtgacttccacagcgtgtccaagctgcgggtgctgatcctgtgccacaaccgcatccagcagctggacctgaagacctttgagttcaacaaggagctgcgctacctggacctgagcaacaaccggctgaagtctgtgacctggtacctgctggccggcctgcgctacctggacctgtccttcaatgactttgacaccatgcccatctgtgaggaggccggcaacatgagccacctggagatcctgggcctgagcggggccaagatccagaagagtgacttccagaagatcgcccacctgcacctgaacacagtgttcctgggcttccgcaccctgccccactatgaggagggcagcctgcccatcctgaacaccaccaagctgcacatcgtgctgcccatggacaccaacttctgggtgctgctgagagatggcatcaagaccagcaagatcctggagatgaccaacattgatggcaagagccagtttgtgtcctatgagatgcagaggaacctgagcctggagaatgccaagacctctgtgctgctgctgaacaaggtggacctgctgtgggatgacctcttcctgatcctgcagtttgtgtggcacacctctgtggagcacttccagatcagaaatgtgacctttggaggcaaggcctacctggaccacaacagctttgactacagcaacacagtgatgaggaccatcaagctggagcacgtgcacttccgggtcttctacatccagcaggacaagatctacctgctgctgaccaagatggacatcgagaacctgaccatcagcaatgcccagatgccccacatgctgttccccaactaccccaccaagttccagtacctgaactttgccaacaacatcctgacagatgagctgttcaagaggaccatccagctgccccacctgaagaccctcatcctgaatggaaacaagctggagaccctgagcctggtgtcctgctttgccaacaacacccccctggagcacctggacctgagccagaacctgctgcagcacaagaatgatgagaactgctcctggccagagaccgtggtgaacatgaacctgagctacaacaagctgagtgacagcgtcttccgctgcctgcccaagagcatccagatcctggacctgaacaacaaccagatccagacagtgcccaaggagaccatccacctgatggccctgcgggagctgaacatcgccttcaacttcctgacagacctgcccggctgcagccacttcagccggctgtctgtgctgaacatcgagatgaacttcatcctgagccccagcctggactttgtgcagagctgccaggaggtgaagaccctgaatgccggcaggaaccccttccgctgcacctgtgagctgaagaacttcatccagctggagacctacagcgaggtgatgatggtgggctggagcgacagctacacctgtgagtaccccctgaacctgcggggcacccggctgaaggatgtgcacctgcacgagctgagctgcaacacagccctgctgattgtgaccatcgtggtgatcatgctggtgctgggcctggccgtggccttctgctgcctgcactttgacctgccctggtacctgaggatgctgggccagtgcacccagacctggcaccgggtgaggaagaccacccaggagcagctgaagagaaatgtgcgcttccacgccttcatctcctacagcgagcatgacagcctgtgggtgaagaatgagctgatccccaacctggagaaggaggatggcagcatcctgatctgcctgtatgagagctactttgaccccgggaagagcatcagcgagaacatcgtgtccttcatcgagaagagctacaagagcatctttgtgctgagccccaactttgtgcagaatgagtggtgccactatgagttctactttgcccaccacaacctcttccacgagaacagcgaccacatcatcctgatcctgctggagcccatccccttctactgcatccccacccgctaccacaagctgaaggccctgctggagaagaaggcctacctggagtggcccaaggacagaagaaaatgtggcctcttctgggccaacctgcgggccgccatcaacgtgaatgtgctggccacccgggagatgtatgagctgcagaccttcacagagctgaatgaggagagccggggcagcaccatcagcctgatgaggacagactgcctgtag

SEQ ID NO: 38876 - DNA, 2436 bp, Artificial Sequence; identical to SEQ ID NO: 38875
  Description of Artificial Sequence: Synthetic coding sequence

SEQ ID NO: 38877 - DNA, 2436 bp, Artificial Sequence; identical to SEQ ID NO: 38875
  Description of Artificial Sequence: Synthetic coding sequence

SEQ ID NO: 38878 - DNA, 2436 bp, Artificial Sequence; identical to SEQ ID NO: 38875
  Description of Artificial Sequence: Synthetic coding sequence

SEQ ID NO: 38879 - DNA, 1215 bp, Artificial Sequence; identical to SEQ ID NO: 38862
  Description of Artificial Sequence: Synthetic coding sequence

SEQ ID NO: 38880 - DNA, 708 bp, Artificial Sequence
  Description of Artificial Sequence: Synthetic coding sequence
atgggcatcggcaagagcaagatcaacagctgccccctgagcctgtcctggggcaagaggcacagcgtggacaccagccctggctaccacgagagtgacagcaagaagtctgaggacctgagcctgtgcaatgtggccgagcacagcaacaccacagagggccccaccgggaagcaggagggcgcccagagcgtggaggagatgtttgaggaggaggccgaggaggaggtgttcctgaagtttgtgatcctgcacgcagaagatgacacagatgaggccctgcgggtgcagaacctgctgcaggatgactttggcatcaagccaggcatcatctttgctgagatgccctgtggccggcagcacctgcagaacctggatgatgctgtgaatggcagcgcctggaccatcctgctgctgacagagaacttcctgcgggacacctggtgcaacttccagttctacaccagcctgatgaacagcgtgaaccggcagcacaagtacaacagcgtcatccccatgaggcccctgaacaaccccctgccccgggagaggaccccatttgccctgcagaccatcaatgccctggaggaggagagccggggcttccccacccaggtggagcgcatcttccaggagagcgtgtacaagacccagcagaccatctggaaggagaccaggaacatggtgcagaggcagttcatcgcctag

SEQ ID NO: 38881 - DNA, 1137 bp, Artificial Sequence
  Description of Artificial Sequence: Synthetic coding sequence
atggctggagatggccggcgggcagaggccgtgcgggagggctggggcgtgtatgtgaccccccgggcccccatccgggagggccggggccgcctggccccccagaatggaggcagcagtgatgccccagcctaccgcaccccacccagccggcagggccggcgggaggtgcgcttcagtgatgagcccccagaggtgtatggagactttgagcccctggtggccaaggagaggagccctgtgggcaagaggacccggctggaggagttcagaagtgacagcgccaaggaggaggtgcgggagagcgcctactacctgcggagccggcagaggcggcagccccggccccaggagacagaggagatgaagaccaggaggaccacccggctgcagcagcagcacagcgagcagccccccctgcagcccagccctgtgatgacccggcggggcctgcgggacagccacagcagtgaagaagatgaggccagcagccagacagacctgagccagaccatcagcaagaagacagtgcgcagcatccaggaggcccctgtgtctgaggacctggtgatccggctgcggcggccccccctgcgctaccccaggtatgaggccacctctgtgcagcagaaggtgaacttcagcgaggagggggagacagaggaggatgaccaggacagcagccacagctctgtgaccaccgtgaaggcccggagccgggacagtgatgaaagtggggacaagaccaccaggagcagcagccagtacatcgagagcttctggcagagcagccagagccagaacttcaccgcccatgacaagcagcccagcgtgctgagcaagggcagcaccctcatcttctacaagtactgtgaccatgaaaatgctgccttcaaggatgtggccctggtgctgactgtgctgctggaggaggagaccctgggcaccagcctgggcctgaaggaggtggaggagaaggtgcgggacttcctgaaggtgaagttcaccaacagcaacacccccaacagctacaaccacatggaccctgacaagctgaatggcctgtggagccgcatcagccacctggtgctgcctgtgcagccagaaaatgccctgaagaggggcatctgcctgtag

SEQ ID NO: 38882 - DNA, 1752 bp, Artificial Sequence
  Description of Artificial Sequence: Synthetic coding sequence
atggctggagatggccggcgggcagaggccgtgcgggagggctggggcgtgtatgtgaccccccgggcccccatccgggagggccggggccgcctggccccccagaatggaggcagcagtgatgccccagcctaccgcaccccacccagccggcagggccggcgggaggtgcgcttcagtgatgagcccccagaggtgtatggagactttgagcccctggtggccaaggagaggagccctgtgggcaagaggacccggctggaggagttcagaagtgacagcgccaaggaggaggtgcgggagagcgcctactacctgcggagccggcagaggcggcagccccggccccaggagacagaggagatgaagaccaggaggaccacccggctgcagcagcagcacagcgagcagccccccctgcagcccagccctgtgatgacccggcggggcctgcgggacagccacagcagtgaagaagatgaggccagcagccagacagacctgagccagaccatcagcaagaagacagtgcgcagcatccaggaggcccctgtgtctgaggacctggtgatccggctgcggcggccccccctgcgctaccccaggtatgaggccacctctgtgcagcagaaggtgaacttcagcgaggagggggagacagaggaggatgaccaggacagcagccacagctctgtgaccaccgtgaaggcccggagccgggacagtgatgaaagtggggacaagaccaccaggagcagcagccagtacatcgagagcttctggcagagcagccagagccagaacttcaccgcccatgacaagcagcccagcgtgctgagcagcggctaccagaagaccccccaggagtgggccccccagacagcccgcatccgcaccaggatgcagaatgacagcatcctgaagtctgagctgggcaaccagagccccagcaccagcagccggcaggtgacaggccagccccagaatgccagctttgtgaagaggaaccgctggtggctgctgcccctgattgctgccctggccagcggcagcttctggttcttcagcaccccagaggtggagaccacagctgtgcaggagttccagaaccagatgaaccagctgaagaacaagtaccagggccaggatgagaagctgtggaagaggagccagaccttcctggagaagcacctgaacagcagccaccccaggagccagcctgccatcctgctgctgacagctgccagagatgctgaggaggccctgcgctgcctgtctgagcagattgctgatgcctacagcagcttccgctctgtgcgggccatcagaattgatggaacagacaaggccacccaggacagcgacacagtgaagctggaggtggaccaggagctgagcaatggcttcaagaatggccagaatgctgctgtggtgcacagatttgagagcttccctgctggcagcaccctcatcttctacaagtactgtgaccatgaaaatgctgccttcaaggatgtggccctggtgctgactgtgctgctggaggaggagaccctgggcaccagcctgggcctgaaggaggtggaggagaaggtgcgggacttcctgaaggtgaagttcaccaacagcaacacccccaacagctacaaccacatggaccctgacaagctgaatggcctgtggagccgcatcagccacctggtgctgcctgtgcagccagaaaatgccctgaagaggggcatctgcctgtag

SEQ ID NO: 38883 - DNA, 1413 bp, Artificial Sequence
  Description of Artificial Sequence: Synthetic coding sequence
atggctgacagcggcctgcgggagccccaggaggacagccagaaggacctggagaatgaccccagcgtgaacagccaggcccaggagaccaccatcatcgccagcaatgctgaggaggccgagatcctgcacagcgcctgtggcctgagcaaggaccaccaggaggtggagacagagggccctgagagcgctgacaccggggacaagtctgagagcccagatgaggccaacgtgggcaagcaccccaaggacaagacagaagatgagaacaagcagagcttcctggatggcggcaagggccaccacctgcccagcgagaacctgggcaaggagcccctggaccctgaccccagccacagccccagcgacaaggtgggccgggcagatgcccacctgggcagcagctctgtggccctgcccaaggaggccagtgatggcactggagccagccaggagccccccaccacagacagccaggaggcccagagccctggccacagcagcgctggccaggagggggaggacaccctgcggcggcggctgctggcccctgaggccggcagccacccccagcagacccagaagctggaggagatcaaggaaaatgcccaggacaccatgaggcagatcaacaagaagggcttctggagctatggccctgtgatcctggtggtgctggtggtggccgtggtggccagctctgtgaacagctactacagcagccctgcccagcaggtgcccaagaacccagccctggaggccttcctggcccagttcagccagctggaggacaagtttcctggccagagcagcttcctgtggcagaggggcaggaagttcctgcagaagcacctgaatgccagcaaccccacagagcccgccaccatcatcttcaccgctgcccgggagggccgggagaccctgaagtgcctgagccaccacgtggctgatgcctacaccagcagccagaaggtgagccccatccagattgatggagctggccgcacctggcaggacagcgacacagtgaagctgctggtggacctggagctgtcctatggctttgaaaatggccagaaggctgctgtggtgcaccactttgagagcttccctgctggcagcaccctcatcttctacaagtactgtgaccatgaaaatgctgccttcaaggatgtggccctggtgctgactgtgctgctggaggaggagaccctggaggcctctgtgggcccccgggagacagaggagaaggtgcgggacctgctgtgggccaagttcaccaacagcgacacccccaccagcttcaaccacatggacagcgacaagctgagcggcctgtggagccgcatcagccacctggtgctgcctgtgcagcctgtgagcagcattgaggagcagggctgcctcttctag

SEQ ID NO: 38884 - DNA, 1014 bp, Artificial Sequence
  Description of Artificial Sequence: Synthetic coding sequence
atgagagctgtgttcatccagggcgctgaggagcaccctgctgccttctgctaccaggtgaatggcagctgccccaggacagtgcacaccctgggcatccagctggtgatctacctggcctgtgccgccggcatgctgatcatcgtgctgggcaatgtgtttgtggcctttgctgtgtcctacttcaaggccctgcacacccccaccaacttcctgctgctgagcctggccctggccgacatgttcctgggcctgctggtgctgcccctgagcaccatccgctctgtggagagctgctggttcttcggggacttcctgtgccgcctgcacacctacctggacaccctcttctgcctgaccagcatcttccacctgtgcttcatcagcattgacagacactgtgccatctgtgaccccctgctgtaccccagcaagttcaccgtgcgggtggccctgcgctacatcctggccggctggggcgtgcctgctgcctacaccagcctcttcctgtacacagatgtggtggagacccggctgagccagtggctggaggagatgccctgtgtgggcagctgccagctgctgctgaacaagttctggggctggctgaacttccccctcttctttgtgccctgcctgatcatgatcagcctgtatgtgaagatctttgtggtggccacccggcaggcccagcagatcaccaccctgagcaagagcctggccggggccgccaagcatgagaggaaggccgccaagaccctgggcattgctgtgggcatctacctgctgtgctggctgcccttcaccatcgacaccatggtggacagcctgctgcacttcatcaccccacccctggtgtttgacatcttcatctggtttgcctacttcaacagcgcctgcaaccccatcatctacgtgttctcctaccagtggttcaggaaggccctgaagctgaccctgagccagaaggtgttcagcccccagaccaggacagtggacctgtaccaggagtag

SEQ ID NO: 38885 - DNA, 1029 bp, Artificial Sequence
  Description of Artificial Sequence: Synthetic coding sequence
atgaccagcaacttcagccagcctgtggtgcagctgtgctatgaagatgtgaatggcagctgcatcgagaccccctacagccctggcagcagggtcatcctgtacacagccttctcctttggcagcctgctggccgtgtttggaaacctgctggtgatgacctctgtgctgcacttcaagcagctgcacagccccaccaacttcctgattgccagcctggcctgtgccgacttcctggtgggcgtgacagtgatgctgttctccatggtgaggacagtggagagctgctggtactttggagccaagttctgcaccctgcacagctgctgtgatgtggccttctgctacagctctgtgctgcacctgtgcttcatctgcatcgaccgctacatcgtggtgacagaccccctggtgtatgccaccaagttcaccgtgtctgtgtctggcatctgcatctctgtgtcctggatcctgcccctgacctacagcggggctgtgttctacacaggagtgaatgatgatggcctggaggagctggtgtctgccctgaactgtgtgggcggctgccagatcatcgtgtcccagggctgggtgctgattgacttcctgctcttcttcatccccaccctggtgatgatcatcctgtacagcaagatcttcctgattgccaagcagcaggccatcaagattgagaccaccagcagcaaggtggagagcagcagcgagagctacaagatccgggtggccaagcgggagaggaaggccgccaagaccctgggcgtgacagtgctggccttcgtcatctcctggctgccctacacagtggacatcctgattgatgccttcatgggcttcctgaccccagcctacatctatgagatctgctgctggagcgcctactacaacagcgccatgaaccccctcatctatgccctcttctacccctggttcaggaaggccatcaagctgatcctgtctggagatgtgctgaaggccagcagcagcaccatcagcctcttcctggagtag

SEQ ID NO: 38886 - DNA, 3780 bp, Artificial Sequence
  Description of Artificial Sequence: Synthetic coding sequence
atggatgccagcgaggagcccctgccccctgtgatctacaccatggagaacaagcccatcgtgacctgtgccggggaccagaacctcttcacctctgtgtaccccaccctgagccagcagctgccccgggagcccatggagtggaggaggagctatggccgggcccccaagatgatccacctggagagcaactttgtgcagttcaaggaggagctgctgcccaaggagggcaacaaggccctgctgaccttccccttcctgcacatctactggacagagtgctgtgacacagaggtgtacaaggccaccgtgaaggatgacctgaccaagtggcagaatgtgctgaaggcccacagctctgtggactggctgattgtgattgtggagaatgatgccaagaagaagaacaagaccaacatcctgcccaggaccagcatcgtggacaagatcagaaatgacttctgcaacaagcagagcgacagatgtgtggtgctgagtgaccccctgaaggacagcagcaggacccaggagagctggaatgccttcctgaccaagctgcggaccctgctgctgatgtccttcaccaagaacctgggcaagtttgaagatgacatgaggaccctgcgggagaagaggacagagcccggctggagcttctgtgagtacttcatggtgcaggaggagctggcctttgtgtttgagatgctgcagcagtttgaagatgccctggtgcagtatgatgagctggatgccctcttcagccagtatgtggtgaactttggagctggagatggagccaactggctgaccttcttctgccagcctgtgaagtcctggaatggcctcatcctgaggaagcccatcgacatggagaagcgggagagcatccagaggcgggaggccaccctgctggacctgcggagctacctgttcagccggcagtgcaccctgctgctcttcctgcagaggccctgggaggtggcccagagggccctggagctgctgcacaactgtgtgcaggagctgaagctgctggaggtgtctgtgcccccaggggccctggactgctgggtgttcctgagctgcctggaggtgctgcagagaattgagggctgctgtgaccgggcccagattgacagcaacatcgcccacacagtgggcctgtggagctatgccacagagaagctgaagagcctgggctacctgtgtggcctggtgtctgagaagggccccaacagcgaggacctgaacagaacagtggacctgctggccggcctgggcgctgagaggcctgagacagccaacacagcccagagcccctacaagaagctgaaggaggccctgagctctgtggaggcctttgagaagcactacctggacctgagccacgccaccatcgagatgtacaccagcatcggccgcatccgcagcgccaagtttgtgggcaaggacctggccgagttctacatgaggaagaaggccccccagaaggccgagatctacctgcagggcgccctgaagaactacctggccgagggctgggccctgcccatcacccacaccaggaagcagctggccgagtgccagaagcacctgggccagatcgagaactacctgcagaccagcagcctgctggccagtgaccaccacctgacagaggaggagaggaagcacttctgccaggagatcctggactttgccagccagcccagcgacagccctggccacaagatcgtgctgcccatgcacagctttgcccagctgcgggacctgcactttgaccccagcaatgctgtggtgcacgtgggcggcgtgctgtgtgtggagatcaccatgtacagccagatgcctgtgcctgtgcacgtggagcagatcgtggtgaatgtgcacttcagcattgagaagaacagctacaggaagacagctgagtggctgaccaagcacaagaccagcaatggcatcatcaacttccccccagagacagcccccttccctgtgtcccagaacagcctgcctgccctggagctgtatgagatgtttgagaggagccccagcgacaacagcctgaacaccaccggcatcatctgcagaaatgtgcacatgctgctgcggcggcaggagagcagcagcagcctggagatgcccagcggcgtggccctggaggagggcgcccacgtgctgcgctgcagccacgtgaccctggagcccggggccaaccagatcaccttccgcacccaggccaaggagcccggcacctacaccctgcggcagctgtgtgcctctgtgggctctgtgtggtttgtgctgccccacatctaccccatcgtgcagtatgatgtgtacagccaggagccccagctgcacgtggagcccctggccgacagcctgctggccggcatcccccagagggtgaagttcaccgtgaccaccggccactacaccatcaagaatggagacagcctgcagctgagcaatgctgaggccatgctgatcctgtgccaggccgagagcagagctgtggtgtacagcaacacccgggagcagagcagcgaggccgccctgcgcatccagagcagtgacaaggtgaccagcatcagcctgcctgtggccccagcctaccacgtgattgaatttgagctggaggtgctgagcctgcccagcgccccagccctgggcggggagagtgacatgctgggcatggccgagccccacaggaagcacaaggacaagcagaggacaggccgctgcatggtgaccacagaccacaaggtgtccattgactgcccctggagcatctacagcacagtgattgccctgaccttctctgtgcccttccgcaccacccacagcctgctgagcagcggcaccaggaaatatgtgcaggtgtgtgtgcagaacctgtctgagctggacttccagctgagtgacagctacctggtggacaccggggacagcacagacctgcagctggtgcccctgaacacccagagccagcagcccatctacagcaagcagagcgtcttctttgtgtgggagctgaagtggacagaggagcccccacccagcctgcactgccgcttctctgtgggcttctccccagccagcgaggagcagctgagcatcagcctgaagccctacacctatgagttcaaggtggagaacttcttcaccctgtacaacgtgaaggccgagatcttccccccatctggcatggagtactgcaggacaggcagcctgtgcagcctggaggtgctgatcacccggctgagtgacctgctggaggtggacaaggatgaggccctgacagaaagtgatgagcacttcagcaccaagctgatgtatgaggtggtggacaacagcagcaactgggccgtgtgtgggaagagctgtggggtcatctccatgcctgtggccgcccgggccacccaccgggtgcacatggaggtgatgcccctgtttgctggctacctgcccctgcctgatgtgcggctcttcaagtacctgccccaccacagcgcccacagcagccagctggatgctgacagctggattgaaaatgacagcctgtctgtggacaagcatggagatgaccagcctgacagcagcagcctgaagagccggggctctgtgcacagcgcctgcagcagcgagcacaagggcctgcccatgccccggctgcaggccctgcctgctggccaggtgttcaacagcagcagcggcacccaggtgctggtgatccccagccaggatgaccacgtgctggaggtgtctgtgacctag

SEQ ID NO: 38887 - DNA, 1173 bp, Artificial Sequence
  Description of Artificial Sequence: Synthetic coding sequence
atgctgatcctgtgccaggccgagagcagagctgtggtgtacagcaacacccgggccccagccctgggcggggagagtgacatgctgggcatggccgagccccacaggaagcacaaggacaagcagaggacaggccgctgcatggtgaccacagaccacaaggtgtccattgactgcccctggagcatctacagcaccgtcatcgccctgaccttctctgtgcccttccgcaccacccacagcctgctgagcagcggcaccaggaaatatgtgcaggtgtgtgtgcagaacctgtctgagctggacttccagctgagtgacagctacctggtggacacaggagacagcacagacctgcagctggtgcccctgaacacccagagccagcagcccatctacagcaagcagagcgtcttctttgtgtgggagctgaagtggacagaggagcccccacccagcctgcactgccgcttctctgtgggcttcagccctgccagcgaggagcagctgagcatcagcctgaagccctacacctatgagttcaaggtggagaacttcttcaccctgtacaacgtgaaggccgagatcttcccccccagcggcatggagtactgcaggacaggcagcctgtgcagcctggaggtgctgatcacccggctgagtgacctgctggaggtggacaaggatgaggccctgacagaaagtgatgagcacttcagcaccaagctgatgtatgaggtggtggacaacagcagcaactgggccgtgtgtgggaagagctgtggggtcatctccatgcctgtggccgcccgggccacccaccgggtgcacatggaggtgatgcccctgtttgctggctacctgcccctgcctgatgtgcggctcttcaagtacctgccccaccacagcgcccacagcagccagctggatgctgacagctggattgaaaatgacagcctgtctgtggacaagcatggagatgaccagcctgacagcagcagcctgaagagccggggctctgtgcacagcgcctgcagcagcgagcacaagggcctgcccatgccccggctgcaggccctgcctgctggccaggtgttcaacagcagcagcggcacccaggtgctggtgatccccagccaggatgaccacgtgctggaggtgtctgtgacctag

SEQ ID NO: 38888 - DNA, 423 bp, Artificial Sequence
  Description of Artificial Sequence: Synthetic coding sequence
atgagcggcagcttctactttgtgattgtgggccaccacgacaaccctgtgtttgagatggagttcctgcctgctgggaaggccgagagcaaggatgaccaccgccacctgaaccagttcatcgcccacgccgccctggacctggtggatgagaacatgtggctgagcaacaacatgtacctgaagacagtggacaagttcaatgagtggtttgtgtctgcctttgtgacagctggccacatgaggttcatcatgctgcatgacatccggcaggaggatggcatcaagaacttcttcacagatgtgtatgacctgtacatcaagttctccatgaaccccttctatgagcccaacagccccatccgcagcagcgcctttgacaggaaggtgcagttcctgggcaagaagcacctgctgtcctag

SEQ ID NO: 38889 - DNA, 567 bp, Artificial Sequence
  Description of Artificial Sequence: Synthetic coding sequence
atggaggcccgcttcacccggggcaagagcgccctgctggagcgggccctggcccggcccaggacagaggtgtccctgagcgcctttgccctgctcttcagcgagctggtgcagcactgccagagcagggtcttctctgtggccgagctgcagagccggctggccgccctgggccggcaggtgggcgcccgggtgctggatgccctggtggcccgggagaagggggcccggcgggagaccaaggtgctgggcgccctgctgtttgtgaagggagctgtgtggaaggccctgtttgggaaggaggccgacaagctggagcaggccaatgatgatgcccggaccttctacatcatcgagcgggagcccctcatcaacacctacatctctgtgcccaaggagaacagcaccctgaactgtgccagcttcaccgctggcatcgtggaggccgtgctgacccacagcggcttccctgccaaggtgacagcccactggcacaagggcaccaccctgatgatcaagtttgaggaggccgtgattgcccgggaccgggccctggagggccgctag

SEQ ID NO: 38890 - DNA, 567 bp, Artificial Sequence; identical to SEQ ID NO: 38889
  Description of Artificial Sequence: Synthetic coding sequence

SEQ ID NO: 38891 - DNA, 567 bp, Artificial Sequence; identical to SEQ ID NO: 38889
  Description of Artificial Sequence: Synthetic coding sequence

SEQ ID NO: 38892 - DNA, 522 bp, Artificial Sequence
  Description of Artificial Sequence: Synthetic coding sequence
atggctgacacagtgctgtttgagttcctgcacacagagatggtggccgagctgtgggcccatgaccctgaccccggccctggggtgtctgctggcctgcggggggaggaggccggggccaccaagggccagaagatgagcctgtctgtgctggagggcatgggcttccgggtgggccaggccctgggggagcggctgccccgggagaccctggccttccgggaggagctggatgtgctgaagttcctgtgcaaggacctgtgggtggccgtgttccagaagcagatggacagcctgcggaccaaccaccagggcacctacgtgctgcaggacaacagcttccccctgctgctgcccatggccagcggcctgcagtacctggaggaggcccccaagttcctggccttcacctgtggcctgctgcggggggccctgtacaccctgggcatcgagagcgtggtgacagcctctgtggccgccctgcctgtgtgcaagttccaggtggtgatccccaagagctag

SEQ ID NO: 38893 - DNA, 480 bp, Artificial Sequence
  Description of Artificial Sequence: Synthetic coding sequence
atggctgacacagtgctgtttgagttcctgcacacagagatggtggccgagctgtgggcccatgaccctgaccccggccctgggggccagaagatgagcctgtctgtgctggagggcatgggcttccgggtgggccaggccctgggggagcggctgccccgggagaccctggccttccgggaggagctggatgtgctgaagttcctgtgcaaggacctgtgggtggccgtgttccagaagcagatggacagcctgcggaccaaccaccagggcacctacgtgctgcaggacaacagcttccccctgctgctgcccatggccagcggcctgcagtacctggaggaggcccccaagttcctggccttcacctgtggcctgctgcggggggccctgtacaccctgggcatcgagagcgtggtgacagcctctgtggccgccctgcctgtgtgcaagttccaggtggtgatccccaagagctag

SEQ ID NO: 38894 - DNA, 342 bp, Artificial Sequence
  Description of Artificial Sequence: Synthetic coding sequence
atggctgacacagtgctgtttgagttcctgcacacagagatggtggccgagctgtgggcccatgaccctgaccccggccctggagctgcccctggagatgctggcctgcagggcggggccggctgcccccaggtgctggtgcagaggcctgtgggcggcggcgtgcctgaggctgatggccagcctgcccaccagagccctggggacctgcggcctgcccggcagcagctgcccccacctcctccagatggcctgtggccagctgtgtctgggggcagcacccaggtgcccggcctgcacctgcggcccccagcccggcggcccctgtacccaggccactag

SEQ ID NO: 38895 - DNA, 477 bp, Artificial Sequence
  Description of Artificial Sequence: Synthetic coding sequence
atggctgatgaggccctcttcctgctgctgcacaatgagatggtgtctggagtgtacaagtctgctgagcagggcgaggtggagaatggccgctgcatcaccaagctggagaacatgggcttccgggtgggccagggcctcatcgagcgcttcaccaaggacacagcccgcttcaaggatgagctggacatcatgaagttcatctgcaaggacttctggaccaccgtcttcaagaagcagattgacaacctgcggaccaaccaccagggcatctacgtgctgcaggacaacaagttccggctgctgacccagatgtctgctgggaagcagtacctggagcacgccagcaagtacctggccttcacctgtggcctcatccggggcggcctgagcaacctgggcatcaagagcatcgtgacagctgaggtgtcctccatgcctgcctgcaagttccaggtgatgatccagaagctgtag

SEQ ID NO: 38896 - DNA, 393 bp, Artificial Sequence
  Description of Artificial Sequence: Synthetic coding sequence
atggctgatgaggccctcttcctgctgctgcacaatgagatggtgtctggagtgtacaagtctgctgagcagggcgaggtggagaatggccgctgcatcaccaagctggagaacatgggcttccgggtgggccagggcctcatcgagcgcttcaccaaggacacagcccgcttcaaggatgagctggacatcatgaagttcatctgcaaggacttctggaccaccgtcttcaagaagcagattgacaacctgcggaccaaccaccagtacctggccttcacctgtggcctcatccggggcggcctgagcaacctgggcatcaagagcatcgtgacagctgaggtgtcctccatgcctgcctgcaagttccaggtgatgatccagaagctgtag

SEQ ID NO: 38897 - DNA, 1092 bp, Artificial Sequence
  Description of Artificial Sequence: Synthetic coding sequence
atgttcaagaggcacaagagcctggccagcgagaggaagagggccctgctgagccagagggccacccgcttcatcctgaaggatgacatgaggaacttccacttcctgagcaagctggtgctgtctgctggccccctgcggcccaccccagctgtgaagcacagcaagaccacccactttgaaattgagatctttgatgcccagaccaggaagcagatctgcatcctggacaaggtgacccagagcagcaccatccatgatgtgaagcagaagttccacaaggcctgccccaagtggtaccccagccgggtgggcctgcagctggagtgtggcggccccttcctgaaggactacatcaccatccagagcattgctgccagcagcatcgtgaccctgtatgccacagacctgggccagcaggtgtcctggaccaccgtcttcctggccgagtacacaggccccctgctgatctacctgctcttctacctgcgcatcccctgcatctatgatggcaaggagagcgcccggcggctgcggcaccctgtggtgcacctggcctgcttctgccactgcatccactacatccgctacctgctggagaccctgtttgtgcacaaggtgtctgctggccacacccccctgaagaacctgatcatgagctgtgccttctactggggcttcacctcctggatcgcctactacatcaaccaccccctgtacaccccacccagctttggaaaccggcagatcaccgtgtctgccatcaacttcctgatctgtgaggccggcaaccacttcatcaacgtgatgctgagccaccccaaccacactggaaataatgcctgcttccccagccccaactacaaccccttcacctggatgttcttcctggtgtcctgccccaactacacctatgaaattggctcctggatctccttcaccgtgatgacccagaccctgcctgtgggcatcttcaccctgctgatgagcatccagatgagcctgtgggcccagaagaagcacaagatctacctgaggaagttcaacagctacatccacaggaagagcgccatgatccccttcatcctgtag

SEQ ID NO: 38898 - DNA, 2262 bp, Artificial Sequence
  Description of Artificial Sequence: Synthetic coding sequence
atggctgctggcagcaccaccctgcatgctgtggagaagctgcaggtgcggctggccaccaagacagagcccaagaagctggagaagtacctgcagaagctgagcgccctgcccatgacagctgacatcctggccgagaccggcatcaggaagacagtgaagaggctgaggaagcaccagcacgtgggggactttgcccgggacctggccgcccgctggaagaagctggtgctggtggacaggaacaccaggcctggcccccaggaccctgaggagagcgccagccggcagagatttggagaggccctgcaggaccaggagaaggcctggggcttcccagaaaatgccacagcccccaggagccccagccacagccctgagcacagaagaacagcccggaggaccccacctggccagcagaggccccaccccaggagccacagccgggagcccagggctgagaggaagtgcccccgcatcgccccagctgacagcggccgctaccgggccagccccaccaggacagcccccctgaggatgcctgagggccctgagcctgctgcccctgggaagcagcccggccggggccacacccacgccgcccagggcggccccctgctgtgccccggctgccagggccagccccagggcaaggctgtggtgagccacagcaagggccacaagagcagccggcaggagaagaggcccctgtgtgcccagggcgactggcacagccccaccctcatccgggagaagagctgtggggcctgcctgcgggaggagacccccaggatgcccagctgggccagcgcccgggaccggcagcccagcgacttcaagacagacaaggagggcggccaggccggcagcggccagagggtgcctgccctggaggaggccccagacagccaccagaagaggccccagcacagccacagcaacaagaagaggcccagcctggatggccgggaccctggaaatggcacccacggcctgagccctgaggagaaggagcagctgagcaatgaccgggagacccaggagggcaagcccccaacagcccacctggacaggacctctgtgagcagcctgtctgaggtggaggaggtggacatggccgaggagtttgagcagcccaccctgagctgtgagaagtacctgacctatgaccagctgaggaagcagaagaagaagacaggcaagagcgccaccacagccctgggggacaagcagaggaaggccaatgaaagcaagggcacccgggagagctgggacagcgccaagaagctgccccctgtgcaggagagccagagcgagcggctgcaggccgccggggctgacagcgctggccccaagacagtgcccagccacgtgttcagcgagctgtgggacctgtctgaggcctggatgcaggccaactatgaccccctgagtgacagcgacagcatgaccagccaggccaagccagaggccctgagcagccccaagttccgggaggaggccgccttccctggccggcgggtgaatgccaagatgcctgtgtacagcggcagcaggcctgcctgccagctgcaggtgcccaccctgcggcagcagtgtgcccaggtgctgaggaacaacccagatgccctgagtgatgtgggggaggtgccctactgggtgctggagcctgtgctggagggctggaggccagaccagctgtacagaaggaagaaggacaaccacgccctggtgcgggagacagatgagctgcggaggaaccactgcttccaggacttcaaggaggagaagccccaggagaacaagacctggagggagcagtacctgcggctgcctgatgcccctgagcagaggctgcgggtgatgaccaccaacatccgcagcgcccggggcaacaaccccaacggccgggaggccaagatgatctgcttcaagtctgtggccaagaccccctatgacaccagccggcggcaggagaagtctgctggagatgctgaccctgaaaatggagagatcaagccagccagcaagccagctggcagcagccacacccccagcagccagagcagcagcggcggcggccgggacagcagcagcagcatcctgcgctggctgcctgagaagagggccaacccctgcctgagcagcagcaatgagcacgccgccccagctgccaagaccaggaagcaggccgccaagaaggtggcccccctgatggccaaggccatccgggactacaagaggcgcttcagcagaagatag

SEQ ID NO: 38899 - DNA, 1641 bp, Artificial Sequence
  Description of Artificial Sequence: Synthetic coding sequence
atggctgctggcagcaccaccctgcgggctgtgggcaagctgcaggtgcggctggccaccaagacagagcccaagaagctggagaagtacctgcagaagctgagcgccctgcccatgacagctgacatcctggccgagaccggcatcaggaagacagtgaagaggctgaggaagcaccagcacgtgggggactttgcccgggacctggccgcccgctggaagaagctggtgctggtggacagaaatactggaccagacccccaggaccctgaggagagcgccagccggcagagatttggagaggccctgcaggagcgggagaaggcctggggcttcccagaaaatgccacagcccccaggagccccagccacagccctgagcacagaagaacagcccggaggaccccacctggccagcagaggccccaccccaggagccccagccgggagcccagggctgagaggaagaggcccaggatggccccagctgacagcggcccccaccgggacccccccaccaggacagcccccctgcccatgcctgagggccctgagcctgctgtgcctggagagcagcccggccggggccacgcccacgccgcccagggcggccccctgctgggccagggctgccagggccagccccagggcgaggccgtgggcagccacagcaagggccacaagagcagcagaggagccagcgcccagaagagcccccctgtgcaggagagccagagcgagcggctgcaggccgccggggctgacagcgctggccccaagacagtgcccagccacgtgttcagcgagctgtgggaccccagcgaggcctggatgcaggccaactatgacctgctgagcgcctttgaggccatgaccagccaggccaaccctgaggccctgagcgccccagccctgcaggaggaggccgccttccctggccggcgggtgaatgccaagatgcctgtgtacagcggcagcaggcctgcctgccagctgcaggtgcccaccctgcggcagcagtgcctgcgggtgcccaggaacaacccagatgccctgggagatgtggagggcgtgccctacagcgtgctggagcctgtgctggagggctggaccccagaccagctgtacagaacagagaaggacaatgctgccctggcccgggagacagatgagctgtggaggatccactgcctgcaggacttcaaggaggagaagccccaggagcacgagagctggagggagctgtacctgcggctgagagatgcccgggagcagaggctgcgggtggtgaccaccaagatccgcagcgcccgggagaacaagcccagcggccggcagaccaagatgatctgcttcaacagcgtggccaagaccccctatgatgccagccggcggcaggagaagtctgctggagctgctgaccctggaaatggagagatggagcccgcccccaagccagctggcagcagccaggcccccagcggcctgggagatggagatggcggctctgtgtctgggggcggcagcagcaacagacatgctgccccagctgacaagaccaggaagcaggccgccaagaaggtggcccccctgatggccaaggccatccgggactacaagggccgcttcagcagaagatag

SEQ ID NO: 38900 - DNA, 1641 bp, Artificial Sequence
  Description of Artificial Sequence: Synthetic coding sequence
atggctgctggcagcaccaccctgcgggctgtgggcaagctgcaggtgcggctggccaccaagacagagcccaagaagctggagaagtacctgcagaagctgagcgccctgcccatgacagctgacatcctggccgagaccggcatcaggaagacagtgaagaggctgaggaagcaccagcacgtgggggactttgcccgggacctggccgcccgctggaagaagctggtgctggtggacagaaatactggaccagacccccaggaccctgaggagagcgccagccggcagagatttggagaggccctgcaggagcgggagaaggcctggggcttcccagaaaatgccacagcccccaggagccccagccacagccctgagcacagaagaacagcccggaggaccccacctggccagcagaggccccaccccaggagccccagccgggagcccagggctgagaggaagaggcccaggatggccccagctgacagcggcccccaccgggacccccccaccaggacagcccccctgcccatgcctgagggccctgagcctgctgtgcctggagagcagcccggccggggccacgcccacgccgcccagggcggccccctgctgggccagggctgccagggccagccccagggcgaggccgtgggcagccacagcaagggccacaagagcagcagaggagccagcgcccagaagagcccccctgtgcaggagagccagagcgagcggctgcaggccgccggggctgacagcgctggccccaagacagtgcccagccacgtgttcagcgagctgtgggaccccagcgaggcctggatgcaggccaactatgacctgctgagcgcctttgaggccatgaccagccaggccaaccctgaggccctgagcgcccccaccctgcaggaggaggccgccttccctggccggcgggtgaatgccaagatgcctgtgtacagcggcagcaggcctgcctgccagctgcaggtgcccaccctgcggcagcagtgcctgcgggtgcccaggaacaacccagatgccctgggagatgtggagggcgtgccctacagcgtgctggagcctgtgctggagggctggaccccagaccagccctacagaacagagaaggacaatgctgccctggcccgggagacagatgagctgtggaggatccactgcctgcaggacttcaaggaggagaagccccaggagcacgagagctggagggagctgtacctgcggctgagagatgcccgggagcagaggctgcgggtggtgaccaccaagatccgcagcgcccgggagaacaagcccagcggccggcagaccaagatgatctgcttcaacagcgtggccaagaccccctatgatgccagccggcggcaggagaagtctgctggagctgctgaccctggaaatggagagatggagcccgcccccaagccagctggcagcagccaggcccccagcggcctgggagatggagatggcggctctgtgtctgggggcggcagcagcaacagacatgctgccccagctgacaagaccaggaagcaggccgccaagaaggtggcccccctgatggccaaggccatccgggactacaagggccgcttcagcagaagatag

SEQ ID NO: 38901 - DNA, 1083 bp, Artificial Sequence
  Description of Artificial Sequence: Synthetic coding sequence
atgagcggctctgtgctcttcaccgctggggagcgctggcgctgcttcctgacccccagccgcagcagcctgtactgggccctgcacaacttctgctgcaggaagaagagcaccacccccaagaagatcacccccaacgtgaccttctgtgatgaaaatgccaaggagccagaaaatgccctggacaagctgttcagcagcgagcagcaggccagcatcctgcacgtgctgaacacagccagcaccaaggagctggaggccttccggctgctgcggggccgccgcagcatcaacatcgtggagcaccgggagaactttggccccttccagaacctggagagcctgatgaatgtgcccctcttcaagtacaagagcacagtgcaggtgtgcaacagcatcctgtgccccaagacaggccgggagaagaggaagagcccagaaaatcgcttcctgaggaagctgctgaagccagacatcgagcgggagcggctgaaggctgtgaacagcatcatcagcatcgtgtttggcacccggcgcatcgcctgggcccacctggacaggaagctgactgtgctggactggcagcagagcgaccgctggagcctgatgaggggcatctacagcagctctgtgtacctggaggagatcagcagcatcatcagcaagatgcccaaggctgacttctacgtgctggagaagacaggcctgagcatccagaacagcagcctcttccccatcctgctgcacttccacatcatggaggccatgctgtatgccctgctgaacaagacctttgcccaggacggccagcaccaggtgctgtccatgaacagaaatgctgtgggcaagcactttgagctgatgattggagacagcaggaccagcggcaaggagctggtgaagcagttcctgtttgacagcatcctgaaggctgaccccagggtcttcttccccagcgacaagatcgtgcactaccggcagatgttcctgagcacagagctgcagagggtggaggagctgtatgacagcctgctgcaggccatcgccttctatgagctggccgtgtttgacagccagccctag

SEQ ID NO: 38902 - DNA, 1083 bp, Artificial Sequence; identical to SEQ ID NO: 38901
  Description of Artificial Sequence: Synthetic coding sequence

SEQ ID NO: 38903 - DNA, 546 bp, Artificial Sequence
  Description of Artificial Sequence: Synthetic coding sequence
atgagcggctctgtgctcttcaccgctggggagcgctggcgctgcttcctgacccccagccgcagcagcctgtactgggccctgcacaacttctgctgcaggaagaagagcaccacccccaagaagatcacccccaacgtgaccttctgtgatgaaaatgccaaggagccagaaaatgccctggacaagctgttcagcagcgagcagcaggccagcatcctgcacgtgctgaacacagccagcaccaaggagctggaggccttccggctgctgcggggccgccgcagcatcaacatcgtggagcaccgggagaactttggccccttccagaacctggagagcctgatgaatgtgcccctcttcaagtacaagagcacagtgcaggtgtgcaacagcatcctgtgccccaagacaggccgggagaagaggaagagcccagaaaatcgcttcctgaggaagctgctgaagccagacatcgagcgggagcggctgaaggtgtacagcagctgcctgctgtactgcctgatctttgagaacctgctgtag

SEQ ID NO: 38904 - DNA, 1191 bp, Artificial Sequence
  Description of Artificial Sequence: Synthetic coding sequence
atgtggatccctgtggtgggcctgccccggcggctgcggctgagcgccctggccggggccggccgcttctgcatcctgggcagcgaggccgccaccaggaagcacctgcctgccaggaaccactgcggcctgagtgacagcagcccccagctgtggccagagccagacttcaggaacccccccaggaaggccagcaaggccagcctggacttcaagcgctacgtgacagaccggcggctggccgagaccctggcccagatctacctgggcaagcccagcaggcctccccacctgctgctggagtgcaaccctggccctggcatcctgacccaggccctgctggaggccggggccaaggtggtggccctggagagtgacaagaccttcatcccccacctggagagcctgggcaagaacctggatggcaagctgcgggtcatccactgtgacttcttcaagctggaccccaggtctgggggcgtcatcaagcccccagccatgagcagccggggcctcttcaagaacctgggcatcgaggccgtgccctggacagctgacatccccctgaaggtggtgggcatgttccccagcagaggagagaagagggccctgtggaagctggcctatgacctgtacagctgcaccagcatctacaagtttggaagaattgaggtgaacatgtttattggagagaaggagttccagaagctgatggctgaccccggcaacccagacctgtaccacgtgctgagcgtcatctggcagctggcctgtgagatcaaggtgctgcacatggagccctggagcagctttgacatctacaccaggaagggccccctggagaaccccaagagaagagagctgctggaccagctgcagcagaagctgtacctgatccagatgatcccccggcagaacctcttcaccaagaacctgacccccatgaactacaacatcttcttccacctgctgaagcactgcttcggccgccgcagcgccaccgtcatcgaccacctgcggagcctgacccccctggatgcccgggacatcctgatgcagatcggcaagcaggaggatgagaaggtggtgaacatgcacccccaggacttcaagaccctgtttgagaccatcgagaggagcaaggactgtgcctacaagtggctgtatgatgagaccctggaggacagatag

SEQ ID NO: 38905 - DNA, 414 bp, Artificial Sequence
  Description of Artificial Sequence: Synthetic coding sequence
atgtggatccctgtggtgggcctgccccggcggctgcggctgagcgccctggccggggccggccgcttctgcatcctgggcagcgaggccgccaccaggaagcacctgcctgccaggaaccactgcggcctgagtgacagcagcccccagctgtggccagagccagacttcaggaacccccccaggaaggccagcaaggccagcctggacttcaagcgctacgtgacagaccggcggctggccgagaccctggcccagatctacctgggcaagcccagcaggcctccccacctgctgctggagtgcaaccctggccctggcatcctgacccaggccctgctggaggccggggccaaggtggtggccctggagagtgacaagaccttcatcccccacctggagaccagcctgtag

SEQ ID NO: 38906 - DNA, 1896 bp, Artificial Sequence
  Description of Artificial Sequence: Synthetic coding sequence
atggccgcccacctggtgaagcgctgcacctgcctgctgcgggaggccgcccggcaggccccagccatggcccctgtgggccgcctgcggctggcctgggtggcccacaagaccctgaccagcagcgccaccagccccatcagccacctgcccggcagcctgatggagcctgtggagaaggagcgggccagcaccccctacatcgagaagcaggtggaccacctgatcaagaaggccaccaggcctgaggagctgctggagctgctgggcggcagccatgacctggacagcaaccaggccgccatggtgctgatccggctgagccacctgctgtctgagaagccagaggacaagggcctgctgatccaggatgcccacttccaccagctgctgtgcctgctgaacagccagatcgcctctgtgtggcacggcaccctgagcaagctgctgggcagcctgtatgccctgggcatccccaaggccagcaaggagctgcagagcgtggagcaggaggtgcgctggaggatgaggaagctgaagtacaagcacctggccttcctggccgagagctgtgccaccctgagccaggagcagcacagccaggagctgctggccgagctgctgacccacctggagcggcgctggacagaaattgaggacagccacaccctggtgacagtgatgatgaaggtgggccacctgtctgagcccctgatgaaccggctggaggacaagtgcctggagctggtggagcacttcggccccaatgagctgaggaaggtgctggtgatgctggccgcccagagccgccgctctgtgcccctgctgcgggccatctcctaccacctggtgcagaagcccttcagcctgaccaaggatgtgctgctggatgtggcctatgcctacggcaagctgtccttccaccagacccaggtgtcccagaggctggccacagacctgctgagcctgatgcccagcctgaccagcggggaggtggcccactgtgccaagagctttgccctgctgaagtggctgagcctgcccctgtttgaggcctttgcccagcacgtgctgaacagagcccaggacatcaccctgccccacctgtgcagcgtgctgctggcctttgcccggctgaacttccacccagaccaggaggaccagttcttcagcctggtgcatgagaagctgggcagcgagctgcccggcctggagcccgccctgcaggtggacctggtgtgggccctgtgtgtgctgcagcaggcccgggaggccgagctgcaggccgtgctgcaccctgagttccacatccagttcctgggcggcaagagccagaaggaccagaacaccttccagaagctgctgcacatcaatgccacagccctgctggagtacccagagtacagcggccccctgctgcctgccagcgctgtggcccctggccccagcgccctggacaggaaggtgacccccctgcagaaggagctgcaggagaccctgaagggcctgctgggcagcgctgacaagggcagcctggaggtggccacccagtatggctgggtgctggatgctgaggtgctgctggacagtgatggagagttcctgcctgtgcgggactttgtggccccccacctggcccagcccaccggcagccagagccccccacctggcagcaagaggctggccttcctgcgctgggagttccccaacttcaacagccgcagcaaggacctgctgggccgctttgtgctggcccggcggcacatcgtggccgccggcttcctgattgtggatgtgcccttctatgagtggctggagctgaagtctgagtggcagaagggggcctacctgaaggacaagatgaggaaggctgtggccgaggagctggccaagtag

SEQ ID NO: 38907 - DNA, 1566 bp, Artificial Sequence
  Description of Artificial Sequence: Synthetic coding sequence
atggccgcccacctggtgaagcgctgcacctgcctgctgcgggaggccgcccggcaggccccagccatggcccctgtgggccgcctgcggctggcctgggtggcccacaagaccctgaccagcagcgccaccagccccatcagccacctgcccggcagcctgatggagcctgtggagaaggagcgggccagcaccccctacatcgagaagcaggtggaccacctgatcaagaaggccaccaggcctgaggagctgctggagctgctgggcggcagccatgacctggacagcaaccaggccgccatggtgctgatccggctgagccacctgctgtctgagaagccagaggacaagggcctgctgatccaggatgcccacttccaccagctgctgtgcctgctgaacagccagatcgcctctgtgtggcacggcaccctgagcaagctgctgggcagcctgtatgccctgggcatccccaaggccagcaaggagctgcagagcgtggagcaggaggtgcgctggaggatgaggaagctgaagtacaagcacctggccttcctggccgagagctgtgccaccctgagccaggagcagcacagccaggagctgctggccgagctgctgacccacctggagcggcgctggacagaaattgaggacagccacaccctggtgacagtgatgatgaaggtgggccacctgtctgagcccctgatgaaccggctggaggacaagcacgtgctgaacagagcccaggacatcaccctgccccacctgtgcagcgtgctgctggcctttgcccggctgaacttccacccagaccaggaggaccagttcttcagcctggtgcatgagaagctgggcagcgagctgcccggcctggagcccgccctgcaggtggacctggtgtgggccctgtgtgtgctgcagcaggcccgggaggccgagctgcaggccgtgctgcaccctgagttccacatccagttcctgggcggcaagagccagaaggaccagaacaccttccagaagctgctgcacatcaatgccacagccctgctggagtacccagagtacagcggccccctgctgcctgccagcgctgtggcccctggccccagcgccctggacaggaaggtgacccccctgcagaaggagctgcaggagaccctgaagggcctgctgggcagcgctgacaagggcagcctggaggtggccacccagtatggctgggtgctggatgctgaggtgctgctggacagtgatggagagttcctgcctgtgcgggactttgtggccccccacctggcccagcccaccggcagccagagccccccacctggcagcaagaggctggccttcctgcgctgggagttccccaacttcaacagccgcagcaaggacctgctgggccgctttgtgctggcccggcggcacatcgtggccgccggcttcctgattgtggatgtgcccttctatgagtggctggagctgaagtctgagtggcagaagggggcctacctgaaggacaagatgaggaaggctgtggccgaggagctggccaagtag

SEQ ID NO: 38908 - DNA, 1566 bp, Artificial Sequence; identical to SEQ ID NO: 38907
  Description of Artificial Sequence: Synthetic coding sequence

SEQ ID NO: 38909 - DNA, 387 bp, Artificial Sequence
  Description of Artificial Sequence: Synthetic coding sequence
atggccgcccacctggtgaagcgctgcacctgcctgctgcgggaggccgcccggcaggccccagccatggcccctgtgggccgcctgcggctggcctgggtggcccacaagaccctgaccagcagcgccaccagccccatcagccacctgcccggcagcctgatggagcctgtggagaaggagcgggccagcaccccctacatcgagaagcaggtggaccacctgatcaagaaggccaccaggcctgaggagctgctggagctgctgggcggcagccatgacctggacagcaaccaggccgccatggtgctgatccggctgagccacctgctgtctgagaagccagaggacaagggcctgctgatccaggatgcccacttccactag

SEQ ID NO: 38910 - DNA, 357 bp, Artificial Sequence
  Description of Artificial Sequence: Synthetic coding sequence
atggccgcccacctggtgaagcgctgcacctgcctgctgcgggaggccgcccggcaggccccagccatggcccctgtgggccgcctgcggctggcctgggtggcccacaagaccctgaccagcagcgccaccagccccatcagccacctgcccggcagcctgatggagcctgtggagaaggagcgggccagcaccccctacatcgagaagcaggtggaccacctgatcaagaaggccaccaggcctgaggagctgctggagctgctgggcggcagccatgacctggacagcaaccaggccgccatggtgctgatccggctgagccacctgctgtctgagaagccagaggacaagtag

SEQ ID NO: 38911 - DNA, 1896 bp, Artificial Sequence; identical to SEQ ID NO: 38906
  Description of Artificial Sequence: Synthetic coding sequence

SEQ ID NO: 38912 - DNA, 312 bp, Artificial Sequence
  Description of Artificial Sequence: Synthetic coding sequence
atggccgcccacctggtgaagcgctgcacctgcctgctgcgggaggccgcccggcaggccccagccatggcccctgtgggccgcctgcggctggcctgggtggcccacaagaccctgaccagcagcgccaccagccccatcagccacctgcccggcagcctgatggagcctgtggagaaggagcgggccagcaccccctacatcgagaagcaggtggaccacctgatcaagaaggccaccaggcctgaggagctgctggagctgctgggcggcagccatgacctggacagcaaccaggccgccatggtgtag

SEQ ID NO: 38913 - DNA, 2547 bp, Artificial Sequence
  Description of Artificial Sequence: Synthetic coding sequence
atggagggcagccccagcctgcggaggatgacagtgatgagggagaagggccggcggcaggccgtgcggggccctgccttcatgtttaatgaccggggcaccagcctgacagctgaggaggagcgcttcctggatgctgctgaatatggcaacatccctgtggtgaggaagatgctggaggagagcaagaccctgaatgtgaactgtgtggactacatgggccagaatgccctgcagctggccgtgggcaatgagcacctggaggtgacagagctgctgctgaagaaggagaacctggccagaattggagatgccctgctgctggccatcagcaagggctacgtgagaattgtggaggccatcctgaaccaccctggctttgctgccagcaagaggctgaccctgagcccctgtgagcaggagctgcaggatgatgacttctacgcctatgatgaagatggcacccgcttctccccagacatcacccccatcatcctggccgcccactgccagaagtatgaggtggtgcacatgctgctgatgaagggggcccgcatcgagcggccccatgactacttctgcaagtgtggggactgcatggagaagcagagacatgacagcttcagccacagccgcagccgcatcaatgcctacaagggcctggccagccctgcctacctgagcctgagcagcgaggaccctgtgctgacagccctggagctgagcaatgagctggccaagctggccaacatcgagaaggagttcaagaatgactacaggaagctgtccatgcagtgcaaggactttgtggtgggcgtgctggacctgtgccgggacagcgaggaggtggaggccatcctgaatggagacctggagagcgctgagcccctggaggtgcaccgccacaaggccagcctgagccgggtgaagctggccatcaagtatgaggtgaagaagtttgtggcccaccccaactgccagcagcagctgctgaccatctggtatgagaacctgagcggcctgcgggagcagaccatcgccatcaagtgcctggtggtgctggtggtggccctgggcctgcccttcctggccatcggctactggatcgccccctgcagccggctgggcaagatcctgcggagccccttcatgaagtttgtggcccacgccgccagcttcatcatcttcctgggcctgctggtgttcaatgccagtgacagatttgagggcatcaccaccctgcccaacatcaccgtgacagactaccccaagcagatcttccgggtgaagaccacccagttcacctggacagagatgctgatcatggtgtgggtgctgggcatgatgtggagcgagtgcaaggagctgtggctggagggcccccgggagtacatcctgcagctgtggaatgtgctggactttggcatgctgagcatcttcatcgccgccttcaccgcccgcttcctggccttcctgcaggccaccaaggcccagcagtatgtggacagctatgtgcaggagagtgacctgtctgaggtgaccctgcccccagagatccagtacttcacctacgcccgggacaagtggctgcccagcgacccccagatcatcagcgagggcctgtatgccatcgctgtggtgctgtccttcagcagaattgcctacatcctgcctgccaatgaaagctttggccccctgcagatcagcctgggccgcacagtgaaggacatcttcaagttcatggtgctcttcatcatggtgttctttgccttcatgattggcatgttcatcctgtacagctactacctgggcgccaaggtgaatgctgccttcaccaccgtggaggagagcttcaagaccctcttctggagcatcttcggcctgtctgaggtgacctctgtggtgctgaagtatgaccacaagttcatcgagaacatcggctacgtgctgtatggcatctacaacgtgaccatggtggtggtgctgctgaacatgctgattgccatgatcaacagcagctaccaggagattgaagatgacagtgatgtggagtggaagtttgcccggagcaagctgtggctgagctactttgatgatggcaagaccctgcccccacccttcagcctggtgcccagccccaagagctttgtgtacttcatcatgagaattgtgaacttccccaagtgcagaagaagaaggctgcagaaggacatcgagatgggcatgggcaacagcaagagccggctgaacctcttcacccagagcaacagccgggtgtttgagagccacagcttcaacagcatcctgaaccagcccacccgctaccagcagatcatgaagaggctcatcaagcgctacgtgctgaaggcccaggtggacaaggaaaatgatgaggtgaatgaaggagagctgaaggagatcaagcaggacatcagcagcctgcgctatgagctgctggaggacaagagccaggccacagaggagctggccatcctgatccacaagctgtctgagaagctgaaccccagcatgctgcgctgtgagtag

SEQ ID NO: 38914 - DNA, 2766 bp, Artificial Sequence
  Description of Artificial Sequence: Synthetic coding sequence
atgagcaccaaggtgaggaagtgcaaggagcaggcccgggtgaccttccctgcccctgaggaggaggaggatgaaggagaagatgagggcgctgagccccagaggagaagaagaggctggaggggcgtgaatggaggcctggagcccaggtctgcccccagccagcgggagccccacggctactgccccccacccttcagccacggccctgacctgtccatggagggcagccccagcctgcggaggatgacagtgatgagggagaagggccggcggcaggccgtgcggggccctgccttcatgtttaatgaccggggcaccagcctgacagctgaggaggagcgcttcctggatgctgctgaatatggcaacatccctgtggtgaggaagatgctggaggagagcaagaccctgaatgtgaactgtgtggactacatgggccagaatgccctgcagctggccgtgggcaatgagcacctggaggtgacagagctgctgctgaagaaggagaacctggccagaattggagatgccctgctgctggccatcagcaagggctacgtgcgcatcgtggaggccatcctgaaccaccctggctttgctgccagcaagaggctgaccctgagcccctgtgagcaggagctgcaggatgatgacttctacgcctatgatgaagatggcacccgcttctccccagacatcacccccatcatcctggccgcccactgccagaagtatgaggtggtgcacatgctgctgatgaagggggccagaattgagcggccccatgactacttctgcaagtgtggggactgcatggagaagcagagacatgacagcttcagccacagccgcagccgcatcaatgcctacaagggcctggccagccctgcctacctgagcctgagcagtgaagatcctgtgctgacagccctggagctgagcaatgagctggccaagctggccaacatcgagaaggagttcaagaatgactacaggaagctgtccatgcagtgcaaggactttgtggtgggcgtgctggacctgtgccgggacagcgaggaggtggaggccatcctgaatggagacctggagagcgctgagcccctggaggtgcaccgccacaaggccagcctgagccgggtgaagctggccatcaagtatgaggtgaagaagtttgtggcccaccccaactgccagcagcagctgctgaccatctggtatgagaacctgagcggcctgcgggagcagaccatcgccatcaagtgcctggtggtgctggtggtggccctgggcctgcccttcctggccatcggctactggatcgccccctgcagccggctgggcaagatcctgcggagccccttcatgaagtttgtggcccatgctgccagcttcatcatcttcctgggcctgctggtgttcaatgccagtgacagatttgagggcatcaccaccctgcccaacatcaccgtgacagactaccccaagcagatcttccgggtgaagaccacccagttcacctggacagagatgctgatcatggtgtgggtgctgggcatgatgtggagcgagtgcaaggagctgtggctggagggcccccgggagtacatcctgcagctgtggaatgtgctggactttggcatgctgagcatcttcatcgccgccttcaccgcccgcttcctggccttcctgcaggccaccaaggcccagcagtatgtggacagctatgtgcaggagagtgacctgtctgaggtgaccctgcccccagagatccagtacttcacctacgcccgggacaagtggctgcccagcgacccccagatcatcagcgagggcctgtatgccatcgctgtggtgctgtccttcagccgcatcgcctacatcctgcctgccaatgaaagctttggccccctgcagatcagcctgggccgcacagtgaaggacatcttcaagttcatggtgctcttcatcatggtgttctttgccttcatgattggcatgttcatcctgtacagctactacctgggcgccaaggtgaatgctgccttcaccaccgtggaggagagcttcaagaccctcttctggagcatcttcggcctgtctgaggtgacctctgtggtgctgaagtatgaccacaagttcattgaaaatattggctacgtgctgtatggcatctacaacgtgaccatggtggtggtgctgctgaacatgctgattgccatgatcaacagcagctaccaggagattgaagatgacagtgatgtggagtggaagtttgcccggagcaagctgtggctgagctactttgatgatggcaagaccctgcccccacccttcagcctggtgcccagccccaagagctttgtgtacttcatcatgagaattgtgaacttccccaagtgcagaagaagaaggctgcagaaggacatcgagatgggcatgggcaacagcaagagccggctgaacctcttcacccagagcaacagccgggtgtttgagagccacagcttcaacagcatcctgaaccagcccacccgctaccagcagatcatgaagaggctcatcaagagatatgtgctgaaggcccaggtggacaaggaaaatgatgaggtgaatgaaggagagctgaaggagatcaagcaggacatcagcagcctgcgctatgagctgctggaggacaagagccaggccacagaggagctggccatcctgatccacaagctgtctgagaagctgaaccccagcatgctgcgctgtgagtag

SEQ ID NO: 38915 - DNA, 282 bp, Artificial Sequence
  Description of Artificial Sequence: Synthetic coding sequence
atggagggcagccccagcctgcggaggatgacagtgatgagggagaagggccggcggcaggccgtgcggggccctgccttcatgtttaatgaccggggcaccagcctgacagctgaggaggagcgcttcctggatgctgctgaatatggcaacatccctgtggtgaggaagatgctggaggagagcaagaccctgaatgtgaactgtgtggactacatgggccagaatgccctgcagctggccgtgggcaatgagcacctggaggtgacagagctgctgtag

SEQ ID NO: 38916 - DNA, 2382 bp, Artificial Sequence
  Description of Artificial Sequence: Synthetic coding sequence
atggagggcagccccagcctgcggaggatgacagtgatgagggagaagggccggcggcaggccgtgcggggccctgccttcatgtttaatgaccggggcaccagcctgacagctgaggaggagcgcttcctggatgctgctgaatatggcaacatccctgtggtgaggaagatgctggaggagagcaagaccctgaatgtgaactgtgtggactacatgggccagaatgccctgcagctggccgtgggcaatgagcacctggaggtgacagagctgctgctgaagaaggagaacctggccagaattggagatgccctgctgctggccatcagcaagggctacgtgagaattgtggaggccatcctgaaccaccctggctttgctgccagcaagaggctgaccctgagcccctgtgagcaggagctgcaggatgatgacttctacgcctatgatgaagatggcacccgcttctccccagacatcacccccatcatcctggccgcccactgccagaagtatgaggtggtgcacatgctgctgatgaagggggcccgcatcgagcggccccatgactacttctgcaagtgtggggactgcatggagaagcagagacatgacagcttcagccacagccgcagccgcatcaatgcctacaagggcctggccagccctgcctacctgagcctgagcagcgaggaccctgtgctgacagccctggagctgagcaatgagctggccaagctggccaacatcgagaaggagttcaagaatgactacaggaagctgtccatgcagtgcaaggactttgtggtgggcgtgctggacctgtgccgggacagcgaggaggtggaggccatcctgaatggagacctggagagcgctgagcccctggaggtgcaccgccacaaggccagcctgagccgggtgaagctggccatcaagtatgaggtgaagaagctgggcaagatcctgcggagccccttcatgaagtttgtggcccatgctgccagcttcatcatcttcctgggcctgctggtgttcaatgccagtgacagatttgagggcatcaccaccctgcccaacatcaccgtgacagactaccccaagcagatcttccgggtgaagaccacccagttcacctggacagagatgctgatcatggtgtgggtgctgggcatgatgtggagcgagtgcaaggagctgtggctggagggcccccgggagtacatcctgcagctgtggaatgtgctggactttggcatgctgagcatcttcatcgccgccttcaccgcccgcttcctggccttcctgcaggccaccaaggcccagcagtatgtggacagctatgtgcaggagagtgacctgtctgaggtgaccctgcccccagagatccagtacttcacctacgcccgggacaagtggctgcccagcgacccccagatcatcagcgagggcctgtatgccatcgctgtggtgctgtccttcagccgcatcgcctacatcctgcctgccaatgaaagctttggccccctgcagatcagcctgggccgcacagtgaaggacatcttcaagttcatggtgctcttcatcatggtgttctttgccttcatgattggcatgttcatcctgtacagctactacctgggcgccaaggtgaatgctgccttcaccaccgtggaggagagcttcaagaccctcttctggagcatcttcggcctgtctgaggtgacctctgtggtgctgaagtatgaccacaagttcattgaaaatattggctacgtgctgtatggcatctacaacgtgaccatggtggtggtgctgctgaacatgctgattgccatgatcaacagcagctaccaggagattgaagatgacagtgatgtggagtggaagtttgcccggagcaagctgtggctgagctactttgatgatggcaagaccctgcccccacccttcagcctggtgcccagccccaagagctttgtgtacttcatcatgagaattgtgaacttccccaagtgcagaagaagaaggctgcagaaggacatcgagatgggcatgggcaacagcaagagccggctgaacctcttcacccagagcaacagccgggtgtttgagagccacagcttcaacagcatcctgaaccagcccacccgctaccagcagatcatgaagaggctcatcaagagatatgtgctgaaggcccaggtggacaaggaaaatgatgaggtgaatgaaggagagctgaaggagatcaagcaggacatcagcagcctgcgctatgagctgctggaggacaagagccaggccacagaggagctggccatcctgatccacaagctgtctgagaagctgaaccccagcatgctgcgctgtgagtag

SEQ ID NO: 38917 - DNA, 747 bp, Artificial Sequence
  Description of Artificial Sequence: Synthetic coding sequence
atgatctgcaccttcctgcgggctgtgcagtacacagagaagctgcacaggagcagcgccaagaggctgctgctgccctacatcgtgctgaacaaggcctgcctgaagacagagcccagcctgcgctgtggcctgcagtaccagaagaagaccctgcggccccgctgcatcctgggcgtgacccagaagaccatctggacccagggccccagccccaggaaggccaaggaggatggcagcaagcaggtgtctgtgcacaggagccagagaggaggaacagctgtgcccaccagccagaaggtgaaggaggccggccgggacttcacctacctgattgtggtgctgtttggcatcagcatcactggaggcctcttctacaccatcttcaaggagctgttcagcagcagcagccccagcaagatctacggccgggccctggagaagtgccgcagccaccctgaggtgattggagtgtttggagagagcgtgaagggctacggggaggtgacccggcggggccggcggcagcacgtgcgcttcacagaatatgtgaaggatggcctgaagcacacctgtgtgaagttctacatcgagggcagcgagcccgggaagcagggcaccgtgtatgcccaggtgaaggagaaccctggcagcggggagtatgacttccgctacatctttgtggagattgagagctaccccaggaggaccatcatcatcgaggacaacagaagccaggatgactag

SEQ ID NO: 38918 - DNA, 405 bp, Artificial Sequence
  Description of Artificial Sequence: Synthetic coding sequence
atggagggcggcggcggcagcggcaacaagaccaccggcggcctggccggcttctttggagctggaggagctggctacagccatgctgacctggccggcgtgcccctgaccggcatgaaccccctgagcccctacctgaatgtggacccccgctacctggtgcaggacacagatgagttcatcctgcccaccggggccaacaagacccggggccgctttgagctggccttcttcaccatcggcggctgctgcatgaccggggccctgtgggccaacaccctgggcagcctggccctgctgtacagcgccttcggggtcatcatcgagaagaccagaggagcagaagatgacctgaacacagtggccgccggcaccatgacaggcatgctgtacaagtgcacctag

SEQ ID NO: 38919 - DNA, 516 bp, Artificial Sequence
  Description of Artificial Sequence: Synthetic coding sequence
atggagggcggcggcggcagcggcaacaagaccaccggcggcctggccggcttctttggagctggaggagctggctacagccatgctgacctggccggcgtgcccctgaccggcatgaaccccctgagcccctacctgaatgtggacccccgctacctggtgcaggacacagatgagttcatcctgcccaccggggccaacaagacccggggccgctttgagctggccttcttcaccatcggcggctgctgcatgaccggggccgccttcggggccatgaatggcctgcggctgggcctgaaggagacccagaacatggcctggagcaagcccagaaatgtgcagatcctgaacatggtgacccggcagggcgccctgtgggccaacaccctgggcagcctggccctgctgtacagcgcctttggagtcatcatcgagaagaccagaggagcagaagatgacctgaacacagtggccgccggcaccatgacaggcatgctgtacaagtgcacctag

SEQ ID NO: 38920 - DNA, 450 bp, Artificial Sequence
  Description of Artificial Sequence: Synthetic coding sequence
atgaccggggccgccttcggggccatgaatggcctgcggctgggcctgaaggagacccagaacatggcctggagcaagcccagaaatgtgcagatcctgaacatggtgacccggcagggcgccctgtgggccaacaccctgggcagcctggccctgctgtacagcgcctttggagtcatcatcgagaagaccagaggagcagaagatgacctgaacacagtggccgccggcaccatgacaggcatgctgtacaagtgcacagccagcgccagccagggcgccggcattgctgatggagtgtccttcacccagtgcagcatgctgccccggctggagtgcagcggggtcatcagcgccagctacaacctgcacctgcctgctgcctgcctgggcctgcccaagtgccgggactgcagcctgtgcccagctgccaccccatctgggaagtag

SEQ ID NO: 38921 - DNA, 372 bp, Artificial Sequence
  Description of Artificial Sequence: Synthetic coding sequence
atggagggcggcggcggcagcggcaacaagaccaccggcggcctggccggcttctttggagctggaggagctggctacagccatgctgacctggccggcgtgcccctgaccggcatgaaccccctgagcccctacctgaatgtggacccccgctacctggtgcaggacacagatgagttcatcctgcccaccggggccaacaagacccggggccgctttgagctggccttcttcaccatcggcggctgctgcatgacagccctgctgtacagcgcctttggagtcatcatcgagaagaccagaggagcagaagatgacctgaacacagtggccgccggcaccatgacaggcatgctgtacaagtgcacctag

SEQ ID NO: 38922 - DNA, 1371 bp, Artificial Sequence
  Description of Artificial Sequence: Synthetic coding sequence
atggccagcgccctgagcctgggcaacaagtgtgaccccttcctgcgctgtgtgctgtgccggggcggcggggccctgcagggcccccggggccggggcccagatgactttgagagccagctgagccccccaggcagcgcccggcggctggtgcgcagcaagagggcctgtggcaaccccccagatgccttcggcctgagccgggcctctgtgcacccccccctgccccgggtgtccatcggctgcagcagcggccctggccgggccaagcgggagcgggtgggcggggccgcctggaggcagaggaagatggccgccagcgctgctgtgttcagccggctgcggagcggcctgcggctgggcagccggggcctgtgcacccggctggccaccccaccccggcgggccccagaccaggccgctgagatcggcagccggggcagcaccaaggcccagggcccccagcagcagcccggcagcgagggccccagctatgccaagaaggtggccctgtggctggccggcctgctgggcgccggcggcaccgtgtctgtggtgtacatctttggaaacaaccctgtggatgaaaatggagccaagatcccagatgaatttgacaatgaccccatcctggtgcagcagctgcggaggacctacaagtacttcaaggactaccggcagatgatcatcgagcccaccagcccctgcctgctgcctgaccccctgcaggagccctactaccagcccccctacaccctggtgctggagctgactggagtgctgctgcaccctgagtggagcctggccaccggctggaggttcaagaagaggcctggcatcgagaccctcttccagcagctggcccccctgtatgaaattgtcatcttcaccagcgagaccggcatgacagccttccccctgattgacagcgtggacccccacggcttcatctcctaccgcctcttcagagatgccacccgctacatggatggccaccacgtgaaggacatcagctgcctgaacagagatcctgcccgggtggtggtggtggactgcaagaaggaggccttccggctgcagccctacaatggagtggccctgcggccctgggatggcaacagtgatgacagagtgctgctggacctgagcgccttcctgaagaccatcgccctgaatggagtggaggatgtgaggacagtgctggagcactacgccctggaggatgaccccctggccgccttcaagcagaggcagagccggctggagcaggaggagcagcagaggctggccgagctgagcaagagcaacaagcagaacctcttcctgggcagcctgaccagccggctgtggcccaggagcaagcagccctag

SEQ ID NO: 38923 - DNA, 723 bp, Artificial Sequence
  Description of Artificial Sequence: Synthetic coding sequence
atggtgccccgcttcctgatgagcagcaccatgatgatcatcgagcccaccagcccctgcctgctgcctgaccccctgcaggagccctactaccagcccccctacaccctggtgctggagctgactggagtgctgctgcaccctgagtggagcctggccaccggctggaggttcaagaagaggcctggcatcgagaccctcttccagcagctggcccccctgtatgaaattgtcatcttcaccagcgagaccggcatgacagccttccccctgattgacagcgtggacccccacggcttcatctcctaccgcctcttcagagatgccacccgctacatggatggccaccacgtgaaggacatcagctgcctgaacagagatcctgcccgggtggtggtggtggactgcaagaaggaggccttccggctgcagccctacaatggagtggccctgcggccctgggatggcaacagtgatgacagagtgctgctggacctgagcgccttcctgaagaccatcgccctgaatggagtggaggatgtgaggacagtgctggagcactacgccctggaggatgaccccctggccgccttcaagcagaggcagagccggctggagcaggaggagcagcagaggctggccgagctgagcaagagcaacaagcagaacctcttcctgggcagcctgaccagccggctgtggcccaggagcaagcagccctag

SEQ ID NO: 38924 - DNA, 252 bp, Artificial Sequence
  Description of Artificial Sequence: Synthetic coding sequence
atggccgagctgggggaggctgatgaggccgagctgcagaggctggtggccgctgagcagcagaaggcccagttcaccgcccaggtgcaccacttcatggagctgtgctgggacaagtgtgtggagaagccaggcaaccggctggacagcaggacagagaactgcctgagcagctgtgtggaccgcttcatcgacaccaccctggccatcaccagcagatttgcccagatcgtgcagaagggcggccagtag

SEQ ID NO: 38925 - DNA, 297 bp, Artificial Sequence
  Description of Artificial Sequence: Synthetic coding sequence
atgaggaagcacagctgcaggaaggtggccagcctgcggaggaccatggccgagctgggggaggctgatgaagctgagctgcagaggctggtggccgctgagcagcagaaggcccagttcaccgcccaggtgcaccacttcatggagctgtgctgggacaagtgtgtggagaagccaggcaaccggctggacagcaggacagagaactgcctgagcagctgtgtggaccgcttcatcgacaccaccctggccatcaccagcagatttgcccagatcgtgcagaagggcggccagtag

SEQ ID NO: 38926 - DNA, 858 bp, Artificial Sequence
  Description of Artificial Sequence: Synthetic coding sequence
atggaggtgcccccaccagcccccaggagcttcctgtgccgggccctgtgcctcttcccccgggtgtttgctgctgaggccgtgacagctgacagcgaggtgctggaggagcggcagaagaggctgccctacgtgcctgagccctactacccagagagcggctgggaccggctgcgggagctgtttgggaaggatgagcagcagaggatcagcaaggacctggccaacatctgcaagacagctgccacagctggcatcatcggctgggtgtatggaggcatcccagccttcatccacgccaagcagcagtacatcgagcagagccaggccgagatctaccacaacagatttgatgctgtgcagagcgcccaccgggccgccacccggggcttcatccgctatggctggcgctggggctggaggacagctgtgtttgtgaccatcttcaacacagtgaacaccagcctgaatgtgtacagaaacaaggatgccctgagccactttgtgattgctggagctgtgacaggcagcctcttccgcatcaacgtgggcctgcggggcctggtggccggcggcatcatcggggccctgctgggcacccctgtgggcggcctgctgatggccttccagaagtacagcggggagaccgtgcaggagaggaagcagaaggacaggaaggccctgcacgagctgaagctggaggagtggaagggccgcctgcaggtgacagagcacctgcctgagaagattgagagcagcctgcaggaggatgagccagaaaatgatgccaagaagattgaggccctgctgaacctgcccaggaaccccagcgtgattgacaagcaggacaaggactag

SEQ ID NO: 38927 - DNA, 438 bp, Artificial Sequence
  Description of Artificial Sequence: Synthetic coding sequence
atggtgggcaggaacagcgccatcgccgccggcgtgtgtggggccctcttcatcggctactgcatctactttgacaggaagagaagaagtgaccccaacttcaagaaccggctgcgggagaggaggaagaagcagaagctggccaaggagcgggccggcctgagcaagctgcctgacctgaaggatgctgaggccgtgcagaagttcttcctggaggagatccagctgggggaggagctgctggcccagggcgagtatgagaagggcgtggaccacctgaccaatgccatcgctgtgtgtggccagccccagcagctgctgcaggtgctgcagcagaccctgcccccacctgtgttccagatgctgctgaccaagctgcccaccatcagccagagaattgtgtctgcccagagcctggctgaagatgatgtggagtag

SEQ ID NO: 38928 - DNA, 459 bp, Artificial Sequence
  Description of Artificial Sequence: Synthetic coding sequence
atgcccagcgtgcgcagcctgctgcggctgctggccgctgctgctgcctgtggggcctttgccttcctgggctactgcatctacctgaacaggaagagaagaggagaccctgccttcaagaggcggctgcgggacaagagaagagctgagccccagaaggccgaggagcagggcacccagctgtgggaccccaccaagaacaagaagctgcaggagctgttcctgcaggaggtgaggatgggagagctgtggctgagcagaggagagcacaggatgggcatccagcacctgggcaatgccctgctggtgtgtgagcagccccgggagctgctgaaggtgttcaagcacaccctgccccccaaggtgtttgagatgctgctgcacaagatccccctcatctgccagcagtttgaagctgacatgaatgagcaggactgcctggaggatgatcctgactag

SEQ ID NO: 38929 - DNA, 930 bp, Artificial Sequence
  Description of Artificial Sequence: Synthetic coding sequence
atggcccccaagttcccagacagcgtggaggagctgcgggctgctggaaatgaaagcttcagaaatggccagtatgcagaggccagcgccctgtatggccgggccctgcgggtgctgcaggcccagggcagcagtgaccctgaggaggagagcgtgctgtacagcaacagagctgcctgccacctgaaggatggcaactgccgggactgcatcaaggactgcaccagcgccctggccctggtgcccttcagcatcaagcccctgctgcggcgggccagcgcctatgaggccctggagaagtaccccatggcctacgtggactacaagacagtgctgcagattgatgacaacgtgaccagcgctgtggagggcatcaacaggatgacccgggccctgatggacagcctgggccctgagtggaggctgaagctgcccagcatccccctggtgcctgtgtctgcccagaagcgctggaacagcctgcccagcgagaaccacaaggagatggccaagagcaagagcaaggagaccacagccaccaagaacagagtgcccagcgctggagatgtggagaaggcccgggtgctgaaggaggagggcaatgagctggtgaagaagggcaaccacaagaaggccatcgagaagtacagcgagagcctgctgtgcagcaacctggagagcgccacctacagcaacagagccctgtgctacctggtgctgaagcagtacacagaggccgtgaaggactgcacagaggccctgaagctggatggcaagaatgtgaaggccttctaccgccgggcccaggcccacaaggccctgaaggactacaagagcagctttgctgacatcagcaacctgctgcagatcgagcccagaaatggacctgcccagaagctgcggcaggaggtgaagcagaacctgcactag

SEQ ID NO: 38930 - DNA, 927 bp, Artificial Sequence
  Description of Artificial Sequence: Synthetic coding sequence
atgggcaacaccctgggcctggcccccatgggcaccctgcccaggaggagcccccggcgggaggagcccctgcccaaccctggcagctttgatgagctgcaccggctgtgcaaggatgtgtttcctgcccagatggagggcgtgaagctggtggtgaacaaggtgctgagcagccacttccaggtggcccacaccatccacatgtctgccctgggcctgcccggctaccacctgcacgccgcctatgctggggactggcagctgagccccacagaggtgttccccaccgtggtgggggacatggacagcagcggcagcctgaatgcccaggtgctgctgctgctggccgagcggctgcgggccaaggctgtgttccagacccagcaggccaagttcctgacctggcagtttgatggagagtacagaggagatgactacacagccaccctgaccctgggcaacccagacctgattggagagagcgtcatcatggtggcccacttcctgcagagcctgacccaccggctggtgctgggcggggagctggtgtaccaccggcggcctggagaggagggcgccatcctgaccctggccggcaagtacagcgctgtgcactgggtggccaccctgaatgtgggcagcggcggggcccacgccagctactaccaccgggccaatgagcaggtgcaggtgggcgtggagtttgaggccaacacccggctgcaggacaccaccttctcctttggctaccacctgaccctgccccaggccaacatggtgttccggggcctggtggacagcaactggtgtgtgggcgctgtgctggagaagaagatgccacccctgcctgtgaccctggccctgggcgccttcctgaaccactggaggaaccgcttccactgcggcttcagcatcaccgtgggctag

SEQ ID NO: 38931 - DNA, 927 bp, Artificial Sequence; identical to SEQ ID NO: 38930
  Description of Artificial Sequence: Synthetic coding sequence

SEQ ID NO: 38932 - DNA, 633 bp, Artificial Sequence
  Description of Artificial Sequence: Synthetic coding sequence
atgagctgcaccgtgtatgccaaggtggcccacaccatccacatgtctgccctgggcctgcccggctaccacctgcatgctgcctatgctggggactggcagctgagccccacagaggtgttccccaccgtggtgggggacatggacagcagcggcagcctgaatgcccaggtgctgctgctgctggccgagcggctgcgggccaaggctgtgttccagacccagcaggccaagttcctgacctggcagtttgatggagagtacagaggagatgactacacagccaccctgaccctggccggcaagtacagcgctgtgcactgggtggccaccctgaatgtgggcagcggcggggcccacgccagctactaccaccgggccaatgagcaggtgcaggtgggcgtggagtttgaggccaacacccggctgcaggacaccaccttctcctttggctaccacctgaccctgccccaggccaacatggtgttccggggcctggtggacagcaactggtgtgtgggcgctgtgctggagaagaagatgccacccctgcctgtgaccctggccctgggcgccttcctgaaccactggaggaaccgcttccactgcggcttcagcatcaccgtgggctag

SEQ ID NO: 38933 - DNA, 825 bp, Artificial Sequence
  Description of Artificial Sequence: Synthetic coding sequence
atgggcaacaccctgggcctggcccccatgggcaccctgcccaggaggagcccccggcgggaggagcccctgcccaaccctggcagctttgatgagctgcaccggctgtgcaaggatgtgtttcctgcccagatggagggcgtgaagctggtggtgaacaaggtgctgagcagccacttccaggtggcccacaccatccacatgtctgccctgggcctgcccggctaccacctgcacgccgcctatgctggggactggcagctgagccccacagagacccagcaggccaagttcctgacctggcagtttgatggagagtacagaggagatgactacacagccaccctgaccctgggcaacccagacctgattggagagagcgtcatcatggtggcccacttcctgcagagcctgacccaccggctggtgctgggcggggagctggtgtaccaccggcggcctggagaggagggcgccatcctgaccctggccggcaagtacagcgctgtgcactgggtggccaccctgaatgtgggcagcggcggggcccacgccagctactaccaccgggccaatgagcaggtgcaggtgggcgtggagtttgaggccaacacccggctgcaggacaccaccttctcctttggctaccacctgaccctgccccaggccaacatggtgttccggggcctggtggacagcaactggtgtgtgggcgctgtgctggagaagaagatgccacccctgcctgtgaccctggccctgggcgccttcctgaaccactggaggaaccgcttccactgcggcttcagcatcaccgtgggctag

SEQ ID NO: 38934 - DNA, 156 bp, Artificial Sequence
  Description of Artificial Sequence: Synthetic coding sequence
atgttccgcatcgagggcctggcccccaagctggaccctgaggagatgaagaggaagatgagagaagatgtgatcagcagcatccggaacttcctgatctacgtggccctgctgcgggtgacccccttcatcctgaagaagctggacagcatctag

SEQ ID NO: 38935 - DNA, 258 bp, Artificial Sequence
  Description of Artificial Sequence: Synthetic coding sequence
atgttccgcatcgagggcctggcccccaagctggaccctgaggagatgaagaggaagatgagagaagatgtgatcagcagcatccggaacttcctgatctacgtggccctgctgcgggtgtctgagtgcctgcccggctgtgactgtgagaccagcggggagctgacagatggccaccccctgaccctgcggggccaccggggcctgaggacagagctgaatgcccccttcatcctgaagaagctggacagcatctag

SEQ ID NO: 38936 - DNA, 279 bp, Artificial Sequence
  Description of Artificial Sequence: Synthetic coding sequence
atgttccgcatcgagggcctggcccccaagctggaccctgaggagatgaagaggaagatgagagaagatgtgatcagcagcatccggaacttcctgatctacgtggccctgctgcgggtgtctgagtgcctgcccggctgtgactgtgagaccagcggggagctgacagatggccaccccctgaccctgcggggccaccggggcctgaggacagagctgaatggcagcggggagcagggcggctgtgccctgaaggccaccggcatctgtgctgtgtag

SEQ ID NO: 38937 - DNA, 225 bp, Artificial Sequence
  Description of Artificial Sequence: Synthetic coding sequence
atggccagcagcacagtgcctgtgtctgctgctggcagcgccaatgagaccccagagatcccagacaacgtgggggactggctgcggggcgtgtacagatttgccacagacagaaatgacttcagaagaaacctgatcctgaacctgggcctgtttgctgctggggtgtggctggccaggaacctgagtgacatcgacctgatggccccccagcccggggtgtag

SEQ ID NO: 38938 - DNA, 225 bp, Artificial Sequence; identical to SEQ ID NO: 38937
  Description of Artificial Sequence: Synthetic coding sequence

SEQ ID NO: 38939 - DNA, 168 bp, Artificial Sequence
  Description of Artificial Sequence: Synthetic coding sequence
atggtgaagctgagcaaggaggccaagcagaggctgcagcagctgttcaagggcagccagtttgccatccgctggggcttcatccccctggtgatctacctgggcttcaagagaggagctgaccccggcatgcctgagcccaccgtgctgagcctgctgtggggctag

SEQ ID NO: 38940 - DNA, 1827 bp, Artificial Sequence
  Description of Artificial Sequence: Synthetic coding sequence
atggccgccagcaagcctgtggaggccgctgtggtggccgctgctgtgcccagcagcggcagcggcgtgggcggcggcggcacagctggccctggcactggaggcctgccccgctggcagctggccctggccgtgggcgcccccctgctgctgggcgctggggccatctacctgtggagccggcagcagaggagaagagaggcccggggcagaggagatgccagcggcctgaagagaaattctgagaggaagaccccagagggccgggccagccctgcccctggcagcggccaccctgagggccctggggcccacctggacatgaacagcctggaccgggcccaggccgccaagaacaagggcaacaagtacttcaaggccggcaagtatgagcaggccatccagtgctacacagaggccatcagcctgtgccccacagagaagaatgtggacctgagcaccttctaccagaacagagctgctgcctttgagcagctgcagaagtggaaggaggtggcccaggactgcaccaaggctgtggagctgaaccccaagtatgtgaaggccctcttccggcgggccaaggcccacgagaagctggacaacaagaaggaatgtctggaggatgtgacagctgtgtgcatcctggagggcttccagaaccagcagagcatgctgctggccgacaaggtgctgaagctgctgggcaaggagaaggccaaggagaagtacaagaaccgggagcccctgatgcccagcccccagttcatcaagagctacttcagcagcttcacagatgacatcatcagccagcccatgctgaagggggagaagagtgatgaggacaaggacaaggagggggaggccctggaggtgaaggagaacagcggctacctgaaggccaagcagtacatggaggaggagaactatgacaagatcatcagcgagtgcagcaaggagattgatgctgagggcaagtacatggccgaggccctgctgctgcgggccaccttctacctgctgattggaaatgccaatgctgccaagccagacctggacaaggtgatcagcctgaaggaggccaacgtgaagctgcgggccaatgccctgatcaagaggggctccatgtacatgcagcagcagcagcccctgctgagcacccaggacttcaacatggctgctgacatcgacccccagaatgctgatgtgtaccaccaccggggccagctgaagatcctgctggaccaggtggaggaggccgtggccgactttgatgagtgcatccggctgcggcctgagagcgccctggcccaggcccagaagtgctttgccctgtaccggcaggcctacacaggcaacaacagcagccagatccaggccgccatgaagggctttgaggaggtgatcaagaagttcccccgctgtgccgagggctacgccctgtatgcccaggccctgacagaccagcagcagtttgggaaggcagatgagatgtatgacaagtgcatcgacctggagccagacaatgccaccacctacgtgcacaagggcctgctgcagctgcagtggaagcaggacctggaccggggcctggagctgatcagcaaggccatcgagattgacaacaagtgtgactttgcctatgagaccatgggcaccatcgaggtgcagaggggcaacatggagaaggccatcgacatgttcaacaaggccatcaacctggccaagtctgagatggagatggcccacctgtacagcctgtgtgatgctgcccacgcccagacagaggtggccaagaagtatggcctgaagccacccaccctgtag

SEQ ID NO: 38941 - DNA, 1506 bp, Artificial Sequence
  Description of Artificial Sequence: Synthetic coding sequence
atgaacagcctggaccgggcccaggccgccaagaacaagggcaacaagtacttcaaggccggcaagtatgagcaggccatccagtgctacacagaggccatcagcctgtgccccacagagaagaatgtggacctgagcaccttctaccagaacagagctgctgcctttgagcagctgcagaagtggaaggaggtggcccaggactgcaccaaggctgtggagctgaaccccaagtatgtgaaggccctcttcagaagagccaaggcccacgagaagctggacaacaagaaggagtgcctggaggatgtgacagctgtgtgcatcctggagggcttccagaaccagcagagcatgctgctggccgacaaggtgctgaagctgctgggcaaggagaaggccaaggagaagtacaagaaccgggagcccctgatgcccagcccccagttcatcaagagctacttcagcagcttcacagatgacatcatcagccagcccatgctgaagggggagaagagtgatgaggacaaggacaaggagggggaggccctggaggtgaaggaaaattctggctacctgaaggccaagcagtacatggaggaggagaactatgacaagatcatcagtgaatgttccaaggagattgatgctgagggcaagtacatggccgaggccctgctgctgcgggccaccttctacctgctgattggaaatgccaatgctgccaagccagacctggacaaggtgatcagcctgaaggaggccaacgtgaagctgcgggccaatgccctgatcaagaggggctccatgtacatgcagcagcagcagcccctgctgagcacccaggacttcaacatggctgctgacatcgacccccagaatgctgatgtgtaccaccaccggggccagctgaagatcctgctggaccaggtggaggaggccgtggccgactttgatgagtgcatccggctgcggcctgagagcgccctggcccaggcccagaagtgctttgccctgtaccggcaggcctacacaggcaacaacagcagccagatccaggccgccatgaagggctttgaggaggtgatcaagaagttcccccgctgtgccgagggctacgccctgtatgcccaggccctgacagaccagcagcagtttgggaaggcagatgagatgtatgacaagtgcatcgacctggagccagacaatgccaccacctacgtgcacaagggcctgctgcagctgcagtggaagcaggacctggaccggggcctggagctgatcagcaaggccattgaaattgacaacaagtgtgactttgcctatgagaccatgggcaccatcgaggtgcagaggggcaacatggagaaggccatcgacatgttcaacaaggccatcaacctggccaagtctgagatggagatggcccacctgtacagcctgtgtgatgctgcccacgcccagacagaggtggccaagaagtatggcctgaagccacccaccctgtag

SEQ ID NO: 38942 - DNA, 1125 bp, Artificial Sequence
  Description of Artificial Sequence: Synthetic coding sequence
atggccatcaggaagaagagcaccaagagcccccctgtgctgagccatgaatttgtgctgcagaaccacgccgacatcgtgtcctgtgtggccatggtgttcctgctgggcctgatgtttgagatcacagccaaggccagcatcatctttgtgaccctgcagtacaacgtgaccctgcctgccacagaggagcaggccacagaatctgtgtccctgtactactacggcatcaaggacctggccaccgtcttcttctacatgctggtggccatcatcatccatgctgtgatccaggagtacatgctggacaagatcaacagaaggatgcacttcagcaagaccaagcacagcaagttcaatgaaagtggccagctgagcgccttctacctgtttgcctgtgtgtggggcaccttcatcctgatcagcgagaactacatcagtgaccccaccatcctgtggagggcctacccccacaacctgatgaccttccagatgaagttcttctacatcagccagctggcctactggctgcacgccttccctgagctgtacttccagaagaccaagaaggaggacatcccccggcagctggtgtacatcggcctgtacctgttccacatcgccggggcctacctgctgaacctgaaccacctgggcctggtgctgctggtgctgcactactttgtggagttcctgttccacatcagccgcctcttctacttcagcaatgagaagtaccagaagggcttcagcctgtgggccgtgctgtttgtgctgggccgcctgctgaccctcatcctgtctgtgctgactgtgggcttcggcctggcccgggcagagaaccagaagctggacttcagcacaggcaacttcaacgtgctggccgtgagaattgctgtgctggccagcatctgtgtgacccaggccttcatgatgtggaagttcatcaacttccagctgcggcgctggagggagcacagcgccttccaggccccagctgtgaagaagaagcccaccgtgaccaagggccgcagcagcaagaagggcacagaaaatggagtgaatggcaccctgaccagcaatgtggccgacagccccaggaacaagaaggagaagagcagctag

SEQ ID NO: 38943 - DNA, 1032 bp, Artificial Sequence
  Description of Artificial Sequence: Synthetic coding sequence
atggtgttcctgctgggcctgatgtttgagatcacagccaaggccagcatcatctttgtgaccctgcagtacaacgtgaccctgcctgccacagaggagcaggccacagagagcgtgtccctgtactactacggcatcaaggacctggccaccgtcttcttctacatgctggtggccatcatcatccacgccgtcatccaggagtacatgctggacaagatcaacagaaggatgcacttcagcaagaccaagcacagcaagttcaatgaaagtggccagctgagcgccttctacctgtttgcctgtgtgtggggcaccttcatcctgatcagcgagaactacatcagtgaccccaccatcctgtggagggcctacccccacaacctgatgaccttccagatgaagttcttctacatcagccagctggcctactggctgcacgccttccctgagctgtacttccagaagaccaagaaggaggacatcccccggcagctggtgtacatcggcctgtacctgttccacatcgccggggcctacctgctgaacctgaaccacctgggcctggtgctgctggtgctgcactactttgtggagttcctgttccacatcagccgcctcttctacttcagcaatgagaagtaccagaagggcttcagcctgtgggccgtgctgtttgtgctgggccgcctgctgaccctcatcctgtctgtgctgactgtgggcttcggcctggcccgggcagagaaccagaagctggacttcagcactggaaacttcaacgtgctggccgtgagaattgctgtgctggccagcatctgtgtgacccaggccttcatgatgtggaagttcatcaacttccagctgcggcgctggagggagcacagcgccttccaggccccagctgtgaagaagaagcccaccgtgaccaagggccgcagcagcaagaagggcacagaaaatggagtgaatggcaccctgaccagcaatgtggccgacagccccaggaacaagaaggagaagagcagctag

SEQ ID NO: 38944 - DNA, 1110 bp, Artificial Sequence
  Description of Artificial Sequence: Synthetic coding sequence
atgggcctgaggaagaagagcaccaagaacccccctgtgctgagccaggagttcatcctgcagaaccacgccgacatcgtgtcctgtgtgggcatgttcttcctgctgggcctggtgtttgagggcacagctgaggccagcatcgtgttcctgaccctgcagcacagcgtggccgtgcctgctgctgaggagcaggccaccggcagcaagagcctgtactactatggagtgaaggacctggccaccgtcttcttctacatgctggtggccatcatcatccacgccaccatccaggagtatgtgctggacaagatcaacaagaggatgcagttcaccaaggccaagcagaacaagttcaatgaaagtggccagttcagcgtcttctacttcttcagctgcatctggggcaccttcatcctgatcagcgagaactgcctgagtgaccccaccctcatctggaaggcccggccccacagcatgatgaccttccagatgaagttcttctacatcagccagctggcctactggttccacgccttccctgagctgtacttccagaagaccaagaagcaggacatcccccggcagctggtgtacatcggcctgcacctgttccacatcaccggggcctacctgctgtacctgaaccacctgggcctgctgctgctggtgctgcactactttgtggagctgctgagccacatgtgtggcctcttctacttcagtgatgagaagtaccagaagggcatcagcctgtgggccatcgtgttcatcctgggccgcctggtgaccctcatcgtgtctgtgctgactgtgggcttccacctggccggcagccagaacagaaatccagatgccctgactggaaatgtgaatgtgctggccgccaagattgctgtgctgagcagcagctgcaccatccaggcctacgtgacctggaacctgatcaccctgtggctgcagcgctgggtggaggacagcaacatccaggccagctgcatgaagaagaagaggagccgcagcagcaagaagaggacagaaaatggagtgggcgtggagaccagcaacagagtggactgcccccccaagaggaaggagaagagcagctag

SEQ ID NO: 38945 - DNA, 1113 bp, Artificial Sequence
  Description of Artificial Sequence: Synthetic coding sequence
atggccttcagaagaaggaccaagagctaccccctcttcagccaggagtttgtgatccacaaccacgccgacatcggcttctgcctggtgctgtgtgtgctgattggcctgatgtttgaggtgacagccaagacagccttcctgttcatcctgccccagtacaacatctctgtgcccacagctgacagcgagaccgtgcactaccactacggccccaaggacctggtgaccatcctcttctacatcttcatcaccatcatcctgcatgctgtggtgcaggagtacatcctggacaagatcagcaagaggctgcacctgagcaaggtgaagcacagcaagttcaatgaaagtggccagctggtggtgttccacttcaccagcgtcatctggtgcttctacgtggtggtgacagagggctacctgaccaaccccaggagcctgtgggaggactacccccacgtgcacctgcccttccaggtgaagttcttctacctgtgccagctggcctactggctgcacgccctgcctgagctgtacttccagaaggtgaggaaggaggagatcccccggcagctgcagtacatctgcctgtacctggtgcacatcgccggggcctacctgctgaacctgagccggctgggcctcatcctgctgctgctgcagtacagcacagagttcctgttccacacagcccggctcttctactttgctgatgaaaataatgagaagctgttcagcgcctgggccgctgtgtttggagtgaccaggctcttcatcctgaccctggccgtgctggccatcggcttcggcctggccaggatggagaaccaggcctttgatcctgagaagggcaacttcaacaccctcttctgccgcctgtgtgtgctgctgctggtgtgtgccgcccaggcctggctgatgtggaggttcatccacagccagctgcggcactggagggagtactggaatgagcagagcgccaagagaagagtgcctgccaccccccggctgcctgcccggctcatcaagcgggagagcggctaccatgaaaatggagtggtgaaggcagaaaatggcaccagccccaggaccaagaagctgaagagcccctag

SEQ ID NO: 38946 - DNA, 513 bp, Artificial Sequence
  Description of Artificial Sequence: Synthetic coding sequence
atgaggctgcagggcgccatctttgtgctgctgccccacctgggccccatcctggtgtggctgttcacccgggaccacatgagcggctggtgtgagggccccaggatgctgtcctggtgccccttctacaaggtgctgctgctggtgcagacagccatctacagcgtggtgggctacgccagctacctggtgtggaaggacctgggcggcggcctgggctggcccctggccctgcccctgggcctgtatgctgtgcagctgaccatctcctggacagtgctggtgctcttcttcaccgtgcacaaccctggcctggccctgctgcacctgctgctgctgtatggcctggtggtgtccacagccctgatctggcaccccatcaacaagctggccgccctgctgctgctgccctacctggcctggctgactgtgaccagcgccctgacctaccacctgtggagggacagcctgtgccctgtgcaccagccccagcccacagagaagagtgactag

SEQ ID NO: 38947 - DNA, 513 bp, Artificial Sequence; identical to SEQ ID NO: 38946
  Description of Artificial Sequence: Synthetic coding sequence

SEQ ID NO: 38948 - DNA, 1047 bp, Artificial Sequence
  Description of Artificial Sequence: Synthetic coding sequence
atgaggctgggcctgctgtctgtggccctgctgtttgtgggcagcagccacctgtacagcgaccactacagccccagcggccgccaccggctgggccccagccctgagcctgctgccagcagccagcaggccgaggccgtgaggaagaggctgcggcggcggcgggagggcggggcccatgctgaggactgtggcacagcccccctgaaggatgtgctgcagggcagccgcatcattggaggaacagaggcccaggccggggcctggccctgggtggtgtccctgcagatcaagtatggccgggtgctggtgcacgtgtgtggcggcaccctggtgcgggagcgctgggtgctgacagctgcccactgcaccaaggatgccagtgaccccctgatgtggacagctgtgattggcaccaacaacatccacggccgctacccccacaccaagaagatcaagatcaaggccatcatcatccaccccaacttcatcctggagagctatgtgaatgacatcgccctcttccacctgaagaaggctgtgcgctacaatgactacatccagcccatctgcctgccctttgatgtgttccagatcctggatggcaacaccaagtgcttcatcagcggctggggccgcaccaaggaggagggcaatgccaccaacatcctgcaggatgctgaggtgcactacatcagccgggagatgtgcaacagcgagaggagctatggaggcatcatccccaacaccagcttctgtgctggagatgaagatggagcctttgacacctgccgcggggacagcggcggccccctgatgtgctacctgcctgagtacaagcgcttctttgtgatgggcatcaccagctatggccacggctgcggccggcggggcttccctggggtgtacatcggccccagcttctaccagaagtggctgacagagcacttcttccacgccagcacccagggcatcctgaccatcaacatcctgcggggccagatcctgattgccctgtgctttgtgatcctgctggccaccacctag

SEQ ID NO: 38949 - DNA, 606 bp, Artificial Sequence
  Description of Artificial Sequence: Synthetic coding sequence
atgggcagcaggaaatgtggcggctgcctgagctgcctgctgatccccctggccctgtggagcatcatcgtgaacatcctgctgtacttccccaacggccagaccagctatgccagcagcaacaagctgaccaactacgtgtggtactttgagggcatctgcttcagcggcatcatgatgctgattgtgaccaccgtgctgctggtgctggagaacaacaacaactacaagtgctgccagagcgagaactgcagcaagaagtatgtgaccctgctgagcatcatcttcagcagcctgggcatcgccttcagcggctactgcctggtgatcagcgccctgggcctggtgcagggcccctactgcaggaccctggatggctgggagtatgcctttgagggcacagctggccgcttcctgacagacagcagcatctggatccagtgcctggagcccgcccacgtggtggagtggaacatcatcctcttcagcatcctgatcaccctgagcggcctgcaggtgatcatctgcctgatccgggtggtgatgcagctgagcaagatcctgtgtggcagctacagcgtcatcttccagcccggcatcatctag

SEQ ID NO: 38950 - DNA, 606 bp, Artificial Sequence; identical to SEQ ID NO: 38949
  Description of Artificial Sequence: Synthetic coding sequence

SEQ ID NO: 38951 - DNA, 480 bp, Artificial Sequence
  Description of Artificial Sequence: Synthetic coding sequence
atgggcagcaggaaatgtggcggctgcctgagctgcctgctgatccccctggccctgtggagcatcatcgtgaacatcctgctgtacttccccaacggccagaccagctatgccagcagcaacaagctgaccaactacgtgtggtactttgagggcatctgcttcagcggcatcatgatgctgattgtgaccaccgtgctgctggtgctggagaacaacaacaactacaagtgctgccagagcgagaactgcagcaagaagtatgtgaccctgctgagcatcatcttcagcagcctgggcatcgccttcagcggctactgcctggtgatcagcgccctgggcctggtgcagggcccctactgcaggaccctggatggctgggagtatgcctttgagggcacagctggccgcttcctgacagacagcagcatctggatccagtgcctggagcccgcccacgtggtggagtggaacatctag

SEQ ID NO: 38952 - DNA, 630 bp, Artificial Sequence
  Description of Artificial Sequence: Synthetic coding sequence
atggtgagcagcccctgcacccaggccagcagcaggacctgcagccgcatcctgggcctgagcctgggcacagctgccctgtttgctgctggggccaacgtggccctgctgctgcccaactgggatgtgacctacctgctgcggggcctgctgggcagacatgccatgctgggcaccggcctgtggggcggcggcctgatggtgctgacagctgccatcctgatcagcctgatgggctggaggtatggctgcttcagcaagagcggcctgtgccgctctgtgctgacagccctgctgagcggcggcctggccctgctgggcgccctgatctgctttgtgaccagcggcgtggccctgaaggatggccccttctgcatgtttgatgtgtcctccttcaaccagacccaggcctggaagtatggctaccccttcaaggacctgcacagcaggaactacctgtatgacaggagcctgtggaacagcgtgtgcctggagcccagcgctgctgtggtgtggcacgtgtccctcttcagcgccctgctgtgcatcagcctgctgcagctgctgctggtggtggtgcacgtgatcaacagcctgctgggcctcttctgcagcctgtgtgagaagtag

SEQ ID NO: 38953 - DNA, 630 bp, Artificial Sequence; identical to SEQ ID NO: 38952
  Description of Artificial Sequence: Synthetic coding sequence

SEQ ID NO: 38954 - DNA, 552 bp, Artificial Sequence
  Description of Artificial Sequence: Synthetic coding sequence
atggtgagcagcccctgcacccaggccagcagcaggacctgcagccgcatcctgggcctgagcctgggcacagctgccctgtttgctgctggggccaacgtggccctgctgctgcccaactgggatgtgacctacctgctgcggggcctgctgggcagacatgccatgctgggcaccggcctgtggggcggcggcctgatggtgctgacagccctgctgagcggcggcctggccctgctgggcgccctgatctgctttgtgaccagcggcgtggccctgaaggatggccccttctgcatgtttgatgtgtcctccttcaaccagacccaggcctggaagtatggctaccccttcaaggacctgcacagcaggaactacctgtatgacaggagcctgtggaacagcgtgtgcctggagcccagcgctgctgtggtgtggcacgtgtccctcttcagcgccctgctgtgcatcagcctgctgcagctgctgctggtggtggtgcacgtgatcaacagcctgctgggcctcttctgcagcctgtgtgagaagtag

SEQ ID NO: 38955 - DNA, 690 bp, Artificial Sequence
  Description of Artificial Sequence: Synthetic coding sequence
atgacctgctgtgagggctggaccagctgcaatggcttcagcctgctggtgctgctgctgctgggcgtggtgctgaatgccatccccctgattgtgtccctggtggaggaggaccagttcagccagaaccccatcagctgctttgagtggtggttccctggcatcatcggggccggcctgatggccatcccagccaccaccatgagcctgacagccaggaagagggcctgctgcaacaacagaacaggcatgttcctgagcagcctcttcagcgtcatcaccgtcatcggggccctgtactgcatgctgatcagcatccaggccctgctgaagggccccctgatgtgcaacagccccagcaacagcaatgccaactgtgagttcagcctgaagaacatcagtgacatccaccctgagagcttcaacctgcagtggttcttcaatgacagctgtgcccccccaacaggcttcaacaagcccaccagcaatgacaccatggccagcggctggagggccagcagcttccactttgattctgaggagaacaagcacaggctcatccacttcagcgtcttcctgggcctgctgctggtgggcatcctggaggtgctgtttggcctgagccagatcgtcatcggcttcctgggctgcctgtgtggggtgtccaagaggaggagccagatcgtgtag

SEQ ID NO: 38956 - DNA, 45 bp, Artificial Sequence
  Description of Artificial Sequence: Synthetic coding sequence
atgacctgctgtgagggctggaccagctgcaatggcttctcctag

SEQ ID NO: 38957 - DNA, 1821 bp, Artificial Sequence
  Description of Artificial Sequence: Synthetic coding sequence
atgacagtggtgggcaaccccaggtcctggagctgccagtggctgcccatcctgatcctgctgctgggcaccggccacggccctggggtggagggcgtgacccactacaaggccggggaccctgtgatcctgtatgtgaacaaggtgggcccctaccacaacccccaggagacctaccactactaccagctgcctgtgtgctgcccagagaagatccgccacaagagcctgagcctgggggaggtgctggatggagacaggatggccgagagcctgtatgagatccgcttcagagaaaatgtggagaagaggatcctgtgccacatgcagctgagcagcgcccaggtggagcagctgcggcaggccatcgaggagctgtactactttgaatttgtggtggatgacctgcccatccggggctttgtgggctacatggaggagagcggcttcctgccccacagccacaagattggcctgtggacccacctggacttccacctggagttccacggggaccgcatcatctttgccaacgtgtctgtgagagatgtgaagccccacagcctggatggcctgcggccagatgagttcctgggcctgacccacacctacagcgtgcgctggagcgagacctctgtggagaggagaagtgacagaagaagaggagatgatggcggcttcttccccaggaccctggagatccactggctgagcatcatcaacagcatggtgctggtgttcctgctggtgggctttgtggccgtcatcctgatgagggtgctgagaaatgacctggcccgctacaacctggatgaggagaccaccagcgctggcagcggagatgactttgaccagggcgacaatggctggaagatcatccacacagatgtgttccgcttccccccctaccggggcctgctgtgtgctgtgctgggcgtgggcgcccagttcctggccctgggcaccggcatcatcgtgatggccctgctgggcatgttcaacgtgcaccgccacggggccatcaacagcgctgccatcctgctgtatgccctgacctgctgcatcagcggctacgtgagcagccacttctaccggcagattggaggagagcgctgggtgtggaacatcatcctgaccaccagcctcttctctgtgcccttcttcctgacctggagcgtggtgaacagcgtgcactgggccaacggcagcacccaggccctgcctgccaccaccatcctgctgctgctgactgtgtggctgctggtgggcttccccctgactgtgattggaggcatctttgggaagaacaatgccagcccctttgatgccccctgcaggaccaagaacatcgcccgggagatccccccccagccctggtacaagagcaccgtcatccacatgacagtgggcggcttcctgcccttcagcgccatctctgtggagctgtactacatctttgccaccgtgtggggccgggagcagtacaccctgtatggcatcctcttctttgtgtttgccatcctgctgtctgtgggcgcctgcatcagcatcgccctgacctacttccagctgtctggagaggactaccgctggtggtggaggtctgtgctgtctgtgggcagcacaggcctcttcatcttcctgtacagcgtcttctactatgcccggcgcagcaacatgtctggagctgtgcagacagtggagttcttcggctacagcctgctgaccggctacgtgttcttcctgatgctgggcaccatctccttcttcagcagcctgaagttcatccgctacatctacgtgaacctgaagatggactag

SEQ ID NO: 38958 - DNA, 1470 bp, Artificial Sequence
  Description of Artificial Sequence: Synthetic coding sequence
atgacagtggtgggcaaccccaggtcctggagctgccagtggctgcccatcctgatcctgctgctgggcaccggccacggccctggggtggagggcgtgacccactacaaggccggggaccctgtgatcctgtatgtgaacaaggtgggcccctaccacaacccccaggagacctaccactactaccagctgcctgtgtgctgcccagagaagatccgccacaagagcctgagcctgggggaggtgctggatggagacaggatggccgagagcctgtatgagatccgcttcagagaaaatgtggagaagaggatcctgtgccacatgcagctgagcagcgcccaggtggagcagctgcggcaggccatcgaggagctgtactactttgaatttgtggtggatgacctgcccatccggggctttgtgggctacatggaggagagcggcttcctgccccacagccacaagattggcctgtggacccacctggacttccacctggagttccacggggaccgcatcatctttgccaacgtgtctgtgagagatgtgaagccccacagcctggatggcctgcggccagatgagttcctgggcctgacccacacctacagcgtgcgctggagcgagacctctgtggagaggagaagtgacagaagaagaggagatgatggcggcttcttccccaggaccctggagatccactggctgagcatcatcaacagcatggtgctggtgttcctgctggtgggctttgtggccgtcatcctgatgagggtgctgagaaatgacctggcccgctacaacctggatgaggagaccaccagcgctggcagcggagatgactttgaccagggcgacaatggctggaagatcatccacacagatgtgttccgcttccccccctaccggggcctgctgtgtgctgtgctgggcgtgggcgcccagttcctggccctgggcaccggcatcatcgtgatggccctgctgggcatgttcaacgtgcaccgccacggggccatcaacagcgctgccatcctgctgtatgccctgacctgctgcatcagcggctacgtgagcagccacttctaccggcagattggaggagagcgctgggtgtggaacatcatcctgaccaccagcctcttctctgtgcccttcttcctgacctggagcgtggtgaacagcgtgcactgggccaacggcagcacccaggccctgcctgccaccaccatcctgctgctgctgactgtgtggctgctggtgggcttccccctgactgtgattggaggcatctttgggaagaacaatgccagcccctttgatgccccctgcaggaccaagaacatcgcccgggagatccccccccagccctggtacaagagcaccgtcatccacatgacagtgggcggcttcctgcccttccgctacccacccttcatcccctggctgctgctgagcggcagctag

SEQ ID NO: 38959 - DNA, 729 bp, Artificial Sequence
  Description of Artificial Sequence: Synthetic coding sequence
atgacagtggtgggcaaccccaggtcctggagctgccagtggctgcccatcctgatcctgctgctgggcaccggccacggccctggggtggagggcgtgacccactacaaggccggggaccctgtgatcctgtatgtgaacaaggtgggcccctaccacaacccccaggagacctaccactactaccagctgcctgtgtgctgcccagagaagatccgccacaagagcctgagcctgggggaggtgctggatggagacaggatggccgagagcctgtatgagatccgcttcagagaaaatgtggagaagaggatcctgtgccacatgcagctgagcagcgcccaggtggagcagctgcggcaggccatcgaggagctgtactactttgaatttgtggtggatgacctgcccatccggggctttgtgggctacatggaggagagcggcttcctgccccacagccacaagattggcctgtggacccacctggacttccacctggagttccacggggaccgcatcatctttgccaacgtgtctgtgagagatgtgaagccccacagcctggatggcctgcggccagatgagttcctgggcctgacccacacctacagcgtgcgctggagcgagacctctgtggagaggagaagtgacagaagaagaggagatgatggcggcttcttccccaggaccctggagatccactggctgagcatcatcaacagctag

SEQ ID NO: 38960 - DNA, 633 bp, Artificial Sequence
  Description of Artificial Sequence: Synthetic coding sequence
atgacagtggtgggcaaccccaggtcctggagctgccagtggctgcccatcctgatcctgctgctgggcaccggccacggccctggggtggagggcgtgacccactacaaggccggggaccctgtgatcctgtatgtgaacaaggtgggcccctaccacaacccccaggagacctaccactactaccagctgcctgtgtgctgcccagagaagatccgccacaagagcctgagcctgggggaggtgctggatggagacaggatggccgagagcctgtatgagatccgcttcagagaaaatgtggagaagaggatcctgtgccacatgcagctgagcagcgcccaggtggagcagctgcggcaggccatcgaggagctgtactactttgaatttgtggtggatgacctgcccatccggggctttgtgggctacatggaggagagcggcttcctgccccacagccacaagattggcctgtggacccacctggacttccacctggagttccacggggaccgcatcatctttgccaacgtgtctgtgagagatgtgaagccccacagcctggatggcctgcggccagatgagttcctgggcctgacccacacctacagcgtgcgctggagcgagtag

SEQ ID NO: 38961 - DNA, 906 bp, Artificial Sequence
  Description of Artificial Sequence: Synthetic coding sequence
atgacagtggtgggcaaccccaggtcctggagctgccagtggctgcccatcctgatcctgctgctgggcaccggccacggccctggggtggagggcgtgacccactacaaggccggggaccctgtgatcctgtatgtgaacaaggtgggcccctaccacaacccccaggagacctaccactactaccagctgcctgtgtgctgcccagagaagatccgccacaagagcctgagcctgggggaggtgctggatggagacaggatggccgagagcctgtatgagatccgcttcagagaaaatgtggagaagaggatcctgtgccacatgcagctgagcagcgcccaggtggagcagctgcggcaggccatcgaggagctgtactactttgaatttgtggtggatgacctgcccatccggggctttgtgggctacatggaggagagcggcttcctgccccacagccacaagattggcctgtggacccacctggacttccacctggagttccacggggaccgcatcatctttgccaacgtgtctgtgagagatgtgaagccccacagcctggatggcctgcggccagatgagttcctgggcctgacccacacctacagcgtgcgctggagcgagacctctgtggagaggagaagtgacagaagaagaggagatgatggcggcttcttccccaggaccctggagatccactggctgagcatcatcaacagcatggtgctggtgttcctgctggtgggctttgtggccgtcatcctgatgagggtgctgagaaatgacctggcccgctacaacctggatgaggagaccaccagcgctggcagcggagatgactttgaccagggcgacaatggctggaagatcatccacacagatgtgttccgcttcccctag

SEQ ID NO: 38962 - DNA, 774 bp, Artificial Sequence
  Description of Artificial Sequence: Synthetic coding sequence
atgacagtggtgggcaaccccaggtcctggagctgccagtggctgcccatcctgatcctgctgctgggcaccggccacggccctggggtggagggcgtgacccactacaaggccggggaccctgtgatcctgtatgtgaacaaggtgggcccctaccacaacccccaggagacctaccactactaccagctgcctgtgtgctgcccagagaagatccgccacaagagcctgagcctgggggaggtgctggatggagacaggatggccgagagcctgtatgagatccgcttcagagaaaatgtggagaagaggatcctgtgccacatgcagctgagcagcgcccaggtggagcagctgcggcaggccatcgaggagctgtactactttgaatttgtggtggatgacctgcccatccggggctttgtgggctacatggaggagagcggcttcctgccccacagccacaagattggcctgtggacccacctggacttccacctggagttccacggggaccgcatcatctttgccaacgtgtctgtgagagatgtgaagccccacagcctggatggcctgcggccagatgagttcctgggcctgacccacacctacagcgtgcgctggagcgagacctctgtggagaggagaagtgacagaagaagaggagatgatggcggcttcttccccaggaccctggagatccactggctgagcatcatcaacagcatggtgctggtgttcctgctggtgggctttgtggccgtcatcctgtag

SEQ ID NO: 38963 - DNA, 2448 bp, Artificial Sequence
  Description of Artificial Sequence: Synthetic coding sequence
atgagcggcctgggccgcctgtttgggaagggcaagaaggagaagggccccaccccagaggaggccatccagaagctgaaggagacagagaagatcctgatcaagaagcaggagttcctggagcagaagatccagcaggagctgcagacagccaagaagtatggcaccaagaacaagagagctgccctgcaggccctgcggaggaagaagagatttgagcagcagctggcccagacagatggcaccctgagcaccctggagttccagcgggaggccattgaaaatgccaccaccaatgctgaggtgctgcggaccatggagctggccgcccagagcatgaagaaggcctaccaggacatggacatcgacaaggtggatgagctgatgacagacatcacagagcagcaggaggtggcccagcagatcagtgatgccatcagccggcccatgggctttggagatgatgtggatgaagatgagctgctggaggagctggaggagctggagcaggaggagctggcccaggagctgctgaatgtgggggacaaggaggaggagcccagcgtgaagctgcccagcgtgcccagcacccacctgcctgctggccctggcagcacagccctgaggatgacagtggtgggcaaccccaggtcctggagctgccagtggctgcccatcctgatcctgctgctgggcactggacatggccctggggtggagggcgtgacccactacaaggccggggaccccgtcatcctgtatgtgaacaaggtgggcccctaccacaacccccaggagacctaccactactaccagctgcctgtgtgctgcccagagaagatccgccacaagagcctgagcctgggggaggtgctggatggagacaggatggccgagagcctgtatgagatccgcttccgggagaatgtggagaagaggatcctgtgccacatgcagctgagcagcgcccaggtggagcagctgcggcaggccatcgaggagctgtactactttgaatttgtggtggatgacctgcccatccggggctttgtgggctacatggaggagagcggcttcctgccccacagccacaagattggcctgtggacccacctggacttccacctggagttccatggagaccgcatcatctttgccaacgtgtctgtgagagatgtgaagccccacagcctggatggcctgcggccagatgagttcctgggcctgacccacacctacagcgtgcgctggagcgagacctctgtggagcggcggagtgacagaagaagaggagatgatggcggcttcttccccaggaccctggagatccactggctgagcatcatcaacagcatggtgctggtgttcctgctggtgggctttgtggccgtcatcctgatgagggtgctgagaaatgacctggcccgctacaacctggatgaggagaccaccagcgctggcagcggagatgactttgaccagggcgacaatggctggaagatcatccacacagatgtgttccgcttccccccctaccggggcctgctgtgtgctgtgctgggcgtgggcgcccagttcctggccctgggcaccggcatcatcgtgatggccctgctgggcatgtttaatgtgcacagacatggagccatcaacagcgctgccatcctgctgtatgccctgacctgctgcatcagcggctacgtgagcagccacttctaccggcagatcggcggggagcgctgggtgtggaacatcatcctgaccaccagcctcttctctgtgcccttcttcctgacctggagcgtggtgaacagcgtgcactgggccaacggcagcacccaggccctgcctgccaccaccatcctgctgctgctgactgtgtggctgctggtgggcttccccctgaccgtcatcggcggcatctttgggaagaacaatgccagcccctttgatgccccctgcaggaccaagaacatcgcccgggagatccccccccagccctggtacaagagcaccgtcatccacatgacagtgggcggcttcctgcccttcagcgccatctctgtggagctgtactacatctttgccaccgtgtggggccgggagcagtacaccctgtatggcatcctcttctttgtgtttgccatcctgctgtctgtgggcgcctgcatcagcatcgccctgacctacttccagctgagcggggaggactaccgctggtggtggaggtctgtgctgtctgtgggcagcacaggcctcttcatcttcctgtacagcgtcttctactatgcccggcgcagcaacatgtctggagctgtgcagacagtggagttcttcggctacagcctgctgaccggctacgtgttcttcctgatgctgggcaccatctccttcttcagcagcctgaagttcatccgctacatctacgtgaacctgaagatggactag

SEQ ID NO: 38964 - DNA, 2448 bp, Artificial Sequence; identical to SEQ ID NO: 38963
  Description of Artificial Sequence: Synthetic coding sequence

SEQ ID NO: 38965 - DNA, 1992 bp, Artificial Sequence
  Description of Artificial Sequence: Synthetic coding sequence
atgtctgcccggctgcctgtgctgagccccccacgctggccccggctgctgctgctgagcctgctgctgctgggcgctgtgcccggccccaggagaagtggggccttctacctgcccggcctggcccctgtgaacttctgtgatgaggagaagaagagtgatgagtgcaaggccgagattgagctgtttgtgaaccggctggacagcgtggagagcgtgctgccctatgagtacacagcctttgacttctgccaggccagcgagggcaagaggccttctgagaacctgggccaggtgctgtttggagagagaattgagcccagcccctacaagttcaccttcaacaagaaggagacctgcaagctggtgtgcaccaagacctaccacacagagaaggccgaggacaagcagaagctggagttcctgaagaagtccatgctgctgaactaccagcaccactggatcgtggacaacatgcctgtgacctggtgctatgatgtggaggatggccagcgcttctgcaaccctggcttccccatcggctgctacatcacagacaagggccacgccaaggatgcctgcgtcatcagcagtgacttccacgagcgggacaccttctacatcttcaaccacgtggacatcaagatctactaccacgtggtggagaccggctccatgggcgcccggctggtggccgccaagctggagcccaagagcttcaagcacacccacatcgacaagccagactgcagcggcccccccatggacatcagcaacaaggccagcggggagatcaagatcgcctacacctacagcgtgtcctttgaagaagatgacaagatccgctgggccagccgctgggactacatcctggagagcatgccccacacccacatccagtggttcagcatcatgaacagcctggtgattgtgctcttcctgagcggcatggtggccatgatcatgctgcggaccctgcacaaggacatcgcccgctacaaccagatggacagcacagaagatgcccaggaggagtttggctggaagctggtgcacggggacatcttccggccccccaggaagggcatgctgctgagcgtcttcctgggcagcggcacccagatcctgatcatgacctttgtgaccctcttctttgcctgcctgggcttcctgagccctgccaacagaggagccctgatgacctgtgctgtggtgctgtgggtgctgctgggcaccccagctggctacgtggccgcccgcttctacaagagctttggaggagagaagtggaagaccaacgtgctgctgaccagcttcctgtgccccggcatcgtgtttgctgacttcttcatcatgaacctgatcctgtggggcgagggcagcagcgctgccatccccttcggcaccctggtggccatcctggccctgtggttctgcatctctgtgcccctgaccttcatcggggcctacttcggcttcaagaagaatgccatcgagcaccctgtgaggaccaaccagatcccccggcagatccctgagcagagcttctacaccaagcccctgcccggcatcatcatgggcggcatcctgcccttcggctgcatcttcatccagctgttcttcatcctgaacagcatctggagccaccagatgtactacatgtttggcttcctgttcctggtgttcatcatcctggtgatcacctgcagcgaggccaccatcctgctgtgctacttccacctgtgtgccgaggactaccactggcagtggaggagcttcctgaccagcggcttcaccgctgtgtacttcctgatctatgctgtgcactacttcttcagcaagctgcagatcaccggcacagccagcaccatcctgtacttcggctacaccatgatcatggtgctgatcttcttcctgttcaccggcaccatcggcttctttgcctgcttctggtttgtgaccaagatctacagcgtggtgaaggtggactag

SEQ ID NO: 38966 - DNA, 1770 bp, Artificial Sequence
  Description of Artificial Sequence: Synthetic coding sequence
atgaggcccctgcccggggccctgggcgtggccgctgctgctgccctgtggctgctgctgctgctgctgcccaggaccagggcagatgaacatgagcacacctaccaggacaaggaggaggtggtgctgtggatgaacacagtgggcccctaccacaaccggcaggagacctacaagtacttcagcctgcccttctgtgtgggcagcaagaagagcatcagccactaccacgagaccctgggggaggccctgcagggcgtggagctggagttcagcggcctggacatcaagttcaaggatgatgtgatgcctgccacctactgtgaaattgacctggacaaggagaagagagatgcctttgtgtatgccatcaagaaccactactggtaccagatgtacattgatgacctgcccatctggggcatcgtgggggaggctgatgaaaatggagaggactactacctgtggacctacaagaagctggagatcggcttcaacggcaaccgcatcgtggatgtgaacctgaccagcgagggcaaggtgaagctggtgcccaacaccaagatccagatgagctacagcgtgaagtggaagaagagtgatgtgaagtttgaagatagatttgacaagtacctggaccccagcttcttccagcaccgcatccactggttcagcatcttcaacagcttcatgatggtgatcttcctggtgggcctggtgtccatgatcctgatgaggaccctgaggaaggactatgcccgctacagcaaggaggaggagatggatgacatggaccgggacctgggagatgaatatggctggaagcaggtgcatggagatgtgttccggcccagcagccaccccctcatcttcagcagcctgattggcagcggctgccagatctttgctgtgtccctgattgtcatcatcgtggccatgattgaagatctctacacagagcggggctccatgctgagcacagccatctttgtgtatgctgccaccagccctgtgaatggctactttggaggcagcctgtatgcccggcagggcggccgccgctggatcaagcagatgtttattggagccttcctgatcccagccatggtgtgtggcacagccttcttcatcaacttcatcgccatctactaccacgccagccgggccatccccttcggcaccatggtggccgtgtgctgcatctgcttcttcgtcatcctgcccctgaacctggtgggcaccatcctgggcaggaacctgagcggccagcccaacttcccctgccgggtgaatgctgtgccccggcccatccctgagaagaagtggttcatggagcctgctgtgattgtgtgcctgggcggcatcctgcccttcggcagcatcttcatcgagatgtacttcatcttcaccagcttctgggcctacaagatctactacgtgtatggcttcatgatgctggtgctggtgatcctgtgcatcgtgacagtgtgtgtgaccatcgtgtgcacctacttcctgctgaatgctgaggactaccgctggcagtggaccagcttcctgtctgctgccagcacagccatctacgtgtacatgtacagcttctactactacttcttcaagaccaagatgtatggcctcttccagaccagcttctacttcggctacatggctgtgttcagcacagccctgggcatcatgtgtggggccatcggctacatgggcaccagcgcctttgtgaggaagatctacaccaacgtgaagattgattag

SEQ ID NO: 38967 - DNA, 765 bp, Artificial Sequence
  Description of Artificial Sequence: Synthetic coding sequence
atgaacacagtgggcccctaccacaaccggcaggagacctacaagtacttcagcctgcccttctgtgtgggcagcaagaagagcatcagccactaccacgagaccctgggggaggccctgcagggcgtggagctggagttcagcggcctggacatcaagttcaaggatgatgtgatgcctgccacctactgtgaaattgacctggacaaggagaagagagatgcctttgtgtatgccatcaagaaccactactggtaccagatgtacattgatgacctgcccatctggggcatcgtgggggaggctgatgaaaatggagaggactactacctgtggacctacaagaagctggagatcggcttcaacggcaaccgcatcgtggatgtgaacctgaccagcgagggcaaggtgaagctggtgcccaacaccaagatccagatgagctacagcgtgaagtggaagaagagtgatgtgaagtttgaagatagatttgacaagtacctggaccccagcttcttccagcaccgcatccactggttcagcatcttcaacagcttcatgatggtgatcttcctggtgggcctggtgtccatgatcctgatgaggaccctgaggaaggactatgcccgctacagcaaggaggaggagatggatgacatggaccgggacctgggagatgaatatggctggaagcaggtgcatggagatgtgttccggcccagcagccaccccctcatcttcagcagcctgattggcagcggctag

SEQ ID NO: 38968 - DNA, 765 bp, Artificial Sequence
  Description of Artificial Sequence: Synthetic coding sequence
atggcctggcagggcctggtgctggccgcctgcctgctgatgttccccagcaccacagctgactgcctgagccgctgcagcctgtgtgctgtgaagacccaggacggccccaagcccatcaaccccctcatctgcagcctgcagtgccaggccgccctgctgcccagcgaggagtgggagcgctgccagagcttcctgtccttcttcacccccagcaccctgggcctgaatgacaaggaggacctgggcagcaagtctgtgggggagggcccctacagcgagctggccaagctgagcggcagcttcctgaaggagctggagaagagcaagttcctgcccagcatcagcaccaaggagaacaccctgagcaagagcctggaggagaagctgcggggcctgagtgatggcttccgggagggcgctgagagcgagctgatgagagatgcccagctgaatgatggagccatggagaccggcaccctgtacctggccgaggaggaccccaaggagcaggtgaagagatatggaggcttcctgaggaagtaccccaagaggagcagcgaggtggccggggagggagatggagacagcatgggccatgaagatctctacaagagatatggaggcttcctgcggcgcatccggcccaagctgaagtgggacaaccagaagagatatggaggcttcctgcggcggcagttcaaggtggtgaccaggagccaggaggaccccaatgcctacagcggggagctgtttgatgcctag

SEQ ID NO: 38969 - DNA, 1929 bp, Artificial Sequence
  Description of Artificial Sequence: Synthetic coding sequence
atggccacagccatggactggctgccctggagcctgctgctcttcagcctgatgtgtgagaccagcgccttctacgtgcctggggtggcccccatcaacttccaccagaatgaccctgtggagatcaaggctgtgaagctgaccagcagcaggacccagctgccctatgagtactacagcctgcccttctgccagcccagcaagatcacctacaaggccgagaacctgggggaggtgctgcggggggacagaattgtgaacacccccttccaggtgctgatgaacagcgagaagaagtgtgaggtgctgtgcagccagagcaacaagcctgtgaccctgactgtggagcagagccggctggtggccgagcgcatcacagaggactactacgtgcacctgattgctgacaacctgcctgtggccacccggctggagctgtacagcaacagagacagtgatgacaagaagaaggagaaggatgtgcagtttgaacatggctaccgcctgggcttcacagatgtgaacaagatctacctgcacaaccacctgtccttcatcctgtactaccaccgggaggacatggaggaggaccaggagcacacctacagagtggtgcgctttgaagtcatcccccagagcatccggctggaggacctgaaggcagatgagaagagcagctgcaccctgcctgagggcaccaacagcagcccccaggagattgaccccaccaaggagaaccagctgtacttcacctacagcgtgcactgggaggagagtgacatcaagtgggccagccgctgggacacctacctgaccatgtctgatgtgcagatccactggttcagcatcatcaacagcgtggtggtggtgttcttcctgagcggcatcctgtccatgatcatcatccgcaccctgaggaaggacatcgccaactacaacaaggaggatgacatcgaggacaccatggaggagagcggctggaagctggtgcatggagatgtgttccggcccccccagtaccccatgatcctgagcagcctgctgggcagcggcatccagctgttctgcatgatcctgattgtcatctttgtggccatgctgggcatgctgagccccagcagcagaggagccctgatgaccacagcctgcttcctgttcatgttcatgggcgtgtttggaggcttctctgctggccgcctgtaccgcaccctgaagggccaccgctggaagaagggggccttctgcacagccaccctgtacccaggagtggtgtttggcatctgctttgtgctgaactgcttcatctggggcaagcacagcagtggagctgtgcccttccccaccatggtggccctgctgtgcatgtggtttggcatcagcctgcccctggtgtacctgggctactacttcggcttcaggaagcagccctatgacaaccctgtgaggaccaaccagatcccccggcagatccctgagcagcgctggtacatgaacagatttgtgggcatcctgatggccggcatcctgccctttggagccatgttcatcgagctgttcttcatcttcagcgccatctgggagaaccagttctactacctgtttggcttcctgttcctggtgttcatcatcctggtggtgtcctgcagccagatcagcatcgtgatggtgtacttccagctgtgtgccgaggactaccgctggtggtggaggaacttcctggtgtctgggggcagcgccttctacgtgctggtgtatgccatcttctactttgtgaacaagctggacatcgtggagttcatccccagcctgctgtacttcggctacacagccctgatggtgctgtccttctggctgctgaccggcaccatcggcttctatgctgcctacatgtttgtgaggaagatctatgctgctgtgaagattgattag

SEQ ID NO: 38970 - DNA, 735 bp, Artificial Sequence
  Description of Artificial Sequence: Synthetic coding sequence
atggcccagatgttcctggagcccctggccgacaagttcatctactgccaggtgctgatgaacagcgagaagaagtgtgaggtgctgtgcagccagagcaacaagcctgtgaccctgactgtggagcagagccggctggtggccgagcgcatcacagaggactactacgtgcacctgattgctgacaacctgcctgtggccacccggctggagctgtacagcaacagagacagtgatgacaagaagaaggagaaggatgtgcagtttgaacatggctaccgcctgggcttcacagatgtgaacaagatctacctgcacaaccacctgtccttcatcctgtactaccaccgggaggacatggaggaggaccaggagcacacctacagagtggtgcgctttgaagtcatcccccagagcatccggctggaggacctgaaggcagatgagaagagcagctgcaccctgcctgagggcaccaacagcagcccccaggagattgaccccaccaaggagaaccagctgtacttcacctacagcgtgcactgggaggagagtgacatcaagtgggccagccgctgggacacctacctgaccatgtctgatgtgcagatccactggttcagcatcatcaacagcgtggtggtggtgttcttcctgagcggcatcctgtccatgatcatcatccgcaccctgaggaaggacatcgccaactacaacaaggaggatgacatctag

SEQ ID NO: 38971 - DNA, 1425 bp, Artificial Sequence
  Description of Artificial Sequence: Synthetic coding sequence
atggtgcagcgcttcagcctgcggcggcagctgagcaagattgaaaggctggaggtgagcagcctggcccagaccagcagcgctgtggccagcagcacagatggcagcatccacacagattctgtggatggcaccccagacccccagaggaccaaggccgccatcgcccacctgcagcagaagatcctgaagctgacagagcagatcaagatcgcccagacagccagagatgacaacgtggccgagtacctgaagctggccaacagcgctgacaagcagcaggccgcccgcatcaagcaggtgtttgagaagaagaaccagaagagcgcccagaccatcctgcagctgcagaagaagctggagcactaccacaggaagctgcgggaggtggagcagaatggcatcccccggcagcccaaggatgtgttccgggacatgcaccagggcctgaaggatgtgggcgccaaggtgacaggcttcagcgagggcgtggtggacagcgtgaagggcggcttcagcagcttcagccaggccacccacagcgctgctggagctgtggtgtccaagccccgggagatcgccagcctcatccggaacaagtttggatctgctgacaacatccccaacctgaaggacagcctggaggagggccaggtggatgatgctgggaaggccctgggcgtcatcagcaacttccagagcagccccaagtatggcagcgaggaggactgcagcagcgccaccagcggctctgtgggcgccaacagcaccaccggcggcattgctgtgggcgccagcagcagcaagaccaacaccctggacatgcagagcagcggctttgatgccctgctgcacgagatccaggagatccgggagacccaggcccggctggaggagagctttgagaccctgaaggagcactaccagagggactacagcctcatcatgcagaccctgcaggaggagcgctaccgctgtgagcggctggaggagcagctgaatgacctgacagagctgcaccagaatgagatcctgaacctgaagcaggagctggcctccatggaggagaagatcgcctaccagagctatgagcgggcccgggacatccaggaggccctggaggcctgccagacccgcatcagcaagatggagctgcagcagcagcagcagcaggtggtgcagctggagggcctggagaatgccacagccaggaacctgctgggcaagctgatcaacatcctgctggccgtgatggctgtgctgctggtgtttgtgtccacagtggccaactgtgtggtgcccctgatgaagaccaggaacagaaccttcagcaccctcttcctggtggtgttcatcgccttcctgtggaagcactgggatgccctcttctcctatgtggagcgcttcttcagcagccccaggtag

SEQ ID NO: 38972 - DNA, 1962 bp, Artificial Sequence
  Description of Artificial Sequence: Synthetic coding sequence
atggagcccagcggcagcgagcagctgtttgaagatcctgaccccggcggcaagagccaggatgctgaggccaggaagcagacagagagcgagcagaagctgagcaagatgacccacaatgccctggagaacatcaacgtcatcggccagggcctgaagcacctgttccagcaccagaggagaagaagctctgtgagcccccatgatgtgcagcagatccaggccgaccctgagcctgagatggacctggagagccagaatgcctgtgccgagattgatggagtgcccacccaccccacagccctgaacagagtgctgcagcagatccgggtgccccccaagatgaagaggggcaccagcctgcacagccggcggggcaagccagaggcccccaagggcagcccccagatcaacaggaagagcggccaggagatgacagctgtgatgcagagcggccggcccaggagcagcagcaccacagatgcccccaccagcagcgccatgatggagatcgcctgtgccgctgctgctgctgctgctgcctgcctgcccggggaggagggcacagctgagagaattgagcggctggaggtgagcagcctggcccagaccagcagcgctgtggccagcagcacagatggcagcatccacacagacagcgtggatggcaccccagacccccagaggaccaaggccgccatcgcccacctgcagcagaagatcctgaagctgacagagcagatcaagatcgcccagacagccagagatgacaacgtggccgagtacctgaagctggccaacagcgctgacaagcagcaggccgcccgcatcaagcaggtgtttgagaagaagaaccagaagagcgcccagaccatcctgcagctgcagaagaagctggagcactaccacaggaagctgcgggaggtggagcagaatggcatcccccggcagcccaaggatgtgttccgggacatgcaccagggcctgaaggatgtgggcgccaaggtgacaggcttcagcgagggcgtggtggacagcgtgaagggcggcttcagcagcttcagccaggccacccacagcgctgctggagctgtggtgtccaagccccgggagatcgccagcctcatccggaacaagtttggcagcgctgacaacatccccaacctgaaggacagcctggaggagggccaggtggatgatgctgggaaggccctgggcgtcatcagcaacttccagagcagccccaagtatggcagcgaggaggactgcagcagcgccaccagcggctctgtgggcgccaacagcaccactggaggcattgctgtgggcgccagcagcagcaagaccaacaccctggacatgcagagcagcggctttgatgccctgctgcacgagatccaggagatccgggagacccaggcccggctggaggagagctttgagaccctgaaggagcactaccagagggactacagcctcatcatgcagaccctgcaggaggagcgctaccgctgtgagcggctggaggagcagctgaatgacctgacagagctgcaccagaatgagatcctgaacctgaagcaggagctggcctccatggaggagaagatcgcctaccagagctatgaaagagcccgggacatccaggaggccctggaggcctgccagacccgcatcagcaagatggagctgcagcagcagcagcagcaggtggtgcagctggagggcctggagaatgccacagccaggaacctgctgggcaagctgatcaacatcctgctggccgtgatggctgtgctgctggtgtttgtgtccacagtggccaactgtgtggtgcccctgatgaagaccaggaacagaaccttcagcaccctcttcctggtggtgttcatcgccttcctgtggaagcactgggatgccctcttctcctatgtggagcgcttcttcagcagccccaggtag

SEQ ID NO: 38973 - DNA, 1620 bp, Artificial Sequence
  Description of Artificial Sequence: Synthetic coding sequence
atgaagaggggcaccagcctgcacagccggcggggcaagccagaggcccccaagggcagcccccagatcaacaggaagagcggccaggagatgacagctgtgatgcagagcggccggcccaggagcagcagcaccacagatgcccccaccagcagcgccatgatggagatcgcctgtgccgctgctgctgctgctgctgcctgcctgcccggggaggagggcacagctgagagaattgagcggctggaggtgagcagcctggcccagaccagcagcgctgtggccagcagcacagatggcagcatccacacagacagcgtggatggcaccccagacccccagaggaccaaggccgccatcgcccacctgcagcagaagatcctgaagctgacagagcagatcaagatcgcccagacagccagagatgacaacgtggccgagtacctgaagctggccaacagcgctgacaagcagcaggccgcccgcatcaagcaggtgtttgagaagaagaaccagaagagcgcccagaccatcctgcagctgcagaagaagctggagcactaccacaggaagctgcgggaggtggagcagaatggcatcccccggcagcccaaggatgtgttccgggacatgcaccagggcctgaaggatgtgggcgccaaggtgacaggcttcagcgagggcgtggtggacagcgtgaagggcggcttcagcagcttcagccaggccacccacagcgctgctggagctgtggtgtccaagccccgggagatcgccagcctcatccggaacaagtttggcagcgctgacaacatccccaacctgaaggacagcctggaggagggccaggtggatgatgctgggaaggccctgggcgtcatcagcaacttccagagcagccccaagtatggcagcgaggaggactgcagcagcgccaccagcggctctgtgggcgccaacagcaccactggaggcattgctgtgggcgccagcagcagcaagaccaacaccctggacatgcagagcagcggctttgatgccctgctgcacgagatccaggagatccgggagacccaggcccggctggaggagagctttgagaccctgaaggagcactaccagagggactacagcctcatcatgcagaccctgcaggaggagcgctaccgctgtgagcggctggaggagcagctgaatgacctgacagagctgcaccagaatgagatcctgaacctgaagcaggagctggcctccatggaggagaagatcgcctaccagagctatgaaagagcccgggacatccaggaggccctggaggcctgccagacccgcatcagcaagatggagctgcagcagcagcagcagcaggtggtgcagctggagggcctggagaatgccacagccaggaacctgctgggcaagctgatcaacatcctgctggccgtgatggctgtgctgctggtgtttgtgtccacagtggccaactgtgtggtgcccctgatgaagaccaggaacagaaccttcagcaccctcttcctggtggtgttcatcgccttcctgtggaagcactgggatgccctcttctcctatgtggagcgcttcttcagcagccccaggtag

SEQ ID NO: 38974 - DNA, 990 bp, Artificial Sequence
  Description of Artificial Sequence: Synthetic coding sequence
atgcaccagggcctgaaggatgtgggcgccaaggtgacaggcttcagcgagggcgtggtggacagcgtgaagggcggcttcagcagcttcagccaggccacccacagcgctgctggagctgtggtgtccaagccccgggagatcgccagcctcatccggaacaagtttggcagcgctgacaacatccccaacctgaaggacagcctggaggagggccaggtggatgatgctgggaaggccctgggcgtcatcagcaacttccagagcagccccaagtatggcagcgaggaggactgcagcagcgccaccagcggctctgtgggcgccaacagcaccactggaggcattgctgtgggcgccagcagcagcaagaccaacaccctggacatgcagagcagcggctttgatgccctgctgcacgagatccaggagatccgggagacccaggcccggctggaggagagctttgagaccctgaaggagcactaccagagggactacagcctcatcatgcagaccctgcaggaggagcgctaccgctgtgagcggctggaggagcagctgaatgacctgacagagctgcaccagaatgagatcctgaacctgaagcaggagctggcctccatggaggagaagatcgcctaccagagctatgaaagagcccgggacatccaggaggccctggaggcctgccagacccgcatcagcaagatggagctgcagcagcagcagcagcaggtggtgcagctggagggcctggagaatgccacagccaggaacctgctgggcaagctgatcaacatcctgctggccgtgatggctgtgctgctggtgtttgtgtccacagtggccaactgtgtggtgcccctgatgaagaccaggaacagaaccttcagcaccctcttcctggtggtgttcatcgccttcctgtggaagcactgggatgccctcttctcctatgtggagcgcttcttcagcagccccaggtag

SEQ ID NO: 38975 - DNA, 1410 bp, Artificial Sequence
  Description of Artificial Sequence: Synthetic coding sequence
atgaagagcaaggaggaggagacagctgtggacaagggggacctggtggccctgagcctgcctgctggccacggggacacagatggccccatcagcctggatgtgcctgatggagccccagacccccagaggaccaaggccgccatcgaccacctgcaccagaagatcctgaagatcacagagcagatcaagattgagcaggaggccagagatgacaacgtggccgagtacctgaagctggccaacaatgctgacaagcagcaggtgagccgcatcaagcaggtgtttgagaagaagaaccagaagagcgcccagaccatcgcccagctgcacaagaagctggagcactacagaagaaggctgaaggagattgagcagaatggccccagccggcagcccaaggatgtgctgcgggacatgcagcagggcctgaaggatgtgggcgccaacgtgcgggccggcatcagcggctttggaggaggagtggtggagggcgtgaagggcagcctgagcggcctgagccaggccacccacacagctgtggtgtccaagccccgggagtttgccagcctcatccggaacaagtttggcagcgctgacaacatcgcccacctgaaggaccccctggaggatggccccccagaggaggccgcccgggccctgagcggcagcgccaccctggtgagcagccccaagtatggcagtgatgatgagtgcagcagcgccagcgccagcagcgctggagctggcagcaacagcggggccggccctggaggagccctgggcagccccaagagcaatgccctgtatggagcccctggcaacctggatgccctgctggaggagctgcgggagatcaaggagggccagagccacctggaggacagcatggaggacctgaagacccagctgcagagggactacacctacatgacccagtgcctgcaggaggagcgctaccgctatgaaaggctggaggagcagctgaatgacctgacagagctgcaccagaatgagatgaccaacctgaagcaggagctggcctccatggaggagaaggtggcctaccagagctatgagcgggcccgggacatccaggaggccgtggagagctgcctgaccagggtgaccaagctggagctgcagcagcagcagcagcaggtggtgcagctggagggcgtggagaatgccaatgcccgggccctgctgggcaagttcatcaacgtcatcctggccctgatggctgtgctgctggtgtttgtgtccaccatcgccaacttcatcacccccctgatgaagacccggctgcgcatcaccagcaccaccctgctggtgctggtgctcttcctgctgtggaagcactgggacagcctgacctacctgctggagcacgtgctgctgcccagctag

SEQ ID NO: 38976 - DNA, 1455 bp, Artificial Sequence
  Description of Artificial Sequence: Synthetic coding sequence
atgaaccaggtggtgcagcccctgatgagccgccacagcgcctgccggggcagccaggcccacctgtcctgggtggacaagggggacctggtggccctgagcctgcctgctggccatggagacacagatggccccatcagcctggatgtgcctgatggagccccagacccccagaggaccaaggccgccatcgaccacctgcaccagaagatcctgaagatcacagagcagatcaagattgagcaggaggccagagatgacaacgtggccgagtacctgaagctggccaacaatgctgacaagcagcaggtgagccgcatcaagcaggtgtttgagaagaagaaccagaagagcgcccagaccatcgcccagctgcacaagaagctggagcactacagaagaaggctgaaggagattgagcagaatggccccagccggcagcccaaggatgtgctgcgggacatgcagcagggcctgaaggatgtgggcgccaacgtgcgggccggcatcagcggctttggaggcggcgtggtggagggcgtgaagggcagcctgagcggcctgagccaggccacccacacagctgtggtgtccaagccccgggagtttgccagcctcatccggaacaagtttggatctgctgacaacatcgcccacctgaaggaccccctggaggatggccccccagaggaggccgcccgggccctgagcggcagcgccaccctggtgagcagccccaagtatggcagtgatgatgaatgtagcagcgccagcgccagcagcgctggggccggcagcaacagcggggccggccctgggggcgccctgggcagccccaagagcaatgccctgtatggagcccctggcaacctggatgccctgctggaggagctgcgggagatcaaggagggccagagccacctggaggacagcatggaggacctgaagacccagctgcagagggactacacctacatgacccagtgcctgcaggaggagcgctaccgctatgagcggctggaggagcagctgaatgacctgacagagctgcaccagaatgagatgaccaacctgaagcaggagctggcctccatggaggagaaggtggcctaccagagctatgaaagagcccgggacatccaggaggccgtggagagctgcctgaccagggtgaccaagctggagctgcagcagcagcagcagcaggtggtgcagctggagggcgtggagaatgccaatgcccgggccctgctgggcaagttcatcaacgtcatcctggccctgatggctgtgctgctggtgtttgtgtccaccatcgccaacttcatcacccccctgatgaagacccggctgcgcatcaccagcaccaccctgctggtgctggtgctcttcctgctgtggaagcactgggacagcctgacctacctgctggagcacgtgctgctgcccagctag

SEQ ID NO: 38977 - DNA, 2130 bp, Artificial Sequence
  Description of Artificial Sequence: Synthetic coding sequence
atgaagcgctgccgcagtgatgagctgcagcagcagcagggcgaggaggatggagctggcctggaggatgctgccagccacctgcctggagctgacctgcggcctggagagaccactggagccaacagcgctgggggccccaccagtgatgctggagctgctgctgcccccaaccctggccccaggagcaagcccccagacctgaagaagatccagcagctgtctgagggctccatgtttggccacggcctgaagcacctgttccacagcagaagaagaagccgggagcgggagcaccagaccagccaggacagccagcagcaccagcagcagcagggcatgtctgaccatgacagcccagatgagaaggagaggagccctgagatgcaccgggtgtcctatgccatgagcctgcatgacctgcctgcccggcccacagccttcaacagagtgctgcagcagatccgcagccggcccagcatcaagagaggagccagcctgcacagcagcagcggcggcggcagcagcggcagcagcagcaggaggaccaagagcagcagcctggagccccagaggggcagcccccacctgctgaggaaggccccccaggacagcagcctggccgccatcctgcaccagcaccagtgccggcccaggagcagcagcaccacagacacagccctgctgctggctgatggcagcaatgtgtacctgctggccgaggaggccgagggcatcggggacaaggtggacaagggggacctggtggccctgagcctgcctgctggccacggggacacagatggccccatcagcctggatgtgcctgatggagccccagacccccagaggaccaaggccgccatcgaccacctgcaccagaagatcctgaagatcacagagcagatcaagattgagcaggaggccagagatgacaacgtggccgagtacctgaagctggccaacaatgctgacaagcagcaggtgagccgcatcaagcaggtgtttgagaagaagaaccagaagagcgcccagaccatcgcccagctgcacaagaagctggagcactacagaagaaggctgaaggagattgagcagaatggccccagccggcagcccaaggatgtgctgcgggacatgcagcagggcctgaaggatgtgggcgccaacgtgcgggccggcatcagcggctttggaggaggagtggtggagggcgtgaagggcagcctgagcggcctgagccaggccacccacacagctgtggtgtccaagccccgggagtttgccagcctcatccggaacaagtttggcagcgctgacaacatcgcccacctgaaggaccccctggaggatggccccccagaggaggccgcccgggccctgagcggcagcgccaccctggtgagcagccccaagtatggcagtgatgatgagtgcagcagcgccagcgccagcagcgctggagctggcagcaacagcggggccggccctggaggagccctgggcagccccaagagcaatgccctgtatggagcccctggcaacctggatgccctgctggaggagctgcgggagatcaaggagggccagagccacctggaggacagcatggaggacctgaagacccagctgcagagggactacacctacatgacccagtgcctgcaggaggagcgctaccgctatgaaaggctggaggagcagctgaatgacctgacagagctgcaccagaatgagatgaccaacctgaagcaggagctggcctccatggaggagaaggtggcctaccagagctatgagcgggcccgggacatccaggaggccgtggagagctgcctgaccagggtgaccaagctggagctgcagcagcagcagcagcaggtggtgcagctggagggcgtggagaatgccaatgcccgggccctgctgggcaagttcatcaacgtcatcctggccctgatggctgtgctgctggtgtttgtgtccaccatcgccaacttcatcacccccctgatgaagacccggctgcgcatcaccagcaccaccctgctggtgctggtgctcttcctgctgtggaagcactgggacagcctgacctacctgctggagcacgtgctgctgcccagctag

SEQ ID NO: 38978 - DNA, 771 bp, Artificial Sequence
  Description of Artificial Sequence: Synthetic coding sequence
atgaaccaggtggtgcagcccctgatgagccgccacagcgcctgccggggcagccaggcccacctgtcctggctgtggacctctgtgcccctgtgctggcccctgacagagttccctgctggcaccgtgaagatgaagagcaaggaggaggagacagctgtggacaagggggacctggtggccctgagcctgcctgctggccacggggacacagatggccccatcagcctggatgtgcctgatggagccccagacccccagaggaccaaggccgccatcgaccacctgcaccagaagatcctgaagatcacagagcagatcaagattgagcaggaggccagagatgacaacgtggccgagtacctgaagctggccaacaatgctgacaagcagcaggtgagccgcatcaagcaggtgtttgagaagaagaaccagaagagcgcccagaccatcgcccagctgcacaagaagctggagcactacagaagaaggctgaaggagattgagcagaatggccccagccggcagcccaaggatgtgctgcgggacatgcagcagggcctgaaggatgtgggcgccaacgtgcgggccggcatcagcggctttggaggaggagtggtggagggcgtgaagggcagcctgagcggcctgagccaggccacccacacagctgtggtgtccaagccccgggagtttgccagcctcatccggaacaagtttggcagcgctgacaacatcgcccacctgaaggaccccctggaggatggatag

SEQ ID NO: 38979 - DNA, 1896 bp, Artificial Sequence
  Description of Artificial Sequence: Synthetic coding sequence
atgtttggccacggcctgaagcacctgttccacagcagaagaagaagccgggagcgggagcaccagaccagccaggacagccagcagcaccagcagcagcagggcatgtctgaccatgacagcccagatgagaaggagaggagccctgagatgcaccgggtgtcctatgccatgagcctgcatgacctgcctgcccggcccacagccttcaacagagtgctgcagcagatccgcagccggcccagcatcaagagaggagccagcctgcacagcagcagcggcggcggcagcagcggcagcagcagcaggaggaccaagagcagcagcctggagccccagaggggcagcccccacctgctgaggaaggccccccaggacagcagcctggccgccatcctgcaccagcaccagtgccggcccaggagcagcagcaccacagacacagccctgctgctggctgatggcagcaatgtgtacctgctggccgaggaggccgagggcatcggggacaaggtggacaagggggacctggtggccctgagcctgcctgctggccacggggacacagatggccccatcagcctggatgtgcctgatggagccccagacccccagaggaccaaggccgccatcgaccacctgcaccagaagatcctgaagatcacagagcagatcaagattgagcaggaggccagagatgacaacgtggccgagtacctgaagctggccaacaatgctgacaagcagcaggtgagccgcatcaagcaggtgtttgagaagaagaaccagaagagcgcccagaccatcgcccagctgcacaagaagctggagcactacagaagaaggctgaaggagattgagcagaatggccccagccggcagcccaaggatgtgctgcgggacatgcagcagggcctgaaggatgtgggcgccaacgtgcgggccggcatcagcggctttggaggaggagtggtggagggcgtgaagggcagcctgagcggcctgagccaggccacccacacagctgtggtgtccaagccccgggagtttgccagcctcatccggaacaagtttggcagcgctgacaacatcgcccacctgaaggaccccctggaggatggccccccagaggaggccgcccgggccctgagcggcagcgccaccctggtgagcagccccaagtatggcagtgatgatgagtgcagcagcgccagcgccagcagcgctggagctggcagcaacagcggggccggccctggaggagccctgggcagccccaagagcaatgccctgtatggagcccctggcaacctggatgccctgctggaggagctgcgggagatcaaggagggccagagccacctggaggacagcatggaggacctgaagacccagctgcagagggactacacctacatgacccagtgcctgcaggaggagcgctaccgctatgaaaggctggaggagcagctgaatgacctgacagagctgcaccagaatgagatgaccaacctgaagcaggagctggcctccatggaggagaaggtggcctaccagagctatgagcgggcccgggacatccaggaggccgtggagagctgcctgaccagggtgaccaagctggagctgcagcagcagcagcagcaggtggtgcagctggagggcgtggagaatgccaatgcccgggccctgctgggcaagttcatcaacgtcatcctggccctgatggctgtgctgctggtgtttgtgtccaccatcgccaacttcatcacccccctgatgaagacccggctgcgcatcaccagcaccaccctgctggtgctggtgctcttcctgctgtggaagcactgggacagcctgacctacctgctggagcacgtgctgctgcccagctag

SEQ ID NO: 38980 - DNA, 1434 bp, Artificial Sequence
  Description of Artificial Sequence: Synthetic coding sequence
atgcctggcagtgacacagccctgactgtggacaggacctacagctacccaggccgccaccaccgctgcaagagccgggtggagagacatgacatgaacaccctgagcctgcccctgaacatccggcggggcggcagtgacaccaacctgaactttgatgtgcctgatggcatcctggacttccacaaggtgaagctgacagctgacagcctgaagcagaagatcctgaaggtgacagagcagatcaagattgagcagaccagcagagatggaaatgtggccgagtacctgaagctggtgaacaatgctgacaagcagcaggccggccgcatcaagcaggtgtttgagaagaagaaccagaagagcgcccacagcatcgcccagctgcagaagaagctggagcagtaccacaggaagctgcgggagattgagcagaatggagccagccgcagcagcaaggacatcagcaaggaccacctgaaggacatccacaggagcctgaaggatgcccacgtgaagagcaggacagccccccactgcatggagagcagcaagagcggcatgcctggggtgtccctgaccccacctgtgtttgtgttcaacaagagccgggagtttgccaacctgatccggaacaagtttggcagcgctgacaacatcgcccacctgaagaacagcctggaggagttccggcctgaggccagcgcccgggcctatggaggcagcgccaccatcgtgaacaagcccaagtatggcagtgatgatgagtgcagcagcggcaccagcggcagcgctgacagcaatggaaaccagagctttggagctggaggagccagcaccctggacagccagggcaagctggccgtcatcctggaggagctgcgggagatcaaggacacccaggcccagctggccgaggacatcgaggccctgaaggtgcagttcaagcgggagtatggcttcatcagccagaccctgcaggaggagcgctaccgctatgagcggctggaggaccagctgcatgacctgacagacctgcaccagcatgaaacagccaacctgaagcaggagctggccagcattgaggagaaggtggcctaccaggcctatgaaagaagccgggacatccaggaggccctggagagctgccagacccgcatcagcaagctggagctgcaccagcaggagcagcaggccctgcagacagacacagtgaatgccaaggtgctgctgggccgctgcatcaacgtcatcctggccttcatgaccgtcatcctggtgtgtgtgtccaccatcgccaagtttgtgagccccatgatgaagagccgctgccacatcctgggcaccttctttgctgtgaccctgctggccatcttctgcaagaactgggaccacatcctgtgtgccatcgagaggatgatcatccccaggtag

SEQ ID NO: 38981 - DNA, 549 bp, Artificial Sequence
  Description of Artificial Sequence: Synthetic coding sequence
atgagcaccagcagcagcagctcctgggacaacctgctggagagcctgagcctgagcacagtgtggaactggatccaggccagcttcctgggggagaccagcgccccccagcagaccagcctgggcctgctggacaacctggccccagctgtgcagatcatcctgcgcatctccttcctgatcctgctgggcatcggcatctatgccctgtggaagaggagcatccagagcatccagaagaccctgctcttcgtcatcaccctgtacaagctgtacaagaagggcagccacatctttgaggccctgctggccaaccctgagggcagcggcctgcgcatccaggacaacaacaacctcttcctgagcctgggcctgcaggagaagatcctgaagaagctgaagacagtggagaacaagatgaagaacctggagggcatcatcgtggcccagaagccagccaccaagagggactgcagcagcgagccctactgcagctgcagcgactgccagagccccctgagcaccagcggcttcaccagccccatctag

SEQ ID NO: 38982 - DNA, 2034 bp, Artificial Sequence
  Description of Artificial Sequence: Synthetic coding sequence
atgaaggtgctgggccgctccttcttctgggtgctcttccctgtgctgccctgggccgtgcaggccgtggagcacgaggaggtggcccagagggtcatcaagctgcaccggggccggggcgtggccgccatgcagagccggcagtgggtgcgggacagctgcaggaagctgagcggcctgctgcggcagaagaatgctgtgctgaacaagctgaagacagccatcggggctgtggagaaggatgtgggcctgagtgatgaggagaagctgttccaggtgcacacctttgagatcttccagaaggagctgaatgaaagtgaaaattctgtgttccaggccgtgtatggcctgcagagggccctgcagggcgactacaaggatgtggtgaacatgaaggagagcagccggcagaggctggaggccctgcgggaggccgccatcaaggaggagacagagtacatggagctgctggccgctgagaagcaccaggtggaggccctgaagaacatgcagcaccagaaccagagcctgtccatgctggatgagatcctggaggatgtgaggaaggctgctgaccggctggaggaggagattgaggagcacgcctttgatgacaacaagtctgtgaagggcgtgaactttgaggccgtgctgcgggtggaggaggaggaggccaacagcaagcagaacatcaccaagcgggaggtggaggatgacctgggcctgtccatgctgattgacagccagaacaaccagtacatcctgaccaagccccgggacagcaccatccccagggctgaccaccacttcatcaaggacatcgtgaccatcggcatgctgagcctgccctgtggctggctgtgcacagccatcggcctgcccaccatgtttggctacatcatctgtggggtgctgctgggccccagcggcctgaacagcatcaagagcatcgtgcaggtggagaccctgggggagtttggagtcttcttcaccctcttcctggtgggcctggagttcagccctgagaagctgaggaaggtgtggaagatcagcctgcagggcccctgctacatgaccctgctgatgattgccttcggcctgctgtggggccacctgctgcgcatcaagcccacccagagcgtcttcatcagcacctgcctgagcctgagcagcacccccctggtgagccgcttcctgatgggcagcgcccggggggacaaggagggggacatcgactacagcacagtgctgctgggcatgctggtgacccaggatgtgcagctgggcctcttcatggctgtgatgcccaccctcatccaggccggggccagcgccagcagcagcatcgtggtggaggtgctgcgcatcctggtgctgattggccagatcctcttcagcctggccgctgtgttcctgctgtgcctggtgatcaagaagtacctgattggcccctactacaggaagctgcacatggagagcaagggcaacaaggagatcctgatcctgggcatcagcgccttcatcttcctgatgctgactgtgacagagctgctggatgtgtccatggagctgggctgcttcctggccggggccctggtgagcagccagggccctgtggtgacagaggagatcgccaccagcattgagcccatccgggacttcctggccatcgtgttctttgccagcatcggcctgcacgtgttccccacctttgtggcctatgagctgactgtgctggtgttcctgaccctgtctgtggtggtgatgaagttcctgctggccgccctggtgctgagcctcatcctgcccaggagcagccagtacatcaagtggatcgtgtctgctggcctggcccaggtgtctgagttctcctttgtgctgggcagccgggcccggcgggccggggtcatcagccgggaggtgtacctgctgatcctgtctgtgaccaccctgagcctgctgctggcccctgtgctgtggagggctgccatcacccgctgtgtgcccaggcctgagaggaggagcagcctgtag

SEQ ID NO: 38983 - DNA, 1905 bp, Artificial Sequence
  Description of Artificial Sequence: Synthetic coding sequence
atggccatgtggaaccggccctgccagaggctgccccagcagcccctggtggccgagcccacagctgagggggagccccacctgcccaccggccgggagctgacagaggccaacagatttgcctatgctgccctgtgtggcatcagcctgagccagctgtttcctgagcctgagcacagcagcttctgcacagagttcatggccggcctggtgcagtggctggagctgtctgaggccgtgctgcccaccatgacagcctttgccagcggcctgggcggggagggcgcagatgtgtttgtgcagatcctgctgaaggaccccatcctgaaggatgaccccaccgtcatcacccaggacctgctgtccttcagcctgaaggatggccactatgatgcccgggcccgggtgctggtgtgccacatgaccagcctgctgcaggtgcccctggaggagctggatgtgctggaggagatgttcctggagagcctgaaggagatcaaggaggaggagagcgagatggccgaggccagcaggaagaagaaggagaacagaaggaagtggaagcgctacctgctgattggcctggccaccgtgggcggcggcaccgtcatcggcgtgactggaggcctggccgcccccctggtggccgccggggccgccaccatcatcggcagcgctggagctgctgccctgggcagcgctgctggcatcgccatcatgaccagcctgtttggagctgctggagctggcctgaccggctacaagatgaagaagagggtgggcgccatcgaggagttcaccttcctgcccctgacagagggccggcagctgcacatcaccatcgctgtgacaggctggctggccagcggcaagtaccgcaccttcagcgccccctgggccgccctggcccacagccgggagcagtactgcctggcctgggaggccaagtacctgatggagctgggcaatgccctggagaccatcctgagcggcctggccaacatggtggcccaggaggccctgaagtacacagtgctgtctggaattgtggccgccctgacctggccagccagcctgctgtctgtggccaacgtcatcgacaacccctggggcgtgtgcctgcacaggtctgctgaggtgggcaagcacctggcccacatcctgctgagccggcagcagggcagaagacctgtgaccctgattggcttcagcctgggcgcccgggtcatctacttctgcctgcaggagatggcccaggagaaggactgccagggcatcattgaagatgtgatcctgctgggcgcccctgtggagggggaggccaagcactgggagcccttcaggaaggtggtgtctggccgcatcatcaatggctactgccgcggggactggctgctgagctttgtgtaccgcaccagctctgtgcagctgcgggtggccggcctgcagcctgtgctgctgcaggaccggcgggtggagaatgtggacctgacctctgtggtgtctggccacctggactatgccaagcagatggatgccatcctgaaggctgtgggcatccgcaccaagccaggctgggatgagaagggcctgctgctggcccctggctgcctgcccagcgaggagccccggcaggccgctgctgctgccagcagcggggagaccccccaccaggtgggccagacccagggccccatcagcggggacaccagcaagctggccatgagcacagaccccagccaggcccaggtgcctgtgggcctggaccagagcgagggcgccagcctgcctgctgctgccagccctgagaggcctcccatctgcagccacggcatggaccccaaccccctgggctgcccagactgtgcctgcaagacccagggccccagcacaggcctggactag

SEQ ID NO: 38984 - DNA, 1785 bp, Artificial Sequence
  Description of Artificial Sequence: Synthetic coding sequence
atggccatgtggaaccggccctgccagaggctgccccagcagcccctggtggccgagcccacagctgagggggagccccacctgcccaccggccgggagctgacagaggccaacagatttgcctatgctgccctgtgtggcatcagcctgagccagctgtttcctgagcctgagcacagcagcttctgcacagagttcatggccggcctggtgcagtggctggagctgtctgaggccgtgctgcccaccatgacagcctttgccagcggcctgggcggggagggcgcagatgtgtttgtgcagatcctgctgaaggaccccatcctgaaggatgaccccaccgtcatcacccaggacctgctgtccttcagcctgaaggatggccactatgatgcccgggcccgggtgctggtgtgccacatgaccagcctgctgcaggtgcccctggaggagctggatgtgctggaggagatgttcctggagagcctgaaggagatcaaggaggaggagagcgagatggccgaggccagcaggaagaagaaggagaacagaaggaagtggaagcgctacctgctgattggcctggccaccgtgggcggcggcaccgtcatcggcgtgactggaggcctggccgcccccctggtggccgccggggccgccaccatcatcggcagcgctggagctgctgccctgggcagcgctgctggcatcgccatcatgaccagcctgtttggagctgctggagctggcctgaccggcaccttcagcgccccctgggccgccctggcccacagccgggagcagtactgcctggcctgggaggccaagtacctgatggagctgggcaatgccctggagaccatcctgagcggcctggccaacatggtggcccaggaggccctgaagtacacagtgctgtctggaattgtggccgccctgacctggccagccagcctgctgtctgtggccaacgtcatcgacaacccctggggcgtgtgcctgcacaggtctgctgaggtgggcaagcacctggcccacatcctgctgagccggcagcagggcagaagacctgtgaccctgattggcttcagcctgggcgcccgggtcatctacttctgcctgcaggagatggcccaggagaaggactgccagggcatcattgaagatgtgatcctgctgggcgcccctgtggagggggaggccaagcactgggagcccttcaggaaggtggtgtctggccgcatcatcaatggctactgccgcggggactggctgctgagctttgtgtaccgcaccagctctgtgcagctgcgggtggccggcctgcagcctgtgctgctgcaggaccggcgggtggagaatgtggacctgacctctgtggtgtctggccacctggactatgccaagcagatggatgccatcctgaaggctgtgggcatccgcaccaagccaggctgggatgagaagggcctgctgctggcccctggctgcctgcccagcgaggagccccggcaggccgctgctgctgccagcagcggggagaccccccaccaggtgggccagacccagggccccatcagcggggacaccagcaagctggccatgagcacagaccccagccaggcccaggtgcctgtgggcctggaccagagcgagggcgccagcctgcctgctgctgccagccctgagaggcctcccatctgcagccacggcatggaccccaaccccctgggctgcccagactgtgcctgcaagacccagggccccagcacaggcctggactag

SEQ ID NO: 38985 - DNA, 1743 bp, Artificial Sequence
  Description of Artificial Sequence: Synthetic coding sequence
atggccatgtggaaccggccctgccagaggctgccccagcagcccctggtggccgagcccacagctgagggggagccccacctgcccaccggccgggagctgacagaggccaacagatttgcctatgctgccctgtgtggcatcagcctgagccagctgtttcctgagcctgagcacagcagcttctgcacagagttcatggccggcctggtgcagtggctggagctgtctgaggccgtgctgcccaccatgacagcctttgccagcggcctgggcggggagggcgcagatgtgtttgtgcagatcctgctgaaggaccccatcctgaaggatgaccccaccgtcatcacccaggacctgctgtccttcagcctgaaggatggccactatgatgcccgggcccgggtgctggtgtgccacatgaccagcctgctgcaggtgcccctggaggagctggatgtgctggaggagatgttcctggagagcctgaaggagatcaaggaggaggagagcgagatggccgaggccagcaggaagaagaaggagaacagaaggaagtggaagcgctacctgctgattggcctggccaccgtgggcggcggcaccgtcatcggcgtgactggaggcctggccgcccccctggtggccgccggggccgccaccatcatcggcagcgctggagctgctgccctgggcagcgctgctggcatcgccatcatgaccagcctgtttggagctgctggagctggcctgaccggctacaagatgaagaagagggtgggcgccatcgaggagttcaccttcctgcccctgacagagggccggcagctgcacatcaccatcgctgtgacaggctggctggccagcggcaagtaccgcaccttcagcgccccctgggccgccctggcccacagccgggagcagtactgcctggcctgggaggccaagtacctgatggagctgggcaatgccctggagaccatcctgagcggcctggccaacatggtggcccaggaggccctgaagtacacagtgctgtctggaattgtggccgccctgacctggccagccagcctgctgtctgtggccaacgtcatcgacaacccctggggcgtgtgcctgcacaggtctgctgaggtgggcaagcacctggcccacatcctgctgagccggcagcagggcagaagacctgtgaccctgattggcttcagcctgggcgcccgggtcatctacttctgcctgcaggagatggcccaggagaaggactgccagggcatcattgaagatgtgatcctgctgggcgcccctgtggagggggaggccaagcactgggagcccttcaggaaggtggtgtctggccgcatcatcaatggctactgccgcggggactggctgctgagctttgtgtaccgcaccagctctgtgcagctgcgggtggccggcctgcagcctgtgctgctgcaggaccggcgggtggagaatgtggacctgacctctgtggtgtctggccacctggactatgccaagcagatggatgccatcctgaaggctgtgggcatccgcaccaagccaggctgggatgagaagggcctgctgctggcccctggctgcctgcccagcgaggagccccggcaggccgctgctgctgccagcagcgccctggagagcggctgccccagcggcggccctgagggcagcctgggccctgaggcccccaccccagccctgccctggccccagtag

SEQ ID NO: 38986 - DNA, 867 bp, Artificial Sequence
  Description of Artificial Sequence: Synthetic coding sequence
atggagatcagccggctggcccagagcaagaggaacatcatcagcctgaacatggacctggagcgggacacccagagaattgatgaggccaaccagaagctgctgctgaagatccaggagcgggaggacaagatccagaggctggagagcgagatcatccagacccggggcctggtggaggatgaggagtgggagaaggaaaatagaaccaccatggagcgggagcgggccctgcaggagctggaggaggagacagcccggctggagaggaagaacaagaccctggtgcacagcatcacagagctgcagcagaagctgaccaggaagagccagaagatcaccaactgtgagcagagcagcccagatggagccctggaggagaccaaggtgaagctgcagcagctggaggccagctatgcctgccaggagaaggagctgctgaaggtgatgaaggagtatgcctttgtgacccagctgtgtgaggaccaggccctgtacatcaagaagtaccaggagaccctgaagaagattgaggaggagctggaggccctcttcctggagcgggaggtgtccaagctggtgtccatgaaccctgtggagaaggagcacaccagccagaacaatgaaggcacccccacccagaagacagcccggctcttcagcaagaagatcttctgctgcctcttcttcatcaccctcttcttcatccggctgctgagctacatgttcttccacgtgcgcttcatcaacccagacctgctggtgaatgtgctgcccaaggtgctgggccgcagcaccctgtggaagctgcgctgcttcttcttccccagcctgaccctggagacagaggacatgctgccccactag

SEQ ID NO: 38987 - DNA, 687 bp, Artificial Sequence
  Description of Artificial Sequence: Synthetic coding sequence
atggagatcagccggctggcccagagcaagaggaacatcatcagcctgaacatggacctggagcgggacacccagagaattgatgaggccaaccagaagctgctgctgaagatccaggagcgggaggacaagatccagaggctggagagcgagatcatccagacccggggcctggtggaggatgaggagtgggagaaggaaaatagaaccaccatggagcgggagcgggccctgcaggagctggaggaggagacagcccggctggagaggaagaacaagaccctggtgcacagcatcacagagctgcagcagaagctgaccaggaagagccagaagatcaccaactgtgagcagagcagcccagatggagccctggaggagaccaaggtgaagctgcagcagctggaggccagctatgcctgccaggagaaggagctgctgaaggtgatgaaggagtatgcctttgtgacccagctgtgtgaggaccaggccctgtacatcaagaagtaccaggagaccctgaagaagattgaggaggagctggaggccctcttcctggagcgggaggtgtccaagctggtgtccatgaaccctgtggagaaggagcacaccagccagaacaatgaaggcacccccacccagaagacagcccggctcttcagcaagaactggcaccacagcttctag

SEQ ID NO: 38988 - DNA, 246 bp, Artificial Sequence
  Description of Artificial Sequence: Synthetic coding sequence
atggagatcagccggctggcccagagcaagaggaacatcatcagcctgaacatggacctggagcgggacacccagagaattgatgaggccaaccagaagctgctgctgaagatccaggagcgggaggacaagatccagaggctggagagcgagatcatccagacccggggcctggtggaggatgaggagtgggagaaggaaaatagaaccaccatggagcgggagcgggccctgcaggagctgtag

SEQ ID NO: 38989 - DNA, 435 bp, Artificial Sequence
  Description of Artificial Sequence: Synthetic coding sequence
atggagatcagccggctggcccagagcaagaggaacatcatcagcctgaacatggacctggagcgggacacccagagaattgatgaggccaaccagaagctgctgctgaagatccaggagcgggaggacaagatccagaggctggagagcgagatcatccagacccggggcctggtggaggatgaggagtgggagaaggaaaatagaaccaccatggagcgggagcgggccctgcaggagctggaggaggagacagcccggctggagaggaagaacaagaccctggtgcacagcatcacagagctgcagcagaagctgaccaggaagagccagaagatcaccaactgtgagcagagcagcccagatggagccctggaggagaccaaggtgaagctgcagcagctggaggccagctatgcctgccaggagaagtag

SEQ ID NO: 38990 - DNA, 687 bp, Artificial Sequence
  Description of Artificial Sequence: Synthetic coding sequence
atggagatcagccggctggcccagagcaagaggaacatcatcagcctgaacatggacctggagcgggacacccagagaattgatgaggccaaccagaagctgctgctgaagatccaggagcgggaggacaagatccagaggctggagagcgagatcatccagacccggggcctggtggaggatgaggagtgggagaaggaaaatagaaccaccatggagcgggagcgggccctgcaggagctggaggaggagacagcccggctggagaggaagaacaagaccctggtgcacagcatcacagagctgcagcagaagctgaccaggaagagccagaagatcaccaactgtgagcagagcagcccagatggagccctggaggagaccaaggtgaagctgcagcagctggaggccagctatgcctgccaggagaaggagctgctgaaggtgatgaaggagtatgcctttgtgacccagctgtgtgaggaccaggccctgtacatcaagaagtaccaggagaccctgaagaagattgaggaggagctggaggccctcttcctggagcgggaggtgtccaagctggtgtccatgaaccctgtggagaaggagcacaccagccagaacaatgaaggcacccccacccagaagacagcccggctcttcagcaagaagtgggccagcagcttctag

SEQ ID NO: 38991 - DNA, 216 bp, Artificial Sequence
  Description of Artificial Sequence: Synthetic coding sequence
atggagatcagccggctggcccagagcaagaggaacatcatcagcctgaacatggacctggagcgggacacccagagaattgatgaggccaaccagaagctgctgctgaagatccaggagcgggaggacaagatccagaggctggagagcgagatcatccagacccggggcctggtggaggatgaggagtgggagaaggaaaatagaaccacctag

SEQ ID NO: 38992 - DNA, 3285 bp, Artificial Sequence
  Description of Artificial Sequence: Synthetic coding sequence
atggccgcccggcaggccgtgggcagcggggcccaggagacctgtggcctggaccgcatcctggaggccctgaagctgctgctgagccctgggggcagcggcagcagcagcctgcaggtgaccaagcatgatgtgctgctggccaccctgaagagcaacctgagcgccctggaggacaagttcctgaaggacccccagtggaagaacctgaagctgctgagagatgaaattgctgacaaggccgagtggccccagaacagcgtggatgtgacctggagcttcaccagccagaccctgctgctgctgctgtgcctgaaggagaccatgatccggctggccgccaacttcaaccctgggaagcccaaccccaggaccccagaggtggccccagccctgagcccagatgccctgagcatcagccagcagaagacagtgcagtttgtgctgcagtttgtggtgaccctgggcatctgcccctacctgatgcctggggtgggcgtgcccctgcgctacagaacagaatttggagctgtggtgcaggatgtggtgtgctttgatgctgccccagatgccacccggcggctgtacaccagctgcaaggccctgctgaatgtggcccagcacaccagcctgggcagcctcatcttctgccaccactttggagacattgctgctggcctgtgccagctgggcttctgccccaccaagaggaagctgctgaccccagctgaggaggtgctgacagaggaggagaggaccctgagcagaggagccctgcgggacatgctggaccaggtgtaccagcccctggccgtgcgggagctgctgatcctgcagggcggccccccccagagctgcacagatgtgaagacccagatgcgctgccgggccccagcctggctgcggcggctgtgtggccagctgctgtctgagcggctgatgaggcccaatggagtgcaggccgtggtgcggggcatcctggagggcgctggggccggggctgctgggggcagtgatgctgaggtgacagctgctgactggaagaagtgtgacctgattgccaagatcctggccagctgcccccagcagagcctgagccctgagaactactacagagacatctgcccccaggtgctggacctcttccacttccaggacaagctgacagcccggcagttccagagggtggccaccaccaccttcatcaccctgagccgggagcggccccacctggccgccaagtacctgctgcagcctgtgctggcccccctgcaccgctgcctgaacacagctgagctgtctgagagtgacatggtgcccggcaccatcctggtgacagaggaggagctgagccgctgcattgaagatgtgttcaaggtgtatgtggtgggcaatgagcccctgactgtgctgatggacagcctgctgcctgtgctgggcgtgctcttcctgctgtactgcttcaccaagcagagcgtgagccacatccgcagcctgtgccaggagatcctgctgtggatcctgggcaagctggagaggaagaaggccatcgccagcctgaagggctttgctggcctggacaaggctgtgcccagcctgcacagcctgtgccagttccgggtggccacccagggcggcatcatgatcaccatcaaggaggccatcagtgatgaagatgaagatgaggccctgtaccagaaggtgagcagcgagcagggccgggtggagcacctgggggacctgctgagccactgccaggagtgtggcctggccggggacttcttcatcttctgcctgaaggagctgacccacgtggcctctgaaaatgaaacagagctgaagacagagcccttcagcagcaagagcctgctggagctggagcagcaccagaccctgctggtggagggccaggagaggaagctgctggtgctgcagctgatggctgtgctgtgtgagaggatgtctgagcagatcttcaccaacgtgacccaggtggtggactttgtggccgccaccctgcagagggcctgtgccagcctggcccaccaggccgagagcacagtggagagccagaccctgtccatgtccatgggcctggtggccgtgatgctgggcggcgctgtgcagctgaagagcagtgactttgctgtgctgaagcagctgctgcccctgctggagaaggtgagcaacacctacccagaccctgtgatccaggagctggccgtggacctgcgcatcaccatcagcacccatggagcctttgccacagaggccgtgtccatggccgcccagagcaccctgaacaggaaggacctggagggcaagattgaggagcagcagcagaccagccatgagcggcccacagatgtggcccacagccacctggagcagcagcagagccatgaaacagccccccagacaggcctgcagagcaatgcccccatcatcccccagggcgtgaatgagcccagcaccaccaccagccagaagagcggctctgtgaccacagagcagctgcaggaggtgctgctgagcgcctatgacccccagatccccaccagggctgctgccctgcggaccctgagccactggattgagcagcgggaggccaaggccctggagatgcaggagaagctgctgaagatcttcctggagaacctggagcacgaggacacctttgtgtacctgagcgccatccagggcgtggccctgctgagtgatgtgtacccagagaagatcctgcctgacctgctggcccagtatgacagcagcaaggacaagcacaccccagagaccaggatgaaggtgggggaggtgctgatgagaattgtgcgggccctgggggacatggtgtccaagtaccgggagcccctcatccacaccttcctgcggggcgtgcgggaccctgatggagcccaccgggccagcagcctggccaacctgggggagctgtgccagaggctggacttcctgctgggctctgtggtgcatgaggtgacagcctgcctgattgctgtggccaagacagatggagaggtgcaggtgcggcgggccgccatccacgtggtggtgctgctgctgcggggcctgagccagaaggccacagaggtgctgtctgctgtgctgaaggacctgtaccacctgctgaagcacgtggtgtgcctggagccagatgatgtggccaagctgcacgcccagctggccctggaggagctggatgacatcatgaagaacttcctgttccccccccagaagctggagaagaagatcatggtgctgccctag

SEQ ID NO: 38993 - DNA, 789 bp, Artificial Sequence
  Description of Artificial Sequence: Synthetic coding sequence
atggcctggaagagcagcgtcatcatgcagatgggccgcttcctgctgctggtgatcctcttcctgccccgggagatgaccagctctgtgctgactgtgaatggcaagacagagaactacatcctggacaccaccccaggcagccaggccagcctcatctgtgctgtgcagaaccacacccgggaggaggagctgctgtggtaccgggaggagggccgggtggacctgaagagcggcaacaagatcaacagcagctctgtgtgtgtgagcagcatcagtgaaaatgacaatggcatctccttcacctgccgcctgggccgggaccagagcgtgtctgtgtctgtggtgctgaatgtgaccttcccccccctgctgtctggaaatgacttccagacagtggaggagggcagcaatgtgaagctggtgtgcaatgtgaaggccaacccccaggcccagatgatgtggtacaagaacagcagcctgctggacctggagaagagccgccaccagatccagcagaccagcgagagcttccagctgagcatcaccaaggtggagaagccagacaatggcacctacagctgcatcgccaagagcagcctgaagacagagagcctggacttccacctgattgtgaaggacaagacagtgggcgtgcccatcgagcccatcatcgccgcctgtgtggtgatcttcctgaccctgtgcttcggcctcatcgcccggaggaagaagatcatgaagctgtgcatgaaggacaaggacccccacagcgagacagccctgtag

SEQ ID NO: 38994 - DNA, 657 bp, Artificial Sequence
  Description of Artificial Sequence: Synthetic coding sequence
atggcctggaagagcagcgtcatcatgcagatgggccgcttcctgctgctggtgatcctcttcctgccccgggagatgaccagctctgtgctgactgtgaatggcaagacagagaactacatcctggacaccaccccaggcagccaggccagcctcatctgtgctgtgcagaaccacacccgggaggaggagctgctgtggtaccgggaggagggccgggtggacctgaagagcggcaacaagatcaacagcagctctgtgtgtgtgagcagcatcagtgaaaatgacaatggcatctccttcacctgccgcctgggccgggaccagagcgtgtctgtgtctgtggtgctgaatgtgaccttcccccccctgctgtctggaaatgacttccagacagtggaggagggcagcaatgtgaagctggtgtgcaatgtgaaggccaacccccaggcccagatgatgtggtacaagaacagcagcctgctggacctggagaagagccgccaccagatccagcagaccagcgagagcttccagctgagcatcaccaaggtggagaagccagacaatggcacctacagctgcatcgccaagagcagcctgaagacagagagcctggacttccacctgattgtgaaggccctgcagcagggctag

SEQ ID NO: 38995 - DNA, 849 bp, Artificial Sequence
  Description of Artificial Sequence: Synthetic coding sequence
atgggcagccctggcatggtgctgggcctgctggtgcagatctgggccctgcaggaggccagcagcctgtctgtgcagcagggccccaacctgctgcaggtgcggcagggcagccaggccaccctggtgtgccaggtggaccaggccacagcctgggagcggctgcgggtgaagtggaccaaggatggagccatcctgtgccagccctacatcaccaacggcagcctgagcctgggcgtgtgtggcccccagggccgcctgtcctggcaggcccccagccacctgaccctgcagctggaccctgtgtccctgaaccacagcggggcctacgtgtgctgggccgctgtggagatccctgagctggaggaggccgagggcaacatcacccggctgtttgtggaccctgatgaccccacccagaacagaaacagaattgccagcttccctggcttcctgtttgtgctgctgggcgtgggctccatgggcgtggccgccatcgtgtggggcgcctggttctggggcagaagaagctgccagcagagggacagcggcaacagccctggaaatgccttctacagcaatgtgctgtaccggcccaggggggcccccaagaagtctgaggactgcagcggggagggcaaggaccagaggggccagagcatctacagcaccagcttcccccagcctgccccccggcagccccacctggccagccggccctgccccagcccccggccctgccccagcccccggcccggccaccctgtgtccatggtgcgggtgagcccccggcccagccccacccagcagccccggcccaagggcttccccaaggtgggggaggagtag

SEQ ID NO: 38996 - DNA, 2325 bp, Artificial Sequence
  Description of Artificial Sequence: Synthetic coding sequence
atgaaccccttctacttccacgctgtgaacatcatcctgcactgcctggtgaccctggtgctgatgtacacctgtgacaagacagtgttcaagaacagaggcctggcctttgtgacagccctgctgtttgctgtgcaccccatccacacagaggccgtggccggcatcgtgggccgggcagatgtgctggcctgcctgctcttcctgctggccttcctgagctacaacagaagcctggaccagggctgtgtgggcggcagcttccccagcacagtgagccccttcttcctgctgctgagcctcttcctgggcacctgtgccatgctggtgaaggagaccggcatcaccgtgtttggagtgtgcctggtgtatgacctcttcagcctgagcaacaagcaggacaagagcagcaatggagccctgtgccccaggagcccccagcagcccggcagcccccagcccagcagcctgcccggccacccccaccgggagaatggcaagcagcagcgcttcccccacaagggggcctggggcggctgccacagccccctgcccccagagcccaagagcagcggcttccctgtgagccccagggctgtgtggagcatgatgaggttcctgacctacagctacctgctggccttcaacgtgtggctgctgctggcccctgtgaccctgtgctatgactggcaggtgggcagcatccccctggtggagaccatctgggacatgaggaacctggccaccatcttcctggccgtggtgatggccctgctgagcctgcactgcctggccgccttcaagaggctggagcacaaggaggtgctggtgggcctgctcttcctggtgttccccttcatcccagccagcaacctcttcttccgggtgggctttgtggtggccgagcgggtgctgtacatgcccagcatgggctactgcatcctgtttgtgcacggcctgagcaagctgtgcacctggctgaacagatgtggggccaccaccctcatcgtgtccacagtgctgctgctgctgctcttctcctggaagacagtgaagcagaatgagatctggctgagccgggagagcctcttccgcagcggcgtgcagaccctgccccacaatgccaaggtgcactacaactatgccaacttcctgaaggaccagggcaggaacaaggaggccatctaccactacagaacagccctgaagctgtaccccaggcatgccagcgccctgaacaacctgggcaccctgacccgggacacagctgaggccaagatgtactaccagagggccctgcagctgcacccccagcacaacagagccctcttcaacctgggcaacctgctgaagagccaggagaagaaggaggaggccatcaccctgctgaaggacagcatcaagtatggccctgagtttgctgatgcctacagcagcctggccagcctgctggccgagcaggagcgcttcaaggaggccgaggagatctaccagacaggcatcaagaactgcccagacagcagtgacctgcacaacaactacggcgtcttcctggtggacaccggcctgcctgagaaggctgtggcccactaccagcaggccatcaagctgagccccagccaccacgtggccatggtgaacctgggccgcctgtaccgcagcctgggagaaaattccatggccgaggagtggtacaagagggccctgcaggtggcccacaaggccgagatcctgagccccctgggcgccctgtactacaacacaggccgctatgaggaggccctgcagatctaccaggaggccgccgccctgcagcccagccagcgggagctgcggctggccctggcccaggtgctggccgtgatgggccagaccaaggaggccgagaagatgaccaaccacatcgtgtctgaggagaccggctgcctggagtgctaccgcctgctgagcgccatctacagcaagcaggagaaccacgacaaggccctggatgccatcgacaaggccctgcagctgaagcccaaggaccccaaggtgatcagcgagctgttcttcaccaagggcaaccagctgcgggagcagaacctgctggacaaggcctttgagagctacagagtggccgtgcagctgaacccagaccaggcccaggcctggatgaacatgggcggcatccagcacatcaagggcaagtatgtgtctgcccgggcctactatgaaagagccctgcagctggtgcctgacagcaagctgctgaaggagaacctggccaagctggaccggctggagaagaggctgcaggaggtgcgggagaaggaccagacctag

SEQ ID NO: 38997 - DNA, 1725 bp, Artificial Sequence
  Description of Artificial Sequence: Synthetic coding sequence
atgaaccccttctacttccacgctgtgaacatcatcctgcactgcctggtgaccctggtgctgatgtacacctgtgacaagacagtgttcaagaacagaggcctggcctttgtgacagccctgctgtttgctgtgcaccccatccacacagaggccgtggccggcatcgtgggccgggcagatgtgctggcctgcctgctcttcctgctggccttcctgagctacaacagaagcctggaccagggctgtgtgggcggcagcttccccagcacagtgagccccttcttcctgctgctgagcctcttcctgggcacctgtgccatgctggtgaaggagaccggcatcaccgtgtttggagtgtgcctggtgtatgacctcttcagcctgagcaacaagcaggacaagagcagcaatggagccctgtgccccaggagcccccagcagcccggcagcccccagcccagcagcctgcccggccacccccaccgggagaatggcaagcagcagcgcttcccccacaagggggcctggggcggctgccacagccccctgcccccagagcccaagagcagcggcttccctgtgagccccagggctgtgtggagcatgatgagatacctgcgggccagcagcaacagaaacttcctgctgaccatgaggcccttcctgaagagggccatcctggtgctgtcctatgtgctggtgatcctgtacttccggctgtggatcatgggcggctccatgcccctcttcagcgagcaggacaacccagccagcttcagcccctacatcctgacccgcttcctgacctacagctacctgctggccttcaacgtgtggctgctgctggcccctgtgaccctgtgctatgactggcaggtgggcagcatccccctggtggagaccatctgggacatgaggaacctggccaccatcttcctggccgtggtgatggccctgctgagcctgcactgcctggccgccttcaagaggctggagcacaaggaggtgctggtgggcctgctcttcctggtgttccccttcatcccagccagcaacctcttcttccgggtgggctttgtggtggccgagcgggtgctgtacatgcccagcatgggctactgcatcctgtttgtgcacggcctgagcaagctgtgcacctggctgaacagatgtggggccaccaccctcatcgtgtccacagtgctgctgctgctgctcttctcctggaagacagtgaagcagaatgagatctggctgagccgggagagcctcttccgcagcggcgtgcagaccctgccccacaatgccaaggtgcactacaactatgccaacttcctgaaggaccagggcaggaacaaggaggccatctaccactacagaacagccctgaagctgtaccccaggcatgccagcgccctgaacaacctgggcaccctgacccgggacacagctgaggccaagatgtactaccagagggccctgcagctgcacccccagcacaacagagccctcttcaacctgggcaacctgctgaagagccaggagaagaaggaggaggccatcaccctgctgaaggacagcatcaagtatggccctgagtttgctgatgcctacagcagcctggccagcctgctggccgagcaggtgattgtgagccacagcagcttcttccagtgctactgctacatgtacaagctgatgctgcaccgcttcctgtactag

SEQ ID NO: 38998 - DNA, 2649 bp, Artificial Sequence
  Description of Artificial Sequence: Synthetic coding sequence
atggtggtgaccaccagcgcccggggcggcggcggggacaggacccccagcagaagaagaggctgcggcctggccccagctggagctgctgccctgctggccggggccagctgcctgtgctacggccgcagcctgcagggcgagtttgtgcatgatgatgtgtgggccatcgtgaacaacccagatgtgcggcctggggcccccctgcgctggggcatcttcaccaatgacttctggggcaagggcatggccgagaacaccagccacaagagctaccggcccctgtgtgtgctgaccttcaagctgaacatcttcctgaccggcatgaaccccttctacttccacgctgtgaacatcatcctgcactgcctggtgaccctggtgctgatgtacacctgtgacaagacagtgttcaagaacagaggcctggcctttgtgacagccctgctgtttgctgtgcaccccatccacacagaggccgtggccggcatcgtgggccgggcagatgtgctggcctgcctgctcttcctgctggccttcctgagctacaacagaagcctggaccagggctgtgtgggcggcagcttccccagcacagtgagccccttcttcctgctgctgagcctcttcctgggcacctgtgccatgctggtgaaggagaccggcatcaccgtgtttggagtgtgcctggtgtatgacctcttcagcctgagcaacaagcaggacaagagcagcaatggagccctgtgccccaggagcccccagcagcccggcagcccccagcccagcagcctgcccggccacccccaccgggagaatggcaagcagcagcgcttcccccacaagggggcctggggcggctgccacagccccctgcccccagagcccaagagcagcggcttccctgtgagccccagggctgtgtggagcatgatgaggttcctgacctacagctacctgctggccttcaacgtgtggctgctgctggcccctgtgaccctgtgctatgactggcaggtgggcagcatccccctggtggagaccatctgggacatgaggaacctggccaccatcttcctggccgtggtgatggccctgctgagcctgcactgcctggccgccttcaagaggctggagcacaaggaggtgctggtgggcctgctcttcctggtgttccccttcatcccagccagcaacctcttcttccgggtgggctttgtggtggccgagcgggtgctgtacatgcccagcatgggctactgcatcctgtttgtgcacggcctgagcaagctgtgcacctggctgaacagatgtggggccaccaccctcatcgtgtccacagtgctgctgctgctgctcttctcctggaagacagtgaagcagaatgagatctggctgagccgggagagcctcttccgcagcggcgtgcagaccctgccccacaatgccaaggtgcactacaactatgccaacttcctgaaggaccagggcaggaacaaggaggccatctaccactacagaacagccctgaagctgtaccccaggcatgccagcgccctgaacaacctgggcaccctgacccgggacacagctgaggccaagatgtactaccagagggccctgcagctgcacccccagcacaacagagccctcttcaacctgggcaacctgctgaagagccaggagaagaaggaggaggccatcaccctgctgaaggacagcatcaagtatggccctgagtttgctgatgcctacagcagcctggccagcctgctggccgagcaggagcgcttcaaggaggccgaggagatctaccagacaggcatcaagaactgcccagacagcagtgacctgcacaacaactacggcgtcttcctggtggacaccggcctgcctgagaaggctgtggcccactaccagcaggccatcaagctgagccccagccaccacgtggccatggtgaacctgggccgcctgtaccgcagcctgggagaaaattccatggccgaggagtggtacaagagggccctgcaggtggcccacaaggccgagatcctgagccccctgggcgccctgtactacaacacaggccgctatgaggaggccctgcagatctaccaggaggccgccgccctgcagcccagccagcgggagctgcggctggccctggcccaggtgctggccgtgatgggccagaccaaggaggccgagaagatgaccaaccacatcgtgtctgaggagaccggctgcctggagtgctaccgcctgctgagcgccatctacagcaagcaggagaaccacgacaaggccctggatgccatcgacaaggccctgcagctgaagcccaaggaccccaaggtgatcagcgagctgttcttcaccaagggcaaccagctgcgggagcagaacctgctggacaaggcctttgagagctacagagtggccgtgcagctgaacccagaccaggcccaggcctggatgaacatgggcggcatccagcacatcaagggcaagtatgtgtctgcccgggcctactatgaaagagccctgcagctggtgcctgacagcaagctgctgaaggagaacctggccaagctggaccggctggagaagaggctgcaggaggtgcgggagaaggaccagacctag

SEQ ID NO: 38999 - DNA, 1938 bp, Artificial Sequence
  Description of Artificial Sequence: Synthetic coding sequence
gtcacagagcgggacagcgtgtccaagaagaagaagaagcgctacctgcgggccagcagcaacagaaacttcctgctgaccatgaggcccttcctgaagagggccatcctggtgctgtcctatgtgctggtgatcctgtacttccggctgtggatcatgggcggctccatgcccctcttcagcgagcaggacaacccagccagcttcagcccctacatcctgacccgcttcctgacctacagctacctgctggccttcaacgtgtggctgctgctggcccctgtgaccctgtgctatgactggcaggtgggcagcatccccctggtggagaccatctgggacatgaggaacctggccaccatcttcctggccgtggtgatggccctgctgagcctgcactgcctggccgccttcaagaggctggagcacaaggaggtgctggtgggcctgctcttcctggtgttccccttcatcccagccagcaacctcttcttccgggtgggctttgtggtggccgagcgggtgctgtacatgcccagcatgggctactgcatcctgtttgtgcacggcctgagcaagctgtgcacctggctgaacagatgtggggccaccaccctgattgtgtccacagtgctgctgctgctgctcttctcctggaagacagtgaagcagaatgagatctggctgagccgggagagcctcttccgctctggagtgcagaccctgccccacaatgccaaggtgcactacaactatgccaacttcctgaaggaccagggcaggaacaaggaggccatctaccactacagaacagccctgaagctgtaccccaggcatgccagcgccctgaacaacctgggcaccctgacccgggacacagctgaggccaagatgtactaccagagggccctgcagctgcacccccagcacaacagagccctcttcaacctgggcaacctgctgaagagccaggagaagaaggaggaggccatcaccctgctgaaggacagcatcaagtatggccctgagtttgctgatgcctacagcagcctggccagcctgctggccgagcaggagcgcttcaaggaggccgaggagatctaccagacaggcatcaagaactgcccagacagcagtgacctgcacaacaactatggagtcttcctggtggacaccggcctgcctgagaaggctgtggcccactaccagcaggccatcaagctgagccccagccaccacgtggccatggtgaacctgggccgcctgtaccgcagcctgggggagaacagcatggccgaggagtggtacaagagggccctgcaggtggcccacaaggccgagatcctgagccccctgggcgccctgtactacaacacaggccgctatgaggaggccctgcagatctaccaggaggccgccgccctgcagcccagccagcgggagctgcggctggccctggcccaggtgctggccgtgatgggccagaccaaggaggccgagaagatgaccaaccacatcgtgtctgaggagaccggctgcctggagtgctaccgcctgctgagcgccatctacagcaagcaggagaaccacgacaaggccctggatgccatcgacaaggccctgcagctgaagcccaaggaccccaaggtgatcagcgagctgttcttcaccaagggcaaccagctgcgggagcagaacctgctggacaaggcctttgagagctacagagtggccgtgcagctgaacccagaccaggcccaggcctggatgaacatgggcggcatccagcacatcaagggcaagtatgtgtctgcccgggcctactatgagcgggccctgcagctggtgcctgacagcaagctgctgaaggagaacctggccaagctggaccggctggagaagaggctgcaggaggtgcgggagaaggaccagacctag

SEQ ID NO: 39000 - DNA, 2835 bp, Artificial Sequence
  Description of Artificial Sequence: Synthetic coding sequence
atggtggtgaccaccagcgcccggggcggcggcggggacaggacccccagcagaagaagaggctgcggcctggccccagctggagctgctgccctgctggccggggccagctgcctgtgctacggccgcagcctgcagggcgagtttgtgcatgatgatgtgtgggccatcgtgaacaacccagatgtgcggcctggggcccccctgcgctggggcatcttcaccaatgacttctggggcaagggcatggccgagaacaccagccacaagagctaccggcccctgtgtgtgctgaccttcaagctgaacatcttcctgaccggcatgaaccccttctacttccacgctgtgaacatcatcctgcactgcctggtgaccctggtgctgatgtacacctgtgacaagacagtgttcaagaacagaggcctggcctttgtgacagccctgctgtttgctgtgcaccccatccacacagaggccgtggccggcatcgtgggccgggcagatgtgctggcctgcctgctcttcctgctggccttcctgagctacaacagaagcctggaccagggctgtgtgggcggcagcttccccagcacagtgagccccttcttcctgctgctgagcctcttcctgggcacctgtgccatgctggtgaaggagaccggcatcaccgtgtttggagtgtgcctggtgtatgacctcttcagcctgagcaacaagcaggacaagagcagcaatggagccctgtgccccaggagcccccagcagcccggcagcccccagcccagcagcctgcccggccacccccaccgggagaatggcaagcagcagcgcttcccccacaagggggcctggggcggctgccacagccccctgcccccagagcccaagagcagcggcttccctgtgagccccagggctgtgtggagcatgatgagatacctgcgggccagcagcaacagaaacttcctgctgaccatgaggcccttcctgaagagggccatcctggtgctgtcctatgtgctggtgatcctgtacttccggctgtggatcatgggcggctccatgcccctcttcagcgagcaggacaacccagccagcttcagcccctacatcctgacccgcttcctgacctacagctacctgctggccttcaacgtgtggctgctgctggcccctgtgaccctgtgctatgactggcaggtgggcagcatccccctggtggagaccatctgggacatgaggaacctggccaccatcttcctggccgtggtgatggccctgctgagcctgcactgcctggccgccttcaagaggctggagcacaaggaggtgctggtgggcctgctcttcctggtgttccccttcatcccagccagcaacctcttcttccgggtgggctttgtggtggccgagcgggtgctgtacatgcccagcatgggctactgcatcctgtttgtgcacggcctgagcaagctgtgcacctggctgaacagatgtggggccaccaccctcatcgtgtccacagtgctgctgctgctgctcttctcctggaagacagtgaagcagaatgagatctggctgagccgggagagcctcttccgcagcggcgtgcagaccctgccccacaatgccaaggtgcactacaactatgccaacttcctgaaggaccagggcaggaacaaggaggccatctaccactacagaacagccctgaagctgtaccccaggcatgccagcgccctgaacaacctgggcaccctgacccgggacacagctgaggccaagatgtactaccagagggccctgcagctgcacccccagcacaacagagccctcttcaacctgggcaacctgctgaagagccaggagaagaaggaggaggccatcaccctgctgaaggacagcatcaagtatggccctgagtttgctgatgcctacagcagcctggccagcctgctggccgagcaggagcgcttcaaggaggccgaggagatctaccagacaggcatcaagaactgcccagacagcagtgacctgcacaacaactacggcgtcttcctggtggacaccggcctgcctgagaaggctgtggcccactaccagcaggccatcaagctgagccccagccaccacgtggccatggtgaacctgggccgcctgtaccgcagcctgggagaaaattccatggccgaggagtggtacaagagggccctgcaggtggcccacaaggccgagatcctgagccccctgggcgccctgtactacaacacaggccgctatgaggaggccctgcagatctaccaggaggccgccgccctgcagcccagccagcgggagctgcggctggccctggcccaggtgctggccgtgatgggccagaccaaggaggccgagaagatgaccaaccacatcgtgtctgaggagaccggctgcctggagtgctaccgcctgctgagcgccatctacagcaagcaggagaaccacgacaaggccctggatgccatcgacaaggccctgcagctgaagcccaaggaccccaaggtgatcagcgagctgttcttcaccaagggcaaccagctgcgggagcagaacctgctggacaaggcctttgagagctacagagtggccgtgcagctgaacccagaccaggcccaggcctggatgaacatgggcggcatccagcacatcaagggcaagtatgtgtctgcccgggcctactatgaaagagccctgcagctggtgcctgacagcaagctgctgaaggagaacctggccaagctggaccggctggagaagaggctgcaggaggtgcgggagaaggaccagacctag

SEQ ID NO: 39001 - DNA, 2511 bp, Artificial Sequence
  Description of Artificial Sequence: Synthetic coding sequence
atgattgctgagctggtgagcagcgccctgggcctggccctgtacctgaacaccctgtctgctgacttctgctatgatgacagccgggccatcaagaccaaccaggacctgctgcctgagaccccctggacccacatcttctacaatgacttctggggcaccctgctgacccacagcggcagccacaagagctaccggcccctgtgcaccctgtccttccggctgaaccacgccatcggcggcctgaacccctggagctaccacctggtgaatgtgctgctgcacgccgctgtgacaggcctcttcaccagcttcagcaagatcctgctgggagatggctactggaccttcatggccggcctgatgtttgccagccaccccatccacacagaggccgtggccggcatcgtgggccgggcagatgtgggcgccagcctcttcttcctgctgagcctgctgtgctacatcaagcactgcagcacccggggctacagcgcccggacctggggctggttcctgggcagcggcctgtgtgccggctgcagcatgctgtggaaggagcagggcgtgacagtgctggccgtgtctgctgtgtatgatgtgtttgtgttccaccggctgaagatcaagcagatcctgcccaccatctacaagaggaagaacctgagcctcttcctgagcatcagcctgctgatcttctggggcagcagcctgctgggcgcccggctgtactggatgggcaacaagccacccagcttcagcaacagcgacaacccagctgctgacagcgacagcctgctgaccaggaccctgaccttcttctacctgcccaccaagaacctgtggctgctgctgtgcccagacaccctgagctttgactggagcatggatgctgtgcccctgctgaagacagtgtgtgactggaggaacctgcacacagtggccttctacacaggcctgctgctgctggcctactacggcctgaagagccccagcgtggaccgggagtgcaatggcaagacagtgaccaacgggaagcagaatgccaacggccacagctgcctgagtgatgtggagtaccagaacagcgagaccaagagcagctttgccagcaaggtggagaatggcatcaagaatgatgtgtcccagaggacccagctgcccagcacagaaaatattgtggtgctgagcctgagcctgctgatcatcccctttgtgcctgccaccaacctcttcttctacgtgggctttgtgattgctgagcgggtgctgtacatccccagcatgggcttctgcctgctgatcaccgtgggcgcccgggccctgtatgtgaaggtgcagaagcgcttcctgaagagcctcatcttctacgccacagccaccctgattgtgttctacggcctgaagacagccatcagaaatggagactggcagaatgaggagatgctgtaccgcagcggcatcaaggtgaacccagccaaggcctggggcaacctgggcaatgtgctgaagagccagagcaagatcagcgaggccgagagcgcctacagaaatgccctgtactaccgcagcaacatggctgacatgctgtacaacctgggcctgctgctgcaggagaacagcagatttgctgaggccctgcactactacaagctggccatcggcagccggcccaccctggccagcgcctacctgaacacaggcatcatcctgatgaaccagggccgcacagaggaggcccggaggaccttcctgaagtgcagcgagatcccagatgagaacctgaaggacccccacgcccacaagagctctgtgaccagctgcctgtacaacctgggcaagctgtaccacgagcagggccactatgaggaggccctgtctgtgtacaaggaggccatccagaagatgccccggcagtttgccccccagagcctgtacaacatgatgggagaggcctacatgaggctgagcaagctgcctgaggccgagcactggtacatggagagcctgcggagcaagacagaccacatcccagcccacctgacctacggcaagctgctggccctgaccggcaggaagtctgaggccgagaagctgttcctgaaggccatcgagctggaccccaccaagggcaactgctacatgcactacggccagttcctgctggaggaggcccggctcatcgaggccgctgagatggccaagaaggctgctgagctggacagcacagaatttgatgtggtgttcaatgctgcccacatgctgcggcaggccagcctgaatgaagctgctgagaagtactatgacctggccgcccggctgcggcccaactacccagctgccctgatgaacctgggcgccatcctgcacctgaatggccgcctgcagaaggccgaggccaactacctgcgggccctgcagctgaagccagatgatgtgatcacccagagcaacctgaggaagctgtggaacatcatggagaagcagggcctgaagaccagcaagacctag

SEQ ID NO: 39002 - DNA, 2745 bp, Artificial Sequence
  Description of Artificial Sequence: Synthetic coding sequence
atggccaacatcaacctgaaggagatcaccctcatcgtgggcgtggtgacagcctgctactggaacagcctcttctgtggctttgtgtttgatgatgtgtctgccatcctggacaacaaggacctgcaccccagcacccccctgaagaccctcttccagaatgacttctggggcacccccatgtctgaggagaggagccacaagagctaccggcccctgactgtgctgaccttccggctgaactacctgctgtctgagctgaagcccatgagctaccacctgctgaacatgatcttccacgctgtggtgtctgtcatcttcctgaaggtgtgcaagctgttcctggacaacaagagcagcgtcatcgccagcctgctgtttgctgtgcaccccatccacacagaggccgtgactggagtggtgggccgggcagagctgctgagcagcatcttcttcctggccgccttcctgagctacaccaggagcaaaggaccagacaacagcatcatctggacccccatcgccctgactgtgttcctggtggccgtggccaccctgtgcaaggagcagggcatcaccgtggtgggcatctgctgcgtgtatgaggtgttcatcgcccagggctacaccctgcccctgctgtgcaccacagctggccagttcctgcggggcaagggcagcatccccttctccatgctgcagaccctggtgaagctgattgtgctgatgttcagcaccctgctgctggtggtgatccgggtgcaggtgatccagagccagctgcccgtcttcaccaggtttgacaacccagctgctgtgagccccacccccacccggcagctgaccttcaactacctgctgcctgtgaatgcctggctgctgctgaaccccagcgagctgtgctgtgactggaccatgggcaccatccccctcatcgagagcctgctggacatccggaacctggccaccttcaccttcttctgcttcctgggcatgctgggcgtcttcagcatccgctacagcggggacagcagcaagacagtgctgatggccctgtgcctgatggccctgcccttcatcccagccagcaacctcttcttccctgtgggctttgtggtggccgagcgggtgctgtatgtgcccagcatgggcttctgcatcctggtggcccacggctggcagaagatcagcaccaagagcgtcttcaagaagctgtcctggatctgcctgtccatggtgatcctgacccacagcctgaagaccttccacaggaactgggactgggagagcgagtacaccctcttcatgtctgccctgaaggtgaacaagaacaatgccaagctgtggaacaacgtgggccacgccctggagaatgagaagaactttgagcgggccctgaagtacttcctgcaggccacccacgtgcagccagatgacatcggggcccacatgaatgtgggccgcacctacaagaacctgaacagaaccaaggaggccgaggagagctacatgatggccaagagcctgatgccccagatcatccctgggaagaagtatgctgccagaattgcccccaaccacctgaatgtgtacatcaacctggccaacctgatccgggccaatgaaagccggctggaggaggccgaccagctgtaccggcaggccatctccatgaggccagacttcaagcaggcctacatcagcagaggagagctgctgctgaagatgaacaagcccctgaaggccaaggaggcctacctgaaggccctggagctggacaggaacaatgctgacctgtggtacaacctggccatcgtgcacatcgagctgaaggagcccaatgaggccctgaagaacttcaacagagccctggagctgaaccccaagcacaagctggccctcttcaacagcgccatcgtgatgcaggagagcggggaggtgaagctgcggcctgaggccaggaagaggctgctgagctacatcaatgaggagcccctggatgccaacggctacttcaacctgggcatgctggccatggatgacaagaaggacaatgaagctgagatctggatgaagaaggccatcaagctgcaggccgacttccgcagcgccctcttcaacctggccctgctgtacagccagacagccaaggagctgaaggccctgcccatcctggaggagctgctgcgctactacccagaccacatcaagggcctcatcctgaagggggacatcctgatgaaccagaagaaggacatcctgggcgccaagaagtgctttgagcgcatcctggagatggaccccagcaatgtgcagggcaagcacaacctgtgtgtggtgtactttgaggagaaggacctgctgaaggccgagcgctgcctgctggagaccctggccctggcccctcatgaggagtacatccagaggcacctgaacatcgtgcgggacaagatcagcagcagcagcttcatcgagcccatcttccccaccagcaagatcagctctgtggagggcaagaagatccccacagaatctgtgaaggagatccggggggagagccggcagacccagatcgtgaagaccagtgacaacaagagccagagcaagagcaacaagcagctgggcaagaatggagatgaggagaccccccacaagaccaccaaggacatcaaggagattgagaagaagagggtggccgccctgaagaggctggaggagattgagcgcatcctgaatggagagtag

SEQ ID NO: 39003 - DNA, 447 bp, Artificial Sequence
  Description of Artificial Sequence: Synthetic coding sequence
atggccaacatcaacctgaaggagatcaccctcatcgtgggcgtggtgacagcctgctactggaacagcctcttctgtggctttgtgtttgatgatgtgtctgccatcctggacaacaaggacctgcaccccagcacccccctgaagaccctcttccagaatgacttctggggcacccccatgtctgaggagaggagccacaagagctaccggcccctgactgtgctgaccttccggctgaactacctgctgtctgagctgaagcccatgagctaccacctgctgaacatgatcttccacgctgtggtgtctgtcatcttcctgaaggtgtgcaagctgttcctggacaacaagagcagcgtcatcgccagcctgctgtttgctgtgcaccccatccacacagaggccgtgactggagtggtgggccgggcagagctgctgtcctag

SEQ ID NO: 39004 - DNA, 1893 bp, Artificial Sequence
  Description of Artificial Sequence: Synthetic coding sequence
atggctgtgctggacacagacctggaccacatcctgcccagctctgtgctgccccccttctgggccaagctggtggtgggctctgtggccatcgtgtgctttgcccggagctatgatggagactttgtgtttgatgattctgaggccatcgtgaacaacaaggtggccggcgtggtgggccgggctgacctgctgtgtgccctcttcttcctgctgtccttcctgggctactgcaaggccttccgggagagcaacaaggagggcgcccacagcagcaccttctgggtgctgctgagcatcttcctgggcgctgtggccatgctgtgcaaggagcagggcatcaccgtgctgggcctgaatgctgtgtttgacatcctggtgattggcaagttcaacgtgctggagatcgtgcagaaggtgctgcacaaggacaagagcctggagaacctgggcatgctgagaaatggaggcctgctcttcaggatgaccctgctgaccagcggcggggccggcatgctgtatgtgcgctggaggatcatgggcaccggccccccagccttcacagaggtggacaacccagccagctttgctgacagcatgctggtgcgggctgtgaactacaactactactacagcctgaatgcctggctgctgctgtgcccctggtggctgtgctttgactggagcatgggctgcatccccctcatcaagagcatcagtgactggagggtgattgccctggccgccctgtggttctgcctgattggcctcatctgccaggccctgtgcagtgaagatggccacaagaggcgcatcctgaccctgggcctgggcttcctggtgatccccttcctgcctgccagcaacctcttcttccgggtgggctttgtggtggccgagcgggtgctgtacctgcccagcgtgggctactgtgtgctgctgaccttcggctttggagccctgagcaagcacaccaagaagaagaagctgattgctgctgtggtgctgggcatcctcttcatcaacaccctgcgctgtgtgctgcggagcggggagtggaggtctgaggagcagctgttccgcagcgccctgtctgtgtgccccctgaatgccaaggtgcactacaacatcggcaagaacctggccgacaagggcaaccagacagctgccatccgctactaccgggaggccgtgcggctgaaccccaagtatgtgcacgccatgaacaacctgggcaacatcctgaaggagagaaatgagctgcaggaggccgaggagctgctgagcctggccgtgcagatccagcctgactttgctgctgcctggatgaacctgggcatcgtgcagaacagcctgaagagatttgaagctgctgagcagagctacagaacagccatcaagcacaggaggaagtacccagactgctactacaacctgggccgcctgtatgctgacctgaacagacatgtggatgccctgaatgcctggagaaatgccaccgtgctgaagccagagcacagcctggcctggaacaacatgatcatcctgctggacaacacaggcaacctggcccaggccgaggccgtgggccgggaggccctggagctgatccccaatgaccacagcctgatgttcagcctggccaacgtgctgggcaagagccagaagtacaaggagagcgaggccctcttcctgaaggccatcaaggccaaccccaatgctgccagctaccacggcaacctggccgtgctgtaccaccgctggggccacctggacctggccaagaagcactatgagatcagcctgcagctggaccccacagccagcggcaccaaggaaaattatggcctgctgcggaggaagctggagctgatgcagaagaaggctgtgtag

SEQ ID NO: 39005 - DNA, 2283 bp, Artificial Sequence
  Description of Artificial Sequence: Synthetic coding sequence
atgatccccaaccagcacaatgctggggccggcagccaccagcctgctgtgttcaggatggctgtgctggacacagacctggaccacatcctgcccagctctgtgctgccccccttctgggccaagctggtggtgggctctgtggccatcgtgtgctttgcccggagctatgatggagactttgtgtttgatgacagcgaggccatcgtgaacaacaaggacctgcaggccgagacccccctgggggacctgtggcaccacgacttctggggcagccggctgagcagcaacaccagccacaagagctaccggcccctgactgtgctgaccttccgcatcaactactacctgagcggcggcttccaccctgtgggcttccacgtggtgaacatcctgctgcacagcggcatctctgtgctgatggtggatgtgttttctgtgctgtttggaggcctgcagtacaccagcaaaggaagaaggctgcacctggccccccgggccagcctgctggccgccctgctgtttgctgtgcaccctgtgcacacagaatgtgtggccggcgtggtgggccgggctgacctgctgtgtgccctcttcttcctgctgtccttcctgggctactgcaaggccttccgggagagcaacaaggagggcgcccacagcagcaccttctgggtgctgctgagcatcttcctgggcgctgtggccatgctgtgcaaggagcagggcatcaccgtgctgggcctgaatgctgtgtttgacatcctggtgattggcaagttcaacgtgctggagatcgtgcagaaggtgctgcacaaggacaagagcctggagaacctgggcatgctgagaaatggaggcctgctcttcaggatgaccctgctgaccagcggcggggccggcatgctgtatgtgcgctggaggatcatgggcaccggccccccagccttcacagaggtggacaacccagccagctttgctgacagcatgctggtgcgggctgtgaactacaactactactacagcctgaatgcctggctgctgctgtgcccctggtggctgtgctttgactggagcatgggctgcatccccctcatcaagagcatcagtgactggagggtgattgccctggccgccctgtggttctgcctgattggcctcatctgccaggccctgtgcagtgaagatggccacaagaggcgcatcctgaccctgggcctgggcttcctggtgatccccttcctgcctgccagcaacctcttcttccgggtgggctttgtggtggccgagcgggtgctgtacctgcccagcgtgggctactgtgtgctgctgaccttcggctttggagccctgagcaagcacaccaagaagaagaagctgattgctgctgtggtgctgggcatcctcttcatcaacaccctgcgctgtgtgctgcggagcggggagtggaggtctgaggagcagctgttccgcagcgccctgtctgtgtgccccctgaatgccaaggtgcactacaacatcggcaagaacctggccgacaagggcaaccagacagctgccatccgctactaccgggaggccgtgcggctgaaccccaagtatgtgcacgccatgaacaacctgggcaacatcctgaaggagagaaatgagctgcaggaggccgaggagctgctgagcctggccgtgcagatccagcctgactttgctgctgcctggatgaacctgggcatcgtgcagaacagcctgaagagatttgaagctgctgagcagagctacagaacagccatcaagcacaggaggaagtacccagactgctactacaacctgggccgcctgtatgctgacctgaacagacatgtggatgccctgaatgcctggagaaatgccaccgtgctgaagccagagcacagcctggcctggaacaacatgatcatcctgctggacaacacaggcaacctggcccaggccgaggccgtgggccgggaggccctggagctgatccccaatgaccacagcctgatgttcagcctggccaacgtgctgggcaagagccagaagtacaaggagagcgaggccctcttcctgaaggccatcaaggccaaccccaatgctgccagctaccacggcaacctggccgtgctgtaccaccgctggggccacctggacctggccaagaagcactatgagatcagcctgcagctggaccccacagccagcggcaccaaggaaaattatggcctgctgcggaggaagctggagctgatgcagaagaaggctgtgtag

SEQ ID NO: 39006 - DNA, 2226 bp, Artificial Sequence
  Description of Artificial Sequence: Synthetic coding sequence
atggctgtgctggacacagacctggaccacatcctgcccagctctgtgctgccccccttctgggccaagctggtggtgggctctgtggccatcgtgtgctttgcccggagctatgatggagactttgtgtttgatgattctgaggccatcgtgaacaacaaggacctgcaggccgagacccccctgggggacctgtggcaccacgacttctggggcagccggctgagcagcaacaccagccacaagagctaccggcccctgactgtgctgaccttccgcatcaactactacctgagcggcggcttccaccctgtgggcttccacgtggtgaacatcctgctgcacagcggcatctctgtgctgatggtggatgtgttttctgtgctgtttggaggcctgcagtacaccagcaagggccggcggctgcacctggccccccgggccagcctgctggccgccctgctgtttgctgtgcaccctgtgcacacagaatgtgtggccggcgtggtgggccgggctgacctgctgtgtgccctcttcttcctgctgtccttcctgggctactgcaaggccttccgggagagcaacaaggagggcgcccacagcagcaccttctgggtgctgctgagcatcttcctgggcgctgtggccatgctgtgcaaggagcagggcatcaccgtgctgggcctgaatgctgtgtttgacatcctggtgattggcaagttcaacgtgctggagatcgtgcagaaggtgctgcacaaggacaagagcctggagaacctgggcatgctgagaaatggaggcctgctcttcaggatgaccctgctgaccagcggcggggccggcatgctgtatgtgcgctggaggatcatgggcactggacctccagccttcacagaggtggacaacccagccagctttgctgacagcatgctggtgcgggctgtgaactacaactactactacagcctgaatgcctggctgctgctgtgcccctggtggctgtgctttgactggagcatgggctgcatccccctcatcaagagcatcagtgactggagggtcatcgccctggccgccctgtggttctgcctgattggcctcatctgccaggccctgtgcagtgaagatggccacaagaggcgcatcctgaccctgggcctgggcttcctggtgatccccttcctgcctgccagcaacctcttcttccgggtgggctttgtggtggccgagcgggtgctgtacctgcccagcgtgggctactgtgtgctgctgacctttggatttggagccctgagcaagcacaccaagaagaagaagctgattgctgctgtggtgctgggcatcctcttcatcaacaccctgcgctgtgtgctgcggtctggagagtggaggtctgaggagcagctgttccgcagcgccctgtctgtgtgccccctgaatgccaaggtgcactacaacatcggcaagaacctggccgacaagggcaaccagacagctgccatccgctactaccgggaggccgtgcggctgaaccccaagtatgtgcacgccatgaacaacctgggcaacatcctgaaggagagaaatgagctgcaggaggccgaggagctgctgagcctggccgtgcagatccagcctgactttgctgctgcctggatgaacctgggcatcgtgcagaacagcctgaagagatttgaggccgctgagcagagctacagaacagccatcaagcacaggaggaagtacccagactgctactacaacctgggccgcctgtatgctgacctgaacagacatgtggatgccctgaatgcctggagaaatgccaccgtgctgaagccagagcacagcctggcctggaacaacatgatcatcctgctggacaacacaggcaacctggcccaggccgaggccgtgggccgggaggccctggagctgatccccaatgaccacagcctgatgttcagcctggccaacgtgctgggcaagagccagaagtacaaggagagcgaggccctcttcctgaaggccatcaaggccaaccccaatgctgccagctaccacggcaacctggccgtgctgtaccaccgctggggccacctggacctggccaagaagcactatgagatcagcctgcagctggaccccacagccagcggcaccaaggagaactacggcctgctgcggaggaagctggagctgatgcagaagaaggctgtgtag

SEQ ID NO: 39007 - DNA, 165 bp, Artificial Sequence
  Description of Artificial Sequence: Synthetic coding sequence
atggctgtgctggacacagacctggaccacatcctgcccagctctgtgctgccccccttctgggccaagctggtggtgggctctgtggccatcgtgtgctttgcccggagctatgatggagactttgtgtttgatgattctgaggccatcgtgaacaacaagtag

SEQ ID NO: 39008 - DNA, 222 bp, Artificial Sequence
  Description of Artificial Sequence: Synthetic coding sequence
atgatccccaaccagcacaatgctggggccggcagccaccagcctgctgtgttcaggatggctgtgctggacacagacctggaccacatcctgcccagctctgtgctgccccccttctgggccaagctggtggtgggctctgtggccatcgtgtgctttgcccggagctatgatggagactttgtgtttgatgacagcgaggccatcgtgaacaacaagtag

SEQ ID NO: 39009 - DNA, 741 bp, Artificial Sequence
  Description of Artificial Sequence: Synthetic coding sequence
atgaccctcatcgagggcgtgggagatgaggtgacagtgctcttctctgtgctggcctgcctgctggtgctggccctggcctgggtgtccacccacacagctgagggcggggaccccctgccccagcccagcggcacccccacccccagccagcccagcgctgccatggccgccacagacagcatgagaggagaggcccctggagctgagacccccagcctgcggcaccggggccaggccgcccagcctgagcccagcacaggcttcaccgccaccccaccagccccagacagcccccaggagcccctggtgctgcggctgaagttcctgaatgattctgagcaggtggcccgggcctggccccatgacaccatcggcagcctgaagaggacccagtttcctggccgggagcagcaggtgcggctcatctaccagggccagctgctgggagatgacacccagaccctgggcagcctgcacctgccccccaactgtgtgctgcactgccacgtgtccaccagggtgggcccccccaaccccccctgccccccaggcagcgagcccggccccagcggcctggagatcggcagcctgctgctgcccctgctgctgctgctgctgctgctgctgtggtactgccagatccagtaccggcccttcttccccctgacagccaccctgggcctggccggcttcaccctgctgctgagcctgctggcctttgccatgtaccggccctag

SEQ ID NO: 39010 - DNA, 741 bp, Artificial Sequence; identical to SEQ ID NO: 39009
  Description of Artificial Sequence: Synthetic coding sequence

SEQ ID NO: 39011 - DNA, 741 bp, Artificial Sequence; identical to SEQ ID NO: 39009
  Description of Artificial Sequence: Synthetic coding sequence

SEQ ID NO: 39012 - DNA, 741 bp, Artificial Sequence; identical to SEQ ID NO: 39009
  Description of Artificial Sequence: Synthetic coding sequence

SEQ ID NO: 39013 - DNA, 741 bp, Artificial Sequence; identical to SEQ ID NO: 39009
  Description of Artificial Sequence: Synthetic coding sequence

SEQ ID NO: 39014 - DNA, 516 bp, Artificial Sequence
  Description of Artificial Sequence: Synthetic coding sequence
atgaccctcatcgagggcgtgggagatgaggtgacagtgctcttctctgtgctggcctgcctgctggtgctggccctggcctgggtgtccacccacacagctgagggcggggaccccctgccccagcccagcggcacccccacccccagccagcccagcgctgccatggccgccacagacagcatgagaggagaggcccctggagctgagacccccagcctgcggcaccggggccaggccgcccagcctgagcccagcacaggcttcaccgccaccccaccagccccagacagcccccaggagcccctggtgctgcggctgaagttcctgaatgattctgagcaggtggcccgggcctggccccatgacaccatcggcagcctgaagaggacccagtttcctggccgggagcagcaggtgcggctcatctaccagggccagctgctgggagatgacacccagaccctgggcagcctgcacctgccccccaactgtgtgctgcactgccacgtgtag

SEQ ID NO: 39015 - DNA, 459 bp, Artificial Sequence
  Description of Artificial Sequence: Synthetic coding sequence
atgaccctcatcgagggcgtgggagatgaggtgacagtgctcttctctgtgctggcctgcctgctggtgctggccctggcctgggtgtccacccacacagctgagggcggggaccccctgccccagcccagcggcacccccacccccagccagcccagcgctgccatggccgccacagacagcatgagaggagaggcccctggagctgagacccccagcctgcggcaccggggccaggccgcccagcctgagcccagcacaggcttcaccgccaccccaccagccccagacagcccccaggagcccctggtgctgcggctgaagttcctgaatgattctgagcaggtggcccgggcctggccccatgacaccatcggcagcctgaagaggacccagtttcctggccgggagcagcaggtgcggctcatctaccagggccagctgctgggagatgactag

SEQ ID NO: 39016 - DNA, 906 bp, Artificial Sequence
  Description of Artificial Sequence: Synthetic coding sequence
atggagctgagtgatgtgaccctgattgaaggagtgggcaatgaggtgatggtggtggccggcgtggtggtgctgatcctggccctggtgctggcctggctgagcacctacgtggccgacagcggcagcaaccagctgctgggcgccatcgtgtctgctggggacacctctgtgctgcacctgggccacgtggaccacctggtggccggccagggcaaccctgagcccacagagctgccccaccccagcgagggcaatgatgagaaggccgaggaggccggggagggccgcggggacagcactggagaggccggggccggcggcggcgtggagcccagcctggagcacctgctggacatccagggcctgcccaagaggcaggccggggccggcagcagcagccctgaggcccccctgcggtctgaggacagcacctgcctgccccccagccctggcctcatcaccgtgcggctgaagttcctgaatgacacagaggagctggccgtggcccggccagaagatactgtgggcgccctgaagagcaagtacttccctggccaggagagccagatgaagctgatctaccagggccgcctgctgcaggaccctgcccggaccctgcggagcctgaacatcacagacaactgtgtgatccactgccacaggagccccccaggcagcgctgtgcccggccccagcgccagcctggcccccagcgccacagagccccccagcctgggcgtgaatgtgggcagcctgatggtgcctgtgtttgtggtgctgctgggcgtggtgtggtacttccgcatcaactaccggcagttcttcaccgccccagccaccgtgtccctggtgggcgtgaccgtcttcttctccttcctggtgtttggcatgtatggaagatag

SEQ ID NO: 39017 - DNA, 906 bp, Artificial Sequence; identical to SEQ ID NO: 39016
  Description of Artificial Sequence: Synthetic coding sequence

SEQ ID NO: 39018 - DNA, 795 bp, Artificial Sequence
  Description of Artificial Sequence: Synthetic coding sequence
atggagctgagtgatgtgaccctgattgaaggagtgggcaatgaggtgatggtggtggccggcgtggtggtgctgatcctggccctggtgctggcctggctgagcacctacgtggccgacagcggcagcaaccagctgctgggcgccatcgtgtctgctggggacacctctgtgctgcacctgggccacgtggaccacctggtggccggccagggcaaccctgagcccacagagctgccccaccccagcgagggcctgcccaagaggcaggccggggccggcagcagcagccctgaggcccccctgcggtctgaggacagcacctgcctgccccccagccctggcctcatcaccgtgcggctgaagttcctgaatgacacagaggagctggccgtggcccggcctgaggacacagtgggcgccctgaagagcaagtacttccctggccaggagagccagatgaagctgatctaccagggccgcctgctgcaggaccctgcccggaccctgcggagcctgaacatcacagacaactgtgtgatccactgccacaggagccccccaggcagcgctgtgcccggccccagcgccagcctggcccccagcgccacagagccccccagcctgggcgtgaatgtgggcagcctgatggtgcctgtgtttgtggtgctgctgggcgtggtgtggtacttccgcatcaactaccggcagttcttcaccgccccagccaccgtgtccctggtgggcgtgacagtgttcttctccttcctggtgtttggcatgtatggccgctag

SEQ ID NO: 39019 - DNA, 966 bp, Artificial Sequence
  Description of Artificial Sequence: Synthetic coding sequence
atgatcagccgccacctgcagaacaacctgatgtctgtggaccctgccagcagccaggccatggagctgagtgatgtgaccctgattgaaggagtgggcaatgaggtgatggtggtggccggcgtggtggtgctgatcctggccctggtgctggcctggctgagcacctacgtggccgacagcggcagcaaccagctgctgggcgccatcgtgtctgctggggacacctctgtgctgcacctgggccacgtggaccacctggtggccggccagggcaaccctgagcccacagagctgccccaccccagcgagggcaatgatgagaaggccgaggaggccggggagggccgcggggacagcactggagaggccggggccggcggcggcgtggagcccagcctggagcacctgctggacatccagggcctgcccaagaggcaggccggggccggcagcagcagccctgaggcccccctgcggtctgaggacagcacctgcctgccccccagccctggcctcatcaccgtgcggctgaagttcctgaatgacacagaggagctggccgtggcccggccagaagatactgtgggcgccctgaagagcaagtacttccctggccaggagagccagatgaagctgatctaccagggccgcctgctgcaggaccctgcccggaccctgcggagcctgaacatcacagacaactgtgtgatccactgccacaggagccccccaggcagcgctgtgcccggccccagcgccagcctggcccccagcgccacagagccccccagcctgggcgtgaatgtgggcagcctgatggtgcctgtgtttgtggtgctgctgggcgtggtgtggtacttccgcatcaactaccggcagttcttcaccgccccagccaccgtgtccctggtgggcgtgaccgtcttcttctccttcctggtgtttggcatgtatggaagatag

SEQ ID NO: 39020 - DNA, 936 bp, Artificial Sequence
  Description of Artificial Sequence: Synthetic coding sequence
atgagcaaccccagcgcccccccaccctatgaagatagaaaccccctgtacccaggccccccacctcctgggggctacggccagcccagcgtgctgcccggcggctacccagcctacccaggctacccccagcccggctacggccaccctgctggctacccccagcccatgccacccacccaccccatgcccatgaactacggccctggccacggctatgatggagaggagagagctgtgtctgacagctttggacctggagagtgggatgacaggaaggtgcgccacaccttcatcaggaaggtgtacagcatcatctctgtgcagctgctgatcaccgtggccatcatcgccatcttcacctttgtggagcctgtgtctgcctttgtgagaagaaatgtggccgtgtactacgtgtcctatgctgtgtttgtggtgacctacctgatcctggcctgctgccagggcccccggcggcgcttcccctggaacatcatcctgctgaccctcttcacctttgccatgggcttcatgacaggcaccatcagctccatgtaccagaccaaggccgtcatcatcgccatgatcatcacagctgtggtgtccatctctgtgaccatcttctgcttccagaccaaggtggacttcaccagctgcaccggcctcttctgtgtgctgggcatcgtgctgctggtgactggaattgtgaccagcatcgtgctgtacttccagtatgtgtactggctgcacatgctgtatgctgccctgggcgccatctgcttcaccctcttcctggcctatgacacccagctggtgctgggcaacaggaagcacaccatcagccctgaggactacatcactggagccctgcagatctacacagacatcatctacatcttcacctttgtgctgcagctgatgggagacaggaactag

SEQ ID NO: 39021 - DNA, 936 bp, Artificial Sequence; identical to SEQ ID NO: 39020
  Description of Artificial Sequence: Synthetic coding sequence

SEQ ID NO: 39022 - DNA, 141 bp, Artificial Sequence
  Description of Artificial Sequence: Synthetic coding sequence
atgagcaaccccagcgcccccccaccctatgaagatagaaaccccctgtacccaggccccccacctcctgggggctacggccagcccagcgtgctgcccggcggctacccagcctacccaggctacccccagcctggatag

SEQ ID NO: 39023 - DNA, 456 bp, Artificial Sequence
  Description of Artificial Sequence: Synthetic coding sequence
atgagcaaccccagcgcccccccaccctatgaagatagaaaccccctgtacccaggccccccacctcctgggggctacggccagcccagcgtgctgcccggcggctacccagcctacccaggctacccccagcccggctacggccaccctgctggctacccccagcccatgccacccacccaccccatgcccatgaactacggccctggccacggctatgatggagaggagagagctgtgtctgacagctttggacctggagagtgggatgacaggaaggtgcgccacaccttcatcaggaaggtgtacagcatcatctctgtgcagctgctgatcaccgtggccatcatcgccatcttcacctttgtggagcctgtgtctgcctttgtgagaagaaatgtggccgtgtactacgtgtcctatgctgtgtttgtggtgacctacctgatcctgtag

SEQ ID NO: 39024 - DNA, 27 bp, Artificial Sequence
  Description of Artificial Sequence: Synthetic coding sequence
atgagcaaccccagcgcccctccttag

SEQ ID NO: 39025 - DNA, 504 bp, Artificial Sequence
  Description of Artificial Sequence: Synthetic coding sequence
atgagcaaccccagcgcccccccaccctatgaagatagaaaccccctgtacccaggccccccacctcctgggggctacggccagcccagcgtgctgcccggcggctacccagcctacccaggctacccccagcccggctacggccaccctgctggctacccccagcccatgccacccacccaccccatgcccatgaactacggccctggccacggctatgatggagaggagagagctgtgtctgacagctttggacctggagagtgggatgacaggaaggtgcgccacaccttcatcaggaaggtgtacagcatcatctctgtgcagctgctgatcaccgtggccatcatcgccatcttcacctttgtggagcctgtgtctgcctttgtgagaagaaatgtggccgtgtactacgtgtcctatgctgtgtttgtggtgacctacctgatcctggcctgctgccagggcccccggcggcgcttcccctggaacatcatcctgtag

SEQ ID NO: 39026 - DNA, 516 bp, Artificial Sequence
  Description of Artificial Sequence: Synthetic coding sequence
atgagcaaccccagcgcccccccaccctatgaagatagaaaccccctgtacccaggccccccacctcctgggggctacggccagcccagcgtgctgcccggcggctacccagcctacccaggctacccccagcccggctacggccaccctgctggctacccccagcccatgccacccacccaccccatgcccatgaactacggccctggccacggctatgatggagaggagagagctgtgtctgacagctttggacctggagagtgggatgacaggaaggtgcgccacaccttcatcaggaaggtgtacagcatcatctctgtgcagctgctgatcaccgtggccatcatcgccatcttcacctttgtggagcctgtgtctgcctttgtgagaagaaatgtggccgtgtactacgtgtcctatgctgtgtttgtggtgacctacctgatcctggcctgctgccagggcccccggcggcgcttcccctggaacatcatcctgctgaccctcttctag

SEQ ID NO: 39027 - DNA, 207 bp, Artificial Sequence
  Description of Artificial Sequence: Synthetic coding sequence
atgagcaaccccagcgcccccccaccctatgaagatagaaaccccctgtacccaggccccccacctcctgggggctacggccagcccagcgtgctgcccggcggctacccagcctacccaggctacccccagcccggctacggccaccctgctggctacccccagcccatgccacccacccaccccatgcccatgaactatggatag

SEQ ID NO: 39028 - DNA, 648 bp, Artificial Sequence
  Description of Artificial Sequence: Synthetic coding sequence
atgagcaaccccagcgcccccccaccctatgaagatagaaaccccctgtacccaggccccccacctcctgggggctacggccagcccagcgtgctgcccggcggctacccagcctacccaggctacccccagcccggctacggccaccctgctggctacccccagcccatgccacccacccaccccatgcccatgaactacggccctggccacggctatgatggagaggagagagctgtgtctgacagctttggacctggagagtgggatgacaggaaggtgcgccacaccttcatcaggaagggcacctgccagaggctgtgtgaggagaagtgtggctgcctgctgcgggtgctgtgctgcctgcgctgccacctgcctgacccctgcctgctgcccggcacccagacccccttccccatggagcaccacagcgctgaccccttctacttctgccacggcctgcatgatggccaccacttccagtatgtgcccaaccagagccgccaccactgcaatgaccaccactgcggcggcatccacttcagccaccacctgctgctgagtgaccagggcggcctgcacctggtgcaccggcccctgctgtgccccggcaactgtgcccctggggactgggactgccactag

SEQ ID NO: 39029 - DNA, 324 bp, Artificial Sequence
  Description of Artificial Sequence: Synthetic coding sequence
atgagcaaccccagcgcccccccaccctatgaagatagaaaccccctgtacccaggccccccacctcctgggggctacggccagcccagcgtgctgcccggcggctacccagcctacccaggctacccccagcccggctacggccaccctgctggctacccccagcccatgccacccacccaccccatgcccatgaactacggccctggccacggctatgatggagaggagagagctgtgtctgacagctttggacctggagagtgggatgacaggaaggtgcgccacaccttcatcaggaaggtgtacagcatcatctcctag

SEQ ID NO: 39030 - DNA, 273 bp, Artificial Sequence
  Description of Artificial Sequence: Synthetic coding sequence
atgagcaaccccagcgcccccccaccctatgaagatagaaaccccctgtacccaggccccccacctcctgggggctacggccagcccagcgtgctgcccggcggctacccagcctacccaggctacccccagcccggctacggccaccctgctggctacccccagcccatgccacccacccaccccatgcccatgaactacggccctggccacggctatgatggagaggagagagctgtgtctgacagctttggacctggagagtgggactag

SEQ ID NO: 39031 - DNA, 321 bp, Artificial Sequence
  Description of Artificial Sequence: Synthetic coding sequence
atgagcaaccccagcgcccccccaccctatgaagatagaaaccccctgtacccaggccccccacctcctgggggctacggccagcccagcgtgctgcccggcggctacccagcctacccaggctacccccagcccggctacggccaccctgctggctacccccagcccatgccacccacccaccccatgcccatgaactacggccctggccacggctatgatggagaggagagagctgtgtctgacagctttggacctggagagtgggatgacaggaaggtgcgccacaccttcatcaggaaggtgtacagcatcatctag

SEQ ID NO: 39032 - DNA, 936 bp, Artificial Sequence; identical to SEQ ID NO: 39020
  Description of Artificial Sequence: Synthetic coding sequence

SEQ ID NO: 39033 - DNA, 414 bp, Artificial Sequence
  Description of Artificial Sequence: Synthetic coding sequence
atgggcttcatgacaggcaccatcagctccatgtaccagaccaaggccgtcatcatcgccatgatcatcacagctgtggtgtccatctctgtgaccatcttctgcttccagaccaaggtggacttcaccagctgcaccggcctcttctgtgtgctgggcatcgtgctgctggtgactggaattgtgaccagcatcgtgctgtacttccagtatgtgtactggctgcacatgctgtatgctgccctgggcgccatctgcttcaccctcttcctggcctatgacacccagctggtgctgggcaacaggaagcacaccatcagccctgaggactacatcactggagccctgcagatctacacagacatcatctacatcttcacctttgtgctgcagctgatgggagacaggaactag

SEQ ID NO: 39034 - DNA, 222 bp, Artificial Sequence
  Description of Artificial Sequence: Synthetic coding sequence
atgagcaaccccagcgcccccccaccctatgaagatagaaaccccctgtacccaggccccccacctcctgggggctacggccagcccagcgtgctgcccggcggctacccagcctacccaggctacccccagcccggctacggccaccctgctggctacccccagcccatgccacccacccaccccatgcccatgaactacggccctggccacggctactag

SEQ ID NO: 39035 - DNA, 255 bp, Artificial Sequence
  Description of Artificial Sequence: Synthetic coding sequence
atgagcaaccccagcgcccccccaccctatgaagatagaaaccccctgtacccaggccccccacctcctgggggctacggccagcccagcgtgctgcccggcggctacccagcctacccaggctacccccagcccggctacggccaccctgctggctacccccagcccatgccacccacccaccccatgcccatgaactacggccctggccacggctatgatggagaggagagagctgtgtctgacagcttctag

SEQ ID NO: 39036 - DNA, 279 bp, Artificial Sequence
  Description of Artificial Sequence: Synthetic coding sequence
atgagcaaccccagcgcccccccaccctatgaagatagaaaccccctgtacccaggccccccacctcctgggggctacggccagcccagcgtgctgcccggcggctacccagcctacccaggctacccccagcccggctacggccaccctgctggctacccccagcccatgccacccacccaccccatgcccatgaactacggccctggccacggctatgatggagaggagagagctgtgtctgacagctttggacctggagagtgggatgacagatag

SEQ ID NO: 39037 - DNA, 750 bp, Artificial Sequence
  Description of Artificial Sequence: Synthetic coding sequence
atgcccatgaactacggccctggccacggctatgatggagaggagagagctgtgtctgacagctttggacctggagagtgggatgacaggaaggtgcgccacaccttcatcaggaaggtgtacagcatcatctctgtgcagctgctgatcaccgtggccatcatcgccatcttcacctttgtggagcctgtgtctgcctttgtgagaagaaatgtggccgtgtactacgtgtcctatgctgtgtttgtggtgacctacctgatcctggcctgctgccagggcccccggcggcgcttcccctggaacatcatcctgctgaccctcttcacctttgccatgggcttcatgacaggcaccatcagctccatgtaccagaccaaggccgtcatcatcgccatgatcatcacagctgtggtgtccatctctgtgaccatcttctgcttccagaccaaggtggacttcaccagctgcaccggcctcttctgtgtgctgggcatcgtgctgctggtgactggaattgtgaccagcatcgtgctgtacttccagtatgtgtactggctgcacatgctgtatgctgccctgggcgccatctgcttcaccctcttcctggcctatgacacccagctggtgctgggcaacaggaagcacaccatcagccctgaggactacatcactggagccctgcagatctacacagacatcatctacatcttcacctttgtgctgcagctgatgggagacaggaactag

SEQ ID NO: 39038 - DNA, 717 bp, Artificial Sequence
  Description of Artificial Sequence: Synthetic coding sequence
atggctgaccctgacccccgctaccccaggagcagcattgaagatgacttcaactacggcagctctgtggccagcgccaccgtgcacatccgcatggccttcctgaggaaggtgtacagcatcctgagcctgcaggtgctgctgaccaccgtgaccagcaccgtcttcctgtactttgaatctgtgaggacctttgtgcatgagagccctgccctgatcctgctgtttgccctgggcagcctgggcctcatctttgccctgatcctgaacagacacaagtaccccctgaacctgtacctgctgtttggcttcaccctgctggaggccctgactgtggccgtggtggtgaccttctatgatgtgtacatcatcctgcaggccttcatcctgaccaccaccgtcttcttcggcctgactgtgtacaccctgcagagcaagaaggacttcagcaagtttggagctggcctgtttgccctgctgtggatcctgtgcctgagcggcttcctgaagttcttcttctacagcgagatcatggagctggtgctggccgctgctggggccctgctcttctgtggcttcatcatctatgacacccacagcctgatgcacaagctgagccctgaggagtatgtgctggccgccatcagcctgtacctggacatcatcaacctcttcctgcacctgctgcgcttcctggaggccgtgaacaagaagtag

SEQ ID NO: 39039 - DNA, 636 bp, Artificial Sequence
  Description of Artificial Sequence: Synthetic coding sequence
atggctgaccctgacccccgctaccccaggagcagcattgaagatgacttcaactacggcagctctgtggccagcgccaccgtgcacatccgcatggccttcctgaggaaggtgtacagcatcctgagcctgcaggtgctgctgaccaccgtgaccagcaccgtcttcctgtactttgaatctgtgaggacctttgtgcatgagagccctgccctgatcctgctgtttgccctgggcagcctgggcctcatctttgccctgatcctgaacagacacaagtaccccctgaacctgtacctgctgtttggcttcaccctgctggaggccctgactgtggccgtggtggtgaccttctatgatgtgtacatcatcctgcaggccttcatcctgaccaccaccgtcttcttcggcctgactgtgtacaccctgcagagcaagaaggacttcagcaagtttggagctggccagagcgccctgctggtggacatcgtgcctgtgcgcatcctggaggtgttcttctacagcgagatcatggagctggtgctggccgctgctggggccctgctcttctgtggcttcatcatctatgacacccacagcctgatgcacaagctgagccccaagagcacctactag

SEQ ID NO: 39040 - DNA, 852 bp, Artificial Sequence
  Description of Artificial Sequence: Synthetic coding sequence
atggctgacaggcctcctgtgcccagcctgagcattgaagatgacttcaactacggcagctctgtggccagcgccaccgtgcacatccgcatggtgctgcagagggactgcaccttcagcaagcagtacatgaggatccccagcgcccccagcgccaccctgaacatcatccgcttcttccacctgcggcagagcggccgcagcggcatggtgaacatcttctacaagggccccaccttcctgaggaaggtgtacagcatcctgagcctgcaggtgctgctgaccaccgtgaccagcaccgtcttcctgtactttgaatctgtgaggacctttgtgcatgagagccctgccctgatcctgctgtttgccctgggcagcctgggcctcatctttgccctgatcctgaacagacacaagtaccccctgaacctgtacctgctgtttggcttcaccctgctggaggccctgactgtggccgtggtggtgaccttctatgatgtgtacatcatcctgcaggccttcatcctgaccaccaccgtcttcttcggcctgactgtgtacaccctgcagagcaagaaggacttcagcaagtttggagctggcctgtttgccctgctgtggatcctgtgcctgagcggcctggaggtgttcttctacagcgagatcatggagctggtgctggccgccgccggggccctgctcttctgtggcttcatcatctatgacacccacagcctgatgcacaagctgagccctgaggagtatgtgctggccgccatcagcctgtacctggacatcatcaacctcttcctgcacctgctgcgcttcctggaggccgtgaacaagaagtag

SEQ ID NO: 39041 - DNA, 507 bp, Artificial Sequence
  Description of Artificial Sequence: Synthetic coding sequence
atggctgaccctgacccccgctaccccaggagcagcattgaagatgacttcaactacggcagctctgtggccagcgccaccgtgcacatccgcatggccttcctgaggaaggtgtacagcatcctgagcctgcaggtgctgctgaccaccgtgaccagcaccgtcttcctgtactttgaatctgtgaggacctttgtgcatgagagccctgccctgatcctgctgtttgccctgggcagcctgggcctcatctttgccctgatcctgaacagacacaagtaccccctgaacctgtacctgctgtttggcttcaccctgctggaggccctgactgtggccgtggtggtgaccttctatgatgtgtacatcatcctgcaggccttcatcctgaccaccaccgtcttcttcggcctgactgtgtacaccctgcagagcaagaaggacttcagcaagtttggagctggccgctgccgcagccccagcttcctgtggatccaccacctgtag

SEQ ID NO: 39042 - DNA, 714 bp, Artificial Sequence
  Description of Artificial Sequence: Synthetic coding sequence
atgaacatctttgacaggaagatcaactttgatgccctgctgaagttcagccacatcacccccagcacccagcagcacctgaagaaggtgtatgccagctttgccctgtgcatgtttgtggccgctgctggggcctacgtgcacatggtgacccacttcatccaggccggcctgctgagcgccctgggcagcctcatcctgatgatctggctgatggccaccccccacagccatgaaacagagcagaagaggctgggcctgctggccggctttgccttcctgactggagtgggcctgggccctgccctggagttctgcatcgctgtgaaccccagcatcctgcccacagccttcatgggcacagccatgatcttcacctgcttcaccctgagcgccctgtatgccaggagaagaagctacctgttcctgggcggcatcctgatgtctgccctgagcctgctgctgctgagcagcctgggcaatgtgttcttcggcagcatctggctgttccaggccaacctgtatgtgggcctggtggtgatgtgtggctttgtgctgtttgacacccagctgatcatcgagaaggccgagcacggggaccaggactacatctggcactgcatcgacctcttcctggacttcatcaccgtcttcaggaagctgatgatgatcctggccatgaatgagaaggacaagaagaaggagaagaagtag

SEQ ID NO: 39043 - DNA, 714 bp, Artificial Sequence; identical to SEQ ID NO: 39042
  Description of Artificial Sequence: Synthetic coding sequence

SEQ ID NO: 39044 - DNA, 888 bp, Artificial Sequence
  Description of Artificial Sequence: Synthetic coding sequence
atgagccacagctctgtgacccgggaggccccccagctgctgagccagaggcagaggcgggaggtgcggggcgtgtggggctggggctgcctgcccggcccccggggcggccctgccctgtttggcctggtgaccttcggccagagcggggactgctgcacagacagcggcaccatgaacatctttgacaggaagatcaactttgatgccctgctgaagttcagccacatcacccccagcacccagcagcacctgaagaaggtgtatgccagctttgccctgtgcatgtttgtggccgctgctggggcctacgtgcacatggtgacccacttcatccaggccggcctgctgagcgccctgggcagcctcatcctgatgatctggctgatggccaccccccacagccatgaaacagagcagaagaggctgggcctgctggccggctttgccttcctgactggagtgggcctgggccctgccctggagttctgcatcgctgtgaaccccagcatcctgcccacagccttcatgggcacagccatgatcttcacctgcttcaccctgagcgccctgtatgccaggagaagaagctacctgttcctgggcggcatcctgatgtctgccctgagcctgctgctgctgagcagcctgggcaatgtgttcttcggcagcatctggctgttccaggccaacctgtatgtgggcctggtggtgatgtgtggctttgtgctgtttgacacccagctgatcatcgagaaggccgagcacggggaccaggactacatctggcactgcatcgacctcttcctggacttcatcaccgtcttcaggaagctgatgatgatcctggccatgaatgagaaggacaagaagaaggagaagaagtag

SEQ ID NO: 39045 - DNA, 381 bp, Artificial Sequence
  Description of Artificial Sequence: Synthetic coding sequence
atgaacatctttgacaggaagatcaactttgatgccctgctgaagttcagccacatcacccccagcacccagcagcacctgaagaaggtgtatgccagctttgccctgtgcatgtttgtggccgctgctggggcctacgtgcacatggtgacccacttcatccaggccggcctgctgagcgccctgggcagcctcatcctgatgatctggctgatggccaccccccacagccatgaaacagagcagaagaggctgggcctgctggccggctttgccttcctgactggagtgggcctgggccctgccctggagttctgcatcgctgtgaaccccagcatcctgcccacagccttcatgggcacagccctgatcagcagctag

SEQ ID NO: 39046 - DNA, 714 bp, Artificial Sequence; identical to SEQ ID NO: 39042
  Description of Artificial Sequence: Synthetic coding sequence

SEQ ID NO: 39047 - DNA, 438 bp, Artificial Sequence
  Description of Artificial Sequence: Synthetic coding sequence
atgaacatctttgacaggaagatcaactttgatgccctgctgaagttcagccacatcacccccagcacccagcagcacctgaagaaggtgtatgccagctttgccctgtgcatgtttgtggccgctgctggggcctacgtgcacatggtgacccacttcatccaggccggcctgctgagcgccctgggcagcctcatcctgatgatctggctgatggccaccccccacagccatgaaacagagcagaagaggctgggcctgctggccggctttgccttcctgactggagtgggcctgggccctgccctggagttctgcatcgctgtgaaccccagcatcctgcccacagccttcatgggcacagccatgatcttcacctgcttcaccctgagcgccctgtatgccaggagaagaagctacctgttcctgggcggctag

SEQ ID NO: 39048 - DNA, 291 bp, Artificial Sequence
  Description of Artificial Sequence: Synthetic coding sequence
atgaacatctttgacaggaagatcaactttgatgccctgctgaagttcagccacatcacccccagcacccagcagcacctgaagaaggtgtatgccagctttgccctgtgcatgtttgtggccgctgctggggcctacgtgcacatggtgacccacttcatccaggccggcctgctgagcgccctgggcagcctcatcctgatgatctggctgatggccaccccccacagccatgaaacagagcagaagaggctgggcctgctggccggctttgccttcctgactggatag

SEQ ID NO: 39049 - DNA, 291 bp, Artificial Sequence; identical to SEQ ID NO: 39048
  Description of Artificial Sequence: Synthetic coding sequence

SEQ ID NO: 39050 - DNA, 417 bp, Artificial Sequence
  Description of Artificial Sequence: Synthetic coding sequence
atgaacatctttgacaggaagatcaactttgatgccctgctgaagttcagccacatcacccccagcacccagcagcacctgaagaaggtgtatgccagctttgccctgtgcatgtttgtggccgctgctggggcctacgtgcacatggtgacccacttcatccaggccggcctgctgagcgccctgggcagcctcatcctgatgatctggctgatggccaccccccacagccatgaaacagagcagaagaggctgggcctgctggccggctttgccttcctgactggagtgggcctgggccctgccctggagttctgcatcgctgtgaaccccagcatcctgcccacagccttcatgggcacagccatgatcttcacctgcttcaccctgagcgccctgtatgccaggagaagatag

SEQ ID NO: 39051 - DNA, 393 bp, Artificial Sequence
  Description of Artificial Sequence: Synthetic coding sequence
atgaacatctttgacaggaagatcaactttgatgccctgctgaagttcagccacatcacccccagcacccagcagcacctgaagaaggtgtatgccagctttgccctgtgcatgtttgtggccgctgctggggcctacgtgcacatggtgacccacttcatccaggccggcctgctgagcgccctgggcagcctcatcctgatgatctggctgatggccaccccccacagccatgaaacagagcagaagaggctgggcctgctggccggctttgccttcctgactggagtgggcctgggccctgccctggagttctgcatcgctgtgaaccccagcatcctgcccacagccttcatgggcacagccatgatcttcacctgcttcaccctgtag

SEQ ID NO: 39052 - DNA, 33 bp, Artificial Sequence
  Description of Artificial Sequence: Synthetic coding sequence
atgaacatctttgacaggaagatcaacttctag

SEQ ID NO: 39053 - DNA, 36 bp, Artificial Sequence
  Description of Artificial Sequence: Synthetic coding sequence
atgaacatctttgacaggaagatcaactttgattag

SEQ ID NO: 39054 - DNA, 51 bp, Artificial Sequence
  Description of Artificial Sequence: Synthetic coding sequence
atgaacatctttgacaggaagatcaactttgatgccctgctgaagttctag

SEQ ID NO: 39055 - DNA, 270 bp, Artificial Sequence
  Description of Artificial Sequence: Synthetic coding sequence
atgaacatctttgacaggaagatcaactttgatgccctgctgaagttcagccacatcacccccagcacccagcagcacctgaagaaggtgtatgccagctttgccctgtgcatgtttgtggccgctgctggggcctacgtgcacatggtgacccacttcatccaggccggcctgctgagcgccctgggcagcctcatcctgatgatctggctgatggccaccccccacagccatgaaacagagcagaagaggctgggcctgctggcctag

SEQ ID NO: 39056 - DNA, 714 bp, Artificial Sequence; identical to SEQ ID NO: 39042
  Description of Artificial Sequence: Synthetic coding sequence

SEQ ID NO: 39057 - DNA, 291 bp, Artificial Sequence; identical to SEQ ID NO: 39048
  Description of Artificial Sequence: Synthetic coding sequence

SEQ ID NO: 39058 - DNA, 327 bp, Artificial Sequence
  Description of Artificial Sequence: Synthetic coding sequence
atgaacatctttgacaggaagatcaactttgatgccctgctgaagttcagccacatcacccccagcacccagcagcacctgaagaaggtgtatgccagctttgccctgtgcatgtttgtggccgctgctggggcctacgtgcacatggtgacccacttcatccaggccggcctgctgagcgccctgggcagcctcatcctgatgatctggctgatggccaccccccacagccatgaaacagagcagaagaggctgggcctgctggccggctttgccttcctgactggagtgggcctgggccctgccctggagttctgcatcgcctag

SEQ ID NO: 39059 - DNA, 438 bp, Artificial Sequence; identical to SEQ ID NO: 39047
  Description of Artificial Sequence: Synthetic coding sequence

SEQ ID NO: 39060 - DNA, 135 bp, Artificial Sequence
  Description of Artificial Sequence: Synthetic coding sequence
atgaacatctttgacaggaagatcaactttgatgccctgctgaagttcagccacatcacccccagcacccagcagcacctgaagaaggtgtatgccagctttgccctgtgcatgtttgtggccgctgctggatag

SEQ ID NO: 39061 - DNA, 126 bp, Artificial Sequence
  Description of Artificial Sequence: Synthetic coding sequence
atgaacatctttgacaggaagatcaactttgatgccctgctgaagttcagccacatcacccccagcacccagcagcacctgaagaaggtgtatgccagctttgccctgtgcatgtttgtggcctag

SEQ ID NO: 39062 - DNA, 618 bp, Artificial Sequence
  Description of Artificial Sequence: Synthetic coding sequence
atgaacatctttgacaggaagatcaactttgatgccctgctgaagttcagccacatcacccccagcacccagcagcacctgaagaaggtgtatgccagctttgccctgtgcatgtttgtggccgctgctggggcctacgtgcacatggtgacccacttcatccaggccggcctgctgagcgccctgggcagcctcatcctgatgatctggctgatggccaccccccacagccatgaaacagagcagaagaggctgggcctgctggccggctttgccttcctgactggagtgggcctgggccctgccctggagttctgcatcgctgtgaaccccagcatcctgcccacagccttcatgggcacagccatgatcttcacctgcttcaccctgagcgccctgtatgccaggagaagaagctacctgttcctgggcggcatcctgatgtctgccctgagcctgctgctgctgagcagcctgggcaatgtgttcttcggcagcatctggctgttccaggccaacctgtatgtgggcctggtggtgatgtgtggctttgtgctgtttgacacccagctgatcatcgagaaggccgagcacggggaccaggactacatctggtag

SEQ ID NO: 39063 - DNA, 888 bp, Artificial Sequence; identical to SEQ ID NO: 39044
  Description of Artificial Sequence: Synthetic coding sequence

SEQ ID NO: 39064 - DNA, 3303 bp, Artificial Sequence
  Description of Artificial Sequence: Synthetic coding sequence
atgaagaccagcaaggccagccagcgctaccggggcatcagaagaaatgccagccagtgctacctgtaccaggagagcctgctgctgagcaacctggatgacagcttcagcgcagatgaaacaggagacagcaatgaccctgagcagatcttccagaacatccagttccagaaggacctgatggccaacatccgctgccggccctggaccatgggccagaagctgcgggccctgcggcaggccaagaacatcgtgctgaagtttgagggccgcctgaccaggacccggggctaccaggccgccggggctgagctgtggaggaagtttgcccggctggcctgcaactttgtggtgatcttcatcccctgggagatgaggatcaagaagattgagagccacttcggcagcggcgtggccagctacttcatcttcctgcgctggctgtttggcatcaacatcgtgctgaccatcatgactggagccttcatcgtcatccctgagctgattgctggccagcccttcggcagcacagccaggaagaccatccccaaggagcaggtgtcctctgcccaggacctggacacagtgtggagcctgggcggctacctgcagtacagcgtgctcttctacggctactacggccgggagaggaagattggccgggccggctaccgcctgcccctggcctacttcctggtgggcatggctgtgtttgcctacagcttcatcatcctgctgaagaagatggccaagaacagcaggaccagcctggccagcgccagcaatgaaaactacaccttctgctggagggtcttctgtgcctgggactacctgattggcaaccctgaggccgctgagagcaagacagctgccatcgtgaacagcatccgggaggccatcctggaggagcaggagaagaagaagagcaagaacctggccgtgaccatctgcctgcgcatcatcgccaacatcctggtgctgctgagcctggccggcagcatctacctgatctactttgtggtggacaggagccagaagctggagcagagcaagaaggagctgaccctgtgggagaagaatgaggtgtctgtggtggtgtccctggtgaccatgattgcccccagcgcctttgacctgattgctgccctggagatgtaccaccccaggaccaccctgcgcttccagctggcccgggtgctggtgctgtacctgggcaacctgtacagcctcatcatcgccctgctggacaaggtgaacagcatgagcattgaggagatggccaccaagaacaacaccagccactggattgacagcaccaccttctttgccaccaggacagcccctgaggaggagaagtggagcaccagccggcccggcatgggcctgcggaggaacaacacctgggccctggaggagaccagcatcagcgcctacaccatgcccctcatcaaggccaacaagaccagcctgcacacccagagcccccaggaccagtgctgggagacctacgtgggccaggagatgctgaagctgagcatcatcgacatgctgttcaccgtggccagcatcctgctgattgacttcttccggggcctgtttgtgcgctacctgagtgactactggtgctgggacctggagagcaagtttcctgaatatggagagttcaagattgctgaaaatgtgctgcacctggtgtacaaccagggcatgatctggatgggcgccttcttcagcccctgcctgcctgccttcaacgtgctgaagctgattggcctgatgtacctgcgctcctgggccgtgctgacctgcaatgtgccccaccagcaggtgttccgggccagccgcagcaacaacttctacctggccatgctgctcttcatgctgttcctgtgcatgctgcccaccatctttgccatcgtgcgctacaagcccagcctgaactgtggccccttcagcggccaggagaagatctatgacatcgtgtctgagaccatcgagaaggacttccctgtgtggtttggatctgtggtgggccacatcagcagccctgtggtgatcctgcctgctgtgctgctgctcttcatgctgatctactacctgcagagcatcgcccggagcctgaagctgagcaaccaccagctgaagatgcagatccagaatgcccggtctgaggacaagaagaaggtggcccagatggtggaggcccgcatccagacccaggaggagagcaccaagaagctgcccaatgacagcgacctgaccagccagctgagcagcgcccacagcggcaccccccagaacaatggaaatgtggcccactttgacagcggcagcagcaagagcggccgcatcgagaccgtggcccagagcatgccccagagccccaggcctggggaccgggcccccagcagccccctgcccggggtgcccaagagccggctggagcacgagaccaaccgctacctgcacggcctgtgtgccagcaccagtgacctgcacaggaacagaagcaggacccccatgaccttcaccacccacattgaagatgtgcacagcgagcccctcttcaggaaggacttccagcagatcaaccccccccaccggggcccccaggccagcaccctgctggcccagggcccccggccccacgccccccgctactacgtgatcaatgaatgtgacagctacaagaagaagcacctgaatgtgtggccagagcggcacttcaagattgatgccagcggggacatcgtggagctgtaccccagaaatgtgcggcagtatgccagccgggtgccccggcagccccccagcccccagctgtctgaggaggaggaggagacccccagccgggactggatcaagaggagcctgcccccaagaagcctgattgacctgcggcgggccccccacttctacatcggggagaggtctgagagccagacccgggaccctgagcaccagggccgggtgcactacaagtcctggaatgaagattttgagggccacctggagaggcctgcctacgtgcccaggaagcccaggagcaggaacttccagtacccccagccccccctgaagccccggggcaagcccaggtttgagcccagcctgacagaaagtgacagcgtgtctgctgccagcagcagtgaccagcagaacagcagcgctgaccagtacctgcaggtgacccacagccagggccgcttccccaggtctgtgggccagcccagcaggaggaaggccaagagcggccaggagctgactgtggacctggatgacctgatctgcagtgatgtgtag

SEQ ID NO: 39065 - DNA, 3306 bp, Artificial Sequence
  Description of Artificial Sequence: Synthetic coding sequence
atgaagaccagcaaggccagccagcgctaccggggcatcagaagaaatgccagccagtgctacctgtaccaggagagcctgctgctgagcaacctggatgacagcttcagcgcagatgaaacaggagacagcaatgaccctgagcagatcttccagaacatccagttccagaaggacctgatggccaacatccgctgccggccctggaccatgggccagaagctgcgggccctgcggcaggccaagaacatcgtgctgaagtttgagggccgcctgaccaggacccggggctaccaggccgccggggctgagctgtggaggaagtttgcccggctggcctgcaactttgtggtgatcttcatcccctgggagatgaggatcaagaagattgagagccacttcggcagcggcgtggccagctacttcatcttcctgcgctggctgtttggcatcaacatcgtgctgaccatcatgactggagccttcatcgtcatccctgagctgattgctggccagcccttcggcagcacagccaggaagaccatccccaaggagcaggtgtcctctgcccaggacctggacacagtgtggagcctgggcggctacctgcagtacagcgtgctcttctacggctactacggccgggagaggaagattggccgggccggctaccgcctgcccctggcctacttcctggtgggcatggctgtgtttgcctacagcttcatcatcctgctgaagaagatggccaagaacagcaggaccagcctggccagcgccagcaatgaaaactacaccttctgctggagggtcttctgtgcctgggactacctgattggcaaccctgaggccgctgagagcaagacagctgccatcgtgaacagcatccgggaggccatcctggaggagcaggagaagaagaagagcaagaacctggccgtgaccatctgcctgcgcatcatcgccaacatcctggtgctgctgagcctggccggcagcatctacctgatctactttgtggtggacaggagccagaagctggagcagagcaagaaggagctgaccctgtgggagaagaatgagcaggtgtctgtggtggtgtccctggtgaccatgattgcccccagcgcctttgacctgattgctgccctggagatgtaccaccccaggaccaccctgcgcttccagctggcccgggtgctggtgctgtacctgggcaacctgtacagcctcatcatcgccctgctggacaaggtgaacagcatgagcattgaggagatggccaccaagaacaacaccagccactggattgacagcaccaccttctttgccaccaggacagcccctgaggaggagaagtggagcaccagcaggcctggcatgggcctgcggaggaacaacacctgggccctggaggagaccagcatcagcgcctacaccatgcccctcatcaaggccaacaagaccagcctgcacacccagagcccccaggaccagtgctgggagacctacgtgggccaggagatgctgaagctgagcatcatcgacatgctgttcaccgtggccagcatcctgctgattgacttcttccggggcctgtttgtgcgctacctgagtgactactggtgctgggacctggagagcaagtttcctgaatatggagagttcaagattgctgaaaatgtgctgcacctggtgtacaaccagggcatgatctggatgggcgccttcttcagcccctgcctgcctgccttcaacgtgctgaagctgattggcctgatgtacctgcgctcctgggccgtgctgacctgcaatgtgccccaccagcaggtgttccgggccagccgcagcaacaacttctacctggccatgctgctcttcatgctgttcctgtgcatgctgcccaccatctttgccatcgtgcgctacaagcccagcctgaactgtggccccttcagcggccaggagaagatctatgacatcgtgtctgagaccatcgagaaggacttccctgtgtggtttggatctgtggtgggccacatcagcagccctgtggtgatcctgcctgctgtgctgctgctcttcatgctgatctactacctgcagagcatcgcccggagcctgaagctgagcaaccaccagctgaagatgcagatccagaatgcccggtctgaggacaagaagaaggtggcccagatggtggaggcccgcatccagacccaggaggagagcaccaagaagctgcccaatgacagcgacctgaccagccagctgagcagcgcccacagcggcaccccccagaacaatggaaatgtggcccactttgattctggcagcagcaagagcggcagaattgaaacagtggcccagagcatgccccagagccccaggcctggggaccgggcccccagcagccccctgcccggggtgcccaagagccggctggagcacgagaccaaccgctacctgcacggcctgtgtgccagcaccagtgacctgcacaggaacagaagcaggacccccatgaccttcaccacccacattgaagatgtgcacagcgagcccctcttcaggaaggacttccagcagatcaaccccccccaccggggcccccaggccagcaccctgctggcccagggcccccggccccacgccccccgctactacgtgatcaatgaatgtgacagctacaagaagaagcacctgaatgtgtggccagagcggcacttcaagattgatgccagcggggacatcgtggagctgtaccccagaaatgtgcggcagtatgccagccgggtgccccggcagccccccagcccccagctgtctgaggaggaggaggagacccccagccgggactggatcaagaggagcctgccccccaggagcctgattgacctgcggcgggccccccacttctacatcggggagaggtctgagagccagacccgggaccctgagcaccagggccgggtgcactacaagtcctggaatgaagattttgagggccacctggagaggcctgcctacgtgcccaggaagcccaggagcaggaacttccagtacccccagccccccctgaagccccggggcaagcccaggtttgagcccagcctgacagaaagtgacagcgtgtctgctgccagcagcagtgaccagcagaacagcagcgctgaccagtacctgcaggtgacccacagccagggccgcttccccaggtctgtgggccagcccagcaggaggaaggccaagagcggccaggagctgactgtggacctggatgacctgatctgcagtgatgtgtag

SEQ ID NO: 39066 - DNA, 2121 bp, Artificial Sequence
  Description of Artificial Sequence: Synthetic coding sequence
atggaggagaaccccaccctggagagcgaggcctggggcagcagccggggctggctggccccccgggaggcccggggcggccccagcctgagctctgtgctgaatgagctgcccagcgctgccaccctgcgctacagagaccccggggtgctgccctggggcgccctggaggaggaggaggaggatggcggccgcagcaggaaggccttcacagaggtgacccagacagagctgcaggacccccaccccagccgggagctgccctggcccatgcaggcccggcgggcccaccggcagagaaatgccagccgggaccaggtggtgtatggcagcggcaccaagacagaccgctgggcccggctgctgcggcgcagcaaggagaagaccaaggagggcctgcggagcctgcagccctgggcctggaccctgaagagaattggaggccagtttggagctggaacagagagctacttcagcctgctgcgcttcctgctgctgctgaatgtgctggcctctgtgctgatggcctgcatgaccctgctgcccacctggctgggcggggcccctcctggccccccaggccctgacatcagcagcccctgtggcagctacaacccccacagccagggcctggtgacctttgccacccagctgttcaacctgctgtctggagagggctacctggagtggagccccctcttctacggcttctacccaccccggccccggctggccgtgacctacctgtgctgggcctttgctgtgggcctcatctgcctgctgctgatcctgcacaggtctgtgtctggcctgaagcagaccctgctggccgagagcgaggccctgaccagctacagccacagggtcttcagcgcctgggactttggcctgtgtggagatgtgcacgtgcggctgcggcagaggatcatcctgtatgagctgaaggtggagctggaggagaccgtggtgcggcggcaggccgctgtgaggaccctgggccagcaggcccgggtgtggctggtgcgggtgctgctgaacctgctggtggtggccctgctgggcgccgccttctacggcgtgtactgggccaccggctgcaccgtggagctgcaggagatgcccctggtgcaggagctgcccctgctgaagctgggcgtgaactacctgcccagcatcttcatcgccggcgtgaactttgtgctgccccctgtgttcaagctgattgcccccctggagggctacaccaggagccggcagatcgtgttcatcctgctgaggacagtgttcctgcggctggccagcctggtggtgctgctcttcagcctgtggaaccagatcacctgtggcggggacagcgaggccgaggactgcaagacctgtggctacaactacaagcagctgccctgctgggagaccgtgctgggccaggagatgtacaagctgctgctgtttgacctgctgactgtgctggccgtggccctgctgatccagttccccaggaagctgctgtgtggcctgtgccctggggccctgggccgcctggccggcacccaggagttccaggtgcctgatgaggtgctgggcctcatctatgcccagacagtggtgtgggtgggcagcttcttctgccccctgctgcccctgctgaacacagtgaagttcctgctgctcttctacctgaagaagctgaccctcttcagcacctgcagccctgctgcccggaccttccgggccagcgctgccaacttcttcttccccctggtgctgctgctgggcctggccatcagctctgtgcccctgctgtacagcatcttcctgatcccccccagcaagctgtgtggccccttccggggccagagcagcatctgggcccagatccctgagagcatcagcagcctgcctgagaccacccagaacttcctgttcttcctgggcacccaggcctttgctgtgcccctgctgctgatcagcagcatcctgatggcctacacagtggccctggccaacagctatggccgcctcatcagcgagctgaagaggcagaggcagacagaggcccagaacaaggtgttcctggcccggcgggctgtggccctgaccagcaccaagccagccctgtag

SEQ ID NO: 39067 - DNA, 2139 bp, Artificial Sequence
  Description of Artificial Sequence: Synthetic coding sequence
atggaggagaaccccaccctggagagcgaggcctggggcagcagccggggctggctggccccccgggaggcccggggggccccctgcagcagccctggccccagcctgagctctgtgctgaatgagctgcccagcgctgccaccctgcgctacagagaccccggggtgctgccctggggcgccctggaggaggaggaggaggatggcggccgcagcaggaaggccttcacagaggtgacccagacagagctgcaggacccccaccccagccgggagctgccctggcccatgcaggcccggcgggcccaccggcagagaaatgccagccgggaccaggtggtgtatggcagcggcaccaagacagaccgctgggcccggctgctgcggcgcagcaaggagaagaccaaggagggcctgcggagcctgcagccctgggcctggaccctgaagagaattggaggccagtttggagctggaacagagagctacttcagcctgctgcgcttcctgctgctgctgaatgtgctggcctctgtgctgatggcctgcatgaccctgctgcccacctggctgggcggggcccctcctggccccccaggccctgacatcagcagcccctgtggcagctacaacccccacagccagggcctggtgacctttgccacccagctgttcaacctgctgtctggagagggctacctggagtggagccccctcttctacggcttctacccaccccggccccggctggccgtgacctacctgtgctgggcctttgctgtgggcctcatctgcctgctgctgatcctgcacaggtctgtgtctggcctgaagcagaccctgctggccgagagcgaggccctgaccagctacagccacagggtcttcagcgcctgggactttggcctgtgtggagatgtgcacgtgcggctgcggcagaggatcatcctgtatgagctgaaggtggagctggaggagaccgtggtgcggcggcaggccgctgtgaggaccctgggccagcaggcccgggtgtggctggtgcgggtgctgctgaacctgctggtggtggccctgctgggcgccgccttctacggcgtgtactgggccaccggctgcaccgtggagctgcaggagatgcccctggtgcaggagctgcccctgctgaagctgggcgtgaactacctgcccagcatcttcatcgccggcgtgaactttgtgctgccccctgtgttcaagctgattgcccccctggagggctacaccaggagccggcagatcgtgttcatcctgctgaggacagtgttcctgcggctggccagcctggtggtgctgctcttcagcctgtggaaccagatcacctgtggcggggacagcgaggccgaggactgcaagacctgtggctacaactacaagcagctgccctgctgggagaccgtgctgggccaggagatgtacaagctgctgctgtttgacctgctgactgtgctggccgtggccctgctgatccagttccccaggaagctgctgtgtggcctgtgccctggggccctgggccgcctggccggcacccaggagttccaggtgcctgatgaggtgctgggcctcatctatgcccagacagtggtgtgggtgggcagcttcttctgccccctgctgcccctgctgaacacagtgaagttcctgctgctcttctacctgaagaagctgaccctcttcagcacctgcagccctgctgcccggaccttccgggccagcgctgccaacttcttcttccccctggtgctgctgctgggcctggccatcagctctgtgcccctgctgtacagcatcttcctgatcccccccagcaagctgtgtggccccttccggggccagagcagcatctgggcccagatccctgagagcatcagcagcctgcctgagaccacccagaacttcctgttcttcctgggcacccaggcctttgctgtgcccctgctgctgatcagcagcatcctgatggcctacacagtggccctggccaacagctatggccgcctcatcagcgagctgaagaggcagaggcagacagaggcccagaacaaggtgttcctggcccggcgggctgtggccctgaccagcaccaagccagccctgtag

SEQ ID NO: 39068 - DNA, 885 bp, Artificial Sequence
  Description of Artificial Sequence: Synthetic coding sequence
atgaagggcggcggcggccagagagatgtgggcgctgacagaacagtgttcctgcggctggccagcctggtggtgctgctcttcagcctgtggaaccagatcacctgtggcggggacagcgaggccgaggactgcaagacctgtggctacaactacaagcagctgccctgctgggagaccgtgctgggccaggagatgtacaagctgctgctgtttgacctgctgactgtgctggccgtggccctgctgatccagttccccaggaagctgctgtgtggcctgtgccctggggccctgggccgcctggccggcacccaggagttccaggtgcctgatgaggtgctgggcctcatctatgcccagacagtggtgtgggtgggcagcttcttctgccccctgctgcccctgctgaacacagtgaagttcctgctgctcttctacctgaagaagctgaccctcttcagcacctgcagccctgctgcccggaccttccgggccagcgctgccaacttcttcttccccctggtgctgctgctgggcctggccatcagctctgtgcccctgctgtacagcatcttcctgatcccccccagcaagctgtgtggccccttccggggccagagcagcatctgggcccagatccctgagagcatcagcagcctgcctgagaccacccagaacttcctgttcttcctgggcacccaggcctttgctgtgcccctgctgctgatcagcagcatcctgatggcctacacagtggccctggccaacagctatggccgcctcatcagcgagctgaagaggcagaggcagacagaggcccagaacaaggtgttcctggcccggcgggctgtggccctgaccagcaccaagccagccctgtag

SEQ ID NO: 39069 - DNA, 1377 bp, Artificial Sequence
  Description of Artificial Sequence: Synthetic coding sequence
atggccgcccagggcgctgctgctgctgtggccgccggcaccagcggcgtggccggggagggggagcccggccctggagaaaatgctgctgctgagggcacagcccccagccctggccgggtgtccccacccaccccagcccggggggagcctgaggtgacagtggagattggagagacctacctgtgccggcggccagacagcacctggcacagcgctgaggtgatccagagccgggtgaatgaccaggagggccgggaggagttctacgtgcactacgtgggcttcaacagaaggctggatgagtgggtggacaagaaccggctggccctgaccaagacagtgaaggatgctgtgcagaagaacagcgagaagtacctgtctgagctggccgagcagcctgagaggaagatcaccaggaaccagaagaggaagcatgatgagatcaaccacgtgcagaagacctatgcagagatggaccccaccacagctgccctggagaaggagcacgaggccatcaccaaggtgaagtatgtggacaagatccacatcggcaactatgaaattgatgcctggtacttcagccccttcccagaagattatggcaagcagcccaagctgtggctgtgtgagtactgcctgaagtacatgaagtatgagaagagctaccgcttccacctgggccagtgccagtggaggcagcccccaggcaaggagatctacaggaagagcaacatctctgtgtatgaggtggatggcaaggaccacaagatctactgccagaacctgtgcctgctggccaagctgttcctggaccacaagaccctgtactttgatgtggagccctttgtgttctacatcctgacagaggtggaccggcagggcgcccacatcgtgggctacttcagcaaggagaaggagagcccagatggcaacaacgtggcctgcatcctgaccctgcccccctaccagaggcggggctacggcaagttcctgattgccttctcctatgagctgagcaagctggagagcacagtgggcagccctgagaagcccctgagtgacctgggcaagctgagctaccgcagctactggagctgggtgctgctggagatcctgcgggacttccggggcaccctgagcatcaaggacctgagccagatgaccagcatcacccagaatgacatcatcagcaccctgcagagcctgaacatggtgaagtactggaagggccagcacgtgatctgtgtgacccccaagctggtggaggagcacctgaagagcgcccagtacaagaagccacccatcaccgtggacagcgtgtgcctgaagtgggccccacccaagcacaagcaggtgaagctgagcaagaagtag

SEQ ID NO: 39070 - DNA, 2847 bp, Artificial Sequence
  Description of Artificial Sequence: Synthetic coding sequence
atgtctgcctactacagaaacaactggagcgaggaggaccctgactacccagactacagcggcagccagaacagaacccagggctacctgaagacccagggctacccagatgtgcccggccccctgaacaacccagactacccaggcaccaggagcaacccctacagcgtggccagcaggaccaggccagactacccaggcagcctggccgagcccaactaccccaggagcctgagcaacccagactacagcggcaccaggagcaatgcctacagcgctgccagcaggaccagcccagaccaccccaccagcctgcctgagccagactacagcgagttccagagccacccctaccaccgggccagcagccggcagcctgactacccaggcagccagagaaatccagactttgctggcagcagcagcagcggcaactatgccggcagcaggacccacccagaccacttcggcagcctggagccagactacccaggggcccagagcaacagcgaccaccctggcccccgggccaacctgaaccaccctggcagcaggaagaacctggagcacaccagcttccgcatcaacccctatgctgacagcctgggcaagccagactacccaggagctgacatccagcccaacagcccccccttcttcggggagccagactaccccagcgctgaggacaaccagaacctgcccagcacctggagggagccagactacagtgatgctgaaaatggacatgactatggcagcagcgagacccccaagatgacccggggcgtgctgagcaggaccagcagcatccagcccagcttccgccacagaagtgatgatcctgtgggcagcctgtggggagaaaatgactacccagagggcatcgagatggcctccatggagatggccaacagctatggccacagcctgcccggggcccctggcagcggctacgtgaacccagcctacgtgggggagagcggccctgtgcacgcctacggcaacccccccctgtctgaatgtgactggcacaagagcccccagggccagaagctgattgccagcctcatccccatgaccagccgggaccgcatcaaggccatccggaaccagcccaggaccatggaggagaagaggaacctgaggaagatcgtggacaaggagaagagcaagcagacccaccgcatcctgcagctgaactgctgcatccagtgcctgaacagcatcagccgggcctacagaagaagcaagaacagcctgtctgagatcctgaacagcatcagcctgtggcagaagaccctgaagatcatcggcggcaagtttggcacctctgtgctgagctacttcaacttcctgcgctggctgctgaagttcaacatcttctccttcatcctgaacttctccttcatcatcatcccccagttcaccgtggccaagaagaacaccctgcagttcaccggcctggagttcttcaccggggtgggctacttccgggacacagtgatgtactacggcttctacaccaacagcaccatccagcacggcaacagcggggccagctacaacatgcagctggcctacatcttcaccatcggggcctgcctgaccacctgcttcttcagcctgctcttctccatggccaagtacttcaggaacaacttcatcaacccccacatctacagcggcggcatcaccaagctgatcttctgctgggacttcaccgtgacccatgagaaggctgtgaagctgaagcagaagaacctgagcacagagatccgggagaacctgtctgagctgcggcaggagaacagcaagctgaccttcaaccagctgctgacccgcttcagcgcctacatggtggcctgggtggtgtccactggagtggccatcgcctgctgtgccgctgtgtactacctggccgagtacaacctggagttcctgaagacccacagcaaccctggagctgtgctgctgctgccctttgtggtgtcctgcatcaacctggccgtgccctgcatctacagcatgttccggctggtggagagatatgagatgcccaggcatgaggtgtatgtgctgctgatccggaacatcttcctgaagatcagcatcatcggcatcctgtgctactactggctgaacacagtggccctgagcggggaggagtgctgggagaccctgattggccaggacatctaccgcctgctgctgatggactttgtgttcagcctggtgaacagcttcctgggggagttcctgcggcgcatcatcggcatgcagctgatcaccagcctgggcctgcaggagtttgatattgccagaaatgtgctggagctgatctatgcccagaccctggtgtggattggcatcttcttctgccccctgctgcccttcatccagatgatcatgctgttcatcatgttctacagcaagaacatcagcctgatgatgaacttccagccccccagcaaggcctggagggccagccagatgatgaccttcttcatcttcctgctcttcttccccagcttcaccggggtgctgtgcaccctggccatcaccatctggaggatcatcacctacctgtactggcagatcacagagggcaggaagatcatgatccggctgctgcacgagcagatcatcaatgaaggcaaggacaagatgttcctgattgagaagctgatcaagctgcaggacatggagaagaaggccaaccccagcagcctggtgctggagcggcgggaggtggagcagcagggcttcctgcacctgggggagcatgatggcagcctggacctgcggagccgccgctctgtgcaggagggcaacccccgggcctag

SEQ ID NO: 39071 - DNA, 3021 bp, Artificial Sequence
  Description of Artificial Sequence: Synthetic coding sequence
atgtctgcctactacagaaacaactggagcgaggaggaccctgactacccagactacagcggcagccagaacagaacccagggctacctgaagacccagggctacccagatgtgcccggccccctgaacaacccagactacccaggcaccaggagcaacccctacagcgtggccagcaggaccaggccagactacccaggcagcctggccgagcccaactaccccaggagcctgagcaacccagactacagcggcaccaggagcaatgcctacagcgctgccagcaggaccagcccagaccaccccaccagcctgcctgagccagactacagcgagttccagagccacccctaccaccgggccagcagccggcagcctgactacccaggcagccagagaaatccagactttgctggcagcagcagcagcggcaactatgccggcagcaggacccacccagaccacttcggcagcctggagccagactacccaggggcccagagcaacagcgaccaccctggcccccgggccaacctgaaccaccctggcagcaggaagaacctggagcacaccagcttccgcatcaacccctatgctgacagcctgggcaagccagactacccaggagctgacatccagcccaacagcccccccttcttcggggagccagactaccccagcgctgaggacaaccagaacctgcccagcacctggagggagccagactacagtgatgctgaaaatggacatgactatggcagcagcgagacccccaagatgacccggggcgtgctgagcaggaccagcagcatccagcccagcttccgccacagaagtgatgatcctgtgggcagcctgtggggagaaaatgactacccagagggcatcgagatggcctccatggagatggccaacagctatggccacagcctgcccggggcccctggcagcggctacgtgaacccagcctacgtgggggagagcggccctgtgcacgcctacggcaacccccccctgtctgaatgtgactggcacaagagcccccagggccagaagctgattgccagcctcatccccatgaccagccgggaccgcatcaaggccatccggaaccagcccaggaccatggaggagaagaggaacctgaggaagatcgtggacaaggagaagagcaagcagacccaccgcatcctgcagctgaactgctgcatccagtgcctgaacagcatcagccgggcctacagaagaagcaagaacagcctgtctgagatcctgaacagcatcagcctgtggcagaagaccctgaagatcatcggcggcaagtttggcacctctgtgctgagctacttcaacttcctgcgctggctgctgaagttcaacatcttctccttcatcctgaacttctccttcatcatcatcccccagttcaccgtggccaagaagaacaccctgcagttcaccggcctggagttcttcaccggggtgggctacttccgggacacagtgatgtactacggcttctacaccaacagcaccatccagcacggcaacagcggggccagctacaacatgcagctggcctacatcttcaccatcggggcctgcctgaccacctgcttcttcagcctgctcttctccatggccaagtacttcaggaacaacttcatcaacccccacatctacagcggcggcatcaccaagctgatcttctgctgggacttcaccgtgacccatgagaaggctgtgaagctgaagcagaagaacctgagcacagagatccgggagaacctgtctgagctgcggcaggagaacagcaagctgaccttcaaccagctgctgacccgcttcagcgcctacatggtggcctgggtggtgtccactggagtggccatcgcctgctgtgccgctgtgtactacctggccgagtacaacctggagttcctgaagacccacagcaaccctggagctgtgctgctgctgccctttgtggtgtcctgcatcaacctggccgtgccctgcatctacagcatgttccggctggtggagagatatgagatgcccaggcatgaggtgtatgtgctgctgatccggaacatcttcctgaagatcagcatcatcggcatcctgtgctactactggctgaacacagtggccctgagcggggaggagtgctgggagaccctgattggccaggacatctaccgcctgctgctgatggactttgtgttcagcctggtgaacagcttcctgggggagttcctgcggcgcatcatcggcatgcagctgatcaccagcctgggcctgcaggagtttgatattgccagaaatgtgctggagctgatctatgcccagaccctggtgtggattggcatcttcttctgccccctgctgcccttcatccagatgatcatgctgttcatcatgttctacagcaagaacatcagcctgatgatgaacttccagccccccagcaaggcctggagggccagccagatgatgaccttcttcatcttcctgctcttcttccccagcttcaccggggtgctgtgcaccctggccatcaccatctggaggctgaagcccagcgctgactgtggccccttccggggcctgcccctcttcatccacagcatctacagctggattgacaccctgagcaccaggcctggctacctgtgggtggtgtggatctacagaaacctgattggctctgtgcacttcttcttcatcctgaccctcatcgtgctgatcatcacctacctgtactggcagatcacagagggcaggaagatcatgatccggctgctgcacgagcagatcatcaatgaaggcaaggacaagatgttcctgattgagaagctgatcaagctgcaggacatggagaagaaggccaaccccagcagcctggtgctggagcggcgggaggtggagcagcagggcttcctgcacctgggggagcatgatggcagcctggacctgcggagccgccgctctgtgcaggagggcaacccccgggcctag

SEQ ID NO: 39072 - DNA, 2103 bp, Artificial Sequence
  Description of Artificial Sequence: Synthetic coding sequence
atgctgagtgatgaccacgtgaatgagatcatcatccagaagctgattgccagcctcatccccatgaccagccgggaccgcatcaaggccatccggaaccagcccaggaccatggaggagaagaggaacctgagcagaggaggcctgaccatcaccacagaagatgagggccgggccaaggcccacctgacctggtggaagatcgtggacaaggagaagagcaagcagacccaccgcatcctgcagctgaactgctgcatccagtgcctgaacagcatcagccgggcctaccgccgcagcaagaacagcctgtctgagatcctgaacagcatcagcctgtggcagaagaccctgaagatcattggaggcaagtttggcacctctgtgctgagctacttcaacttcctgcgctggctgctgaagttcaacatcttctccttcatcctgaacttctccttcatcatcatcccccagttcaccgtggccaagaagaacaccctgcagttcaccggcctggagttcttcaccggggtgggctacttccgggacacagtgatgtactacggcttctacaccaacagcaccatccagcacggcaacagcggggccagctacaacatgcagctggcctacatcttcaccatcggggcctgcctgaccacctgcttcttcagcctgctcttctccatggccaagtacttcaggaacaacttcatcaacccccacatctacagcggcggcatcaccaagctgatcttctgctgggacttcaccgtgacccatgagaaggctgtgaagctgaagcagaagaacctgagcacagagatccgggagaacctgtctgagctgcggcaggagaacagcaagctgaccttcaaccagctgctgacccgcttcagcgcctacatggtggcctgggtggtgtccactggagtggccatcgcctgctgtgccgctgtgtactacctggccgagtacaacctggagttcctgaagacccacagcaaccctggagctgtgctgctgctgccctttgtggtgtcctgcatcaacctggccgtgccctgcatctacagcatgttccggctggtggagagatatgagatgcccaggcatgaggtgtatgtgctgctgatccggaacatcttcctgaagatcagcatcatcggcatcctgtgctactactggctgaacacagtggccctgtctggagaggagtgctgggagaccctcatcggccaggacatctaccgcctgctgctgatggactttgtgttcagcctggtgaacagcttcctgggggagttcctgcggcgcatcatcggcatgcagctgatcaccagcctgggcctgcaggagtttgacatcgccagaaatgtgctggagctgatctatgcccagaccctggtgtggattggcatcttcttctgccccctgctgcccttcatccagatgatcatgctgttcatcatgttctacagcaagaacatcagcctgatgatgaacttccagccccccagcaaggcctggagggccagccagatgatgaccttcttcatcttcctgctcttcttccccagcttcaccggggtgctgtgcaccctggccatcaccatctggaggctgaagcccagcgctgactgtggccccttccggggcctgcccctcttcatccacagcatctacagctggattgacaccctgagcacccggcccggctacctgtgggtggtgtggatctacagaaacctgattggctctgtgcacttcttcttcatcctgaccctgattgtgctgatcatcacctacctgtactggcagatcacagagggcaggaagatcatgatccggctgctgcacgagcagatcatcaatgaaggcaaggacaagatgttcctgattgagaagctgatcaagctgcaggacatggagaagaaggccaaccccagcagcctggtgctggagcggcgggaggtggagcagcagggcttctgcatctggggcaacatgatggctgtgctgacctgtgacctggaggaccagttcaagaaggtgatccagggcccagatgacagctttggaaaccagacccccatcaagtag

SEQ ID NO: 39073 - DNA, 2865 bp, Artificial Sequence
  Description of Artificial Sequence: Synthetic coding sequence
atgtctgcctactacagaaacaactggagcgaggaggaccctgactacccagactacagcggcagccagaacagaacccagggctacctgaagacccagggctacccagatgtgcccggccccctgaacaacccagactacccaggcaccaggagcaacccctacagcgtggccagcaggaccaggccagactacccaggcagcctggccgagcccaactaccccaggagcctgagcaacccagactacagcggcaccaggagcaatgcctacagcgctgccagcaggaccagcccagaccaccccaccagcctgcctgagccagactacagcgagttccagagccacccctaccaccgggccagcagccggcagcctgactacccaggcagccagagaaatccagactttgctggcagcagcagcagcggcaactatgccggcagcaggacccacccagaccacttcggcagcctggagccagactacccaggggcccagagcaacagcgaccaccctggcccccgggccaacctgaaccaccctggcagcaggaagaacctggagcacaccagcttccgcatcaacccctatgctgacagcctgggcaagccagactacccaggagctgacatccagcccaacagcccccccttcttcggggagccagactaccccagcgctgaggacaaccagaacctgcccagcacctggagggagccagactacagtgatgctgaaaatggacatgactatggcagcagcgagacccccaagatgacccggggcgtgctgagcaggaccagcagcatccagcccagcttccgccacagaagtgatgatcctgtgggcagcctgtggggagaaaatgactacccagagggcatcgagatggcctccatggagatggccaacagctatggccacagcctgcccggggcccctggcagcggctacgtgaacccagcctacgtgggggagagcggccctgtgcacgcctacggcaacccccccctgtctgaatgtgactggcacaagagcccccagggccagaagctgattgccagcctcatccccatgaccagccgggaccgcatcaaggccatccggaaccagcccaggaccatggaggagaagaggaacctgaggaagatcgtggacaaggagaagagcaagcagacccaccgcatcctgcagctgaactgctgcatccagtgcctgaacagcatcagccgggcctacagaagaagcaagaacagcctgtctgagatcctgaacagcatcagcctgtggcagaagaccctgaagatcatcggcggcaagtttggcacctctgtgctgagctacttcaacttcctgcgctggctgctgaagttcaacatcttctccttcatcctgaacttctccttcatcatcatcccccagttcaccgtggccaagaagaacaccctgcagttcaccggcctggagttcttcaccggggtgggctacttccgggacacagtgatgtactacggcttctacaccaacagcaccatccagcacggcaacagcggggccagctacaacatgcagctggcctacatcttcaccatcggggcctgcctgaccacctgcttcttcagcctgctcttctccatggccaagtacttcaggaacaacttcatcaacccccacatctacagcggcggcatcaccaagctgatcttctgctgggacttcaccgtgacccatgagaaggctgtgaagctgaagcagaagaacctgagcacagagatccgcttcctgaagacccacagcaaccctggagctgtgctgctgctgccctttgtggtgtcctgcatcaacctggccgtgccctgcatctacagcatgttccggctggtggagagatatgagatgcccaggcatgaggtgtatgtgctgctgatccggaacatcttcctgaagatcagcatcatcggcatcctgtgctactactggctgaacacagtggccctgagcggggaggagtgctgggagaccctgattggccaggacatctaccgcctgctgctgatggactttgtgttcagcctggtgaacagcttcctgggggagttcctgcggcgcatcatcggcatgcagctgatcaccagcctgggcctgcaggagtttgatattgccagaaatgtgctggagctgatctatgcccagaccctggtgtggattggcatcttcttctgccccctgctgcccttcatccagatgatcatgctgttcatcatgttctacagcaagaacatcagcctgatgatgaacttccagccccccagcaaggcctggagggccagccagatgatgaccttcttcatcttcctgctcttcttccccagcttcaccggggtgctgtgcaccctggccatcaccatctggaggctgaagcccagcgctgactgtggccccttccggggcctgcccctcttcatccacagcatctacagctggattgacaccctgagcaccaggcctggctacctgtgggtggtgtggatctacagaaacctgattggctctgtgcacttcttcttcatcctgaccctcatcgtgctgatcatcacctacctgtactggcagatcacagagggcaggaagatcatgatccggctgctgcacgagcagatcatcaatgaaggcaaggacaagatgttcctgattgagaagctgatcaagctgcaggacatggagaagaaggccaaccccagcagcctggtgctggagcggcgggaggtggagcagcagggcttcctgcacctgggggagcatgatggcagcctggacctgcggagccgccgctctgtgcaggagggcaacccccgggcctag

SEQ ID NO: 39074 - DNA, 3021 bp, Artificial Sequence; identical to SEQ ID NO: 39071
  Description of Artificial Sequence: Synthetic coding sequence

SEQ ID NO: 39075 - DNA, 2172 bp, Artificial Sequence
  Description of Artificial Sequence: Synthetic coding sequence
atgtctgagagcagcggcagcgccctgcagcccggccggcccagccggcagcctgctgtgcaccctgagaacctgagcctggacagcagctgcttcagcagcccccctgtgaacttcctgcaggagctgcccagctaccgcagcatcgcccggcggaggaccaccgtgcacagccgggacaagcagagcggcaccctgctgaagcccacagacagctacagcagccagctggaggacagaattgctgagaacctgagcagccacagcctgagaaattatgccctgaacatcagcgagaagaggcggctgcgggacatccaggagacccagatgaagtacctgtctgagtgggaccagtggaagcgctacagcagcaagtcctggaagcgcttcctggagaaggcccgggagatgaccacccacctggagctgtggagggaggacatccgcagcattgagggcaagtttggcaccggcatccagagctacttctccttcctgcgcttcctggtgctgctgaacctggtgatcttcctgatcatcttcatgctggtgctgctgcctgtgctgctgaccaagtacaagatcaccaacagcagctttgtgctgatccccttcaaggacatggacaagcagtgcaccgtgtaccctgtgagcagcagcggcctcatctacttctacagctacatcatcgacctgctgtctggaacaggcttcctggaggagaccagcctcttctacggccactacaccattgatggagtgaagttccagaacttcacctatgacctgcccctggcctacctgctgagcaccatcgccagcctggccctgagcctgctgtggatcgtgaagaggtctgtggagggcttcaagatcaacctgatccgctctgaggagcacttccagagctactgcaacaagatctttgctggctgggacttctgcatcaccaacagatccatggctgacctgaagcacagcagcctgcgctatgagctgcgggctgacctggaggaggagaggatgaggcagaagattgctgagaggaccagcgaggagaccatccgcatctacagcctgcggctcttcctgaactgcatcgtgctggccgtgctgggcgcctgcttctacgccatctacgtggccaccgtcttcagccaggagcacatgaagaaggagattgacaagatggtgtttggagagaacctcttcatcctgtacctgcccagcatcgtcatcaccctggccaacttcatcacccccatgatctttgccaagatcatccgctatgaggactacagccctggctttgagatccggctgaccatcctgcgctgtgtgttcatgaggctggccaccatctgtgtgctggtgttcaccctgggcagcaagatcaccagctgtgatgatgacacctgtgacctgtgtggctacaaccagaagctgtacccctgctgggagacccaggtgggccaggagatgtacaagctgatgatctttgacttcatcatcatcctggccgtgaccctgtttgtggacttccccaggaagctgctggtgacctactgcagcagctgcaagctgatccagtgctggggccagcaggagtttgccatcccagacaacgtgctgggcatcgtgtatggccagaccatctgctggattggagccttcttcagccccctgctgcctgccatcgccaccctgaagttcatcatcatcttctacgtgaaggagtggagcctgctgtacacctgccggcccagcccccggcccttccgggccagcaacagcaacttcttcttcctgctggtgctgctgattggcctgtgcctggccatcatccccctgaccatcagcatcagccgcatccccagcagcaaggcctgtggccccttcaccaacttcaacaccacctgggaggtgatccccaagacagtgtccaccttccccagcagcctgcagagcttcatccacggcgtgaccagcgaggcctttgctgtgcccttcttcatgatcatctgcctgatcatgttctacttcatcgccctggccggggcccacaagagggtggtgatccagctgcgggagcagctgagcctggagagccgggacaagtgctacctgatccagaagctgacagaggcccagagggacatgaggaactag

SEQ ID NO: 39076 - DNA, 1842 bp, Artificial Sequence
  Description of Artificial Sequence: Synthetic coding sequence
atgaagtacctgtctgagtgggaccagtggaagcgctacagcagcaagtcctggaagcgcttcctggagaaggcccgggagatgaccacccacctggagctgtggagggaggacatccgcagcattgagggcaagtttggcaccggcatccagagctacttctccttcctgcgcttcctggtgctgctgaacctggtgatcttcctgatcatcttcatgctggtgctgctgcctgtgctgctgaccaagtacaagatcaccaacagcagctttgtgctgatccccttcaaggacatggacaagcagtgcaccgtgtaccctgtgagcagcagcggcctcatctacttctacagctacatcatcgacctgctgtctggaacaggcttcctggaggagaccagcctcttctacggccactacaccattgatggagtgaagttccagaacttcacctatgacctgcccctggcctacctgctgagcaccatcgccagcctggccctgagcctgctgtggatcgtgaagaggtctgtggagggcttcaagatcaacctgatccgctctgaggagcacttccagagctactgcaacaagatctttgctggctgggacttctgcatcaccaacagatccatggctgacctgaagcacagcagcctgcgctatgagctgcgggctgacctggaggaggagaggatgaggcagaagattgctgagaggaccagcgaggagaccatccgcatctacagcctgcggctcttcctgaactgcatcgtgctggccgtgctgggcgcctgcttctacgccatctacgtggccaccgtcttcagccaggagcacatgaagaaggagattgacaagatggtgtttggagagaacctcttcatcctgtacctgcccagcatcgtcatcaccctggccaacttcatcacccccatgatctttgccaagatcatccgctatgaggactacagccctggctttgagatccggctgaccatcctgcgctgtgtgttcatgaggctggccaccatctgtgtgctggtgttcaccctgggcagcaagatcaccagctgtgatgatgacacctgtgacctgtgtggctacaaccagaagctgtacccctgctgggagacccaggtgggccaggagatgtacaagctgatgatctttgacttcatcatcatcctggccgtgaccctgtttgtggacttccccaggaagctgctggtgacctactgcagcagctgcaagctgatccagtgctggggccagcaggagtttgccatcccagacaacgtgctgggcatcgtgtatggccagaccatctgctggattggagccttcttcagccccctgctgcctgccatcgccaccctgaagttcatcatcatcttctacgtgaaggagtggagcctgctgtacacctgccggcccagcccccggcccttccgggccagcaacagcaacttcttcttcctgctggtgctgctgattggcctgtgcctggccatcatccccctgaccatcagcatcagccgcatccccagcagcaaggcctgtggccccttcaccaacttcaacaccacctgggaggtgatccccaagacagtgtccaccttccccagcagcctgcagagcttcatccacggcgtgaccagcgaggcctttgctgtgcccttcttcatgatcatctgcctgatcatgttctacttcatcgccctggccggggcccacaagagggtggtgatccagctgcgggagcagctgagcctggagagccgggacaagtgctacctgatccagaagctgacagaggcccagagggacatgaggaactag

SEQ ID NO: 39077 - DNA, 606 bp, Artificial Sequence
  Description of Artificial Sequence: Synthetic coding sequence
atggtgaccctggccgagctgctggtgctgctggccgccctgctggccaccgtgtctggctactttgtgtccattgatgcccatgctgaggagtgcttctttgagcgggtgaccagcggcaccaagatgggcctcatctttgaggtggccgagggcggcttcctggacattgatgtggagatcaccggccctgacaacaagggcatctacaagggggaccgggagagcagcggcaagtacacctttgctgcccacatggatggcacctacaagttctgcttcagcaacaggatgagcaccatgacccccaagatcgtgatgttcaccatcgacatcggggaggcccccaagggccaggacatggagacagaggcccaccagaacaagctggaggagatgatcaatgagctggccgtggccatgacagctgtgaagcatgagcaggagtacatggaggtgcgggagcgcatccaccgggccatcaatgacaacaccaacagccgggtggtgctgtggagcttctttgaggccctggtgctggtggccatgaccctgggccagatctactacctgaagcgcttctttgaggtgcggcgggtggtgtag

SEQ ID NO: 39078 - DNA, 510 bp, Artificial Sequence
  Description of Artificial Sequence: Synthetic coding sequence
atggtgaccctggccgagctgctggtgctgctggccgccctgctggccaccgtgtctggctactttgtgtccattgatgtggagatcaccggccctgacaacaagggcatctacaagggggaccgggagagcagcggcaagtacacctttgctgcccacatggatggcacctacaagttctgcttcagcaacaggatgagcaccatgacccccaagatcgtgatgttcaccatcgacatcggggaggcccccaagggccaggacatggagacagaggcccaccagaacaagctggaggagatgatcaatgagctggccgtggccatgacagctgtgaagcatgagcaggagtacatggaggtgcgggagcgcatccaccgggccatcaatgacaacaccaacagccgggtggtgctgtggagcttctttgaggccctggtgctggtggccatgaccctgggccagatctactacctgaagcgcttctttgaggtgcggcgggtggtgtag

SEQ ID NO: 39079 - DNA, 456 bp, Artificial Sequence
  Description of Artificial Sequence: Synthetic coding sequence
atggtgaccctggccgagctgctggtgctgctggccgccctgctggccaccgtgtctggctactttgtgtccattgatgcccatgctgaggagtgcttctttgagcgggtgaccagcggcaccaagatgggcctcatctttgaggtggccgagggcggcttcctggacattgatgtggagatcaccggccctgacaacaagggccaggacatggagacagaggcccaccagaacaagctggaggagatgatcaatgagctggccgtggccatgacagctgtgaagcatgagcaggagtacatggaggtgcgggagcgcatccaccgggccatcaatgacaacaccaacagccgggtggtgctgtggagcttctttgaggccctggtgctggtggccatgaccctgggccagatctactacctgaagcgcttctttgaggtgcggcgggtggtgtag

SEQ ID NO: 39080 - DNA, 654 bp, Artificial Sequence
  Description of Artificial Sequence: Synthetic coding sequence
atgggcagcacagtgcccaggtctgcctctgtgctgctgctgctgctgctgctgcggcgggcagagcagccctgtggggctgagctgacctttgagctgcctgacaatgccaagcagtgcttccacgaggaggtggagcagggcgtgaagttcagcctggactaccaggtgatcactggaggccactatgatgtggactgctacgtggaggacccccagggcaacaccatctaccgggagaccaagaagcagtatgacagcttcacctacagagctgaggtgaagggcgtgtaccagttctgcttcagcaatgagttcagcaccttcagccacaagacagtgtactttgacttccaggtgggagatgagccccccatcctgcctgacatgggcaacagagtgacagccctgacccagatggagagcgcctgtgtgaccatccacgaggccctgaagacagtgattgacagccagacccactaccgcctgcgggaggcccaggaccgggcccgggcagaggacctgaacagccgggtgtcctactggagcgtgggggagaccatcgccctgtttgtggtgtccttcagccaggtgctgctgctgaagagcttcttcacagagaagaggcccatcagcagagctgtgcacagctag

SEQ ID NO: 39081 - DNA, 522 bp, Artificial Sequence
  Description of Artificial Sequence: Synthetic coding sequence
atgggcagcacagtgcccaggtctgcctctgtgctgctgctgctgctgctgctgcggcgggcagagcagccctgtggggctgagctgacctttgagctgcctgacaatgccaagcagtgcttccacgaggaggtggagcagggcgtgaagttcagcctggactaccaggtgatcactggaggccactatgatgtggactgctacgtggaggacccccagggcaacaccatctaccgggagaccaagaagcagtatgacagcttcacctacagagctgaggtgaagggcgtgtaccagttctgcttcagcaatgagttcagcaccttcagccacaagacagtgtactttgacttccaggtgggagatgagccccccatcctgcctgacatgggcaacagagtgacagccctgacccagcgcttccggggggcctactggaaggaggtggacaagatggtggactacatgcagcccggcggcaccccagccacagagggcctgggccgcctggcccccagctag

SEQ ID NO: 39082 - DNA, 489 bp, Artificial Sequence
  Description of Artificial Sequence: Synthetic coding sequence
atgggagacaagatctggctgcccttccctgtgctgctgctggccgccctgccccctgtgctgctgcctggagctgctggcttcacccccagcctggacagcgacttcaccttcaccctgcctgctggccagaaggagtgcttctaccagcccatgcccctgaaggccagcctggagattgagtaccaggtgctggatggagctggcctggacatcgacttccacctggccagccctgagggcaagaccctggtgtttgagcagaggaagagtgatggagtgcacacagtggagacagaggtgggggactacatgttctgctttgacaacaccttcagcaccatcagcgagaaggtgatcttctttgagctgatcctggacaacatgggagagcaggcccaggagcaggaggactggaagaagtacatcaccggcacagacatcctggacatgaagctggaggacatcctggtgtccatggtgttctag

SEQ ID NO: 39083 - DNA, 690 bp, Artificial Sequence
  Description of Artificial Sequence: Synthetic coding sequence
atgggagacaagatctggctgcccttccctgtgctgctgctggccgccctgccccctgtgctgctgcctggagctgctggcttcacccccagcctggacagcgacttcaccttcaccctgcctgctggccagaaggagtgcttctaccagcccatgcccctgaaggccagcctggagattgagtaccaggtgctggatggagctggcctggacatcgacttccacctggccagccctgagggcaagaccctggtgtttgagcagaggaagagtgatggagtgcacacagtggagacagaggtgggggactacatgttctgctttgacaacaccttcagcaccatcagcgagaaggtgatcttctttgagctgatcctggacaacatgggagagcaggcccaggagcaggaggactggaagaagtacatcaccggcacagacatcctggacatgaagctggaggacatcctggagagcatcaacagcatcaagagccggctgagcaagagcggccacatccagaccctgctgcgggcctttgaggcccgggacaggaacatccaggagagcaactttgacagagtgaacttctggagcatggtgaacctggtggtgatggtggtggtgtctgccatccaggtgtacatgctgaagagcctgtttgaggacaagaggaagagcaggacatag

SEQ ID NO: 39084 - DNA, 582 bp, Artificial Sequence
  Description of Artificial Sequence: Synthetic coding sequence
atgggagacaagatctggctgcccttccctgtgctgctgctggccgccctgccccctgtgctgctgcctggagctgctggcttcacccccagcctggacagcgacttcaccttcaccctgcctgctggccagaaggagtgcttctaccagcccatgcccctgaaggccagcctggagattgagtaccaggtgctggatggagctggcctggacatcgacttccacctggccagccctgagggcaagaccctggtgtttgagcagaggaagagtgatggagtgcacacagtggagacagaggtgggggactacatgttctgctttgacaacaccttcagcaccatcagcgagaaggtgatcttctttgagctgatcctggacaacatgggagagcaggcccaggagcaggaggactggaagaagtacatcaccggcacagacatcctggacatgaagctggaggacatcctggaccccatcatcaagatcgccagtgatgtgcagatccggctgcacctgggcatccaccagcagcaccaggtgcagaccaagcagaagtgggcccacaccaacagcgcctag

SEQ ID NO: 39085 - DNA, 537 bp, Artificial Sequence
  Description of Artificial Sequence: Synthetic coding sequence
atgcccctgaaggccagcctggagattgagtaccaggtgctggatggagctggcctggacatcgacttccacctggccagccctgagggcaagaccctggtgtttgagcagaggaagagtgatggagtgcacacagtggagacagaggtgggggactacatgttctgctttgacaacaccttcagcaccatcagcgagaaggtgatcttctttgagctgatcctggacaacatgggagagcaggcccaggagcaggaggactggaagaagtacatcactggaacagacatcctggacatgaagctggaggacatcctggagagcatcaacagcatcaagagccggctgagcaagagcggccacatccagaccctgctgcgggcctttgaggcccgggacaggaacatccaggagagcaactttgacagagtgaacttctggagcatggtgaacctggtggtgatggtggtggtgtctgccatccaggtgtacatgctgaagagcctgtttgaggacaagaggaagagcaggacatag

SEQ ID NO: 39086 - DNA, 723 bp, Artificial Sequence
  Description of Artificial Sequence: Synthetic coding sequence
atgagccccctgctgtttggagctggcctggtggtgctgaacctggtgaccagcgcccggagccagaagacagagcccctgagcggcagcggggaccagcccctcttcagaggagctgacagatatgactttgccatcatgatccccccaggcggcacagagtgcttctggcagtttgcccaccagacaggctacttctacttctcctatgaggtgcagaggacagtgggcatgagccatgacagacatgtggccgccacagcccacaacccccagggcttcctgattgacaccagccagggcgtgcggggccagatcaacttcagcacccaggagaccggcttctaccagctgtgcctgagcaaccagcacaaccactttggatctgtgcaggtgtacctgaactttggagtcttctatgagggccctgagacagaccacaagcagaaggagaggaagcagctgaatgacaccctggatgccattgaagatggcacccagaaggtgcagaacaacatcttccacatgtggagatactacaactttgccaggatgaggaagatggctgacttcttcctgatccagagcaactacaactacgtgaactggtggagcacagcccagagcctggtgatcatcctgagcggcatcctgcagctgtacttcctgaagaggctcttcaacgtgcccaccaccacagacaccaagaagccccgctgctag

SEQ ID NO: 39087 - DNA, 675 bp, Artificial Sequence
  Description of Artificial Sequence: Synthetic coding sequence
atgccccggcccggcagcgcccagcgctgggccgctgtggccggccgctggggctgccgcctgctggccctgctgctgctggtgcccggccctggaggagccagcgagatcacctttgagctgcctgacaatgccaagcagtgcttctatgaagatattgcccagggcaccaagtgcaccctggagttccaggtgatcactggaggccactatgatgtggactgccgcctggaggaccctgatggcaaggtgctgtacaaggagatgaagaagcagtatgacagcttcaccttcaccgccagcaagaatggcacctacaagttctgcttcagcaatgagttcagcaccttcacccacaagacagtgtactttgacttccaggtgggggaggaccccccactcttccccagcgagaacagagtgtctgccctgacccagatggagagcgcctgtgtgtccatccacgaggccctgaagagcgtcatcgactaccagacccacttccggctgcgggaggcccagggccgcagcagagctgaggacctgaacaccagggtggcctactggagcgtgggggaggccctgatcctgctggtggtgtccatcggccaggtgttcctgctgaagagcttcttcagtgacaagaggaccaccaccaccagggtgggcagctag

SEQ ID NO: 39088 - DNA, 249 bp, Artificial Sequence
  Description of Artificial Sequence: Synthetic coding sequence
atgccccggcccggcagcgcccagcgctgggccgctgtggccggccgctggggctgccgcctgctggccctgctgctgctggtgcccggccctggaggagccagcgagatcacctttgagctgcctgacaatgccaagcagtgcttctatgaagatattgcccagggcaccaagtgcaccctggagttccaggtgatcactggaggccactatgatgtggactgccgcctggaggaccctgatggatag

SEQ ID NO: 39089 - DNA, 651 bp, Artificial Sequence
  Description of Artificial Sequence: Synthetic coding sequence
atgcaggccggcaagcccatcctgtacagctacttccgcagcagctgctcctggagggtgcgcatcgccctggccctgaagggcattgattatgaaacagtgcccatcaacctgatcaaggatggcggccagcagttcagcaaggacttccaggccctgaaccccatgaagcaggtgcccaccctgaagattgatggcatcaccatccaccagagcctggccatcatcgagtacctggaggagatgaggcccaccccccggctgctgccccaggaccccaagaagagggcctctgtgaggatgatcagtgacctgattgctgggggcatccagcccctgcagaacctgtctgtgctgaagcaggtgggggaggagatgcagctgacctgggcccagaatgccatcacctgtggcttcaatgccctggagcagatcctgcagagcacagctggcatctactgtgtgggagatgaggtgaccatggctgacctgtgcctggtgccccaggtggccaatgctgagcgcttcaaggtggacctgaccccctaccccaccatcagcagcatcaacaagaggctgctggtgctggaggccttccaggtgagccacccctgccggcagcctgacacccccacagagctgcgggcctag

SEQ ID NO: 39090 - DNA, 708 bp, Artificial Sequence
  Description of Artificial Sequence: Synthetic coding sequence
atggctgtggagctgggcgtgctgctggtgcggccccggcccggcaccggcctgggccgggtgatgaggaccctgctgctggtgctgtggctggccacccggggcagcgccctgtacttccacatcggggagacagagaagaagtgcttcatcgaggagatcccagatgagaccatggtgattggcaactaccgcacccagctgtatgacaagcagcgggaggagtaccagcctgccaccccaggcctgggcatgtttgtggaggtgaaggaccctgaggacaaggtgatcctggcccggcagtatggcagcgagggccgcttcaccttcaccagccacaccccaggagagcaccagatctgcctgcacagcaacagcaccaagttcagcctgtttgctgggggcatgctgcgggtgcacctggacatccaggtgggggagcacgccaatgactatgcagaaattgctgccaaggacaagctgtctgagctgcagctgcgggtgcggcagctggtggagcaggtggagcagatccagaaggagcagaactaccagcgctggagggaggagcgcttccggcagaccagcgagagcaccaaccagagggtgctgtggtggagcatcctgcagaccctcatcctggtggccatcggcgtgtggcagatgaggcacctgaagagcttctttgaggccaagaagctggtgtag

SEQ ID NO: 39091 - DNA, 822 bp, Artificial Sequence
  Description of Artificial Sequence: Synthetic coding sequence
atgatcctgaagggctgcctgctgtaccccctgtgcagccccaggaacaagcagagatgtgcccggctgtggaagatcgcctacggcggcctgctgaagatcgtgacaggcagcctgctgaccttctacgtggtgctgtgcctggatggcggcatggtgctgatgaggaagcaggtgcccagccgcttcatgtaccccaaggagtggcagcacctgaccatgttcatcctgctgaccctgaatggctgtgtggacttcatgagcaagaatgtgctgccccagagatgtgtgggcctggagaagggcaccctggtgctgatcatctatgagctgctgctgctgatggtgagccacgtgaaggacagcgagggcgtggagctgcacgtgtacagcctgctgatcctggtggtgttcctgctgctgctggtgctgacagctgagctgtgggcccccaacatgtgccacctgcagctgatggagaccttcctgatcctgatgatgggctcctggctgatgcaggccggcttcatcctgtacagacctgtgtctggctacccctggcaggatgatgacatcagtgacatcatgtttgtgaccaccttcttctgctggcacgtgatgatcaatgccagcttcctgctgggcatctacggcttcagcagcttctggtaccactgcttccggcccagcctgaagctgaccggccccaaggaggccccctactatgccagcaccccaggccccctgtacaagctgctgcaggaggtggagcagagcgagaaggaggaccaggccctgctgctgcccaagagcagcccctag

SEQ ID NO: 39092 - DNA, 1338 bp, Artificial Sequence
  Description of Artificial Sequence: Synthetic coding sequence
atgaatgaaagcccccagaccaatgagttcaagggcaccacagaggaggccccagccaaggagagcccccacaccagcgagttcaagggagctgccctggtgagccccatcagcaagaggatctttggagtcttcctggtgctgctggatgtgaccctgctgctggccgacctgatcttcacagacagcaagctgtacatccccctggagtaccgcagcatcagcctggccatcggcctcttcttcctgatggatgtgctgctgcgggtgtttgtggagggctggacccacctggtgcggctgctgcggctcatcatcctgatccgcatcttccacctgctgcaccagaagaggcagctggagaagctgatgaggcggctggtgtctgagaacaagaggcgctacaccagagatggctttgacctggacctgacctacgtgacagagcgcatcatcgccatgtccttccccagcagcggccggcagagcttctacagaaaccccatcgaggaggtggtgcgcttcctggacaagaagcacaggaaccactacagagtgtacaacctgtgcagcgagcgggcctatgaccccaagcacttccacaacagagtgagccgcatcatgattgatgaccacaacgtgcccaccctgcacgagatggtggtgttcaccaaggaggtgaatgagtggatggcccaggacctggagaacatcgtggccatccactgcaagggcggcaaaggaagaacaggcaccatggtgtgtgccctgctgattgccagcgagatcttcctgacagctgaggagagcctgtactactttggagagaggaggaccaacaagacccacagcaacaagttccagggcgtggagacccccagccagaaccgctacgtgggctactttgcccaggtgaagcacctgtacaactggaacctgcccccccggcgcatcctcttcatcaagcgcttcatcatctacagcatcagaggagatgtgtgtgacctgaaggtgcaggtggtgatggagaagaaggtggtgttcagcagcaccagcctgggcaactgcagcatcctgcatgacatcgagacagacaagatcctgatcaacgtgtatgatggcccccccctgtatgatgatgtgaaggtgcagttcttcagcagcaacctgcccaagtactatgacaactgccccttcttcttctggttcaacaccagcttcatccagaacaaccggctgtgcctgcccagaaatgagctggacaacccccacaagcagaaggcctggaagatctacccacctgagtttgctgtggagatcctgtttggagagaagtag

SEQ ID NO: 39093 - DNA, 1467 bp, Artificial Sequence
  Description of Artificial Sequence: Synthetic coding sequence
atgaacaccagcccccagaccaatgagttcaagggcaccacagaggaggccccagccaaggagagcccccacaccagcgagttcaagggagctgccctggtgagccccatcagcaagtccatgctggagcggctgagcaagtttgaggtggaggatgctgaaaatgtggccagctatgacagcaagatcaagaagatcgtgcacagcatcgtgtcctcctttgccttcggcatctttggagtcttcctggtgctgctggatgtgaccctgctgctggccgacctgatcttcacagacagcaagctgtacatccccctggagtaccgcagcatcagcctggccatcggcctcttcttcctgatggatgtgctgctgcgggtgtttgtggagggccggcagcagtacttcagtgacctcttcaacatcctggacacagccatcatcgtcatccccctgctggtggatgtgatctacatcttctttgacatcaagctgctgaggaacatcccccgctggacccacctggtgcggctgctgcggctcatcatcctgatccgcatcttccacctgctgcaccagaagaggcagctggagaagctgatgaggcggctggtgtctgagaacaagaggcgctacaccagagatggctttgacctggacctgacctacgtgacagagcgcatcatcgccatgtccttccccagcagcggccggcagagcttctacagaaaccccatcgaggaggtggtgcgcttcctggacaagaagcacaggaaccactacagagtgtacaacctgtgcagcgagcgggcctatgaccccaagcacttccacaacagagtgagccgcatcatgattgatgaccacaacgtgcccaccctgcacgagatggtggtgttcaccaaggaggtgaatgagtggatggcccaggacctggagaacatcgtggccatccactgcaagggcggcaagggccgcacaggcaccatggtgtgtgccctgctgattgccagcgagatcttcctgacagctgaggagagcctgtactactttggagagaggaggaccaacaagacccacagcaacaagttccagggcgtggagacccccagccagaacagatatgtgggctactttgcccaggtgaagcacctgtacaactggaacctgcccccccggcgcatcctcttcatcaagcgcttcatcatctacagcatcagaggagatgtgtgtgacctgaaggtgcaggtggtgatggagaagaaggtggtgttcagcagcaccagcctgggcaactgcagcatcctgcatgacattgaaacagacaagatcctgatcaacgtgtatgatggcccccccctgtatgatgatgtgaaggtgcagttcttcagcagcagagctgagaagagagctgcccaccgggccaactggaagggggagcccagcagaagacctgtgctggactag

SEQ ID NO: 39094 - DNA, 1449 bp, Artificial Sequence
  Description of Artificial Sequence: Synthetic coding sequence
atgaatgaaagcccccagaccaatgagttcaagggcaccacagaggaggccccagccaaggagagcccccacaccagcgagttcaagggagctgccctggtgagccccatcagcaagtccatgctggagcggctgagcaagtttgaggtggaggatgctgaaaatgtggccagctatgacagcaagatcaagaagatcgtgcacagcatcgtgtcctcctttgccttcggcatctttggagtcttcctggtgctgctggatgtgaccctgctgctggccgacctgatcttcacagacagcaagctgtacatccccctggagtaccgcagcatcagcctggccatcggcctcttcttcctgatggatgtgctgctgcgggtgtttgtggagggctggacccacctggtgcggctgctgcggctcatcatcctgatccgcatcttccacctgctgcaccagaagaggcagctggagaagctgatgaggcggctggtgtctgagaacaagaggcgctacaccagagatggctttgacctggacctgacctacgtgacagagcgcatcatcgccatgtccttccccagcagcggccggcagagcttctacagaaaccccatcgaggaggtggtgcgcttcctggacaagaagcacaggaaccactacagagtgtacaacctgtgcagcgagcgggcctatgaccccaagcacttccacaacagagtgagccgcatcatgattgatgaccacaacgtgcccaccctgcacgagatggtggtgttcaccaaggaggtgaatgagtggatggcccaggacctggagaacatcgtggccatccactgcaagggcggcaagggccgcacaggcaccatggtgtgtgccctgctgattgccagcgagatcttcctgacagctgaggagagcctgtactactttggagagaggaggaccaacaagacccacagcaacaagttccagggcgtggagacccccagccagaacagatatgtgggctactttgcccaggtgaagcacctgtacaactggaacctgcccccccggcgcatcctcttcatcaagcgcttcatcatctacagcatcagaggagatgtgtgtgacctgaaggtgcaggtggtgatggagaagaaggtggtgttcagcagcaccagcctgggcaactgcagcatcctgcatgacattgaaacagacaagatcctgatcaacgtgtatgatggcccccccctgtatgatgatgtgaaggtgcagttcttcagcagcaacctgcccaagtactatgacaactgccccttcttcttctggttcaacaccagcttcatccagaacaaccggctgtgcctgcccagaaatgagctggacaacccccacaagcagaaggcctggaagatctacccacctgagtttgctgtggagatcctgtttggagagaagtag

SEQ ID NO: 39095 - DNA, 1569 bp, Artificial Sequence
  Description of Artificial Sequence: Synthetic coding sequence
atgaatgaaagcccccagaccaatgagttcaagggcaccacagaggaggccccagccaaggagagcccccacaccagcgagttcaagggagctgccctggtgagccccatcagcaagtccatgctggagcggctgagcaagtttgaggtggaggatgctgaaaatgtggccagctatgacagcaagatcaagaagatcgtgcacagcatcgtgtcctcctttgccttcggcatctttggagtcttcctggtgctgctggatgtgaccctgctgctggccgacctgatcttcacagacagcaagctgtacatccccctggagtaccgcagcatcagcctggccatcggcctcttcttcctgatggatgtgctgctgcgggtgtttgtggagggccggcagcagtacttcagtgacctcttcaacatcctggacacagccatcatcgtcatccccctgctggtggatgtgatctacatcttctttgacatcaagctgctgaggaacatcccccgctggacccacctggtgcggctgctgcggctcatcatcctgatccgcatcttccacctgctgcaccagaagaggcagctggagaagctgatgaggcggctggtgtctgagaacaagaggcgctacaccagagatggctttgacctggacctgacctacgtgacagagcgcatcatcgccatgtccttccccagcagcggccggcagagcttctacagaaaccccatcgaggaggtggtgcgcttcctggacaagaagcacaggaaccactacagagtgtacaacctgtgcagcgagcgggcctatgaccccaagcacttccacaacagagtgagccgcatcatgattgatgaccacaacgtgcccaccctgcacgagatggtggtgttcaccaaggaggtgaatgagtggatggcccaggacctggagaacatcgtggccatccactgcaagggcggcaagggccgcacaggcaccatggtgtgtgccctgctgattgccagcgagatcttcctgacagctgaggagagcctgtactactttggagagaggaggaccaacaagacccacagcaacaagttccagggcgtggagacccccagccagaacagatatgtgggctactttgcccaggtgaagcacctgtacaactggaacctgcccccccggcgcatcctcttcatcaagcgcttcatcatctacagcatcagaggagatgtgtgtgacctgaaggtgcaggtggtgatggagaagaaggtggtgttcagcagcaccagcctgggcaactgcagcatcctgcatgacattgaaacagacaagatcctgatcaacgtgtatgatggcccccccctgtatgatgatgtgaaggtgcagttcttcagcagcaacctgcccaagtactatgacaactgccccttcttcttctggttcaacaccagcttcatccagaacaaccggctgtgcctgcccagaaatgagctggacaacccccacaagcagaaggcctggaagatctacccacctgagtttgctgtggagatcctgtttggagagaagtag

SEQ ID NO: 39096 - DNA, 1338 bp, Artificial Sequence; identical to SEQ ID NO: 39092
  Description of Artificial Sequence: Synthetic coding sequence

SEQ ID NO: 39097 - DNA, 1236 bp, Artificial Sequence
  Description of Artificial Sequence: Synthetic coding sequence
atgaatgaaagcccccagaccaatgagttcaagggcaccacagaggaggccccagccaaggagagcccccacaccagcgagttcaagggagctgccctggtgagccccatcagcaagtccatgctggagcggctgagcaagtttgaggtggaggatgctgaaaatgtggccagctatgagtggacccacctggtgcggctgctgcggctcatcatcctgatccgcatcttccacctgctgcaccagaagaggcagctggagaagctgatgaggcggctggtgtctgagaacaagaggcgctacaccagagatggctttgacctggacctgacctacgtgacagagcgcatcatcgccatgtccttccccagcagcggccggcagagcttctacagaaaccccatcgaggaggtggtgcgcttcctggacaagaagcacaggaaccactacagagtgtacaacctgtgcagcgagcgggcctatgaccccaagcacttccacaacagagtgagccgcatcatgattgatgaccacaacgtgcccaccctgcacgagatggtggtgttcaccaaggaggtgaatgagtggatggcccaggacctggagaacatcgtggccatccactgcaagggcggcaaaggaagaacaggcaccatggtgtgtgccctgctgattgccagcgagatcttcctgacagctgaggagagcctgtactactttggagagaggaggaccaacaagacccacagcaacaagttccagggcgtggagacccccagccagaaccgctacgtgggctactttgcccaggtgaagcacctgtacaactggaacctgcccccccggcgcatcctcttcatcaagcgcttcatcatctacagcatcagaggagatgtgtgtgacctgaaggtgcaggtggtgatggagaagaaggtggtgttcagcagcaccagcctgggcaactgcagcatcctgcatgacatcgagacagacaagatcctgatcaacgtgtatgatggcccccccctgtatgatgatgtgaaggtgcagttcttcagcagcaacctgcccaagtactatgacaactgccccttcttcttctggttcaacaccagcttcatccagaacaaccggctgtgcctgcccagaaatgagctggacaacccccacaagcagaaggcctggaagatctacccacctgagtttgctgtggagatcctgtttggagagaagtag

SEQ ID NO: 39098 - DNA, 1569 bp, Artificial Sequence; identical to SEQ ID NO: 39095
  Description of Artificial Sequence: Synthetic coding sequence

SEQ ID NO: 39099 - DNA, 975 bp, Artificial Sequence
  Description of Artificial Sequence: Synthetic coding sequence
atgaatgaaagcccccagaccaatgagttcaagggcaccacagaggaggccccagccaaggagagcccccacaccagcgagttcaagggagctgccctggtgagccccatcagcaagcgctggacccacctggtgcggctgctgcggctcatcatcctgatccgcatcttccacctgctgcaccagaagaggcagctggagaagctgatgaggcggctggtgtctgagaacaagaggcgctacaccagagatggctttgacctggacctgacctacgtgacagagcgcatcatcgccatgtccttccccagcagcggccggcagagcttctacagaaaccccatcgaggaggtggtgcgcttcctggacaagaagcacaggaaccactacagagtgtacaacctgtgcagcgagcgggcctatgaccccaagcacttccacaacagagtgagccgcatcatgattgatgaccacaacgtgcccaccctgcacgagatggtggtgttcaccaaggaggtgaatgagtggatggcccaggacctggagaacatcgtggccatccactgcaagggcggcaaaggaagaacaggcaccatggtgtgtgccctgctgattgccagcgagatcttcctgacagctgaggagagcctgtactactttggagagaggaggaccaacaagacccacagcaacaagttccagggcgtggagacccccagccagaaccgctacgtgggctactttgcccaggtgaagcacctgtacaactggaacctgcccccccggcgcatcctcttcatcaagcgcttcatcatctacagcatcagaggagatgtgtgtgacctgaaggtgcaggtggtgatggagaagaaggtggtgttcagcagcaccagcctgggcaactgcagccgggaggagggcagcacccgggccaactggaagggggagcccagcagaagacctgtgctggactag

SEQ ID NO: 39100 - DNA, 1236 bp, Artificial Sequence; identical to SEQ ID NO: 39097
  Description of Artificial Sequence: Synthetic coding sequence

SEQ ID NO: 39101 - DNA, 1257 bp, Artificial Sequence
  Description of Artificial Sequence: Synthetic coding sequence
atgtacagacctgcccgggtgaccagcaccagccgcttcctgaacccctacgtggtgtgcttcatcgtggtggccggcgtggtgatcctggccgtgaccatcgccctgctggtgtacttcctggcctttgaccagaagagctacttctaccgcagcagcttccagctgctgaatgtggagtacaacagccagctgaacagccctgccacccaggagtaccgcaccctgagcggccgcatcgagagcctcatcaccaagaccttcaaggagagcaacctgaggaaccagttcatccgggcccacgtggccaagctgcggcaggacggcagcggcgtgcgggcagatgtggtgatgaagttccagttcaccaggaacaacaatggagcctccatgaagagcagaattgaatctgtgctgcggcagatgctgaacaacagcggcaacctggagatcaaccccagcacagagatcaccagcctgacagaccaggccgccgccaactggctgatcaatgaatgtggggccggccctgacctgatcaccctgtctgagcagaggatcctgggcggcacagaagctgaggagggctcctggccctggcaggtgtccctgcggctgaacaatgcccaccactgcggcggcagcctcatcaacaacatgtggatcctgacagctgcccactgcttccgcagcaacagcaacccccgggactggatcgccaccagcggcatcagcaccaccttccccaagctgaggatgagggtgaggaacatcctgatccacaacaactacaagagcgccacccatgaaaatgacatcgccctggtgcggctggagaacagcgtgaccttcaccaaggacatccacagcgtgtgcctgcctgctgccacccagaacatccccccaggcagcacagcctacgtgacaggctggggcgcccaggagtatgccggccacacagtgcctgagctgcggcagggccaggtgcgcatcatcagcaatgatgtgtgcaatgccccccacagctacaacggggccatcctgagcggcatgctgtgtgccggcgtgccccagggcggcgtggatgcctgccagggcgacagcggcggccccctggtgcaggaggacagccggcggctgtggttcatcgtgggcatcgtgtcctggggagaccagtgtggcctgcctgacaagccaggagtgtacaccagggtgacagcctacctggactggatccggcagcagacaggcatctag

SEQ ID NO: 39102 - DNA, 906 bp, Artificial Sequence
  Description of Artificial Sequence: Synthetic coding sequence
atgaagttccagttcaccaggaacaacaacggggcctccatgaagagccgcatcgagagcgtgctgcggcagatgctgaacaacagcggcaacctggagatcaaccccagcacagagatcaccagcctgacagaccaggccgccgccaactggctgatcaatgaatgtggggccggccctgacctgatcaccctgtctgagcagaggatcctgggcggcacagaggccgaggagggctcctggccctggcaggtgtccctgcggctgaacaatgcccaccactgcggcggcagcctcatcaacaacatgtggatcctgacagctgcccactgcttccgcagcaacagcaacccccgggactggatcgccaccagcggcatcagcaccaccttccccaagctgaggatgagggtgaggaacatcctgatccacaacaactacaagagcgccacccatgaaaatgacatcgccctggtgcggctggagaacagcgtgaccttcaccaaggacatccacagcgtgtgcctgcctgctgccacccagaacatccccccaggcagcacagcctacgtgacaggctggggcgcccaggagtatgccggccacacagtgcctgagctgcggcagggccaggtgcgcatcatcagcaatgatgtgtgcaatgccccccacagctacaatggagccatcctgagcggcatgctgtgtgccggcgtgccccagggcggcgtggatgcctgccagggcgacagcggcggccccctggtgcaggaggacagccggcggctgtggttcatcgtgggcatcgtgtcctggggagaccagtgtggcctgcctgacaagccaggagtgtacaccagggtgacagcctacctggactggatccggcagcagacaggcatctag

SEQ ID NO: 39103 - DNA, 3060 bp, Artificial Sequence
  Description of Artificial Sequence: Synthetic coding sequence
atgggcagcaagaggggcatcagcagccgccaccacagcctgagcagctatgagatcatgtttgctgccctgtttgccatcctggtggtgctgtgtgccggcctgattgctgtgtcctgcctgaccatcaaggagagccagagaggagctgccctgggccagagccatgaggcccgggccaccttcaagatcaccagcggcgtgacctacaaccccaacctgcaggacaagctgtctgtggacttcaaggtgctggcctttgacctgcagcagatgattgatgagatcttcctgagcagcaacctgaagaatgagtacaagaacagccgggtgctgcagtttgaaaatggcagcatcatcgtggtgtttgacctcttctttgcccagtgggtgtctgatgaaaatgtgaaggaggagctgatccagggcctggaggccaacaagagcagccagctggtgaccttccacatcgacctgaacagcgtggacatcctggacaagctgaccaccaccagccacctggccaccccaggaaatgtgtccattgaatgtctgcccggcagcagcccctgcacagatgccctgacctgcatcaaggctgacctcttctgtgatggagaggtgaactgcccagatggcagtgatgaggacaacaagatgtgtgccaccgtgtgtgatggccgcttcctgctgaccggcagcagcggcagcttccaggccacccactaccccaagcccagcgagacctctgtggtgtgccagtggatcatccgggtgaaccagggcctgagcatcaagctgagctttgatgacttcaacacctactacacagacatcctggacatctatgaaggagtgggcagcagcaagatcctgcgggccagcatctgggagaccaaccctggcaccatccgcatcttcagcaaccaggtgacagccaccttcctgattgaaagtgatgaaagtgactatgtgggcttcaatgccacctacacagccttcaacagcagcgagctgaacaactatgagaagatcaactgcaactttgaagatggcttctgcttctgggtgcaggacctgaatgatgacaatgagtgggagcgcatccagggcagcaccttcagccccttcaccggccccaactttgaccacacctttggaaatgccagcggcttctacatcagcacccccaccggccctgggggccggcaggagcgggtgggcctgctgagcctgcccctggaccccaccctggagcccgcctgcctgtccttctggtaccacatgtacggggagaatgtgcacaagctgagcatcaacatcagcaatgaccagaacatggagaagacagtgttccagaaggagggcaactacggggacaactggaactacggccaggtgaccctgaatgagaccgtgaagttcaaggtggccttcaatgccttcaagaacaagatcctgagtgacatcgccctggatgacatcagcctgacctacggcatctgcaatggcagcctgtacccagagcccaccctggtgcccaccccacctcctgagctgcccacagactgtggcggcccctttgagctgtgggagcccaacaccaccttcagcagcaccaacttccccaacagctaccccaacctggccttctgtgtgtggatcctgaatgcccagaagggcaagaacatccagctgcacttccaggagtttgacctggagaacatcaatgatgtggtggagatcagagatggagaggaggccgacagcctgctgctggccgtgtacacaggccctggccctgtgaaggatgtgttcagcaccaccaacaggatgacagtgctgctgatcaccaatgatgtgctggcccggggcggcttcaaggccaacttcaccaccggctaccacctgggcatccctgagccctgcaaggctgaccacttccagtgcaagaatggagaatgtgtgcccctggtgaacctgtgtgatggccacctgcactgtgaagatggcagtgatgaagctgactgtgtgcgcttcttcaacggcaccaccaacaacaacggcctggtgcgcttccgcatccagagcatctggcacacagcctgtgccgagaactggaccacccagatcagcaatgatgtgtgccagctgctgggcctgggcagcggcaacagcagcaagcccatcttccccacagatggcggcccctttgtgaagctgaacacagccccagatggccacctgatcctgacccccagccagcagtgcctgcaggacagcctcatccggctgcagtgcaaccacaagagctgtgggaagaagctggccgcccaggacatcacccccaagatcgtgggcggcagcaatgccaaggagggcgcctggccctgggtggtgggcctgtactacggcggccgcctgctgtgtggggccagcctggtgtccagtgactggctggtgtctgctgcccactgtgtgtatggcaggaacctggagcccagcaagtggacagccatcctgggcctgcacatgaagagcaacctgaccagcccccagacagtgccccggctgattgatgagatcgtcatcaacccccactacaacagaagaaggaaggacaatgacatcgccatgatgcacctggagttcaaggtgaactacacagactacatccagcccatctgcctgcctgaggagaaccaggtgtttcctcctggcaggaactgcagcattgctggctggggcaccgtggtgtaccagggcaccacagccaacatcctgcaggaggctgatgtgcccctgctgagcaatgaacgctgccagcagcagatgcctgagtacaacatcacagagaacatgatctgtgccggctatgaggagggcggcatcgacagctgccagggcgacagcggcggccccctgatgtgccaggagaacaaccgctggttcctggccggcgtgaccagctttggctacaagtgtgccctgcccaacagacctggggtgtatgcccgggtgagccgcttcacagagtggatccagagcttcctgcactag

SEQ ID NO: 39104 - DNA, 2154 bp, Artificial Sequence
  Description of Artificial Sequence: Synthetic coding sequence
atgttccgcatcaccaacatcgagttcctgcctgagtaccggcagaaggagagccgggagttcctgtctgtgtccaggacagtgcagcaggtgatcaacctggtgtacaccaccagcgccttcagcaagttctatgagcagagcgtggtggctgatgtgagcaacaacaagggcggcctgctggtgcacttctggatcgtgtttgtgatgccccgggccaagggccacatcttctgtgaggactgtgtggccgccatcctgaaggacagcatccagaccagcatcatcaacagaacatctgtgggcagcctgcagggcctggccgtggacatggattctgtggtgctgaatgacaagggctgcagccagtacttctatgcagagcacctgagcctgcactaccccctggagatctctgctgccagcggccgcctgatgtgccacttcaagctggtggccatcgtgggctacctgatccggctgagcatcaagagcatccagatcgaggccgacaactgtgtgacagacagcctgaccatctatgacagcctgctgcccatccgcagcagcatcctgtaccgcatctgtgagcccaccaggaccctgatgagctttgtgtccaccaacaacctgatgctggtgaccttcaagagcccccacatccggcggctgagcggcatccgggcctactttgaagtcatccctgagcagaagtgtgagaacacagtgctggtgaaggacatcactggatttgagggcaagatcagcagcccctactaccccagctactacccacccaagtgcaagtgcacctggaagttccagaccagcctgagcaccctgggcatcgccctgaagttctacaactacagcatcaccaagaagtccatgaagggctgtgagcacggctggtgggagatcaatgagcacatgtactgcggcagctacatggaccaccagaccatcttccgggtgcccagccccctggtgcacatccagctgcagtgcagcagccggctgagtgacaagcccctgctggccgagtatggcagctacaacatcagccagccctgccctgtgggcagcttccgctgcagcagcggcctgtgtgtgccccaggcccagagatgtgatggagtgaatgactgctttgatgaaagtgatgagctgttctgtgtgagcccccagcctgcctgcaacaccagcagcttccggcagcacggccccctcatctgtgatggcttccgggactgtgaaaatggaagagatgagcagaactgcacccagagcatcccctgcaacaacagaaccttcaagtgtggaaatgacatctgcttcaggaagcagaatgccaagtgtgatggcaccgtggactgcccagatggcagtgatgaggagggctgcacctgcagccgcagcagcagcgccctgcaccgcatcattggaggaacagacaccctggagggcggctggccctggcaggtgtccctgcactttgtgggcagcgcctactgtggggccagcgtcatcagccgggagtggctgctgtctgctgcccactgcttccacggcaaccggctgagtgaccccaccccctggacagcccacctgggcatgtatgtgcagggcaatgccaagtttgtgtcccctgtgcggcgcatcgtggtgcatgagtactacaacagccagacctttgattatgacatcgccctgctgcagctgagcatcgcctggccagagaccctgaagcagctgatccagcccatctgcatcccccccaccggccagagggtgcgcagcggggagaagtgctgggtgacaggctggggcagaagacatgaagctgacaacaagggcagcctggtgctgcagcaggccgaggtggagctgattgaccagaccctgtgtgtgtccacctacggcatcatcaccagcaggatgctgtgtgccggcatcatgtctgggaagagagatgcctgcaagggggacagcggcggccccctgagctgcaggaggaagagtgatggcaagtggatcctgactggaattgtgtcctggggccacggcagcggccggcccaacttccctggggtgtacaccagggtgagcaactttgtgccctggatccacaagtatgtgcccagcctgctgtag

SEQ ID NO: 39105 - DNA, 2454 bp, Artificial Sequence
  Description of Artificial Sequence: Synthetic coding sequence
atggacaaggagaacagtgatgtgtctgctgccccagctgacctgaagatcagcaacatctctgtgcaggtggtgtctgcccagaagaagctgcccccaggaagaagaccaccccagaggcccatcggcaaggccaagcccaagaagcagagcaagaagaaggtgcccttctggaatgtgcagaacaagatcatcctcttcaccgtcttcctgttcatcctggccgtgattgcctggaccctgctgtggctgtacatcagcaagacagagagcaaggatgccttctactttgctggcatgttccgcatcaccaacatcgagttcctgcctgagtaccggcagaaggagagccgggagttcctgtctgtgtccaggacagtgcagcaggtgatcaacctggtgtacaccaccagcgccttcagcaagttctatgagcagagcgtggtggctgatgtgagcagcaacaacaagggcggcctgctggtgcacttctggatcgtgtttgtgatgccccgggccaagggccacatcttctgtgaggactgtgtggccgccatcctgaaggacagcatccagaccagcatcatcaacagaacatctgtgggcagcctgcagggcctggccgtggacatggattctgtggtgctgaatgacaagggctgcagccagtacttctatgcagagcacctgagcctgcactaccccctggagatctctgctgccagcggccgcctgatgtgccacttcaagctggtggccatcgtgggctacctgatccggctgagcatcaagagcatccagatcgaggccgacaactgtgtgacagacagcctgaccatctatgacagcctgctgcccatccgcagcagcatcctgtaccgcatctgtgagcccaccaggaccctgatgagctttgtgtccaccaacaacctgatgctggtgaccttcaagagcccccacatccggcggctgagcggcatccgggcctactttgaagtcatccctgagcagaagtgtgagaacacagtgctggtgaaggacatcactggatttgagggcaagatcagcagcccctactaccccagctactacccacccaagtgcaagtgcacctggaagttccagaccagcctgagcaccctgggcatcgccctgaagttctacaactacagcatcaccaagaagtccatgaagggctgtgagcacggctggtgggagatcaatgagcacatgtactgcggcagctacatggaccaccagaccatcttccgggtgcccagccccctggtgcacatccagctgcagtgcagcagccggctgagtgacaagcccctgctggccgagtatggcagctacaacatcagccagccctgccctgtgggcagcttccgctgcagcagcggcctgtgtgtgccccaggcccagagatgtgatggagtgaatgactgctttgatgaaagtgatgagctgttctgtgtgagcccccagcctgcctgcaacaccagcagcttccggcagcacggccccctcatctgtgatggcttccgggactgtgaaaatggaagagatgagcagaactgcacccagagcatcccctgcaacaacagaaccttcaagtgtggaaatgacatctgcttcaggaagcagaatgccaagtgtgatggcaccgtggactgcccagatggcagtgatgaggagggctgcacctgcagccgcagcagcagcgccctgcaccgcatcattggaggaacagacaccctggagggcggctggccctggcaggtgtccctgcactttgtgggcagcgcctactgtggggccagcgtcatcagccgggagtggctgctgtctgctgcccactgcttccacggcaaccggctgagtgaccccaccccctggacagcccacctgggcatgtatgtgcagggcaatgccaagtttgtgtcccctgtgcggcgcatcgtggtgcatgagtactacaacagccagacctttgattatgacatcgccctgctgcagctgagcatcgcctggccagagaccctgaagcagctgatccagcccatctgcatcccccccaccggccagagggtgcgcagcggggagaagtgctgggtgacaggctggggcagaagacatgaagctgacaacaagggcagcctggtgctgcagcaggccgaggtggagctgattgaccagaccctgtgtgtgtccacctacggcatcatcaccagcaggatgctgtgtgccggcatcatgtctgggaagagagatgcctgcaagggggacagcggcggccccctgagctgcaggaggaagagtgatggcaagtggatcctgactggaattgtgtcctggggccacggcagcggccggcccaacttccctggggtgtacaccagggtgagcaactttgtgccctggatccacaagtatgtgcccagcctgctgtag

SEQ ID NO: 39106 - DNA, 2496 bp, Artificial Sequence
  Description of Artificial Sequence: Synthetic coding sequence
atggacaaggagaacagtgatgtgtctgctgccccagctgacctgaagatcagcaacatctctgtgcaggtggtgtctgcccagaagaagctgcccccaggaagaagaccaccccagaggcccatcggcaaggccaagcccaagaagcagagcaagaagaaggtgcccttctggaatgtgcagaacaagatcatcctcttcaccgtcttcctgttcatcctggccgtgattgcctggaccctgctgtggctgtacatcagcaagacagagagcaaggatgccttctactttgctggcatgttccgcatcaccaacatcgagttcctgcctgagtaccggcagaaggagagccgggagttcctgtctgtgtccaggacagtgcagcaggtgatcaacctggtgtacaccaccagcgccttcagcaagttctatgagcagagcgtggtggctgatgtgagcagcaacaacaagggcggcctgctggtgcacttctggatcgtgtttgtgatgccccgggccaagggccacatcttctgtgaggactgtgtggccgccatcctgaaggacagcatccagaccagcatcatcaacagaacatctgtgggcagcctgcagggcctggccgtggacatggattctgtggtgaatgctgctggcctgcggagtgactacagcagcaccatcggcagcgctgacaagggctgcagccagtacttctatgcagagcacctgagcctgcactaccccctggagatctctgctgccagcggccgcctgatgtgccacttcaagctggtggccatcgtgggctacctgatccggctgagcatcaagagcatccagatcgaggccgacaactgtgtgacagacagcctgaccatctatgacagcctgctgcccatccgcagcagcatcctgtaccgcatctgtgagcccaccaggaccctgatgagctttgtgtccaccaacaacctgatgctggtgaccttcaagagcccccacatccggcggctgagcggcatccgggcctactttgaagtcatccctgagcagaagtgtgagaacacagtgctggtgaaggacatcactggatttgagggcaagatcagcagcccctactaccccagctactacccacccaagtgcaagtgcacctggaagttccagaccagcctgagcaccctgggcatcgccctgaagttctacaactacagcatcaccaagaagtccatgaagggctgtgagcacggctggtgggagatcaatgagcacatgtactgcggcagctacatggaccaccagaccatcttccgggtgcccagccccctggtgcacatccagctgcagtgcagcagccggctgagtgacaagcccctgctggccgagtatggcagctacaacatcagccagccctgccctgtgggcagcttccgctgcagcagcggcctgtgtgtgccccaggcccagagatgtgatggagtgaatgactgctttgatgaaagtgatgagctgttctgtgtgagcccccagcctgcctgcaacaccagcagcttccggcagcacggccccctcatctgtgatggcttccgggactgtgaaaatggaagagatgagcagaactgcacccagagcatcccctgcaacaacagaaccttcaagtgtggaaatgacatctgcttcaggaagcagaatgccaagtgtgatggcaccgtggactgcccagatggcagtgatgaggagggctgcacctgcagccgcagcagcagcgccctgcaccgcatcattggaggaacagacaccctggagggcggctggccctggcaggtgtccctgcactttgtgggcagcgcctactgtggggccagcgtcatcagccgggagtggctgctgtctgctgcccactgcttccacggcaaccggctgagtgaccccaccccctggacagcccacctgggcatgtatgtgcagggcaatgccaagtttgtgtcccctgtgcggcgcatcgtggtgcatgagtactacaacagccagacctttgattatgacatcgccctgctgcagctgagcatcgcctggccagagaccctgaagcagctgatccagcccatctgcatcccccccaccggccagagggtgcgcagcggggagaagtgctgggtgacaggctggggcagaagacatgaagctgacaacaagggcagcctggtgctgcagcaggccgaggtggagctgattgaccagaccctgtgtgtgtccacctacggcatcatcaccagcaggatgctgtgtgccggcatcatgtctgggaagagagatgcctgcaagggggacagcggcggccccctgagctgcaggaggaagagtgatggcaagtggatcctgactggaattgtgtcctggggccacggcagcggccggcccaacttccctggggtgtacaccagggtgagcaactttgtgccctggatccacaagtatgtgcccagcctgctgtag

SEQ ID NO: 39107 - DNA, 2532 bp, Artificial Sequence
  Description of Artificial Sequence: Synthetic coding sequence
atggacaaggagaacagtgatgtgtctgctgccccagctgacctgaagatcagcaacatctctgtgcaggtggtgtctgcccagaagaagctgcctgtgcggcggccccccctgcctggaagaaggctgcccctgcccggccggcggcccccccagaggcccatcggcaaggccaagcccaagaagcagagcaagaagaaggtgcccttctggaatgtgcagaacaagatcatcctcttcaccgtcttcctgttcatcctggccgtcatcgcctggaccctgctgtggctgtacatcagcaagacagagagcaaggatgccttctactttgctggcatgttccgcatcaccaacatcgagttcctgcctgagtaccggcagaaggagagccgggagttcctgtctgtgtccaggacagtgcagcaggtgatcaacctggtgtacaccaccagcgccttcagcaagttctatgagcagagcgtggtggctgatgtgagcagcaacaacaagggcggcctgctggtgcacttctggatcgtgtttgtgatgccccgggccaagggccacatcttctgtgaggactgtgtggccgccatcctgaaggacagcatccagaccagcatcatcaacagaacatctgtgggcagcctgcagggcctggccgtggacatggacagcgtggtgctgaatgccggcctgcggagtgactacagcagcaccatcggcagtgacaagggctgcagccagtacttctatgcagagcacctgagcctgcactaccccctggagatctctgctgccagcggccgcctgatgtgccacttcaagctggtggccatcgtgggctacctgatccggctgagcatcaagagcatccagatcgaggccgacaactgtgtgacagacagcctgaccatctatgacagcctgctgcccatccgcagcagcatcctgtaccgcatctgtgagcccaccaggaccctgatgagctttgtgtccaccaacaacctgatgctggtgaccttcaagagcccccacatccggcggctgagcggcatccgggcctactttgaagtcatccctgagcagaagtgtgagaacacagtgctggtgaaggacatcactggatttgagggcaagatcagcagcccctactaccccagctactacccacccaagtgcaagtgcacctggaagttccagaccagcctgagcaccctgggcatcgccctgaagttctacaactacagcatcaccaagaagtccatgaagggctgtgagcacggctggtgggagatcaatgagcacatgtactgcggcagctacatggaccaccagaccatcttccgggtgcccagccccctggtgcacatccagctgcagtgcagcagccggctgagtgacaagcccctgctggccgagtatggcagctacaacatcagccagccctgccctgtgggcagcttccgctgcagcagcggcctgtgtgtgccccaggcccagagatgtgatggagtgaatgactgctttgatgaaagtgatgagctgttctgtgtgagcccccagcctgcctgcaacaccagcagcttccggcagcacggccccctcatctgtgatggcttccgggactgtgaaaatggaagagatgagcagaactgcacccagagcatcccctgcaacaacagaaccttcaagtgtggaaatgacatctgcttcaggaagcagaatgccaagtgtgatggcaccgtggactgcccagatggcagtgatgaggagggctgcacctgcagccgcagcagcagcgccctgcaccgcatcattggaggaacagacaccctggagggcggctggccctggcaggtgtccctgcactttgtgggcagcgcctactgtggggccagcgtcatcagccgggagtggctgctgtctgctgcccactgcttccacggcaaccggctgagtgaccccaccccctggacagcccacctgggcatgtatgtgcagggcaatgccaagtttgtgtcccctgtgcggcgcatcgtggtgcatgagtactacaacagccagacctttgattatgacatcgccctgctgcagctgagcatcgcctggccagagaccctgaagcagctgatccagcccatctgcatcccccccaccggccagagggtgcgcagcggggagaagtgctgggtgacaggctggggcagaagacatgaagctgacaacaagggcagcctggtgctgcagcaggccgaggtggagctgattgaccagaccctgtgtgtgtccacctacggcatcatcaccagcaggatgctgtgtgccggcatcatgtctgggaagagagatgcctgcaagggggacagcggcggccccctgagctgcaggaggaagagtgatggcaagtggatcctgactggaattgtgtcctggggccacggcagcggccggcccaacttccctggggtgtacaccagggtgagcaactttgtgccctggatccacaagtatgtgcccagcctgctgtag

SEQ ID NO: 39108 - DNA, 3180 bp, Artificial Sequence
  Description of Artificial Sequence: Synthetic coding sequence
atggagcccaccgtggctgatgtgcacctggtgcccaggaccaccaaggaggtgcctgccctggatgctgcctgctgccgggccgccagcattggagtggtggccaccagcctggtggtgctgaccctgggcgtgctgctggccttcctgagcacccagggcttccacgtggaccacacagctgagctgcggggcatccgctggaccagcagcctgcggcgggagaccagtgactaccacaggaccctgacccccaccctggaggccctgctgcacttcctgctgcggcccctgcagaccctgagcctgggcctggaggaggagctgctgcagaggggcatccgggcccggctgcgggagcacggcatcagcctggccgcctacggcaccatcgtgtctgctgagctgaccggccgccacaagggccccctggccgagcgggacttcaagagcggccgctgccccggcaacagcttcagctgtggcaacagccagtgtgtgaccaaggtgaacccagaatgtgatgaccaggaggactgcagtgatggcagtgatgaggcccactgtgaatgtggcctgcagcctgcctggaggatggccggcagaattgtgggcggcatggaggccagccctggagagttcccctggcaggccagcctgcgggagaacaaggagcacttctgtggggccgccatcatcaatgcccgctggctggtgtctgctgcccactgcttcaatgagttccaggaccccaccaagtgggtggcctacgtgggcgccacctacctgagcggcagcgaggccagcacagtgcgggcccaggtggtgcagatcgtgaagcaccccctgtacaatgctgacacagctgactttgatgtggccgtgctggagctgaccagccccctgcccttcggccgccacatccagcctgtgtgcctgcctgctgccacccacatcttcccccccagcaagaagtgcctgatcagcggctggggctacctgaaggaggacttcctggtgaagccagaggtgctgcagaaggccaccgtggagctgctggaccaggccctgtgtgccagcctgtatggccacagcctgacagacaggatggtgtgtgccggctacctggatggcaaggtggacagctgccagggcgacagcggcggccccctggtgtgtgaggagcccagcggccgcttcttcctggccggcatcgtgtcctggggcatcggctgtgccgaggcccggcggcctggggtgtatgcccgggtgacccggctgcgggactggatcctggaggccaccaccaaggcctccatgcccctggcccccaccatggccccagccccagctgcccccagcacagcctggcccaccagccctgagagccctgtggtgtccacccccaccaagtccatgcaggccctgagcacagtgcccctggactgggtgacagtgcccaagctgcaggagtgtggggcccggcctgccatggagaagcccaccagggtggtgggcggctttggagctgccagcggggaggtgccctggcaggtgtccctgaaggagggcagccgccacttctgtggggccaccgtggtgggggaccgctggctgctgtctgctgcccactgcttcaaccacaccaaggtggagcaggtgcgggcccacctgggcacagccagcctgctgggcctgggcggcagccctgtgaagattggcctgcggcgggtggtgctgcaccccctgtacaaccctggcatcctggactttgacctggccgtgctggagctggccagccccctggccttcaacaagtacatccagcctgtgtgcctgcccctggccatccagaagtttcctgtgggcaggaagtgcatgatcagcggctggggcaacacccaggagggcaatgccaccaagccagagctgctgcagaaggcctctgtgggcatcatcgaccagaagacctgcagcgtgctgtacaacttcagcctgacagacaggatgatctgtgccggcttcctggagggcaaggtggacagctgccagggcgacagcggcggccccctggcctgtgaggaggcccctggggtcttctacctggccggcatcgtgtcctggggcatcggctgtgcccaggtgaagaagccaggagtgtacacccgcatcacccggctgaagggctggatcctggagatcatgagcagccagcccctgcccatgagcccccccagcaccaccaggatgctggccaccaccagccccaggaccacagctggcctgactgtgcctggggccacccccagccggcccacccctggggccgccagccgggtgacaggccagcctgccaacagcaccctgtctgctgtgtccaccacagcccggggccagacccccttcccagatgcccctgaggccaccacccacacccagctgcctgactgtggcctggccccagctgccctgaccagaattgtgggcggcagcgctgctggccgcggggagtggccctggcaggtgtccctgtggctgcggcggcgggagcaccgctgtggggctgtgctggtggccgagcgctggctgctgtctgctgcccactgctttgatgtgtatggagaccccaagcagtgggccgccttcctgggcacccccttcctgtctggagctgagggccagctggagcgggtggcccgcatctacaagcaccccttctacaacctgtacaccctggactatgatgtggccctgctggagctggccggccctgtgcggcgcagccggctggtgcggcccatctgcctgcctgagcccgccccccggcccccagatggcacccgctgtgtgatcaccggctggggctctgtgcgggagggcggctccatggcccggcagctgcagaaggctgctgtgcggctgctgtctgagcagacctgccgccgcttctaccctgtgcagatcagcagcaggatgctgtgtgccggcttcccccagggcggcgtggacagctgcagcggagatgctgggggccccctggcctgccgggagcccagcggccgctgggtgctgactggagtgacctcctggggctacggctgcggccggccccacttccctggggtgtacaccagggtggccgctgtgcggggctggattggccagcacatccaggagtag

SEQ ID NO: 39109 - DNA, 1596 bp, Artificial Sequence
  Description of Artificial Sequence: Synthetic coding sequence
atggagcccaccgtggctgatgtgcacctggtgcccaggaccaccaaggaggtgcctgccctggatgctgcctgctgccgggccgccagcattggagtggtggccaccagcctggtggtgctgaccctgggcgtgctgctggccttcctgagcacccagggcttccacgtggaccacacagctgagctgcggggcatccgctggaccagcagcctgcggcgggagaccagtgactaccacaggaccctgacccccaccctggaggccctgtttgtgagcagcttccagaagacagagctggaggccagctgtgtgggctgcagcgtgctgaactacagagatggcaacagctctgtgctggtgcacttccagctgcacttcctgctgcggcccctgcagaccctgagcctgggcctggaggaggagctgctgcagaggggcatccgggcccggctgcgggagcacggcatcagcctggccgcctacggcaccatcgtgtctgctgagctgaccggccgccacaagggccccctggccgagcgggacttcaagagcggccgctgccccggcaacagcttcagctgtggcaacagccagtgtgtgaccaaggtgaacccagaatgtgatgaccaggaggactgcagtgatggcagtgatgaggcccactgtgaatgtggcctgcagcctgcctggaggatggccggcagaattgtgggcggcatggaggccagccctggagagttcccctggcaggccagcctgcgggagaacaaggagcacttctgtggggccgccatcatcaatgcccgctggctggtgtctgctgcccactgcttcaatgagttccaggaccccaccaagtgggtggcctacgtgggcgccacctacctgagcggcagcgaggccagcacagtgcgggcccaggtggtgcagatcgtgaagcaccccctgtacaatgctgacacagctgactttgatgtggccgtgctggagctgaccagccccctgcccttcggccgccacatccagcctgtgtgcctgcctgctgccacccacatcttcccccccagcaagaagtgcctgatcagcggctggggctacctgaaggaggacttcctggtgaagccagaggtgctgcagaaggccaccgtggagctgctggaccaggccctgtgtgccagcctgtatggccacagcctgacagacaggatggtgtgtgccggctacctggatggcaaggtggacagctgccagggcgacagcggcggccccctggtgtgtgaggagcccagcggccgcttcttcctggccggcatcgtgtcctggggcatcggctgtgccgaggcccggcggcctggggtgtatgcccgggtgacccggctgcgggactggatcctggaggccaccaccaaggcctccatgcccctggcccccaccatggccccagccccagctgcccccagcacagcctggcccaccagccctgagagccctgtggtgtccacccccaccaagtccatgcaggccctgagcacagtgcccctggactgggtgacagtgcccaagctgcagggcatctttggagctgagaggtag

SEQ ID NO: 39110 - DNA, 405 bp, Artificial Sequence
  Description of Artificial Sequence: Synthetic coding sequence
atgacagaggagcccatcaaggagatcctgggcgcccccaaggcccacatggccgccaccatggagaagagccccaagtctgaggtggtgatcaccaccgtgcccctggtgtctgagatccagctgatggccgccaccggcggcacagagctgagctgctaccgctgcatcatcccctttgctgtggtggtgttcatcgccggcatcgtggtgacagctgtggcctacagcttcaacagccacggcagcatcatcagcatcttcggcctggtggtgctgagcagcggcctcttcctgctggccagcagcgccctgtgctggaaggtgcggcagaggagcaagaaggccaagaggcgggagagccagacagccctggtggccaaccagaggagcctgtttgcctag

SEQ ID NO: 39111 - DNA, 405 bp, Artificial Sequence; identical to SEQ ID NO: 39110
  Description of Artificial Sequence: Synthetic coding sequence

SEQ ID NO: 39112 - DNA, 405 bp, Artificial Sequence; identical to SEQ ID NO: 39110
  Description of Artificial Sequence: Synthetic coding sequence

SEQ ID NO: 39113 - DNA, 633 bp, Artificial Sequence; identical to SEQ ID NO: 37479
  Description of Artificial Sequence: Synthetic coding sequence

SEQ ID NO: 39114 - DNA, 600 bp, Artificial Sequence
  Description of Artificial Sequence: Synthetic coding sequence
atgggcgctgctgtgctgtgtgccagcttcatgagctttggagtgaagaggcgctggtttgccctgggcgccgccctgcagctggccatcagcacctacgccgcctacatcggcggctacgtgcactatggagactggctgaaggtgaggatgtacagcaggacagtggccatcattggaggcttcctggtgctggccagcggggccggggagctgtacagaaggaagcccaggagccgcagcctgcagagcacaggccaggtgttcctgggcatctacctgatctgtgtggcctacagcctgcagcacagcaaggaggaccggctggcctacctgaaccacctgcccggcggggagctgatgatccagctgttctttgtgctgtatggcatcctggccctggccttcctgagcggctactacgtgaccctggccgcccagatcctggccgtgctgctgccccctgtgatgctgctgattgatggaaatgtggcctactggcacaacaccaggagagtggagttctggaaccagatgaagctgctgggggagagcgtgggcatctttggaacagctgtgatcctggccacagatggatag

SEQ ID NO: 39115 - DNA, 774 bp, Artificial Sequence
  Description of Artificial Sequence: Synthetic coding sequence
atggccagcaagattggcagccgccgctggatgctgcagctgatcatgcagctgggctctgtgctgctgacccgctgccccttctggggctgcttcagccagctgatgctgtatgcagagcgggcagaggcccggaggaagccagacatccctgtgccctacctgtactttgacatgggcgctgctgtgctgtgtgccagcttcatgagctttggagtgaagaggcgctggtttgccctgggcgccgccctgcagctggccatcagcacctacgccgcctacatcggcggctacgtgcactatggagactggctgaaggtgaggatgtacagcaggacagtggccatcattggaggcttcctggtgctggccagcggggccggggagctgtacagaaggaagcccaggagccgcagcctgcagagcacaggccaggtgttcctgggcatctacctgatctgtgtggcctacagcctgcagcacagcaaggaggaccggctggcctacctgaaccacctgcccggcggggagctgatgatccagctgttctttgtgctgtatggcatcctggccctggccttcctgagcggctactacgtgaccctggccgcccagatcctggccgtgctgctgccccctgtgatgctgctgattgatggaaatgtggcctactggcacaacaccaggagagtggagttctggaaccagatgaagctgctgggggagagcgtgggcatctttggaacagctgtgatcctggccacagatggatag

SEQ ID NO: 39116 - DNA, 1491 bp, Artificial Sequence
  Description of Artificial Sequence: Synthetic coding sequence
atggccggggagatcacagagaccggggagctgtacagcagctatgtgggcctggtgtacatgttcaacctgattgtgggcaccggggccctgaccatgcccaaggcctttgccacagctggctggctggtgtccctggtgctgctggtgttcctgggcttcatgagctttgtgaccaccaccttcgtcatcgaggccatggctgctgccaatgcccagctgcactggaagaggatggagaacctgaaggaggaggaggatgatgacagcagcacagccagtgacagtgatgtgctgatccgggacaactatgaaagagctgagaagaggcccatcctgtctgtgcagaggcggggcagccccaacccctttgagatcacagacagagtggagatgggccagatggcctccatgttcttcaacaaggtgggcgtgaacctcttctacttctgcatcatcgtgtacctgtatggagacctggccatctatgctgctgctgtgcccttcagcctgatgcaggtgacctgcagcgccactggaaatgacagctgtggggtggaggccgacaccaagtacaatgacacagaccgctgctggggccccctgcggcgggtggatgcctaccgcatctacctggccatcttcaccctgctgctgggccccttcaccttctttgatgtgcagaagaccaagtacctgcagatcctgaccagcctgatgcgctggatcgcctttgctgtgatgattgtgctggccctgatccgcatcggccacggccagggcgagggccacccccccctggccgacttctctggagtgaggaacctgtttggagtgtgtgtgtacagcttcatgtgccagcacagcctgcccagcctcatcacccctgtgagcagcaagaggcacctgacccggctggtgttcctggactatgtgctgatcctggccttctacggcctgctgtccttcaccgccatcttctgcttccggggggacagcctgatggacatgtacaccctgaactttgcccgctgtgatgtggtgggcctggccgctgtgcgcttcttcctgggcctcttccctgtgttcaccatcagcaccaacttccccatcatcgctgtgaccctgaggaacaactggaagaccctcttccaccgggagggcggcacctacccctgggtggtggacagagtggtgttccccaccatcaccctggtgccccctgtgctggtggccttctgcacccatgacctggagagcctggtgggcatcactggagcctatgccggcaccggcatccagtatgtgatcccagccttcctggtgtaccactgccggcgggacacccagctggccttcggctgcggcgtgagcaacaagcacaggagccccttccgccacaccttctgggtgggctttgtgctgctgtgggccttcagctgcttcatctttgtgacagccaacatcatcctgtctgagaccaagctgtag

SEQ ID NO: 39117 - DNA, 984 bp, Artificial Sequence
  Description of Artificial Sequence: Synthetic coding sequence
atggccggggagatcacagagaccggggagctgtacagcagctatgtgtttgtgcgggtggtgaagcccaacaagatcgccatgctgttcatcatgctgatccctggctgggcccgctggctgacccctgtgatcccagccctgtgggaggccgaggccggccgcagccctgaggtgcgcagcagcaggcctgcctggcccacctgctttgtgaccaccacctttgtgattgaggccatggccgccgccaatgcccagctgcactggaagaggatggagaacctgaaggaggaggaggatgatgacagcagcacagccagtgacagtgatgtgctgatccgggacaactatgagcgggcagagaagaggcccatcctgtctgtgcagaggcggggcagccccaacccctttgagatcacagacagagtggagatgggccagatggcctccatgttcttcaacaaggtgggcgtgaacctcttctacttctgcatcatcgtgtacctgtatggagacctggccatctatgctgctgctgtgcccttcagcctgatgcaggtgacctgcagcgccactggaaatgacagctgtggggtggaggccgacaccaagtacaatgacacagaccgctgctggggccccctgcggcgggtggatgcctaccgcatctacctggccatcttcaccctgctgctgggccccttcaccttctttgatgtgcagaagaccaagtacctgcagatcctgaccagcctgatgcgctggattgatggccccccaggctctgtgatgggccgggcagaagaagatgccagccctgcctggcccaggagccgctgccgctgtggcggcaagctgaagctgaacagcctgtaccccaccagcgccacctgcatggccccagatgcccctggggccggccaggtgaaggtgggcgtgaacttcctgtgcctgcccccccacaggagcacccggcccacctag

SEQ ID NO: 39118 - DNA, 390 bp, Artificial Sequence
  Description of Artificial Sequence: Synthetic coding sequence
atgctgctgaaggtgcggcgggccagcctgaagcccccagccaccccccaccagggcgccttccgggctggaaatgtgattggccagctgatctacctgctgacctggagcctcttcaccgcctggctgcggccccccaccctgctgcagggccccaggaccagcccccagggcagcccccccaggagcccctggggagactgtgccgagcccagctgcctgtgtgagatgaagatcagaagaagaagacatgagggccctgcctggggccagagcggcttcctggccggcggcctgcacctggtgcccagcagcctgagcctggccgcctgtggggtggtgaggatgaagggcctgtggggccgcggggccggcatccggggccgctag

SEQ ID NO: 39119 - DNA, 789 bp, Artificial Sequence
  Description of Artificial Sequence: Synthetic coding sequence
atgggcaagaccttcagccagctgggctcctggagagaagatgagaacaagagcatcctgagcagcaagccagccatcggcagcaaggctgtgaactacagcagcacaggcagcagcaagagcttctgcagctgtgtgccctgtgagggcacagcagatgccagctttgtgacctgccccacctgccagggcagcggcaagatcccccaggagctggagaagcagctggtggccctgatcccctacggggaccagaggctgaagcccaagcacaccaagctgtttgtgttcctggccgtgctgatctgcctggtgaccagcagcttcatcgtgttcttcctgttccccaggagcgtcatcgtgcagcctgctggcctgaacagcagcacagtggcctttgatgaggccgacatctacctgaacatcaccaacatcctgaacatcagcaatggaaactactaccccatcatggtgacccagctgaccctggaggtgctgcacctgagcctggtggtgggccaggtgagcaacaacctgctgctgcacatcggccccctggccagcgagcagatgttttatgctgtggccaccaagatcagagatgagaacacctacaagatctgcacctggctggagatcaaggtgcaccacgtgctgctgcacatccagggcaccctgacctgcagctacctgagccacagcgagcagctggtgttccagagctatgaatatgtggactgcagaggaaatgcctctgtgccccaccagctgaccccccaccccccatag

SEQ ID NO: 39120 - DNA, 648 bp, Artificial Sequence
  Description of Artificial Sequence: Synthetic coding sequence
atgggcaagaccttcagccagctgggctcctggagagaagatgagaacaagagcatcctgagcagcaagccagccatcggcagcaaggctgtgaactacagcagcacaggcagcagcaagagcttctgcagctgtgtgccctgtgagggcacagcagatgccagctttgtgacctgccccacctgccagggcagcggcaagatcccccaggagctggagaagcagctggtggccctgatcccctacggggaccagaggctgaagcccaagcacaccaagctgtttgtgttcctggccgtgctgatctgcctggtgaccagcagcttcatcgtgttcttcctgttccccaggagcgtcatcgtgcagcctgctggcctgaacagcagcacagtggcctttgatgaggccgacatctacctgaacatcaccatgttttatgctgtggccaccaagatcagagatgagaacacctacaagatctgcacctggctggagatcaaggtgcaccacgtgctgctgcacatccagggcaccctgacctgcagctacctgagccacagcgagcagctggtgttccagagctatgaatatgtggactgcagaggaaatgcctctgtgccccaccagctgaccccccaccccccatag

SEQ ID NO: 39121 - DNA, 645 bp, Artificial Sequence
  Description of Artificial Sequence: Synthetic coding sequence
atgggcacagcagatgccagctttgtgacctgccccacctgccagggcagcggcaagatcccccaggagctggagaagcagctggtggccctgatcccctacggggaccagaggctgaagcccaagcacaccaagctgtttgtgttcctggccgtgctgatctgcctggtgaccagcagcttcatcgtgttcttcctgttccccaggagcgtcatcgtgcagcctgctggcctgaacagcagcacagtggcctttgatgaggccgacatctacctgaacatcaccaacatcctgaacatcagcaatggaaactactaccccatcatggtgacccagctgaccctggaggtgctgcacctgagcctggtggtgggccaggtgagcaacaacctgctgctgcacatcggccccctggccagcgagcagatgttttatgctgtggccaccaagatcagagatgagaacacctacaagatctgcacctggctggagatcaaggtgcaccacgtgctgctgcacatccagggcaccctgacctgcagctacctgagccacagcgagcagctggtgttccagagctatgaatatgtggactgcagaggaaatgcctctgtgccccaccagctgaccccccaccccccatag

SEQ ID NO: 39122 - DNA, 696 bp, Artificial Sequence
  Description of Artificial Sequence: Synthetic coding sequence
atgggcagccagcacagcgctgctgcccggcccagcagctgcaggaggaagcaggaggatgacagagatggcctgctggccgagcgggagcaggaggaggccatcgcccagttcccctacgtggagttcaccggccgggacagcatcacctgcctgacctgccagggcaccggctacatccccacagagcaggtgaatgagctggtggccctgatcccccacagcgaccagaggctgcggccccagaggaccaagcagtatgtgctgctgagcatcctgctgtgcctgctggccagcggcctggtggtgttcttcctgttcccccacagcgtgctggtggatgatgatggcatcaaggtggtgaaggtgaccttcaacaagcaggacagcctggtgatcctgaccatcatggccaccctgaagatccggaacagcaacttctacacagtggccgtgaccagcctgagcagccagatccagtacatgaacacagtggtgaacttcaccgggaaggccgagatgggcggccccttctcctatgtgtacttcttctgcaccgtgcctgagatcctggtgcacaacatcgtcatcttcatgaggacctctgtgaagatctcctacatcggcctgatgacccagagcagcctggagacccaccactacgtggactgtggcggcaacagcacagccatctag

SEQ ID NO: 39123 - DNA, 753 bp, Artificial Sequence
  Description of Artificial Sequence: Synthetic coding sequence
atgggcagccagcacagcgctgctgcccggcccagcagctgcaggaggaagcaggaggatgacagagatggcctgctggccgagcgggagcaggaggaggccatcgcccagttcccctacgtggagttcaccggccgggacagcatcacctgcctgacctgccagggcaccggctacatccccacagagcaggtgaatgagctggtggccctgatcccccacagcgaccagaggctgcggccccagaggaccaagcagtatgtgctgctgagcatcctgctgtgcctgctggccagcggcctggtggtgttcttcctgttcccccacagcgtgctggtggatgatgatggcatcaaggtggtgaaggtgaccttcaacaagcaggacagcctggtgatcctgaccatcatggccaccctgaagatccggaacagcaacttctacacagtggccgtgaccagcctgagcagccagatccagtacatgaacacagtggtgtccacctacgtgaccaccaacgtgtccctcatcccccccaggtctgagcagctggtgaacttcaccgggaaggccgagatgggcggccccttctcctatgtgtacttcttctgcaccgtgcctgagatcctggtgcacaacatcgtcatcttcatgaggacctctgtgaagatctcctacatcggcctgatgacccagagcagcctggagacccaccactacgtggactgtggcggcaacagcacagccatctag

SEQ ID NO: 39124 - DNA, 696 bp, Artificial Sequence; identical to SEQ ID NO: 39122
  Description of Artificial Sequence: Synthetic coding sequence

SEQ ID NO: 39125 - DNA, 753 bp, Artificial Sequence; identical to SEQ ID NO: 39123
  Description of Artificial Sequence: Synthetic coding sequence

SEQ ID NO: 39126 - DNA, 441 bp, Artificial Sequence
  Description of Artificial Sequence: Synthetic coding sequence
atgggccgggtgtctggcctggtgcccagccgcttcctgaccctgctggcccacctggtggtggtgatcaccctcttctggagccgggacagcaacatccaggcctgcctgcccctgaccttcaccccagaggagtatgacaagcaggacatccaccccctgcccctgtgccgcctggtggccgccctgtctgtgaccctgggcctgtttgctgtggagctggccggcttcctgtctggagtgtccatgttcaacagcacccagagcctcatcagcattggagcccactgcagcgcctctgtggccctgtccttcttcatctttgagcgctgggagtgcaccacctactggtacatctttgtgttctgcagcgccctgcctgctgtgacagagatggccctgtttgtgacagtgtttggcctgaagaagaagcccttctag

SEQ ID NO: 39127 - DNA, 492 bp, Artificial Sequence
  Description of Artificial Sequence: Synthetic coding sequence
atgggccgggtgtctggcctggtgcccagccgcttcctgaccctgctggcccacctggtggtggtgatcaccctcttctggagccgggtgcggcccacagctgccctgaaccccagccccttccccagcctgagcggccccagccccaccctgcccccaccttctgtgctgcccagctgggtgttcctgtttcctgctgcccccaggcctgccctgcagcctgcccccttcagcctgctgtctgctggctggtggcccaggagcctgagcccctgggccagcctgcagtggagctggcctgtgagcagccaggagagcccctgcagcacagccccccgggccagctctgtgtccttcctgcctgcccacctgagccacaccacccacttctaccaggacagcctgcagcccccagacaccatcgtgtctgctgtggccaaccccagcagcagcaagatcttcaatgatgtgctgaacccagctgtgtactag

SEQ ID NO: 39128 - DNA, 423 bp, Artificial Sequence
  Description of Artificial Sequence: Synthetic coding sequence
atgggccgggtgtctggcctggtgcccagccgcttcctgaccctgctggcccacctggtggtggtgatcaccctcttctggagccgggacagcaacatccaggcctgcctgcccctgaccttcaccccagaggagtatgacaagcaggacatccagctggtggccgccctgtctgtgaccctgggcctgtttgctgtggagctggccggcttcctgtctggagtgtccatgttcaacagcacccagagcctcatcagcattggagcccactgcagcgcctctgtggccctgtccttcttcatctttgagcgctgggagtgcaccacctactggtacatctttgtgttctgcagcgccctgcctgctgtgacagagatggccctgtttgtgacagtgtttggcctgaagaagaagcccttctag

SEQ ID NO: 39129 - DNA, 420 bp, Artificial Sequence
  Description of Artificial Sequence: Synthetic coding sequence
atgggccgggtgtctggcctggtgcccagccgcttcctgaccctgctggcccacctggtggtggtgatcaccctcttctggagccgggacagcaacatccaggcctgcctgcccctgaccttcaccccagaggagtatgacaagcaggacatccaccccctgcccctgtgccgcctggtggccgccctgtctgtgaccctgggcctgtttgctgtggagctggccggcttcctgtctggagtgtccatgttcaacagcacccagagcctcatcagcattggagcccactgcagcgcctctgtggccctgtccttcttcatctttgagcgctgggagtgcaccacctactgtgccctgcctgctgtgacagagatggccctgtttgtgacagtgtttggcctgaagaagaagcccttctag

SEQ ID NO: 39130 - DNA, 1728 bp, Artificial Sequence
  Description of Artificial Sequence: Synthetic coding sequence
atgaagaggagcctgcaggccctgtactgccagctgctgtccttcctgctgatcctggccctgacagaggccctggcctttgccatccaggagcccagcccccgggagagcctgcaggtgctgcccagcggcaccccacctggcaccatggtgacagccccccacagcagcaccaggcacacctctgtggtgatgctgacccccaacccagatggcccccccagccaggccgccgcccccatggccacccccacccccagggctgagggccacccccccacccacaccatcagcaccatcgccgccaccgtgacagccccccacagcgagagcagcctgagcactggacctgccccagctgccatggccaccaccagcagcaagccagagggccggccccggggccaggccgcccccaccatcctgctgaccaagcccccaggggccaccagccggcccaccacagccccacccaggaccaccaccaggaggcctccccggcccccaggcagcagcaggaagggggccggcaacagcagcaggcctgtgcccccagcccctgggggccacagccgcagcaaggagggccagaggggcaggaaccccagcagcacccccctgggccagaagaggcccctgggcaagatcttccagatctacaagggcaacttcaccggctctgtggagcctgagcccagcaccctgacccccaggacccccctgtggggctacagcagcagcccccagccccagacagtggccgccaccaccgtgcccagcaacacctcctgggcccccaccaccaccagcctgggccctgccaaggacaagccaggcctgcggcgggccgcccagggcggcggcagcaccttcaccagccagggcggcaccccagatgccacagctgccagcggggcccctgtgagcccccaggccgcccctgtgcccagccagaggccccaccacggggacccccaggacggccccagccacagcgacagctggctgactgtgaccccaggcaccagccggcccctgagcaccagcagcggggtcttcaccgctgccaccggccccaccccagctgcctttgacacctctgtgtctgcccccagccagggcatcccccagggcgccagcaccaccccccaggcccccacccaccccagccgggtgtctgagagcaccatcagcggggccaaggaggagaccgtggccaccctgaccatgacagacagagtgcccagccccctgagcacagtggtgtccacagccaccggcaacttcctgaaccggctggtgcctgctggcacctggaagccaggcacagctggcaacatcagccacgtggccgagggggacaagccccagcaccgggccaccatctgcctgagcaagatggacatcgcctgggtgatcctggccatctctgtgcccatcagcagctgcagcgtgctgctgactgtgtgctgcatgaagaggaagaagaagacagccaaccctgagaacaacctgagctactggaacaacaccatcaccatggactacttcaacagacatgctgtggagctgccccgggagatccagagcctggagaccagcgaggaccagctgtctgagcccaggagccctgccaacggggactacagagacaccggcatggtgctggtgaaccccttctgccaggagaccctgtttgtgggcaatgaccaggtgtctgagatctag

SEQ ID NO: 39131 - DNA, 1728 bp, Artificial Sequence; identical to SEQ ID NO: 39130
  Description of Artificial Sequence: Synthetic coding sequence

SEQ ID NO: 39132 - DNA, 318 bp, Artificial Sequence
  Description of Artificial Sequence: Synthetic coding sequence
atgaagaggagcctgcaggccctgtactgccagctgctgactgtgctgctgactgtgtgctgcatgaagaggaagaagaagacagccaaccctgagaacaacctgagctactggaacaacaccatcaccatggactacttcaacagacatgctgtggagctgccccgggagatccagagcctggagaccagcgaggaccagctgtctgagcccaggagccctgccaacggggactacagagacaccggcatggtgctggtgaaccccttctgccaggagaccctgtttgtgggcaatgaccaggtgtctgagatctag

SEQ ID NO: 39133 - DNA, 462 bp, Artificial Sequence
  Description of Artificial Sequence: Synthetic coding sequence
atgaagaggagcctgcaggccctgtactgccagctgctgtccttcctgctgatcctggccctgacagaggccctggcctttgccatccaggagcccagcccccgggagagcctgcaggtgctgcccagcggcaccccacctggcaccatggtgacagccccccacagcagcaccaggcacacctctgtggtgatgctgacccccaacccagatggcccccccagccaggccgccgcccccatggccacccccacccccagggctgagggccacccccccacccacaccatcagcaccatcgccgccaccgtgacagccccccacagcgagagcagcctgagcactggacctgccccagctgccatggccaccaccagcagcaagccagagggccggccccggggccaggccgcccccaccatcctgctgaccaagcccccaggggccaccagccggccctag

SEQ ID NO: 39134 - DNA, 219 bp, Artificial Sequence
  Description of Artificial Sequence: Synthetic coding sequence
atgaagaggagcctgcaggccctgtactgccagctgctgtccttcctgctgatcctggccctgacagaggccctggcctttgccatccaggagcccagcccccgggagagcctgcaggtgctgcccagcggcaccccacctggcaccatggtgacagccccccacagcagcaccaggcacacctctgtggtgatgctgacccccaacccagatggatag

SEQ ID NO: 39135 - DNA, 450 bp, Artificial Sequence
  Description of Artificial Sequence: Synthetic coding sequence
atgaagaggagcctgcaggccctgtactgccagctgctgtccttcctgctgatcctggccctgacagaggccctggcctttgccatccaggagcccagcccccgggagagcctgcaggtgctgcccagcggcaccccacctggcaccatggtgacagccccccacagcagcaccaggcacacctctgtggtgatgctgacccccaacccagatggcccccccagccaggccgccgcccccatggccacccccacccccagggctgagggccacccccccacccacaccatcagcaccatcgccgccaccgtgacagccccccacagcgagagcagcctgagcactggacctgccccagctgccatggccaccaccagcagcaagccagagggccggccccggggccaggccgcccccaccatcctgctgaccaagcccccaggggcctag

SEQ ID NO: 39136 - DNA, 1467 bp, Artificial Sequence
  Description of Artificial Sequence: Synthetic coding sequence
atgaagaggagcctgcaggccctgtactgccagctgctgtccttcctgctgatcctggccctgacagaggccctggcctttgccatccaggagcccagcccccgggagagcctgcaggtgctgcccagcggcaccccacctggcaccatggtgacagccccccacagcagcaccaggcacacctctgtggtgatgctgacccccaacccagatggcccccccagccaggccgccgcccccatggccacccccacccccagggctgagggccacccccccacccacaccatcagcaccatcgccgccaccgtgacagccccccacagcgagagcagcctgagcactggacctgccccagctgccatggccaccaccagcagcaagccagagggccggccccggggccaggccgcccccaccatcctgctgaccaagcccccaggggccaccagccggcccaccacagccccacccaggaccaccaccaggaggcctccccggcccccaggcagcagcaggaagggggccggcaacagcagcaggcctgtgcccccagcccctgggggccacagccgcagcaaggagggccagaggggcaggaaccccagcagcacccccctgggccagaagaggcccctgggcaagatcttccagatctacaagggcaacttcaccggctctgtggagcctgagcccagcaccctgacccccaggacccccctgtggggctacagcagcagcccccagccccagacagtggccgccaccaccgtgcccagcaacacctcctgggcccccaccaccaccagcctgggccctgccaaggacaagccaggcctgcggcgggccgcccagggcggcggcagcaccttcaccagccagggcggcaccccagatgccacagctgccagcggggcccctgtgagcccccaggccgcccctgtgcccagccagaggccccaccacggggacccccaggacggccccagccacagcgacagctggctgactgtgaccccaggcaccagccggcccctgagcaccagcagcggggtcttcaccgctgccaccggccccaccccagctgcctttgacacctctgtgtctgcccccagccagggcatcccccagggcgccagcaccaccccccaggcccccacccaccccagccgggtgtctgagagcaccatcagcggggccaaggaggagaccgtggccaccctgaccatgacagacagagtgcccagccccctgagcacagtggtgtccacagccaccggcaacttcctgaaccggctggtgcctgctggcacctggaagccaggcacagctggcaacatcagccacgtggccgagggggacaagccccagcaccgggccaccatctgcctgagcaagatggacatcgcctgggtgatcctggccatctctgtgcccatcagcagctgcagcgaccccatcacctag

SEQ ID NO: 39137 - DNA, 1515 bp, Artificial Sequence
  Description of Artificial Sequence: Synthetic coding sequence
atgagcctcatctgcagcatcagcaatgaggtgcctgagcacccctgtgtgtcccctgtgagcaaccacgtgtatgaaagaagactcatcgagaagtacatcgccgagaatggaacagaccccatcaacaaccagcccctgtctgaggagcagctgattgacatcaaggtggcccaccccatccggcccaagcccccatctgccaccagcatcccagccatcctgaaggccctgcaggatgagtgggatgctgtgatgctgcacagcttcaccctgcggcagcagctgcagaccacccggcaggagctgagccacgccctgtaccagcatgatgctgcctgccgggtgattgcccggctgaccaaggaggtgacagctgcccgggaggccctggccaccctgaagccccaggccggcctgattgtgccccaggccgtgcccagcagccagcccagcgtggtgggcgctggggagcccatggacctgggggagctggtgggcatgaccccagagatcatccagaagctgcaggacaaggccaccgtgctgaccacagagaggaagaagaggggcaagacagtgcctgaggagctggtgaagccagaggagctgagcaagtaccggcaggtggccagccacgtgggcctgcacagcgccagcatccctggcatcctggccctggacctgtgccccagcgacaccaacaagatcctgactggaggagctgacaagaatgtggtggtgtttgacaagagcagcgagcagatcctggccaccctgaagggccacaccaagaaggtgacctctgtggtgttccaccccagccaggacctggtgttttctgccagcccagatgccaccatccgcatctggagcgtgcccaatgccagctgtgtgcaggtggtgcgggcccatgaatctgctgtgacaggcctgagcctgcacgccactggagactacctgctgagcagcagtgatgaccagtactgggccttcagtgacatccagacaggccgggtgctgaccaaggtgacagatgagaccagcggctgcagcctgacctgtgcccagttccacccagatggcctcatctttggaacaggcaccatggacagccagatcaagatctgggacctgaaggagaggaccaacgtggccaacttccctggccacagcggccccatcaccagcatcgccttctctgaaaatggctactacctggccacagctgctgatgacagctctgtgaagctgtgggacctgaggaagctgaagaacttcaagaccctgcagctggacaacaactttgaggtgaagagcctcatctttgaccagagcggcacctacctggccctgggcggcacagatgtgcagatctacatctgcaagcagtggacagagatcctgcacttcacagagcacagcggcctgaccactggagtggccttcggccaccacgccaagttcatcgccagcacaggcatggacaggagcctgaagttctacagcctgtag

SEQ ID NO: 39138 - DNA, 705 bp, Artificial Sequence
  Description of Artificial Sequence: Synthetic coding sequence
atggccgccagcagcatcagcagcccctggggcaagcacgtgttcaaggccatcctgatggtgctggtggccctgatcctgctgcacagcgccctggcccagagccggcgggactttgcccctcctggccagcagaagcgggaggcccctgtggatgtgctgacccagatcggccgctctgtgcggggcaccctggatgcctggattggccctgagaccatgcacctggtgtctgagagcagcagccaggtgctgtgggccatcagcagcgccatctctgtggccttctttgccctgagcggcattgctgcccagctgctgaatgccctgggcctggccggggactacctggcccagggcctgaagctgagccctggccaggtgcagaccttcctgctgtggggcgctggggccctggtggtgtactggctgctgagcctgctgctgggcctggtgctggccctgctgggccgcatcctgtggggcctgaagctggtgatcttcctggccggctttgtggccctgatgaggtctgtgcctgaccccagcacccgggccctgctgctgctggccctgctgaccccctgccccttcctggccctgagcctgaacctgcagaacatcgacccctgccgcagccccaccagccaggagaagcagaggaagaccatccccccagcctgcccctgtggccctgtgttctag

SEQ ID NO: 39139 - DNA, 732 bp, Artificial Sequence
  Description of Artificial Sequence: Synthetic coding sequence
atggccgccagcagcatcagcagcccctggggcaagcacgtgttcaaggccatcctgatggtgctggtggccctgatcctgctgcacagcgccctggcccagagccggcgggactttgcccctcctggccagcagaagcgggaggcccctgtggatgtgctgacccagatcggccgctctgtgcggggcaccctggatgcctggattggccctgagaccatgcacctggtgtctgagagcagcagccaggtgctgtgggccatcagcagcgccatctctgtggccttctttgccctgagcggcattgctgcccagctgctgaatgccctgggcctggccggggactacctggcccagggcctgaagctgagccctggccaggtgcagaccttcctgctgtggggcgctggggccctggtggtgtactggctgctgagcctgctgctgggcctggtgctggccctgctgggccgcatcctgtggggcctgaagctggtgatcttcctggccggctttgtggccctgatgaggtctgtgcctgaccccagcacccgggccctgctgctgctggccctgctgatcctgtatgccctgctgagccggctgaccggcagccgggccagcggggcccagctggaggccaaggtgcggggcctggagcggcaggtggaggagctgcgctggaggcagaggagagctgccaagggggcccggtctgtggaggaggagtag

SEQ ID NO: 39140 - DNA, 579 bp, Artificial Sequence
  Description of Artificial Sequence: Synthetic coding sequence
atggccgcctggggcagaagaaggctgggccctggcagcagcggcggcagcgcccgggagcgggtgtccctgagcgccacagactgctacatcgtgcatgagatctacaatggagaaaatgcccaggaccagtttgaatatgagctggagcaggccctggaggcccagtacaagtacatcgtcatcgagcccaccagaattggagatgaaacagcccgctggatcaccgtgggcaactgcctgcacaagacagctgtgctggccggcacagcctgcctcttcacccccctggccctgcccctggactacagccactacatcagcctgcctgctggggtgctgagcctggcctgctgcaccctgtatggcatctcctggcagtttgacccctgctgcaagtaccaggtggagtatgatgcctacaagctgagccggctgcccctgcacaccctgaccagcagcacccctgtggtgctggtgaggaaggatgacctgcacaggaagaggctgcacaacaccatcgccctggccgccctggtgtactgtgtgaagaagatctatgagctgtatgctgtgtag

SEQ ID NO: 39141 - DNA, 885 bp, Artificial Sequence
  Description of Artificial Sequence: Synthetic coding sequence
atgcagggccctgctggaaatgccagccggggcctgcccggcggcccccccagcacagtggccagcggggccggccgctgtgagagcggggccctgatgcacagctttggcatcttcctgcagggcctgctgggcgtggtggccttcagcaccctgatgctgaagcgcttccgggagcccaagcatgagcggcggccctggaggatctggttcctggacaccagcaagcaggccatcggcatgctgttcatccactttgccaacgtgtacctggccgacctgacagaggaggacccctgcagcctgtacctgatcaacttcctgctggatgccaccgtgggcatgctgctgatctacgtgggcgtgcgggctgtgtctgtgctggtggagtggcagcagtgggagagcctgcgctttggagaatatggagaccccctgcagtgtggggcctgggtgggccagtgtgccctgtacatcgtcatcatgatctttgagaagtctgtggtgttcatcgtgctgctgatcctgcagtggaagaaggtggccctgctgaaccccatcgagaacccagacctgaagctggccatcgtgatgctgattgtgcccttctttgtgaatgccctgatgttctgggtggtggacaacttcctgatgaggaagggcaagaccaaggccaagctggaggagcggggggccaaccaggacagcagaaatggcagcaaggtgcgctacagaagagctgccagccatgaggagagcgagagcgagatcctgatctctgcagatgatgagatggaggagagtgatgtggaggaggacctgcggcggctgacccccctgaagcctgtgaagaagaagaagcaccgcttcggcctgcctgtgtag

SEQ ID NO: 39142 - DNA, 786 bp, Artificial Sequence
  Description of Artificial Sequence: Synthetic coding sequence
atggccggccctgagctgctgctggacagcaacatccggctgtgggtggtgctgcccatcgtcatcatcaccttctttgtgggcatgatccgccactacgtgtccatcctgctgcagagcgacaagaagctgacccaggagcaggtgtctgacagccaggtgctgatccgcagccgggtgctgagagaaaatggcaagtacatccccaagcagagcttcctgaccaggaagtactacttcaacaacccagaagatggcttcttcaagaagaccaagaggaaggtggtgccccccagccccatgacagaccccaccatgctgacagacatgatgaagggaaatgtgaccaacgtgctgcccatgatcctgattggaggctggatcaacatgaccttcagcggctttgtgaccaccaaggtgcccttccccctgaccctgcgcttcaagcccatgctgcagcagggcatcgagctgctgaccctggatgcctcctgggtgagcagcgcctcctggtacttcctgaatgtgtttggcctgcggagcatctacagcctcatcctgggccaggacaatgctgctgaccagagcaggatgatgcaggagcagatgaccggggccgccatggccatgcctgctgacaccaacaaggccttcaagacagagtgggaggccctggagctgacagaccaccagtgggccctggatgatgtggaggaggagctgatggccaaggacctgcactttgagggcatgttcaagaaggagctgcagaccagcatcttctag

SEQ ID NO: 39143 - DNA, 612 bp, Artificial Sequence
  Description of Artificial Sequence: Synthetic coding sequence
atggccggccctgagctgctgctggacagcaacatccggctgtgggtggtgctgcccatcgtcatcatcaccttctttgtgggcatgatccgccactacgtgtccatcctgctgcagagcgacaagaagctgacccaggagcaggtgtctgacaggaagtacctgagcggcctggtgcagtggctgacccccatcatcccagccctgtggggcgctgagatgggcggcagcctggagcccaggaacctgcggcccaccctggccgcctgccaggtgctgatccgcagccgggtgctgagagaaaatggcaagtacatccccaagcagagcttcctgaccaggaagtactacttcaacaacccagaagatggcttcttcaagaagaccaagaggaaggtggtgccccccagccccatgacagaccccaccatgctgacagacatgatgaagggaaatgtgaccaacgtgctgcccatgatcctgattggaggctggatcaacatgaccttcagcggctttgtgaccaccaaggtgcccttccccctgaccctgcgcttcaagcccatgctgcagcagggcatcgagctgctgaccctggatgcctcctggtag

SEQ ID NO: 39144 - DNA, 1056 bp, Artificial Sequence
  Description of Artificial Sequence: Synthetic coding sequence
atgcagagggccctgcccggggcccggcagcacctgggcgccatcctggccagcgcctctgtggtggtgaaggccctgtgtgccgctgtgctcttcctgtacctgctgagctttgctgtggacaccggctgcctggccgtgaccccaggctacctgttcccccccaacttctggatctggaccctggccacccacggcctgatggagcagcacgtgtgggatgtggccatcagcctgaccaccgtggtggtggccggccgcctgctggagcccctgtggggcgccctggagctgctgatcttcttctctgtggtgaatgtgtctgtgggcctgctgggcgcctttgcctacctgctgacctacatggccagcttcaacctggtgtacctgttcaccgtgcgcatccacggggccctgggcttcctgggcggcgtgctggtggccctgaagcagaccatgggagactgtgtggtgctgcgggtgccccaggtgcgggtgtctgtgatgcccatgctgctgctggccctgctgctgctgctgcggctggccaccctgctgcagagccctgccctggccagctatggcttcggcctgctgagctcctgggtgtacctgcgcttctaccagaggcacagccggggccgcggggacatggctgaccactttgcctttgccaccttcttccctgagatcctgcagcctgtggtgggcctgctggccaacctggtgcacagcctgctggtgaaggtgaagatctgccagaagacagtgaagagatatgatgtgggcgcccccagcagcatcaccatcagcctgcctggaacagacccccaggatgctgagcggcggcggcagctggccctgaaggccctgaatgaaaggctgaagagggtggaggaccagagcatctggcccagcatggatgatgatgaggaggagagcggggccaaggtggacagccccctgcccagcgacaaggcccccaccccacctggaaaaggagctgcccctgagagcagcctcatcacctttgaggccgccccacccaccctgtag

SEQ ID NO: 39145 - DNA, 738 bp, Artificial Sequence
  Description of Artificial Sequence: Synthetic coding sequence
atgaagcacacccagagcggccagagcaccagccccctggtgattgactacacctgccgggtgtgccagatggcctttgtgttcagcagcctcatccccctgctgctgatgacccctgtgttctgcctgggcaacaccagcgagtgcttccagaacttcagccagagccacaagtgcatcctgatgcacagccccccatctgccatggccgagctgcccccatctgccaacacctctgtgtgcagcaccctgtacttctatggaattgccatcttcctgggcagctttgtgctgagcctgctgaccatcatggtgctgctgatccgggcccagaccctgtacaagaagtttgtgaagagcacaggcttcctgggcagcgagcagtgggccgtcatccacatcgtggaccagagggtgcgcttctaccctgtggccttcttctgctgctggggccctgctgtgatcctgatgatcatcaagctgaccaagccccaggacaccaagctgcacatggccctgtatgtgctgcaggccctgacagccaccagccagggcctgctgaactgtggggtgtatggctggacccagcacaagttccaccagctgaagcaggaggccaggagagatgctgacacccagacccccctgctgtgcagccagaagcgcttctacagccggggcctgaacagcctggagagcaccctgaccttccctgccagcaccagcaccatcttctag

SEQ ID NO: 39146 - DNA, 738 bp, Artificial Sequence; identical to SEQ ID NO: 39145
  Description of Artificial Sequence: Synthetic coding sequence

SEQ ID NO: 39147 - DNA, 225 bp, Artificial Sequence
  Description of Artificial Sequence: Synthetic coding sequence
atggccaccctgtctgtgattggcagcagcagcctgattgcctatgctgtgttccacaacatccagaagagccctgagatccggcccctcttctacctgtccttctgtgacctgctgctgggcctgtgctggctgacagagaccctgctgtatggagcctctgtggccaacaaggacatcatctgctacaacctgcaggccgtgggccaggtgtctgccacctag

SEQ ID NO: 39148 - DNA, 321 bp, Artificial Sequence
  Description of Artificial Sequence: Synthetic coding sequence
atggccaccctgtctgtgattggcagcagcagcctgattgcctatgctgtgttccacaacatccagaagagccctgagatccggcccctcttctacctgtccttctgtgacctgctgctgggcctgtgctggctgacagagaccctgctgtatggagcctctgtggccaacaaggacatcatctgctacaacctgcaggccgtgggccagatcttctacatcagcagcttcctgtacacagtgaactacatctggtacctgtacacagagctgaggatgaagcacacccagagcggccagagcaccagccccctggtgtag

SEQ ID NO: 39149 - DNA, 528 bp, Artificial Sequence
  Description of Artificial Sequence: Synthetic coding sequence
atggccaccctgtctgtgattggcagcagcagcctgattgcctatgctgtgttccacaacatccagaagagccctgagatccggcccctcttctacctgtccttctgtgacctgctgctgggcctgtgctggctgacagagaccctgctgtatggagcctctgtggccaacaaggacatcatctgctacaacctgcaggccgtgggccagatcttctacatcagcagcttcctgtacacagtgaactacatctggtacctgtacacagagctgaggatgaagcacacccagagcggccagagcaccagccccctggtgattgactacacctgccgggtgtgccagatggcctttgtgttcagcagcctcatccccctgctgctgatgacccctgtgttctgcctgggcaacaccagcgagtgcttccagaacttcagccagagccacaagtgcatcctgatgcacagccccccatctgccatggccgagctgcccccatctgccaacacctctgtgtgcagcacctag

SEQ ID NO: 39150 - DNA, 156 bp, Artificial Sequence
  Description of Artificial Sequence: Synthetic coding sequence
atggccaccctgtctgtgattggcagcagcagcctgattgcctatgctgtgttccacaacatccagaagagccctgagatccggcccctcttctacctgtccttctgtgacctgctgctgggcctgtgctggctgacagagaccctgctgtactag

SEQ ID NO: 39151 - DNA, 738 bp, Artificial Sequence; identical to SEQ ID NO: 39145
  Description of Artificial Sequence: Synthetic coding sequence

SEQ ID NO: 39152 - DNA, 1014 bp, Artificial Sequence
  Description of Artificial Sequence: Synthetic coding sequence
atggccaccctgtctgtgattggcagcagcagcctgattgcctatgctgtgttccacaacatccagaagagccctgagatccggcccctcttctacctgtccttctgtgacctgctgctgggcctgtgctggctgacagagaccctgctgtatggagcctctgtggccaacaaggacatcatctgctacaacctgcaggccgtgggccagatcttctacatcagcagcttcctgtacacagtgaactacatctggtacctgtacacagagctgaggatgaagcacacccagagcggccagagcaccagccccctggtgattgactacacctgccgggtgtgccagatggcctttgtgttcagcagcctcatccccctgctgctgatgacccctgtgttctgcctgggcaacaccagcgagtgcttccagaacttcagccagagccacaagtgcatcctgatgcacagccccccatctgccatggccgagctgcccccatctgccaacacctctgtgtgcagcaccctgtacttctatggaattgccatcttcctgggcagctttgtgctgagcctgctgaccatcatggtgctgctgatccgggcccagaccctgtacaagaagtttgtgaagagcacaggcttcctgggcagcgagcagtgggccgtcatccacatcgtggaccagagggtgcgcttctaccctgtggccttcttctgctgctggggccctgctgtgatcctgatgatcatcaagctgaccaagccccaggacaccaagctgcacatggccctgtatgtgctgcaggccctgacagccaccagccagggcctgctgaactgtggggtgtatggctggacccagcacaagttccaccagctgaagcaggaggccaggagagatgctgacacccagacccccctgctgtgcagccagaagcgcttctacagccggggcctgaacagcctggagagcaccctgaccttccctgccagcaccagcaccatcttctag

SEQ ID NO: 39153 - DNA, 909 bp, Artificial Sequence
  Description of Artificial Sequence: Synthetic coding sequence
atggccaccctgtctgtgattggcagcagcagcctgattgcctatgctgtgttccacaacatccagaagagccctgagatccggcccctcttctacctgtccttctgtgacctgctgctgggcctgtgctggctgacagagaccctgctgtatggagcctctgtggccaacaaggacatcatctgctacaacctgcaggccgtgggccaggtgattgactacacctgccgggtgtgccagatggcctttgtgttcagcagcctcatccccctgctgctgatgacccctgtgttctgcctgggcaacaccagcgagtgcttccagaacttcagccagagccacaagtgcatcctgatgcacagcccccccagcgccatggccgagctgccccccagcgccaacacctctgtgtgcagcaccctgtacttctacggcatcgccatcttcctgggcagctttgtgctgagcctgctgaccatcatggtgctgctgatccgggcccagaccctgtacaagaagtttgtgaagagcacaggcttcctgggcagcgagcagtgggccgtcatccacatcgtggaccagagggtgcgcttctaccctgtggccttcttctgctgctggggccctgctgtgatcctgatgatcatcaagctgaccaagccccaggacaccaagctgcacatggccctgtatgtgctgcaggccctgacagccaccagccagggcctgctgaactgtggggtgtatggctggacccagcacaagttccaccagctgaagcaggaggccaggagagatgctgacacccagacccccctgctgtgcagccagaagcgcttctacagccggggcctgaacagcctggagagcaccctgaccttccctgccagcaccagcaccatcttctag

SEQ ID NO: 39154 - DNA, 1545 bp, Artificial Sequence
  Description of Artificial Sequence: Synthetic coding sequence
atgggcaaggacttccgctactacttccagcacccctggagcaggatgattgtggcctacctggtgatcttcttcaacttcctgatctttgctgaggaccctgtgagccacagccagacagaggccaacgtgattgtggtgggcaactgcttctcctttgtgaccaacaagtacccccggggcgtgggctggaggatcctgaaggtgctgctgtggctgctggccatcctgaccggcctgattgctgggaagttcctgttccaccagaggctgtttggccagctgctgcggctgaagatgttcagagaagatcatggctcctggatgaccatgttcttcagcaccatcctcttcctgttcatcttcagccacatctacaacaccatcctgctgatggatggcaacatgggcgcctacatcatcacagactacatgggcatcagaaatgaaagcttcatgaagctggccgctgtgggcacctggatgggagactttgtgacagcctggatggtgacagacatgatgctgcaggacaagccctacccagactggggcaagagcgcccgggccttctggaagaagggaaatgtgcgcatcaccctcttctggacagtgctcttcaccctgacctctgtggtggtgctggtgatcaccacagactggatctcctgggacaagctgaacagaggcttcctgcccagtgatgaggtgtcccgggccttcctggccagcttcatcctggtgtttgacctgctgattgtgatgcaggactgggagttcccccacttcatgggagatgtggatgtgaacctgcccggcctgcacaccccccacatgcagttcaagatccccttcttccagaagatcttcaaggaggagtaccgcatccacatcaccgggaagtggttcaactacggcatcatcttcctggtgctgatcctggacctgaacatgtggaagaaccagatcttctacaagccccatgaatatggccagtacatcggccctggccagaagatctacacagtgaaggacagcgagagcctgaaggacctgaacagaaccaagctgtcctgggagtggaggagcaaccacaccaaccccaggaccaacaagacctacgtggagggggacatgttcctgcacagccgcttcatcggggccagcctggatgtgaagtgcctggcctttgtgcccagcctcatcgcctttgtgtggtttggcttcttcatctggttcttcggccgcttcctgaagaatgagcccaggatggagaaccaggacaagacctacaccaggatgaagaggaagagccccagcgagcacagcaaggacatgggcatcacccgggagaacacccaggcctctgtggaggaccccctgaatgaccccagcctggtgtgcatccgcagtgacttcaatgagatcgtgtacaagagcagccacctgaccagcgagaacctgagcagccagctgaatgaaagcaccagcgccacagaagctgaccaggaccccaccaccagcaagagcacccccaccaactag

SEQ ID NO: 39155 - DNA, 789 bp, Artificial Sequence
  Description of Artificial Sequence: Synthetic coding sequence
atgtacatcaaggactgggagttcccccacttcatgggagatgtggatgtgaacctgcccggcctgcacaccccccacatgcagttcaagatccccttcttccagaagatcttcaaggaggagtaccgcatccacatcaccgggaagtggttcaactacggcatcatcttcctggtgctgatcctggacctgaacatgtggaagaaccagatcttctacaagccccatgaatatggccagtacatcggccctggccagaagatctacacagtgaaggacagcgagagcctgaaggacctgaacagaaccaagctgtcctgggagtggaggagcaaccacaccaaccccaggaccaacaagacctacgtggagggggacatgttcctgcacagccgcttcatcggggccagcctggatgtgaagtgcctggcctttgtgcccagcctcatcgcctttgtgtggtttggcttcttcatctggttcttcggccgcttcctgaagaatgagcccaggatggagaaccaggacaagacctacaccaggatgaagaggaagagccccagcgagcacagcaaggacatgggcatcacccgggagaacacccaggcctctgtggaggaccccctgaatgaccccagcctggtgtgcatccgcagtgacttcaatgagatcgtgtacaagagcagccacctgaccagcgagaacctgagcagccagctgaatgaaagcaccagcgccacagaagctgaccaggaccccaccaccagcaagagcacccccaccaactag

SEQ ID NO: 39156 - DNA, 1233 bp, Artificial Sequence
  Description of Artificial Sequence: Synthetic coding sequence
atggccacctgccacagccacaggaccaacagctggcagatctctgtgcccagcgcctttgtgtggagcgtggcccccatcaagaatgtgagccgccgctcctgggtggtggatgacaacgtgctgcagcacaacagcctgagcctgcacatcttcagccacatccagcacgacagcagcaatggctgggagcacggcgtgacagacatgatgctgcaggacaagccctacccagactggggcaagagcgcccgggccttctggaagaagggaaatgtgcgcatcaccctcttctggacagtgctcttcaccctgacctctgtggtggtgctggtgatcaccacagactggatctcctgggacaagctgaacagaggcttcctgcccagtgatgaggtgtcccgggccttcctggccagcttcatcctggtgtttgacctgctgattgtgatgcaggactgggagttcccccacttcatgggagatgtggatgtgaacctgcccggcctgcacaccccccacatgcagttcaagatccccttcttccagaagatcttcaaggaggagtaccgcatccacatcaccgggaagtggttcaactacggcatcatcttcctggtgctgatcctggacctgaacatgtggaagaaccagatcttctacaagccccatgaatatggccagtacatcggccctggccagaagatctacacagtgaaggacagcgagagcctgaaggacctgaacagaaccaagctgtcctgggagtggaggagcaaccacaccaaccccaggaccaacaagacctacgtggagggggacatgttcctgcacagccgcttcatcggggccagcctggatgtgaagtgcctggcctttgtgcccagcctcatcgcctttgtgtggtttggcttcttcatctggttcttcggccgcttcctgaagaatgagcccaggatggagaaccaggacaagacctacaccaggatgaagaggaagagccccagcgagcacagcaaggacatgggcatcacccgggagaacacccaggcctctgtggaggaccccctgaatgaccccagcctggtgtgcatccgcagtgacttcaatgagatcgtgtacaagagcagccacctgaccagcgagaacctgagcagccagctgaatgaaagcaccagcgccacagaagctgaccaggaccccaccaccagcaagagcacccccaccaactag

SEQ ID NO: 39157 - DNA, 852 bp, Artificial Sequence
  Description of Artificial Sequence: Synthetic coding sequence
atggtgtctgctgctgcccccagcctgctgatcctgctgctgctgctgctgggctctgtgcctgccacagatgcccggtctgtgcccctgaaggccaccttcctggaggatgtggccggcagcggggaggccgagggcagcagcgccagcagccccagcctgcccccaccctggaccccagccctgagccccacctccatgggcccccagcccatcaccctgggcggccccagcccccccaccaacttcctggatggcatcgtggacttcttccggcagtatgtgatgctgattgctgtggtgggcagcctggccttcctgctgatgtttattgtgtgtgccgctgtgatcacccggcagaagcagaaggccagcgcctactaccccagcagcttccccaagaagaagtatgtggaccagagcgaccgggccggcggcccccgggccttcagcgaggtgcctgaccgggccccagacagcaggcctgaggaggccctggacagcagccggcagctgcaggccgacatcctggccgccacccagaacctgaagagccccaccagggctgccctgggcggcggagatggagccaggatggtggagggcagaggagctgaggaggaggagaagggcagccaggagggggaccaggaggtgcagggccacggcgtgcctgtggagaccccagaggcccaggaggagccctgcagcggcgtgctggagggcgctgtggtggccggggagggccagggcgagctggagggcagcctgctgctggcccaggaggcccagggccctgtgggccccccagagagcccctgtgcctgcagctctgtgcaccccagcgtgtag

SEQ ID NO: 39158 - DNA, 654 bp, Artificial Sequence
  Description of Artificial Sequence: Synthetic coding sequence
atgggcccccagcccatcaccctgggcggccccagcccccccaccaacttcctggatggcatcgtggacttcttccggcagtatgtgatgctgattgctgtggtgggcagcctggccttcctgctgatgtttattgtgtgtgccgctgtgatcacccggcagaagcagaaggccagcgcctactaccccagcagcttccccaagaagaagtatgtggaccagagcgaccgggccggcggcccccgggccttcagcgaggtgcctgaccgggccccagacagcaggcctgaggaggccctggacagcagccggcagctgcaggccgacatcctggccgccacccagaacctgaagagccccaccagggctgccctgggcggcggagatggagccaggatggtggagggcagaggagctgaggaggaggagaagggcagccaggagggggaccaggaggtgcagggccacggcgtgcctgtggagaccccagaggcccaggaggagccctgcagcggcgtgctggagggcgctgtggtggccggggagggccagggcgagctggagggcagcctgctgctggcccaggaggcccagggccctgtgggccccccagagagcccctgtgcctgcagctctgtgcaccccagcgtgtag

SEQ ID NO: 39159 - DNA, 87 bp, Artificial Sequence
  Description of Artificial Sequence: Synthetic coding sequence
atggtgtctgctgctgcccccagcctgctgatcctgctgctgctgctgctgggctctgtgcctgccacagatgcccggtctgtgtag

SEQ ID NO: 39160 - DNA, 423 bp, Artificial Sequence
  Description of Artificial Sequence: Synthetic coding sequence
atggtgtctgctgctgcccccagcctgctgatcctgctgctgctgctgctgggctctgtgcctgccacagatgcccggtctgtgcccctgaaggccaccttcctggaggatgtggccggcagcggggaggccgagggcagcagcgccagcagccccagcctgcccccaccctggaccccagccctgagccccacctccatgggcccccagcccatcaccctgggcggccccagcccccccaccaacttcctggatggcatcgtggacttcttccggcagtatgtgatgctgattgctgtggtgggcagcctggccttcctgctgatgtttattgtgtgtgccgctgtgatcacccggcagaagcagaaggccagcgcctactaccccagcagcttccccaagaagaagtatgtggaccagtag

SEQ ID NO: 39161 - DNA, 135 bp, Artificial Sequence
  Description of Artificial Sequence: Synthetic coding sequence
atggtgtctgctgctgcccccagcctgctgatcctgctgctgctgctgctgggctctgtgcctgccacagatgcccggtctgtgcccctgaaggccaccttcctggaggatgtggccggcagcggggaggcctag

SEQ ID NO: 39162 - DNA, 1020 bp, Artificial Sequence
  Description of Artificial Sequence: Synthetic coding sequence
atgagcggccagctggagcgctgtgagcgggagtggcatgagctggagggggagttccaggagctgcaggagacccaccgcatctacaagcagaagctggaggagctggccgccctgcagaccctgtgcagcagcagcatcagcaagcagaagaagcacctgaaggacctgaagctgaccctgcagcgctgcaagagacatgccagccgggaggaggccgagctggtgcagcagatggccgccaacatcaaggagcggcaggatgtgttctttgacatggaggcctacctgcccaagaagaatggcctgtacctgaacctggtgctgggcaatgtgaatgtgaccctgctgagcaaccaggccaagtttgcctacaaggatgaatatgagaagttcaagctgtacctgaccatcatcctgctgctgggcgctgtggcctgccgctttgtgctgcactacagagtgacagatgaggtgttcaacttcctgctggtgtggtactactgcaccctgaccatccgggagagcatcctgatcagcaatggcagccgcatcaagggctggtgggtgagccaccactacgtgtccaccttcctgagcggcgtgatgctgacctggcccaacggccccatctaccagaagttcaggaaccagttcctggccttcagcatcttccagagctgtgtgcagttcctgcagtactactaccagaggggctgcctgtaccgcctgcgggccctgggggagaggaaccacctggacctgactgtggagggcttccagagctggatgtggaggggcctgaccttcctgctgcccttcctgttctgtggccacttctggcagctgtacaatgctgtgaccctgtttgagctgagcagccatgaagaatgtcgggagtggcaggtgtttgtgctggccttcaccttcctgatcctcttcctgggcaacttcctgaccaccctgaaggtggtgcacgccaagctgcagaagaacagaggcaagaccaagcagccctag

SEQ ID NO: 39163 - DNA, 1020 bp, Artificial Sequence; identical to SEQ ID NO: 39162
  Description of Artificial Sequence: Synthetic coding sequence

SEQ ID NO: 39164 - DNA, 960 bp, Artificial Sequence
  Description of Artificial Sequence: Synthetic coding sequence
atggtgctgcccccaccagaccggcggcacgtgtgcctgaccaccctggtgatcatgggctccatggctgtgatggatgcctacctggtggagcagaaccagggccccaggaagattggagtgtgcatcatcgtgctggtgggagatgtgtgcttcctgctggtgctgcgctacgtggccgtgtgggtgggcgctgaggtgaggacagccaagaggggctacgccatgatcctgtggttcctgtacatctttgtgctggagatcaagctgtacttcatcttccagaactacaaggccgccaggagaggagctgctgaccctgtggccaggaaggccctgaccctgctgctgtctgtgtgtgtgcccggcctcttcctgctgctggtggccctggacaggatggagtatgtgaggaccttcaggaagcgggaggacctgcggggccgcctcttctgggtggccctggacctgctggacctgctggacatgcaggccagcctgtgggagccccccaggagcggcctgcccctgtgggccgagggcctgaccttcttctactgctacatgctgctgctggtgctgccctgtgtggccctgtctgaggtgtccatgcagggcgagcacatcgccccccagaagatgatgctgtaccctgtgctgagcctggccaccgtgaatgtggtggccgtgctggcccgggccgccaacatggccctcttccgggacagccgggtgtctgccatctttgtgggcaagaatgtggtggccctggccaccaaggcctgcaccttcctggagtaccgccggcaggtgcgggacttccccccaccagccctgagcctggagctgcagcccccaccaccccagaggaacagcgtgcccccacctcctccacccctgcacggccccccaggccggccccacatgagcagccccacccgggaccccctggacacctag

SEQ ID NO: 39165 - DNA, 960 bp, Artificial Sequence; identical to SEQ ID NO: 39164
  Description of Artificial Sequence: Synthetic coding sequence

SEQ ID NO: 39166 - DNA, 660 bp, Artificial Sequence
  Description of Artificial Sequence: Synthetic coding sequence
atgtctgagcaggaggcccaggcccctgggggccggggcctgcccccagacatgctggccgagcaggtggagctgtggtggagccagcagccccggcgcagcgccctgtgctttgtggtggccgtgggcctggtggccggctgtggggccggcggcgtggccctgctgagcaccaccagcagccgctctggagagtggaggctggccaccggcaccgtgctgtgcctgctggccctgctggtgctggtgaagcagctgatgagcagcgctgtgcaggacatgaactgcatccggcaggcccaccacgtggccctgctgcggagcggcggcggcgcagatgccctggtggtgctgctgagcggcctggtgctgctggtgacaggcctgaccctggccggcctggccgccgccccagccccagcccggcccctggccgccatgctgtctgtgggcatcgccctggccgccctgggcagcctgctgctgctgggcctgctgctgtaccaggtgggcgtgtctggccactgccccagcatctgcatggccacccccagcacccacagcggccacggcggccacggcagcatcttcagcatcagcggccagctgtctgctggaagaagacatgagaccaccagcagcatcgccagcctcatctag

SEQ ID NO: 39167 - DNA, 660 bp, Artificial Sequence; identical to SEQ ID NO: 39166
  Description of Artificial Sequence: Synthetic coding sequence

SEQ ID NO: 39168 - DNA, 51 bp, Artificial Sequence
  Description of Artificial Sequence: Synthetic coding sequence
atgtctgagcaggaggcccaggcccctgggggccggggcctgcccccatag

SEQ ID NO: 39169 - DNA, 693 bp, Artificial Sequence
  Description of Artificial Sequence: Synthetic coding sequence
atggtggtgtttggctatgaggccggcaccaagccccgggacagcggcgtggtgcctgtgggcacagaggaggcccccaaggtgttcaagatggccgcctccatgcacggccagcccagccccagcctggaggatgccaagctgcggcggcccatggtgattgagatcatcgagaagaactttgactacctgaggaaggagatgacccagaacatctaccagatggccaccttcggcaccacagctggcttcagcggcatcttcagcaacttcctgttccgccgctgcttcaaggtgaagcatgatgccctgaagacctacgccagcctggccaccctgcccttcctgagcacagtggtgacagacaagctgtttgtgattgatgccctgtacagcgacaacatcagcaaggagaactgtgtgttccgcagcagcctgattggaattgtgtgtggggtcttctaccccagcagcctggccttcaccaagaatggccgcctggccaccaagtaccacacagtgcccctgccccccaagggccgggtgctgatccactggatgaccctgtgccagacccagatgaagctgatggccatccccctggtgttccagatcatgtttggcatcctgaatggcctgtaccactatgctgtgtttgaggagaccctggagaagaccatccacgaggagtag

SEQ ID NO: 39170 - DNA, 603 bp, Artificial Sequence
  Description of Artificial Sequence: Synthetic coding sequence
atggccgcctccatgcacggccagcccagccccagcctggaggatgccaagctgcggcggcccatggtgattgagatcatcgagaagaactttgactacctgaggaaggagatgacccagaacatctaccagatggccaccttcggcaccacagctggcttcagcggcatcttcagcaacttcctgttccgccgctgcttcaaggtgaagcatgatgccctgaagacctacgccagcctggccaccctgcccttcctgagcacagtggtgacagacaagctgtttgtgattgatgccctgtacagcgacaacatcagcaaggagaactgtgtgttccgcagcagcctgattggaattgtgtgtggggtcttctaccccagcagcctggccttcaccaagaatggccgcctggccaccaagtaccacacagtgcccctgccccccaagggccgggtgctgatccactggatgaccctgtgccagacccagatgaagctgatggccatccccctggtgttccagatcatgtttggcatcctgaatggcctgtaccactatgctgtgtttgaggagaccctggagaagaccatccacgaggagtag

SEQ ID NO: 39171 - DNA, 513 bp, Artificial Sequence
  Description of Artificial Sequence: Synthetic coding sequence
atggtggtgtttggctatgaggccggcaccaagccccgggacagcggcgtggtgcctgtgggcacagaggaggcccccaaggtgttcaagatggccgcctccatgcacggccagcccagccccagcctggaggatgccaagctgcggcggcccatggtgattgagatcatcgagaagaactttgactacctgaggaaggagatgacccagaacatctaccagatggccaccttcggcaccacagctggcttcagcggcatcttcagcaacttcctgttccgccgctgcttcaaggtgaagcatgatgccctgaagacctacgccagcctggccaccctgcccttcctgagcacagtggtgacagacaagctgtttgtgattgatgccctgtacagcgacaacatcagcaaggagaactgtgtgttccgcagcagcctgattggaattgtgtgtggggtcttctaccccagcagcctggccttcaccaagaatggccgcctggccaccaagtag

SEQ ID NO: 39172 - DNA, 177 bp, Artificial Sequence
  Description of Artificial Sequence: Synthetic coding sequence
atggtggtgtttggctatgaggccggcaccaagccccgggacagcggcgtggtgcctgtgggcacagaggaggcccccaaggacaccaagtacatcagcaatggagacatctggaacaacagctggttcctgtggaacatcctgaagctgcctgtgcagaccctgctgcagggctag

SEQ ID NO: 39173 - DNA, 426 bp, Artificial Sequence
  Description of Artificial Sequence: Synthetic coding sequence
atgccacccttcggctacaagacagagaccagcacagctgtggagaagaaggagaagcccctgccccggctgaacatccacagcggcttctggatcctggccagcatcgtggtgacctactacgtggacttcttcaagaccctgaaggagaacttccacaccagctcctggttcctgtgtggcagcgccctgctgctggtgtccctgagcatcgccttctactgcatcgtgtacctggagtggtactgcggcattggagaatatgatgtgaagtacccagccctgatccccatcaccacagccagcttcatcgccgccggcatctgcttcaacatcgccctgtggcacgtgtggagcttcttcacccccctgctgctcttcacccagttcatgggcgtggtgatgttcatcaccctgctgggctag

SEQ ID NO: 39174 - DNA, 498 bp, Artificial Sequence
  Description of Artificial Sequence: Synthetic coding sequence
atggacagcagccgggcccggcagcagctgcggcggcgcttcctgctgctgcctgatgctgaggcccagctggaccgggagggagatgctggccctgagaccagcacagctgtggagaagaaggagaagcccctgccccggctgaacatccacagcggcttctggatcctggccagcatcgtggtgacctactacgtggacttcttcaagaccctgaaggagaacttccacaccagctcctggttcctgtgtggcagcgccctgctgctggtgtccctgagcatcgccttctactgcatcgtgtacctggagtggtactgcggcattggagaatatgatgtgaagtacccagccctgatccccatcaccacagccagcttcatcgccgccggcatctgcttcaacatcgccctgtggcacgtgtggagcttcttcacccccctgctgctcttcacccagttcatgggcgtggtgatgttcatcaccctgctgggctag

SEQ ID NO: 39175 - DNA, 399 bp, Artificial Sequence
  Description of Artificial Sequence: Synthetic coding sequence
atggacagcagccgggcccggcagcagctgcggcggcgcttcctgctgctgcctgatgctgaggcccagctggaccgggagggagatgctggccctgagaccagcacagctgtggagaagaaggagaagcccctgccccggctgaacatccacagcggcttctggatcctggccagcatcgtggtgacctactacgtggacttcttcaagaccctgaaggagaacttccacaccagctcctggttcctgtgtggcagcgccctgctgctggtgtccctgagcatcgccttctactgcatcgtgtacctggagtggtactgcggcattggagaatatgatgtgaagtacccagccctgatccccatcaccacagccagcttcatcgccgccggcatctag

SEQ ID NO: 39176 - DNA, 498 bp, Artificial Sequence; identical to SEQ ID NO: 39174
  Description of Artificial Sequence: Synthetic coding sequence

SEQ ID NO: 39177 - DNA, 1089 bp, Artificial Sequence
  Description of Artificial Sequence: Synthetic coding sequence
atggacagccctgaggtgaccttcaccctggcctacctggtgtttgctgtgtgctttgtgttcaccccaaatgagttccacgccgccggcctgactgtgcagaacctgctgagcggctggctgggctctgaagatgctgcctttgtgcccttccacctgcggaggacagctgccaccctgctgtgccacagcctgctgcccctgggctactacgtgggcatgtgcctggccgccagcgagaagaggctgcacgccctgagccaggcccctgaggcctggaggctcttcctgctgctggccgtgaccctgcccagcatcgcctgcatcctgatctactactggagccgggaccgctgggcctgccaccccctggcccggaccctggccctgtatgccctgccccagagcggctggcaggccgtggccagctctgtgaacacagagttcagaagaattgacaagtttgccactggagcccctggggcccgggtgattgtgacagacacctgggtgatgaaggtgaccacctacagagtgcacgtggcccagcagcaggatgtgcacctgactgtgacagagagccggcagcacgagctgagcccagacagcaacctgcctgtgcagctgctgaccatccgggtggccagcaccaacccagctgtgcaggcctttgacatctggctgaacagcacagaatatggagagctgtgtgagaagctgcgggcccccatcagaagagctgcccacgtggtgatccaccagagcctgggggacctcttcctggagacctttgccagcctggtggaggtgaacccagcctacagcgtgcccagcagccaggagctggaggcctgcatcggctgcatgcagacccgggcctctgtgaagctggtgaagacctgccaggaggccgccaccggggagtgccagcagtgctactgccggcccatgtggtgcctgacctgcatgggcaagtggtttgccagccggcaggaccccctgcggccagacacctggctggccagccgggtgccctgccccacctgccgggcccgcttctgcatcctggatgtgtgcaccgtgaggtag

SEQ ID NO: 39178 - DNA, 1089 bp, Artificial Sequence; identical to SEQ ID NO: 39177
  Description of Artificial Sequence: Synthetic coding sequence

SEQ ID NO: 39179 - DNA, 699 bp, Artificial Sequence
  Description of Artificial Sequence: Synthetic coding sequence
atggacagccctgaggtgaccttcaccctggcctacctggtgtttgctgtgtgctttgtgttcaccccaaatgagttccacgccgccggcctgactgtgcagaacctgctgagcggctggctgggctctgaagatgctgcctttgtgcccttccacctgcggaggacagctgccaccctgctgtgccacagcctgctgcccctgggctactacgtgggcatgtgcctggccgccagcgagaagaggctgcacgccctgagccaggcccctgaggcctggaggctcttcctgctgctggccgtgaccctgcccagcatcgcctgcatcctgatctactactggagccgggaccgctgggcctgccaccccctggcccggaccctggccctgtatgccctgccccagagcggctggcaggccgtggccagctctgtgaacacagagttcagaagaattgacaagtttgccactggagcccctggggcccgggtgattgtgacagacacctgggtgatgaaggtgaccacctacagagtgcacgtggcccagcagcaggatgtgcacctgactgtgacagagagccggcagcacgagctgagcccagacagcaacctgcctgtgcagctgctgaccatccgggtggccagcaccaacccagctgtgcaggcctttgacatctggagctggaggcctgcctag

SEQ ID NO: 39180 - DNA, 1272 bp, Artificial Sequence
  Description of Artificial Sequence: Synthetic coding sequence
atggcccaggccgtgtggagccggctgggccgcatcctgtggctggcctgcctgctgccctgggccccagctggggtggccgccggcctgtatgagctgaacctgaccacagacagccctgccaccactggagctgtggtgaccatcagcgccagcctggtggccaaggacaatggcagcctggccctgcctgcagatgcccacctgtaccgcttccactggatccacacccccctggtgctgaccgggaagatggagaagggcctgagcagcaccatccgggtggtgggccacgtgcctggagagttccctgtgtctgtgtgggtgacagctgctgactgctggatgtgccagcctgtggcccggggctttgtggtgctgcccatcacagagttcctggtgggggacctggtggtgacccagaacaccagcctgccctggcccagcagctacctgaccaagacagtgctgaaggtgtccttcctgctgcatgaccccagcaacttcctgaagacagccctcttcctgtacagctgggactttggagatggcacccagatggtgacagaggacagcgtggtgtactacaactacagcatcatcggcaccttcaccgtgaagctgaaggtggtggccgagtgggaggaggtggagccagatgccaccagggctgtgaagcagaagacaggagacttcagcgccagcctgaagctgcaggagaccctgcggggcatccaggtgctgggccccaccctcatccagaccttccagaagatgacagtgaccctgaacttcctgggcagcccccccctgactgtgtgctggaggctgaagccagagtgcctgcccctggaggagggggagtgccaccctgtgtctgtggccagcacagcctacaacctgacccacaccttccgggaccccggggactactgcttcagcatccgggcagagaacatcatcagcaagacccaccagtaccacaagatccaggtgtggcccagccgcatccagcctgctgtgtttgccttcccctgtgccaccctcatcaccgtgatgctggccttcatcatgtacatgaccctgagaaatgccacccagcagaaggacatggtggagaaccctgagcccccatctggagtgcgctgctgctgccagatgtgctgcggccccttcctgctggagacccccagcgagtacctggagatcgtgcgggagaaccacggcctgctgccccccctgtacaagtctgtgaagacctacacagtgtag

SEQ ID NO: 39181 - DNA, 966 bp, Artificial Sequence
  Description of Artificial Sequence: Synthetic coding sequence
atggcccaggccgtgtggagccggctgggccgcatcctgtggctggcctgcctgctgccctgggccccagctggggtggccgctgagttcctggtgggggacctggtggtgacccagaacaccagcctgccctggcccagcagctacctgaccaagacagtgctgaaggtgtccttcctgctgcatgaccccagcaacttcctgaagacagccctcttcctgtacagctgggactttggagatggcacccagatggtgacagaggacagcgtggtgtactacaactacagcatcatcggcaccttcaccgtgaagctgaaggtggtggccgagtgggaggaggtggagccagatgccaccagggctgtgaagcagaagacaggagacttcagcgccagcctgaagctgcaggagaccctgcggggcatccaggtgctgggccccaccctcatccagaccttccagaagatgacagtgaccctgaacttcctgggcagcccccccctgactgtgtgctggaggctgaagccagagtgcctgcccctggaggagggggagtgccaccctgtgtctgtggccagcacagcctacaacctgacccacaccttccgggaccccggggactactgcttcagcatccgggcagagaacatcatcagcaagacccaccagtaccacaagatccaggtgtggcccagccgcatccagcctgctgtgtttgccttcccctgtgccaccctcatcaccgtgatgctggccttcatcatgtacatgaccctgagaaatgccacccagcagaaggacatggtggagaaccctgagcccccatctggagtgcgctgctgctgccagatgtgctgcggccccttcctgctggagacccccagcgagtacctggagatcgtgcgggagaaccacggcctgctgccccccctgtacaagtctgtgaagacctacacagtgtag

SEQ ID NO: 39182 - DNA, 1308 bp, Artificial Sequence
  Description of Artificial Sequence: Synthetic coding sequence
atggcccaggccgtgtggagccggctgggccgcatcctgtggctggcctgcctgctgccctgggccccagctggggtggccgccggcctgtatgagctgaacctgaccacagacagccctgccaccactggagctgtggtgaccatcagcgccagcctggtggccaaggacaatggcagcctggccctgcctgcagatgcccacctgtaccgcttccactggatccacacccccctggtgctgaccgggaagatggagaagggcctgagcagcaccatccgggtggtgggccacgtgcctggagagttccctgtgtctgtgtgggtgacagctgctgactgctggatgtgccagcctgtggcccggggctttgtggtgctgcccatcacagagttcctggtgggggacctggtggtgacccagaacaccagcctgccctggcccagcagctacctgaccaagacagtgctgaaggtgtccttcctgctgcatgaccccagcaacttcctgaagacagccctcttcctgtacagctgggactttggagatggcacccagatggtgacagaggacagcgtggtgtactacaactacagcatcatcggcaccttcaccgtgaagctgaaggtggtggccgagtgggaggaggtggagccagatgccaccagggctgtgaagcagaagacaggagacttcagcgccagcctgaagctgcaggagaccctgcggggcatccaggtgctgggccccaccctcatccagaccttccagaagatgacagtgaccctgaacttcctgggcagcccccccctgactgtgtgctggaggctgaagccagagtgcctgcccctggaggagggggagtgccaccctgtgtctgtggccagcacagcctacaacctgacccacaccttccgggaccccggggactactgcttcagcatccgggcagagaacatcatcagcaagacccaccagtaccacaagatccaggtgtggcccagccgcatccagcctgctgtgtttgccttcccctgtgccaccctcatcaccgtgatgctggccttcatcatgtacatgaccctgagaaatgccacccagcagaaggacatggtggaggtggccgactttgacttcagccccatgtctgacaagaaccctgagcccccatctggagtgcgctgctgctgccagatgtgctgcggccccttcctgctggagacccccagcgagtacctggagatcgtgcgggagaaccacggcctgctgccccccctgtacaagtctgtgaagacctacacagtgtag

SEQ ID NO: 39183 - DNA, 1215 bp, Artificial Sequence
  Description of Artificial Sequence: Synthetic coding sequence
atggaccctgagctgaccggctcctggggcctgtatgagctgaacctgaccacagacagccctgccaccaccggggctgtggtgaccatcagcgccagcctggtggccaaggacaatggcagcctggccctgcctgcagatgcccacctgtaccgcttccactggatccacacccccctggtgctgaccgggaagatggagaagggcctgagcagcaccatccgggtggtgggccacgtgcctggagagttccctgtgtctgtgtgggtgacagctgctgactgctggatgtgccagcctgtggcccggggctttgtggtgctgcccatcacagagttcctggtgggggacctggtggtgacccagaacaccagcctgccctggcccagcagctacctgaccaagacagtgctgaaggtgtccttcctgctgcatgaccccagcaacttcctgaagacagccctcttcctgtacagctgggactttggagatggcacccagatggtgacagaagattctgtggtgtactacaactacagcatcatcggcaccttcaccgtgaagctgaaggtggtggccgagtgggaggaggtggagccagatgccaccagggctgtgaagcagaagacaggagacttcagcgccagcctgaagctgcaggagaccctgcggggcatccaggtgctgggccccaccctcatccagaccttccagaagatgacagtgaccctgaacttcctgggcagcccccccctgactgtgtgctggaggctgaagccagaatgtctgcccctggaggagggggagtgccaccctgtgtctgtggccagcacagcctacaacctgacccacaccttccgggaccccggggactactgcttcagcatccgggcagagaacatcatcagcaagacccaccagtaccacaagatccaggtgtggcccagccgcatccagcctgctgtgtttgccttcccctgtgccaccctcatcaccgtgatgctggccttcatcatgtacatgaccctgagaaatgccacccagcagaaggacatggtggagaaccctgagccccccagcggcgtgcgctgctgctgccagatgtgctgcggccccttcctgctggagaccccatctgagtacctggagatcgtgagagaaaatcatggcctgctgccccccctgtacaagtctgtgaagacctacacagtgtag

SEQ ID NO: 39184 - DNA, 5652 bp, Artificial Sequence
  Description of Artificial Sequence: Synthetic coding sequence
atgggcaagagagctgggggcggggccaccggggccaccacagctgctgtgtccaccagcgctggagctggcctggagcctgctgctgcccggagcggcggccccaggtctgctgctgctggcctgctgggcgccctgcacctggtgatgaccctggtggtggccgccgcccgggcagagaaggaggcctttgtgcagagcgagagcatcatcgaggtgctgcgctttgatgatggcggcctgctgcagacagagaccaccctgggcctgagcagctaccagcagaagagcatcagcctgtaccggggcaactgccggcccatccgctttgagccccccatgctggacttccacgagcagcctgtgggcatgcccaagatggagaaggtgtacctgcacaaccccagcagcgaggagaccatcaccctggtgtccatcagcgccaccaccagccacttccacgccagcttcttccagaacaggaagatcctgcccggcggcaacaccagctttgatgtggtgttcctggcccgggtggtgggcaatgtggagaacaccctcttcatcaacaccagcaaccacggcgtcttcacctaccaggtgtttggagtgggcgtgcccaacccctaccgcctgcggcccttcctgggcgcccgggtgcctgtgaacagcagcttcagccccatcatcaacatccacaacccccacagcgagcccctgcaggtggtggagatgtacagcagcggcggggacctgcacctggagctgcccaccggccagcagggcggcaccaggaagctgtgggagatccccccctatgagaccaagggcgtgatgagggccagcttcagcagccgggaggccgacaaccacacagccttcatccgcatcaagaccaatgccagtgacagcacagagttcatcatcctgcctgtggaggtggaggtgaccacagcccctggcatctacagcagcacagagatgctggactttggcaccctgcggacccaggacctgcccaaggtgctgaacctgcacctgctgaacagcggcaccaaggatgtgcccatcacctctgtgcggcccaccccccagaatgatgccatcaccgtgcacttcaagcccatcaccctgaaggccagcgagagcaagtacaccaaggtggccagcatcagctttgatgccagcaaggccaagaagcccagccagttcagcggcaagatcaccgtgaaggccaaggagaagagctacagcaagctggagatcccctaccaggccgaggtgctggatggctacctgggctttgaccacgccgccaccctcttccacatccgggacagccctgctgaccctgtggagcggcccatctacctgaccaacaccttctcctttgccatcctgattcatgatgtgctgctgcctgaggaggccaagaccatgttcaaggtgcacaacttcagcaagcctgtgctgatcctgcccaatgaaagtggctacatcttcaccctgctcttcatgcccagcaccagctccatgcacatcgacaacaacatcctgctgatcaccaatgccagcaagttccacctgcctgtgcgggtgtacacaggcttcctggactactttgtgctgccccccaagattgaggagcgcttcatcgactttggagtgctgagcgccacagaggccagcaacatcctgtttgccatcatcaacagcaaccccatcgagctggccatcaagtcctggcacatcattggagatggcctgagcattgagctggtggccgtggagcggggcaacagaaccaccatcatcagcagcctgcctgagtttgagaagagcagcctgagtgaccagagctctgtgaccctggccagcggctactttgctgtgttccgggtgaagctgacagccaagaagctggagggcatccatgatggagccatccagatcaccacagattatgagatcctgaccatccctgtgaaggctgtgattgctgtgggcagcctgacctgcttccccaagcacgtggtgctgcccccatccttccctgggaagatcgtgcaccagagcctgaacatcatgaacagcttcagccagaaggtgaagatccagcagatccgcagcctgtctgaagatgtgcgcttctactacaagaggctgcggggcaacaaggaggacctggagcccgggaagaagagcaagatcgccaacatctactttgaccccggcctgcagtgtggggaccactgctacgtgggcctgcccttcctgagcaagtctgagcccaaggtgcagcccggggtggccatgcaggaggacatgtgggatgctgactgggacctgcaccagagcctcttcaagggctggacaggcatcaaggagaacagcggccaccggctgagcgccatctttgaggtgaacacagacctgcagaagaacatcatcagcaagatcacagctgagctgtcctggcccagcatcctgagcagccccaggcacctgaagttccccctgaccaacaccaactgcagcagcgaggaggagatcaccctggagaacccagcagatgtgcctgtgtatgtgcagttcatccccctggccctgtacagcaaccccagcgtgtttgtggacaagctggtgagccgcttcaacctgagcaaggtggccaagattgacctgcggaccctggagttccaggtgttcaggaacagcgcccaccccctgcagagcagcacaggcttcatggagggcctgagccgccacctgatcctgaacctgatcctgaagccaggagagaagaagtctgtgaaggtgaagttcacccctgtgcacaacagaacagtgagcagcctcatcatcgtgaggaacaacctgactgtgatggatgctgtgatggtgcagggccagggcaccacagagaacctgcgggtggccggcaagctgcccggccctggcagcagcctgcgcttcaagatcacagaggccctgctgaaggactgcacagacagcctgaagctgcgggagcccaacttcaccctgaagaggaccttcaaggtggagaacacaggccagctgcagatccacatcgagaccatcgagatcagcggctacagctgtgagggctacggcttcaaggtggtgaactgccaggagttcaccctgagcgccaatgccagccgggacatcatcatcctcttcaccccagacttcaccgccagcagggtcatccgggagctgaagttcatcaccaccagcggcagcgagtttgtgttcatcctgaatgccagcctgccctaccacatgctggccacctgtgccgaggccctgccccggcccaactgggagctggccctgtacatcatcatcagcggcatcatgtctgccctcttcctgctggtgattggaacagcctacctggaggcccagggcatctgggagcccttcagaagaaggctgagctttgaggccagcaaccccccatttgatgtgggccggccctttgacctgcggcgcatcgtgggcatcagcagcgagggcaacctgaacaccctgagctgtgaccccggccacagccggggcttctgtggggccggcggcagcagcagccggcccagcgctggcagccacaagcagtgtggccccagcgtgcacccccacagcagccacagcaacagaaattctgcagatgtggagaatgtgcgggccaagaacagcagcagcaccagcagcaggaccagcgcccaggccgccagcagccagagcgccaacaagaccagccccctggtgctggacagcaacacagtgacccagggccacacagctggcaggaagagcaaaggagccaagcagagccagcacggcagccagcaccacgcccacagccccctggagcagcacccccagccccccctgcccccacctgtgccccagccccaggagccccagcctgagcggctgagccctgcccccctggcccaccccagccaccctgagcgggccagcagcgcccggcacagcagtgaagattctgacatcaccagcctgattgaggccatggacaaggactttgaccaccacgacagccctgccctggaggtgttcacagagcagccccccagccccctgcccaagagcaagggcaagggcaagcccctgcagaggaaggtgaagccacccaagaagcaggaggagaaggagaagaagggcaagggcaagccccaggaggatgagctgaaggacagcctggctgatgatgacagcagcagcaccaccacagagaccagcaacccagacacagagcccctgctgaaggaggacacagagaagcagaagggcaagcaggccatgcctgagaagcatgaaagtgagatgagccaggtgaagcagaagagcaagaagctgctgaacatcaagaaggagatccccacagatgtgaagcccagcagcctggagctgccctacaccccacccctggagagcaagcagaggaggaacctgcccagcaagatccccctgcccacagccatgaccagcggcagcaagagcagaaatgcccagaagaccaagggcaccagcaagctggtggacaaccggcccccagccctggccaagttcctgcccaacagccaggagctgggcaacaccagcagcagcgagggggagaaggacagccccccacctgagtgggacagcgtgcctgtgcacaagccaggcagcagcacagacagcctgtacaagctgagcctgcagaccctgaatgctgacatcttcctgaagcagaggcagaccagccccaccccagccagccccagccccccagctgccccctgcccctttgtggcccggggcagctacagcagcatcgtgaacagcagcagcagcagtgaccccaagatcaagcagcccaacggcagcaagcacaagctgaccaaggccgccagcctgcccgggaagaatggaaaccccacctttgctgctgtgacagctggctatgacaagagccctggaggaaatggatttgccaaggtgagcagcaacaagacaggcttcagcagcagcctgggcatcagccacgcccctgtggacagtgatggcagtgacagcagcggcctgtggagccctgtgagcaaccccagcagcccagacttcacccccctgaacagcttcagcgcctttggaaacagcttcaacctgaccggggaggtgttcagcaagctgggcctgagccgcagctgcaaccaggccagccagaggtcctggaatgagttcaacagcggccccagctacctgtgggagagccctgccacagaccccagccccagctggccagccagcagcggcagccccacccacacagccacctctgtgctgggcaacaccagcggcctgtggagcaccacccccttcagcagcagcatctggagcagcaacctgagcagcgccctgcccttcaccaccccagccaacaccctggccagcatcggcctgatgggcacagagaacagccctgcccctcatgcccccagcaccagcagccctgcagatgacctgggccagacctacaacccctggaggatctggagccccaccatcggccgccgcagcagtgacccctggagcaacagccacttcccccatgagaactag

SEQ ID NO: 39185 - DNA, 999 bp, Artificial Sequence
  Description of Artificial Sequence: Synthetic coding sequence
tgaggactgctgggcgccctgcacctggtgatgaccctggtggtggccgccgcccgggcagagaaggaggcctttgtgcagagcgagagcatcatcgaggtgctgcgctttgatgatggcggcctgctgcagacagagaccaccctgggcctgagcagctaccagcagaagagcatcagcctgtaccggggcaactgccggcccatccgctttgagccccccatgctggacttccacgagcagcctgtgggcatgcccaagatggagaaggtgtacctgcacaaccccagcagcgaggagaccatcaccctggtgtccatcagcgccaccaccagccacttccacgccagcttcttccagaacaggaagatcctgcccggcggcaacaccagctttgatgtggtgttcctggcccgggtggtgggcaatgtggagaacaccctcttcatcaacaccagcaaccacggcgtcttcacctaccaggtgtttggagtgggcgtgcccaacccctaccgcctgcggcccttcctgggcgcccgggtgcctgtgaacagcagcttcagccccatcatcaacatccacaacccccacagcgagcccctgcaggtggtggagatgtacagcagtggaggagacctgcacctggagctgcccaccggccagcagggcggcaccaggaagctgtgggagatccccccctatgagaccaagggcgtgatgagggccagcttcagcagccgggaggccgacaaccacacagccttcatccgcatcaagaccaatgccagtgacagcacagagttcatcatcctgcctgtggaggtggaggtgaccacagcccctggcatctacagcagcacagagatgctggactttggcaccctgcggacccaggacctgcccaaggtgctgaacctgcacctgctgaacagcggcaccaaggatgtgcccatcacccaccggcggcagaagagccacctgtccttcctgggcaagtag

SEQ ID NO: 39186 - DNA, 969 bp, Artificial Sequence
  Description of Artificial Sequence: Synthetic coding sequence
atgaccctggtggtggccgccgcccgggcagagaaggaggcctttgtgcagagcgagagcatcatcgaggtgctgcgctttgatgatggcggcctgctgcagacagagaccaccctgggcctgagcagctaccagcagaagagcatcagcctgtaccggggcaactgccggcccatccgctttgagccccccatgctggacttccacgagcagcctgtgggcatgcccaagatggagaaggtgtacctgcacaaccccagcagcgaggagaccatcaccctggtgtccatcagcgccaccaccagccacttccacgccagcttcttccagaacaggaagatcctgcccggcggcaacaccagctttgatgtggtgttcctggcccgggtggtgggcaatgtggagaacaccctcttcatcaacaccagcaaccacggcgtcttcacctaccaggtgtttggagtgggcgtgcccaacccctaccgcctgcggcccttcctgggcgcccgggtgcctgtgaacagcagcttcagccccatcatcaacatccacaacccccacagcgagcccctgcaggtggtggagatgtacagcagtggaggagacctgcacctggagctgcccaccggccagcagggcggcaccaggaagctgtgggagatccccccctatgagaccaagggcgtgatgagggccagcttcagcagccgggaggccgacaaccacacagccttcatccgcatcaagaccaatgccagtgacagcacagagttcatcatcctgcctgtggaggtggaggtgaccacagcccctggcatctacagcagcacagagatgctggactttggcaccctgcggacccaggacctgcccaaggtgctgaacctgcacctgctgaacagcggcaccaaggatgtgcccatcacccaccggcggcagaagagccacctgtccttcctgggcaagtag

SEQ ID NO: 39187 - DNA, 3237 bp, Artificial Sequence
  Description of Artificial Sequence: Synthetic coding sequence
atgtttggagctgccagcaggatggacaccacagctgtgtgcacaggaggagtgacagagagccggggcatcgtggacagcctgcagaagttcagcagcctgcctgcctacctgcccaccaacctgcacatcagcaatgctgaggagagcttcttcctgaaggaggccaaccaggacctgaccaggaacagcagcctgcaggcccgggtggagcccttcttcatctaccgggcccggaccccacccatcatcaatgccagctatggccccttctctgtggagaagatcatcccccaggagctgctgctgaccagcacagccttcggcaacatggacaagttccccttcaactggaagctgaagagccacatcctggacagcagcatctacagcaaccggcccaaggtgcagaccctcttctacgtgacaggcatgggctgggatgacagcgacctgacagaggacctgccctgtgtgaagatgtttgccttccctgaggcccgggaggtggccgccagctgccgcctgcagggcgcccctggcctgtgtgtggccgagctggagctgctgcctgagtggttcagcagcggcctggacctggagcctgaggaggagatcccagccctgctgggcggcaccaccatggagctgttcttcaccctgtacccagctgacaaggccggccagtgccccctggaggaggagggcaagtgggagaacaacatccacagcggcctggagagcccccagcaggccttccctgcccgggagagaattggctctgtggtggtgtaccccacccaggatgacctgaagtggagcctggtgtccctggatgaaaatgtggtgatctctgtgcccctgaacctggtgcgggagggggacacagccaccttcctggtgtccctgaccagcagctctgtggccgaccagttcaccctgcgcatcaaggctgctgctggggtgaagatcacagctgtgcgggtgtcctctgaggaccagtgggccgtgcaggaggagattgacaatggcagcacccagaccagcgccaccctgacctgcatgggccacaggccagacacccagagccgggtgaatggcagcttctatgagatcctgcaggtggactttggaattgacaacagcagtgacctggccggggcccagcagatcacctggcaggtggagtaccccatcgaggacagcatgtctgagctggtggtgtctgagatctttgtgtcccagaccacctttgtgggcatcgtgcccctggccatggacacagaggtgctgaacacagccatcctgaccgggaagcctgtgtctgtgcctgtgaaggtggtgggcgtgcaggaggatggctctgtggtggatgtgtctgagagcgtggagtgcaagtctgcagatgaagatgtgatcaaggtgagcaacaactgtgacagcatctttgtgaatggcaaggagatgaagagcaaggtggacaccatcgtgaacttcacccaccagcacttcaccagccagtttgaggtgacagtgtgggccccccggctgcccctgcagatcgagatcagtgacacagagctgagccagatcaagggctggagaattcctgtggccgccaacagaagacccacccgggagagtgatgatgaagatgatgaggagaagaagggccggggctgcagcctgcagtaccagcacgccaccgtgcgggtgctgacccagtttgtggccgagagcccagacctgggccagctgacctacatgctgggccctgactggcagtttgacatcacagacctggtgacagagttcatgaaggtggaggagcccaagatcgcccagctgcaggacggccgcaccctggccggccgggagcccggcatcaccaccgtgcaggtgctgagccccctgagtgacagcatcctggccgagaagacagtgattgtgctggatgacagagtgaccatcgccgagctgggcgtgcagctggtggccggcatgagcctgagcctgcagccccacagagctgacaagagggccatcgtgtccacagctgctgccctggatgtgctgcagagcccccagcaggaggccatcgtgtcctcctggatcctcttcagtgatggctctgtgacccccctggacatctatgaccccaaggactacagcgtgacagtgagcagcctggatgagatggtggtgtctgtgcaggccaacctggagagcaagtggcccatcgtggtggccgagggggagggccagggccccctcatcaagctggagatgatgatcagcgagccctgccagaagaccaagaggaagtctgtgctggccgtgggcaaaggaaatgtgaaggtgaagtttgagcccagcagtgatgagcaccagggcggcagcaatgacatcgagggcatcaaccgggagtacaaggaccacctgagcaacagcattgaaagagagggcaaccaggagagagctgtgcaggagtggttccaccggggcacccctgtgggccaggaggagagcaccaacaagagcaccaccccccagagccccatggagggcaagaacaagctgctgaagagcggcggcccagatgccttcaccagcttccccacccagggcaagagcccagaccccaacaaccccagcgacctgactgtgaccagccggggcctgacagacctggagatcggcatgtatgccctgctgtgtgtgttctgcctggccatcctggtgttcctgatcaactgtgtggcctttgcctggaagtaccgccacaagagatttgctgtgtctgagcagggcaacatcccccacagccatgactgggtgtggctgggcaatgaggtggagctgctggagaaccctgtggacatcaccctgcccagtgaagaatgtaccaccatgattgaccggggcctgcagtttgaggagaggaacttcctgctgaatggcagcagccagaagaccttccacagccagctgctgcggcccagcgactatgtgtatgagaaggagatcaagaatgagcccatgaacagcagcggccccaagaggaagagggtgaagttcaccagctacaccaccatcctgcctgaagatggcggcccctacaccaacagcatcctgtttgacagtgatgacaacatcaagtgggtgtgccaggacatgggcctgggggacagccaggacttccgggactacatggagagcctgcaggaccagatgtag

SEQ ID NO: 39188 - DNA, 3327 bp, Artificial Sequence
  Description of Artificial Sequence: Synthetic coding sequence
atgaggtctgagggcgccgcccctggccctgctgcccccctgtgtggggccctgagcctgctgctgggcgccctgctgggcaaggtgattgagggccatggagtgacagacaacatccagcgcttcagcagcctgcccccctacctgcctgtgtcctaccacatcctgcgggcagagaccagcttcttcctgaaggaggccaaccaggacctgctgaggaacagcagcctgcaggcccgggtggagagcttcttcacctacaagacccggcagccccctgtgctgaatgccagctatggccccttctctgtggagaaggtggtgcccctggacctgatgctgaccagcaacttcctgggccccaccaacaagttctcctttgactggaagctgaaggcccacatcctgcgggacaaggtgtacctgagccggcccaaggtgcaggtgctcttccacatcatgggccgggactgggatgaccatggagctggggagaagctgccctgcctgcgggtgtttgccttccgggagacccgggaggtgcggggcagctgccgcctgaagggggacctgggcctgtgtgtggccgagctggagctgctgagctcctggttcagcgcccccaccgtgggcgccggcaggaagaagtccatggaccagcctgagggcacccctgtggagctgtactacacagtgcaccctggaaatgaaagaggagactgtgccggcggggacttcagaaaaggaaatgccatccggcctgggaaggatggcctggaggagaccaccagccacctgcagagaattggaacagtgggcctgtaccgggcccaggacagcgcccagctgtctgagctgcggctggatggaaatgtggtgatctggctgcccagcaggcctgtgaagcagggcgaggtggtgacagcctacgtgaccatcagcagcaacagctctgtggacctcttcatcctgcgggccaaggtgaagaagggcgtgaacatcctgagcgcccagacccgggagccccggcagtggggcgtgaagcaggaggtgggcagcggcggcaagcacgtgacagccaccgtggcctgccagaggctgggccccagccccaggaacagaagcagcagcctcttcaatgaggtggtgcagatgaactttgaaattgccagcttcagcagcctgagcggcacccagcccatcacctggcaggtggagtaccccaggaagggcaccacagacattgctgtgtctgagatctttgtgtcccagaaggacctggtgggcatcgtgcccctggccatggacacagagatcctgaacacagctgtgctgaccgggaagacagtggccatgcccatcaaggtggtgtctgtggaggagaacagcgctgtgatggacatcagcgagagcgtggagtgcaagagcacagatgaagatgtgatcaaggtgtctgagcgctgtgactacatctttgtgaatggcaaggagatcaagggcaagatggatgctgtggtgaacttcacctaccagtacctgagcgcccccctgtgtgtgacagtgtgggtgccccggctgcccctgcagatcgaggtgtctgacacagagctgagccagatcaagggctggagggtgcccatcgtgaccaacaagaggcccacccgggagagtgaagatgaagatgaggaggagcggcggggccggggctgtgccctgcagtaccagcacgccaccgtgcgggtgctgacccagtttgtgtctgagggcgccggcccctggggccagcccaactacctgctgagccccaactggcagtttgacatcacccacctggtggccgacttcatgaagctggaggagccccacgtggccaccctgcaggacagccgggtgctggtgggccgggaggtgggcatgaccaccatccaggtgctgagccccctgagtgacagcatcctggccgagaagaccatcaccgtgctggatgacaaggtgtctgtgacagacctggccatccagctggtggccggcctgtctgtggccctgtacccaaatgctgagaacagcaaggctgtgacagctgtggtgacagctgaggaggtgctgcggacccccaagcaggaggccgtgttcagcacctggctgcagttcagtgatggctctgtgacccccctggacatctatgacaccaaggacttcagcctggccgccaccagccaggatgaagctgtggtgtctgtgccccagcccaggagcccccgctggcctgtggtggtggccgagggggagggccagggccccctcatccgggtggacatgaccatcgccgaggcctgccagaagagcaagaggaagagcatcctggccgtgggcgtgggcaatgtgcgggtgaagtttggccagaatgatgctgacagcagccctggaggagactatgaggaggatgagatcaagaaccacgccagtgaccggcggcagaagggccagcaccacgagaggacaggccaggacggccacctgtatggcagcagccctgtggagcgggaggagggcgccctgcggcgggccaccaccacagcccggagcctgctggacaacaaggtggtgaagaacagcagagcagatggcggccgcctggccggggagggccagctgcagaacatccccatcgacttcaccaacttccctgcccacgtggacctgcccaaggccggcagcggcctggaggagaatgacctggtgcagaccccccggggcctgagtgacctggagatcggcatgtatgccctgctgggcgtcttctgcctggccatcctggtgttcctgatcaactgtgccacctttgccctgaagtaccgccacaagcaggtgcccctggagggccaggcctccatgacccacagccatgactgggtgtggctgggcaatgaggccgagctgctggagagcatgggagatgcccccccaccccaggatgagcacaccaccatcatcgaccggggccctggggcctgtgaggagagcaaccacctgctgctgaatggaggcagccacaagcacgtgcagagccagatccacaggtctgctgacagcggcggccggcagggccgggagcagaagcaggaccccctgcacagccccaccagcaagaggaagaaggtgaagttcaccaccttcaccaccatccccccagatgacagctgccccaccgtgaacagcatcgtgagcagcaatgatgaggacatcaagtgggtgtgccaggatgtggccgtgggcgcccccaaggagctgaggaactacctggagaagctgaaggacaaggcctag

SEQ ID NO: 39189 - DNA, 1914 bp, Artificial Sequence
  Description of Artificial Sequence: Synthetic coding sequence
atgcagagagatgagagcagccccttccccccactcttcagcctgaccagcagccaggtgtctgacagatgtgactatgtgtttgtgaatggcaaggagatgaagggcaaggtgaatgtggtggtgaacttcacctaccagcacctgagcagccccctggagatgacagtgtgggtgccccggctgcccctgcagatcgaggtgtctgacacagagctgaaccagatcaagggctggagggtgcccatcgtgagcagcagaagacctgctggggacagcgaggaggaggaggatgatgaaagaagaggccggggctgcaccctgcagtaccagcacgccatggtgcgggtgctgacccagtttgtggccgaggccgccggccctgggggccacctggcccacctgctgggcagtgactggcaggtggacatcacagagctgatcaatgacttcatgcaggtggaggagcccagaattgccaagctgcagggcggccagatcctgatgggccaggagctgggcatgaccaccatccagatcctgagccccctgagtgacaccatcctggccgagaagaccatcaccgtgctggatgagaaggtgaccatcacagacctgggcgtgcagctggtgacaggcctgagcctgagcctgcagctgagccctggcagcaacagagccatctttgccacagctgtggcccaggagctgctgcagaggcccaagcaggaggccgccatcagctgctgggtgcagttcagtgatggctctgtgacccccctggacatctatgatggcaaggacttcagcctgatggccaccagcctggatgagaaggtggtgtccatccaccaggaccccaagttcaagtggcccatcatcgctgctgagacagagggccagggcaccctggtgaaggtggagatggtgatcagcgagagctgccagaagagcaagaggaagtctgtgctggccgtgggcacagccaacatcaaggtgaagtttggccagaatgatgccaaccccaacaccagtgacagccgccacactggagctggggtgcacatggagaacaacgtgtctgacagaagacccaagaagcccagccaggagtggggcagccaggagggccagtactacggcagcagctccatgggcctgatggagggccggggcaccaccacagacaggagcatcctgcagaagaagaagggccaggagagcctgctggatgacaacagccacctgcagaccatccccagcgacctgaccagcttccctgcccaggtggacctgcccaggagcaatggagagatggatggaaatgacctgatgcaggccagcaagggcctgagtgacctggagatcggcatgtatgccctgctgggcgtcttctgcctggccatcctggtgttcctgatcaactgtgtgacctttgccctgaagtaccgccacaagcaggtgccctttgaggagcaggagggcatgagccacagccatgactgggtgggcctgagcaacagaacagagctgctggagaaccacatcaactttgccagcagccaggatgagcagatcacagccatcgaccggggcatggactttgaggagagcaagtacctgctgagcaccaacagccagaagagcatcaatggccagctgttcaagcccctgggccccatcatcattgatggcaaggaccagaagtctgagccccccaccagccccaccagcaagaggaagagggtgaagttcaccaccttcaccgctgtgtccagtgatgatgagtaccccaccaggaacagcatcgtgatgagcagtgaagatgacatcaagtgggtgtgccaggacctggaccccggggactgcaaggagctgcacaactacatggagcggctgcatgaaaatgtgtag

SEQ ID NO: 39190 - DNA, 3300 bp, Artificial Sequence
  Description of Artificial Sequence: Synthetic coding sequence
atgtgccccagcgagatgggcaccctgtggcaccactggagccctgtgctgatcagcctggccgccctcttcagcaaggtgacagagggccggggcatcctggagagcatccagcgcttcagcctgctgcccacctacctgcctgtgacctaccacatcaacaatgctgatgtgtccttcttcctgaaggaggccaaccaggacatcatgaggaacagcagcctgcagagccgggtggagagcttcctgatctacaagagccggcggctgcctgtgctgaatgccagctatggccccttcagcattgagcaggtggtgccccaggacctgatgctgcccagcaaccccttcggcttcaccaacaagttcagcctgaactggaagctgaaggcccacatcctgcgggacaaggtgtacctgagccggcccaaggtgcaggtgctcttccacatcatgggccgggactgggatgacagatctgctggggagaagctgccctgcctgcgggtgtttgccttccgggagacccgggaggtgcggggcagctgccgcctgcagggcgacctgggcctgtgtgtggccgagctggagctgctgagctcctggttcagccccccaacagtggtggccggccgcaggaagtctgtggaccagcctgagggcacccctgtggagctgtactacacagtgcaccctggaggagagcggggggactgtgtgcgggaggatgcccggcgcagcaatggcatcagaacaggccacagcgacattgatgagagcggcccccccctgcagagaattggcagcatcttcctgtaccagacccacaggaagcccagcctgcgggagctgcggctggacaacagcgtggccatccactacatccccaagacagtgaggaaaggagatgtgctgaccttccctgtgtccatcagcaggaacagcacagaagatcgcttcaccctgcgggccaaggtgaagaagggcgtgaacatcattggagtgcgggccagcagccccagcatctgggatgtgaaggagaggacagactacaccgggaagtatgccccagctgtgattgtgtgccagaagaaggctgctggcagcgagaacagcgcagatggagccagctatgaggtgatgcagattgatgtggaggtggaggagcccggggacctgcctgccacccagctggtgacctggcaggtggagtacccaggagagatcaccagtgacctgggcgtgtccaagatctacgtgagccccaaggacctgattggagtggtgcccctggccatggaggccgagatcctgaacacagccatcctgaccgggaagacagtggccgtgcctgtgaaggtggtgtctgtggaggatgatggcaccgtgacagagctgctggagagcgtggagtgccgcagcagtgatgaagatgtgatcaaggtgtctgacagatgtgactatgtgtttgtgaatggcaaggagatgaagggcaaggtgaatgtggtggtgaacttcacctaccagcacctgagcagccccctggagatgacagtgtgggtgccccggctgcccctgcagatcgaggtgtctgacacagagctgaaccagatcaagggctggagggtgcccatcgtgagcagcagaagacctgctggggacagcgaggaggaggaggatgatgaaagaagaggccggggctgcaccctgcagtaccagcacgccatggtgcgggtgctgacccagtttgtggccgaggccgccggccctgggggccacctggcccacctgctgggcagtgactggcaggtggacatcacagagctgatcaatgacttcatgcaggtggaggagcccagaattgccaagctgcagggcggccagatcctgatgggccaggagctgggcatgaccaccatccagatcctgagccccctgagtgacaccatcctggccgagaagaccatcaccgtgctggatgagaaggtgaccatcacagacctgggcgtgcagctggtgacaggcctgagcctgagcctgcagctgagccctggcagcaacagagccatctttgccacagctgtggcccaggagctgctgcagaggcccaagcaggaggccgccatcagctgctgggtgcagttcagtgatggctctgtgacccccctggacatctatgatggcaaggacttcagcctgatggccaccagcctggatgagaaggtggtgtccatccaccaggaccccaagttcaagtggcccatcatcgctgctgagacagagggccagggcaccctggtgaaggtggagatggtgatcagcgagagctgccagaagagcaagaggaagtctgtgctggccgtgggcacagccaacatcaaggtgaagtttggccagaatgatgccaaccccaacaccagtgacagccgccacactggagctggggtgcacatggagaacaacgtgtctgacagaagacccaagaagcccagccaggagtggggcagccaggagggccagtactacggcagcagctccatgggcctgatggagggccggggcaccaccacagacaggagcatcctgcagaagaagaagggccaggagagcctgctggatgacaacagccacctgcagaccatccccagcgacctgaccagcttccctgcccaggtggacctgcccaggagcaatggagagatggatggaaatgacctgatgcaggccagcaagggcctgagtgacctggagatcggcatgtatgccctgctgggcgtcttctgcctggccatcctggtgttcctgatcaactgtgtgacctttgccctgaagtaccgccacaagcaggtgccctttgaggagcaggagggcatgagccacagccatgactgggtgggcctgagcaacagaacagagctgctggagaaccacatcaactttgccagcagccaggatgagcagatcacagccatcgaccggggcatggactttgaggagagcaagtacctgctgagcaccaacagccagaagagcatcaatggccagctgttcaagcccctgggccccatcatcattgatggcaaggaccagaagtctgagccccccaccagccccaccagcaagaggaagagggtgaagttcaccaccttcaccgctgtgtccagtgatgatgagtaccccaccaggaacagcatcgtgatgagcagtgaagatgacatcaagtgggtgtgccaggacctggaccccggggactgcaaggagctgcacaactacatggagcggctgcatgaaaatgtgtag

SEQ ID NO: 39191 - DNA, 2955 bp, Artificial Sequence
  Description of Artificial Sequence: Synthetic coding sequence
atggcccctggcatgagcggccggggcggggccgccctgctgtgcctgagcgccctgctggcccacgccagcggccgcagccacccagccagccccagccccccaggcccccaggccagccctgtgctgcctgtgtcctaccgcctgagccacacccggctggccttcttcctgcgggaggcccggccccccagccctgctgtggccaacagcagcctgcagaggtctgagccctttgtggtgttccagaccaaggagctgcctgtgctgaatgtgtccctgggccccttcagcaccagccaggtggtggcccgggagctgctgcagcccagcagcaccctggacatccctgagcggctgactgtgaactggaaggtgcgggccttcatcgtgcgcagccacgtgcctgccagccagcctgtggtgcaggtgctcttctacgtggccggccgggactgggatgactttggagtgacagagcggctgccctgtgtgcggctgcacgccttcagagatgcccgggagcaccccctgctgagaattggcagcatcagcctcttccggcccccacccaggaggaccctgcaggagcaccggctggacagcaacctgatgatccggctgcctgaccggcccctgaagccaggagaggtgctgagcatcctgctgtacctggcccccaacagcagcagccccagcagccccagcgtggagcacttcaccctgcgggtgaaggccaagaagggcgtgaccctgctgggcaccaagagccgcagcggccagtggcacgtgaccagcgagctgctgaccggggccaagcacagcacagccaccgtggatgtggcctgggcccagagcacccccctgcccccccgggagggccagggccccctggagatcctgcagctggactttgagatggagaacttcaccagccagagcgtgaagaggcgcatcatgtggcacatcgactaccggggccacggggccctgcctgacctggagagagctgtgacagagctgaccgtcatccagagagatgtgcaggccatcctgcccctggccatggacacagagatcatcaacacagccatcctgactggaagaacagtggccatccctgtgaaggtgattgccatcgaggtgaatggcctggtgctggacatcagcgccctggtggagtgtgagagtgacaatgaagacatcatcaaggtgagcagcagctgtgactatgtgtttgtgtctgggaaggagagccggggctccatgaatgcccgggtgaccttccgctatgatgtgctgaatgcccccctggagatgacagtgtgggtgcccaagctgcccctgcacatcgagctgagtgatgcccggctgagccaggtgaagggctggagggtgcccatcctgcctgaccggcgctctgtgcgggagagtgaagatgaagatgaggaggaggaggagcggcggcagagcgccagccggggctgcaccctgcagtaccagcacgccaccctgcaggtgttcacccagttccacaccaccagcagcgagggcacagaccaggtggtgaccatgctgggccctgactggctggtggaggtgacagacctggtgtctgacttcatgagggtgggggacccccgggtggcccacatggtggacagcagcaccctggccggcctggagcccggcaccacccccttcaaggtggtgagccccctgacagaagctgtgctgggggagaccctgctgactgtgacagaggagaaggtgtccatcacccagctgcaggcccaggtggtggccagcctggccctgagcctgcggcccagccctggcagcagccacaccatcctggccaccacagctgcccagcagaccctgtccttcctgaagcaggaggccctgctgagcctgtggctgagctacagtgatggcaccacagcccccctgagcctgtacagcccccgggactatggcctgctggtgagcagcctggatgaacatgtggccaccgtgacccaggaccgggccttccccctggtggtggccgaggccgagggcagcggggagctgctgcgggcagagctgaccatcgccgagagctgccagaagaccaagaggaagtctgtgctggccaccacccctgtgggcctgcgggtgcacttcggcagagatgaggaggaccccacctatgactacccaggccccagccagcccggccctgggggcggggaggatgaggcccggggggccggccccccaggcagcgccctgcctgcccctgaggcccctggccctggaacagccagccctgtggtgcccccaacagaggacttcctgcccctgcccaccggcttcctgcaggtgccccggggcctgacagacctggagatcggcatgtatgccctgctgggcgtcttctgcctggccatcctggtgttcctgatcaactgcatcgtgtttgtgctgcgctaccgccacaagaggatccccccagagggccagacctccatggaccacagccaccactgggtgttcctgggcaatggccagcccctgcgggtgcagggcgagctgagccccccagctggcaaccccctggagaccgtgcctgccttctgccacggggaccaccacagcagcggcagcagccagacctctgtgcagagccaggtgcacggcagaggagatggcagcagcggcggcagcgcccgggaccaggccgaggaccctgccagcagccccaccagcaagaggaagagggtgaagttcaccaccttcaccaccctgcccagcgaggagctggcctatgacagcgtgcctgctggggaggaggatgaggaggaggaggaggacctgggctggggctgcccagatgtggccggccccacccggcccacagcccccccagacctgcacaactacatgaggcgcatcaaggagatcgcctag

SEQ ID NO: 39192 - DNA, 390 bp, Artificial Sequence
  Description of Artificial Sequence: Synthetic coding sequence
atgaccagccaccactgtgtgggccctggcaaccacatctcctggagcggccacgagaaggagcaccggctggactactgcccagaggtgaccttccccctgaccaagggcttccccctgggctacaccctgctcttcaactttgccagctaccccttcctgctgcccagcaagatcaagaccctgctgaggaacaaggacagcttcctgaacatcctgtgcccagcctgcctgctgctgatccgccgctgcaacatcgagtacagcagcacaggcctgaacttcctgaacaccttcaccgtgtccctcatcgtgaccgtcatccccctgctgcagaatgtgcctgtgcccctgggcaacaacgtgggcaagatgcaggtgtatgaatag

SEQ ID NO: 39193 - DNA, 588 bp, Artificial Sequence
  Description of Artificial Sequence: Synthetic coding sequence
atgtctgctgcccggccccagttcagcattgatgatgcctttgagctgagcctggaggatggcggccctggccctgagagcagcggcgtggccaggtttggccccctgcactttgagcggcgggccaggtttgaggtggctgatgaggacaagcagagccggctgcgctaccagaacctggagaatgatgaagatggagcccaggccagccctgagccagatggcggcgtgggcacccgggacagcagcaggaccagcatccgcagcagccagtggagcttcagcaccatcagcagcagcacccagaggagctacaacacctgctgctcctggacccagcaccccctcatccagaagaacagaagagtggtgctggccagcttcctgctgctgctgctgggcctggtgctgatcctggtgggcgtgggcctggaggccacccccagccctggggtgagcagcgccatcttctttgtgcccggcttcctgctgctggtgcctggggtgtaccacgtgatcttcatctactgtgctgtgaagggccaccggggcttccagttcttctacctgccctactttgagaagtag

SEQ ID NO: 39194 - DNA, 543 bp, Artificial Sequence
  Description of Artificial Sequence: Synthetic coding sequence
atgtctgctgcccggccccagttcagcattgatgatgcctttgagctgagcctggaggatggcggccctggccctgagagcagcggcgtggccaggtttggccccctgcactttgagcggcgggccaggtttgaggtggctgatgaggacaagcagagccggctgcgctaccagaacctggagaatgatgaagatggagcccaggccagccctgagccagatggcggcgtgggcacccgggacagcagcaggaccagcatccgcagcagccagtggagcttcagcaccatcagcagcagcacccagaggagctacaacacctgctgctcctggacccagcaccccctcatccagaagaacagaagagtggtgctggccagcttcctgctgctgctgctgggcctgggcgtgtcctctgccatcttctttgtgcccggcttcctgctgctggtgcctggggtgtaccacgtgatcttcatctactgtgctgtgaagggccaccggggcttccagttcttctacctgccctactttgagaagtag

SEQ ID NO: 39195 - DNA, 1377 bp, Artificial Sequence
  Description of Artificial Sequence: Synthetic coding sequence
atggccgccctgagcaagagcatcccccacaactgctatgaaattggccacacctggcaccccagctgccgggtgtccttcctgcagatcactggaggagccctggaggagagcctgaagatctatgcccccctgtacctgattgctgccatcctgaggaagaggaagctggactactacctgcacaagctgctgcctgagatcctgcagagcgccagcttcctgacagccaacggggccctgtacatggccttcttctgcatcctgaggaagatcctgggcaagttctacagctggaccccaggctttggagctgccctgcctgccagctatgtggccatcctgattgaaaggaagagcagaagaggcctgctgaccatctacatggccaacctggccacagagaccctcttcaggatgggcgtggcccggggcaccatcaccaccctgagaaatggagaggtgctgctcttctgcatcacagctgccatgtacatgttcttcttccgctgcaaggatggcctgaagggcttcaccttcagcgccctgcgcttcatcgtgggcaaggaggagatccccacccacagcttcagccctgaggccgcctatgccaaggtggagcagaagcgggagcagcacgaggagaagccaggccgcatgaacatgattggcctggtgaggaagtttgtggacagcatctgcaagcacggccccaggcaccgctgctgcaagcactatgaggacaactgcatctcctactgcatcaagggcttcatccgcatgttttctgtgggctacctgatccagtgctgcctgcgcatccccagcgccttccgccacctgttcacccagcccagccggctgctgagcctcttctacaacaaggagaacttccagctgggcgccttcctgggcagctttgtgtccatctacaagggcaccagctgcttcctgcgctggatccggaacctggatgatgagctgcacgccatcatcgccggcttcctggccggcatctccatgatgttctacaagagcaccaccatctccatgtacctggccagcaagctggtggagaccatgtacttcaagggcatcgaggccggcaaggtgccctacttcccccatgctgacaccatcatctacagcatcagcacagccatctgcttccaggccgctgtgatggaggtgcagaccctgcggcccagctactggaagttcctgctgcggctgaccaagggcaagtttgctgtgatgaacaggaaggtgctggatgtgtttggaactggagccagcaagcacttccaggacttcatcccccggctggacccccgctacaccaccgtgaccccagagctgcccacagagttctcctag

SEQ ID NO: 39196 - DNA, 1311 bp, Artificial Sequence
  Description of Artificial Sequence: Synthetic coding sequence
atggccgccctgagcaagagcatcccccacaactgctatgaaattggccacacctggcaccccagctgccgggtgtccttcctgcagatcactggaggagccctggaggagagcctgaagatctatgcccccctgtacctgattgctgccatcctgaggaagaggaagctggactactacctgcacaagctgctgcctgagatcctgcagagcgccagcttcctgacagccaacggggccctgtacatggccttcttctgcatcctgaggaagatcctgggcaagttctacagctggaccccaggctttggagctgccctgcctgccagctatgtggccatcctgattgaaaggaagagcagaagaggcctgctgaccatctacatggccaacctggtgctgctcttctgcatcacagctgccatgtacatgttcttcttccgctgcaaggatggcctgaagggcttcaccttcagcgccctgcgcttcatcgtgggcaaggaggagatccccacccacagcttcagccctgaggccgcctatgccaaggtggagcagaagcgggagcagcacgaggagaagccaggccgcatgaacatgattggcctggtgaggaagtttgtggacagcatctgcaagcacggccccaggcaccgctgctgcaagcactatgaggacaactgcatctcctactgcatcaagggcttcatccgcatgttttctgtgggctacctgatccagtgctgcctgcgcatccccagcgccttccgccacctgttcacccagcccagccggctgctgagcctcttctacaacaaggagaacttccagctgggcgccttcctgggcagctttgtgtccatctacaagggcaccagctgcttcctgcgctggatccggaacctggatgatgagctgcacgccatcatcgccggcttcctggccggcatctccatgatgttctacaagagcaccaccatctccatgtacctggccagcaagctggtggagaccatgtacttcaagggcatcgaggccggcaaggtgccctacttcccccatgctgacaccatcatctacagcatcagcacagccatctgcttccaggccgctgtgatggaggtgcagaccctgcggcccagctactggaagttcctgctgcggctgaccaagggcaagtttgctgtgatgaacaggaaggtgctggatgtgtttggaactggagccagcaagcacttccaggacttcatcccccggctggacccccgctacaccaccgtgaccccagagctgcccacagagttctcctag

SEQ ID NO: 39197 - DNA, 483 bp, Artificial Sequence
  Description of Artificial Sequence: Synthetic coding sequence
atggccgccctgagcaagagcatcccccacaactgctatgaaattggccacacctggcaccccagctgccgggtgtccttcctgcagatcactggaggagccctggaggagagcctgaagatctatgcccccctgtacctgattgctgccatcctgaggaagaggaagctggactactacctgcacaagctgctgcctgagatcctgcagagcgccagcttcctgacagccaacggggccctgtacatggccttcttctgcatcctgaggaagatcctgggcaagttctacagctggaccccaggctttggagctgccctgcctgccagctatgtggccatcctgattgaaaggaagagcagaagaggcctgctgaccatctacatggccaacctgatggagagccactgcctgccccaggccggggtcatcagcgccccctgcagcctgtgcctgcccggcagccgggacagccctgcctag

SEQ ID NO: 39198 - DNA, 960 bp, Artificial Sequence
  Description of Artificial Sequence: Synthetic coding sequence
atgggcgtggcccggggcaccatcaccaccctgagaaatggagaggtgctgctcttctgcatcacagctgccatgtacatgttcttcttccgctgcaaggatggcctgaagggcttcaccttcagcgccctgcgcttcatcgtgggcaaggaggagatccccacccacagcttcagccctgaggccgcctatgccaaggtggagcagaagcgggagcagcacgaggagaagccaggccgcatgaacatgattggcctggtgaggaagtttgtggacagcatctgcaagcacggccccaggcaccgctgctgcaagcactatgaggacaactgcatctcctactgcatcaagggcttcatccgcatgttttctgtgggctacctgatccagtgctgcctgcgcatccccagcgccttccgccacctgttcacccagcccagccggctgctgagcctcttctacaacaaggagaacttccagctgggcgccttcctgggcagctttgtgtccatctacaagggcaccagctgcttcctgcgctggatccggaacctggatgatgagctgcacgccatcatcgccggcttcctggccggcatctccatgatgttctacaagagcaccaccatctccatgtacctggccagcaagctggtggagaccatgtacttcaagggcattgaagctgggaaggtgccctacttcccccacgccgacaccatcatctacagcatcagcacagccatctgcttccaggccgctgtgatggaggtgcagaccctgcggcccagctactggaagttcctgctgcggctgaccaagggcaagtttgctgtgatgaacaggaaggtgctggatgtgtttggcaccggggccagcaagcacttccaggacttcatcccccggctggacccccgctacaccaccgtgaccccagagctgcccacagagttctcctag

SEQ ID NO: 39199 - DNA, 888 bp, Artificial Sequence
  Description of Artificial Sequence: Synthetic coding sequence
atgtacatgttcttcttccgctgcaaggatggcctgaagggcttcaccttcagcgccctgcgcttcatcgtgggcaaggaggagatccccacccacagcttcagccctgaggccgcctatgccaaggtggagcagaagcgggagcagcacgaggagaagccaggccgcatgaacatgattggcctggtgaggaagtttgtggacagcatctgcaagcacggccccaggcaccgctgctgcaagcactatgaggacaactgcatctcctactgcatcaagggcttcatccgcatgttttctgtgggctacctgatccagtgctgcctgcgcatccccagcgccttccgccacctgttcacccagcccagccggctgctgagcctcttctacaacaaggagaacttccagctgggcgccttcctgggcagctttgtgtccatctacaagggcaccagctgcttcctgcgctggatccggaacctggatgatgagctgcacgccatcatcgccggcttcctggccggcatctccatgatgttctacaagagcaccaccatctccatgtacctggccagcaagctggtggagaccatgtacttcaagggcattgaagctgggaaggtgccctacttcccccacgccgacaccatcatctacagcatcagcacagccatctgcttccaggccgctgtgatggaggtgcagaccctgcggcccagctactggaagttcctgctgcggctgaccaagggcaagtttgctgtgatgaacaggaaggtgctggatgtgtttggcaccggggccagcaagcacttccaggacttcatcccccggctggacccccgctacaccaccgtgaccccagagctgcccacagagttctcctag

SEQ ID NO: 39200 - DNA, 804 bp, Artificial Sequence
  Description of Artificial Sequence: Synthetic coding sequence
atgacccagtgctgcttcctgcgggtgcaccccctcttcttctggttctggagcttccaccacaggatggccctggccctgtgcctgcaggtgctgtgcagcctgtgtggctggctgagcctgtacatctccttctgccacctgaacaagcacaggagctatgagtggagctgccgcctggtgaccttcacccatggagtgctgagcatcggcctgagcgcctacatcggcttcattgatggcccctggcccttcacccaccctggcagccccaacacccccctgcaggtgcacgtgctgtgcctgaccctgggctacttcatctttgacctgggctggtgtgtgtacttccagagcgagggcgccctgatgctggcccaccacaccctgagcatcctgggcatcatcatggccctggtgctgggggagagcggcacagaggtgaatgctgtgctgtttggaagtgagctgaccaaccccctgctgcagatgcgctggttcctgcgggagaccggccactaccacagcttcaccggagatgtggtggacttcctgtttgtggccctcttcaccggggtgagaattggagtgggcgcctgcctgctcttctgtgagatggtgagccccacccccaagtggtttgtgaaggccggcggcgtggccatgtatgctgtgtcctggtgcttcatgttcagcatctggaggtttgcctggaggaagagcatcaagaagtaccacgcctggaggagcagaagaagtgaggagcggcagctgaagcacaacggccacctgaagatccactag

SEQ ID NO: 39201 - DNA, 738 bp, Artificial Sequence
  Description of Artificial Sequence: Synthetic coding sequence
atggccctggccctgtgcctgcaggtgctgtgcagcctgtgtggctggctgagcctgtacatctccttctgccacctgaacaagcacaggagctatgagtggagctgccgcctggtgaccttcacccatggagtgctgagcatcggcctgagcgcctacatcggcttcattgatggcccctggcccttcacccaccctggcagccccaacacccccctgcaggtgcacgtgctgtgcctgaccctgggctacttcatctttgacctgggctggtgtgtgtacttccagagcgagggcgccctgatgctggcccaccacaccctgagcatcctgggcatcatcatggccctggtgctgggggagagcggcacagaggtgaatgctgtgctgtttggaagtgagctgaccaaccccctgctgcagatgcgctggttcctgcgggagaccggccactaccacagcttcaccggagatgtggtggacttcctgtttgtggccctcttcaccggggtgagaattggagtgggcgcctgcctgctcttctgtgagatggtgagccccacccccaagtggtttgtgaaggccggcggcgtggccatgtatgctgtgtcctggtgcttcatgttcagcatctggaggtttgcctggaggaagagcatcaagaagtaccacgcctggaggagcagaagaagtgaggagcggcagctgaagcacaacggccacctgaagatccactag

SEQ ID NO: 39202 - DNA, 447 bp, Artificial Sequence
  Description of Artificial Sequence: Synthetic coding sequence
atgacccagtgctgcttcctgcgggtgcaccccctcttcttctggttctggagcttccaccacaggatggccctggccctgtgcctgcaggtgctgtgcagcctgtgtggctggctgagcctgtacatctccttctgccacctgaacaagcacaggagctatgagtggagctgccgcctggtgaccttcacccatggagtgctgagcatcggcctgagcgcctacatcggcttcattgatggcccctggcccttcacccaccctggcagccccaacacccccctgcaggtgcacgtgctgtgcctgaccctgggctacttcatctttgacctgggctgcatctggaggtttgcctggaggaagagcatcaagaagtaccacgcctggaggagccgccgctctgaggagcggcagctgaagcacaacggccacctgaagatccactag

SEQ ID NO: 39203 - DNA, 651 bp, Artificial Sequence
  Description of Artificial Sequence: Synthetic coding sequence
atggtgcccatgcacctgctgggccgcctggagaagcccctgctgctgctgtgctgtgccagcttcctgctgggcctggccctgctgggcatcaagacagacatcacccctgtggcctacttcttcctgaccctgggcggcttcttcctgtttgcctacctgctggtgcgcttcctggagtggggcctgcggagccagctgcagagcatgcagacagagagccctggccccagcggaaatgcccgggacaatgaggcctttgaggtgcctgtgtatgaggaggccgtggtgggcctggagagccagtgccggccccaggagctggaccagcccccaccctacagcacagtggtgatccccccagcccctgaggaggagcagcccagccaccctgagggcagcagaagagccaagctggagcagaggaggatggccagcgagggctccatggcccaggagggcagccctggccgggcccccatcaacctgcggctgcggggccccagggctgtgtccacagccccagacctgcagagcctggccgctgtgcccaccctggagcccctgaccccacctccagcctatgatgtgtgcttcggccacccagatgatgacagcgtcttctatgaggacaactgggcccctccttag

SEQ ID NO: 39204 - DNA, 651 bp, Artificial Sequence; identical to SEQ ID NO: 39203
  Description of Artificial Sequence: Synthetic coding sequence

SEQ ID NO: 39205 - DNA, 651 bp, Artificial Sequence; identical to SEQ ID NO: 39203
  Description of Artificial Sequence: Synthetic coding sequence

SEQ ID NO: 39206 - DNA, 651 bp, Artificial Sequence; identical to SEQ ID NO: 39203
  Description of Artificial Sequence: Synthetic coding sequence

SEQ ID NO: 39207 - DNA, 651 bp, Artificial Sequence; identical to SEQ ID NO: 39203
  Description of Artificial Sequence: Synthetic coding sequence

SEQ ID NO: 39208 - DNA, 558 bp, Artificial Sequence
  Description of Artificial Sequence: Synthetic coding sequence
atggccggcccccggccccgctggagggaccagctgctcttcatgagcatcatcgtgctggtgattgtggtgatctgcctgatgttctacgccctgctgtgggaggccggcaacctgacagacctgcccaacctgagaattggcttctacaacttctgcctgtggaatgaagacaccagcaccctgcagtgccaccagtttcctgagctggaggccctgggcgtgccccgggtgggcctgggcctggcccggctgggcgtgtatggcagcctggtgctgaccctgtttgccccccagcccctgctgctggcccagtgcaacagtgatgagcgggcctggaggctggccgtgggcttcctggccgtgtcctctgtgctgctggccggcggcctgggcctcttcctgtcctatgtgtggaagtgggtgcggctgagcctgcccggccctggcttcctggccctgggcagcgcccaggccctgctgatcctgctgctgattgccatggctgtgttccccctgcgggcagagcgggcagagagcaagctggagagctgctag

SEQ ID NO: 39209 - DNA, 447 bp, Artificial Sequence
  Description of Artificial Sequence: Synthetic coding sequence
atggccggcccccggccccgctggagggaccagctgctcttcatgagcatcatcgtgctggtgattgtggtgatctgcctgatgttctacgccctgctgtgggaggccggcaacctgacagacctgcccaacctgagaattggcttctacaacttctgcctgtggaatgaagacaccagcaccctgcagtgccaccagtttcctgagctggaggccctgggcgtgccccgggtgggcctgggcctggcccggctgggcgtgtatggcagcctggtgctgaccctcttcttcctgtcctatgtgtggaagtgggtgcggctgagcctgcccggccctggcttcctggccctgggcagcgcccaggccctgctgatcctgctgctgattgccatggctgtgttccccctgcgggcagagagagctgagagcaagctggagagctgctag

SEQ ID NO: 39210 - DNA, 327 bp, Artificial Sequence
  Description of Artificial Sequence: Synthetic coding sequence
atggtgaacctgggcctgagccgggtggatgatgctgtggccgccaagcaccctggcctgggggagtatgctgcctgccagagccacgccttcatgaagggcgtcttcacctttgtgacaggcaccggcatggccttcggcctgcagatgttcatccagaggaagttcccctaccccctgcagtggagcctgctggtggccgtggtggccggctctgtggtgtcctatggagtgaccagggtggagagcgagaagtgcaacaacctgtggctgttcctggagaccggccagctgcccaaggacaggagcacagaccagaggagctag

SEQ ID NO: 39211 - DNA, 1380 bp, Artificial Sequence
  Description of Artificial Sequence: Synthetic coding sequence
atgacagtggagctgtggctgcggctgcggggcaagggcctggccatgctgcacgtgacccggggcgtgtggggcagccgggtgcgggtgtggcccctgctgcctgccctgctgggccccccccgggccctgagcagcctggccgccaagatgggagagtacaggaagatgtggaacccccgggagccccgggactgggcccagcagtaccgggagcgcttcatccccttcagcaaggagcagctgctgcggctgctgatccaggagttccacagcagccctgctgagaaggccgccctggaggccttcagcgcccacgtggacttctgcaccctcttccactaccaccagatcctggcccggctgcaggccctgtatgaccccatcaacccagaccgggagaccctggaccagcccagcctgacagacccccagaggctgagcaatgagcaggaggtgctgcgggccctggagcccctgctggcccaggccaacttcagccccctgtctgaggacaccctggcctatgccctggtggtgcaccacccccaggatgaggtgcaggtgacagtgaacctggaccagtatgtgtacatccacttctgggccctgggccagagggtgggccagatgcccctgaagagctctgtgggcagccggcggggcttcttcaccaagctgcccccagctgagcggcgctacttcaagagggtggtgctggccgcccggaccaagaggggccacctggtgctgaagagcttcaaggacacccccctggagggcctggagcagctgctgcctgagctgaaggtgaggacccccaccctgcagagggccctgctgaacctgatgctggtggtgtctggagtggccatctttgtgaatgtgggcatggtggtgctgacagacctgaaggtggccaccagcctgctgctgctgctgtttgccatcttcatgggcctgcgggccagcaagatgtttggccagaggagaagtgcccaggccctggagctggcccacatgctgtactaccgcagcaccagcaacaacagcgagctgctgagcgccctggccctgcgggcccaggatgagcacaccaaggaggccctgctggcccacagcttcctggcccggcggcctgggggcacccagggcagccctgaggagaccagccgctggctgcggtctgaggtggagaactggctgctggccaagagcggctgtgaggtgaccttcaacggcacccgggccctggcccacctgcaggccctgacccccagcatgggcctgtacccacctcctggcttccccaagctggaccctgtggcccccatcaccagcgagcccccccaggccacccccagcagcaacatctcctag

SEQ ID NO: 39212 - DNA, 1080 bp, Artificial Sequence
  Description of Artificial Sequence: Synthetic coding sequence
atgacagtggagctgtggctgcggctgcggggcaagggcctggccatgctgcacgtgacccggggcgtgtggggcagccgggtgcgggtgtggcccctgctgcctgccctgctgggccccccccgggccctgagcagcctggccgccaagatgggagagtacaggaagatgtggaacccccgggagccccgggactgggcccagcagtaccgggagcgcttcatccccttcagcaaggagcagctgctgcggctgctgatccaggtgacagtgaacctggaccagtatgtgtacatccacttctgggccctgggccagagggtgggccagatgcccctgaagagctctgtgggcagccggcggggcttcttcaccaagctgcccccagctgagcggcgctacttcaagagggtggtgctggccgcccggaccaagaggggccacctggtgctgaagagcttcaaggacacccccctggagggcctggagcagctgctgcctgagctgaaggtgaggacccccaccctgcagagggccctgctgaacctgatgctggtggtgtctggagtggccatctttgtgaatgtgggcatggtggtgctgacagacctgaaggtggccaccagcctgctgctgctgctgtttgccatcttcatgggcctgcgggccagcaagatgtttggccagaggagaagtgcccaggccctggagctggcccacatgctgtactaccgcagcaccagcaacaacagcgagctgctgagcgccctggccctgcgggcccaggatgagcacaccaaggaggccctgctggcccacagcttcctggcccggcggcctgggggcacccagggcagccctgaggagaccagccgctggctgcggtctgaggtggagaactggctgctggccaagagcggctgtgaggtgaccttcaacggcacccgggccctggcccacctgcaggccctgacccccagcatgggcctgtacccacctcctggcttccccaagctggaccctgtggcccccatcaccagcgagcccccccaggccacccccagcagcaacatctcctag

SEQ ID NO: 39213 - DNA, 1275 bp, Artificial Sequence
  Description of Artificial Sequence: Synthetic coding sequence
atgacagtggagctgtggctgcggctgcggggcaagggcctggccatgctgcacgtgacccggggcgtgtggggcagccgggtgcgggtgtggcccctgctgcctgccctgctgggccccccccgggccctgagcagcctggccgccaagatgggagagtacaggaagatgtggaacccccgggagccccgggactgggcccagcagtaccgggagcgcttcatccccttcagcaaggagcagctgctgcggctgctgatccaggccctgtatgaccccatcaacccagaccgggagaccctggaccagcccagcctgacagacccccagaggctgagcaatgagcaggaggtgctgcgggccctggagcccctgctggcccaggccaacttcagccccctgtctgaggacaccctggcctatgccctggtggtgcaccacccccaggatgaggtgcaggtgacagtgaacctggaccagtatgtgtacatccacttctgggccctgggccagagggtgggccagatgcccctgaagagctctgtgggcagcagaagaggcttcttcaccaagctgcccccagctgagcggcgctacttcaagagggtggtgctggccgcccggaccaagaggggccacctggtgctgaagagcttcaaggacacccccctggagggcctggagcagctgctgcctgagctgaaggtgaggacccccaccctgcagagggccctgctgaacctgatgctggtggtgtctggagtggccatctttgtgaatgtgggcatggtggtgctgacagacctgaaggtggccaccagcctgctgctgctgctgtttgccatcttcatgggcctgcgggccagcaagatgtttggccagaggagaagtgcccaggccctggagctggcccacatgctgtactaccgcagcaccagcaacaacagcgagctgctgagcgccctggccctgcgggcccaggatgagcacaccaaggaggccctgctggcccacagcttcctggcccggcggcctgggggcacccagggcagccctgaggagaccagccgctggctgcggtctgaggtggagaactggctgctggccaagagcggctgtgaggtgaccttcaacggcacccgggccctggcccacctgcaggccctgacccccagcatgggcctgtacccacctcctggcttccccaagctggaccctgtggcccccatcaccagcgagcccccccaggccacccccagcagcaacatctcctag

SEQ ID NO: 39214 - DNA, 1185 bp, Artificial Sequence
  Description of Artificial Sequence: Synthetic coding sequence
atgacagtggagctgtggctgcggctgcggggcaagggcctggccatgctgcacgtgacccggggcgtgtggggcagccgggtgcgggtgtggcccctgctgcctgccctgctgggccccccccgggccctgagcagcctggccgccaagatgggagagtacaggaagatgtggaacccccgggagccccgggactgggcccagcagtaccgggagcgcttcatccccttcagcaaggagcagctgctgcggctgctgatccaggagttccacagcagccctgctgagaaggccgccctggaggccttcagcgcccacgtggacttctgcaccctcttccactaccaccagatcctggcccggctgcaggtgacagtgaacctggaccagtatgtgtacatccacttctgggccctgggccagagggtgggccagatgcccctgaagagctctgtgggcagcagaagaggcttcttcaccaagctgcccccagctgagcggcgctacttcaagagggtggtgctggccgcccggaccaagaggggccacctggtgctgaagagcttcaaggacacccccctggagggcctggagcagctgctgcctgagctgaaggtgaggacccccaccctgcagagggccctgctgaacctgatgctggtggtgtctggagtggccatctttgtgaatgtgggcatggtggtgctgacagacctgaaggtggccaccagcctgctgctgctgctgtttgccatcttcatgggcctgcgggccagcaagatgtttggccagaggagaagtgcccaggccctggagctggcccacatgctgtactaccgcagcaccagcaacaacagcgagctgctgagcgccctggccctgcgggcccaggatgagcacaccaaggaggccctgctggcccacagcttcctggcccggcggcctgggggcacccagggcagccctgaggagaccagccgctggctgcggtctgaggtggagaactggctgctggccaagagcggctgtgaggtgaccttcaacggcacccgggccctggcccacctgcaggccctgacccccagcatgggcctgtacccacctcctggcttccccaagctggaccctgtggcccccatcaccagcgagcccccccaggccacccccagcagcaacatctcctag

SEQ ID NO: 39215 - DNA, 1050 bp, Artificial Sequence
  Description of Artificial Sequence: Synthetic coding sequence
atgagaagaaggctgaatgacagccgggccctggccaaggccctgtatgaccccatcaacccagaccgggagaccctggaccagcccagcctgacagacccccagaggctgagcaatgagcaggaggtgctgcgggccctggagcccctgctggcccaggccaacttcagccccctgtctgaggacaccctggcctatgccctggtggtgcaccacccccaggatgaggtgcaggtgacagtgaacctggaccagtatgtgtacatccacttctgggccctgggccagagggtgggccagatgcccctgaagagctctgtgggcagccggcggggcttcttcaccaagctgcccccagctgagcggcgctacttcaagagggtggtgctggccgcccggaccaagaggggccacctggtgctgaagagcttcaaggacacccccctggagggcctggagcagctgctgcctgagctgaaggtgaggacccccaccctgcagagggccctgctgaacctgatgctggtggtgtctggagtggccatctttgtgaatgtgggcatggtggtgctgacagacctgaaggtggccaccagcctgctgctgctgctgtttgccatcttcatgggcctgcgggccagcaagatgtttggccagaggagaagtgcccaggccctggagctggcccacatgctgtactaccgcagcaccagcaacaacagcgagctgctgagcgccctggccctgcgggcccaggatgagcacaccaaggaggccctgctggcccacagcttcctggcccggcggcctgggggcacccagggcagccctgaggagaccagccgctggctgcggtctgaggtggagaactggctgctggccaagagcggctgtgaggtgaccttcaacggcacccgggccctggcccacctgcaggccctgacccccagcatgggcctgtacccacctcctggcttccccaagctggaccctgtggcccccatcaccagcgagcccccccaggccacccccagcagcaacatctcctag

SEQ ID NO: 39216 - DNA, 1038 bp, Artificial Sequence
  Description of Artificial Sequence: Synthetic coding sequence
atgagcaacaacggggctgacctgaccttcggctacatcagctgctttgtggccatcctgctgtttggcagcaactttgtgcccctgaagaagtttgacacaggagatggcatgttcctgcagtgggtgctgtgtgccgccatctggctggtggccctggtggtgaacctgatcctgcactgccccaagttctggccctttgccatgctgggcggctgcatctgggccactggaaatattgctgtggtgcccatcatcaagaccatcggcctgggcctgggcatcctgatctggggcagcttcaatgccctgaccggctgggccagcagccgcttcggctggtttggcctggatgctgaggaggtgagcaaccccctgctgaactacatcggggccggcctgtctgtggtgtctgccttcatcttcctgttcatcaagtctgagatccccaacaacacctgcagcatggacaccacccccctcatcacagaacatgtgatcaacaccacccaggacccctgctcctgggtggacaagctgagcacagtgcaccacagaattgtgggctgcagcctggccgtcatcagcggcgtgctgtatggcagcacctttgtgcccatcatctacatcaaggaccacagcaagagaaatgacagcatctatgctggggccagccagtatgacctggactatgtgtttgcccacttcagcggcatcttcctgaccagcacagtgtacttcctggcctactgcatcgccatgaagaacagccccaagctgtacccagaggccgtgctgcccggcttcctgtctggagtgctgtgggccatcgccacctgctgctggttcatcgccaaccacagcctgtctgctgtggtgtccttccccatcatcacagctggccctggcttcatcgccgccatgtggggcatcttcatgttcaaggagatcaagggcctgcagaactacctgctgatgatcctggccttctgcatcatcctgactggagccctgtgcacagccttcagcaagatctag

SEQ ID NO: 39217 - DNA, 234 bp, Artificial Sequence
  Description of Artificial Sequence: Synthetic coding sequence
atgagcaacaacggggctgacctgaccttcggctacatcagctgctttgtggccatcctgctgtttggcagcaactttgtgcccctgaagaagtttgacacaggagatggcatgttcctgcagtgggtgctgtgtgccgccatctggctggtggccctggtggtgaacctgatcctgcactgccccaagttctggccctttgccatgctgggcggctgcatctgggccacctag

SEQ ID NO: 39218 - DNA, 333 bp, Artificial Sequence
  Description of Artificial Sequence: Synthetic coding sequence
atgagcaacaacggggctgacctgaccttcggctacatcagctgctttgtggccatcctgctgtttggcagcaactttgtgcccctgaagaagtttgacacaggagatggcatgttcctgcagtgggtgctgtgtgccgccatctggctggtggccctggtggtgaacctgatcctgcactgccccaagttctggccctttgccatgctgggcggctgcatctgggccactggaaatattgctgtggtgcccatcatcaagaccatcggcctgggcctgggcatcctgatctggggcagcttcaatgccctgaccggctgggccagcagctag

SEQ ID NO: 39219 - DNA, 414 bp, Artificial Sequence
  Description of Artificial Sequence: Synthetic coding sequence
atgagcaacaacggggctgacctgaccttcggctacatcagctgctttgtggccatcctgctgtttggcagcaactttgtgcccctgaagaagtttgacacaggagatggcatgttcctgcagtgggtgctgtgtgccgccatctggctggtggccctggtggtgaacctgatcctgcactgccccaagttctggccctttgccatgctgggcggctgcatctgggccactggaaatattgctgtggtgcccatcatcaagaccatcggcctgggcctgggcatcctgatctggggcagcttcaatgccctgaccggctgggccagcagccgcttcggctggtttggcctggatgctgaggaggtgagcaaccccctgctgaactacatcggggccggcctgtctgtggtgtag

SEQ ID NO: 39220 - DNA, 234 bp, Artificial Sequence; identical to SEQ ID NO: 39217
  Description of Artificial Sequence: Synthetic coding sequence

SEQ ID NO: 39221 - DNA, 264 bp, Artificial Sequence
  Description of Artificial Sequence: Synthetic coding sequence
atgagcaacaacggggctgacctgaccttcggctacatcagctgctttgtggccatcctgctgtttggcagcaactttgtgcccctgaagaagtttgacacaggagatggcatgttcctgcagtgggtgctgtgtgccgccatctggctggtggccctggtggtgaacctgatcctgcactgccccaagttctggccctttgccatgctgggcggctgcatctgggccactggaaatattgctgtggtgcccatcatcaagtag

SEQ ID NO: 39222 - DNA, 504 bp, Artificial Sequence
  Description of Artificial Sequence: Synthetic coding sequence
atgagcaacaacggggctgacctgaccttcggctacatcagctgctttgtggccatcctgctgtttggcagcaactttgtgcccctgaagaagtttgacacaggagatggcatgttcctgcagtgggtgctgtgtgccgccatctggctggtggccctggtggtgaacctgatcctgcactgccccaagttctggccctttgccatgctgggcggctgcatctgggccactggaaatattgctgtggtgcccatcatcaagaccatcggcctgggcctgggcatcctgatctggggcagcttcaatgccctgaccggctgggccagcagccgcttcggctggtttggcctggatgctgaggaggtgagcaaccccctgctgaactacatcggggccggcctgtctgtggtgtctgccttcatcttcctgttcatcaagtctgagatccccaacaacacctgcagcatggacaccacccccctcatcacagaacatgtgatctag

SEQ ID NO: 39223 - DNA, 33 bp, Artificial Sequence
  Description of Artificial Sequence: Synthetic coding sequence
atgagcaacaacggggctgacctgaccttctag

SEQ ID NO: 39224 - DNA, 264 bp, Artificial Sequence; identical to SEQ ID NO: 39221
  Description of Artificial Sequence: Synthetic coding sequence

SEQ ID NO: 39225 - DNA, 510 bp, Artificial Sequence
  Description of Artificial Sequence: Synthetic coding sequence
atgagcaacaacggggctgacctgaccttcggctacatcagctgctttgtggccatcctgctgtttggcagcaactttgtgcccctgaagaagtttgacacaggagatggcatgttcctgcagtgggtgctgtgtgccgccatctggctggtggccctggtggtgaacctgatcctgcactgccccaagttctggccctttgccatgctgggcggctgcatctgggccactggaaatattgctgtggtgcccatcatcaagaccatcggcctgggcctgggcatcctgatctggggcagcttcaatgccctgaccggctgggccagcagccgcttcggctggtttggcctggatgctgaggaggtgagcaaccccctgctgaactacatcggggccggcctgtctgtggtgtctgccttcatcttcctgttcatcaagtctgagatccccaacaacacctgcagcatggacaccacccccctcatcacagaacatgtgtccatcgtgtag

SEQ ID NO: 39226 - DNA, 276 bp, Artificial Sequence
  Description of Artificial Sequence: Synthetic coding sequence
atgagcaacaacggggctgacctgaccttcggctacatcagctgctttgtggccatcctgctgtttggcagcaactttgtgcccctgaagaagtttgacacaggagatggcatgttcctgcagtgggtgctgtgtgccgccatctggctggtggccctggtggtgaacctgatcctgcactgccccaagttctggccctttgccatgctgggcggctgcatctgggccactggaaatattgctgtggtgcccatcatcaagaccatcggcctgtag

SEQ ID NO: 39227 - DNA, 1482 bp, Artificial Sequence
  Description of Artificial Sequence: Synthetic coding sequence
atggagcccctgcgggccccagccctgcggcggctgctgccccccctgctgctgctgctgctgagcctgcccccccgggcccgggccaagtatgtgcggggcaacctgagcagcaaggaggactgggtgttcctgacccgcttctgcttcctgagtgactatggccgcctggacttccgcttccgctacccagaggccaagtgctgccagaacatcctgctgtactttgatgaccccagccagtggccagctgtgtacaaggccggggacaaggactgcctggccaaggagagcgtcatccggcctgagaacaaccaggtgatcaacctgaccacccagtatgcctggagcggctgccaggtggtgtctgaggagggcacccgctacctgagctgcagcagcggccgctccttccgctctggagatggcctgcagctggagtatgagatggtgctgaccaacgggaagagcttctggaccaggcacttcagcgcagatgaatttggcatcctggagacagatgtgaccttcctgctgatcttcatcctgatcttcttcctgagctgctacttcggctacctgctgaagggccggcagctgctgcacaccacctacaagatgttcatggctgctgctggggtggaggtgctgagcctgctcttcttctgcatctactggggccagtatgccacagatggcattggaaatgaatctgtgaagatcctggccaagctgctcttcagcagcagcttcctgatcttcctgctgatgctgatcctgctgggcaagggcttcaccgtgacccggggccgcatcagccatgctggctctgtgaagctgtctgtgtacatgaccctgtacaccctgacccacgtggtgctgctgatctatgaagctgagttctttgaccccggccaggtgctgtacacctatgagagccctgctggctacggcctcatcggcctgcaggtggccgcctacgtgtggttctgctatgctgtgctggtgtccctgcggcacttccctgagaagcagcccttctacgtgcccttctttgctgcctacaccctgtggttctttgctgtgcctgtgatggccctgattgccaactttggcatccccaagtgggcccgggagaagatcgtgaatggcatccagctgggcatccacctgtatgcccacggcgtcttcctgatcatgacccggcccagcgctgccaacaagaacttcccctaccacgtgaggaccagccagatcgccagcgctggggtgcccggccctgggggcagccagagcgctgacaaggccttcccccagcacgtgtatggaaatgtgaccttcatcagtgacagcgtgcccaacttcacagagctgttcagcatccccccaccagccaccagccccctgccccgggccgccccagacagcggcctgcccctcttccgggacctgcggcccccaggccccctgcgggacctgtag

SEQ ID NO: 39228 - DNA, 1404 bp, Artificial Sequence
  Description of Artificial Sequence: Synthetic coding sequence
cggctgcggcactgcacccccacctgggccacagagccagattctgtgaagaagaagaggaacaggaagaggtctggagctgtggcccacaactgcaacctgaagcacttcggccggccccgctgggaggaccacctgtgccccggcatctgggaccagaggggcaacatcatcgagttcctgaccggggagttcatctacaggatgtacaccatcgacatgcacagccagctggagctgacagccagcctcatcccccagcccggcaccagcctcatccccctggtgatggtgagcaacccccacagcctgggcttccaggccaccttctatgaaaatggctacaccagtgatggcaacaccaagtacaagctggacatcttcctgaagcagcagcagcactggggccgcacagacagcaacttcaccagcagcctgaagaaggccaccatgagcaccctgactgtggacatcgccaacaaggagatcagctgtgtggacatcaagcccctgagcaccctcatctctgtgggctgtgacctggacaagaagatcgtcatccagaacaaggtgtctgcctgcagcatgggcatcctggaccccctgaccctgcaggacaactacagcttcatcatcgagaaggagttctatgaccccggcttccagggccagcagagcagcgaggacctgcacgtgttctacagctaccagcagctgggctgccccctgctggtgtactatgacaccctgtggaagcctgtggtggagctgtggaggaaggacagcttccaggaggtgattgatgctgaatatgtgctgctggaggtgaatggccagttctcctacagctacagcctgacagcccagagcgccatgtgcaccagccagccccagaactggaccaccatgatcaaggagtttggaggccccttcttctggaaccgggagaactacgtgtcctgccacgaccccaacaacaatgcccccctgcgctggccagatgtgcagtaccagatcctgggcggccgcacagccaaccagatcatcttcggccacaacggcttctacgtgttctacatcagcatcgtggacccctactacagctactgccagctggagaccatcttcagcatctacgtgtatggagccttccctgtgcagctggtgtctgctggggtggtgatcctgctgatcatcagcagcatcctgggctctgtgtggctggcctacaagacccccaagctgctgaggacagcccggggccgccgcatcaagaagtgtgccacccagctgtgccgccgctgcaagacagtgtgccagttccgggccagcgccacagcccgggccggcacagagcccccaggccgccacaggacccctcatggaggccgcagtgaccactag

SEQ ID NO: 39229 - DNA, 1080 bp, Artificial Sequence
  Description of Artificial Sequence: Synthetic coding sequence
atgttccgcagccctggcaccctggagatcctgacccccctgcgggacacagccttccctgcctttgacttccagaagtgcctggtgaacatccaggccctgctgatggaccctgagctgcacgtgggcaagtgcaagattgagttcctgactggagagttcatctacaggatgtacaccatcgacatgcacagccagctggagctgacagccagcctcatcccccagcccggcaccagcctcatccccctggtgatggtgagcaacccccacagcctgggcttccaggccaccttctatgaaaatggctacaccagtgatggcaacaccaagtacaagctggacatcttcctgaagcagcagcagcactggggccgcacagacagcaacttcaccagcagcctgaagaaggccaccatgagcaccctgactgtggacatcgccaacaaggagatcagctgtgtggacatcaagcccctgagcaccctcatctctgtgggctgtgacctggacaagaagatcgtcatccagaacaaggtgtctgcctgcagcatgggcatcctggaccccctgaccctgcaggacaactacagcttcatcatcgagaaggagttctatgaccccggcttccagggccagcagagcagcgaggacctgcacgtgttctacagctaccagcagctgggctgccccctgctggtgtactatgacaccctgtggaagcctgtggtggagctgctggagagcagcggcatgaacacagtgcactgcagcctgaacctgcccggcagcagcggccccccagccagcgccagccaggtggccggcacagctgtggcctaccacaatgcccggctcatcttcttcttcttcttcttcttcttcttcctgcggcagagcctggccctgagcccccggctggagtgcagcggggtcatcctggcccacaggaagctgtgcctgcccggcagccgccacagccctgccagcgccagccgggtggccggcatcaccggggcccggcactgtgcccggctcatcttcttcatcttcagccgggacagagtgagcccctgctag

SEQ ID NO: 39230 - DNA, 2397 bp, Artificial Sequence
  Description of Artificial Sequence: Synthetic coding sequence
atgctgatgctgatgctggtggccgctgtgaccatgtggctgcggcccctggtgacagcccagctgtgccgcagcaggacagtgaggacaggcaaggtgttcaacctgatccaggatgtgcagggcgaccggctgtacttccaccccaccaccaccaggctcatcaagcacccctgtgagaagaacatcgccctgtacctgggcaagcaggtgttcttcaccatggacaactttgagaccagcctgctgcccttcaccatccccacctccatgcaggtgggcgtgcctgaggtgaccagcgcccactttgctggcagcctgctgctgctggtggtggaccagaaggtgtacatctatgactatgagaacaacagctggagcatgagcctgggcatcaagcaccctgtgacccacgtgtctggggacaactgctgctacacaggcagcctcttctgtgtgcacgtgagcaacctggtgtttgcctacttccggggggaccagatcagccagacctacatctactacagcaacacaggaggcttctccttctggaagtaccactatgaccggcaggccgagatcatcggcagcctgggcggcatcttccacttcttcagcctgagccaggtggccatgctggtggtgaaccagggcaagggcatgttcaagtacagcgaccaccccctgaacagaagctttggcctgagctttgactacaacggcaccctggacatcctgattgcccctggccagaggggcatcctgctgctgtggtttgagaacagcctgctcttcagccacaatgccggccagctggtggacacagtgcgggtgaagaagggggaccagaccctcttcagcagcatctttgaggccaagatcaccatccacaacattgctgtgacagaaaatgagctggccgtcatcacccgggaggacaacctgtactacggcaacctgggcatcgtgcccagcagcatcatcaagtttgctgaccagtacatctggagcgaagatgtggccctgatgttccgcagccctggcaccctggagatcctgacccccctgcgggacacagccttccctgcctttgacttccagaagtgcctggtgaacatccaggccctgctgatggaccctgagctgcacgtgggcaagtgcaagattgagttcctgactggagagttcatctacaggatgtacaccatcgacatgcacagccagctggagctgacagccagcctcatcccccagcccggcaccagcctcatccccctggtgatggtgagcaacccccacagcctgggcttccaggccaccttctatgaaaatggctacaccagtgatggcaacaccaagtacaagctggacatcttcctgaagcagcagcagcactggggccgcacagacagcaacttcaccagcagcctgaagaaggccaccatgagcaccctgactgtggacatcgccaacaaggagatcagctgtgtggacatcaagcccctgagcaccctcatctctgtgggctgtgacctggacaagaagatcgtcatccagaacaaggtgtctgcctgcagcatgggcatcctggaccccctgaccctgcaggacaactacagcttcatcatcgagaaggagttctatgaccccggcttccagggccagcagagcagcgaggacctgcacgtgttctacagctaccagcagctgggctgccccctgctggtgtactatgacaccctgtggaagcctgtggtggagctgtggaggaaggacagcttccaggaggtgattgatgctgaatatgtgctgctggaggtgaatggccagttctcctacagctacagcctgacagcccagagcgccatgtgcaccagccagccccagaactggaccaccatgatcaaggagtttggaggccccttcttctggaacagagaaaattatgtgtcctgccacgaccccaacaacaatgcccccctgcgctggccagatgtgcagtaccagatcctgggcggccgcacagccaaccagatcatcttcggccacaacggcttctacgtgttctacatcagcatcgtggacccctactacagctactgccagctggagaccatcttcagcatctacgtgtatggagccttccctgtgcagctggtgtctgctggggtggtgatcctgctgatcatcagcagcatcctgggctctgtgtggctggcctacaagacccccaagctgctgaggacagcccggggccgccgcatcaagaagtgtgccacccagctgtgccgccgctgcaagacagtgtgccagttccgggccagcgccacagcccgggccggcacagagcccccaggccgccacaggaccccccacggcggccgcagtgaccactag

SEQ ID NO: 39231 - DNA, 777 bp, Artificial Sequence
  Description of Artificial Sequence: Synthetic coding sequence
atggccagcgctgctgctgctgaggccgagaagggcagccctgtggtggtgggcctgctggtggtgggcaacatcatcatcctgctgagcggcctgagcctgtttgctgagaccatctgggtgacagctgaccagtacagagtgtaccccctgatgggcgtgtctgggaaggatgatgtgtttgctggggcctggatcgccatcttctgtggcttctccttcttcatggtggccagctttggagtgggcgccgccctgtgcagaagaagatccatggtgctgacctacctggtgctgatgctgattgtgtacatctttgaatgtgccagctgcatcaccagctacacccaccgggactacatggtgagcaaccccagcctcatcaccaagcagatgctgaccttctacagcgctgacacagaccagggccaggagctgacccggctgtgggacagagtgatgattgagcaggagtgctgcggcaccagcggccccatggactgggtgaacttcaccagcgccttccgggccgccaccccagaggtggtgttcccctggccacccctgtgctgcagaagaacaggcaacttcatccccctgaatgaggagggctgccgcctgggccacatggactacctgttcaccaagggctgctttgagcacatcggccacgccatcgacagctacacctggggcatctcctggtttggatttgccatcctgatgtggaccctgcctgtgatgctgattgccatgtacttctacaccatgctgtag

SEQ ID NO: 39232 - DNA, 528 bp, Artificial Sequence
  Description of Artificial Sequence: Synthetic coding sequence
atgctgttcctggccaccttcttccccacctgggagggcggcatctatgacttcatcggggagttcatgaaggcctctgtggatgtggccgacctgattggcctgaacctggtgatgagcagaaatgctggaaaaggagagtacaagatcatggtggccgccctgggctgggccacagctgagctgatcatgagccgctgcatccccctgtgggtgggcgcccggggcattgaatttgactggaagtacatccagatgagcattgacagcaacatcagcctggtgcactacatcgtggccagcgcccaggtgtggatgatcaccaggtatgacctgtaccacaccttccggcctgctgtgctgctgctgatgttcctgtctgtgtacaaggcctttgtgatggagacctttgtgcacctgtgcagcctgggctcctgggccgccctgctggcccgggctgtggtgacaggcctgctggccctgagcaccctggccctgtatgtggccgtggtgaatgtgcacagctag

SEQ ID NO: 39233 - DNA, 555 bp, Artificial Sequence
  Description of Artificial Sequence: Synthetic coding sequence
atgaccctcttccacttcggcaactgctttgccctggcctacttcccctacttcatcacctacaagtgcagcggcctgtctgagtacaatgccttctggaagtgtgtgcaggccggcgtgacctacctgtttgtgcagctgtgcaagatgctgttcctggccaccttcttccccacctgggagggcggcatctatgacttcatcggggagttcatgaaggcctctgtggatgtggccgacctgattggcctgaacctggtgatgagcagaaatgctgggaagggggagtacaagatcatggtggccgccctgggctgggccacagctgagctgatcatgagccgctgcatccccctgtgggtgggcgcccggggcatcgagtttgactggaagtacatccagatgagcattgacagcaacatcagcctggtgcactacatcgtggccagcgcccaggtgtggatgatcaccaggtatgacctgtaccacaccttccggcctgctgtgctgctgctgatgttcctgtctgtgtacaaggcctttgtgatggagtag

SEQ ID NO: 39234 - DNA, 96 bp, Artificial Sequence
  Description of Artificial Sequence: Synthetic coding sequence
atgaggcctggctggagccacctgcccctgtgccccaccctgcaggatgctgtgctgggccacttcctgagccacctgggccgccgccacctgtag

SEQ ID NO: 39235 - DNA, 1098 bp, Artificial Sequence
  Description of Artificial Sequence: Synthetic coding sequence
atgagcctcatcaggaagaagggcttctacaagcaggatgtgaacaagacagcctgggagctgcccaagacctacgtgagccccacccacgtgggcagcggggcctacggctctgtgtgcagcgccatcgacaagaggtctggagagaaggtggccatcaagaagctgagccggcccttccagagcgagatctttgccaagagggcctaccgggagctgctgctgctgaagcacatgcagcatgaaaatgtgattggcctgctggatgtgttcaccccagccagcagcctgaggaacttctatgacttctacctggtgatgcccttcatgcagacagacctgcagaagatcatgggcatggagttcagcgaggagaagatccagtacctggtgtaccagatgctgaagggcctgaagtacatccacagcgctggggtggtgcaccgggacctgaagccaggcaacctggccgtgaatgaagactgtgagctgaagatcctggactttggcctggcccggcatgctgatgctgagatgacaggctacgtggtgacccgctggtaccgggcccctgaggtgatcctgtcctggatgcactacaaccagacagtggacatctggagcgtgggctgcatcatggccgagatgctgaccgggaagaccctcttcaagggcaaggactacctggaccagctgacccagatcctgaaggtgactggagtgcccggcacagaatttgtgcagaagctgaatgacaaggccgccaagagctacatccagagcctgccccagacccccaggaaggacttcacccagctgttcccccgggccagcccccaggccgctgacctgctggagaagatgctggagctggatgtggacaagaggctgacagctgcccaggccctgacccaccccttctttgagcccttccgggaccctgaggaggagacagaggcccagcagccctttgatgacagcctggagcacgagaagctgactgtggatgagtggaagcagcacatctacaaggagatcgtgaacttcagccccatcgccaggaaggacagcagaagaagaagtggcatgaagctgtag

SEQ ID NO: 39236 - DNA, 243 bp, Artificial Sequence
  Description of Artificial Sequence: Synthetic coding sequence
atggagaagcccctcttccccctggtgcccctgcactggtttggcttcggctacacagccctggtggtgtctgggggcatcgtgggctacgtgaagacagctgccacctctgtgacctttgtgggcgtgatgggcatgaggagctactactacggcaagttcatgcctgtgggcctgattgctggggccagcctgctgatggccgccaaggtgggcgtgaggatgctgatgaccagtgactag

SEQ ID NO: 39237 - DNA, 345 bp, Artificial Sequence
  Description of Artificial Sequence: Synthetic coding sequence
atggagaagcccctcttccccctggtgcccctgcactggtttggcttcggctacacagccctggtggtgtctgggggcatcgtgggctacgtgaagacaggctctgtgcccagcctggccgccggcctgctgtttggcagcctggccggcctgggcgcctaccagctgtaccaggaccccagaaatgtgtggggcttcctggccgccacctctgtgacctttgtgggcgtgatgggcatgaggagctactactacggcaagttcatgcctgtgggcctgattgctggggccagcctgctgatggccgccaaggtgggcgtgaggatgctgatgaccagtgactag

SEQ ID NO: 39238 - DNA, 345 bp, Artificial Sequence; identical to SEQ ID NO: 39237
  Description of Artificial Sequence: Synthetic coding sequence

SEQ ID NO: 39239 - DNA, 408 bp, Artificial Sequence
  Description of Artificial Sequence: Synthetic coding sequence
atggagaagcccctcttccccctggtgcccctgcactggtttggcttcggctacacagccctggtggtgtctgggggcatcgtgggctacgtgaagacaggctctgtgcccagcctggccgccggcctgctgtttggcagcctggccggcctgggcgcctaccagctgtaccaggaccccagaaatgtgtggggcttcctggccgccacctctgtgacctttgtgggcgtgatgggcatgaggagctactactacggcaagttcatgcctgtgggcctgattgctggggcccgctacttccacagcatcaccctgctgtaccacgtggagttcagcctgctgccccgcatcctgtatgccttcaagaccctgctggtgtctgagtacctgatgctgtgcatcaactag

SEQ ID NO: 39240 - DNA, 2151 bp, Artificial Sequence
  Description of Artificial Sequence: Synthetic coding sequence
atggaggacagcaccagccccaagcaggagaaggagaaccaggaggagctgggggagacccggcggccctgggagggcaagacagctgccagcccccagtacagcgagcctgagagcagcgagcccctggaggccaagcagggccctgagaccggccggcagagccgcagcagccggccctggagcccccagagccgggccaagacccccctgggcggccctgctggccctgagaccagcagccctgcccctgtgagcccccgggagcccagcagcagccccagccccctggccccagcccggcaggacctggccgccccaccccagagcgacaggaccaccagcgtcatccctgaggccggcaccccctacccagaccccctggagcagagcagtgacaagcgggagagcaccccccaccacaccagccagagcgagggcaacaccttccagcagagccagcagcccaagccccacctgtgtggcagaagagatgtgtcctacaacaatgccaagcagaaggagctgcgctttgatgtgttccaggaggaggacagcaacagcgactatgacctgcagcagcctgcccctgggggcagcgaggtggcccccagcatgctggagatcaccatccagaatgccaaggcctacctgctgaagaccagcagcaacagcggcttcaacctgtatgaccacctgagcaacatgctgaccaagatcctgaatgaaagaccagaaaatgctgtggacatctttgagaacatcagccaggatgtgaagatggcccacttcagcaagaagtttgatgccctgcagaatgaaaatgagctgctgcccacctatgaaattgctgagaagcagaaggccctcttcctgcagggccacctggagggcgtggaccaggagctggaggatgaaattgctgaaaatgccctgcccaacgtgatggagagcgccttctactttgagcaggccggcgtgggcctgggcacagatgagacctaccgcatcttcctggccctgaagcagctgacagacacccaccccatccagcgctgccgcttctggggcaagatcctgggcctggagatgaactacatcgtggccgaggtggagttccgggagggagaagatgaggaggaggtggaggaggaggatgtggccgaggagcgggacaatggagagagcgaggcccatgaagatgaagaagatgagctgcccaagagcttctacaaggccccccaggccatccccaaggaggagagcaggactggagccaacaagtatgtgtactttgtgtgcaatgaacctggccggccctgggtgaagctgccccctgtgatcccagcccagatcgtcatcgccaggaagatcaagaagttcttcaccggccgcctggatgcccccatcatctcctacccacccttccctggaaatgaaagcaactacctgcgggcccagatcgcccgcatctctgctggcacccacgtgagccccctgggcttctaccagtttggagaggaggagggggaggaggaggaggaggccgagggcggcaggaacagctttgaagaaaatccagactttgagggcatccaggtgattgacctggtggagagcctgagcaactgggtgcaccacgtgcagcacatcctgagccagggccgctgcaactggttcaacagcatccagaagaatgaggaggaggaggaggaggaggatgaggagaaggatgacagcgactacatcgagcaggaggtgggcctgcccctgctgacccccatcagcgaggacctggagatccagaacatccccccctggaccacccggctgagcagcaacctgatcccccagtatgccatcgctgtgctgcagagcaacctgtggccaggggcctatgccttcagcaatggcaagaagtttgagaacttctacatcggctggggccacaagtacagcccagacaactacaccccacctgtgcccccacctgtgtaccaggagtaccccagcggccctgagatcacagagatggatgaccccagcgtggaggaggagcaggccttccgggccgcccaggaggccgtgctgctggccgcagaaaatgaggagagtgaagaagatgaagatgaggaggatgattatgactag

SEQ ID NO: 39241 - DNA, 315 bp, Artificial Sequence
  Description of Artificial Sequence: Synthetic coding sequence
atgcaggacaccggctctgtggtgcccctgcactggtttggatttggctacgccgccctggtggccagcggcggcatcatcggctacgtgaaggccggctctgtgcccagcctggccgccggcctgctgtttggcagcctggccggcctgggcgcctaccaggtgtctggcagcaaggagcggctgggcttccccagctacatctggtacctgggctggcactatggaaatgaggtgctgcccctgtggaagatccacgcctgccgcttcaactgccgctgccagtttgctgatggccggcagagctggagctag

SEQ ID NO: 39242 - DNA, 339 bp, Artificial Sequence; identical to SEQ ID NO: 33340
  Description of Artificial Sequence: Synthetic coding sequence

SEQ ID NO: 39243 - DNA, 378 bp, Artificial Sequence
  Description of Artificial Sequence: Synthetic coding sequence
atgcagatggaccccggcccccaggtgcccctgtactggctgggctttgtgtatgctgccctggccgccctgggcggcatcagcggctacgccaaggtgggctctgtgcagagccccagcgctggcttcttcttcagcgagctggccggcctggatgccagccagcccagcaggaaccccaaggagcacctgagcagccctgtgtacatctgggacctggcccgctactatgccaacaagatcctgaccctgtggaacatctatgcctgtggcttcagctgccgctgcctgctgattgtgtccaagctgggctccatgtatggagagcagatcctgtctgtggtggccatgagccagctgggcctgatgaagaactag

SEQ ID NO: 39244 - DNA, 657 bp, Artificial Sequence
  Description of Artificial Sequence: Synthetic coding sequence
atgtatgccctgtggaggacaggccccaccaccagccctgccctgctgaccctgctgagcaaaggagtgcccaggcctgctgccccctggaccatgagccccagctctgtggccctgatctgcctgctgcgctatggccagctgctggagcagagccgccacagctgggtgaacaccacagccctgatcaccggctgcaccaatgctgctggcctgctggtggtgggcaacttccaggtggaccacgcccggagcctgcactacgtgggcgccggcgtggccttccctgctggcctgctgtttgtgtgcctgcactgtgccctgagctaccagggcgccacagcccccctggacctggccgtggcctacctgcggtctgtgctggccgtgattgccttcatcaccctggtgctgtctggagtcttctttgtgcatgagagcagccagctgcagcacggggccgccctgtgtgagtgggtgtgtgtgattgacatcctgatcttctacggcaccttctcctatgaatttggagctgtgtccagtgacaccctggtggccgccctgcagcccaccccaggccgggcctgcaagagcagcggcagcagcagcaccagcacccacctgaactgtgcccctgagagcatcgccatgatctag

SEQ ID NO: 39245 - DNA, 816 bp, Artificial Sequence
  Description of Artificial Sequence: Synthetic coding sequence
atgacagcctggatcctgctgcctgtgtccctgagcgccttcagcatcaccggcatctggacagtgtatgccatggctgtgatgaaccaccacgtgtgccctgtggagaactggagctacaatgaaagctgccccccagaccctgctgagcagggcggccccaagacctgctgcaccctggatgatgtgcccctcatcagcaaatgtggcagctacccacctgagagctgcctcttcagcctcatcggcaacatgggcgccttcatggtggccctgatctgcctgctgcgctatggccagctgctggagcagagccgccacagctgggtgaacaccacagccctgatcaccggctgcaccaatgctgctggcctgctggtggtgggcaacttccaggtggaccacgcccggagcctgcactacgtgggcgctggggtggccttccctgctggcctgctgtttgtgtgcctgcactgtgccctgagctaccagggcgccacagcccccctggacctggccgtggcctacctgcggtctgtgctggccgtcatcgccttcatcaccctggtgctgagcggggtcttctttgtgcatgagagcagccagctgcagcacggggccgccctgtgtgagtgggtgtgtgtgattgacatcctgatcttctacggcaccttctcctatgaatttggagctgtgtccagtgacaccctggtggccgccctgcagcccaccccaggccgggcctgcaagagcagcggcagcagcagcaccagcacccacctgaactgtgcccctgagagcatcgccatgatctag

SEQ ID NO: 39246 - DNA, 816 bp, Artificial Sequence; identical to SEQ ID NO: 39245
  Description of Artificial Sequence: Synthetic coding sequence

SEQ ID NO: 39247 - DNA, 204 bp, Artificial Sequence
  Description of Artificial Sequence: Synthetic coding sequence
atgtatgccctgtggaggacaggccccaccaccagccctgccctgctgaccctgctgagcaaaggagtgcccaggcctgctgccccctggaccatgagccccagctctgtggccctgatctgcctgctgcgctatggccagctgctggagcagagccgccacagctgggtgaacaccacagccctgatcaccggctgcacctag

SEQ ID NO: 39248 - DNA, 702 bp, Artificial Sequence
  Description of Artificial Sequence: Synthetic coding sequence
atgtggggctacctgagcctgatgcctgtgttcctggccgtgtgggccatcagcggcgtgtggatcgtgtttgccatcgctgtgaccaacagaacagtggacctgagcaagggcttcccctacatcagcatctgtggcagcttccccccccagagctgcatcttcagccaggtgctgaacatgggcgccgccctggccgcctggatctgcatcgtgcgctaccaccagctgcgggactggggcgtgcggcgctggcccaaccagctgatcctgtggacaggcctgctgtgtgccctgggcacctctgtggtgggcaacttccaggagaagaaccagaggcccacccacctggccggggccttcctggccttcatcctgggcaatgtgtacttctggctgcagctgctgctgtggaggctgaagaggctgccccagcccggggccgcctggattggccccctgcggctgggcctgtgcagcgtgtgcaccatcctgattgtggccatgattgtgctgcacgcctgcagcctgcggtctgtgtctgctgcctgtgagtgggtggtggccatgctgctgtttgccctgtttggcctgctggccgtggacttcagcgccctggagagctgcaccctgtgtgtgcagccctggcccagcctgagccccccaccagccagccccatcagcctgcctgtgcagctgtag

SEQ ID NO: 39249 - DNA, 702 bp, Artificial Sequence; identical to SEQ ID NO: 39248
  Description of Artificial Sequence: Synthetic coding sequence

SEQ ID NO: 39250 - DNA, 750 bp, Artificial Sequence
  Description of Artificial Sequence: Synthetic coding sequence
atggatggcaagaagtgcagcgtgtggatgttcctgcccctggtgttcaccctcttcaccagcgctggcctgtggatcgtgtacttcatcgctgtggaggatgacaagatcctgcccctgaacagcgctgagaggaagccaggagtgaagcacgccccctacatcagcattgctggagatgaccccccagccagctgtgtgttcagccaggtgatgaacatggccgccttcctggccctggtggtggccgtgctgcgcttcatccagctgaagcccaaggtgctgaacccctggctgaacatcagcggcctggtggccctgtgcctggccagctttggcatgaccctgctgggcaacttccagctgaccaatgatgaggagatccacaacgtgggcaccagcctgacctttggatttggcaccctgacctgctggatccaggccgccctgaccctgaaggtgaacatcaagaatgaaggaagaagagtgggcatccccagggtcatcctgagcgccagcatcaccctgtgtgtggtgctgtacttcatcctgatggcccagagcatccacatgtatgctgcccgggtgcagtggggcctggtgatgtgcttcctgagctacttcggcacctttgctgtggagttccgccactaccgctatgagatcgtgtgcagcgagtaccaggagaacttcctgtccttcagcgagagcctgtctgaggccagcgagtaccagacagaccaggtgtag

SEQ ID NO: 39251 - DNA, 204 bp, Artificial Sequence
  Description of Artificial Sequence: Synthetic coding sequence
atggatggcaagaagtgcagcgtgtggatgttcctgcccctggtgttcaccctcttcaccagcgctggcctgtggatcgtgtacttcatcgctgtggaggatgacaagatcctgcccctgaacagcgctgagaggaagccaggagtgaagcacgccccctacatcagcattgctggagatgaccccccagccagctgtgtgtag

SEQ ID NO: 39252 - DNA, 750 bp, Artificial Sequence; identical to SEQ ID NO: 39250
  Description of Artificial Sequence: Synthetic coding sequence

SEQ ID NO: 39253 - DNA, 1407 bp, Artificial Sequence
  Description of Artificial Sequence: Synthetic coding sequence
atgccagaagatggagctggagatggaggagaggtgcctgccctgatcccagatggagagcccctgcgggaggagcagaggcccctgaagcagagcctgggcagcagcctgtgccgggagagccactggaagtgcctgctgctgaccctgctgattcatgcctgtggggctgtggtggcctggtgccgcctggccaccgtgccccggctggtgctgggccctgaggccgccctggcccggggggccggcggccccccacccacctacccagccagcccctgcagtgatggctacctgtacatccccctggcctttgtgtccctgctgtacctgctgtacctggccgagtgctggcactgccacgtgcgcagctgccaggcccccaggacagatgcccacacagtgctggccctgatccggcggctgcagcaggccccaccctgtgtgtggtggaaggccaccagctaccactacgtgcggaggacccggcagatcacccgctacagaaatggagatgcctacaccaccacccaggtgtaccacgagagagctgacagcaggacagcccggggggagtttgactacagcgcccacggcgtgagagatgtgtccaaggagctggtgggcctggccgagcacgccgccacccggctgcgcttcaccaagtgcttctcctttggcagcgctgaggccgaggccagctacctgacccagagggcccgcttcttcagcgccaatgaaggcctggatgactacctggaggcccgggagggcatgcacctgaaggatgtggacttccgggagagcctgatggtgtttgctgaccccaggagccccccctggtacgcccgggcctgggtgttctggctggtgtctgctgccaccctgtcctggcccctgcgggtggtggccgcctacggcacagcccacgtgcactaccaggtggagaagctgtttggagccagcagccccccacctggagctgtgcccagcggcccccccctgagccgggtggccaccgtggacttcacagagctggagtggcacatctgcagcaaccggcagctggtgcccagctacagcgaggccgtggtgatgggcgccggcagcggggcctacctgcggggctgccagcgctgcagaagatctgtgagcagcaacagcctgcccccagcccggcccagcggcccccggctgcccttcagccgcagccggctgagcctgggcgctgggggccgggccaccccaggagtcttccgcagcctgagcggcggccccctgggcagaagaggagaggacacagagcccctggagagccccccctgctatgaagatgccctgtacttccctgtgctgattgtgcatggagacagcggctgccagggagatggccagggcgccctgtag

SEQ ID NO: 39254 - DNA, 669 bp, Artificial Sequence
  Description of Artificial Sequence: Synthetic coding sequence
atgagccccccaggcagcgctgctggggagagcgctgctgggggcggcggcggcggcggcggccctggggtgtctgaggagctgacagctgctgctgctgctgctgctgctgatgagggccctgcccgggaggagcagaggcccatccagcccagcttcaccaagagcctgtgccgggagagccactggaagtgcctgctgctgagcctgctgatgtatggctgcctgggcgctgtggcctggtgccacgtgaccaccgtgacccggctgaccttcagcagcgcctaccagggcaacagcctgatgtaccatgacagcccctgcagcaatggctacgtgtacatccccctggccttcctgctgatgctgtatgctgtgtacctggtggagtgctggcactgccaggcccggcatgagctgcagcaccgggtggatgtgtcctctgtgcgggagcgggtgggccgcatgcagcaggccaccccctgcatctggtggaaggccatctcctaccactacgtgcggaggacccggcaggtgacccgctacagaaatggagatgcctacaccaccacccaggtgcccggctgcctgggcagccaggtggtgcccctgcggagcccctggagaaatgcccagctggatgctggcagtgatgaggagcccgcctag

SEQ ID NO: 39255 - DNA, 1701 bp, Artificial Sequence
  Description of Artificial Sequence: Synthetic coding sequence
atgagccccccaggcagcgctgctggggagagcgctgctgggggcggcggcggcggcggcggccctggggtgtctgaggagctgacagctgctgctgctgctgctgctgctgatgagggccctgcccgggaggagcagaggcccatccagcccagcttcaccaagagcctgtgccgggagagccactggaagtgcctgctgctgagcctgctgatgtatggctgcctgggcgctgtggcctggtgccacgtgaccaccgtgacccggctgaccttcagcagcgcctaccagggcaacagcctgatgtaccatgacagcccctgcagcaatggctacgtgtacatccccctggccttcctgctgatgctgtatgctgtgtacctggtggagtgctggcactgccaggcccggcatgagctgcagcaccgggtggatgtgtcctctgtgcgggagcgggtgggccgcatgcagcaggccaccccctgcatctggtggaaggccatctcctaccactacgtgcggaggacccggcaggtgacccgctacagaaatggagatgcctacaccaccacccaggtgtaccacgagcgggtgaacacccacgtggccgaggccgagtttgattatgcccgctgtggggtgagagatgtgtccaagaccctggtgggcctggagggcgccccagccacccggctgcgcttcaccaagtgcttctcctttgcctctgtggaggccgagaatgcctacctgtgccagagggcccgcttctttgctgaaaatgaaggcctggatgactacatggaggcccgggagggcatgcacctgaagaatgtggacttccgggagttcatggtggccttcccagaccctgcccggcccccctggtacgcctgcagcagcgccttctgggccgccgccctgctgaccctgtcctggcccctgcgggtgctggccgagtacagaacagcctatgcccactaccacgtggagaagctgtttggcctggagggccctggcagcgccagcagcgctgggggcggcctgagccccagtgatgagctgctgccccccctgacccaccggctgccccgggtgaacacagtggacagcacagagctggagtggcacatccgcagcaaccagcagctggtgcccagctacagcgaggccgtgctgatggacctggccggcctgggcacccgctgtggcggggccggcggcggctacgcccccagctgccgctatggaggagtgggcggccctggagctgctggggtggccccctaccgccgcagctgtgagcactgccagagagctgtgagcagcagcagcatcttcagccgcagcgccctgagcatctgtgccagccccagggctggccctggccctgggggcggggccggctgcggcggcagccgcttcagcctgggccgcctgtatggcagcagaagaagctgcctgtggaggagccgcagcggctctgtgaatgaggccagctgccccacagagcagacccggctgagcagccaggcctccatgggagatgatgaagatgatgatgaggaggaggccggccccccaccaccctaccatgatgccctgtacttccctgtgctgattgtgcaccggcaggagggctgcctgggccacagccaccggcccctgcaccgccacggcagctgtgtggagaccagcctgtag

SEQ ID NO: 39256 - DNA, 552 bp, Artificial Sequence
  Description of Artificial Sequence: Synthetic coding sequence
atgcaggccccccgggccgccctggtgtttgccctggtgattgccctggtgcctgtgggccggggcaactatgaggagctggagaacagcggggacaccaccgtggagagcgagcggcccaacaaggtgaccatccccagcacctttgctgctgtgaccatcaaggagaccctgaatgccaacatcaacagcaccaactttgccccagatgagaaccagctggagttcatcctgatggtgctgatccccctcatcctgctggtgctgctgctgctgtctgtggtgttcctggccacctactacaagaggaagaggaccaagcaggagcccagcagccagggcagccagagcgccctgcagacctatgagctgggctctgaaaatgtgaaggtgcccatctttgaggaggacacccccagcgtgatggagattgagatggaggagctggacaagtggatgaacagcatgaacagaaatgctgactttgaatgtctgcccaccctgaaggaggagaaggagagcaaccacaaccccagcgacagcgagagctag

SEQ ID NO: 39257 - DNA, 378 bp, Artificial Sequence
  Description of Artificial Sequence: Synthetic coding sequence
atgcaggccccccgggccgccctggtgtttgccctggtgattgccctggtgcctgtgggccggggcaactatgaggagctggagaacagcggggacaccaccgtggagagcgagcggcccaacaaggtgaccatccccagcacctttgctgctgtgaccatcaaggagaccctgaatgccaacatcaacagcaccaactttgccccagatgagaaccagctggagttcatcctgatggtgctgatccccctcatcctgctggtgctgctgctgctgtctgtggtgttcctggccacctactacaagaggaagaggaccaagcaggagcccagcagccagggcagccagagcgccctgcagacctacctgctggtgtag

SEQ ID NO: 39258 - DNA, 891 bp, Artificial Sequence
  Description of Artificial Sequence: Synthetic coding sequence
atgaccaagacagccctgctgaagctgtttgtggccatcgtcatcaccttcatcctgatcctgcctgagtacttcaagacccccaaggagaggaccctggagctgagctgcctggaggtgtgcctgcagagcaacttcacctacagcctgagcagcctgaacttctcctttgtgaccttcctgcagcctgtgcgggagacccagatcatcatgaggatcttcctgaaccccagcaacttcaggaacttcaccaggacctgccaggacatcactggagagttcaagatgtgcagcagctgcctggtgtgtgagagcaagggcaacatggacttcatcagccaggagcagaccagcaaggtgctgatcagaagaggctccatggaggtgaaggccaatgacttccacagcccctgccagcacttcaacttctctgtggcccccctggtggaccacctggaggagtacaacaccacctgccacctgaagaaccacacaggccgcagcaccatcatggaggatgagcccagcaaggagaagagcatcaactacacctgccgcatcatggagtacccaaatgactgcatccacatcagcctgcacctggagatggacatcaagaacatcacctgcagcatgaagatcacctggtacatcctggtgctgctggtgttcatcttcctgatcatcctgaccatcaggaagatcctggagggccagaggagagtgcagaagtggcagagccaccgggacaagcccacctctgtgctgctgcggggcagtgacagcgagaagctgcgggccctgaatgtgcaggtgctgtctgctgagaccacccagaggctgcccctggaccaggtgcaggaggtgctgccccccatccctgagctgtag

SEQ ID NO: 39259 - DNA, 567 bp, Artificial Sequence
  Description of Artificial Sequence: Synthetic coding sequence
atgggcggcggctggtggtgggcccgggccgcccggctggcccggctgcgcttcagaagaagcctgctgcccccccagaggcccaggtctgggggcgcccggggcagctttgcccctggccacggccccagggctggggccagccccccacctgtgtctgagctggacagagcagatgcctggctgctgaggaaggcccatgaaacagccttcctgtcctggttcagaaatggcctgctggccagcggcatcggggtcatctccttcatgcagagcgacatgggccgggaggccgcctacggcttcttcctgctgggcggcctgtgtgtggtgtggggcagcgccagctatgctgtgggcctggccgccctgcggggccccatgcagctgaccctgggcggcgctgctgtgggcgctggagctgtgctggccgccagcctgctgtgggcctgtgctgtgggcctgtacatgggccagctggagctggatgtggagctggtgcctgaagatgatggaacagccagcgctgagggcccagatgaggccggccggcccccacctgagtag

SEQ ID NO: 39260 - DNA, 1440 bp, Artificial Sequence
  Description of Artificial Sequence: Synthetic coding sequence
atggctgtgctgggcgtgcagctggtggtgaccctgctgacagccaccctgatgcaccggctggccccccactgcagctttgcccgctggctgctgtgcaatggcagcctcttccgctacaagcaccccagcgaggaggagctgcgggccctggccggcaagccccggccccggggcaggaaggagcgctgggccaacggcctgtctgaggagaagcccctgtctgtgcccagagatgcccccttccagctggagacctgccccctgaccaccgtggatgccctggtgctgcgcttcttcctggagtaccagtggtttgtggactttgctgtgtacagcggaggagtgtacctgttcacagaggcctactactacatgctgggccctgccaaggagaccaacattgctgtgttctggtgcctgctgactgtgaccttcagcatcaagatgttcctgactgtgacccggctgtacttctctgctgaggagggcggggagaggtctgtgtgcctgacctttgccttcctgttcctgctgctggccatgctggtgcaggtggtgcgggaggagaccctggagctgggcctggagcccggcctggcctccatgacccagaacctggagcccctgctgaagaagcagggctgggactgggccctgcctgtggccaagctggccatccgggtgggcctggccgtggtgggctctgtgctgggcgccttcctgaccttccctggcctgcggctggcccagacccacagagatgccctgaccatgtctgaagatcggcccatgctgcagttcctgctgcacaccagcttcctgagccccctcttcatcctgtggctgtggaccaagcccatcgcccgggacttcctgcaccagcccccatttggagagacccgcttcagcctgctgagtgacagcgcctttgattctggccgcctgtggctgctggtggtgctgtgcctgctgcggctggccgtgacccggccccacctgcaggcctacctgtgcctggccaaggcccgggtggagcagctgcggcgggaggccggcagaattgaggcccgggagatccagcagagggtggtgcgggtgtactgctacgtgacagtggtgtccctgcagtacctgacccccctcatcctgaccctgaactgcaccctgctgctgaagaccctgggcggctacagctggggcctgggccctgcccccctgctgagcccagaccccagcagcgccagcgctgcccccatcggcagcggggaggatgaggtgcagcagacagctgccagaattgctggggccctgggcggcctgctgacccccctcttcctgcggggcgtgctggcctacctgatctggtggacagctgcctgccagctgctggccagcctgtttggcctgtacttccaccagcacctggccggcagctag

SEQ ID NO: 39261 - DNA, 1131 bp, Artificial Sequence
  Description of Artificial Sequence: Synthetic coding sequence
atggctgtgctgggcgtgcagctggtggtgaccctgctgacagccaccctgatgcaccggctggccccccactgcagctttgcccgctggctgctgtgcaatggcagcctcttccgctacaagcaccccagcgaggaggagctgcgggccctggccggcaagccccggccccggggcaggaaggagcgctgggccaacggcctgtctgaggagaagcccctgtctgtgcccagagatgcccccttccagctggagacctgccccctgaccaccgtggatgccctgggcctggcctccatgacccagaacctggagcccctgctgaagaagcagggctgggactgggccctgcctgtggccaagctggccatccgggtgggcctggccgtggtgggctctgtgctgggcgccttcctgaccttccctggcctgcggctggcccagacccacagagatgccctgaccatgtctgaggaccggcccatgctgcagttcctgctgcacaccagcttcctgagccccctcttcatcctgtggctgtggaccaagcccatcgcccgggacttcctgcaccagcccccatttggagagacccgcttcagcctgctgagtgacagcgcctttgacagcggccgcctgtggctgctggtggtgctgtgcctgctgcggctggccgtgacccggccccacctgcaggcctacctgtgcctggccaaggcccgggtggagcagctgcggcgggaggccggccgcatcgaggcccgggagatccagcagagggtggtgcgggtgtactgctacgtgacagtggtgtccctgcagtacctgacccccctcatcctgaccctgaactgcaccctgctgctgaagaccctgggcggctacagctggggcctgggccctgcccccctgctgagcccagaccccagcagcgccagcgctgcccccatcggcagcggagaagatgaggtgcagcagacagctgccagaattgctggggccctgggcggcctgctgacccccctcttcctgcggggcgtgctggcctacctgatctggtggacagctgcctgccagctgctggccagcctgtttggcctgtacttccaccagcacctggccggcagctag

SEQ ID NO: 39262 - DNA, 1464 bp, Artificial Sequence
  Description of Artificial Sequence: Synthetic coding sequence
atgggcgtcatcggcatccagctggtggtgaccatggtgatggcctctgtgatgcagaagatcatcccccactacagcctggcccgctggctgctgtgcaatggcagcctgcgctggtaccagcaccccacagaggaggagctgcgcatcctggccggcaagcagcagaagggcaagaccaagaaggacaggaagtacaacggccacatcgagagcaagcccctgaccatccccaaggacatcgacctgcacctggagaccaagtctgtgacagaggtggacaccctggccctgcactacttccctgagtaccagtggctggtggacttcaccgtggccgccaccgtggtgtacctggtgacagaggtgtactacaacttcatgaagcccacccaggagatgaacatcagcctggtgtggtgcctgctggtgctgagctttgccatcaaggtgctcttcagcctgaccacccactacttcaaggtggaggatggaggagagaggtctgtgtgtgtgaccttcggcttcttcttctttgtgaaggccatggctgtgctgattgtgacagagaactacctggagtttggcctggagaccggcttcaccaacttcagtgacagcgccatgcagttcctggagaagcagggcctggagagccagagccctgtgtccaagctgaccttcaagttcttcctggccatcttctgcagcttcatcggggccttcctgaccttccctggcctgcggctggcccagatgcacctggatgccctgaacctggccacagagaagatcacccagaccctgctgcacatcaacttcctggcccccctcttcatggtgctgctgtgggtgaagcccatcaccaaggactacatcatgaacccccccctgggcaaggagagcatccccctgatgacagaggccacctttgacaccctgcggctgtggctgatcatcctgctgtgtgccctgcggctggccatgatgaggagccacctgcaggcctacctgaacctggcccagaagtgtgtggaccagatgaagaaggaggccggccgcatcagcacagtggagctgcagaagatggtggcccgggtcttctactacctgtgtgtgattgccctgcagtatgtggcccccctggtgatgctgctgcacaccaccctgctgctgaagaccctgggcaaccacagctggggcatctacccagagagcatcagcaccctgcctgtggacaacagcctgctgagcaacagcgtgtacagcgagctgcccagcgctgagggcaagatgaaggtgacagtgacccagatcaccgtggccctgagcagcctgaagaacatcttcacccccctgctcttccggggcctgctgtccttcctgacctggtggattgctgcctgcctcttcagcaccagcctgtttggcctcttctaccaccagtacctgactgtggcctag

SEQ ID NO: 39263 - DNA, 924 bp, Artificial Sequence
  Description of Artificial Sequence: Synthetic coding sequence
atgggcgtcatcggcatccagctggtggtgaccatggtgatggcctctgtgatgcagaagatcatcccccactacagcctggcccgctggctgctgtgcaatggcagcctgcgctggtaccagcaccccacagaggaggagctgcgcatcctggccggcaagcagcagaagggcaagaccaagaaggacaggaagtacaacggccacatcgagagcaagcccctgaccatccccaaggacatcgacctgcacctggagaccaagtctgtgacagaggtggacaccctggccctgcactacttccctgagtaccagtggctggtggacttcaccgtggccgccaccgtggtgtacctggtgacagaggtgtactacaacttcatgaagcccacccaggagatgaacatcagcctggtgtggtgcctgctggtgctgagctttgccatcaaggtgctcttcagcctgaccacccactacttcaaggtggaggatggaggagagaggtctgtgtgtgtgaccttcggcttcttcttctttgtgaaggccatggctgtgctgattgtgacagagaactacctggagtttggcctggagaccggcttcaccaacttcagtgacagcgccatgcagttcctggagaagcagggcctggagagccagagccctgtgtccaagctgaccttcaagttcttcctggccatcttctgcagcttcatcggggccttcctgaccttccctggcctgcggctggcccagatgcacctggatgccctgaacctggccacagagaagatcacccagaccctgctgcacatcaacttcctggcccccctcttcatggtgctgctgtgggtgaagcccatcaccaaggactacatcatgaacccccccctgggcaaggagatcagccccagcggccgctag

SEQ ID NO: 39264 - DNA, 870 bp, Artificial Sequence
  Description of Artificial Sequence: Synthetic coding sequence
atggagcctgctgctggcatccagaggaggagcagccagggccccaccgtgcccccaccaccccggggccacgcccccccagctgctgcccctggccctgcccccctgagcagccctgtgcgggagcccccccagctggaggaggagcggcaggtgcgcatcagcgagagcggccagttcagtgatggcctggaggaccggggcctgctggagagcagcacccggctgaagccccatgaggcccagaactacaggaagaaggccctgtgggtgtcctggttcagcatcatcgtgaccctggccctggccgtggccgccttcaccgtgtctgtgatgagatacagcgccagcgcctttggatttgcctttgatgccatcctggatgtgctgagcagcgccatcgtgctgtggagatacagcaatgctgctgctgtgcacagcgcccaccgggagtacatcgcctgtgtgatcctgggcgtcatcttcctgctgagcagcatctgcatcgtggtgaaggccatccatgacctgagcacccggctgctgcctgaggtggatgacttcctgttctctgtgtccatcctgagcggcatcctgtgcagcatcctggccgtgctgaagttcatgctgggcaaggtgctgaccagccgggccctgatcacagatggcttcaacagcctggtgggcggcgtgatgggcttcagcatcctgctgtctgctgaggtgttcaagcatgattctgctgtgtggtacctggatggcagcattggagtgctgattggcctgaccatctttgcctatggagtgaagctgctgattgacatggtgccccgggtgcggcagaccaggcactatgagatgtttgaatag

SEQ ID NO: 39265 - DNA, 279 bp, Artificial Sequence
  Description of Artificial Sequence: Synthetic coding sequence
tgtggcatgagccgcagcggcctgctggagagcagcacccggctgaagccccatgaggcccagaactacaggaagaaggccctgtgggtgtcctggttcagcatcatcgtgaccctggccctggccgtggccgccttcaccgtgtctgtgatgagatacagcgccagcgccttcggctttgcctttgatgccatcctggatgtgctgagcagcgccatcgtgctgtggagatacagcaatgctgctgctgtgcacagcgcccaccgggagtacatgtag

SEQ ID NO: 39266 - DNA, 777 bp, Artificial Sequence
  Description of Artificial Sequence: Synthetic coding sequence
atgagccgctacagctaccagagcctgctggactggctgtatggaggagtggaccccagctttgctggaaatggaggccctgactgtgccgccttcctgtcctggcagcagaggctgctggagagcgtggtggtgctgaccctggccctgctggagatcctggtggccctgcggcacatcctgcggcagaccaaggaggatggccggggcagccctggcagccagcctgagcaggtgacccagaggcctgaggagggcaaggagagcctgagcaagaacctgctgctggtggccctgtgcctgacctttggagtggaggtgggcttcaagtttgccaccaagacagtcatctacctgctgaacccctgccacctggtgaccatgatgcacctgccctttgagctggagatctactacatccagcacgtgatgctgtatgtggtgcccatctacctgctgtggaagggcggggcctacaccccagagcccctgagcagcttccgctgggccctgctgagcacaggcctgatgttcttctaccacttctctgtgctgcagatcctgggcctggtgacagaggtgaacctgaacaacatgctgtgcccagccatcagtgaccccttctacggcccctggtaccgcatctgggccagcggccaccagaccctgatgaccatgacccacggcaagctggtgatcctcttctcctacatggccggccccctgtgcaagtacctgctggacctgctgcggctgcctgccaagaagattgattag

SEQ ID NO: 39267 - DNA, 894 bp, Artificial Sequence
  Description of Artificial Sequence: Synthetic coding sequence
atgagccgctacagctaccagagcctgctggactggctgtatggaggagtggaccccagctttgctggaaatggaggccctgactgtgccgccttcctgtcctggcagcagaggctgctggagagcgtggtggtgctgaccctggccctgctggagatcctggtggccctgcggcacatcctgcggcagaccaaggaggatggccggggcagccctggcagccagcctgagcaggtgacccagaggcctgaggagggcaaggagagcctgagcaagaacctgctgctggtggccctgtgcctgacctttggagtggaggtgggcttcaagtttgccaccaagacagtcatctacctgctgaacccctgccacctggtgaccatgatgcacatcttcctgctggcctgccccccctgccgcggggccatcgtggtgttcaagctgcagatgcacatgctgaatggagccctgctggccctgctcttccctgtggtgaacacccggctgctgccctttgagctggagatctactacatccagcacgtgatgctgtatgtggtgcccatctacctgctgtggaagggcggggcctacaccccagagcccctgagcagcttccgctgggccctgctgagcacaggcctgatgttcttctaccacttctctgtgctgcagatcctgggcctggtgacagaggtgaacctgaacaacatgctgtgcccagccatcagtgaccccttctacggcccctggtaccgcatctgggccagcggccaccagaccctgatgaccatgacccacggcaagctggtgatcctcttctcctacatggccggccccctgtgcaagtacctgctggacctgctgcggctgcctgccaagaagattgattag

SEQ ID NO: 39268 - DNA, 447 bp, Artificial Sequence
  Description of Artificial Sequence: Synthetic coding sequence
atgcacatgctgaatggagccctgctggccctgctcttccctgtggtgaacacccggctgctgccctttgagctggagatctactacatccagcacgtgatgctgtatgtggtgcccatctacctgctgtggaagggcggggcctacaccccagagcccctgagcagcttccgctgggccctgctgagcacaggcctgatgttcttctaccacttctctgtgctgcagatcctgggcctggtgacagaggtgaacctgaacaacatgctgtgcccagccatcagtgaccccttctacggcccctggtaccgcatctgggccagcggccaccagaccctgatgaccatgacccacggcaagctggtgatcctcttctcctacatggccggccccctgtgcaagtacctgctggacctgctgcggctgcctgccaagaagattgattag

SEQ ID NO: 39269 - DNA, 894 bp, Artificial Sequence; identical to SEQ ID NO: 39267
  Description of Artificial Sequence: Synthetic coding sequence

SEQ ID NO: 39270 - DNA, 777 bp, Artificial Sequence; identical to SEQ ID NO: 39266
  Description of Artificial Sequence: Synthetic coding sequence

SEQ ID NO: 39271 - DNA, 975 bp, Artificial Sequence
  Description of Artificial Sequence: Synthetic coding sequence
atggctgctgctgcccctggaaatggccgggccagcgccccccggctgctgctgctcttcctggtgcccctgctgtgggccccagctgctgtgcgggccggcccagatgaggacctgagccacaggaacaaggagcccccagccccagcccagcagctgcagccccagcctgtggccgtgcagggccctgagcccgcccgggtggagaagatcttcaccccagctgcccctgtgcacaccaacaaggaggaccctgccacccagaccaacctgggcttcatccacgcctttgtggccgccatcagcgtcatcatcgtgtctgagctgggggacaagaccttcttcatcgccgccatcatggccatgagatacaaccggctgactgtgctggccggggccatgctggccctgggcctgatgacctgcctgtctgtgctgtttggctacgccaccaccgtcatcccccgggtgtacacctactacgtgtccacagtgctgtttgccatcttcggcatccgcatgctgcgggagggcctgaagatgagcccagatgagggccaggaggagctggaggaggtgcaggccgagctgaagaagaaggatgaggagttccagaggaccaagctgctgaatggacctggagatgtggagaccggcaccagcatcaccgtgccccagaagaagtggctgcacttcatcagccccatctttgtgcaggccctgaccctgaccttcctggccgagtggggagacaggagccagctgaccaccatcgtgctggccgcccgggaggacccctatggagtggccgtgggcggcaccgtgggccactgcctgtgcaccggcctggccgtcatcggcggccgcatgattgcccagaagatctctgtgaggacagtgaccatcattggaggcatcgtgttcctggcctttgccttcagcgccctcttcatcagcccagacagcggcttctag

SEQ ID NO: 39272 - DNA, 786 bp, Artificial Sequence
  Description of Artificial Sequence: Synthetic coding sequence
atggagatccccatgcagaagatcttcaccccagctgcccctgtgcacaccaacaaggaggaccctgccacccagaccaacctgggcttcatccacgcctttgtggccgccatcagcgtcatcatcgtgtctgagctgggggacaagaccttcttcatcgccgccatcatggccatgagatacaaccggctgactgtgctggccggggccatgctggccctgggcctgatgacctgcctgtctgtgctgtttggctacgccaccaccgtcatcccccgggtgtacacctactacgtgtccacagtgctgtttgccatcttcggcatccgcatgctgcgggagggcctgaagatgagcccagatgagggccaggaggagctggaggaggtgcaggccgagctgaagaagaaggatgaggagttccagaggaccaagctgctgaatggacctggagatgtggagaccggcaccagcatcaccgtgccccagaagaagtggctgcacttcatcagccccatctttgtgcaggccctgaccctgaccttcctggccgagtggggagacaggagccagctgaccaccatcgtgctggccgcccgggaggacccctacggcgtggccgtgggcggcaccgtgggccactgcctgtgcaccggcctggccgtgattggaggccgcatgattgcccagaagatctctgtgaggacagtgaccatcatcggcggcatcgtgttcctggcctttgccttcagcgccctcttcatcagcccagattctggcttctag

SEQ ID NO: 39273 - DNA, 219 bp, Artificial Sequence
  Description of Artificial Sequence: Synthetic coding sequence
atgtctgccatcttcaacttccagagcctgctgaccgtcatcctgctgctgatctgcacctgtgcctacatccgcagcctggcccccagcctgctggacaggaacaagacaggcctgctgggcatcttctggaagtgtgccagaattggagagaggaagagcccctacgtggccgtgtgctgcatcgtgatggccttcagcatcctcttcatccagtag

SEQ ID NO: 39274 - DNA, 225 bp, Artificial Sequence
  Description of Artificial Sequence: Synthetic coding sequence
atgaccaacgtgtacagcctggatggcatcctggtgtttggcctgctgtttgtgtgcacctgtgcctacttcaagaaggtgccccggctgaagacctggctgctgtctgagaagaagggcgtgtggggcgtcttctacaaggctgctgtgattggcacccggctgcatgctgctgtggccatcgcctgtgtggtgatggccttctacgtgctcttcatcaagtag

SEQ ID NO: 39275 - DNA, 2094 bp, Artificial Sequence
  Description of Artificial Sequence: Synthetic coding sequence
atgtgcaagagcctgcgctactgcttcagccactgcctgtacctggccatgacccggctggaggaggtgaaccgggaggtgaacatgcacagctctgtgcgctacctgggctacctggcccgcatcaacctgctggtggccatctgcctgggcctgtatgtgcgctgggagaagacagccaacagcctcatcctggtgatcttcatcctgggcctgtttgtgctgggcatcgccagcatcctgtactactacttctccatggaggccgccagcctgagcctgagcaacctgtggtttggcttcctgctgggcctgctgtgcttcctggacaacagcagcttcaagaatgatgtgaaggaggagagcaccaagtacctgctgctgaccagcatcgtgctgcgcatcctgtgcagcctggtggagcgcatcagcggctacgtgcgccaccggcccaccctgctgaccaccgtggagttcctggagctggtgggctttgccatcgccagcaccaccatgctggtggagaagagcctgagcgtcatcctgctggtggtggccctggccatgctgatcatcgacctgaggatgaagagcttcctggccatccccaacctggtgatctttgctgtgctgctcttcttcagcagcctggagacccccaagaaccccatcgcctttgcctgcttcttcatctgcctgatcacagaccccttcctggacatctacttcagcggcctgtctgtgacagagcgctggaagcccttcctgtaccggggccgcatctgccggcggctgtctgtggtgtttgctggcatgattgagctgaccttcttcatcctgagcgccttcaagctgcgggacacccacctgtggtactttgtgattcctggcttcagcatcttcggcatcttctggatgatctgccacatcatcttcctgctgaccctgtggggcttccacaccaagctgaatgactgccacaaggtgtacttcacccacaggacagactacaacagcctggaccgcatcatggccagcaagggcatgaggcacttctgcctgatcagcgagcagctggtgttcttcagcctgctggccacagccatcctgggcgctgtgtcctggcagcccaccaacggcatcttcctgtccatgttcctgattgtgctgcccctggagagcatggcccacggcctcttccacgagctgggcaactgcctgggcggcacctctgtgggctacgccatcgtcatccccaccaacttctgcagcccagatggccagcccaccctgctgcccccagagcacgtgcaggagctgaacctgcggagcacaggcatgctgaatgccatccagcgcttctttgcctaccacatgattgagacctacggctgtgactacagcaccagcggcctgagctttgacaccctgcacagcaagctgaaggccttcctggagctgaggacagtggatggccccaggcatgacacctacatcctgtactacagcggccacacccatggaactggagagtgggccctggccggcggggacaccctgcggctggacaccctcatcgagtggtggagggagaagaatggcagcttctgcagccgcctcatcatcgtgctggacagcgagaacagcaccccctgggtgaaggaggtgaggaagatcaatgaccagtacatcgctgtgcagggcgctgagctgatcaagacagtggacatcgaggaggccgaccccccccagctgggggacttcaccaaggactgggtggagtacaactgcaacagcagcaacaacatctgctggacagagaagggccgcacagtgaaggctgtgtatggagtgtccaagcgctggagcgactacaccctgcacctgcccactggaagtgatgtggccaagcactggatgctgcacttcccccgcatcacctaccccctggtgcacctggccaactggctgtgtggcctgaacctcttctggatctgcaagacctgcttccgctgcctgaagaggctgaagatgtcctggttcctgcccaccgtgctggacaccggccagggcttcaagctggtgaagagctag

SEQ ID NO: 39276 - DNA, 942 bp, Artificial Sequence
  Description of Artificial Sequence: Synthetic coding sequence
atgttcctgattgtgctgcccctggagagcatggcccacggcctcttccacgagctgggcaactgcctgggcggcacctctgtgggctacgccatcgtcatccccaccaacttctgcagcccagatggccagcccaccctgctgcccccagagcacgtgcaggagctgaacctgcggagcacaggcatgctgaatgccatccagcgcttctttgcctaccacatgattgagacctacggctgtgactacagcaccagcggcctgagctttgacaccctgcacagcaagctgaaggccttcctggagctgaggacagtggatggccccaggcatgacacctacatcctgtactacagcggccacacccatggaactggagagtgggccctggccggcggggacaccctgcggctggacaccctcatcgagtggtggagggagaagaatggcagcttctgcagccgcctcatcatcgtgctggacagcgagaacagcaccccctgggtgaaggaggtgaggaagatcaatgaccagtacatcgctgtgcagggcgctgagctgatcaagacagtggacatcgaggaggccgaccccccccagctgggggacttcaccaaggactgggtggagtacaactgcaacagcagcaacaacatctgctggacagagaagggccgcacagtgaaggctgtgtatggagtgtccaagcgctggagcgactacaccctgcacctgcccactggaagtgatgtggccaagcactggatgctgcacttcccccgcatcacctaccccctggtgcacctggccaactggctgtgtggcctgaacctcttctggatctgcaagacctgcttccgctgcctgaagaggctgaagatgtcctggttcctgcccaccgtgctggacaccggccagggcttcaagctggtgaagagctag

SEQ ID NO: 39277 - DNA, 2094 bp, Artificial Sequence; identical to SEQ ID NO: 39275
  Description of Artificial Sequence: Synthetic coding sequence

SEQ ID NO: 39278 - DNA, 894 bp, Artificial Sequence
  Description of Artificial Sequence: Synthetic coding sequence
atggaggagcccacagctgtggagggccaggtgcagctgcccagcccccaccagggcagcctgaggaaggctgtggccgccgccctggccctggatggagagagcaccatgggccacaggaagaagaagaggaaggagagcaggcctgagagcatcatcatctacagaagtgacaatgagaagacagatgaggagcccggggagagcgagggcggggaccagcccaaggaggaggagggagatgacttcctggactaccctgtggatgatgacatgtggaacctgcccctggacagccgctacgtgaccctgaccggcaccatcacccggggcaagaagaagggccagatggtggacatccacgtgaccctgacagagaaggagctgcaggagctgaccaagcccaaggagagcagccgggagaccaccccagagggccgcatggcctgccagatgggcgctgaccggggcccccacgtggtgctgtggaccctcatctgcctgcctgtggtgttcatcctgagctttgtggtgtccttctactacggcaccatcacctggtacaacatcttcctggtgtacaatgaggagaggaccttctggcacaagatctcctactgcccctgcctggtgctcttctaccctgtgctgatcatggccatggccagcagcctgggcctgtatgctgctgtggtgcagctgtcctggagctgggaggcctggtggcaggccgcccgggacatggagaagggcttctgtggctggctgtgcagcaagctgggcctggaggactgcagcccctacagcatcgtggagctgctggagagtgacaacatcagcagcaccctgagcaacaaggaccccatccaggaggtggagaccagcacagtgtag

SEQ ID NO: 39279 - DNA, 894 bp, Artificial Sequence; identical to SEQ ID NO: 39278
  Description of Artificial Sequence: Synthetic coding sequence

SEQ ID NO: 39280 - DNA, 351 bp, Artificial Sequence
  Description of Artificial Sequence: Synthetic coding sequence
atggaggagcccacagctgtggagggccaggtgcagctgcccagcccccaccagggcagcctgaggaaggctgtggccgccgccctggccctggatggagagagcaccatgggccacaggaagaagaagaggaaggagagcaggcctgagagcatcatcatctacagaagtgacaatgagaagacagatgaggagcccggggagagcgagggcggggaccagcccaaggaggaggagggagatgacttcctggactaccctgtggatgatgacatgtggaacctgcccctggacagccgctacgtgaccctgaccggcaccatcacccggggcaagaagaagggccagtag

SEQ ID NO: 39281 - DNA, 894 bp, Artificial Sequence; identical to SEQ ID NO: 39278
  Description of Artificial Sequence: Synthetic coding sequence

SEQ ID NO: 39282 - DNA, 894 bp, Artificial Sequence; identical to SEQ ID NO: 39278
  Description of Artificial Sequence: Synthetic coding sequence

SEQ ID NO: 39283 - DNA, 309 bp, Artificial Sequence
  Description of Artificial Sequence: Synthetic coding sequence
atggaggagcccacagctgtggagggccaggtgcagctgcccagcccccaccagggcagcctgaggaaggctgtggccgccgccctggccctggatggagagagcaccatgggccacaggaagaagaagaggaaggagagcaggcctgagagcatcatcatctacagaagtgacaatgagaagacagatgaggagcccggggagagcgagggcggggaccagcccaaggaggaggagggagatgacttcctggactaccctgtggatgatgacatgtggaacctgcccctggacagccgctacgtgtag

SEQ ID NO: 39284 - DNA, 597 bp, Artificial Sequence
  Description of Artificial Sequence: Synthetic coding sequence
atggagctgcctgaccctgtgcggcagaggctgggcaacttcagcagagctgtgttcagtgacagcaacagaactggacctgagagcaatgaaggaccagaaaatgagatggtgagcagcctggccctgcagatgagcctgtacttcaacacctactacttccccctgtggtgggtgagcagcatcatgatgctgcacatgaagtacagcatcctgcctgactactacaagttcatcgtcatcaccgtcatcatcctgatcaccctcatcgaggccatccggctgtacctgggctacgtgggcaacctgcaggagaaggtgcctgagctggccggcttctggctgctgagcctgctgctgcagctgcccctcatcctcttcctgctcttcaatgaaggcctgaccaacctgcccctggagaaggccatccacatcatcttcaccctcttcctggccttccaggtggtggccgccttcctgaccctgaggaagatggtgaaccagctggccgtgcgcttccacctgcaggactttgaccggctgagcgccaacagaggagacatgaggaggatgaggagctgcatcgaggagatctag

SEQ ID NO: 39285 - DNA, 435 bp, Artificial Sequence
  Description of Artificial Sequence: Synthetic coding sequence
atggagcgggagggcagcggcggcagcggcggcagcgctggcctgctgcagcagatcctgagcctgaaggtggtgccccgggtgggcaatggcaccctgtgccccaacagcaccagcctgtgcagcttccctgagatgtggtacggcgtcttcctgtgggccctggtgagcagcctcttcttccacgtgcctgctggcctgctggccctcttcaccctgcggcaccacaagtatggccgcttcatgtctgtgtccatcctgctgatgggcatcgtgggccccatcacagctggcatcctgaccagcgctgccatcgccggcgtgtacagagctgctgggaaggagatgatcccctttgaggccctgaccctgggcaccggccagaccttctgtgtgctggtggtgtccttcctgcgcatcctggccaccctgtag

SEQ ID NO: 39286 - DNA, 435 bp, Artificial Sequence; identical to SEQ ID NO: 39285
  Description of Artificial Sequence: Synthetic coding sequence

SEQ ID NO: 39287 - DNA, 399 bp, Artificial Sequence
  Description of Artificial Sequence: Synthetic coding sequence
atgaaggccgagggcggggaccacagcatgatcaacctgtctgtgcagcaggtgctgagcctgtgggcccacggcaccgtgctgaggaacctgacagagatgtggtactggatcttcctgtgggccctcttcagcagcctgtttgtgcacggggctgctggggtgctgatgtttgtgatgctgcagaggcaccggcagggccgggtcatctctgtgattgctgtgtccatcggcttcctggcctctgtgactggagccatgatcaccagcgctgctgtggccggcatctacagagtggccggcaagaacatggcccccctggaggccctggtgtggggcgtgggccagacagtgctgaccctcatcatctccttcagccgcatcctggccaccctgtag

SEQ ID NO: 39288 - DNA, 399 bp, Artificial Sequence; identical to SEQ ID NO: 39287
  Description of Artificial Sequence: Synthetic coding sequence

SEQ ID NO: 39289 - DNA, 972 bp, Artificial Sequence
  Description of Artificial Sequence: Synthetic coding sequence
atgagccctgctgctgctgctgagccagatggagaccagcaggacagacatgtgtccaagctgatcttctgcttctttgtgtttggagctgtgctgctgtgtgtgggcgtgctgctgagcatcttcggcttccaggcctgccagtacaagcccctgcctgactgccccatggtgctgaaggtggccggccctgcctgtgctgtggtgggcctgggcgctgtgatcctggcccggagccgggcccagctgcagctgcgggccggcctgcagaggggccagcagatggaccctgaccgggccttcatctgtggggagagccggcagtttgcccagtgcctgatcttcggcttcctgttcctgaccagcggcatgctgatctctgtgctgggcatctgggtgcccggctgcggcagcaactgggcccaggagcccctgaatgaaacagacaccggggacagcgagcccaggatgtgtggcttcctgagcctgcagatcatgggccccctcatcgtgctggtgggcctgtgcttctttgtggtggcccacgtgaagaagaggaacaccctgaatgccggccaggatgccagcgagcgggaggagggccagatccagatcatggagcctgtgcaggtgacagtgggggacagcgtcatcatcttccccccacctcctccaccctacttccctgagagcagcgccagcgctgtggccgagagccctggcaccaacagcctgctgcccaatgaaaatcctccttcctactacagcatcttcaactacggcacccccaccagcgagggcgccgccagcgagcgggactgtgagagcatctacaccatcagcggcaccaacagcagcagcgaggccagccacaccccccacctgcccagcgagctgccccccaggtatgaggagaaggaaaatgctgctgccaccttcctgcccctgagcagcgagcccagccccccatag

SEQ ID NO: 39290 - DNA, 975 bp, Artificial Sequence
  Description of Artificial Sequence: Synthetic coding sequence
atgagccctgctgctgctgctgagccagatggagaccagcaggacagacatgtgtccaagctgatcttctgcttctttgtgtttggagctgtgctgctgtgtgtgggcgtgctgctgagcatcttcggcttccaggcctgccagtacaagcccctgcctgactgccccatggtgctgaaggtggccggccctgcctgtgctgtggtgggcctgggcgctgtgatcctggcccggagccgggcccagctgcagctgcgggccggcctgcagaggggccagcagatggaccctgaccgggccttcatctgtggggagagccggcagtttgcccagtgcctgatcttcggcttcctgttcctgaccagcggcatgctgatctctgtgctgggcatctgggtgcccggctgcggcagcaactgggcccaggagcccctgaatgaaacagacaccggggacagcgagcccaggatgtgtggcttcctgagcctgcagatcatgggccccctcatcgtgctggtgggcctgtgcttctttgtggtggcccacgtgaagaagaggaacaccctgaatgccggccaggatgccagcgagcgggaggagggccagatccagatcatggagcctgtgcaggtgacagtgggggacagcgtcatcatcttccccccacctcctccaccctacttccctgagagcagcgccagcgctgtggccgagagccctggcaccaacagcctgctgcccaatgaaaatcctccttcctactacagcatcttcaactacggccgcacccccaccagcgagggcgccgccagcgagcgggactgtgagagcatctacaccatcagcggcaccaacagcagcagcgaggccagccacaccccccacctgcccagcgagctgcccccaagatatgaggagaaggaaaatgctgctgccaccttcctgcccctgagcagcgagcccagccccccatag

SEQ ID NO: 39291 - DNA, 732 bp, Artificial Sequence
  Description of Artificial Sequence: Synthetic coding sequence
atggagcagggcagcggccgcctggaggacttccctgtgaatgtgttttctgtgaccccctacacccccagcacagctgacatccaggtgtctgatgatgacaaggccggggccaccctgctcttcagcggcatcttcctgggcctggtgggcatcaccttcaccgtgatgggctggatcaagtaccagggcgtgagccactttgagtggacccagctgctgggccctgtgctgctgtctgtgggcgtgaccttcatcctgattgctgtgtgcaagttcaagatgctgagctgccagctgtgcaaggagagcgaggagcgggtgcctgattctgagcagaccccaggcggccccagctttgtgttcaccggcatcaaccagcccatcaccttccacggggccaccgtggtgcagtacatccccccaccctacggcagccctgagcccatgggcatcaacaccagctacctgcagagcgtggtgagcccctgtggcctcatcaccagcggcggcgctgctgctgccatgagcagccccccccagtactacaccatctacccccaggacaacagcgcctttgtggtggatgagggctgcctgtccttcacagatggcggcaaccaccggcccaacccagatgtggaccagctggaggagacccagctggaggaggaggcctgtgcctgcttcagccccccaccctatgaggagatctacagcctgcccaggtag

SEQ ID NO: 39292 - DNA, 1515 bp, Artificial Sequence
  Description of Artificial Sequence: Synthetic coding sequence
atgagccagcccaggaccccagagcaggccctggacacccctggggactgccccccaggaagaagagatgaagatgctggggagggcatccagtgcagccagaggatgctgtccttcagtgatgccctgctgagcatcatcgccaccgtgatgatcctgcctgtgacccacacagagatcagccctgagcagcagtttgacagatctgtgcagaggctgctggccaccagaattgctgtgtacctgatgaccttcctgattgtgacagtggcctgggccgcccacaccaggctcttccaggtggtgggcaagacagatgacaccctggccctgctgaacctggcctgcatgatgaccatcaccttcctgccctacaccttcagcctgatggtgaccttcccagatgtgcccctgggcatcttcctgttctgtgtgtgtgtgattgccatcggcgtggtgcaggccctgattgtgggctacgccttccacttcccccacctgctgagcccccagatccagaggtctgcccaccgggccctgtaccgccgccacgtgctgggcatcgtgctgcagggccctgccctgtgctttgctgctgccatcttcagcctcttctttgtgcccctgagctacctgctgatggtgaccgtcatcctgctgccctacgtgtccaaggtgacaggctggtgccgggaccggctgctgggccaccgggagcccagcgcccaccctgtggaggtgttctcctttgacctgcacgagcccctgagcaaggagcgggtggaggccttcagtgatggagtgtatgccatcgtggccaccctgctgatcctggacatctgtgaggacaacgtgcctgaccccaaggatgtgaaggagcgcttcagcggcagcctggtggccgccctgagcgccaccggcccccgcttcctggcctacttcggcagctttgccaccgtgggcctgctgtggtttgcccaccacagcctcttcctgcacgtgaggaaggccacccgggccatgggcctgctgaacaccctgagcctggcctttgtgggcggcctgcccctggcctaccagcagaccagcgcctttgcccggcagcccagagatgagctggagcgggtgcgggtgtcctgcaccatcatcttcctggccagcatcttccagctggccatgtggaccacagccctgctgcaccaggccgagaccctgcagcccagcgtgtggtttggaggccgggagcacgtgctgatgtttgccaagctggccctgtacccctgtgccagcctgctggcctttgccagcacctgcctgctgagccgcttctctgtgggcatcttccacctgatgcagattgctgtgccctgtgccttcctgctgctgcggctgctggtgggcctggccctggccaccctgcgggtgctgcggggcctggcccggcctgagcaccccccaccagcccccaccggccaggatgacccccagagccagctgctgcctgccccctgctag

SEQ ID NO: 39293 - DNA, 798 bp, Artificial Sequence
  Description of Artificial Sequence: Synthetic coding sequence
atgaccttcctgattgtgacagtggcctgggccgcccacaccaggctcttccaggtggtgggcaagacagatgacaccctggccctgctgaacctggcctgcatgatgaccatcaccttcctgccctacaccttcagcctgatggtgaccttcccagatgtgcccctgggcatcttcctgttctgtgtgtgtgtgattgccatcggcgtggtgcaggccctgattgtgggctacgccttccacttcccccacctgctgagcccccagatccagaggtctgcccaccgggccctgtaccgccgccacgtgctgggcatcgtgctgcagggccctgccctgtgctttgctgctgccatcttcagcctcttctttgtgcccctgagctacctgctgatggtgaccgtcatcctgctgccctacgtgtccaaggtgacaggctggtgccgggaccggctgctgggccaccgggagcccagcgcccaccctgtggaggtgttctcctttgacctgcacgagcccctgagcaaggagcgggtggaggccttcagtgatggagtgtatgccatcgtggccaccctgctgatcctggacatctgtgccccccacagatttgctgcccccccagcccccttcggctggctgctgctgcccagctctgtgtgcagcagcgctgccagcagcgccagcagctctgtgcgggcccgggtgagcagccagagcagccgcttctggttcctgtggggcttcttcttcttcttcctgcggcagagctgctgcgtggcccaggccggcgtgtag

SEQ ID NO: 39294 - DNA, 405 bp, Artificial Sequence
  Description of Artificial Sequence: Synthetic coding sequence
atgagccagcccaggaccccagagcaggccctggacacccctggggactgccccccaggaagaagagatgaagatgctggggagggcatccagtgcagccagaggatgctgtccttcagtgatgccctgctgagcatcatcgccaccgtgatgatcctgcctgtgacccacacagagatcagccctgagcagcagtttgacagatctgtgcagaggctgctggccaccagaattgctgtgtacctgatgaccttcctgattgtgacagtggcctgggccgcccacaccaggctcttccaggtggtgggcaagacagatgacaccctggccctgctgaacctggcctgcatgatgaccatcaccttcctgccctacaccttcagcctgatggtgaccttcccctag

SEQ ID NO: 39295 - DNA, 1167 bp, Artificial Sequence
  Description of Artificial Sequence: Synthetic coding sequence
atgatgaccatcaccttcctgccctacaccttcagcctgatggtgaccttcccagatgtgcccctgggcatcttcctgttctgtgtgtgtgtgattgccatcggcgtggtgcaggccctgattgtgggctacgccttccacttcccccacctgctgagcccccagatccagaggtctgcccaccgggccctgtaccgccgccacgtgctgggcatcgtgctgcagggccctgccctgtgctttgctgctgccatcttcagcctcttctttgtgcccctgagctacctgctgatggtgaccgtcatcctgctgccctacgtgtccaaggtgacaggctggtgccgggaccggctgctgggccaccgggagcccagcgcccaccctgtggaggtgttctcctttgacctgcacgagcccctgagcaaggagcgggtggaggccttcagtgatggagtgtatgccatcgtggccaccctgctgatcctggacatctgtgaggacaacgtgcctgaccccaaggatgtgaaggagcgcttcagcggcagcctggtggccgccctgagcgccaccggcccccgcttcctggcctacttcggcagctttgccaccgtgggcctgctgtggtttgcccaccacagcctcttcctgcacgtgaggaaggccacccgggccatgggcctgctgaacaccctgagcctggcctttgtgggcggcctgcccctggcctaccagcagaccagcgcctttgcccggcagcccagagatgagctggagcgggtgcgggtgtcctgcaccatcatcttcctggccagcatcttccagctggccatgtggaccacagccctgctgcaccaggccgagaccctgcagcccagcgtgtggtttggaggccgggagcacgtgctgatgtttgccaagctggccctgtacccctgtgccagcctgctggcctttgccagcacctgcctgctgagccgcttctctgtgggcatcttccacctgatgcagattgctgtgccctgtgccttcctgctgctgcggctgctggtgggcctggccctggccaccctgcgggtgctgcggggcctggcccggcctgagcaccccccaccagcccccaccggccaggatgacccccagagccagctgctgcctgccccctgctag

SEQ ID NO: 39296 - DNA, 708 bp, Artificial Sequence
  Description of Artificial Sequence: Synthetic coding sequence
atgggcacagctgacagtgatgagatggcccctgaggccccccagcacacccacattgatgtgcacatccaccaggagagcgccctggccaagctgctgctgacctgctgcagcgccctgcggccccgggccacccaggcccggggcagcagccggctgctggtggcctcctgggtgatgcagatcgtgctgggcatcctgtctgctgtgctgggcggcttcttctacatccgggactacaccctgctggtgaccagcggggccgccatctggacaggagctgtggccgtgctggccggggccgccgccttcatctatgagaagaggggcggcacctactgggccctgctgcggaccctgctgaccctggccgccttcagcacagccatcgccgccctgaagctgtggaatgaagacttccgctatggctacagctactacaacagcgcctgccgcatcagcagcagcagtgactggaacaccccagcccccacccagagccctgaggaggtgcggcggctgcacctgtgcaccagcttcatggacatgctgaaggccctcttccgcaccctgcaggccatgctgctgggcgtgtggatcctgctgctgctggccagcctgacccccctgtggctgtactgctggaggatgttccccaccaagggcaagagggaccagaaggagatgctggaggtgtctggcatctag

SEQ ID NO: 39297 - DNA, 708 bp, Artificial Sequence; identical to SEQ ID NO: 39296
  Description of Artificial Sequence: Synthetic coding sequence

SEQ ID NO: 39298 - DNA, 813 bp, Artificial Sequence
  Description of Artificial Sequence: Synthetic coding sequence
atgacccagaacacagtgattgtgaatggagtggccatggccagccggcccagccagcccacccacgtgaatgtgcacatccaccaggagagcgccctgacccagctgctgaaggccggcggcagcctgaagaagttcctgttccaccctggggacacagtgcccagcacagcccgcatcggctatgagcagctggccctgggcgtgacccagatcctgctgggcgtggtgtcctgtgtgctgggcgtgtgcctgagcctgggcccctggacagtgctgagcgccagcggctgtgccttctgggccggctctgtggtgattgctgctggagctggggccatcgtgcatgagaagcaccctgggaagctggccggctacatcagcagcctgctgaccctggccggctttgccacagccatggctgctgtggtgctgtgtgtgaacagcttcatctggcagacagagcccttcctgtacatcgacacagtgtgtgacagaagtgaccctgtgttccccaccaccggctaccgctggatgaggaggagccaggagaaccagtggcagaaggaggagtgccgggcctacatgcagatgctgaggaagctgttcaccgccatccgggccctcttcctggccgtgtgtgtgctgaaggtgattgtgtccctggtgtccctgggcgtgggcctgaggaacctgtgtggccagagcagccagcccctgaatgaggagggcagcgagaagaggctgctgggggagaacagcgtgccccccagccccagccgggagcagaccagcacagccatcgtgctgtag

SEQ ID NO: 39299 - DNA, 813 bp, Artificial Sequence; identical to SEQ ID NO: 39298
  Description of Artificial Sequence: Synthetic coding sequence

SEQ ID NO: 39300 - DNA, 813 bp, Artificial Sequence; identical to SEQ ID NO: 39298
  Description of Artificial Sequence: Synthetic coding sequence

SEQ ID NO: 39301 - DNA, 813 bp, Artificial Sequence; identical to SEQ ID NO: 39298
  Description of Artificial Sequence: Synthetic coding sequence

SEQ ID NO: 39302 - DNA, 702 bp, Artificial Sequence
  Description of Artificial Sequence: Synthetic coding sequence
atgacccagaacacagtgattgtgaatggagtggccatggccagccggcccagccagcccacccacgtgaatgtgcacatccaccaggagagcgccctgacccagctgctgaaggccggcggcagcctgaagaagttcctgttccaccctggggacacagtgcccagcacagcccgcatcggctatgagcagctggccctgggcgtgattgctgctggggccggggccatcgtgcatgagaagcaccctgggaagctggccggctacatcagcagcctgctgaccctggccggctttgccacagccatggctgctgtggtgctgtgtgtgaacagcttcatctggcagacagagcccttcctgtacatcgacacagtgtgtgacagaagtgaccccgtcttccccaccaccggctaccgctggatgagaagaagccaggagaaccagtggcagaaggaggagtgccgggcctacatgcagatgctgaggaagctgttcaccgccatccgggccctcttcctggccgtgtgtgtgctgaaggtgattgtgtccctggtgtccctgggcgtgggcctgaggaacctgtgtggccagagcagccagcccctgaatgaggagggcagcgagaagaggctgctgggagaaaattctgtgccccccagccccagccgggagcagaccagcacagccatcgtgctgtag

SEQ ID NO: 39303 - DNA, 813 bp, Artificial Sequence; identical to SEQ ID NO: 39298
  Description of Artificial Sequence: Synthetic coding sequence

SEQ ID NO: 39304 - DNA, 813 bp, Artificial Sequence; identical to SEQ ID NO: 39298
  Description of Artificial Sequence: Synthetic coding sequence

SEQ ID NO: 39305 - DNA, 936 bp, Artificial Sequence
  Description of Artificial Sequence: Synthetic coding sequence
atggccggccccctgtggaggacagctgcctttgtgcagaggcacaggacaggcctgctggtgggcagctgtgccggcctgtttggagtgcccatctcctaccacctgttcccagaccctgtggtgcagtggctgtaccagtactggccccagggccagcctgcccccctgcccccccagctgcagagcctcttccaggaggtgctgcaggacatcggcgtgcccagcggccactgctacaagcccttcaccaccttcaccttccagcctgtgtctgctggcttcccccggctgcctgctggagctgtggtgggcatcccagccagcttcctgggggacctggtgatcaacaccaaccaccctgtggtgattcatggccacacagtggactggaggagccctgctggggcccggctgcgggccagcctgaccctgagccgggaggcccagaagtttgccctggcccgggaggtggtgtacctggagagcagcaccacagctgtgcacgccctgctggccccagcctgcctggccggcacctgggccctgggcgtgggcgccaagtacaccctgggcctgcatgctggccccatgaacctgcgggccgccttcagcctggtggccgctgtggccggctttgtggcctatgccttcagccaggacagcctgacccatgctgtggagagctggctggacagaagaacagccagcctgtctgctgcctatgcctgtggcggcgtggagttctatgagaagctgctgagcggcaacctggccctgcggagcctgctgggcaaggatggagagaagctgtacaccccatctggcaacatcgtgcccaggcacctgttccgcatcaagcacctgccctacaccacccggcgggacagcgtgctgcagatgtggaggggcatgctgaaccctggccgctcctag

SEQ ID NO: 39306 - DNA, 936 bp, Artificial Sequence; identical to SEQ ID NO: 39305
  Description of Artificial Sequence: Synthetic coding sequence

SEQ ID NO: 39307 - DNA, 753 bp, Artificial Sequence
  Description of Artificial Sequence: Synthetic coding sequence
atggccggccccctgtggaggacagctgcctttgtgcagaggcacaggacaggcctgctggtgggcagctgtgccggcctgtttggagtgcccatctcctaccacctgttcccagaccctgtggtgcagtggctgtaccagtactggccccagggccagcctgcccccctgcccccccagctgcagagcctcttccaggaggtgctgcaggacatcggcgtgcccagcggccactgctacaagcccttcaccaccttcaccttccagcctgtgtctgctggcttcccccggctgcctgctggagctgtggtgggcatcccagccagcttcctgggggacctggtgatcaacaccaaccaccctgtggtgattcatggccacacagtggactggaggagccctgctggggcccggctgcgggccagcctgaccctgagccgggaggcccagaagtttgccctggcccgggaggtggtgtacctggagagcagcaccacagctgtgcacgccctgctggccccagcctgcctggccggcacctgggccctgggcgtgggcgccaagtacaccctgggcctgcatgctggccccatgaacctgcgggccgccagcctgtctgctgcctatgcctgtggcggcgtggagttctatgagaagctgctgagcggcaacctggccctgcggagcctgctgggcaaggatggagagaagctgcagatgtggaggggcatgctgaaccctggccgctcctag

SEQ ID NO: 39308 - DNA, 936 bp, Artificial Sequence; identical to SEQ ID NO: 39305
  Description of Artificial Sequence: Synthetic coding sequence

SEQ ID NO: 39309 - DNA, 345 bp, Artificial Sequence
  Description of Artificial Sequence: Synthetic coding sequence
atggccggccccctgtggaggacagctgcctttgtgcagaggcacaggacaggcctgctggtgggcagctgtgccggcctgtttggagtgcccatctcctaccacctgttcccagaccctgtggtgcagtggctgtaccagtactggccccagggccagcctgcccccctgcccccccagctgcagagcctcttccaggaggtgctgcaggacatcggcgtgcccagcggccactgctacaagcccttcaccaccttcaccttccagcctgtgtctgctggcttcccccggctgcctgctggagctgtggtgggcatcccagccagcttcctgggggacctgtag

SEQ ID NO: 39310 - DNA, 894 bp, Artificial Sequence
  Description of Artificial Sequence: Synthetic coding sequence
atggagccccgggccctggtgacagccctgagcctgggcctgagcctgtgcagcctgggcctgctggtgacagccatcttcacagaccactggtatgaaacagaccccaggaggcacaaggagagctgtgagaggagccgggccggggctgaccccccagaccagaagaaccggctgatgcccctgagccacctgcccctgcgggacagcccccccctgggccgccgcctgctgcccggcggccctggccgggctgaccctgagagctggaggagcctgctgggcctgggcggcctggatgctgaatgtggccggcccctgtttgccacctacagcggcctgtggaggaagtgctacttcctgggcatcgaccgggacatcgacaccctcatcctgaagggcatcgcccagcgctgcacagccatcaagtaccacttcagccagcccatccggctgaggaacatccccttcaacctgaccaagaccatccagcaggatgagtggcacctgctgcacctgcggcgcatcacagctggcttcctgggcatggctgtggccgtgctgctgtgtggctgcatcgtggccaccgtgtccttcttctgggaggagagcctgacccagcacgtggccggcctgctcttcctgatgacaggcatcttctgcaccatcagcctgtgcacctatgctgccagcatctcctatgacctgaaccggctgcccaagctgatctacagcctgcctgcagatgtggagcacggctacagctggagcatcttctgtgcctggtgcagcctgggcttcatcgtggccgccggcggcctgtgcatcgcctaccccttcatcagcaggaccaagatcgcccagctgaagagcggccgggacagcacagtgtag

SEQ ID NO: 39311 - DNA, 336 bp, Artificial Sequence
  Description of Artificial Sequence: Synthetic coding sequence
atggagccccgggccctggtgacagccctgagcctgggcctgagcctgtgcagcctgggcctgctggtgacagccatcttcacagaccactggtatgaaacagaccccaggaggcacaaggagagctgtgagaggagccgggccggggctgaccccccagaccagaagaaccggctgatgcccctgagccacctgctgggccccctggaggaggtgctgctgcccggccacaggcctggccaccgccacccccaccctgagcgctactgtgccgccatgcacggccaccaggtgcccctcttcagcgcccaccccctggccaagcacagcttctag

SEQ ID NO: 39312 - DNA, 594 bp, Artificial Sequence
  Description of Artificial Sequence: Synthetic coding sequence
atggccctgaacaacttcctgtttgcccagtgtgcctgctacttcctggccttcctgttctcctttgtggtggtggtgcccctgtctgaaaatggacatgacttccggggccgctgcctgctcttcacagagggcatgtggctgagcgccaacctgactgtgcaggagcgggagcgcttcaccgtgcaggagtggggccccccagctgcctgccgcttcagcctgctggccagcctgctgagcctgctgctggccgccgcccacgcctggaggaccctcttcttcctgtgcaagggccacgagggcagcttcttcagcgccttcctgaacctgctggtgtctgcctttgtggtgttcctggtgttcatcgccagcaccatcgtgtctgtgggcttcaccatgtggtgtgacaccatcacagagaagggcaccgtgccccacagctgtgaggagctgcaggacatcgacctggagctgggcgtggacaacagcgccttctatgaccagtttgccatcgcccaggtgggcggcagcggccaggagggccgcctggccatgctgggcggcggccacctgctgctggacatctgctag

SEQ ID NO: 39313 - DNA, 702 bp, Artificial Sequence
  Description of Artificial Sequence: Synthetic coding sequence
atggccctgaacaacttcctgtttgcccagtgtgcctgctacttcctggccttcctgttctcctttgtggtggtggtgcccctgtctgaaaatggacatgacttccggggccgctgcctgctcttcacagagggcatgtggctgagcgccaacctgactgtgcaggagcgggagcgcttcaccgtgcaggagtggggccccccagctgcctgccgcttcagcctgctggccagcctgctgagcctgctgctggccgccgcccacgcctggaggaccctcttcttcctgtgcaagggccacgagggcagcttcttcagcgccttcctgaacctgctggtgtctgcctttgtggtgttcctggtgttcatcgccagcaccatcgtgtctgtgggcttcaccatgtggtgtgacaccatcacagagaagggcaccgtgccccacagctgtgaggagctgcaggacatcgacctggagctgggcgtggacaacagcgccttctatgaccagtttgccatcgcccagtttggcctgtgggcctcctggctggcctggctggccatcaccaccctggccttcctgaaggtgtaccacaactaccggcaggaggacctgctggacagcctcatccacgagaaggagctgctgctggcccggcccagccccaggaccagcttccaggaggagaagtctgctgtgatctag

SEQ ID NO: 39314 - DNA, 660 bp, Artificial Sequence
  Description of Artificial Sequence: Synthetic coding sequence
atggccctgtcctggctgcagagggtggagctggccctgtttgctgctgccttcctgtgtggggctgtggccgccgccgccatgaccaggacccagggcagcttcagcggccgctgccccctgtatggagtggccaccctgaatggcagcagcctggccctgagccggcccagcgcccccagcctgtgctactttgtggccggggccagcggcctgctggccctgtactgcctgctgctgctgctcttctggatctacagcagctgcatcgaggacagccacagaggagccatcggcctgcgcatcgccctggccatcagcgccatcgctgtgttcctggtgctggtgtctgcctgcatcctgcgcttcggcaccaggagcctgtgcaacagcatcatcagcctgaacaccaccatcagctgcagcgaggcccagaagatcccctggaccccacctggaacagccctgcagttctacagcaacctgcacaatgctgagaccagctcctgggtgaacctggtgctgtggtgtgtggtgctggtgctgcaggtggtgcagtggaagtctgaggccaccccctaccggcccctggagcggggggaccctgagtggagcagcgagacagatgccctggtgggcagccggctgagccacagctag

SEQ ID NO: 39315 - DNA, 1554 bp, Artificial Sequence
  Description of Artificial Sequence: Synthetic coding sequence
atgggcctgggccagccccaggcctggctgctgggcctgcccacagctgtggtgtatggcagcctggccctcttcaccaccatcctgcacaacgtgttcctgctgtactacgtggacacctttgtgtctgtgtacaagatcaacaagatggccttctgggtgggggagaccgtcttcctgctgtggaacagcctgaatgaccccctgtttggctggctgagtgaccggcagttcctgagcagccagcccaggtctggagctggcctgagcagcagagctgtggtgctggcccgggtgcaggccctgggctggcacggccccctgctggccctgtccttcctggccttctgggtgccctgggccccagctggcctgcagttcctgctgtgcctgtgcctgtatgatggcttcctgaccctggtggacctgcaccaccacgccctgctggccgacctggccctgagcgcccatgacaggacccacctgaacttctactgcagcctcttctctgctgctggcagcctgtctgtgtttgccagctatgccttctggaacaaggaggacttcagcagcttccgggccttctgtgtgaccctggccgtgagcagcggcctgggcttcctgggcgccacccagctgctgcggcggcgggtggaggccgccaggaaggaccccggctgcagcggcctggtggtggacagcggcctgtgtggggaggagctgctggtgggcagcgaggaggccgacagcatcaccctgggccgctacctgcggcagctggcccggcacaggaacttcctgtggtttgtgtccatggacctggtgcaggtgttccactgccacttcaacagcaacttcttccccctcttcctggagcacctgctgagtgaccacatcagcctgagcacaggcagcatcctgctgggcctgtcctatgtggccccccacctgaacaacctgtacttcctgagcctgtgccgccgctggggcgtgtatgctgtggtgcggggcctcttcctgctgaagctgggcctgagcctgctgatgctgctggccggccctgaccacctgagcctgctgtgcctcttcatcgccagcaacagagtcttcacagagggcacctgcaagctgctgaccctggtggtgacagacctggtggatgaggacctggtgctgaaccacaggaagcaggccgccagcgccctgctgtttggcatggtggccctggtgaccaagccaggccagacctttgcccccctgctgggcacctggctgctgtgcttctacacaggccatgacctcttccagcagagcctcatcacccctgtgggcagcgcccacccctggccagagcccccagccccagccccagcccaggcccccaccctgcggcagggctgcttctacctgctggtgctggtgcccatcacctgtgccctgctgcagctgttcacctggagccagttcaccctgcacggccggcggctgcacatggtgaaggcccagaggcagaacctgagccaggcccagaccctggatgtgaagatggtgtag

SEQ ID NO: 39316 - DNA, 741 bp, Artificial Sequence
  Description of Artificial Sequence: Synthetic coding sequence
atggacctggtgcaggtgttccactgccacttcaacagcaacttcttccccctcttcctggagcacctgctgagtgaccacatcagcctgagcacaggcagcatcctgctgggcctgtcctatgtggccccccacctgaacaacctgtacttcctgagcctgtgccgccgctggggcgtgtatgctgtggtgcggggcctcttcctgctgaagctgggcctgagcctgctgatgctgctggccggccctgaccacctgagcctgctgtgcctcttcatcgccagcaacagagtcttcacagagggcacctgcaagctgctgaccctggtggtgacagacctggtggatgaggacctggtgctgaaccacaggaagcaggccgccagcgccctgctgtttggcatggtggccctggtgaccaagccaggccagacctttgcccccctgctgggcacctggctgctgtgcttctacacaggccatgacctcttccagcagagcctcatcacccctgtgggcagcgcccacccctggccagagcccccagccccagccccagcccaggcccccaccctgcggcagggctgcttctacctgctggtgctggtgcccatcacctgtgccctgctgcagctgttcacctggagccagttcaccctgcatggaagaaggctgcacatggtgaaggcccagaggcagaacctgagccaggcccagaccctggatgtgaagatggtgtag

SEQ ID NO: 39317 - DNA, 741 bp, Artificial Sequence; identical to SEQ ID NO: 39316
  Description of Artificial Sequence: Synthetic coding sequence

SEQ ID NO: 39318 - DNA, 462 bp, Artificial Sequence
  Description of Artificial Sequence: Synthetic coding sequence
atgggcctgggccagccccaggcctggctgctgggcctgcccacagctgtggtgtatggcagcctggccctcttcaccaccatcctgcacaacgtgttcctgctgtactacgtggacacctttgtgtctgtgtacaagatcaacaagatggccttctgggtgggggagaccgtcttcctgctgtggaacagcctgaatgaccccctgtttggctggctgagtgaccggcagttcctgagcagccagccccggctgtgtggggaggagctgctggtgggcagcgaggaggccgacagcatcaccctgggccgctacctgcggcagctggcccggcacaggaacttcctgtggtttgtgtccatggacctggtgcaggtgcagtggctgacccctgtgatcccagccctgagagatgccaaggtggagcggcccctggagcccaggagcagccggctgcagtag

SEQ ID NO: 39319 - DNA, 948 bp, Artificial Sequence
  Description of Artificial Sequence: Synthetic coding sequence
atgggcctgggccagccccaggcctggctgctgggcctgcccacagctgtggtgtatggcagcctggccctcttcaccaccatcctgcacaacgtgttcctgctgtactacgtggacacctttgtgtctgtgtacaagatcaacaagatggccttctgggtgggggagaccgtcttcctgctgtggaacagcctgaatgaccccctgtttggctggctgagtgaccggcagttcctgagcagccagccccggctgtgtggggaggagctgctggtgggcagcgaggaggccgacagcatcaccctgggccgctacctgcggcagctggcccggcacaggaacttcctgtggtttgtgtccatggacctggtgcaggtgttccactgccacttcaacagcaacttcttccccctcttcctggagcacctgctgagtgaccacatcagcctgagcacaggcagcatcctgctgggcctgtcctatgtggccccccacctgaacaacctgtacttcctgagcctgtgccgccgctggggcgtgtatgctgtggtgcggggcctcttcctgctgaagctgggcctgagcctgctgatgctgctggccggccctgaccacctgagcctgctgtgcctcttcatcgccagcaacagagtcttcacagagggcacctgcaagctgctgaccctggtggtgacagacctggtggatgaggacctggtgctgaaccacaggaagcaggccgccagcgccctgctgtttggcatggtggccctggtgaccaagccaggccagacctttgcccccctgctgggcacctggctgctgtgcttctacacaggctgggacctgggctacgccctggcccacagcctgctgaaccaggccggccccaggagcaggatggcccaggaccagccccggggcggcctgcccaccagcaccacctag

SEQ ID NO: 39320 - DNA, 402 bp, Artificial Sequence
  Description of Artificial Sequence: Synthetic coding sequence
atgagaggagagcacaacagcaccagctatgacagcgctgtgatctaccggggcttctgggccgtgctgatgctgctgggcgtggtggccgtggtgattgccagcttcctgatcatctgtgccgccccctttgccagccacttcctgtacaaggccggcggcggcagctacatcgccgccggcatcctcttcagcctggtggtgatgctgtatgtgatctgggtgcaggccgtggccgacatggagagctacagaaacatgaagatgaaggactgcctggacttcacccccagcgtgctgtatggctggagcttcttcctggccccagctggcatcttcttcagcctgctggccggcctgctcttcctggtggtgggctggcacatccagatccaccactag

SEQ ID NO: 39321 - DNA, 690 bp, Artificial Sequence
  Description of Artificial Sequence: Synthetic coding sequence
atgaggctgaacatcgccatcttctttggagccctgtttggagccctgggcgtgctgctcttcctggtggcctttggaagtgactactggctgctggccacagaggtgggccgctgcagcggggagaagaacattgaaaatgtgaccttccaccacgagggcttcttctggcgctgctggttcaacggcatcgtggaggagaatgacagcaacatctggaagttctggtacaccaaccagccccccagcaagaactgcacccacgcctacctgagcccctaccccttcatgagaggagagcacaacagcaccagctatgacagcgctgtgatctaccggggcttctgggccgtgctgatgctgctgggcgtggtggccgtggtgattgccagcttcctgatcatctgtgccgccccctttgccagccacttcctgtacaaggccggcggcggcagctacatcgccgccggcatcctcttcagcctggtggtgatgctgtatgtgatctgggtgcaggccgtggccgacatggagagctacagaaacatgaagatgaaggactgcctggacttcacccccagcgtgctgtatggctggagcttcttcctggccccagctggcatcttcttcagcctgctggccggcctgctcttcctggtggtgggctggcacatccagatccaccactag

SEQ ID NO: 39322 - DNA, 1131 bp, Artificial Sequence
  Description of Artificial Sequence: Synthetic coding sequence
atggcccggggccctggccccctgggccggcccaggccagacacagtggccatgcccaagaggggcaagaggctgaagttccgggcccatgatgcctgcagcggccgggtgacagtggccgactatgccaacagcgaccctgctgtggtgcgcagcggccgggtgaagaaggctgtggccaatgctgtgcagcaggaggtgaagagcctgtgtggcctggaggccagccaggtgcctgctgaggaggccctgtctggagctggggagccctgtgacatcatcgacagcagtgatgagatggatgcccaggaggagagcatccacgagaggacagtgtccaggaagaagaagagcaagaggcacaaggaggagctggatggagctggaggagaggagtaccccatggacatctggctgctgctggccagctacatccggcctgaggacatcgtgaacttcagcctcatctgcaagaatgcctggacagtgacctgcacagctgccttctggacccggctgtacagaagacactacaccctggatgccagcctgcccctgcggctgcggcctgagagcatggagaagctgcgctgcctgcgggcctgcgtcatccgcagcctgtaccacatgtatgagccctttgctgcccgcatcagcaagaacccagccatccctgagagcacccccagcaccctgaagaacagcaagtgcctgctcttctggtgcaggaagatcgtgggcaaccggcaggagcccatgtgggagttcaacttcaagttcaagaagcagagcccccggctgaagagcaagtgcaccggcggcctgcagccccctgtgcagtatgaagatgtgcacaccaacccagaccaggactgctgcctgctgcaggtgaccaccctgaacttcatcttcatccccatcgtgatgggcatgatcttcaccctcttcaccatcaacgtgtccacagacatgaggcaccaccgggtgcggctggtgttccaggacagccctgtgcatggaggcaggaagctgcggtctgagcagggcgtgcaggtgatcctggaccctgtgcacagcgtgcggctgtttgactggtggcacccccagtaccccttcagcctgcgggcctag

SEQ ID NO: 39323 - DNA, 1242 bp, Artificial Sequence
  Description of Artificial Sequence: Synthetic coding sequence
atgagcaatgtgtctggcatcctggagacagctggggtgcccctggtgtctgccaactggccccagcccagccccccacctgctgtgcctgctggcccccagatggaccacatgggcaacagcagccagggcgccccctggctgttcctgaccagcgccctggcccggggcgtgtctggcatctttgtgtggacagccctggtgctgacctgccaccagatctacctgcacctgcggagctacacagtgccccaggagcagcgctacatcatccggctgctgctgattgtgcccatctatgcctttgacagctggctgagcctgctgctgctgggggaccaccagtactacgtgtactttgacagcgtgcgggactgctatgaggccttcgtcatctacagcttcctgagcctgtgcttccagtacctgggcggggagggcgccatcatggccgagatccggggcaagcccatcaagagcagctgcctgtatggcacctgctgcctgcggggcatgacctacagcatcggcttcctgcgcttctgcaagcaggccaccctgcagttctgcctggtgaagcctgtgatggctgtgaccaccatcatcctgcaggccttcggcaagtaccatgatggagacttcaacgtgcgcagcggctacctgtatgtgaccctcatctacaatgcctctgtgtccctggccctgtatgccctcttcctgttctacttcaccacccgggagctgctgcggcccttccagcctgtgctgaagttcctgaccatcaaggctgtgatcttcctgtccttctggcagggcctgctgctggccatcctggagcgctgtggggtcatccctgaggtggagaccagcggcggcaacaagctgggcgccggcaccctggccgccggctaccagaacttcatcatctgtgtggagatgctgtttgcctctgtggccctgcgctatgccttcccctgccaggtgtatgcagagaagaaggagaacagccctgcccccccagcccccatgcagagcatcagcagcggcatccgggagaccgtgagcccccaggacatcgtgcaggatgccatccacaacttctccccagcctaccagcactacacccagcaggccacccatgaggcccccaggcctggcacccaccccagcggcggcagcggcggcagcaggaagagccgcagcctggagaagaggatgctgatccccagcgaggacctgtag

SEQ ID NO: 39324 - DNA, 528 bp, Artificial Sequence
  Description of Artificial Sequence: Synthetic coding sequence
atgagcaatgtgtctggcatcctggagacagctggggtgcccctggtgtctgccaactggccccagcccagccccccacctgctgtgcctgctggcccccagatggaccacatgggcaacagcagccagggcgccccctggctgttcctgaccagcgccctggcccggggcgtgtctggcatctttgtgtggacagccctggtgctgacctgccaccagatctacctgcacctgcggagctacacagtgccccaggagcagcgctacatcatccggctgctgctgattgtgcccatctatgcctttgacagctggctgagcctgctgctgctgggggaccaccagtactacgtgtactttgacagcgtgcgggactgctatgaggccttcgtcatctacagcttcctgagcctgtgcttccagtacctgggcggggagggcgccatcatggccgagatccggggcaagcccatcaagagcagctgcctgtatggcacctgctgcctgcggggcatgacctacagctag

SEQ ID NO: 39325 - DNA, 420 bp, Artificial Sequence
  Description of Artificial Sequence: Synthetic coding sequence
atgagcaatgtgtctggcatcctggagacagctggggtgcccctggtgtctgccaactggccccagcccagccccccacctgctgtgcctgctggcccccagatggaccacatgggcaacagcagccagggcgccccctggctgttcctgaccagcgccctggcccggggcgtgtctggcatctttgtgtggacagccctggtgctgacctgccaccagatctacctgcacctgcggagctacacagtgccccaggagcagcgctacatcatccggctgctgctgattgtgcccatctatgcctttgacagctggctgagcctgctgctgctgggggaccaccagtactacgtgtactttgacagcgtgcgggactgctatgaggccttcgtcatctacagcttcctgagcctgtgctag

SEQ ID NO: 39326 - DNA, 477 bp, Artificial Sequence
  Description of Artificial Sequence: Synthetic coding sequence
atgagcaatgtgtctggcatcctggagacagctggggtgcccctggtgtctgccaactggccccagcccagccccccacctgctgtgcctgctggcccccagatggaccacatgggcaacagcagccagggcgccccctggctgttcctgaccagcgccctggcccggggcgtgtctggcatctttgtgtggacagccctggtgctgacctgccaccagatctacctgcacctgcggagctacacagtgccccaggagcagcgctacatcatccggctgctgctgattgtgcccatctatgcctttgacagctggctgagcctgctgctgctgggggaccaccagtactacgtgtactttgacagcgtgcgggactgctatgaggccttcgtcatctacagcttcctgagcctgtgcttccagtacctgggcggggagggcgccatcatggccgagatccggggcaagcccatctag

SEQ ID NO: 39327 - DNA, 1224 bp, Artificial Sequence
  Description of Artificial Sequence: Synthetic coding sequence
atgacagtgagaggagatgtgctggccccagaccctgccagccccaccacagctgctgccagccccagcgtgtctgtcatccctgagggcagccccacagccatggagcagcccgtcttcctgatgaccacagctgcccaggccatcagcggcttctttgtgtggacagccctgctgatcacctgccaccagatctacatgcacctgcgctgctacagctgccccaatgagcagcgctacatcgtgcgcatcctcttcatcgtgcccatctatgcctttgacagctggctgagcctgctcttcttcaccaatgaccagtactacgtgtactttggaacagtgcgggactgctatgaggccctggtgatctacaacttcctgagcctgtgctatgagtacctgggcggggagagcagcatcatgtctgagatccggggcaagcccatcgagagcagctgcatgtatggcacctgctgcctgtggggcaagacctacagcatcggcttcctgcgcttctgcaagcaggccaccctgcagttctgtgtggtgaagcccctgatggctgtgtccacagtggtgctgcaggccttcggcaagtacagagatggagactttgatgtgaccagcggctacctgtatgtgaccatcatctacaacatctctgtgtccctggccctgtatgccctcttcctgttctactttgccacccgggagctgctgagcccctacagccctgtgctgaagttcttcatggtgaagagcgtcatcttcctgtccttctggcagggcatgctgctggccatcctggagaagtgtggggccatccccaagatccacagcgcccgggtgtctgtgggggagggcaccgtggccgccggctaccaggacttcatcatctgtgtggagatgttctttgctgccctggccctgcggcatgccttcacctacaaggtgtatgctgacaagaggctggatgcccagggccgctgtgcccccatgaagagcatcagcagcagcctgaaggagaccatgaacccccatgacatcgtgcaggatgccatccacaacttctccccagcctaccagcagtacacccagcagagcaccctggagcccggccccacctggaggggcggggcccacggcctgagccgcagccacagcctgagcggggcccgggacaatgagaagaccctgctgctgagcagtgatgatgagttctag

SEQ ID NO: 39328 - DNA, 1224 bp, Artificial Sequence; identical to SEQ ID NO: 39327
  Description of Artificial Sequence: Synthetic coding sequence

SEQ ID NO: 39329 - DNA, 420 bp, Artificial Sequence
  Description of Artificial Sequence: Synthetic coding sequence
atgcacctgcgctgctacagctgccccaatgagcagcgctacatcgtgcgcatcctcttcatcgtgcccatctatgcctttgacagctggctgagcctgctcttcttcaccaatgaccagtactacgtgtactttggaacagtgcgggactgctatgaggccctggtgatctacaacttcctgagcctgtgctatgagtacctgggcggggagagcagcatcatgtctgagatccggggcaagcccatcgagagcagctgcatgtatggcacctgctgcctgtggggcaagacctacagcatcggcttcctgcgcttctgcaagcaggccaccctgcagttctgtgtggtgaagcccctgatggctgtgtccacagtggtgctgcaggccttcggcaagtacagagatggagacttctag

SEQ ID NO: 39330 - DNA, 219 bp, Artificial Sequence
  Description of Artificial Sequence: Synthetic coding sequence
atgacagtgagaggagatgtgctggccccagaccctgccagccccaccacagctgctgccagccccagcgtgtctgtcatccctgagggcagccccacagccatggagcagcccgtcttcctgatgaccacagctgcccaggccatcagcggcttctttgtgtggacagccctgctgatcacctgccaccagccccgggcccggctgggccaggtgtag

SEQ ID NO: 39331 - DNA, 1053 bp, Artificial Sequence
  Description of Artificial Sequence: Synthetic coding sequence
atgaacccccggggcctcttccaggacttcaaccccagcaagttcctgatctacacctgcctgctgctcttctctgtgctgctgcccctgcggctggatggcatcatccagtggagctactgggccgtgtttgcccccatctggctgtggaagctgctggtggtggccggggcctctgtgggcgctggggtgtgggccaggaacccccgctacagaacagaaggagaggcctgtgtggagttcaaggccatgctgattgctgtgggcatccacctgctgctgctgatgtttgaggtgctggtgtgtgacagagtggagcggggcacccacttctggctgctggtgttcatgcccctcttctttgtgtcccctgtgtctgtggccgcctgtgtgtggggcttcagacatgacaggagcctggagctggagatcctgtgcagcgtgaacatcctgcagttcatcttcatcgccctgaagctggaccgcatcatccactggccctggctggtggtgtttgtgcccctgtggatcctgatgtccttcctgtgcctggtggtgctgtactacatcgtgtggagcctgctcttcctgcggagcctggatgtggtggccgagcagaggaggacccacgtgaccatggccatctcctggatcaccatcgtggtgcccctgctgacctttgaggtgctgctggtgcaccggctggatggccacaacaccttctcctatgtgtccatctttgtgcccctgtggctgagcctgctgaccctgatggccaccaccttcagaagaaaaggaggcaaccactggtggtttggcatcagaagagacttctgccagttcctgctggagatcttccccttcctgcgggagtatggcaacatctcctatgacctgcaccacgaggacagtgaagatgctgaggagacctctgtgcctgaggcccccaagatcgcccccatctttgggaagaaggcccgggtggtgatcacccagagccctgggaagtatgtgcccccaccacccaagctgaacatcgacatgccagactag

SEQ ID NO: 39332 - DNA, 642 bp, Artificial Sequence
  Description of Artificial Sequence: Synthetic coding sequence
atggccgccctgctgcgggctgtgcggcgcttccggggcaaggctgtgtgggagcggcccctgcacggcctgtggtgctgcagcggccaggaggaccccaagcgctgggtgggcagcagcagccccatcagcaaggagaagctgcccaatgctgagacagagaagttctggatgttctacagatttgatgccatccgcaccttcggcttcctgagccggctgaagctggcccagacagccctgactgtggtggccctgcccccaggctactacctgtacagccagggcctgctgaccctgaacacagtgtgcctgatgagcggcatcagcggctttgccctgaccatgctgtgctggatgagctacttcctgcggcggctggtgggcatcctgtacctgaatgaaagtggcaccatgctgcgggtggcccacctgaacttctggggctggaggcaggacacctactgccccatggctgatgtgatccccctgacagagaccaaggaccggccccaggagatgtttgtgcgcatccagcgctacagcggcaagcagaccttctacgtgaccctgcgctatggccgcatcctggaccgggagcgcttcacccaggtgtttggagtgcaccagatgctgaagtag

SEQ ID NO: 39333 - DNA, 786 bp, Artificial Sequence
  Description of Artificial Sequence: Synthetic coding sequence
atgaaccctgagtggggccaggcctttgtgcacgtggccgtggccggcggcctgtgtgctgtggccgtgttcaccggcatctttgacagcgtgtctgtgcaggtgggctatgagcactatgcagaggcccctgtggccggcctgcctgccttcctggccatgcccttcaacagcctggtgaacatggcctacaccctgctgggcctgtcctggctgcacagaggaggagccatgggcctgggcccccgctacctgaaggatgtgtttgctgccatggccctgctgtatggccctgtgcagtggctgcggctgtggacccagtggaggagagctgctgtgctggaccagtggctgaccctgcccatctttgcctggcctgtggcctggtgcctgtacctggaccggggctggaggccctggctgttcctgagcctggagtgtgtgtccctggccagctatggcctggccctgctgcacccccagggctttgaggtggccctgggcgcccacgtggtggccgctgtgggccaggccctgcggacccaccgccactacggcagcaccaccagcgccacctacctggccctgggcgtgctgagctgcctgggctttgtggtgctgaagctgtgtgaccaccagctggcccgctggaggctcttccagtgcctgaccggccacttctggagcaaggtgtgtgatgtgctgcagttccactttgccttcctgttcctgacccacttcaacacccacccccgcttccaccccagcggcggcaagaccaggtag

SEQ ID NO: 39334 - DNA, 201 bp, Artificial Sequence
  Description of Artificial Sequence: Synthetic coding sequence
atgaaccctgagtggggccaggcctttgtgcacgtggccgtggccggcggcctgtgtgctgtggccgtgttcaccggcatctttgacagcgtgtctgtgcaggtgggctatgagcactatgcagaggcccctgtggccggcctgcctgccttcctggccatgcccttcaacagcctggtgaacatggcctacaccctgtag

SEQ ID NO: 39335 - DNA, 102 bp, Artificial Sequence
  Description of Artificial Sequence: Synthetic coding sequence
atgaaccctgagtggggccaggcctttgtgcacgtggccgtggccggcggcctgtgtgctgtggccgtgttcaccggcatctttgacagcgtgtctgtgtag

SEQ ID NO: 39336 - DNA, 144 bp, Artificial Sequence
  Description of Artificial Sequence: Synthetic coding sequence
atgaacagcctggagcaggccgaggacctgaaggcctttgaaagaaggctgacagagtacatccactgcctgcagcctgccaccggccgctggaggtctgtgctgctgcacatcatcatggagagccccatcttccaccactag

SEQ ID NO: 39337 - DNA, 378 bp, Artificial Sequence
  Description of Artificial Sequence: Synthetic coding sequence
atgaacagcctggagcaggccgaggacctgaaggcctttgaaagaaggctgacagagtacatccactgcctgcagcctgccaccggccgctggaggatgctgctgattgtggtgtctgtgtgcacagccaccggggcctggaactggctgattgatcctgagacccagaaggtgtccttcttcaccagcctgtggaaccaccccttcttcaccatcagctgcatcaccctcatcggcctcttctttgctggcatccacaagagggtggtggcccccagcatcatcgccgcccgctgcaggacagtgctggccgagtacaacatgagctgtgatgacaccgggaagctgatcctgaagccccggccccacgtgcagtag

SEQ ID NO: 39338 - DNA, 429 bp, Artificial Sequence
  Description of Artificial Sequence: Synthetic coding sequence
atgaacagcctggagcaggccgaggccccccgggtggtgtccctcatcccagctgtggtgtctggcaactgccaggacctgaaggcctttgagcggcggctgacagagtacatccactgcctgcagcctgccaccggccgctggaggatgctgctgattgtggtgtctgtgtgcacagccactggagcctggaactggctgattgatcctgagacccagaaggtgtccttcttcaccagcctgtggaaccaccccttcttcaccatcagctgcatcaccctgattggcctcttctttgctggcatccacaagagggtggtggcccccagcatcatcgccgcccgctgcaggacagtgctggccgagtacaacatgagctgtgatgacaccgggaagctgatcctgaagccccggccccacgtgcagtag

SEQ ID NO: 39339 - DNA, 804 bp, Artificial Sequence
  Description of Artificial Sequence: Synthetic coding sequence
atggccggggctgagaactggccaggccagcagctggagctggatgaagatgaggccagctgctgccgctggggcgcccagcacgccggggcccgggagctggccgccctgtacagccctgggaagaggctgcaggagtggtgcagcgtcatcctgtgcttcagcctgattgcccacaacctggtgcacctgctgctgctggcccgctgggaggacacccccctggtgatcctgggcgtggtggccggggccctgattgctgacttcctgagcggcctggtgcactggggcgctgacacctggggctctgtggagctgcccatcgccttcatccggcccttccgggagcaccacatcgaccccacagccatcaccaggcatgacttcatcgagaccaatggagacaactgcctggtgaccctgctgcccctgctgaacatggcctacaagttccgcacccacagccctgaggccctggagcagctgtacccctgggagtgctttgtgttctgcctgatcatcttcggcaccttcaccaaccagatccacaagtggagccacacctacttcggcctgccccgctgggtgaccctgctgcaggactggcacgtgatcctgcccaggaagcaccaccgcatccaccacgtgagcccccatgagacctacttctgcatcaccaccggctggctgaactaccccctggagaagattggcttctggaggcggctggaggacctgatccagggcctgactggagagaagcccagggcagatgacatgaagtgggcccagaagatcaagtag

SEQ ID NO: 39340 - DNA, 813 bp, Artificial Sequence
  Description of Artificial Sequence: Synthetic coding sequence
atggccggggctgagaactggccaggccagcagctggagctggatgaagatgaggccagctgctgccgctggggcgcccagcacgccggggcccgggagctggccgccctgtacagccctgggaagaggctgcaggagtggtgcagcgtcatcctgtgcttcagcctgattgcccacaacctggtgcacctgctgctgctggcccgctgggaggacacccccctggtgatcctgggcgtggtggccggggccctgattgctgacttcctgagcggcctggtgcactggggcgctgacacctggggctctgtggagctgcccatcgtgggcaaggccttcatccggcccttccgggagcaccacatcgaccccacagccatcaccaggcatgacttcatcgagaccaacggggacaactgcctggtgaccctgctgcccctgctgaacatggcctacaagttccgcacccacagccctgaggccctggagcagctgtacccctgggagtgctttgtgttctgcctgatcatcttcggcaccttcaccaaccagatccacaagtggagccacacctacttcggcctgccccgctgggtgaccctgctgcaggactggcacgtgatcctgcccaggaagcaccaccgcatccaccacgtgagcccccatgagacctacttctgcatcaccaccggctggctgaactaccccctggagaagattggcttctggaggcggctggaggacctgatccagggcctgaccggggagaagcccagggcagatgacatgaagtgggcccagaagatcaagtag

SEQ ID NO: 39341 - DNA, 588 bp, Artificial Sequence
  Description of Artificial Sequence: Synthetic coding sequence
atgaatgaaagagccatcgccggggccctgattgctgacttcctgagcggcctggtgcactggggcgctgacacctggggctctgtggagctgcccatcgtgggcaaggccttcatccggcccttccgggagcaccacatcgaccccacagccatcaccaggcatgacttcatcgagaccaatggagacaactgcctggtgaccctgctgcccctgctgaacatggcctacaagttccgcacccacagccctgaggccctggagcagctgtacccctgggagtgctttgtgttctgcctgatcatcttcggcaccttcaccaaccagatccacaagtggagccacacctacttcggcctgccccgctgggtgaccctgctgcaggactggcacgtgatcctgcccaggaagcaccaccgcatccaccacgtgagcccccatgagacctacttctgcatcaccaccggctggctgaactaccccctggagaagattggcttctggaggcggctggaggacctgatccagggcctgactggagagaagcccagggcagatgacatgaagtgggcccagaagatcaagtag

SEQ ID NO: 39342 - DNA, 1113 bp, Artificial Sequence
  Description of Artificial Sequence: Synthetic coding sequence
atggccggggctgagaactggccaggccagcagctggagctggatgaagatgaggccagctgctgccgctggggcgcccagcacgccggggcccgggagctggccgccctgtacagccctgggaagaggctgcaggagtggtgcagcgtcatcctgtgcttcagcctgattgcccacaacctggtgcacctgctgctgctggcccgctgggaggacacccccctggtgatcctgggcgtggtggccggggccctgattgctgacttcctgagcggcctggtgcactggggcgctgacacctggggctctgtggagctgcccatcgtgggcaaggccttcatccggcccttccgggagcaccacatcgaccccacagccatcaccaggcatgacttcatcgagaccaacggggacaactgcctggtgaccctgctgcccctgctgaacatggcctacaagttccgcacccacagccctgaggccctggagcagctgtacccctgggagtgctttgtgttctgcctgatcatcttcggcaccttcaccaaccagatccacaagtggagccacacctacttcggcctgccccgctgggtgaccctgctgcaggactggcacgtgatcctgcccaggaagcaccaccgcatccaccacgtgagcccccatgagacctacttctgcatcaccaccggggtgaaggtgcccaggaacttccggctgctggaggagctggaggagggccagaagggcgtgggagatggcaccgtgtcctggggcctggaggatgatgaggacatgaccctgacccgctggacaggcatgatcatcggcccccccaggaccatctatgagaaccgcatctacagcctgaagattgaatgtggccccaagtacccagaggcccccccatttgtgcgctttgtgaccaagatcaacatgaatggagtgaacagcagcaatggagtggtggacccccgggccatctctgtgctggccaagtggcagaacagctacagcatcaaggtggtgctgcaggagctgcggcggctgatgatgagcaaagaaaacatgaagctgccccagcccccagagggccagtgctacagcaactag

SEQ ID NO: 39343 - DNA, 1011 bp, Artificial Sequence
  Description of Artificial Sequence: Synthetic coding sequence
atgacagacctgaatgacaacatctgcaagcgctacatcaagatgatcaccaacatcgtcatcctgagcctcatcatctgcatcagcctggccttctggatcatctccatgacagccagcacctactacggcaacctgcggcccatcagcccctggcgctggctgttctctgtggtggtgcctgtgctgattgtgtccaatggcctgaagaagaagagcctggaccacagcggggccctgggcggcctggtggtgggcttcatcctgaccatcgccaacttctccttcttcaccagcctgctgatgttcttcctgagcagcagcaagctgaccaagtggaagggggaggtgaagaagaggctggacagcgagtacaaggagggcggccagaggaactgggtgcaggtgttctgcaatggagctgtgcccacagagctggccctgctgtacatgattgaaaatggacctggagagatccctgtggacttcagcaagcagtacagcgcctcctggatgtgcctgagcctgctggccgccctggcctgcagcgctggggacacctgggccagcgaggtgggccctgtgctgagcaagagcagccccaggctcatcaccacctgggagaaggtgcctgtgggcaccaatggaggagtgacagtggtgggcctggtgagcagcctgctgggcggcacctttgtgggcatcgcctacttcctgacccagctgatctttgtgaatgacctggacatcagcgccccccagtggcccatcatcgccttcggcggcctggccggcctgctgggcagcatcgtggacagctacctgggcgccaccatgcagtacacaggcctggatgagagcacaggcatggtggtgaacagccccaccaacaaggcccggcacatcgccggcaagcccatcctggacaacaatgctgtgaacctcttcagctctgtgctgattgccctgctgctgcccacagctgcctggggcttctggccccggggctag

SEQ ID NO: 39344 - DNA, 1011 bp, Artificial Sequence; identical to SEQ ID NO: 39343
  Description of Artificial Sequence: Synthetic coding sequence

SEQ ID NO: 39345 - DNA, 897 bp, Artificial Sequence
  Description of Artificial Sequence: Synthetic coding sequence
atgacagacctgaatgacaacatctgcaagcgctacatcaagatgatcaccaacatcgtcatcctgagcctcatcatctgcatcagcctggccttctggatcatctccatgacagccagcacctactacggcaacctgcggcccatcagcccctggcgctggctgttctctgtggtggtgcctgtgctgattgtgtccaatggcctgaagaagaagagcctggaccacagcggggccctgggcggcctggtggtgggcttcatcctgaccatcgccaacttctccttcttcaccagcctgctgatgttcttcctgagcagcagcaagctgaccaagtggaagggggaggtgaagaagaggctggacagcgagtacaaggagggcggccagaggaactgggtgcaggtgttctgcaatggagctgtgcccacagagctggccctgctgtacatgattgaaaatggacctggagagatccctgtggacttcagcaagcagtacagcgcctcctggatgtgcctgagcctgctggccgccctggcctgcagcgctggggacacctgggccagcgaggtgggccctgtgctgagcaagagcagccccaggctcatcaccacctgggagaaggtgcctgtgggcaccaatggaggagtgacagtggtgggcctggtgagcagcctgctgggcggcacctttgtgggcatcgcctacttcctgacccagctgatctttgtgaatgacctggacatcagcgccccccagtggcccatcatcgccttcggcggcctggccggcctgctgggcagcatcgtggacagctacctgggcgccaccatgcagtacaccgggaagaacatccccagcttcctgcagctgattggcatgctgaagaagtag

SEQ ID NO: 39346 - DNA, 513 bp, Artificial Sequence
  Description of Artificial Sequence: Synthetic coding sequence
atgacagacctgaatgacaacatctgcaagcgctacatcaagatgatcaccaacatcgtcatcctgagcctcatcatctgcatcagcctggccttctggatcatctccatgacagccagcacctactacggcaacctgcggcccatcagcccctggcgctggctgttctctgtggtggtgcctgtgctgattgtgtccaatggcctgaagaagaagagcctggaccacagcggggccctgggcggcctggtggtgggcttcatcctgaccatcgccaacttctccttcttcaccagcctgctgatgttcttcctgagcagcagcaagctgaccaagtggaagggggaggtgaagaagaggctggacagcgagtacaaggagggcggccagaggaactgggtgcaggtgttctgcaatggagctgtgcccacagagctggccctgctgtacatgattgaaaatggacctggagagatccctgtggacttcagcaagcagtacagcgccagctag

SEQ ID NO: 39347 - DNA, 459 bp, Artificial Sequence
  Description of Artificial Sequence: Synthetic coding sequence
tgagacacctgggccagcgaggtgggccctgtgctgagcaagagcagccccaggctcatcaccacctgggagaaggtgcctgtgggcaccaatggaggagtgacagtggtgggcctggtgagcagcctgctgggcggcacctttgtgggcatcgcctacttcctgacccagctgatctttgtgaatgacctggacatcagcgccccccagtggcccatcatcgccttcggcggcctggccggcctgctgggcagcatcgtggacagctacctgggcgccaccatgcagtacacaggcctggatgagagcacaggcatggtggtgaacagccccaccaacaaggcccggcacatcgccggcaagcccatcctggacaacaatgctgtgaacctcttcagctctgtgctgattgccctgctgctgcccacagctgcctggggcttctggccccggggctag

SEQ ID NO: 39348 - DNA, 534 bp, Artificial Sequence
  Description of Artificial Sequence: Synthetic coding sequence
atgctgggctgcggcatcccagccctgggcctgctgctgctgctgcagggcagcgcagatggaaatggcatccagggcttcttctacccctggagctgtgagggggacatctgggaccgggagagctgtggcggccaggccgccatcgacagccccaacctgtgcctgcggctgcgctgctgctacagaaatggagtgtgctaccaccagaggccagatgaaaatgtgcggaggaagcacatgtgggccctggtgtggacctgcagcggcctgctgctgctgagctgcagcatctgcctcttctggtgggccaagagaagagatgtgctgcacatgcctggcttcctggccggcccctgtgacatgagcaagtctgtgtccctgctgagcaagcaccggggcaccaagaagacccccagcactggatctgtgcctgtggccctgagcaaggagagcagagatgtggagggcggcacagaaggagagggcacagaggagggggaggagacagaaggagaggaggaggaggactag

SEQ ID NO: 39349 - DNA, 816 bp, Artificial Sequence
  Description of Artificial Sequence: Synthetic coding sequence
atggctgctgggggccgcatggaggatggcagcctggacatcacccagagcattgaagatgaccccctgctggatgcccagctgctgccccaccacagcctgcaggcccacttccggccccgcttccaccccctgcccaccgtcatcatcgtgaacctgctgtggttcatccacctggtgtttgtggtgctggccttcctgactggagtgctgtgcagctaccccaaccccaatgaagataaatgtcctggcaactacaccaaccccctgaaggtgcagaccgtcatcatcctgggcaaggtgatcctgtggatcctgcacctgctgctggagtgctacatccagtaccaccacagcaagatccggaacagaggctacaacctgatctaccgcagcaccaggcacctgaagaggctggccctgatgatccagagcagcggcaacacagtgctgctgctgatcctgtgcatgcagcacagcttccctgagcccggccgcctgtacctggacctgatcctggccatcctggccctggagctgatctgcagcctcatctgcctgctgatctacacagtgaagatccgccgcttcaacaaggccaagccagagccagacatcctggaggaggagaagatctatgcctaccccagcaacatcaccagcgagaccggcttccgcaccatcagcagcctggaggagatcgtggagaagcagggcgacaccatcgagtacctgaagaggcacaatgccctgctgagcaagaggctgctggccctgaccagcagtgacctgggctgccagcccagcaggacatag

SEQ ID NO: 39350 - DNA, 804 bp, Artificial Sequence
  Description of Artificial Sequence: Synthetic coding sequence
atgaacaaggccaccggcagcctggacatcacccagagcattgaagatgaccccctgctggatgcccagctgctgccccaccacagcctgcaggcccacttccggccccgcttccaccccctgcccaccgtcatcatcgtgaacctgctgtggttcatccacctggtgtttgtggtgctggccttcctgactggagtgctgtgcagctaccccaaccccaatgaagataaatgtcctggcaactacaccaaccccctgaaggtgcagaccgtcatcatcctgggcaaggtgatcctgtggatcctgcacctgctgctggagtgctacatccagtaccaccacagcaagatccggaacagaggctacaacctgatctaccgcagcaccaggcacctgaagaggctggccctgatgatccagagcagcggcaacacagtgctgctgctgatcctgtgcatgcagcacagcttccctgagcccggccgcctgtacctggacctgatcctggccatcctggccctggagctgatctgcagcctcatctgcctgctgatctacacagtgaagatccgccgcttcaacaaggccaagccagagccagacatcctggaggaggagaagatctatgcctaccccagcaacatcaccagcgagaccggcttccgcaccatcagcagcctggaggagatcgtggagaagcagggcgacaccatcgagtacctgaagaggcacaatgccctgctgagcaagaggctgctggccctgaccagcagtgacctgggctgccagcccagcaggacatag

SEQ ID NO: 39351 - DNA, 1335 bp, Artificial Sequence
  Description of Artificial Sequence: Synthetic coding sequence
atggccggcggcatgaaggtggccgtgtccccagctgtgggccctggcccctggggcagcggcgtgggcggcggcggcaccgtgcggctgctgctgatcctgagcggctgcctggtgtatggaacagctgagacagatgtgaatgtggtgatgctgcaggagagccaggtgtgtgagaagagggccagccagcagttctgctacaccaacgtgctgatccccaagtggcatgacatctggacccgcatccagatccgggtgaacagcagccggctggtgcgggtgacccaggtggagaatgaggagaagctgaaggagctggagcagttcagcatctggaacttcttcagcagcttcctgaaggagaagctgaatgacacctacgtgaatgtgggcctgtacagcaccaagacctgcctgaaggtggagatcatcgagaaggacaccaagtacagcgtcatcgtcatcagaagatttgaccccaagctgttcctggtgttcctgctgggcctgatgctgttcttctgtggggacctgctgagccgcagccagatcttctactacagcacaggcatgacagtgggcatcgtggccagcctgctgatcatcatcttcatcctgagcaagttcatgcccaagaagagccccatctacgtgatcctggtgggcggctggagcttcagcctgtacctgatccagctggtgttcaagaacctgcaggagatctggcgctgctactggcagtacctgctgtcctatgtgctgactgtgggcttcatgagctttgctgtgtgctacaagtatggccccctggagaatgaaagaagcatcaacctgctgacctggaccctgcagctgatgggcctgtgcttcatgtacagcggcatccagatcccccacatcgccctggccatcatcatcatcgccctgtgcaccaagaacctggagcaccccatccagtggctgtacatcacctgcaggaaggtgtgcaagggagctgagaagcctgtgcccccccggctgctgacagaggaggagtaccgcatccagggcgaggtggagaccaggaaggccctggaggagctgcgggagttctgcaacagcccagactgcagcgcctggaagacagtgagccgcatccagagccccaagagatttgctgactttgtggagggcagcagccacctgaccccaaatgaggtgtctgtgcatgagcaggagtatggcctgggcagcatcatcgcccaggatgagatctatgaggaggccagcagcgaggaggaggacagctacagccgctgcccagccatcacccagaacaacttcctgacctag

SEQ ID NO: 39352 - DNA, 1116 bp, Artificial Sequence
  Description of Artificial Sequence: Synthetic coding sequence
atggccggcggcatgaaggtggccgtgtccccagctgtgggccctggcccctggggcagcggcgtgggcggcggcggcaccgtgcggctgctgctgatcctgagcggctgcctggtgtatggaacagctgagacagatgtgaatgtggtgatgctgcaggagagccaggtgtgtgagaagagggccagccagcagttctgctacaccaacgtgctgatccccaagtggcatgacatctggacccgcatccagatccgggtgaacagcagccggctggtgcgggtgacccaggtggagaatgaggagaagctgaaggagctggagcagagccagatcttctactacagcacaggcatgacagtgggcatcgtggccagcctgctgatcatcatcttcatcctgagcaagttcatgcccaagaagagccccatctacgtgatcctggtgggcggctggagcttcagcctgtacctgatccagctggtgttcaagaacctgcaggagatctggcgctgctactggcagtacctgctgtcctatgtgctgactgtgggcttcatgagctttgctgtgtgctacaagtatggccccctggagaatgaaagaagcatcaacctgctgacctggaccctgcagctgatgggcctgtgcttcatgtacagcggcatccagatcccccacatcgccctggccatcatcatcatcgccctgtgcaccaagaacctggagcaccccatccagtggctgtacatcacctgcaggaaggtgtgcaagggagctgagaagcctgtgcccccccggctgctgacagaggaggagtaccgcatccagggcgaggtggagaccaggaaggccctggaggagctgcgggagttctgcaacagcccagactgcagcgcctggaagacagtgagccgcatccagagccccaagagatttgctgactttgtggagggcagcagccacctgaccccaaatgaggtgtctgtgcatgagcaggagtatggcctgggcagcatcatcgcccaggatgagatctatgaggaggccagcagcgaggaggaggacagctacagccgctgcccagccatcacccagaacaacttcctgacctag

SEQ ID NO: 39353 - DNA, 519 bp, Artificial Sequence
  Description of Artificial Sequence: Synthetic coding sequence
atgtgcaccagcggccagatcatcggcagcctgctggtgctgtctgtgctggagatcggcctgggcgtgtcctctgtggccgtgggcgctgtgtccttcagcctggccctgcgggagcacaagccccagctgggggacagcagccccttcctgctgtgtggcatctgtggcatcctgtgtgccaagaagaagagcggcctggtgatgatcctcttcagcgcctgctgcatctgtggcctgattggaggcatcctgaacttccagttcctgcgggctgtgaccaagaagaccagcagcctgtaccccctgcacctggcctccatgagcctggcctgcattggaattggaggctgcaccctgagctcctggctgacctgccgcctggccagctatgagcagaggaggatgttcagcgagcgggagcacagcctgcaccacagccatgagatggccgagaaggagatcacagacaacatgagcaatggaggcccccagctgatcttcaacggccgggtgtag

SEQ ID NO: 39354 - DNA, 270 bp, Artificial Sequence
  Description of Artificial Sequence: Synthetic coding sequence
atgatcctcttcagcgcctgctgcatctgtggcctgattggaggcatcctgaacttccagttcctgcgggctgtgaccaagaagaccagcagcctgtaccccctgcacctggcctccatgagcctggcctgcattggaattggaggctgcaccctgagctcctggctgacctgccgcctggccagctatgagcagaggaggatgttcagcgagcgggagcacagcctgcaccacagccatgagatggccgagaagattgagggctactag

SEQ ID NO: 39355 - DNA, 1083 bp, Artificial Sequence
  Description of Artificial Sequence: Synthetic coding sequence
atgcctggcaccgtggccaccctgcgcttccagctgctgcccccagagccagatgatgccttctggggcgccccctgtgagcagcccctggagcggcgctaccaggccctgcctgccctggtgtgcatcatgtgctgcctgtttggagtggtgtactgcttcttcggctaccgctgcttcaaggctgtgctcttcctgaccggcctgctgtttggatctgtggtgatcttcctgctgtgctaccgggagcgggtgctggagacccagctgtctgctggggccagcgctggcatcgccctgggcatcggcctgctgtgtggcctggtggccatgctggtgcgctctgtgggcctcttcctggtgggcctgctgctgggcctgctgctggccgccgccgccctgctgggcagcgccccctactaccagcccggctctgtgtggggccccctgggcctgctgctgggcggcggcctgctgtgtgccctgctgaccctgcgctggccccggcccctgaccaccctggccacagctgtgactggagctgccctgattgccacagctgctgactactttgctgagctgctgctgctgggccgctacgtggtggagcggctgcgggccgcccctgtgccccccctgtgctggaggtcctgggccctgctggccctgtggcccctgctgagcctgatgggcgtgctggtgcagtggagggtgacagctgagggggacagccacacagaggtggtgatcagccggcagaggagaagagtgcagctgatgaggatccggcagcaggaggacaggaaggagaagaggaggaagaagaggcctccccgggcccccctgcggggcccccgggccccacccaggcctggccccccagaccctgcctacagaagaagacctgtgcccatcaagcgcttcaatggagatgtgctgagccccagctacatccagagcttccgggaccggcagacaggcagcagcctgagcagcttcatggccagccccacagatgctgactatgaatatggcagccggggccccctgacagcctgcagcggcccccctgtgcgggtgtag

SEQ ID NO: 39356 - DNA, 1083 bp, Artificial Sequence; identical to SEQ ID NO: 39355
  Description of Artificial Sequence: Synthetic coding sequence

SEQ ID NO: 39357 - DNA, 684 bp, Artificial Sequence
  Description of Artificial Sequence: Synthetic coding sequence
atgcctggcaccgtggccaccctgcgcttccagctgctgcccccagagccagatgatgccttctggggcgccccctgtgagcagcccctggagcggcgctaccaggccctgcctgccctggtgtgcatcatgtgctgcctgtttggagtggtgtactgcttcttcggctaccgctgcttcaaggctgtgctcttcctgaccggcctgctgtttggatctgtggtgatcttcctgctgtgctaccgggagcgggtgctggagacccagctgtctgctggggccagcgctggcatcgccctgggcatcggcctgctgtgtggcctggtggccatgctggtgcgctctgtgggcctcttcctggtgggcctgctgctgggcctgctgctggccgccgccgccctgctgggcagcgccccctactaccagcccggctctgtgtggggccccctgggcctgctgctgggcggcggcctgctgtgtgccctgctgaccctgcgctggccccggcccctgaccaccctggccacagctgtgactggagctgccctgattgccacagctgctgactactttgctgagctgctgctgctgggccgctacgtggtggagcggctgcgggccgcccctgtgccccccctgtgctggaggtcctgggccctgctggccctgtggcccctgctgtag

SEQ ID NO: 39358 - DNA, 627 bp, Artificial Sequence
  Description of Artificial Sequence: Synthetic coding sequence
atggccagcagcctgctggccggggagcggctggtgcgggccctgggccctggaggagagctggagcctgagcggctgcccaggaagctgcgggcagagctggaggccgccctgggcaagaagcacaagggcggggacagcagcagcggcccccagaggctggtgtccttccgcctcatccgggacctgcaccagcacctgcgggagcgggacagcaagctgtacctgcacgagctgctggagggcagcgagatctacctgcctgaggtggtgaagcccccaagaaatcctgagctggtggcccggctggagaagatcaagatccagctggccaatgaggagtacaagaggatcaccagaaatgtgacctgccaggacaccaggcatggaggcaccctgagtgacctgggcaagcaggtgcgcagcctgaaggccctggtgatcaccatcttcaacttcatcgtgacagtggtggccgcctttgtgtgcacctacctgggcagccagtacatcttcacagagatggccagccgggtgctggccgccctgattgtggcctctgtggtgggcctggccgagctgtatgtgatggtgcgggccatggagggggagctgggggagctgtag

SEQ ID NO: 39359 - DNA, 900 bp, Artificial Sequence
  Description of Artificial Sequence: Synthetic coding sequence
atggccagcagcctgctggccggggagcggctggtgcgggccctgggccctggaggagagctggagcctgagcggctgcccaggaagctgcgggcagagctggaggccgccctgggcaagaagcacaagggcggggacagcagcagcggcccccagaggctggtgtccttccgcctcatccgggacctgcaccagcacctgcgggagcgggacagcaagctgtacctgcacgagctgctggagggcagcgagatctacctgcctgaggtggtgaagcccccaagaaatcctgagctggtggcccggctggagaagatcaagatccagctggccaatgaggagtacaagaggatcaccagaaatgtgacctgccaggacaccaggcatggaggcaccctgagtgacctgggcaagcaggtgcgcagcctgaaggccctggtgatcaccatcttcaacttcatcgtgacagtggtggccgcctttgtgtgcacctacctgggcagccagtacatcttcacagagatggccagccggcccaggggggcccactgggccggccgggaccctgagcctggagagggcaccaggacccggcgggccggggctgagtgggtgcgccacctgggcgcccacgtgcaggcctttggaggagacatgcctgaggccggcggcggccggcggcccggccgcggggctgtgctggtgcccccccacggccccagggctgctgcccccctgcgggccggggccggccagctgcgggccgcccggggccctggaggagctgccacccacggccgggaggcccggagccgggtggccctgcctgcccggctgctgcagggcggccgggccgcctttgctgcccggctgcccaggagcagtggagtgggggactag

SEQ ID NO: 39360 - DNA, 1476 bp, Artificial Sequence
  Description of Artificial Sequence: Synthetic coding sequence
atgattgccaccggcggcgtcatcaccggcctggccgccctgaagaggcaggacagcgcccggagccagcagcacgtgaacctgagccccagccctgccacccaggagaagaagcccatcagaagaagacccagggcagatgtggtggtggtgcggggcaagatccggctgtacagccccagcggcttcttcctgatcctgggcgtgctgatcagcatcatcggcatcgccatggctgtgctgggctactggccccagaaggagcacttcattgatgctgagaccaccctgagcaccaatgagacccaggtgatcagaaatgaaggaggagtggtggtgcgcttctttgagcagcacctgcacagcgacaagatgaagatgctgggccccttcaccatgggcatcggcatcttcatcttcatctgtgccaatgccatcctgcatgaaaatagagacaaggagaccaagatcatccacatgagggacatctacagcaccgtcatcgacatccacaccctgcgcatcaaggagcagaggcagatgaatggcatgtacacaggcctgatgggagaaacagaggtgaagcagaatggcagcagctgtgccagccggctggccgccaacaccatcgccagcttcagcggcttccgcagcagcttcaggatggacagctctgtggaggaggatgagctgatgctgaatgaaggcaagagcagcggccacctgatgccacccctgctgagtgacagctctgtgtctgtgtttggcctgtaccccccacccagcaagaccacagatgacaagaccagcggcagcaagaagtgtgagaccaagagcatcgtgagcagcagcatcagcgccttcaccctgcctgtgatcaagctgaacaactgtgtgattgatgagcccagcattgacaacatcacagaagatgctgacaacctgaagagccgcagcaggaacctgtccatggacagcctggtggtgcccctgcccaacaccagcgagagcttccagcctgtgtccacagtgctgcccaggaacaacagcattggagagagcctgagcagccagtacaagagctccatggccctgggccctggagctggccagctgctgagccctggagctgcccggcggcagtttggcagcaacaccagcctgcacctgctgagcagccacagcaagagcctggacctggaccggggccccagcaccctgactgtgcaggccgagcagaggaagcaccccagctggccccggctggacaggaacaacagcaagggctacatgaagctggagaacaaggaggaccccatggaccggctgctggtgccccaggtggccatcaagaaggacttcaccaacaaggagaagctgctgatgatcagccgcagccacaacaacctgagctttgaacatgatgagttcctgagcaacaacctgaagaggggcaccagcgagacccgcttctag

SEQ ID NO: 39361 - DNA, 1476 bp, Artificial Sequence; identical to SEQ ID NO: 39360
  Description of Artificial Sequence: Synthetic coding sequence

SEQ ID NO: 39362 - DNA, 1476 bp, Artificial Sequence; identical to SEQ ID NO: 39360
  Description of Artificial Sequence: Synthetic coding sequence

SEQ ID NO: 39363 - DNA, 924 bp, Artificial Sequence
  Description of Artificial Sequence: Synthetic coding sequence
atgacagctggcagccctgaggagtgtggggaggtgagaagaagccctgagggccgggtgtcccggctgggccgccgcctgggcagaagaagaagacccaggagccccccagagcccctgcgggtgcgggcccggctgcggctgcggagccccagcggggcctttgctgccctgggcgccctggtggtgctggtgggcatgggcattgctgtggccggctactggccccacagagctggggcccctggcagccgggccgccaatgccagcagcccccagatgtctgagctgcggcgggagggccggggcggcggccgggcccacggcccccatgagcggctgcggctgctgggccctgtgatcatgggcgtgggcctgtttgtgttcatctgtgccaacaccctgctgtatgagaacagagacctggagacccggcggctgcggcagggcgtgctgcgggcccaggccctgcggcccccagatggccctggctgggactgtgccctgctgcccagccctggccccaggagccccagggctgtgggctgtgccgagcctgagatctgggaccccagcccccggcggggcaccagccctgtgcccagcgtgcgcagcctgcggtctgagcccgccaacccccggctgggcctgcctgccctgctgaacagctaccccctgaagggccctggcctgcccccaccctggggccccaggacccagacaggccacgtgatcatcaccgtgcagcccagcggcagctgcatcgagcacagcaagagcctggacctgggcctgggggagctgctgctgggcgccccagctgcccgggactgtgcccaccgctcctggccccggctggaccggctgagcctgggcggctacgccaagctgggcggcggcggggacctgggcgcccgggtgtag

SEQ ID NO: 39364 - DNA, 924 bp, Artificial Sequence; identical to SEQ ID NO: 39363
  Description of Artificial Sequence: Synthetic coding sequence

SEQ ID NO: 39365 - DNA, 1866 bp, Artificial Sequence
  Description of Artificial Sequence: Synthetic coding sequence
atgattgccaccggcggcctgctgcgcatcagcgccaggaagcaggaccccctgcggccccccagccagatccccaagaggaagaggaaggccaagaagaggaggaagaatgatgtggtggtggtgaagggcaagctgaagctgtgcagcatcagcggcctgattgccctgtgtggcatcctggtgctgctggtgggcatcgccatggctgtggtgggctactggcccaaggccaccggcaccaaccgggagggcggcaagcagctgcccccagctggcagcagccaccgggtgcccaccacagccaacagcagcagcagcggcagcaagaacagaagccgcagccacccccgggcccctgggggcgtgaacagcagcagcgctggggcccccaggagcaccccaccagcccgggccgccagccccagcagcagcagcacctctgtgggcttcttcttccgcatcttcagcggctacctgcacagcgacaagctgaaggtgtttggccccctcatcatgggcatcggcatcttcctgttcatctgtgccaatgctgtgctgcatgaaaatagagacaagaagaccaagatcatcaacctgcgggacctgtacagcacagtgattgatgtgcacagcctgcgggccaaggacctggccgctgctgctgctgctgctgctgctgctgctgccagcagcagcagcagcgccccagctgctgcccctcctggggccatccccctgaatggcttcctgtcctatgtgcagagccggggcctggagctgaagccaggcggctgcggcggcagcggagatgcctttggagctgctgccatgctggccaagggctcctggccaccccaccctgctgcccccagcggcggccggcccagaggagctgccagccccccagacctggccagcagcccccgctgcccccgggagccccccagcctggccgaggccgtgtacagcgtgtaccgggagaggtctggagtggccggcagccggcgggctgctgctgccacagctgctgctgctgccagcagctgcagcagccctgccccctgcagccccccagagagctggggccggcagagcacagccagcagctttgtggacagcagcctgagcgcctttgccctgctgcccctgcagggcggccgggacagaggaggagatgctgagggcgccagctgctcctggcagaggcctcctggagagcggggcagccaggagatccccagaggagagctggacctgtccatgaccaacctgcggggagctgagggctccatgagaggagcccggcgggagcctgaggagcctgagggcgctgtggccgcccgggccgcccggggccagggcggccgcctgcccaggacaggccgctatgctgccctgcggcggcgcagcaccagcggcctgcctgactaccgggccccacccagccctgagcccccacccagccctggcagcgctgaccctgacagcagccccctggccaaggccgccagccccagcccccccctgcggctggagggcagcccccccacccggcgggacagcggcagcagccagagtgatgaccccagcagcagcaacaagggctacacccccctgcgggaggccggcaccagcacagaatctgtgctggatgctgtggccggccagacccgggacagcgctgtggccgcccctgtgctgggcgctgagcagagcagccctgagggcgccagccaggagcccccaacagctgagcagccccagcctgtgcagaggcagttcaccaacaaggagaagctgatcatgatcagccgcagccacgccatcggcgtggaggaggagctggagagcacaggcatctag

SEQ ID NO: 39366 - DNA, 1866 bp, Artificial Sequence; identical to SEQ ID NO: 39365
  Description of Artificial Sequence: Synthetic coding sequence

SEQ ID NO: 39367 - DNA, 1179 bp, Artificial Sequence
  Description of Artificial Sequence: Synthetic coding sequence
atggagggcgtgtctgccctgctggcccgctgccccacagctggcctggccggcggcctgggcgtgacagcctgtgccgccgccggcgtgctgctgtacagaattgcccggaggatgaagcccacccacaccatggtgaactgctggttctgcaaccaggacaccctggtgccctacggcaacagaaactgctgggactgcccccactgtgagcagtacaacggcttccaggagaatggagactacaacaagcccatcccagcccagtacctggagcacctgaaccacgtggtgagcagcgcccccagcctgcgggaccccagccagccccagcagtgggtgagcagccaggtgctgctgtgcaagcgctgcaaccaccaccagaccaccaagatcaagcagctggccgcctttgccccccgggaggagggccgctatgatgaggaggtggaggtgtaccgccaccacctggagcagatgtacaagctgtgccggccctgccaggccgctgtggagtactacatcaagcaccagaaccggcagctgcgggccctgctgctgagccaccagttcaagagaagagaggccgaccagacccacgcccagaacttcagcagcgctgtgaagagccctgtgcaggtgatcctgctgcgggccctggccttcctggcctgtgccttcctgctgaccacagccctgtatggagccagcggccactttgcccctggcaccaccgtgcccctggccctgcccccaggcggcaatggaagtgccaccccagacaatggcaccaccccaggagctgagggctggaggcagctgctgggcctgctgcctgagcacatggccgagaagctgtgtgaggcctgggccttcggccagagccaccagacaggagtggtggccctgggcctgctgacctgcctgctggccatgctgctggccggccgcatccggctgcggagaattgatgccttctgcacctgcctgtgggccctgctgctgggcctgcacctggccgagcagcacctgcaggccgccagccccagctggctggacaccctgaagttcagcaccaccagcctgtgctgcctggtgggcttcaccgctgctgtggccaccaggaaggccaccggcccccggcgcttccggccccggcgctctgagaagcagccctag

SEQ ID NO: 39368 - DNA, 2001 bp, Artificial Sequence
  Description of Artificial Sequence: Synthetic coding sequence
atggagggcgtgtctgccctgctggcccgctgccccacagctggcctggccggcggcctgggcgtgacagcctgtgccgccgccggcgtgctgctgtacagaattgcccggaggatgaagcccacccacaccatggtgaactgctggttctgcaaccaggacaccctggtgccctacggcaacagaaactgctgggactgcccccactgtgagcagtacaacggcttccaggagaatggagactacaacaagcccatcccagcccagtacctggagcacctgaaccacgtggtgagcagcgcccccagcctgcgggaccccagccagccccagcagtgggtgagcagccaggtgctgctgtgcaagcgctgcaaccaccaccagaccaccaagatcaagcagctggccgcctttgccccccgggaggagggccgctatgatgaggaggtggaggtgtaccgccaccacctggagcagatgtacaagctgtgccggccctgccaggccgctgtggagtactacatcaagcaccagaaccggcagctgcgggccctgctgctgagccaccagttcaagagaagagaggccgaccagacccacgcccagaacttcagcagcgctgtgaagagccctgtgcaggtgatcctgctgcgggccctggccttcctggcctgtgccttcctgctgaccacagccctgtatggagccagcggccactttgcccctggcaccaccgtgcccctggccctgcccccaggcggcaatggaagtgccaccccagacaatggcaccaccccaggagctgagggctggaggcagctgctgggcctgctgcctgagcacatggccgagaagctgtgtgaggcctgggccttcggccagagccaccagacaggagtggtggccctgggcctgctgacctgcctgctggccatgctgctggccggccgcatccggctgcggagaattgatgccttctgcacctgcctgtgggccctgctgctgggcctgcacctggccgagcagcacctgcaggccgccagccccagctggctggacaccctgaagttcagcaccaccagcctgtgctgcctggtgggcttcaccgctgctgtggccaccaggaaggccaccggcccccggcgcttccggccccggcgcttcttccctggggacagcgctggcctcttccccaccagccccagcctggccatcccccaccccagcgtgggcggcagccctgccagcctcttcatccccagcccccccagcttcctgcccctggccaaccagcagctgttccgcagccccaggaggaccagccccagcagcctgcccggccgcctgagccgggccctgagcctgggcaccatccccagcctgaccagggctgacagcggctacctgttcagcggcagcaggcctcccagccaggtgagccgcagcggggagttccctgtgtctgactacttcagcctgctgagcggcagctgccccagcagccccctgcccagccctgcccccagcgtggccggctctgtggccagcagcagcggcagcctgcggcaccggcggcccctcatcagccctgcccggctgaacctgaagggccagaagctgctgctcttccccagccccccaggagaggcccccaccacccccagcagcagtgatgagcacagcccccacaacggcagcctcttcaccatggagcccccccacgtgcccaggaagccacccctgcaggatgtgaagcacgccctggacctgcggagcaagctggagcggggcagcgcctgcagcaacagaagcatcaagaaggaggatgacagcagccagagcagcacctgtgtggtggacaccaccacccggggctgcagcgaggaggccgccacctggaggggccgcttcggccccagcctggtgcggggcctgctggccgtgtccctggccgccaatgccctcttcaccagcgtcttcctgtaccagagcctgaggtag

SEQ ID NO: 39369 - DNA, 1929 bp, Artificial Sequence
  Description of Artificial Sequence: Synthetic coding sequence
atggagggcgtgtctgccctgctggcccgctgccccacagctggcctggccggcggcctgggcgtgacagcctgtgccgccgccggcgtgctgctgtacagaattgcccggaggatgaagcccacccacaccatggtgaactgctggttctgcaaccaggacaccctggtgccctacggcaacagaaactgctgggactgcccccactgtgagcagtacaacggcttccaggagaatggagactacaacaagcccatcccagcccagtacctggagcacctgaaccacgtggtgagcagcgcccccagcctgcgggaccccagccagccccagcagtgggtgagcagccaggtgctgctgtgcaagcgctgcaaccaccaccagaccaccaagatcaagcagctggccgcctttgccccccgggaggagggccgctatgatgaggaggtggaggtgtaccgccaccacctggagcagatgtacaagctgtgccggccctgccaggccgctgtggagtactacatcaagcaccagaaccggcagctgcgggccctgctgctgagccaccagttcaagagaagagaggccgaccagacccacgcccagaacttcagcagcgctgtgaagagccctgtgcaggtgatcctgctgcgggccctggccttcctggcctgtgccttcctgctgaccacagccctgtatggagccagcggccactttgcccctggcaccaccgtgcccctggccctgcccccaggcggcaatggaagtgccaccccagacaatggcaccaccccaggagctgagggctggaggcagctgctgggcctgctgcctgagcacatggccgagaagctgtgtgaggcctgggccttcggccagagccaccagacaggagtggtggccctgggcctgctgacctgcctgctggccatgctgctggccggccgcatccggctgcggagaattgatgccttctgcacctgcctgtgggccctgctgctgggcctgcacctggccgagcagcacctgcaggccgccagccccagctggctggacaccctgaagttcagcaccaccagcctgtgctgcctggtgggcttcaccgctgctgtggccaccaggaaggccaccggcccccggcgcttccggccccggcgcttcttccctggggacagcgctggcctcttccccaccagccccagcctggccatcccccaccccagcgtgggcggcagccctgccagcctcttcatccccagcccccccagcttcctgcccctggccaaccagcagctgttccgcagccccaggaggaccagccccagcagcctgcccggccgcctgagccgggccctgagcctgggcaccatccccagcctgaccagggctgactacttcagcctgctgagcggcagctgccccagcagccccctgcccagccctgcccccagcgtggccggctctgtggccagcagcagcggcagcctgcggcaccggcggcccctcatcagccctgcccggctgaacctgaagggccagaagctgctgctcttccccagccccccaggagaggcccccaccacccccagcagcagtgatgagcacagcccccacaacggcagcctcttcaccatggagcccccccacgtgcccaggaagccacccctgcaggatgtgaagcacgccctggacctgcggagcaagctggagcggggcagcgcctgcagcaacagaagcatcaagaaggaggatgacagcagccagagcagcacctgtgtggtggacaccaccacccggggctgcagcgaggaggccgccacctggaggggccgcttcggccccagcctggtgcggggcctgctggccgtgtccctggccgccaatgccctcttcaccagcgtcttcctgtaccagagcctgaggtag

SEQ ID NO: 39370 - DNA, 411 bp, Artificial Sequence
  Description of Artificial Sequence: Synthetic coding sequence
atgctgttcagcctgcgggagctggtgcagtggctgggctttgccacctttgagatctttgtgcacctgctggccctgctggtgttttctgtgctgctggccctgcgggtggatggcctggtgcccggcctgtcctggtggaatgtgtttgtgcccttctttgctgctgatggcctgagcacctacttcaccaccatcgtgtctgtgcggctcttccaggatggagagaagaggctggccgtgctgcggctcttctgggtgctgactgtgctgagcctgaagtttgtgtttgagatgctgctgtgccagaagctggccgagcagacccgggagctgtggtttggcctcatcaccagccccctcttcatcctgctgcagctgctgatgatccgggcctgccgggtgaactag

SEQ ID NO: 39371 - DNA, 411 bp, Artificial Sequence; identical to SEQ ID NO: 39370
  Description of Artificial Sequence: Synthetic coding sequence

SEQ ID NO: 39372 - DNA, 681 bp, Artificial Sequence
  Description of Artificial Sequence: Synthetic coding sequence
atgacagtgcagaggctggtggccgctgctgtgctggtggccctggtgtccctcatcctgaacaacgtggccgccttcaccagcaactgggtgtgccagaccctggaggatggaagaagaagatctgtgggcctgtggaggagctgctggctggtggacaggacccggggcggccccagccctggggcccgggccggccaggtggatgcccatgactgtgaggccctgggctggggcagcgaggccgccggcttccaggagagccggggcaccgtgaagctgcagtttgacatgatgagggcctgcaacctggtggccacagctgccctgacagctggccagctgaccttcctgctgggcctggtgggcctgcccctgctgagcccagatgccccctgctgggaggaggccatggccgccgccttccagctggccagctttgtgctggtgattggcctggtgaccttctacagaattggcccctacaccaacctgtcctggagctgctacctgaacattggagcctgcctgctggccaccctggccgccgccatgctgatctggaacatcctgcacaagcgggaggactgcatggccccccgggtgattgtcatcagccgcagcctgacagcccgcttccggcggggcctggacaatgactatgtggagagcccctgctag

SEQ ID NO: 39373 - DNA, 681 bp, Artificial Sequence; identical to SEQ ID NO: 39372
  Description of Artificial Sequence: Synthetic coding sequence

SEQ ID NO: 39374 - DNA, 1053 bp, Artificial Sequence
  Description of Artificial Sequence: Synthetic coding sequence
atgatccggcaggagaggagcaccagctaccaggagctgtctgaggagctggtgcaggtggtggagaacagcgagctggctgatgagcaggacaaggagaccgtgcgggtgcagggccctggcatcctgcccggcctggacagcgagagcgccagcagcagcatccgcttcagcaaggcctgcctgaagaatgtgttttctgtgctgctgatcttcatctacctgctgctgatggctgtggccgtgttcctggtgtaccgcaccatcacagacttccgggagaagctgaagcaccctgtgatgtctgtgtcctacaaggaggtggacagatatgatgcccctggcatcgccctgtacccaggccaggcccagctgctgagctgcaagcaccactatgaggtgatcccccccctgaccagccctggccagcccggggacatgaactgcaccacccagaggatcaactacacagaccccttcagcaaccagacagtgaagagcgccctgattgtgcagggcccccgggaggtgaagaagcgggagctggtgttcctgcagttccggctgaacaagagcagcgaggacttcagcgccatcgactacctgctcttcagcagcttccaggagttcctgcagagccccaacagagtgggcttcatgcaggcctgtgagagcgcctacagctcctggaagttcagcggcggcttccgcacctgggtgaagatgagcctggtgaagaccaaggaggaggatggccgggaggccgtggagttccggcaggagacctctgtggtgaactacatcgaccagaggcctgctgccaagaagagcgcccagctgttctttgtggtgtttgagtggaaggaccccttcatccagaaggtgcaggacatcgtgacagccaacccctggaacaccatcgccctgctgtgtggggccttcctggccctcttcaaggctgctgagtttgccaagctgagcatcaagtggatgatcaagatcaggaagcgctacctgaagagaagaggccaggccaccagccacatctcctag

SEQ ID NO: 39375 - DNA, 1236 bp, Artificial Sequence
  Description of Artificial Sequence: Synthetic coding sequence
atgatccggcaggagaggagcaccagctaccaggaggccgtgcggcctgccctgcccagcagcaagccctgcctgctgaccagccctgctgtgctggtgaagctgctgagcagcagcgccagcaccagcaggcctcccaacctgggccacctgtggcagcccagcagctctgtgcccctgcacagagctgccagcctggccaaggtgcggcagttccagctgtctgaggagctggtgcaggtggtggagaacagcgagctggctgatgagcaggacaaggagaccgtgcgggtgcagggccctggcatcctgcccggcctggacagcgagagcgccagcagcagcatccgcttcagcaaggcctgcctgaagaatgtgttttctgtgctgctgatcttcatctacctgctgctgatggctgtggccgtgttcctggtgtaccgcaccatcacagacttccgggagaagctgaagcaccctgtgatgtctgtgtcctacaaggaggtggacagatatgatgcccctggcatcgccctgtacccaggccaggcccagctgctgagctgcaagcaccactatgaagtcatcccccccctgaccagccctggccagcccggggacatgaactgcaccacccagaggatcaactacacagaccccttcagcaaccagacagtgaagagcgccctgattgtgcagggcccccgggaggtgaagaagcgggagctggtgttcctgcagttccggctgaacaagagcagcgaggacttcagcgccatcgactacctgctcttcagcagcttccaggagttcctgcagagccccaacagagtgggcttcatgcaggcctgtgagagcgcctacagctcctggaagttcagcggcggcttccgcacctgggtgaagatgagcctggtgaagaccaaggaggaggatggccgggaggccgtggagttccggcaggagacctctgtggtgaactacatcgaccagaggcctgctgccaagaagagcgcccagctgttctttgtggtgtttgagtggaaggaccccttcatccagaaggtgcaggacatcgtgacagccaacccctggaacaccatcgccctgctgtgtggggccttcctggccctcttcaaggctgctgagtttgccaagctgagcatcaagtggatgatcaagatcaggaagcgctacctgaagaggcggggccaggccaccagccacatctcctag

SEQ ID NO: 39376 - DNA, 441 bp, Artificial Sequence
  Description of Artificial Sequence: Synthetic coding sequence
atgagccgcagccgcctcttctctgtgaccagcgccatcagcaccatcggcatcctgtgcctgcccctcttccagctggtgctgagtgacctgccctgtgaagaagatgagatgtgtgtgaactacaatgaccagcaccccaacggctggtacatctggatcctgctgctgctggtgctggtggccgccctgctgtgtggggctgtggtgctgtgcctgcagtgctggctgcggcggcccagaattgacagccacaggaggaccatggctgtgtttgctgtgggggacctggacagcatctatggaacagaagctgctgtgagccccaccgtgggcatccacctgcagacccagaccccagacctgtaccctgtgcctgccccctgcttcggccccctgggcagccccccaccctatgaggagatcgtgaagaccacctag

SEQ ID NO: 39377 - DNA, 522 bp, Artificial Sequence
  Description of Artificial Sequence: Synthetic coding sequence
atggcccccaagggcaaggtgggcacccggggcaagaagcagatctttgaggagaaccgggagaccctgaagttctacctgcgcatcatcctgggcgccaatgccatctactgcctggtgaccctggtgttcttctacagcagcgccagcttctgggcctggctggccctgggcttcagcctggccgtgtatggagccagctaccacagcatgagctccatggcccgggccgccttctctgaagatggagccctgatggatggcggcatggacctgaacatggagcagggcatggccgagcacctgaaggatgtgatcctgctgacagccatcgtgcaggtgctgagctgcttcagcctgtatgtgtggagcttctggctgctggcccctggccgggccctgtacctgctgtgggtgaatgtgctgggcccctggttcaccgctgacagcggcaccccagcccctgagcacaatgagaagaggcagaggcggcaggagcggcggcagatgaagaggctgtag

SEQ ID NO: 39378 - DNA, 1557 bp, Artificial Sequence
  Description of Artificial Sequence: Synthetic coding sequence
atgcagggcgaggcccaccccagcgccagcctgattgacaggaccatcaagatgaggaaggagacagaggccaggaaggtggtgctggcctggggcctgctgaatgtgtccatggccggcatgatctacacagagatgaccgggaagctgatcagcagctactacaacgtgacctactggcccctgtggtacatcgagctggccctggccagcctcttcagcctgaatgccctgtttgacttctggagatacttcaagtacacagtggcccccaccagcctggtggtgtccccaggccagcagaccctgctgggcctgaagacagctgtggtgcagaccaccccacctcatgacctggccgccacccagatccccccagccccacccagccccagcatccagggccagagcgtgctgagctacagccccagccgcagccccagcaccagccccaagttcaccaccagctgcatgacaggctacagcccccagctgcagggcctgagcagcggcggcagcggcagctacagccctggggtgacctacagccctgtgtctggctacaacaagctggccagcttcagccccagcccccccagcccctaccccaccaccgtgggccctgtggagagcagcggcctgcggagccgctaccgcagcagccccaccgtgtacaacagccccacagacaaggaggactacatgacagacctgcggaccctggacaccttcctgcggtctgaggaggagaagcagcaccgggtgaagctgggcagcccagacagcaccagccccagcagcagccccaccttctggaactacagccgctccatgggagactatgcccagaccctgaagaagttccagtaccagctggcctgccgcagccaggccccctgtgccaacaaggatgaggccgacctgagcagcaagcaggccgctgaggaggtgtgggcccgggtggccatgaaccggcagctgctggaccacatggacagctggacagccaagttcaggaactggatcaatgagaccatcctggtgcccctggtgcaggagattgagagcgtgtccacccagatgaggaggatgggctgcccagagctgcagattggagagctgagccagggcggctgcatgagcagcttccgctggaacagaggaggagacttcaagggcaggaagtgggacacagacctgcccacagacagcgccatcatcatgcacgtgttctgcacctacctggacagccggctgcccccccaccccaagtacccagatggcaagaccttcaccagccagcactttgtgcagacccccaacaagccagatgtgaccaatgaaaatgtgttctgcatctaccagagcgccatcaaccccccccactatgagctgatctaccagagacatgtgtacaacctgcccaagggcaggaacaacatgttccacaccctgctgatgttcctgtacatcatcaagaccaaggagagcggcatgctgggccgggtgaacctgggcctgagcggcgtgaacatcctgtggatctttggagagtag

SEQ ID NO: 39379 - DNA, 1686 bp, Artificial Sequence
  Description of Artificial Sequence: Synthetic coding sequence
atgatgcagggcgaggcccaccccagcgccagcctgattgacaggaccatcaagatgaggaaggagacagaggccaggaaggtggtgctggcctggggcctgctgaatgtgtccatggccggcatgatctacacagagatgaccgggaagctgatcagcagctactacaacgtgacctactggcccctgtggtacatcgagctggccctggccagcctcttcagcctgaatgccctgtttgacttctggagatacttcaagtacacagtggcccccaccagcctggtggtgtccccaggccagcagaccctgctgggcctgaagacagctgtggtgcagaccaccccacctcatgacctggccgccacccagatccccccagccccacccagccccagcatccagggccagagcgtgctgagctacagccccagccgcagccccagcaccagccccaagttcaccaccagctgcatgacaggctacagcccccagctgcagggcctgagcagcggcggcagcggcagctacagccctggggtgacctacagccctgtgtctggctacaacaagctggccagcttcagccccagcccccccagcccctaccccaccaccgtgggccctgtggagagcagcggcctgcggagccgctaccgcagcagccccaccgtgtacaacagccccacagacaaggaggactacatgacagacctgcggaccctggacaccttcctgcggtctgaggaggagaagcagcaccgggtgaagctgggcagcccagacagcaccagccccagcagcagccccaccttctggaactacagccgctccatgggagactatgcccagaccctgaagaagttccagtaccagctggcctgccgcagccaggccccctgtgccaacaaggatgaagctgacctgagcagcaagcaggccgctgaggaggtgtgggcccgggtggccatgaaccggcagctgctggaccacatggacagctggacagccaagttcaggaactggatcaatgagaccatcctggtgcccctggtgcaggagattgaatctgtgtccacccagatgaggaggatgggctgcccagagctgcagatcggggaggccagcatcaccagcctgaagcaggccgccctggtgaaggcccccctcatccccaccctgaacaccatcgtgcagtacctggacctgacccccaaccaggagtacctgtttgagcgcatcaaggagctgagccagggcggctgcatgagcagcttccgctggaacagaggaggagacttcaagggcaggaagtgggacacagacctgcccacagattctgccatcatcatgcacgtgttctgcacctacctggacagccggctgcccccccaccccaagtacccagatggcaagaccttcaccagccagcactttgtgcagacccccaacaagccagatgtgaccaatgaaaatgtgttctgcatctaccagagcgccatcaaccccccccactatgagctgatctaccagagacatgtgtacaacctgcccaagggcaggaacaacatgttccacaccctgctgatgttcctgtacatcatcaagaccaaggagagcggcatgctgggccgggtgaacctgggcctgtctggagtgaacatcctgtggatctttggagagtag

SEQ ID NO: 39380 - DNA, 1683 bp, Artificial Sequence
  Description of Artificial Sequence: Synthetic coding sequence
atgcagggcgaggcccaccccagcgccagcctgattgacaggaccatcaagatgaggaaggagacagaggccaggaaggtggtgctggcctggggcctgctgaatgtgtccatggccggcatgatctacacagagatgaccgggaagctgatcagcagctactacaacgtgacctactggcccctgtggtacatcgagctggccctggccagcctcttcagcctgaatgccctgtttgacttctggagatacttcaagtacacagtggcccccaccagcctggtggtgtccccaggccagcagaccctgctgggcctgaagacagctgtggtgcagaccaccccacctcatgacctggccgccacccagatccccccagccccacccagccccagcatccagggccagagcgtgctgagctacagccccagccgcagccccagcaccagccccaagttcaccaccagctgcatgacaggctacagcccccagctgcagggcctgagcagcggcggcagcggcagctacagccctggggtgacctacagccctgtgtctggctacaacaagctggccagcttcagccccagcccccccagcccctaccccaccaccgtgggccctgtggagagcagcggcctgcggagccgctaccgcagcagccccaccgtgtacaacagccccacagacaaggaggactacatgacagacctgcggaccctggacaccttcctgcggtctgaggaggagaagcagcaccgggtgaagctgggcagcccagacagcaccagccccagcagcagccccaccttctggaactacagccgctccatgggagactatgcccagaccctgaagaagttccagtaccagctggcctgccgcagccaggccccctgtgccaacaaggatgaggccgacctgagcagcaagcaggccgctgaggaggtgtgggcccgggtggccatgaaccggcagctgctggaccacatggacagctggacagccaagttcaggaactggatcaatgagaccatcctggtgcccctggtgcaggagattgagagcgtgtccacccagatgaggaggatgggctgcccagagctgcagattggagaggccagcatcaccagcctgaagcaggccgccctggtgaaggcccccctcatccccaccctgaacaccatcgtgcagtacctggacctgacccccaaccaggagtacctgtttgagcgcatcaaggagctgagccagggcggctgcatgagcagcttccgctggaacagaggaggagacttcaagggcaggaagtgggacacagacctgcccacagacagcgccatcatcatgcacgtgttctgcacctacctggacagccggctgcccccccaccccaagtacccagatggcaagaccttcaccagccagcactttgtgcagacccccaacaagccagatgtgaccaatgaaaatgtgttctgcatctaccagagcgccatcaaccccccccactatgagctgatctaccagagacatgtgtacaacctgcccaagggcaggaacaacatgttccacaccctgctgatgttcctgtacatcatcaagaccaaggagagcggcatgctgggccgggtgaacctgggcctgagcggcgtgaacatcctgtggatctttggagagtag

SEQ ID NO: 39381 - DNA, 171 bp, Artificial Sequence
  Description of Artificial Sequence: Synthetic coding sequence
atgcagggcgaggcccaccccagcgccagcctgattgacaggaccatcaagatgaggaaggagacagaggccaggaaggtggtgctggcctggggcctgctgaatgtgtccatggccggcatgatctacacagagatgaccgggaagctgatcagcagctactacaactag

SEQ ID NO: 39382 - DNA, 1560 bp, Artificial Sequence
  Description of Artificial Sequence: Synthetic coding sequence
atgatgcagggcgaggcccaccccagcgccagcctgattgacaggaccatcaagatgaggaaggagacagaggccaggaaggtggtgctggcctggggcctgctgaatgtgtccatggccggcatgatctacacagagatgaccgggaagctgatcagcagctactacaacgtgacctactggcccctgtggtacatcgagctggccctggccagcctcttcagcctgaatgccctgtttgacttctggagatacttcaagtacacagtggcccccaccagcctggtggtgtccccaggccagcagaccctgctgggcctgaagacagctgtggtgcagaccaccccacctcatgacctggccgccacccagatccccccagccccacccagccccagcatccagggccagagcgtgctgagctacagccccagccgcagccccagcaccagccccaagttcaccaccagctgcatgacaggctacagcccccagctgcagggcctgagcagcggcggcagcggcagctacagccctggggtgacctacagccctgtgtctggctacaacaagctggccagcttcagccccagcccccccagcccctaccccaccaccgtgggccctgtggagagcagcggcctgcggagccgctaccgcagcagccccaccgtgtacaacagccccacagacaaggaggactacatgacagacctgcggaccctggacaccttcctgcggtctgaggaggagaagcagcaccgggtgaagctgggcagcccagacagcaccagccccagcagcagccccaccttctggaactacagccgctccatgggagactatgcccagaccctgaagaagttccagtaccagctggcctgccgcagccaggccccctgtgccaacaaggatgaagctgacctgagcagcaagcaggccgctgaggaggtgtgggcccgggtggccatgaaccggcagctgctggaccacatggacagctggacagccaagttcaggaactggatcaatgagaccatcctggtgcccctggtgcaggagattgaatctgtgtccacccagatgaggaggatgggctgcccagagctgcagatcggggagctgagccagggcggctgcatgagcagcttccgctggaacagaggaggagacttcaagggcaggaagtgggacacagacctgcccacagattctgccatcatcatgcacgtgttctgcacctacctggacagccggctgcccccccaccccaagtacccagatggcaagaccttcaccagccagcactttgtgcagacccccaacaagccagatgtgaccaatgaaaatgtgttctgcatctaccagagcgccatcaaccccccccactatgagctgatctaccagagacatgtgtacaacctgcccaagggcaggaacaacatgttccacaccctgctgatgttcctgtacatcatcaagaccaaggagagcggcatgctgggccgggtgaacctgggcctgtctggagtgaacatcctgtggatctttggagagtag

SEQ ID NO: 39383 - DNA, 612 bp, Artificial Sequence
  Description of Artificial Sequence: Synthetic coding sequence
atgatgcagggcgaggcccaccccagcgccagcctgattgacaggaccatcaagatgaggaaggagacagaggccaggaaggtggtgctggcctggggcctgctgaatgtgtccatggccggcatgatctacacagagatgaccgggaagctgatcagcagctactacaacgtgacctactggcccctgtggtacatcgagctggccctggccagcctcttcagcctgaatgccctgtttgacttctggagatacttcaagtacacagtggcccccaccagcctggtggtgtccccaggccagcagaccctgctgggcctgaagacagctgtggtgcagaccaccccacctcatgacctggccgccacccagatccccccagccccacccagccccagcatccagggccagagcgtgctgagctacagccccagccgcagccccagcaccagccccaagttcaccaccagctgcatgacaggctacagcccccagctgcagggcctgagcagcggcggcagcggcagctacagccctggggtgacctacagccctgtgtctggctacaacaaggtgatgaccctcttcagctgcctggtgaccctcttctag

SEQ ID NO: 39384 - DNA, 390 bp, Artificial Sequence
  Description of Artificial Sequence: Synthetic coding sequence
atgctgctgggcggctggctgctgctggccttcaatgccatcttcctgctgtcctgggccgtggcccccaagggcctgtgccccaggaggagctctgtgcccatgcctggggtgcaggccgtggccgccacagccatgattgtgggcctgctgatcttccccatcggcctggccagccccttcatcaaggaggtgtgtgaggccagctccatgtactatggaggcaagtgccgcctgggctggggctacatgacagccatcctgaatgctgtgctggccagcctgctgcccatcatctcctggccccacaccaccaaggtgcagggccgcaccatcatcttcagcagcgccacagagcgcatcatctttgtgcctgagatgaacaagtag

SEQ ID NO: 39385 - DNA, 390 bp, Artificial Sequence; identical to SEQ ID NO: 39384
  Description of Artificial Sequence: Synthetic coding sequence

SEQ ID NO: 39386 - DNA, 603 bp, Artificial Sequence
  Description of Artificial Sequence: Synthetic coding sequence
atgctgagctctgtgtgggtggccctgggcctgagcctgacctgcaccagcgccttcagcctcatcagccctgcctggttccagacccccaccttctcctttggcatcctgacctactgctcctggccccagggcaacagctggaaccagagctgtgtgaccttcagcagcctggaggacatcccagactttgcctggaaggtgtctgctgtgatgctgctgggcggctggctgctgctggccttcaatgccatcttcctgctgtcctgggccgtggcccccaagggcctgtgcccccggcgcagctctgtgcccatgcctggggtgcaggccgtggccgccacagccatgattgtgggcctgctgatcttccccatcggcctggccagccccttcatcaaggaggtgtgtgaggccagctccatgtactacggcggcaaatgtcggctgggctggggctacatgacagccatcctgaatgctgtgctggccagcctgctgcccatcatctcctggccccacaccaccaaggtgcagggccgcaccatcatcttcagcagcgccacagagcgcatcatctttgtgcctgagatgaacaagtag

SEQ ID NO: 39387 - DNA, 474 bp, Artificial Sequence
  Description of Artificial Sequence: Synthetic coding sequence
atggtgttcccccccaacacccagcacaagttcaccagcggccgggtggccttccagctgctgcaggtgggcgtggacagccctgctgctggcaccaggcacaacagcgctggccctgcccacctgcaccgggccctgagcacagccagctccatgcagaggctgcctgctgccacccgggccaccctcatcctgagcctggcctttgccagcctgcacagcgcctgcagcgctgccagcagcagcaacagcagcagcctgacagcccaccacccagaccccggcaccctggagcagtgcctgaatgtggacttctgcccccaggccgcccgctgctgcaggactggagtggatgaatatggctggattgctgctgctgtgggctggagcctgtggttcctgaccctcatcctgctgtgtgtggacaagctgatgaagctgaccccagatgagcccaaggacctgcaggcctag

SEQ ID NO: 39388 - DNA, 324 bp, Artificial Sequence
  Description of Artificial Sequence: Synthetic coding sequence
atgcagaggctgcctgctgccacccgggccaccctcatcctgagcctggcctttgccagcctgcacagcgcctgcagcgctgaggccagcagcagcaacagcagcagcctgacagcccaccacccagaccccggcaccctggagcagtgcctgaatgtggacttctgcccccaggccgcccgctgctgcaggactggagtggatgaatatggctggattgctgctgctgtgggctggagcctgtggttcctgaccctcatcctgctgtgtgtggacaagctgatgaagctgaccccagatgagcccaaggacctgcaggcctag

SEQ ID NO: 39389 - DNA, 2070 bp, Artificial Sequence
  Description of Artificial Sequence: Synthetic coding sequence
atggccaccaagacagctggggtgggccgctgggaggtggtgaagaagggccggcggcctggggtgggcgctggggccggcggccggggcggcggcaggaacagaagagccctgggggaggccaacggggtgtggaagtatgacctgaccccagccatccagaccaccagcaccctgtatgaaagaggatttgagaacatcatgaagaggcagaacaaggagcaggtgcccccacctgctgtggagcccaagaagccaggcaacaagaagcagcccaagaaggtggccaccccacccaaccagaaccagaagcagggccgcttccgcagcctggaggaggccctgaaggccctggatgtggccgacctgcagaaggagctggacaagagccagagcgtcttcagcggcaaccccagcatctggctgaaggacctggccagctacctgaactacaagctgcaggcccccctgtctgagcccaccctgagccagcacacccatgactacccctacagcctggtgtcccgggagctgcggggcatcatccggggcctgctggccaaggccgccggcagcctggagctgttctttgaccactgcctcttcaccatgctgcaggagctggacaagaccccaggagagagcctgcacggctaccgcatctgcatccaggccatcctgcaggacaagcccaagatcgccacagccaacctgggcaagttcctggagctgctgcggagccaccagagcaggcctgccaagtgcctgaccatcatgtgggccctgggccaggccggctttgccaacctgacagagggcctgaaggtgtggctgggcatcatgctgcctgtgctgggcatcaagagcctgagcccctttgccatcacctacctggaccggctgctgctgatgcaccccaacctgaccaagggcttcggcatgattggccccaaggacttcttccccctgctggactttgcctacatgcccaacaacagcctgacccccagcctgcaggagcagctgtgccagctgtacccccggctgaaggtgctggccttcggggccaagccagacagcaccctgcacacctacttccccagcttcctgagccgggccacccccagctgccccccagagatgaagaaggagctgctgagcagcctgacagaatgtctgactgtggaccccctgagcgcctctgtgtggaggcagctgtaccccaagcacctgagccagagcagcctgctgctggagcacctgctgagctcctgggagcagatccccaagaaggtgcagaagagcctgcaggagaccatccagagcctgaagctgaccaaccaggagctgctgaggaagggcagcagcaacaaccaggatgtggtgacctgtgacatggcctgcaagggcctgctgcagcaggtgcagggcccccggctgccctggacccggctgctgctgctgctgctggtgtttgctgtgggcttcctgtgccacgacctgcggagccacagcagcttccaggccagcctgaccggccgcctgctgcggagcagcggcttcctgcctgccagccagcaggcctgtgccaagctgtacagctacagcctgcagggctacagctggctgggggagaccctgcccctgtggggcagccacctgctgactgtggtgcggcccagcctgcagctggcctgggcccacaccaatgccaccgtgtccttcctgagcgcccactgtgccagccacctggcctggtttggagacagcctgaccagcctgagccagaggctgcagatccagctgcctgattctgtgaaccagctgctgcgctacctgcgggagctgcccctgctcttccaccagaatgtgctgctgcccctgtggcacctgctgctggaggccctggcctgggcccaggagcactgccacgaggcctgccgcggggaggtgacctgggactgcatgaagacccagctgtctgaggccgtgcactggacctggctgtgcctgcaggacatcaccgtggccttcctggactgggccctggccctgatcagccagcagtag

SEQ ID NO: 39390 - DNA, 2070 bp, Artificial Sequence; identical to SEQ ID NO: 39389
  Description of Artificial Sequence: Synthetic coding sequence

SEQ ID NO: 39391 - DNA, 1935 bp, Artificial Sequence
  Description of Artificial Sequence: Synthetic coding sequence
atggccaccaagacagctggggtgggccgctgggaggtggtgaagaagggccggcggcctggggtgggcgctggggccggcggccggggcggcggcaggaacagaagagccctgggggaggccaacggggtgtggaagtatgacctgaccccagccatccagaccaccagcaccctgtatgaaagaggatttgagaacatcatgaagaggcagaacaaggagcaggtgcccccacctgctgtggagcccaagaagccaggcaacaagaagcagcccaagaaggtggccaccccacccaaccagaaccagaagcagggccgcttccgcagcctggaggaggccctgaaggccctggatgtggccgacctgcagaaggagctggacaagagccagagcgtcttcagcggcaaccccagcatctggctgaaggacctggccagctacctgaactacaagctgcaggcccccctgtctgagcccaccctgagccagcacacccatggagagagcctgcacggctaccgcatctgcatccaggccatcctgcaggacaagcccaagatcgccacagccaacctgggcaagttcctggagctgctgcggagccaccagagcaggcctgccaagtgcctgaccatcatgtgggccctgggccaggccggctttgccaacctgacagagggcctgaaggtgtggctgggcatcatgctgcctgtgctgggcatcaagagcctgagcccctttgccatcacctacctggaccggctgctgctgatgcaccccaacctgaccaagggcttcggcatgattggccccaaggacttcttccccctgctggactttgcctacatgcccaacaacagcctgacccccagcctgcaggagcagctgtgccagctgtacccccggctgaaggtgctggcctttggagccaagccagacagcaccctgcacacctacttccccagcttcctgagccgggccacccccagctgccccccagagatgaagaaggagctgctgagcagcctgacagagtgcctgactgtggaccccctgagcgcctctgtgtggaggcagctgtaccccaagcacctgagccagagcagcctgctgctggagcacctgctgagctcctgggagcagatccccaagaaggtgcagaagagcctgcaggagaccatccagagcctgaagctgaccaaccaggagctgctgaggaagggcagcagcaacaaccaggatgtggtgacctgtgacatggcctgcaagggcctgctgcagcaggtgcagggcccccggctgccctggacccggctgctgctgctgctgctggtgtttgctgtgggcttcctgtgccacgacctgcggagccacagcagcttccaggccagcctgaccggccgcctgctgcggagcagcggcttcctgcctgccagccagcaggcctgtgccaagctgtacagctacagcctgcagggctacagctggctgggggagaccctgcccctgtggggcagccacctgctgactgtggtgcggcccagcctgcagctggcctgggcccacaccaatgccaccgtgtccttcctgagcgcccactgtgccagccacctggcctggtttggagacagcctgaccagcctgagccagaggctgcagatccagctgcctgacagcgtgaaccagctgctgcgctacctgcgggagctgcccctgctcttccaccagaatgtgctgctgcccctgtggcacctgctgctggaggccctggcctgggcccaggagcactgccacgaggcctgccgcggggaggtgacctgggactgcatgaagacccagctgtctgaggccgtgcactggacctggctgtgcctgcaggacatcaccgtggccttcctggactgggccctggccctgatcagccagcagtag

SEQ ID NO: 39392 - DNA, 483 bp, Artificial Sequence
  Description of Artificial Sequence: Synthetic coding sequence
atggccaccaagacagctggggtgggccgctgggaggtggtgaagaagggccggcggcctggggtgggcgctggggccggcggccggggcggcggcaggaacagaagagccctgggggaggccaacggggtgtggaagtatgacctgaccccagccatccagaccaccagcaccctgtatgaaagaggatttgagaacatcatgaagaggcagaacaaggagcaggtgcccccacctgctgtggagcccaagaagccaggcaacaagaagcagcccaagaaggtggccaccccacccaaccagaaccagaagcagggccgcttccgcagcctggaggaggccctgaaggccctggatgtggccgacctgcagaaggagctggacaagagccagagcgtcttcagcggcaaccccagcatctggctgaaggacctggccagctacctgaactacaagctgcaggcccctgagcagcctgactag

SEQ ID NO: 39393 - DNA, 1290 bp, Artificial Sequence
  Description of Artificial Sequence: Synthetic coding sequence
atgtgggccctgggccaggccggctttgccaacctgacagagggcctgaaggtgtggctgggcatcatgctgcctgtgctgggcatcaagagcctgagcccctttgccatcacctacctggaccggctgctgctgatgcaccccaacctgaccggcctgcggcatgactggccccagggcctgctgcccaccagcggcctgtgcctgtatgcagagcagctgcctgacacccagcctgctggggcctgccagctgtacccccggctgaaggtgctggccttcggggccaagccagacagcaccctgcacacctacttccccagcttcctgagccgggccacccccagctgccccccagagatgaagaaggagctgctgagcagcctgacagaatgtctgactgtggaccccctgagcgcctctgtgtggaggcagctgtaccccaagcacctgagccagagcagcctgctgctggagcacctgctgagctcctgggagcagatccccaagaaggtgcagaagagcctgcaggagaccatccagagcctgaagctgaccaaccaggagctgctgaggaagggcagcagcaacaaccaggatgtggtgacctgtgacatggcctgcaagggcctgctgcagcaggtgcagggcccccggctgccctggacccggctgctgctgctgctgctggtgtttgctgtgggcttcctgtgccacgacctgcggagccacagcagcttccaggccagcctgaccggccgcctgctgcggagcagcggcttcctgcctgccagccagcaggcctgtgccaagctgtacagctacagcctgcagggctacagctggctgggggagaccctgcccctgtggggcagccacctgctgactgtggtgcggcccagcctgcagctggcctgggcccacaccaatgccaccgtgtccttcctgagcgcccactgtgccagccacctggcctggtttggagacagcctgaccagcctgagccagaggctgcagatccagctgcctgattctgtgaaccagctgctgcgctacctgcgggagctgcccctgctcttccaccagaatgtgctgctgcccctgtggcacctgctgctggaggccctggcctgggcccaggagcactgccacgaggcctgccgcggggaggtgacctgggactgcatgaagacccagctgtctgaggccgtgcactggacctggctgtgcctgcaggacatcaccgtggccttcctggactgggccctggccctgatcagccagcagtag

SEQ ID NO: 39394 - DNA, 708 bp, Artificial Sequence
  Description of Artificial Sequence: Synthetic coding sequence
atgaggccagatgacatcaaccccaggacaggcctggtggtggccctggtgtctgtgttcctggtgtttggcttcatgttcaccgtgtctggcatgaagggggagaccctgggcaacatccccctgctggccatcggccctgccatctgcctgcccggcattgctgccatcgccctggccaggaagacagagggctgcaccaagtggccagaaaatgagctgctgtgggtgaggaagctgccctgcttcaggaagcccaaggacaaggaggtggtggagctgctgcggacccccagcgacctggagagcggcaagggcagcagtgatgagctggccaagaaggccggcctgcggggcaagcccccaccccagagccagggcgaggtgtctgtggccagcagcatcaacagccccacccccacagaggagggggagtgccagagcctggtgcagaatggccaccaggaggagaccagccgctacctggatggctactgccccagcggcagcagcctgacctacagcgccctggatgtgaagtgcagcgcccgggacagaagtgagtgcccagagccagaagattccatcttctttgtgccccaggacagcatcatcgtgtgcagctacaagcagaacagcccctatgaccgctactgctgctacatcaaccagatccagggccgctgggaccacgagaccatcgtgtag

SEQ ID NO: 39395 - DNA, 690 bp, Artificial Sequence
  Description of Artificial Sequence: Synthetic coding sequence
atgaagcagcagcagtggtgtggcatgacagccaagatgggcaccgtgctgagcggggtcttcaccatcatggctgtggacatgtacctgatctttgagcagaagcacctgggcaatggcagctgcacagagatcacccccaagtacagaggagccagcaacatcatcaacaacttcatcatctgctggagcttcaagatcgtgctcttcctgtccttcatcaccatcctgatcagctgcttcctgctgtacagcgtgtatgcccagatcttccggggcctggtgatctacatcgtgtggatcttcttctatgaaacagccaacgtggtgatccagatcctgaccaacaatgactttgacatcaaggaggtgcgcatcatgcgctggtttggcctggtgtccaggacagtgatgcactgcttctggatgttctttgtgatcaactatgcccacatcacctacaagaacagaagccagggcaacatcatctcctacaagaggcgcatcagcacagctgagatcctgcacagcaggaacaagaggctgagcatcagcagcggcttcagcggcagccacctggagagccagtactttgagcggcagagcttccacaccagcatcttcacctgcctgagccctgtgcccagcagcgcccccagcacctgccgctacaccattgatgtgtgctag

SEQ ID NO: 39396 - DNA, 636 bp, Artificial Sequence
  Description of Artificial Sequence: Synthetic coding sequence
atgaagcagcagcagtggtgtggcatgacagccaagatgggcaccgtgctgagcggggtcttcaccatcatggctgtggacatgtacctgatctttgagcagaagcacctgggcaatggcagctgcacagagatcacccccaagtacagaggagccagcaacatcatcaacaacttcatcatctgctggagcttcaagatcgtgctcttcctgtccttcatcaccatcctgatcagctgcttcctgctgtacagcgtgtatgcccagatcttccggggcctggtgatctacatcgtgtggatcttcttctatgaaacagccaacgtggtgatccagatcctgaccaacaatgactttgacatcaaggaggtgcgcatcatgcgctggtttggcctggtgtccaggacagtgatgcactgcttctggatgttctttgtgatcaactatgcccacatcacctacaagaacagaagccagggcaacatcatctcctacaagaggcgcatcagcacagctgagatcctgcacagcaggaacaagaggctgagcatcagcagcggcttcagcggcagccacctggagagccagtactttgagcggcagaggcgctgcagcggcaagaccagcatcaagtag

SEQ ID NO: 39397 - DNA, 348 bp, Artificial Sequence
  Description of Artificial Sequence: Synthetic coding sequence
atggccggcaccgtgctgggcgtgggcgctggggtcttcatcctggccctgctgtgggtggccgtgctgctgctgtgtgtgctgctgagccgggccagcggggccgcccgcttcagcgtcatcttcctgttctttggagctgtgatcatcacctctgtgctgctgctcttcccccgggccggggagttccctgcccctgaggtggaggtgaagatcgtggatgacttcttcatcggccgctacgtgctgctggccttcctgagcgccatcttcctgggcggcctcttcctggtgctgatccactacgtgctggagcccatctatgccaagcccctgcacagctactag

SEQ ID NO: 39398 - DNA, 348 bp, Artificial Sequence; identical to SEQ ID NO: 39397
  Description of Artificial Sequence: Synthetic coding sequence

SEQ ID NO: 39399 - DNA, 348 bp, Artificial Sequence; identical to SEQ ID NO: 39397
  Description of Artificial Sequence: Synthetic coding sequence

SEQ ID NO: 39400 - DNA, 348 bp, Artificial Sequence; identical to SEQ ID NO: 39397
  Description of Artificial Sequence: Synthetic coding sequence

SEQ ID NO: 39401 - DNA, 348 bp, Artificial Sequence; identical to SEQ ID NO: 39397
  Description of Artificial Sequence: Synthetic coding sequence

SEQ ID NO: 39402 - DNA, 348 bp, Artificial Sequence; identical to SEQ ID NO: 39397
  Description of Artificial Sequence: Synthetic coding sequence

SEQ ID NO: 39403 - DNA, 348 bp, Artificial Sequence; identical to SEQ ID NO: 39397
  Description of Artificial Sequence: Synthetic coding sequence

SEQ ID NO: 39404 - DNA, 348 bp, Artificial Sequence; identical to SEQ ID NO: 39397
  Description of Artificial Sequence: Synthetic coding sequence

SEQ ID NO: 39405 - DNA, 723 bp, Artificial Sequence
  Description of Artificial Sequence: Synthetic coding sequence
atgggcaactgccaggccggccacaacctgcacctgtgcctggcccaccacccccccctggtgtgtgccaccctcatcctgctgctgctgggcctgagcggcctgggcctgggcagcttcctgctgacccacaggacaggcctgcggagcccagacatcccccaggactgggtgtccttcctgcggagctttggccagctgaccctgtgccccagaaatggaacagtgacaggcaagtggaggggcagccacgtggtgggcctgctgaccaccctgaactttggagatggccctgacaggaacaagaccaggaccttccaggccaccgtgctgggcagccagatgggcctgaagggcagcagcgctggccagctggtgctgatcacagcccgggtgaccacagagaggacagctggcacctgcctgtacttctctgctgtgcccggcatcctgcccagcagccagccccccatcagctgcagcgaggagggcgctggaaatgccaccctgagccccaggatgggagaagaatgtgtgtctgtgtggagccatgagggcctggtgctgaccaagctgctgaccagcgaggagctggccctgtgtggcagccggctgctggtgctgggcagcttcctgctgctcttctgtggcctgctgtgctgcgtgacagccatgtgcttccacccccggcgggagagccactggagcaggacccggctgtag

SEQ ID NO: 39406 - DNA, 723 bp, Artificial Sequence; identical to SEQ ID NO: 39405
  Description of Artificial Sequence: Synthetic coding sequence

SEQ ID NO: 39407 - DNA, 1239 bp, Artificial Sequence
  Description of Artificial Sequence: Synthetic coding sequence
atggacaccagccccagcaggaagtaccctgtgaagaagagggtgaagatccaccccaacacagtgatggtgaagtacaccagccactacccccagcctggagatgatggctatgaggagatcaatgaaggctacggcaacttcatggaggagaaccccaagaagggcctgctgtctgagatgaagaagaagggccgggccttcttcggcaccatggacaccctgcccccacccacagaggaccccatgatcaatgaaattggccagttccagagctttgctgagaagaacatcttccagagcaggaagatgtggatcgtgctgtttggaagtgccctggcccacggctgtgtggccctgatcacccggctggtgtctgacaggagcaaggtgcccagcctggagctgatcttcatccgctctgtgttccaggtgctgtctgtgctggtggtgtgctactaccaggaggcccccttcggccccagcggctaccgcctgcggctcttcttctatggagtgtgcaacgtcatcagcatcacctgtgcctacaccagcttcagcatcgtgccccccagcaatggcaccaccatgtggagggccaccaccaccgtcttcagcgccatcctggccttcctgctggtggatgagaagatggcctacgtggacatggccaccgtggtgtgcagcatcctgggcgtgtgcctggtgatgatccccaacatcgtggatgaggacaacagcctgctgaatgcctggaaggaggccttcggctacaccatgacagtgatggccggcctgaccacagccctgtccatgattgtgtaccgcagcatcaaggagaagatctccatgtggacagccctcttcaccttcggctggacaggcaccatctggggcatcagcaccatgttcatcctgcaggagcccatcatccccctggatggagagacctggagctacctgattgccatctgtgtgtgcagcacagctgccttcctgggcgtgtactatgccctggacaagttccacccagccctggtgtccacagtgcagcacctggagatcgtggtggccatggtgctgcagctgctggtgctgcacatcttccccagcatctatgatgtgtttggaggagtcatcatcatgatctctgtgtttgtgctggccggctacaagctgtactggaggaacctgaggaagcaggactaccaggagatcctggacagccccatcaagtag

SEQ ID NO: 39408 - DNA, 1239 bp, Artificial Sequence; identical to SEQ ID NO: 39407
  Description of Artificial Sequence: Synthetic coding sequence

SEQ ID NO: 39409 - DNA, 483 bp, Artificial Sequence
  Description of Artificial Sequence: Synthetic coding sequence
atggccccagccctgtggagggcctgcaatggcctgatggccgccttctttgccctggccgccctggtgcaggtgaatgaccctgatgctgaggtgtgggtggtggtgtacaccatcccagctgtgctgaccctgctggtgggcctgaaccctgaggtgactggaaatgtcatctggaagagcatcagcgccatccacatcctcttctgcaccgtgtgggccgtgggcctggccagctacctgctgcacaggacccagcagaacatcctgcacgaggaggagggccgggagctgagcggcctggtgatcatcacagcctggatcatcctgtgccacagcagcagcaagaaccctgtgggcggccgcatccagctggccatcgccatcgtcatcaccctcttccccttcatctcctgggtgtacatctacatcaacaaggagatgaggagctcctggcccacccactgcaagacagtcatctag

SEQ ID NO: 39410 - DNA, 453 bp, Artificial Sequence
  Description of Artificial Sequence: Synthetic coding sequence
atggccccagccctgtggagggcctgcaatggcctgatggccgccttctttgccctggccgccctggtgcaggtggtgtacaccatcccagctgtgctgaccctgctggtgggcctgaaccctgaggtgactggaaatgtcatctggaagagcatcagcgccatccacatcctcttctgcaccgtgtgggccgtgggcctggccagctacctgctgcacaggacccagcagaacatcctgcacgaggaggagggccgggagctgagcggcctggtgatcatcacagcctggatcatcctgtgccacagcagcagcaagaaccctgtgggcggccgcatccagctggccatcgccatcgtcatcaccctcttccccttcatctcctgggtgtacatctacatcaacaaggagatgaggagctcctggcccacccactgcaagacagtcatctag

SEQ ID NO: 39411 - DNA, 603 bp, Artificial Sequence
  Description of Artificial Sequence: Synthetic coding sequence
atgaagcagtaccagggcagcggaggagtggccatggatgtggagaggagccgcttcccctactgtgtggtgtggacccccatccctgtgctgacctggttcttccccatcatcggccacatgggcatctgcaccagcactggagtcatccgggactttgctggcccctactttgtgtctgaggacaacatggccttcggcaagccagccaagtgccacctgcaggaggccttcagccaccccatcctggtgcgcagcggctgccacaacaagatcagcagcatcggctactggaagctggaccctgcccaggtgtatgccagcggccccaatgcctgggacacagctgtgcatgatgccagcgaggagtacaagcacaggatgcacaacctgtgctgtgacaactgccacagccacgtggccctggccctgaacctgatgagatacaacaacagcaccaactggaacatggtgaccctgtgcttcttctgcctgctgtatggcaagtatgtgtctgtgggcgcctttgtgaagacctggctgcccttcatcctgctgctgggcatcatcctgactgtgtccctggtgttcaacctgaggtag

SEQ ID NO: 39412 - DNA, 627 bp, Artificial Sequence
  Description of Artificial Sequence: Synthetic coding sequence
atggccgaggccgagggcagcagcctgctgctgctgcccccacctcctcctccacccaggatggccgaggtggaggcccccacagctgctgagacagacatgaagcagtaccagggcagcggcggcgtggccatggatgtggagaggagccgcttcccctactgtgtggtgtggacccccatccctgtgctgacctggttcttccccatcatcggccacatgggcatctgcaccagcactggagtcatccgggactttgctggcccctactttgtgtctgaggacaacatggccttcggcaagccagccaagtactggaagctggaccctgcccaggtgtatgccagcggccccaatgcctgggacacagctgtgcatgatgccagcgaggagtacaagcacaggatgcacaacctgtgctgtgacaactgccacagccacgtggccctggccctgaacctgatgagatacaacaacagcaccaactggaacatggtgaccctgtgcttcttctgcctgctgtatggcaagtatgtgtctgtgggcgcctttgtgaagacctggctgcccttcatcctgctgctgggcatcatcctgactgtgtccctggtgttcaacctgaggtag

SEQ ID NO: 39413 - DNA, 609 bp, Artificial Sequence
  Description of Artificial Sequence: Synthetic coding sequence
atggccgccccctggaggcgctggcccaccggcctgctggccgtgctgcggcccctgctgacctgccggcccctgcagggcaccaccctgcagagagatgtgctgctgtttgaacatgaccggggccgcttcttcaccatcctgggcctcttctgtgccggccagggcgtcttctgggcctccatggctgtggccgctgtgtcccggccccctgtgcctgtgcagcccctggatgctgaggtgcccaacagaggcccctttgacctgcggagcgccctgtggaggtatggcctggccgtgggctgtggggccatcggggccctggtgctgggcgccggcctgctcttcagcctgcggtctgtgcgctctgtggtgctgcgggccggcggccagcaggtgaccctgaccacccacgcccccttcggcctgggcgcccacttcaccgtgcccctgaagcaggtgtcctgcatggcccacagaggagaggtgcctgccatgctgcccctgaaggtgaagggccgccgcttctacttcctgctggacaagacaggccacttccccaacaccaagctgtttgacaacacagtgggcgcctaccgcagcctgtag

SEQ ID NO: 39414 - DNA, 678 bp, Artificial Sequence
  Description of Artificial Sequence: Synthetic coding sequence
atggtgcacgtgagcaacagaagcatccagggcatgaacatcctcttcagctcctgggccgtggtgctgatggtgatgggcatcaccctggacaagtgggtggagctgatcagtgaagatgagcgggccaagatgaaccacagcccctggatgatgtgctgcccagccctgtggccagaagatgacctgaaggtggtgcgcatcatgatgaccagcagcctgggcctgtccttcctgctgaacctgatcctgggcatgaagttcacctacctgatcccccagaacaagtacatccagctgttcaccaccatcctgtccttcttcagcggcatcagcctgctgtgggccctgatcctgtaccacaacaagctgaagcagggccagagcatgcacttcagcaactaccgcatcacctggatcatgtacacagcctacctgaatgtgttcttcctgtctgtgtgtggggtgctgagcctgctggagtgcaagctgagcaccagcagctgcacctgcctgaacatccacaagagtgacaatgaatgcaaggagagtgaaaattccattgaggacatcagcctgcctgaatgtacagccatgcccaggagcatcgtgcgggcccacacagtgaacagcctgaacaagaaggtgcagaccaggcatgtgacctgggccctgtag

SEQ ID NO: 39415 - DNA, 1143 bp, Artificial Sequence
  Description of Artificial Sequence: Synthetic coding sequence
atggccggcagtgatgtggacagcgagggccctgccaggagaggaggagctgcccggcggcctggggcccctgggggccctggcagcgaggccgctgctggctgcccagagcccctgagcacagctgaggccccagctgagagcgccaccctgcctgcctggatgaggctgtacttctacggcatgcacggcatcaccctggatgtgctggtgtcctctgccaggagatttgcccggagcccagacctgaggatgctgggcttcagcagcccctaccgctgcctgctgcacagcctgacccactttgccctggagaaggtgtacctgcagcagaggcgctgccccaatgcctttgtgttcaacttcctgctgtaccccagcgcccacgtgggcctgcagaccctggccggccaggccctgctgctgagcctgggcggcggggccggcgtggccgtggcccctggggccctggacctggccctgcagtatgtgctggccctgtaccactgccaggtgttcctgaagcgcttcctgcggctgcgctatggccggcagaggcggcggcagcagcagcagcagcagcagcagcagcagcagcagaggagaggagccctgcctgtgcccccaggggcccgggtgcccacagctgctggggccaggagaagaagaccccggggccccaggggggccggcggggcccccagccagggcctgcctgacctgccccgcttcctgttcttcggcatgcacggcttcctggatgagatcttcttcaccttcttcttcaacgtgctgggccagggagatggcaccaccagcggccacaccagcctgtggagcttcttcatgtatggcagctgcagctttgtggtggagaagctgtacttccacctgcactacagccggggctggggcacctggaagagggtgcccatctacgtgatcttcatctacgtgtgggagctgtcctggggcctgggcctgcggacctgtggggcctgctcctgggactacagccactaccccctgaacttcatgggcctcatcaccctgatgtacctgcccggctggatcttcctgtctgtgtaccaggacctgatcagcaatgtgctgtggagggtgcagtatgtgcctgccaactag

SEQ ID NO: 39416 - DNA, 504 bp, Artificial Sequence
  Description of Artificial Sequence: Synthetic coding sequence
atggccagcgctgagcccctgacagccctgagccgctggtacctgtatgccatccacggctacttctgtgaggtgatgttcaccgctgcctgggagtttgtggtgaacctgaactggaagtttcctggggtgacctctgtgtgggccctcttcatctacggcaccagcatcctgattgtggagaggatgtacctgcggctgcggggccgctgccccctgctgctgcgctgcctgatctacaccctgtggacctacctgtgggagttcaccaccggcttcatcctgcggcagttcaatgcctgcccctgggactacagccagtttgattttgacttcatgggcctcatcaccctggagtatgctgtgccctggttctgtggggccctgatcatggagcagttcatcatccggaacaccctgcggctgcgctttgacaaggatgctgagcccggggagcccagcggggccctggccctggccaatggacatgtgaagacagactag

SEQ ID NO: 39417 - DNA, 405 bp, Artificial Sequence
  Description of Artificial Sequence: Synthetic coding sequence
atggccagcgctgagcccctgacagccctgagccgctggtacctgtatgccatccacggctacttctgtgaggtgatgttcaccgctgcctgggagtttgtggtgaacctgaactggaagtttcctggggtgacctctgtgtgggccctcttcatctacggcaccagcatcctgattgtggagaggatgtacctgcggctgcggggccgctgccccctgctgctgcgctgcctgatctacaccctgtggacctacctgtgggagttcaccaccggcttcatcctgcggcagttcaatgcctgcccctgggactacagccagtttgattttgacttcatgggcctcatcaccctggagtatgctgtgccctggttctgtggggccctgatcatggagcagttctag

SEQ ID NO: 39418 - DNA, 240 bp, Artificial Sequence
  Description of Artificial Sequence: Synthetic coding sequence
atggccagcgctgagcccctgacagccctgagccgctggtacctgtatgccatccacggctacttctgtgaggtgatgttcaccgctgcctgggagtttgtggtgaacctgaactggaagtttcctggggtgacctctgtgtgggccctcttcatctacggcaccagcatcctgattgtggagaggatgtacctgcggctgcggggccgctgccccctgctgctgcgctgcctgatctag

SEQ ID NO: 39419 - DNA, 504 bp, Artificial Sequence; identical to SEQ ID NO: 39416
  Description of Artificial Sequence: Synthetic coding sequence

SEQ ID NO: 39420 - DNA, 171 bp, Artificial Sequence
  Description of Artificial Sequence: Synthetic coding sequence
atggccagcgctgagcccctgacagccctgagccgctggtacctgtatgccatccacggctacttctgtgaggtgatgttcaccgctgcctgggagtttgtggtgaacctgaactggaagtttcctggggtgacctctgtgtgggccctcttcatctacggcaccagctag

SEQ ID NO: 39421 - DNA, 504 bp, Artificial Sequence; identical to SEQ ID NO: 39416
  Description of Artificial Sequence: Synthetic coding sequence

SEQ ID NO: 39422 - DNA, 168 bp, Artificial Sequence
  Description of Artificial Sequence: Synthetic coding sequence
atggccagcgctgagcccctgacagccctgagccgctggtacctgtatgccatccacggctacttctgtgaggtgatgttcaccgctgcctgggagtttgtggtgaacctgaactggaagtttcctggggtgacctctgtgtgggccctcttcatctacggcacctag

SEQ ID NO: 39423 - DNA, 951 bp, Artificial Sequence
  Description of Artificial Sequence: Synthetic coding sequence
atggccctgtatgagctgttcagccaccctgtggagaggagctacagagctggcctgtgcagcaaggccgccctcttcctgctgctggccgccgccctgacctacatcccccccctgctggtggccttccgcagccacggcttctggctgaagaggagcagctatgaggagcagcccaccgtgcgcttccagcaccaggtgctgctggtggccctgctgggccctgagagtgatggcttcctggcctggagcaccttccctgccttcaaccggctgcagggcgaccggctgcgggtgcccctggtgtccacccgggaggaggacaggaaccaggacggcaagacagacatgctgcacttcaagctggagctgcccctgcagagcacagaacatgtgctgggcgtgcagctgatcctgaccttctcctaccgcctgcacaggatggccaccctggtgatgcagagcatggccttcctgcagagcagcttccctgtgcccggcagccagctgtatgtgaatggagacctgcggctgcagcagaagcagcccctgagctgtggcggcctggatgcccgctacaacatcagcgtcatcaatggcaccagcccctttgcctatgactatgacctgacccacatcgtggccgcctaccaggagagaaatgtgaccaccgtgctgaatgaccccaaccccatctggctggtgggccgggctgctgatgccccctttgtgatcaatgccatcatccgctaccctgtggaggtgatctcctaccagcccggcttctgggagatggtgaagtttgcctgggtgcagtatgtgtccatcctgctgatcttcctgtgggtgtttgagcgcatcaagatctttgtgttccagaaccaggtggtgaccaccatccctgtgacagtgacccccaggggggacctgtgcaaggagcacctgtcctag

SEQ ID NO: 39424 - DNA, 1038 bp, Artificial Sequence
  Description of Artificial Sequence: Synthetic coding sequence
atgagcagcagcctgaccaggagcagcgctgtgacagcccggggcagcgcccccaagccccgctgcagctgctgctggcccctgcggagcaggaccagccgccgctgctggtggcccagcggggccaccgtgtccctgccccggcccctgtgccacgaggccccccgggcccggagcgcccgggccggcctgcccaaccggctgcccacagccctcttcaacagcggcttctggctgaagaggagcagctatgaggagcagcccaccgtgcgcttccagcaccaggtgctgctggtggccctgctgggccctgagagtgatggcttcctggcctggagcaccttccctgccttcaaccggctgcagggcgaccggctgcgggtgcccctggtgtccacccgggaggaggacaggaaccaggacggcaagacagacatgctgcacttcaagctggagctgcccctgcagagcacagagcacgtgctgggcgtgcagctgatcctgaccttctcctaccgcctgcacaggatggccaccctggtgatgcagagcatggccttcctgcagagcagcttccctgtgcccggcagccagctgtatgtgaatggagacctgcggctgcagcagaagcagcccctgagctgtggcggcctggatgcccgctacaacatcagcgtcatcaatggcaccagcccctttgcctatgactatgacctgacccacatcgtggccgcctaccaggagagaaatgtgaccaccgtgctgaatgaccccaaccccatctggctggtgggccgggcagcagatgcccccttcgtcatcaatgccatcatccgctaccctgtggaggtgatctcctaccagcccggcttctgggagatggtgaagtttgcctgggtgcagtatgtgtccatcctgctgatcttcctgtgggtgtttgagcgcatcaagatctttgtgttccagaaccaggtggtgaccaccatccctgtgacagtgacccccaggggggacctgtgcaaggagcacctgtcctag

SEQ ID NO: 39425 - DNA, 1521 bp, Artificial Sequence
  Description of Artificial Sequence: Synthetic coding sequence
atgaacatgcctgtgaacaagagccccatgatcaacacctgtggcggcatcagcagcccctaccacgaggagctgtggaagctgaacttccagcacctgagcggggagcggggccacaagagccggcccaccttcagcatcaccaaggagttcatcctgcgcttcaaccagacccagaacagcaaggagaaggaggagctgctggagctggccaggaagatcatcctgcgctgcaagaggaagctgggcctgaagaccctgggcagcggccgccacgtgcacctgcctgctgcctggacagaggtgatctacctggcccagtgcaagggggagatccaggatgagagcctgaacatgctgtatgccagcctggaccacgccagctttgattatgaccacctgcctgccctcttctttgtggccgagagcgtgctgtaccgcctgtgctgtgatgccagcctgaagacctacctgtacagcgtggagatcaagctggccaagattggctacctggtgttcctgcggctcttcatcttcttcctgcacggccacctggagagcttcaagcagcacctgctgcggctgcagccctacctgtatgccctgtccttcagcggggccagctaccacaagtaccccaacatcttcagcaatgtgcagttcatcctgaaggccagcgagatcatcggcaagcgggagctgcggtctgagagcatcttccggcctgtggaggacaagaagagatatgagaacacagacagcgacatgggcggctatgagatcaaccacctgctgtggcactgtgtggccgcctggagctgtgtgcagaacaacagcccccagctgaacaacgtgctggagcacctggtgttccacaagacccagctgcagaagaagtgctggctggacagcgtgctggccctgctggtgctgggggaggccgccaagctgaacatggcctgcctgaaggccctgatggatgtggtgcgggactttgtgagcagcatcatgtctgtgcagaaccaggaggagagctgcaaggtggatgacttctcctgggcctggaatgtggtgtacatctacaccgtcatcctggccgagatctgcctgtatgctgccaccagtgacctgaggaagacagccctgattggcttctgccactgcaagagcagccagaagaacatcctgtacctggacaagtctgtgcccccagagctgaaggagaccagcatcctgagcctgctggagtacttcagcagcaagatgtctgagaactgtgaccaggtggtgtggacaggctactacggcctggtgtacaacctggtgaagatctcctgggagctgcagggagatgaggagcaggacggcctgaggaacatgatctggcagaccctgcagaagaccaaggactatgaagaagatgtgcgcatccagaatgccatcaacatcgcccagggcaccagcttctgcatccggaacagccacgtgtccatcagccgcttcctgcaccagggccgctag

SEQ ID NO: 39426 - DNA, 1974 bp, Artificial Sequence
  Description of Artificial Sequence: Synthetic coding sequence
atgaacatgcctgtgaacaagagccccatgatcaacacctgtggcggcatcagcagcccctaccacgaggagctgtggaagctgaacttccagcacctgagcggggagcggggccacaagagccggcccaccttcagcatcaccaaggagttcatcctgcgcttcaaccagacccagaacagcaaggagaaggaggagctgctggagctggccaggaagatcatcctgcgctgcaagaggaagctgggcctgaagaccctgggcagcggccgccacgtgcacctgcctgctgcctggacagaggtgatctacctggcccagtgcaagggggagatccaggatgagagcctgaacatgctgtatgccagcctggaccacgccagctttgattatgaccacctgcctgccctcttctttgtggccgagagcgtgctgtaccgcctgtgctgtgatgccagcctgaagacctacctgtacagcgtggagatcaagctggccaagattggctacctggtgttcctgcggctcttcatcttcttcctgcacggccacctggagagcttcaagcagcacctgctgcggctgcagccctacctgtatgccctgtccttcagcggggccagctaccacaagtaccccaacatcttcagcaatgtgcagttcatcctgaaggccagcgagatcatcggcaagcgggagctgcggtctgagagcatcttccggcctgtggaggacaagaagagatatgagaacacagacagcgacatgggcggctatgagatcaaccacctgctgtggcactgtgtggccgcctggagctgtgtgcagaacaacagcccccagctgaacaacgtgctggagcacctggtgttccacaagacccagctgcagaagaagtgctggctggacagcgtgctggccctgctggtgctgggggaggccgccaagctgaacatggcctgcctgaaggccctgatggatgtggtgcgggactttgtgagcagcatcatgtctgtgcagaaccaggaggagagctgcaaggtggatgacttctcctgggcctggaatgtggtgtacatctacaccgtcatcctggccgagatctgcctgtatgctgccaccagtgacctgaggaagacagccctgattggcttctgccactgcaagagcagccagaagaacatcctgtacctggacaagtctgtgcccccagagctgaaggagaccagcatcctgagcctgctggagtacttcagcagcaagatgtctgagaactgtgaccaggtggtgtggacaggctactacggcctggtgtacaacctggtgaagatctcctgggagctgcagggagatgaggagcaggacggcctgaggaacatgatctggcagaccctgcagaagaccaaggactatgaagaagatgtgcgcatccagaatgccatcaacatcgcccaggccgagctgaatgaccccacagaccccttcacccgctacagcaccaacatcagcagcaatgtgggggaggaggtgttcagcaagtacatcggctggagaattgccaacaccctgagcaagctgttcttcccccccatcgaggcccacttcctgcccctgaagaagcccagcatcaagaaggaccagaccaagtaccccaacaagaagctggagagcgtgaagaagcaggtgctgcacttcaccgtgcgggagcaccccagcgtgtctgagatccccatgttcccctacccagacttcttcaccaaggctgacaaggagctggccaagatcatcgaccaccactggcaggaggagctgaagatccgggagaaggaggatgccatctgcaaggcccaggagctgaaggacaagaagctggccgagaagaaccacttccaggaggtgatgaagaagcgggaggagaagctgcacaagcagaccaagccctatgagctgccctacaggaaggaggtgatctag

SEQ ID NO: 39427 - DNA, 330 bp, Artificial Sequence
  Description of Artificial Sequence: Synthetic coding sequence
atgagccagtatgcccccagcccagacttcaagagggccctggacagcagccctgaggccaacacagaagatgacaagacagaagaagatgtgcccatgcccaagaactacctgtggctgaccatcgtgtcctgcttctgcccagcctaccccatcaacatcgtggccctggtgttcagcatcatgagcctgaacagctacaatgatggagactatgagggcgcccggcggctgggcagaaatgccaagtgggtggccatcgccagcatcatcatcggcctgctgatcatcggcatcagctgtgctgtgcacttcaccagaaatgcctag

SEQ ID NO: 39428 - DNA, 423 bp, Artificial Sequence
  Description of Artificial Sequence: Synthetic coding sequence
atggccgccagcctgggccaggtgctggccctggtgctggtggccgccctgtggggcggcacccagcccctgctgaagagggccagcgctggcctgcagagggtgcatgagcccacctgggcccagcagctgctgcaggagatgaagaccctcttcctgaacacagagtacctgatgcccttcctgctgaaccagtgtggcagcctgctgtactacctgaccctggccagcacagacctgaccctggccgtgcccatctgcaacagcctggccatcatcttcaccctgattgtgggcaaggccctgggggaggacatcggcggcaagagagctgtggccggcatggtgctgaccgtcatcggcatcagcctgtgcatcaccagctctgtgtccaagacccagggccagcagagcaccctgtag

SEQ ID NO: 39429 - DNA, 495 bp, Artificial Sequence
  Description of Artificial Sequence: Synthetic coding sequence
atggccgccagcctgggccaggtgctggccctggtgctggtggccgccctgtggggcggcacccagcccctgctgaagagggccagcgctggcctgcagagggtgcatgagcccacctgggcccagcagctgctgcaggagatgaagaccctcttcctgaacacagagtacctgatgcccttcctgctgaaccagtgtggcagcctgctgtactacctgaccctggccagcacagacctgaccctggccgtgcccatctgcaacagcctggccatcatcttcaccctgattgtgggcaaggccctgggggaggacatcggcggcaagagagctgtggccggcatggtgctgaccgtcatcggcatcagcctgtgcatcaccagctctgtgccctggacagctgagctgcagctgcacggcaagggccagctgcagaccctgagccagaagtgcaagcgggaggccagcggcacccagagcgagagatttggatag

SEQ ID NO: 39430 - DNA, 495 bp, Artificial Sequence; identical to SEQ ID NO: 39429
  Description of Artificial Sequence: Synthetic coding sequence

SEQ ID NO: 39431 - DNA, 495 bp, Artificial Sequence; identical to SEQ ID NO: 39429
  Description of Artificial Sequence: Synthetic coding sequence

SEQ ID NO: 39432 - DNA, 495 bp, Artificial Sequence; identical to SEQ ID NO: 39429
  Description of Artificial Sequence: Synthetic coding sequence

SEQ ID NO: 39433 - DNA, 486 bp, Artificial Sequence
  Description of Artificial Sequence: Synthetic coding sequence
atggccgccagcctgggccaggtgctggccctggtgctggtggccgccctgtggggcggcacccagcccctgctgaagagggccagcgctggcctgcagagggtgcatgagcccacctgggcccagcagctgctgcaggagatgaagaccctcttcctgaacacagagtacctgatgcccttcctgctgaaccagtgtggcagcctgctgtactacctgaccctggccagcacagacctgaccctggccgtgcccatctgcaacagcctggccatcatcttcaccctgattgtgggcaaggccctgggggaggacatcggcggcaagcctgtgctgctgccctgtggccaccagagcagcctgcccctggacagcctggagaaggaccggggctggggcctgggcctgaagacccggccccacctgagccccagcagcagccctgtgcctgcccccaccggcatggccgagctgcggcccagctag

SEQ ID NO: 39434 - DNA, 591 bp, Artificial Sequence
  Description of Artificial Sequence: Synthetic coding sequence
atggcccggctgggcgccctgctgctggccgccgccctgggcgccctgctgagctttgccctgctggccgctgctgtggccagtgactactggtacatcctggaggtggctgatgctggaaatggaagtgcctggccaggccgggcagagctgctgagcagccacagcggcctgtggaggatctgtgaggtgctgcaccgggccgtcatcgtggtgctgcccctgagcctggtgctgctggtgtgtggctggatctgtggcctgctgagcagcctggcccagagcgtgtccctgctgctcttcaccggctgctacttcctgctgggctctgtgctgaccctggccggcgtgtccatctacatctcctacagccacctggcctttgctgagaccgtgcagcagtatggcccccagcacatgcagggcgtgcgggtgtcctttggctggagcatggccctggcctggggcagctgtgccctggaggccttcagcggcaccctgctgctgtctgctgcctggaccctgagcctgagcccccccatctgtggccacctgagcccccagcaggtgggcggccggggcggggactag

SEQ ID NO: 39435 - DNA, 1185 bp, Artificial Sequence
  Description of Artificial Sequence: Synthetic coding sequence
atgcccagcggctggagcagcggcctcatccagaccaggaccccaggccctgcccgggcccggctgctgtgcttccaggagcacggctgggtggtgctgctgcccggccggcccagctcctggggccgcagcctggccgacccccccagcagcagccaggccctgcacagccctgcccggcaggtgcacctggtgtggctgctgcggagccggggcttccgggagatcaaggagcgggcccagggccctggggccagcccctggggccgctgggactggagccccagccccaggtttgctgcccggctgagcaccagcagccccttcccccagggccgggcccagaggccccagagaggaggagtggacctgcctgccacccctgggggcccccggggccagtgtgccggccgctctggagatgtgctgcggcgggccggcagaagaagagcccggcccccacctgtgccccggctgcctgccccccgggccccccggcggccccggggccctgccaccccagaccccagccccccagctggccggccccacggccctgctggccgggccgcccctggccggcggcccggctgcacagcccagctgcgggcccctggaagaagaggccggcagaggctgctggtgcaccctgggggcggcggccggcggcagtggcagaggctggcccgggcccggcgggccgccctgctggccctgggcgccctggcccacctgcggcgctgcccagacacaggaggcggccagcacctgcaccagctgctggcccctggcctgtgtggagatggagctgctgtgtggccagctgcccacgccggccggccccggcagctgcggctggtgcacggccctggcctgggcctgctgtgcctgggcggcatccagaggaaccccccagccctgagctgcctggacccccagcctgagccccccaacctgtggagcagcgagagccctgctgggggccgggagcggggccgcctgcggcccagggctgctgagggccccacccagatcgcctggaggcagagagatgctgtgtctggccagggcctgcccggcctgtgcagcgtgcacagcccccggcgggccggcctggtggagaagaggctgatgaggggccctgagagccccagcgacctgcagggctggggcgcccggagctag

SEQ ID NO: 39436 - DNA, 453 bp, Artificial Sequence
  Description of Artificial Sequence: Synthetic coding sequence
atggcccggctgggcgccctgctgctggccgccgccctgggcgccctgctgagctttgccctgctggccgctgctgtggccagtgactactggtacatcctggaggtggctgatgctggaaatggaagtgcctggccaggccgggcagagctgctgagcagccacagcggcctgtggaggatctgtgagggcgtgctgaccctggccggcgtgtccatctacatctcctacagccacctggcctttgctgagaccgtgcagcagtatggcccccagcacatgcagggcgtgcgggtgtcctttggctggagcatggccctggcctggggcagctgtgccctggaggccttcagcggcaccctgctgctgtctgctgcctggaccctgagcctgagcccccccatctgtggccacctgagcccccagcaggtgggcggccggggcggggactag

SEQ ID NO: 39437 - DNA, 591 bp, Artificial Sequence; identical to SEQ ID NO: 39434
  Description of Artificial Sequence: Synthetic coding sequence

SEQ ID NO: 39438 - DNA, 672 bp, Artificial Sequence
  Description of Artificial Sequence: Synthetic coding sequence
atggcccggctgggcgccctgctgctggccgccgccctgggcgccctgctgagctttgccctgctggccgctgctgtggccagtgactactggtacatcctggaggtggctgatgctggaaatggaagtgcctggccaggccgggcagagctgctgagcagccacagcggcctgtggaggatctgtgagggccagaatggctgcatccccctggtggacccctttgccagcgagagcctggatgtgtccacctctgtgcagcacctgatcctgctgcacagagctgtgattgtggtgctgcccctgagcctggtgctgctggtgtgtggctggatctgtggcctgctgagcagcctggcccagagcgtgtccctgctgctcttcaccggctgctacttcctgctgggctctgtgctgaccctggccggcgtgtccatctacatctcctacagccacctggcctttgctgagaccgtgcagcagtatggcccccagcacatgcagggcgtgcgggtgtcctttggctggagcatggccctggcctggggcagctgtgccctggaggccttcagcggcaccctgctgctgtctgctgcctggaccctgagcctgagcccccccatctgtggccacctgagcccccagcaggtgggcggccggggcggggactag

SEQ ID NO: 39439 - DNA, 453 bp, Artificial Sequence; identical to SEQ ID NO: 39436
  Description of Artificial Sequence: Synthetic coding sequence

SEQ ID NO: 39440 - DNA, 1056 bp, Artificial Sequence
  Description of Artificial Sequence: Synthetic coding sequence
atggccagcggccgcctcatcaagtttgtggtgtttgagctgctggagtttgctgccttcagcatccccaccctggtgatcacagagcagtttgccacagcctaccagggcacccgggcccggagtgacaacacccactactggctgatcatcagctgcagcatcgcctacgtggccctggtgaccctgctgatctgggtgcctgtgaaggtgatcctgcacaagaagcgctacatctacaggaagatcaagggctggaggcctgtgctgatgatgtgtgtggtgctgaccaccctgccctgcctgaccttcagcattgctgtgacagaggtgcagaagagcatcaatggcagcgcagatgtgctgcctgacatgctgcctgacctgcctgtgtccctggtgctgctgagcctcatcatggtggacatcatcgagaagctgcgcatctaccccctgcggggcagccagaagagcagtgaaaatggccacatccacagcaccagcctgcagcacatcaagacagtgacagagcaggtgcggcagagcccagaaaatgctgccagcccccaggccaccaacagcacccaggtgtcccagcccagcggggccatgaccaggagccaggagagcgtcttcatgggcccccaggagcccagctgtgacagcggcatcctgaggatgatgagcagaagagatgtgcgggcagagctgttcctgtggagcttcctgctgtggagcgacaccatcgagatggtgcgggtggccggccaccccaacgtgtacaagagctcctggctgtaccctgtgtacatcttctccttcatcagcctgctgcgcatcaccttcaccccccagaaccccctgctgaacagcctgtctgtgctgctgcaggacctgccctttgtgtttgtgcggctgggcctcatcatcgccctgggcaccatcacccctgtgctgggcctgtgcaagaacatcctggtgaccctgagctacatctacttcaactacctgacccgcatccgcatcttcagcgcctttgagatgagccccttctag

SEQ ID NO: 39441 - DNA, 1056 bp, Artificial Sequence; identical to SEQ ID NO: 39440
  Description of Artificial Sequence: Synthetic coding sequence

SEQ ID NO: 39442 - DNA, 1056 bp, Artificial Sequence; identical to SEQ ID NO: 39440
  Description of Artificial Sequence: Synthetic coding sequence

SEQ ID NO: 39443 - DNA, 1056 bp, Artificial Sequence; identical to SEQ ID NO: 39440
  Description of Artificial Sequence: Synthetic coding sequence

SEQ ID NO: 39444 - DNA, 522 bp, Artificial Sequence
  Description of Artificial Sequence: Synthetic coding sequence
atgtccatgtctgccaacaccatgatcttcatgatcctgggcgcctctgtggtgatggccatcgcctgcctgatggacatgaatgccctgctggaccgcttccacaactacatcctgccccacctgcggggagaagatagagtgtgccactgcaactgtggccgccaccacatccactacgtgatcccctatgatggagaccagagcgtggtggatgccagcgagaactactttgtgacagacagcgtgaccaagcaggagattgacctgatgctgggcctgctgctgggcttctgcatctcctggttcctggtgtggatggatggagtgctgcactgtgctgtgcgggcctggagggctggccgccgctatgatggctcctggacctggctgcccaagctgtgcagcctgcgggagctgggccggcggccccaccggccctttgaggaggccgccggcaacatggtgcacgtgaagcagaagctgtaccacaacggccaccccagccccaggcacctgtag

SEQ ID NO: 39445 - DNA, 522 bp, Artificial Sequence; identical to SEQ ID NO: 39444
  Description of Artificial Sequence: Synthetic coding sequence

SEQ ID NO: 39446 - DNA, 891 bp, Artificial Sequence
  Description of Artificial Sequence: Synthetic coding sequence
atgtgtgtgcggcgcagcctggtgggcctgaccttctgcacctgctacctggccagctacctgaccaacaagtatgtgctgtctgtgctgaagttcacctaccccaccctcttccagggctggcagaccctgattggaggcctgctgctgcacgtgtcctggaagctgggctgggtggagatcaacagcagcagccgcagccacgtgctggtgtggctgcctgcctctgtgctgtttgtgggcatcatctatgccggcagccgggccctgagccggctggccatccctgtgttcctgaccctgcacaacgtggccgaggtgatcatctgtggctaccagaagtgcttccagaaggagaagaccagccctgccaagatctgcagcgccctgctgctgctggccgccgccggctgcctgcccttcaatgacagccagttcaacccagatggctacttctgggccatcatccacctgctgtgtgtgggcgcctacaagatcctgcagaagagccagaagcccagcgccctgagtgacatcgaccagcagtacctgaactacatcttctctgtggtgctgctggcctttgccagccaccccaccggggacctcttctctgtgctggacttccccttcctgtacttctaccgcttccacggcagctgctgtgccagcggcttcctgggcttcttcctgatgttcagcacagtgaagctgaagaacctgctggcccctggccagtgtgccgcctggatcttctttgccaagatcatcacagctggcctgagcatcctgctgtttgatgccatcctgaccagcgccaccaccggctgcctgctgctgggcgccctgggggaggccctgctggtgttttctgagaggaagagcagctag

SEQ ID NO: 39447 - DNA, 372 bp, Artificial Sequence
  Description of Artificial Sequence: Synthetic coding sequence
atgtgtgtgcggcgcagcctggtgggcctgaccttctgcacctgctacctggccagctacctgaccaacaagtatgtgctgtctgtgctgaagttcacctaccccaccctcttccagggcagccacgtgctggtgtggctgcctgcctctgtgctgtttgtgggcatcatctatgccggcagccgggccctgagccggctggccatccctgtgttcctgaccctgcacaacgtggccgaggtgatcatctgtggctaccagaagtgcttccagaaggagaagaccagccctgccaagatctgccgcctgcacctggagaggacccggcagaaccagaccagccggctgagcagctgcctgaagggggactag

SEQ ID NO: 39448 - DNA, 468 bp, Artificial Sequence
  Description of Artificial Sequence: Synthetic coding sequence
atgatcccagatgtgatcagcgccctgctgctgctggccgctgctggctgcctgcccttcaatgacagccagttcaacccagatggctacttctgggccatcatccacctgctgtgtgtgggcgcctacaagatcctgcagaagagccagaagcccagcgccctgagtgacatcgaccagcagtacctgaactacatcttctctgtggtgctgctggcctttgccagccaccccactggagacctcttctctgtgctggacttccccttcctgtacttctaccgcttccacggcagctgctgtgccagcggcttcctgggcttcttcctgatgttcagcacagtgaagctgaagaacctgctggcccctggccagtgtgccgcctggatcttctttgccaagatcatcacagctggcctgagcatcctgctgtttgatgccatcctgaccagcgccaccaccggctag

SEQ ID NO: 39449 - DNA, 507 bp, Artificial Sequence
  Description of Artificial Sequence: Synthetic coding sequence
atgtgtgtgcggcgcagcctggtgggcctgaccttctgcacctgctacctggccagctacctgaccaacaagtatgtgctgtctgtgctgaagttcacctaccccaccctcttccagggctggcagaccctgattggaggcctgctgctgcacgtgtcctggaagctgggctgggtggagatcaacagcagcagccgcagccacgtgctggtgtggctgcctgcctctgtgctgtttgtgggcatcatctatgccggcagccgggccctgagccggctggccatccctgtgttcctgaccctgcacaacgtggccgaggtgatcatctgtggctaccagaagtgcttccagaaggagaagaccagccctgccaagatctgcagcgccctgctgctgctggccgccgccggctgcctgcccttcaatgacagccagttcaacccagatggctacttctgggccatcatccacctgctgtgtgtggtgaccctgaccagcaacacctag

SEQ ID NO: 39450 - DNA, 387 bp, Artificial Sequence
  Description of Artificial Sequence: Synthetic coding sequence
atggagacagctggggccgccaccggccagcctgccagcggcctggaggcccctggcagcaccaatgacaggctcttcctggtgaagggcggcatcttcctgggcaccgtggccgccgccggcatgctggccggcttcatcaccaccctgagcctggccaagaagaagagccctgagtggttcaacaagggctccatggccacagctgccctgcctgagagcggcagcagcctggccctgcgggccctgggctggggcagcctgtatgcctggtgtggggtgggcgtcatcagctttgctgtgtggaaggccctgggcgtgcacagcgtgagcaactactgcctggtgcccggcatctacatgttcatcctgctgaccgtcttctag

SEQ ID NO: 39451 - DNA, 426 bp, Artificial Sequence
  Description of Artificial Sequence: Synthetic coding sequence
atggagacagctggggccgccaccggccagcctgccagcggcctggaggcccctggcagcaccaatgacaggctcttcctggtgaagggcggcatcttcctgggcaccgtggccgccgccggcatgctggccggcttcatcaccaccctgagcctggccaagaagaagagccctgagtggttcaacaagggctccatggccacagctgccctgcctgagagcggcagcagcctggccctgcgggccctgggctggggcagcctgtatgcctggtgtggggtgggcgtcatcagctttgctgtgtggaaggccctgggcgtgcacagcatgaatgacttccgcagcaagatgcagagcatcttccccaccatccccaagaacagcgagagcgctgtggagtgggaggagaccctgaagagcaagtag

SEQ ID NO: 39452 - DNA, 651 bp, Artificial Sequence
  Description of Artificial Sequence: Synthetic coding sequence
atgcccaagggccgggccggcagcctgcccaccaccagcatcggctggaggttccagctgtggttcctgggcctgacctgcccagagcggcacctggcccggcggctgaagaacaacagcttctacccctttgtgcagcaggagcccaacggggctgaggcccgggacctgggcctgccccgggtgagaagaggccggggccctgtggcccgggacctggtggccgctgctgcccctcctggagctgagccccacgccaggagagtgcccctgctgcaccctggcccccaccgggtgcccggccccctggccagcggcctgcgggcccctggggcccagctgcgctgccccaggaaggtgctgctgcccccaggcccccggcggccccaggtgggcgcccctggggccggggctgctgtgggcgccctgcgggccaacggcatcctgggccccctgcacaggcctgagacccagcaccagctgctgcggctgcccggccacctgctgcctgcccggggcagccccctggccaccccctggcgctggcactgtgatggccaggagccccacggcagccaggcccagctgctgtctgtgcagcctggaggagtgaccctgcgggccagccccaccagcggcctgtgcagctag

SEQ ID NO: 39453 - DNA, 672 bp, Artificial Sequence
  Description of Artificial Sequence: Synthetic coding sequence
atggagggcctggtgttcctgaatgccctggccacccggctgctcttcctgctgcacagcctggtgggcgtgtggagggtgacagaggtgaagaaggagccccgctactggctgctggccctgctgaacctgctgctcttcctggagacagccctgaccctgaagttcaagaggggccggggctacaagtggttctccccagccatcttcctgtacctgatcagcatcgtgcccagcctgtggctgctggagctgcaccacgagacccagtactgcagcatccaggccgagggcaccagccagaacaccagcaggaaagaagacttcaaccagaccctgaccagcaatgagcagaccagcagagcagatgacctgattgaaacagccaaggtgtttgtgaacaacctgagcacagtgtgtgagaaggtgtggaccctgggcctgcaccagaccttcctgctgatgctgatcatcggccgctggctgctgcccatcggcggcggcatcacccgggaccagctgagccagctgctgctgatgtttgtgggcacagctgctgacatcctggagttcaccagcgagaccctggaggagcagaatgtgcggctgtgctggaagaacagcaccaacagaagacacaccaaccccaagtggcagctggtgctcttctag

SEQ ID NO: 39454 - DNA, 1107 bp, Artificial Sequence
  Description of Artificial Sequence: Synthetic coding sequence
atggagggcctggtgttcctgaatgccctggccacccggctgctcttcctgctgcacagcctggtgggcgtgtggagggtgacagaggtgaagaaggagccccgctactggctgctggccctgctgaacctgctgctcttcctggagacagccctgaccctgaagttcaagaggggccggggctacaagtggttctccccagccatcttcctgtacctgatcagcatcgtgcccagcctgtggctgctggagctgcaccacgagacccagtactgcagcatccaggccgagggcaccagccagaacaccagcaggaaagaagacttcaaccagaccctgaccagcaatgagcagaccagcagagcagatgacctgattgaaacagccaaggtgtttgtgaacaacctgagcacagtgtgtgagaaggtgtggaccctgggcctgcaccagaccttcctgctgatgctgatcatcggccgctggctgctgcccatcggcggcggcatcacccgggaccagctgagccagctgctgctgatgtttgtgggcacagctgctgacatcctggagttcaccagcgagaccctggaggagcagaatgtgaggaacagccctgccctggtgtatgccatcctggtgatctggacctggagcatgctgcagttccccctggacctggccgtgcagaatgtggtgtgccctgtgtctgtgacagagcggggcttccccagcctcttcttctgccagtacagcgctgacctgtggaacatcggcatcagcgtcttcatccaggacggccccttcctggtggtgcggctcatcctgatgacctacttcaaggtgatcaaccagatgctggtgttctttgctgccaagaacttcctggtggtggtgctgcagctgtaccgcctggtggtgctggccctggccgtgcgggccagcctgcggagccagagcgagggcctgaagggggagcacggctgccgggcccagaccagcgagagcggccccagccagagggactggcagaatgaaagcaaggagggcctggccatccccctgcggggcagccctgtgaccagtgatgacagccaccacaccccctag

SEQ ID NO: 39455 - DNA, 1107 bp, Artificial Sequence; identical to SEQ ID NO: 39454
  Description of Artificial Sequence: Synthetic coding sequence

SEQ ID NO: 39456 - DNA, 507 bp, Artificial Sequence
  Description of Artificial Sequence: Synthetic coding sequence
atgaggctgacagagaagtctgagggggagcagcagctgaagcccaacaacagcaatgccccaaatgaagaccaggaggaggagatccagcagagcgagcagcacaccccagcccggcagaggacccagagagctgacacccagcccagccgctgccgcctgcccagcaggaggacccccaccaccagcagtgacaggaccatcaacctgctggaggtgctgccctggcccacagagtggatcttcaacccctaccgcctgcctgccctgtttgagctgtacccagagttcctgctggtgttcaaggaggccttccatgacatcagccactgcctgaaggcccagatggagaagattggcctgcccatcatcctgcacctgtttgccctgagcaccctgtacttctacaagttcttcctgcccaccatcctgagcctgtccttcttcatcctgctggtgctgctgctgctgctcttcatcatcgtgttcatcctgatcttcttctag

SEQ ID NO: 39457 - DNA, 744 bp, Artificial Sequence
  Description of Artificial Sequence: Synthetic coding sequence
atggctgacaccaccccaaatggcccccagggcgctggagctgtgcagttcatgatgaccaacaagctggacacagccatgtggctgagccgcctcttcaccgtgtactgcagcgccctgtttgtgctgcccctgctgggcctgcatgaagctgccagcttctaccagagggccctgctggccaatgccctgaccagcgccctgcggctgcaccagaggctgccccacttccagctgagccgggccttcctggcccaggccctgctggaggacagctgccactacctgctgtacagcctcatctttgtgaacagctaccctgtgaccatgagcatcttccctgtgctgctcttcagcctgctgcatgctgccacctacaccaagaaggtgctggatgcccggggcagcaacagcctgcccctgctgcggtctgtgctggacaagctgagcgccaaccagcagaacatcctgaagttcatcgcctgcaatgagatcttcctgatgcctgccaccgtcttcatgctgttcagcggccagggcagcctgctgcagcccttcatctactaccgcttcctgaccctgcgctacagcagcagaagaaacccctactgcaggaccctcttcaatgagctgagaattgtggtggagcacatcatcatgaagccagcctgccccctgtttgtgcggcggctgtgcctgcagagcatcgccttcatcagccggctggcccccaccgtgccctag

SEQ ID NO: 39458 - DNA, 744 bp, Artificial Sequence; identical to SEQ ID NO: 39457
  Description of Artificial Sequence: Synthetic coding sequence

SEQ ID NO: 39459 - DNA, 669 bp, Artificial Sequence
  Description of Artificial Sequence: Synthetic coding sequence
atggctgacaccaccccaaatggcccccagggcgctggagctgtgcagttcatgatgaccaacaagctggacacagccatgtggctgagccgcctcttcaccgtgtactgcagcgccctgtttgtgctgcccctgctgggcctgcatgaagctgccagcttctaccagagggccctgctggccaatgccctgaccagcgccctgcggctgcaccagaggctgccccacttccagctgagccgggccttcctggcccaggccctgctggaggacagctgccactacctgctgtacagcctcatctttgtgaacagctaccctgtgaccatgagcatcttccctgtgctgctcttcagcctgctgcatgctgccacctacaccaagaaggtgctggatgcccggggcagcaacagcctgcccctgctgcggtctgtgctggacaagctgagcgccaaccagcagaacatcctgaagttcatcgcctgcaatgagatcttcctgatgcctgccaccgtcttcatgctgttcagcggccagggcagcctgctgcagcccttcatctactaccgcttcctgaccctgcgctacagcagcagaagaaacccctactgcaggaccctcttcaatgagctgagaattgtggtggagcacatcatcatgaagccctag

SEQ ID NO: 39460 - DNA, 744 bp, Artificial Sequence; identical to SEQ ID NO: 39457
  Description of Artificial Sequence: Synthetic coding sequence

SEQ ID NO: 39461 - DNA, 504 bp, Artificial Sequence
  Description of Artificial Sequence: Synthetic coding sequence
atggccagccccaggacagtgaccatcgtggccctgtctgtggccctgggcctcttctttgtgttcatgggcaccatcaagctgaccccccggctgagcaaggatgcctacagcgagatgaagagggcctacaagagctatgtgcgggccctgcccctgctgaagaagatgggcatcaacagcatcctgctgaggaagagcatcggggccctggaggtggcctgtggcatcgtgatgaccctggtgcccggccggcccaaggatgtggccaacttcttcctgctgctgctggtgctggccgtgctcttcttccaccagctggtgggggaccccctgaagagatatgcccacgccctggtgtttggcatcctgctgacctgccgcctgctgattgccaggaagccagaggacaggagcagcgagaagaagcccctgcctggaaatgctgaggagcagcccagcctgtatgagaaggccccccagggcaaggtgaaggtgtcctag

SEQ ID NO: 39462 - DNA, 381 bp, Artificial Sequence
  Description of Artificial Sequence: Synthetic coding sequence
atggccagccccaggacagtgaccatcgtggccctgtctgtggccctgggcctcttctttgtgttcatgggcaccatcaagctgaccccccggctgagcaaggatgcctacagcgagatgaagagggcctacaagagctatgtgcgggccctgcccctgctgaagaagatgggcatcaacagcatcctgcaccagctggtgggggaccccctgaagagatatgcccacgccctggtgtttggcatcctgctgacctgccgcctgctgattgccaggaagccagaagatagaagcagcgagaagaagcccctgcctggaaatgctgaggagcagcccagcctgtatgagaaggccccccagggcaaggtgaaggtgtcctag

SEQ ID NO: 39463 - DNA, 573 bp, Artificial Sequence
  Description of Artificial Sequence: Synthetic coding sequence
atgacagctgtgggcgtgcaggcccagaggcccctgggccagaggcagccccggcgctccttctttgagagcttcatccgcaccctcatcatcacctgtgtggccctggccgtggtgctgagctctgtgtccatctgtgatggccactggctgctggccgaggaccggctgtttggcctgtggcacttctgcaccaccaccaaccagaccatctgcttccgggacctgggccaggcccacgtgcccggcctggccgtgggcatgggcctggtgcgctctgtgggcgccctggccgtggtggccgccatcttcggcctggagttcctgatggtgtcccagctgtgtgaggacaagcacagccagtgcaagtgggtgatgggcagcatcctgctgctggtgtcctttgtgctgagcagcggcggcctgctgggctttgtgatcctgctgaggaaccaggtgaccctcatcggcttcaccctgatgttctggtgtgagttcaccgccagcttcctgctcttcctgaatgccatcagcggcctgcacatcaacagcatcacccacccctgggagtag

SEQ ID NO: 39464 - DNA, 900 bp, Artificial Sequence
  Description of Artificial Sequence: Synthetic coding sequence
atggagctgctgagcgccctgagcctgggggagctggccctgtccttcagccgggtgcccctcttccctgtgtttgacctgagctacttcatcgtgtccatcctgtacctgaagtatgagcctggagctgtggagctgagccgccgccaccccatcgcctcctggctgtgtgccatgctgcactgcttcggcagctacatcctggccgacctgctgctgggggagcccctgattgactacttcagcaacaacagcagcatcctgctggccagcgctgtgtggtacctgatcttcttctgccccctggacctcttctacaagtgtgtgtgcttcctgcctgtgaagctgatctttgtggccatgaaggaggtggtgcgggtgaggaagattgctgtgggcatccaccacgcccaccaccactaccaccacggctggtttgtgatgattgccaccggctgggtgaagggcagcggcgtggccctgatgagcaactttgagcagctgctgcggggcgtgtggaagccagagaccaatgagatcctgcacatgtccttccccaccaaggccagcctgtatggagccatcctcttcaccctgcagcagacccgctggctgcctgtgtccaaggccagcctcatcttcatcttcaccctcttcatggtgtcctgcaaggtgttcctgacagccacccacagccacagcagcccctttgatgccctggagggctacatctgccctgtgctgtttggaagtgcctgtggcggggaccaccaccacgacaaccacggcggcagccacagcggcggcggccctggggcccagcacagcgccatgcctgccaagagcaaggaggagctgtctgagggcagcaggaagaagaaggccaagaaggctgactag

SEQ ID NO: 39465 - DNA, 714 bp, Artificial Sequence
  Description of Artificial Sequence: Synthetic coding sequence
atgctgcactgctttggaggcggcatcctgagctgcctgctgctggccgagccccccctgaagttcctggccaaccacaccaacatcctgctggccagcagcatctggtacatcaccttcttctgcccccatgacctggtgtcccagggctacagctacctgcctgtgcagctgctggccagcggcatgaaggaggtgaccaggacctggaagatcgtgggcggcgtgacccacgccaacagctactacaagaatggctggatcgtgatgattgccatcggctgggcccggggagctgggggcaccatcatcaccaactttgagcggctggtgaagggggactggaagccagaaggagatgagtggctgaagatgagctacccagccaaggtgaccctgctgggcagcgtcatcttcaccttccagcacacccagcacctggccatcagcaagcacaacctgatgttcctgtacaccatcttcatcgtggccaccaagatcaccatgatgaccacccagaccagcaccatgacctttgccccctttgaggacaccctgtcctggatgctgtttggctggcagcagcccttcagcagctgtgagaagaagtctgaggccaagagccccagcaatggagtgggcagcctggccagcaagcctgtggatgtggccagtgacaacgtgaagaagaagcacaccaagaagaatgaatag

SEQ ID NO: 39466 - DNA, 876 bp, Artificial Sequence
  Description of Artificial Sequence: Synthetic coding sequence
atggacagcccctgggatgagctggccctggccttcagcaggacctccatgttccccttctttgatattgcccactacctggtgtctgtgatggctgtgaagaggcagcctggagctgctgccctggcctggaagaaccccatcagctcctggttcaccgccatgctgcactgctttggaggcggcatcctgagctgcctgctgctggccgagccccccctgaagttcctggccaaccacaccaacatcctgctggccagcagcatctggtacatcaccttcttctgcccccatgacctggtgtcccagggctacagctacctgcctgtgcagctgctggccagcggcatgaaggaggtgaccaggacctggaagatcgtgggcggcgtgacccacgccaacagctactacaagaatggctggatcgtgatgattgccatcggctgggcccggggagctgggggcaccatcatcaccaactttgagcggctggtgaagggggactggaagccagaaggagatgagtggctgaagatgagctacccagccaaggtgaccctgctgggcagcgtcatcttcaccttccagcacacccagcacctggccatcagcaagcacaacctgatgttcctgtacaccatcttcatcgtggccaccaagatcaccatgatgaccacccagaccagcaccatgacctttgccccctttgaggacaccctgtcctggatgctgtttggctggcagcagcccttcagcagctgtgagaagaagtctgaggccaagagccccagcaatggagtgggcagcctggccagcaagcctgtggatgtggccagtgacaacgtgaagaagaagcacaccaagaagaatgaatag

SEQ ID NO: 39467 - DNA, 108 bp, Artificial Sequence
  Description of Artificial Sequence: Synthetic coding sequence
atgctgcactgctttggaggcggcatcctgagctgcctgctgctggccgagccccccctgaagttcctggccaaccacaccaacatcctgctggccagcagcatctag

SEQ ID NO: 39468 - DNA, 489 bp, Artificial Sequence
  Description of Artificial Sequence: Synthetic coding sequence
tgaagctgcctgctgctggccgagccccccctgaagttcctggccaaccacaccaacatcctgctggccagcagcatctggtacatcaccttcttctgcccccatgacctggtgtcccagggctacagctacctgcctgtgcagctgctggccagcggcatgaaggaggtgaccaggacctggaagatcgtgggcggcgtgacccacgccaacagctactacaagaatggctggatcgtgatgattgccatcggctgggcccggggggccggcggcaccatcatcaccaactttgagcggctggtgaagggggactggaagccagaaggagatgagtggctgaagatgagctacccagccaaggtgaccctgctgggcagcgtcatcttcaccttccagcacacccagcacctggccatcagcaagcacaacctgatgttcctgtacaccatcttcatcgtggccaccaagagcctgaactggaggtag

SEQ ID NO: 39469 - DNA, 246 bp, Artificial Sequence
  Description of Artificial Sequence: Synthetic coding sequence
tgatggatcgtgatgattgccatcggctgggcccggggggccggcggcaccatcatcaccaactttgagcggctggtgaagggggactggaagccagaaggagatgagtggctgaagatgagctacccagccaaggtgaccctgctgggcagcgtcatcttcaccttccagcacacccagcacctggccatcagcaagcacaacctgatgttcctgtacaccatcttcatcgtggccaccaagtag

SEQ ID NO: 39470 - DNA, 1467 bp, Artificial Sequence
  Description of Artificial Sequence: Synthetic coding sequence
atgcctgggggcagaagaggccccagccggcagcagctgagccgcagcgccctgcccagcctgcagaccctggtgggcggcggctgtggaaatggaacaggcctgaggaacagaaatggaagtgccatcggcctgcctgtgccccccatcacagccctgatcaccccaggccctgtgcgccactgccagatcccagacctgcctgtggatggcagcctgctgtttgagttcctgttcttcatctacctgctggtggccctcttcatccagtacatcaacatctacaagacagtgtggtggtacccctacaaccacccagccagctgcaccagcctgaacttccacctgattgactaccacctggccgccttcatcaccgtgatgctggcccggcggctggtgtgggccctgatcagcgaggccaccaaggccggggccgcctccatgatccactacatggtgctgatcagcgcccggctggtgctgctgaccctgtgtggctgggtgctgtgctggaccctggtgaacctcttccgcagccacagcgtgctgaacctgctcttcctgggctacccctttggagtgtatgtgcccctgtgctgcttccaccaggacagccgggcccacctgctgctgacagactacaactacgtggtgcagcatgaagctgtggaggagagcgccagcacagtgggcggcctggccaagagcaaggacttcctgagcctgctgctggagagcctgaaggagcagttcaacaatgccacccccatccccacccacagctgccccctgagcccagacctgatcagaaatgaggtggagtgcctgaaggctgacttcaaccaccgcatcaaggaggtgctcttcaacagcctcttcagcgcctactacgtggccttcctgcccctgtgctttgtgaagagcacccagtactatgacatgcgctggagctgtgagcacctgatcatggtgtggatcaatgcctttgtgatgctgaccacccagctgctgcccagcaagtactgtgacctgctgcacaagtctgctgcccacctgggcaagtggcagaagctggagcacggcagctacagcaatgccccccagcacatctggagcgagaacaccatctggccccagggcgtgctggtgcgccacagccgctgcctgtaccgggccatgggcccctacaacgtggccgtgcccagtgatgtgtcccatgcccgcttctacttcctgttccaccggcccctgcggctgctgaacctgctgatcctgattgagggctctgtggtgttctaccagctgtacagcctgctgcggtctgagaagtggaaccacaccctgtccatggccctgatcctcttctgcaactactacgtgctcttcaagctgctgcgggaccgcatcgtgctgggccgggcctacagctaccccctgaacagctatgagctgaaggccaactag

SEQ ID NO: 39471 - DNA, 339 bp, Artificial Sequence
  Description of Artificial Sequence: Synthetic coding sequence
atgcctgggggcagaagaggccccagccggcagcagctgagccgcagcgccctgcccagcctgcagaccctggtgggcggcggctgtggaaatggaacaggcctgaggaacagaaatggaagtgccatcggcctgcctgtgccccccatcacagccctgatcaccccaggccctgtgcgccactgccagatcccagacctgcctgtggatggcagcctgctgtttgagttcctgttcttcatctacctgctggtggccctcttcatccagtacatcaacatctacaagacagtgtggtggtacccctacaaccacccagccagctgcaccagcctgtag

SEQ ID NO: 39472 - DNA, 579 bp, Artificial Sequence
  Description of Artificial Sequence: Synthetic coding sequence
atgcctgggggcagaagaggccccagccggcagcagctgagccgcagcgccctgcccagcctgcagaccctggtgggcggcggctgtggaaatggaacaggcctgaggaacagaaatggaagtgccatcggcctgcctgtgccccccatcacagccctgatcaccccaggccctgtgcgccactgccagatcccagacctgcctgtggatggcagcctgctgtttgagttcctgttcttcatctacctgctggtggccctcttcatccagtacatcaacatctacaagacagtgtggtggtacccctacaaccacccagccagctgcaccagcctgaacttccacctgattgactaccacctggccgccttcatcaccgtgatgctggcccggcggctggtgtgggccctgatcagcgaggccaccaaggccggggccgcctccatgatccactacatggtgctgatcagcgcccggctggtgctgctgaccctgtgtggctgggtgctgtgctggaccctggtgaacctcttccgcagccacagcgtgctgaacctgctcttcctgggctacccctag

SEQ ID NO: 39473 - DNA, 423 bp, Artificial Sequence
  Description of Artificial Sequence: Synthetic coding sequence
atgcctgggggcagaagaggccccagccggcagcagctgagccgcagcgccctgcccagcctgcagaccctggtgggcggcggctgtggaaatggaacaggcctgaggaacagaaatggaagtgccatcggcctgcctgtgccccccatcacagccctgatcaccccaggccctgtgcgccactgccagatcccagacctgcctgtggatggcagcctgctgtttgagttcctgttcttcatctacctgctggtggccctcttcatccagtacatcaacatctacaagacagtgtggtggtacccctacaaccacccagccagctgcaccagcctgaacttccacctgattgactaccacctggccgccttcatcaccgtgatgctggcccggcggctggtgtgggccctgatcagcgagtag

SEQ ID NO: 39474 - DNA, 1479 bp, Artificial Sequence
  Description of Artificial Sequence: Synthetic coding sequence
atgggcggccggcggggccccaacagaaccagctactgcaggaaccccctgtgtgagcccggcagcagcggcggcagcagcggcagccacaccagcagcgcctctgtgacctctgtgcgcagcaggaccaggagcagcagcggcaccggcctgagcagcccccccctggccacccagacagtggtgcccctgcagcactgcaagatccctgagctgcctgtgcaggccagcatcctgtttgagctgcagctgttcttctgccagctgattgccctgtttgtgcactacatcaacatctacaagacagtgtggtggtacccacccagccacccccccagccacaccagcctgaacttccacctgattgacttcaacctgctgatggtgaccaccatcgtgctgggccgccgcttcatcggcagcatcgtgaaggaggccagccagaggggcaaggtgtccctcttccgcagcatcctgctcttcctgacccgcttcaccgtgctgacagccaccggctggagcctgtgccgcagcctcatccacctgttccgcacctacagcttcctgaacctgctcttcctgtgctaccccttcggcatgtacatccccttcctgcagctgaactgtgacctgaggaagaccagcctcttcaaccacatggcctccatgggcccccgggaggccgtgtctggcctggccaagagccgggactacctgctgaccctgcgggagacctggaagcagcacacccggcagctgtatggcccagatgccatgcccacccacgcctgctgcctgagccccagcctcatccgctctgaggtggagttcctgaagatggacttcaactggaggatgaaggaggtgctggtgtcctccatgctgagcgcctactacgtggcctttgtgcctgtgtggtttgtgaagaacacccactactatgacaagcgctggagctgtgagctgttcctgctggtgtccatcagcaccagcgtcatcctgatgcagcacctgctgcctgccagctactgtgacctgctgcacaaggctgctgcccacctgggctgctggcagaaggtggaccctgccctgtgcagcaatgtgctgcagcacccctggacagaggagtgcatgtggccccagggcgtgctggtgaagcacagcaagaatgtgtacaaggctgtgggccactacaacgtggccatccccagtgatgtgagccacttccgcttccacttcttcttcagcaagcccctgcgcatcctgaacatcctgctgctgctggagggcgctgtgattgtgtaccagctgtacagcctgatgagcagcgagaagtggcaccagaccatcagcctggccctgatcctcttcagcaactactatgccttcttcaagctgctgcgggaccggctggtgctgggcaaggcctacagctacagcgccagcccccagagggacctggaccaccgcttctcctag

SEQ ID NO: 39475 - DNA, 579 bp, Artificial Sequence
  Description of Artificial Sequence: Synthetic coding sequence
atgggcggccggcggggccccaacagaaccagctactgcaggaaccccctgtgtgagcccggcagcagcggcggcagcagcggcagccacaccagcagcgcctctgtgacctctgtgcgcagcaggaccaggagcagcagcggcaccggcctgagcagcccccccctggccacccagacagtggtgcccctgcagcactgcaagatccctgagctgcctgtgcaggccagcatcctgtttgagctgcagctgttcttctgccagctgattgccctgtttgtgcactacatcaacatctacaagacagtgtggtggtacccacccagccacccccccagccacaccagcctggccagccagaggggcaaggtgtccctcttccgcagcatcctgctcttcctgacccgcttcaccgtgctgacagccaccggctggagcctgtgccgcagcctcatccacctgttccgcacctacagcttcctgaacctgctcttcctgtgctaccccttcggcatgtacatccccttcctgcagctgaactgtgacctgaggaagaccagcctcttcaaccacatgtag

SEQ ID NO: 39476 - DNA, 882 bp, Artificial Sequence
  Description of Artificial Sequence: Synthetic coding sequence
atgtacatccccttcctgcagctgaactgtgacctgaggaagaccagcctcttcaaccacatggcctccatgggcccccgggaggccgtgtctggcctggccaagagccgggactacctgctgaccctgcgggagacctggaagcagcacacccggcagctgtatggcccagatgccatgcccacccacgcctgctgcctgagccccagcctcatccgctctgaggtggagttcctgaagatggacttcaactggaggatgaaggaggtgctggtgtcctccatgctgagcgcctactacgtggcctttgtgcctgtgtggtttgtgaagaacacccactactatgacaagcgctggagctgtgagctgttcctgctggtgtccatcagcaccagcgtcatcctgatgcagcacctgctgcctgccagctactgtgacctgctgcacaaggccgccgcccacctgggctgctggcagaaggtggaccctgccctgtgcagcaatgtgctgcagcacccctggacagaggagtgcatgtggccccagggcgtgctggtgaagcacagcaagaatgtgtacaaggctgtgggccactacaacgtggccatccccagtgatgtgagccacttccgcttccacttcttcttcagcaagcccctgcgcatcctgaacatcctgctgctgctggagggcgccgtcatcgtgtaccagctgtacagcctgatgagcagcgagaagtggcaccagaccatcagcctggccctgatcctcttcagcaactactatgccttcttcaagctgctgcgggaccggctggtgctgggcaaggcctacagctacagcgccagcccccagagggacctggaccaccgcttctcctag

SEQ ID NO: 39477 - DNA, 1029 bp, Artificial Sequence
  Description of Artificial Sequence: Synthetic coding sequence
atgaagaacttccacctgattgacttcaacctgctgatggtgaccaccatcgtgctgggccgccgcttcatcggcagcatcgtgaaggaggccagccagaggggcaaggtgtccctcttccgcagcatcctgctcttcctgacccgcttcaccgtgctgacagccaccggctggagcctgtgccgcagcctcatccacctgttccgcacctacagcttcctgaacctgctcttcctgtgctaccccttcggcatgtacatccccttcctgcagctgaactgtgacctgaggaagaccagcctcttcaaccacatggcctccatgggcccccgggaggccgtgtctggcctggccaagagccgggactacctgctgaccctgcgggagacctggaagcagcacacccggcagctgtatggcccagatgccatgcccacccacgcctgctgcctgagccccagcctcatccgctctgaggtggagttcctgaagatggacttcaactggaggatgaaggaggtgctggtgtcctccatgctgagcgcctactacgtggcctttgtgcctgtgtggtttgtgaagaacacccactactatgacaagcgctggagctgtgagctgttcctgctggtgtccatcagcaccagcgtcatcctgatgcagcacctgctgcctgccagctactgtgacctgctgcacaaggccgccgcccacctgggctgctggcagaaggtggaccctgccctgtgcagcaatgtgctgcagcacccctggacagaggagtgcatgtggccccagggcgtgctggtgaagcacagcaagaatgtgtacaaggctgtgggccactacaacgtggccatccccagtgatgtgagccacttccgcttccacgtgtccctgctgcccggggagggcggcctgggccctgagcgggtgggcggcagcgctggccaggagtgtgatgtgattgcccgggagagctacttccagtacttccccaaccccaaggaggacagcgcccacatgtag

SEQ ID NO: 39478 - DNA, 579 bp, Artificial Sequence; identical to SEQ ID NO: 39475
  Description of Artificial Sequence: Synthetic coding sequence

SEQ ID NO: 39479 - DNA, 666 bp, Artificial Sequence
  Description of Artificial Sequence: Synthetic coding sequence
atgggcggccggcggggccccaacagaaccagctactgcaggaaccccctgtgtgagcccggcagcagcggcggcagcagcggcagccacaccagcagcgcctctgtgacctctgtgcgcagcaggaccaggagcagcagcggcaccggcctgagcagcccccccctggccacccagacagtggtgcccctgcagcactgcaagatccctgagctgcctgtgcaggccagcatcctgtttgagctgcagctgttcttctgccagctgattgccctgtttgtgcactacatcaacatctacaagacagtgtggtggtacccacccagccacccccccagccacaccagcctgaacttccacctgattgacttcaacctgctgatggtgaccaccatcgtgctgggccgccgcttcatcggcagcatcgtgaaggaggtgtgggatgtgcacagcgtgcctgctgctgagctgcggcccccccaggacaagcccctgcagccccacggcctgcatggagcccctgggggcggccagtggccaggcaaggagcccggcctgcccccagacacagctggagatgtggaggccgcccacaagacagctgtgtggccaggaagacatgcccacccctgcctgctgcctgtgacccagccccacccccagtag

SEQ ID NO: 39480 - DNA, 702 bp, Artificial Sequence
  Description of Artificial Sequence: Synthetic coding sequence
atggagaccagcgccagcagcagccagccccaggacaacagccaggtgcaccgggagacagaagatgtggactatggagaaacagacttccacaagcaggacggcaaggccggcctcttcagccaggagcagtatgaaagaaacaagagcagcagcagcagcagcagcagcagcagcagcagcagcagcagcagcagcagcagcagcagcgagagcaatgatgaggaccagcagccccgggccaccgggaagcaccggcgcagcctgggcgccggctacccccatggaaatggcagccctggccctggccacggggagccagatgtgctgaaggatgagctgcagctgtatggagatgcccctggagaggtggtgcccagcggggagagcggcctgcggcggcggggcagtgaccctgccagcggggaggtggaggccagccagctgcggcggctgaacatcaagaaggatgatgagttcttccactttgtgctgctgtgctttgccatcggggccctgctggtgtgctaccactactatgctgactggttcatgagcctgggcgtgggcctgctgacctttgccagcctggagaccgtgggcatctacttcggcctggtgtaccgcatccacagcgtgctgcagggcttcatccccctcttccagaagttccggctgaccggcttcaggaagacagactag

SEQ ID NO: 39481 - DNA, 702 bp, Artificial Sequence; identical to SEQ ID NO: 39480
  Description of Artificial Sequence: Synthetic coding sequence

SEQ ID NO: 39482 - DNA, 750 bp, Artificial Sequence
  Description of Artificial Sequence: Synthetic coding sequence
atggccgaggccggggccggcagcctgagcctgcccggcggcaaggccatggagaccagcgccagcagcagccagccccaggacaacagccaggtgcaccgggagacagaagatgtggactatggagaaacagacttccacaagcaggacggcaaggccggcctcttcagccaggagcagtatgaaagaaacaagagcagcagcagcagcagcagcagcagcagcagcagcagcagcagcagcagcagcagcagcagcgagagcaatgatgaggaccagcagccccgggccaccgggaagcaccggcgcagcctgggcgccggctacccccatggaaatggcagccctggccctggccacggggagccagatgtgctgaaggatgagctgcagctgtatggagatgcccctggagaggtggtgcccagcggggagagcggcctgcggcggcggggcagtgaccctgccagcggggaggtggaggccagccagctgcggcggctgaacatcaagaaggatgatgagttcttccactttgtgctgctgtgctttgccatcggggccctgctggtgtgctaccactactatgctgactggttcatgagcctgggcgtgggcctgctgacctttgccagcctggagaccgtgggcatctacttcggcctggtgtaccgcatccacagcgtgctgcagggcttcatccccctcttccagaagttccggctgaccggcttcaggaagacagactag

SEQ ID NO: 39483 - DNA, 612 bp, Artificial Sequence
  Description of Artificial Sequence: Synthetic coding sequence
atggagaccagcgccagcagcagccagccccaggacaacagccaggtgcaccgggagacagaagatgtggactatggagaaacagacttccacaagcaggacggcaaggccggcctcttcagccaggagcagtatgaaagaaacaagagcagcagcagcagcagcagcagcagcagcagcagcagcagcagcagcagcagcagcagcagcggccctggccacggggagccagatgtgctgaaggatgagctgcagctgtatggagatgcccctggagaggtggtgcccagcggggagagcggcctgcggcggcggggcagtgaccctgccagcggggaggtggaggccagccagctgcggcggctgaacatcaagaaggatgatgagttcttccactttgtgctgctgtgctttgccatcggggccctgctggtgtgctaccactactatgctgactggttcatgagcctgggcgtgggcctgctgacctttgccagcctggagaccgtgggcatctacttcggcctggtgtaccgcatccacagcgtgctgcagggcttcatccccctcttccagaagttccggctgaccggcttcaggaagacagactag

SEQ ID NO: 39484 - DNA, 474 bp, Artificial Sequence
  Description of Artificial Sequence: Synthetic coding sequence
atggagaccagcgccagcagcagccagccccaggacaacagccaggtgcaccgggagacagaagatgtggactgccccggccacggggagccagatgtgctgaaggatgagctgcagctgtatggagatgcccctggagaggtggtgcccagcggggagagcggcctgcggcggcggggcagtgaccctgccagcggggaggtggaggccagccagctgcggcggctgaacatcaagaaggatgatgagttcttccactttgtgctgctgtgctttgccatcggggccctgctggtgtgctaccactactatgctgactggttcatgagcctgggcgtgggcctgctgacctttgccagcctggagaccgtgggcatctacttcggcctggtgtaccgcatccacagcgtgctgcagggcttcatccccctcttccagaagttccggctgaccggcttcaggaagacagactag

SEQ ID NO: 39485 - DNA, 795 bp, Artificial Sequence
  Description of Artificial Sequence: Synthetic coding sequence
atgaggcccctgctgggcctgctgctggtgtttgctggctgcacctttgccctgtacctgctgagcacccggctgccccggggccgccgcctgggcagcacagaggaggccggcggccgcagcctgtggttccccagcgacctggccgagctgcgggagctgtctgaggtgctgcgggagtacaggaaggagcaccaggcctacgtgttcctgctcttctgtggggcctacctgtacaagcagggctttgccatccctggcagcagcttcctgaatgtgctggccggggccctgtttggcccctggctgggcctgctgctgtgctgcgtgctgacctctgtgggcgccacctgctgctacctgctgagcagcatctttgggaagcagctggtggtgtcctacttcccagacaaggtggccctgctgcagaggaaggtggaggagaacagaaacagcctcttcttcttcctgctcttcctgcggctcttccccatgacccccaactggttcctgaacctgagcgcccccatcctgaacatccccatcgtgcagttcttcttctctgtgctgattggcctcatcccctacaacttcatctgtgtgcagacaggcagcatcctgagcaccctgaccagcctggatgccctcttctcctgggacacagtgttcaagctgctggccatcgccatggtggccctgatccctggcaccctcatcaagaagttcagccagaagcacctgcagctgaatgagaccagcacagccaaccacatccacagcaggaaggacacctag

SEQ ID NO: 39486 - DNA, 876 bp, Artificial Sequence
  Description of Artificial Sequence: Synthetic coding sequence
atggccaagggccgggtggccgagaggagccagctgggcgcccaccacaccacccctgtgggagatggagctgctggcacccggggcctggccgcccctggcagccgggaccaccagaaggagaagtcctgggtggaggccggcagcgccaggatgagcctgctgatcctggtgtccatcttcctgtctgctgcctttgtgatgttcctggtgtacaagaacttcccccagctgtctgaggaggagcgggtgaacatgaaggtgccccgggacatggatgatgccaaggccctgggcaaggtgctgagcaagtacaaggacaccttctacgtgcaggtgctggtggcctactttgccacctacatcttcctgcagacctttgccatccctggcagcatcttcctgagcatcctgagcggcttcctgtaccccttccccctggccctcttcctggtgtgcctgtgcagcggcctgggcgccagcttctgctacatgctgagctacctggtgggccggcctgtggtgtacaagtacctgacagagaaggctgtgaagtggagccagcaggtggagcggcaccgggagcacctgatcaactacatcatcttcctgcgcatcacccccttcctgcccaactggttcatcaacatcaccagccctgtgatcaacgtgcccctgaaggtgttcttcatcggcaccttcctgggcgtggcccctccttcctttgtggccatcaaggccggcaccaccctgtaccagctgaccacagctggggaggccgtgtcctggaacagcatcttcatcctgatgatcctggccgtgctgagcatcctgcctgccatcttccagaagaagctgaagcagaagtttgaatag

SEQ ID NO: 39487 - DNA, 876 bp, Artificial Sequence; identical to SEQ ID NO: 39486
  Description of Artificial Sequence: Synthetic coding sequence

SEQ ID NO: 39488 - DNA, 384 bp, Artificial Sequence
  Description of Artificial Sequence: Synthetic coding sequence
atggccaagggccgggtggccgagaggagccagctgggcgcccaccacaccacccctgtgggagatggagctgctggcacccggggcctggccgcccctggcagccgggaccaccagaaggagaagtcctgggtggaggccggcagcgccaggatgagcctgctgatcctggtgtccatcttcctgtctgctgcctttgtgatgttcctggtgtacaagaacttcccccagctgtctgaggaggagcgggtgaacatgaaggtgccccgggacatggatgatgccaaggccctgggcaaggtgctgagcaagtacaaggacaccttctacgtgcaggtgctggtggcctactttgccacctacatcctgtaccccttcaactag

SEQ ID NO: 39489 - DNA, 480 bp, Artificial Sequence
  Description of Artificial Sequence: Synthetic coding sequence
atggccgagaggcctggccccccaggcggcgctgtgtctgccacagcctacccagacaccccagctgagttccccccccacctgcaggccggggccatgagaagacgcttctggggcgtcttcaactgcctgtgtgccggggcctttggagccctggccgccgccagcgccaagctggcctttggaagtgaggtgtccatgggcctgtgtgtgctgggcatcatcgtgatggccagcaccaacagcctgatgtggaccttcttcagccggggcctgtccttctccatgagcagcgccatcgcctctgtgacagtgaccttcagcaacatcctgagcagcgccttcctgggctacgtgctgtatggagagtgccaggaggtgctgtggtggggcggcgtcttcctgatcctgtgtggcctgaccctcatccacaggaagctgccccccacctggaagcccctgccccacaagcagcagtag

SEQ ID NO: 39490 - DNA, 828 bp, Artificial Sequence
  Description of Artificial Sequence: Synthetic coding sequence
atgggcaacttccggggccacgccctgcccggcaccttcttcttcatcatcggcctgtggtggtgcaccaagagcatcctgaagtacatctgcaagaagcagaagaggacctgctacctgggcagcaagaccctcttctaccgcctggagatcctggagggcatcaccatcgtgggcatggccctgaccggcatggccggggagcagttcatccctgggggcccccacctgatgctgtatgactacaagcagggccactggaaccagctgctgggctggcaccacttcaccatgtacttcttcttcggcctgctgggcgtggccgacatcctgtgcttcaccatcagcagcctgcctgtgtccctgaccaagctgatgctgagcaatgccctgtttgtggaggccttcatcttctacaaccacacccacggccgggagatgctggacatctttgtgcaccagctgctggtgctggtggtgttcctgaccggcctggtggccttcctggagttcctggtgaggaacaacgtgctgctggagctgctgcggagcagcctcatcctgctgcagggctcctggttcttccagattggatttgtgctgtacccaccttctgggggccctgcctgggacctgatggaccacgagaacatcctcttcctgaccatctgcttctgctggcactatgctgtgaccatcgtgattgtgggcatgaactatgccttcatcacctggctggtgaagagccggctgaagaggctgtgcagcagcgaggtgggcctgctgaagaatgctgagcgggagcaggagagcgaggaggagatgtag

SEQ ID NO: 39491 - DNA, 876 bp, Artificial Sequence
  Description of Artificial Sequence: Synthetic coding sequence
atgaccaatgattctgagggcaagatgggcttcaagcaccccaagatcatgggcaacttccggggccacgccctgcccggcaccttcttcttcatcatcggcctgtggtggtgcaccaagagcatcctgaagtacatctgcaagaagcagaagaggacctgctacctgggcagcaagaccctcttctaccgcctggagatcctggagggcatcaccatcgtgggcatggccctgaccggcatggccggggagcagttcatccctgggggcccccacctgatgctgtatgactacaagcagggccactggaaccagctgctgggctggcaccacttcaccatgtacttcttcttcggcctgctgggcgtggccgacatcctgtgcttcaccatcagcagcctgcctgtgtccctgaccaagctgatgctgagcaatgccctgtttgtggaggccttcatcttctacaaccacacccacggccgggagatgctggacatctttgtgcaccagctgctggtgctggtggtgttcctgaccggcctggtggccttcctggagttcctggtgaggaacaacgtgctgctggagctgctgcggagcagcctcatcctgctgcagggctcctggttcttccagattggatttgtgctgtacccaccttctgggggccctgcctgggacctgatggaccacgagaacatcctcttcctgaccatctgcttctgctggcactatgctgtgaccatcgtgattgtgggcatgaactatgccttcatcacctggctggtgaagagccggctgaagaggctgtgcagcagcgaggtgggcctgctgaagaatgctgagcgggagcaggagagcgaggaggagatgtag

SEQ ID NO: 39492 - DNA, 828 bp, Artificial Sequence
  Description of Artificial Sequence: Synthetic coding sequence
atggccaacttcaagggccacgccctgcccggcagcttcttcctgatcatcggcctgtgctggagcgtgaagtaccccctgaagtacttcagccacaccaggaagaacagccccctgcactactaccagaggctggagatcgtggaggccgccatccgcaccctcttctctgtgacaggcatcctggccgagcagtttgtgcctgatggcccccacctgcacctgtaccacgagaaccactggatcaagctgatgaactggcagcacagcaccatgtacctgttctttgctgtgtctggaattgtggacatgctgacctacctggtgagccacgtgcccctgggcgtggaccggctggtgatggctgtggccgtgttcatggagggcttcctgttctactaccacgtgcacaaccggccccccctggaccagcacatccacagcctgctgctgtatgccctgtttggaggctgtgtgtccatcagcctggaggtgatcttccgggaccacatcgtgctggagctgttccgcaccagcctcatcatcctgcagggcacctggttctggcagattggatttgtgctcttccccccatttggcaccccagagtgggaccagaaggatgatgccaacctgatgttcatcaccatgtgcttctgctggcactacctggccgccctgagcatcgtggccgtgaactacagcctggtgtactgcctgctgaccaggatgaagagacatggccgcggggagatcatcggcatccagaagctgaacagtgatgacacctaccagacagccctgctgagcggcagtgatgaggagtag

SEQ ID NO: 39493 - DNA, 828 bp, Artificial Sequence; identical to SEQ ID NO: 39492
  Description of Artificial Sequence: Synthetic coding sequence

SEQ ID NO: 39494 - DNA, 474 bp, Artificial Sequence
  Description of Artificial Sequence: Synthetic coding sequence
atgagcggcttcctggagggcctgcgctgcagcgagtgcatcgactggggcgagaagaggaacaccatcgccagcattgctgctggggtgctcttcttcaccggctggtggatcatcattgatgctgctgtgatctaccccaccatgaaggacttcaaccacagctaccacgcctgtggggtcatcgccaccatcgccttcctgatgatcaatgctgtgtccaatggccaggtgcggggggacagctacagcgagggctgcctgggccagacaggagcccgcatctggctgtttgtgggcttcatgctggccttcggcagcctgattgcctccatgtggatcctgtttggaggctacgtggccaaggagaaggacatcgtgtacccaggcattgctgtgttcttccagaatgccttcatcttcttcggcggcctggtgttcaagtttggaagaacagaggacctgtggcagtag

SEQ ID NO: 39495 - DNA, 477 bp, Artificial Sequence
  Description of Artificial Sequence: Synthetic coding sequence
atggccggcttcctggacaacttccgctggccagaatgtgagtgcatcgactggagcgagaggagaaatgctgtggcctctgtggtggccggcatcctcttcttcaccggctggtggatcatgattgatgctgctgtggtgtaccccaagccagagcagctgaaccacgccttccacacctgtggggtcttcagcaccctggccttcttcatgatcaatgctgtgtccaatgcccaggtgcggggggacagctatgaaagtggctgcctgggccgcactggagcccgggtgtggctgttcatcggcttcatgctgatgtttggcagcctgattgcctccatgtggatcctgtttggagcctacgtgacccagaacacagatgtgtacccaggcctggccgtgttcttccagaatgccctgatcttcttcagcaccctcatctacaagtttggccgcacagaggagctgtggacctag

SEQ ID NO: 39496 - DNA, 246 bp, Artificial Sequence
  Description of Artificial Sequence: Synthetic coding sequence
atggccggcttcctggacaacttccgctggccagaatgtgagtgcatcgactggagcgagaggagaaatgctgtggcctctgtggtggccggcatcctcttcttcaccggctggtggatcatgattgatgctgctgtggtgtaccccaagccagagcagctgaaccacgccttccacacctgtggggtcttcagcaccctggccttcttcatgatcaatgctgtgtccaatgcccaggtgaggtag

SEQ ID NO: 39497 - DNA, 189 bp, Artificial Sequence
  Description of Artificial Sequence: Synthetic coding sequence
atggccggcttcctggacaacttccgctggccagaatgtgagtgcatcgactggagcgagaggagaaatgctgtggcctctgtggtggccggcatcctcttcttcaccggctggtggatcatgattgatgctgctgtggtgtaccccaagccagagcagctgaaccacgccttccacacctgtggctag

SEQ ID NO: 39498 - DNA, 381 bp, Artificial Sequence
  Description of Artificial Sequence: Synthetic coding sequence
atggccggcttcctggacaacttccgctggccagaatgtgagtgcatcgactggagcgagaggagaaatgctgtggcctctgtggtggccggcatcctcttcttcaccggctggtggatcatgattgatgctgctgtggtgtaccccaagccagagcagctgaaccacgccttccacacctgtggggtcttcagcaccctggccttcttcatgatcaatgctgtgtccaatgcccaggtgcggggggacagctatgaaagtggctgcctgggccgcactggagcccgggtgtggctgttcatcggcttcatgctgatgtttggcagcctgattgcctccatgtggatcctgtttggagcctacgtgacccagaacctgtag

SEQ ID NO: 39499 - DNA, 477 bp, Artificial Sequence; identical to SEQ ID NO: 39495
  Description of Artificial Sequence: Synthetic coding sequence

SEQ ID NO: 39500 - DNA, 762 bp, Artificial Sequence
  Description of Artificial Sequence: Synthetic coding sequence
atgatggcccagagcaaggccaacggcagccactacgccctgacagccatcggcctgggcatgctggtgctgggcgtcatcatggccatgtggaacctggtgcccggcttctctgctgctgagaagcccacagcccagggcagcaacaagacagaggtgggcggcggcatcctgaagagcaagaccttctctgtggcctacgtgctggtgggcgctggggtgatgctgctgctgctgagcatctgcctgagcatccgggacaagaggaagcagaggcagggcgaggacctggcccacgtgcagcaccccaccggggccggcccccacgcccaggaggaggacagccaggaggaggaggaggaggatgaggaggccgccagccgctactacgtgcccagctatgaggaggtgatgaacaccaactacagcgaggcccggggggaggagcagaacccccggctgagcatcagcctgcccagctatgagagcctgaccggcctggatgagaccacccccaccagcaccagggcagatgtggaggccagccctggcaaccccccagaccggcagaacagcaagctggccaagaggctgaagcccctgaaggtgcggcgcatcaagtctgagaagctgcacctgaaggacttccgcatcaacctgcctgacaagaatgtgcccccacccagcattgagcccctgaccccaccaccccagtatgatgaggtgcaggagaaggccccagacacccggcccccagactag

SEQ ID NO: 39501 - DNA, 762 bp, Artificial Sequence; identical to SEQ ID NO: 39500
  Description of Artificial Sequence: Synthetic coding sequence

SEQ ID NO: 39502 - DNA, 762 bp, Artificial Sequence; identical to SEQ ID NO: 39500
  Description of Artificial Sequence: Synthetic coding sequence

SEQ ID NO: 39503 - DNA, 762 bp, Artificial Sequence; identical to SEQ ID NO: 39500
  Description of Artificial Sequence: Synthetic coding sequence

SEQ ID NO: 39504 - DNA, 762 bp, Artificial Sequence; identical to SEQ ID NO: 39500
  Description of Artificial Sequence: Synthetic coding sequence

SEQ ID NO: 39505 - DNA, 762 bp, Artificial Sequence; identical to SEQ ID NO: 39500
  Description of Artificial Sequence: Synthetic coding sequence

SEQ ID NO: 39506 - DNA, 528 bp, Artificial Sequence
  Description of Artificial Sequence: Synthetic coding sequence
atgatggcccagagcaaggccaacggcagccactacgccctgacagccatcggcctgggcatgctggtgctgggcgtcatcatggccatgtggaacctggtgcccggcttctctgctgctgagaagcccacagcccagggcagcaacaagacagaggtgggcggcggcatcctgaagagcaagaccttctctgtggcctacgtgctggtgggcgctggggtgatgctgctgctgctgagcatctgcctgagcatccgggacaagaggaagcagaggcagggcgaggacctggcccacgtgcagcaccccaccggggccggcccccacgcccaggaggaggacagccaggaggaggaggaggaggatgaggaggccgccagccgctactacgtgcccagctatgaggaggtgatgaacaccaactacagcgaggcccggggggaggagcagaacccccggctgagcatcagcctgcccagctatgagagcctgaccggcctggatgagaccacccccaccagcacctag

SEQ ID NO: 39507 - DNA, 630 bp, Artificial Sequence
  Description of Artificial Sequence: Synthetic coding sequence
atggcccggggccccctggccgcccggggcctgcggctgctgctgcccctgctgcccctgctgcccctgctgcccctgccccaggtggccctgggctttgctgatggcagctgtgaccccagcgaccagtgccccccccaggcccgctggagcagcctgtggcacgtgggcctcatcctgctggccgtgctgctgctgctgctgtgtggggtgacagctggctgtgtgcgcttctgctgcctgaggaagcaggcccaggcccagccccacctgcccccagcccggcagccctgtgatgtggccgtcatccccatggacagcgacagccctgtgcacagcacagtgaccagctacagctctgtgcagtaccccctgggcatgaggctgcccctgccctttggagagctggacctggacagcatggcccccccagcctacagcctgtacaccccagagcccccacccagctatgatgaggccgtgaagatggccaagccccgggaggagggccctgccctgagccagaagcccagccccctgctgggcgccagcggcctggagaccacccctgtgccccaggagagcggccccaacacccagctgcccccctgcagccctggggccccctag

SEQ ID NO: 39508 - DNA, 375 bp, Artificial Sequence
  Description of Artificial Sequence: Synthetic coding sequence
gggggccgctggcccccagctgactgtggctgctgctgccgcagctgccgcagctgccgcagctgccgctgccgccgctgggtgggccgccgcagcctgtctgtgcggcccccccggggcggcagcctgctgggcccccggcccagccgggcccacccctgcccccaccgctggcgctgggccagcaggacagctgctgccacccccaggaccagcgcccggcccaggcctgctggggccgcctgtggcacctgggcctgcacccccaggagcctgcacccccccaccatgaagctgagccgctggcccagccctgagaggaaggaccagcacagccccaggaacccagccctgagcctgggcccccgggcctag

SEQ ID NO: 39509 - DNA, 585 bp, Artificial Sequence
  Description of Artificial Sequence: Synthetic coding sequence
atggagcggcactgcctgctcttcatcctgctgacctgcctgcgctggctgtgccacgacatcccccagggcgctggggcccgctggccccgggtgtcccctgtggtggagccctgcagccccaggctcatcctgctggccgtgctgctgctgctgctgtgtggggtgacagctggctgtgtgcgcttctgctgcctgaggaagcaggcccaggcccagccccacctgcccccagcccggcagccctgtgatgtggccgtcatccccatggacagcgacagccctgtgcacagcacagtgaccagctacagctctgtgcagtaccccctgggcatgaggctgcccctgccctttggagagctggacctggacagcatggcccccccagcctacagcctgtacaccccagagcccccacccagctatgatgaagctgtgaagatggccaagccccgggaggagggccctgccctgagccagaagcccagccccctgctgggcgccagcggcctggagaccacccctgtgccccaggagagcggccccaacacccagctgcccccctgcagccctggggccccctag

SEQ ID NO: 39510 - DNA, 312 bp, Artificial Sequence
  Description of Artificial Sequence: Synthetic coding sequence
atggcccggggccccctggccgcccggggcctgcggctgctgctgcccctgctgcccctgctgcccctgctgcccctgccccaggtgggccgggccgccttcagcctgggcagcgccacagctggccgggtgcctgcccggaccacccccctgcccggcagccccctgagcccccaggtggccctgggctttgctgatggcagctgtgaccccagcgaccagtgccccccccaggcccgctggagcagcctgtggcacgtgggcctcatcctgctggccgtgctgctgctgctgctgtgtggggtgacctag

SEQ ID NO: 39511 - DNA, 744 bp, Artificial Sequence
  Description of Artificial Sequence: Synthetic coding sequence
atggccagcgctgagctggactacaccatcgagatcccagaccagccctgctggagccagaagaacagccccagccctgggggcaaggaggccgagacccggcagcctgtggtgatcctgctgggctggggcggctgcaaggacaagaacctggccaagtacagcgccatctaccacaagaggaagctgctggagctgctgtttgattatgaaattgagaaggagcccctgctcttccacgtgttcagcaatggaggagtgatgctgtaccgctacgtgctggagctgctgcagacccggcgcttctgccgcctgcgggtggtgggcaccatctttgacagcgcccctggggacagcaacctggtgggcgccctgcgggccctggccgccatcctggagcggcgggccgccatgctgcggctgctgctgctggtggcctttgccctggtggtggtgctcttccacgtgctgctggcccccatcacagccctcttccacacccacttctatgaccggctgcaggatgctggcagccgctggccagagctgtacctgtacagcagagcagatgaggtggtgctggcccgggacatcgagaggatggtggaggcccggctggcccggcgggtgctggcccggtctgtggactttgtgagcagcgcccacgtgagccacctgcgggactaccccacctactacaccagcctgtgtgtggacttcatgaggaactgtgtgcgctgctag

SEQ ID NO: 39512 - DNA, 834 bp, Artificial Sequence
  Description of Artificial Sequence: Synthetic coding sequence
atggccagcgctgagctggactacaccatcgagatcccagaccagccctgctggagccagaagaacagccccagccctgggggcaaggaggccgagacccggcagcctgtggtgatcctgctgggctggggcggctgcaaggacaagaacctggccaagtacagcgccatctaccacaagaggggctgcatcgtcatccgctacacagccccctggcacatggtgttcttcagcgagagcctgggcatccccagcctgcgggtgctggcccagaagctgctggagctgctgtttgattatgaaattgagaaggagcccctgctcttccacgtgttcagcaatggaggagtgatgctgtaccgctacgtgctggagctgctgcagacccggcgcttctgccgcctgcgggtggtgggcaccatctttgacagcgcccctggggacagcaacctggtgggcgccctgcgggccctggccgccatcctggagcggcgggccgccatgctgcggctgctgctgctggtggcctttgccctggtggtggtgctcttccacgtgctgctggcccccatcacagccctcttccacacccacttctatgaccggctgcaggatgctggcagccgctggccagagctgtacctgtacagcagagcagatgaggtggtgctggcccgggacatcgagaggatggtggaggcccggctggcccggcgggtgctggcccggtctgtggactttgtgagcagcgcccacgtgagccacctgcgggactaccccacctactacaccagcctgtgtgtggacttcatgaggaactgtgtgcgctgctag

SEQ ID NO: 39513 - DNA, 606 bp, Artificial Sequence
  Description of Artificial Sequence: Synthetic coding sequence
atggccagcgctgagctggactacaccatcgagatcccagaccagccctgctggagccagaagaacagccccagccctgggggcaaggaggccgagacccggcagcctgtggtgatcctgctgggctggggcggctgcaaggacaagaacctggccaagtacagcgccatctaccacaagaggggctgcatcgtcatccgctacacagccccctggcacatggtgttcttcagcgagagcctgggcatccccagcctgcgggtgctggcccagaagctgctggagctgctgtttgattatgaaattgagaaggagcccctgctcttccacgtgttcagcaatggaggagtgatgctgtaccgctacgtgctggagctgctgcagacccggcgcttctgccgcctgcgggtggtgggcaccatctttgacagcgcccctggggacagcaacctggtgttctgcatggccagctgcctgctgctgagccccctgctggtggatggcatctctgctggaacagagggccagctgaccctgcggccagactgggccgcccaggtgctgacccggctgggctgccacctgcagtgcatcaccaggagctag

SEQ ID NO: 39514 - DNA, 336 bp, Artificial Sequence
  Description of Artificial Sequence: Synthetic coding sequence
atggccagcgctgagctggactacaccatcgagatcccagaccagccctgctggagccagaagaacagccccagccctgggggcaaggaggccgagacccggcagcctgtggtgatcctgctgggctggggcggctgcaaggacaagaacctggccaagtacagcgccatctaccacaagagggtcttctgcatggccagctgcctgctgctgagccccctgctggtggatggcatctctgctggaacagagggccagctgaccctgcggccagactgggccgcccaggtgctgacccggctgggctgccacctgcagtgcatcaccaggagctag

SEQ ID NO: 39515 - DNA, 237 bp, Artificial Sequence
  Description of Artificial Sequence: Synthetic coding sequence
atggccagcgctgagctggactacaccatcgagatcccagaccagccctgctggagccagagcctgctgcacggcctgctgctggccgccttcaccatcgccggcggctggcacctgtgctgggacagaggagccacccacaccccagcccggctgggcagcactggagccaatgctgcctggctgagccccagcatgcaccaccccaagctgcgggcccccctgcggcacagctag

SEQ ID NO: 39516 - DNA, 408 bp, Artificial Sequence
  Description of Artificial Sequence: Synthetic coding sequence
atggccagcgctgagctggactacaccatcgagatcccagaccagccctgctggagccagaagaacagccccagccctgggggcaaggaggccgagacccggcagcctgtggtgatcctgctgggctggggcggctgcaaggacaagaacctggccaagtacagcgccatctaccacaagaggctgctggagctgctgtttgattatgaaattgagaaggagcccctgctcttccacgtgttcagcaatggaggagtgatgctgtaccgctacgtgctggagctgctgcagacccggcgcttctgccgcctgcgggtggtgggcaccatctttgattctgcccctggggacagcaacctggtgggcgccctgcgggccctggccgccatcctggagcggcgggcctag

SEQ ID NO: 39517 - DNA, 510 bp, Artificial Sequence
  Description of Artificial Sequence: Synthetic coding sequence
atgtgcctgcggctgggcggcctgtctgtgggggacttcaggaaggtgctgatgaagacaggcctggtgctggtggtgctgggccacgtgtccttcatcacagctgccctcttccatggaacagtgctgcgctacgtgggcaccccccaggatgctgtggccctgcagtactgtgtggtgaacatcctgtctgtgaccagcgccatcgtgggcaaggccctgctggccgcctgcaccttcggcagcagcgagctgctggccctggccccagactgcccctttgaccccacccgcatctacagcagcagcctgtgcctgtggggcatcgccctggtgctgtgtgtggctgaaaatgtgtttgctgtgcgctgtgcccagctgacccaccagctgctggagctgcggccctggtggggcaagagcagccaccacatgatgagggagaaccctgagctggtggagggccgggacctgctgagctgcaccagcagcgagcccctgaccctgtag

SEQ ID NO: 39518 - DNA, 669 bp, Artificial Sequence
  Description of Artificial Sequence: Synthetic coding sequence
atgtgcctgcggctgggcggcctgtctgtgggggacttcaggaaggtgctgatgaagacaggcctggtgctggtggtgctgggccacgtgtccttcatcacagctgccctcttccatggaacagtgctgcgctacgtgggcaccccccaggatgctgtggccctgcagtactgtgtggtgaacatcctgtctgtgaccagcgccatcgtggtgatcaccagcggcattgctgccatcgtgctgagccgctacctgcccagcacccccctgcgctggacagtgttcagcagctctgtggcctgtgccctgctgagcctgacctgtgccctgggcctgctggccagcatcgccatgacctttgccacccagggcaaggccctgctggccgcctgcaccttcggcagcagcgagctgctggccctggccccagactgcccctttgaccccacccgcatctacagcagcagcctgtgcctgtggggcatcgccctggtgctgtgtgtggccgagaatgtgtttgctgtgcgctgtgcccagctgacccaccagctgctggagctgcggccctggtggggcaagagcagccaccacatgatgagagaaaatcctgagctggtggagggccgggacctgctgagctgcaccagcagcgagcccctgaccctgtag

SEQ ID NO: 39519 - DNA, 834 bp, Artificial Sequence
  Description of Artificial Sequence: Synthetic coding sequence
atggctgctgatggagagaggagccccctgctgtctgagcccattgatggaggagctggaggaaatggcctggtgggccctgggggcagcggggccggccctgggggcggcctgaccccatctgccccaccctatggagctgccttcccccccttccctgagggccaccctgctgtgctgcctggagaagatcctccaccctacagccccctgaccagcccagacagcggcagcgcccccatgatcacctgccgggtgtgccagagcctcatcaacgtggagggcaagatgcaccagcacgtggtgaagtgtggggtgtgcaatgaggccacccccatcaagaatgcccctcctgggaagaagtatgtgcgctgcccctgcaactgcctgctgatctgcaaggtgaccagccagagaattgcctgcccccggccctactgcaagaggatcatcaacctgggccctgtgcaccctggccccctgagccctgagccccagcccatgggcgtgcgggtcatctgtggccactgcaagaacaccttcctgtggacagagttcacagacaggaccctggcccgctgcccccactgcaggaaggtgagcagcattggaagacgctaccccaggaagcgctgcatctgctgcttcctgctgggcctgctgctggccgtgacagccaccggcctggccttcggcacctggaagcacgcccggcgctatggaggcatctatgctgcctgggcctttgtgatcctgctggccgtgctgtgcctgggccgggccctgtactgggcctgcatgaaggtgagccaccctgtgcagaacttctcctag

SEQ ID NO: 39520 - DNA, 855 bp, Artificial Sequence
  Description of Artificial Sequence: Synthetic coding sequence
atggctgctgatggagagaggagccccctgctgtctgagcccattgatggaggagctggaggaaatggcctggtgggccctgggggcagcggggccggccctgggggcggcctgaccccatctgccccaccctatggagctgggaagcacgccccaccccaggccttcccccccttccctgagggccaccctgctgtgctgcccggggaggaccccccaccctacagccccctgaccagcccagattctggcagcgcccccatgatcacctgccgggtgtgccagagcctcatcaacgtggagggcaagatgcaccagcacgtggtgaagtgtggggtgtgcaatgaggccacccccatcaagaatgcccctcctgggaagaagtatgtgcgctgcccctgcaactgcctgctgatctgcaaggtgaccagccagagaattgcctgcccccggccctactgcaagaggatcatcaacctgggccctgtgcaccctggccccctgagccctgagccccagcccatgggcgtgcgggtcatctgtggccactgcaagaacaccttcctgtggacagagttcacagacaggaccctggcccgctgcccccactgcaggaaggtgagcagcatcggccgccgctaccccaggaagcgctgcatctgctgcttcctgctgggcctgctgctggccgtgacagccaccggcctggccttcggcacctggaagcacgccaggagatatggaggcatctatgctgcctgggccttcgtcatcctgctggccgtgctgtgcctgggccgggccctgtactgggcctgcatgaaggtgagccaccctgtgcagaacttctcctag

SEQ ID NO: 39521 - DNA, 792 bp, Artificial Sequence
  Description of Artificial Sequence: Synthetic coding sequence
atggagatcaacaccaagctgctgatctctgtgacctgcatctccttcttcaccttccagctgctcttctactttgtgtcctactggttcagcgccaaggtgtccccaggcttcaacagcctgtccttcaagaagaagattgagtggaacagccgggtggtgtccacctgccacagcctggtggtgggcatcttcggcctgtacatcttcctgtttgatgaggccaccaaggctgaccccctgtggggcggccccagcctggccaacgtgaacatcgccatcgccagcggctacctgatcagtgacctgagcatcatcatcctgtactggaaggtgattggagacaagttcttcatcatgcaccactgtgccagcctgtatgcctactacctggtgctgaagaatggagtgctggcctacatcggcaacttccggctgctggccgagctgagcagcccctttgtgaaccagcgctggttctttgaggccctgaagtaccccaagttcagcaaggccatcgtcatcaatggcatcctgatgacagtggtgttcttcatcgtgagaattgcctccatgctgccccactacggcttcatgtacagcgtgtatggaacagagccctacatccggctgggcgtgctgatccagctgtcctgggtgatcagctgtgtggtgctggatgtgatgaatgtgatgtggatgatcaagatcagcaagggctgcatcaaggtgatcagccacatccggcaggagaaggccaagaacagcctgcagaatggcaagctggactag

SEQ ID NO: 39522 - DNA, 432 bp, Artificial Sequence
  Description of Artificial Sequence: Synthetic coding sequence
atggagatcaacaccaagctgctgatctctgtgacctgcatctccttcttcaccttccagctgctcttctactttgtgtcctactggttcagcgccaaggtgtccccaggcttcaacagcctgtccttcaagaagaagattgagtggaacagccgggtggtgtccacctgccacagcctggtggtgggcatcttcggcctgtacatcttcctgtttgatgaggccaccaaggctgaccccctgtggggcggccccagcctggccaacgtgaacatcgccatcgccagcggctacctgatcagtgacctgagcatcatcatcctgtactggaaggtgattggagacaagttcttcatcatgcaccactgtgccagcctgtatgcctactacctggtgctgaagaatggagtgctggcctacatcggcaactag

SEQ ID NO: 39523 - DNA, 465 bp, Artificial Sequence
  Description of Artificial Sequence: Synthetic coding sequence
atggagatcaacaccaagctgctgatctctgtgacctgcatctccttcttcaccttccagctgctcttctactttgtgtcctactggttcagcgccaaggtgtccccaggcttcaacagcctgtccttcaagaagaagattgagtggaacagccgggtggtgtccacctgccacagcctggtggtgggcatcttcggcctgtacatcttcctgtttgatgaggccaccaaggctgaccccctgtggggcggccccagcctggccaacgtgaacatcgccatcgccagcggctacctgatcagtgacctgagcatcatcatcctgtactggaaggtgattggagacaagttcttcatcatgcaccactgtgccagcctgtatgcctactacctggtgctgaagaatggagtgctggcctacatcggcaacttccggctgctggccgagctgagcagccccttctag

SEQ ID NO: 39524 - DNA, 1995 bp, Artificial Sequence
  Description of Artificial Sequence: Synthetic coding sequence
atgaagagaagaaatgctgactgcagcaagctgcggcggcccctgaagaggaaccgcatcacagagggcatctacggcagcaccttcctgtacctgaagttcctggtggtgtgggccctggtgctgctggccgactttgtgctggagttccgctttgagtacctgtggcccttctggctgttcatccgctctgtgtatgacagcttccgctaccagggcctggccttctctgtgttctttgtgtgtgtggccttcaccagcaacatcatctgcctgctcttcatccccatccagtggctgttctttgctgccagcacctacgtgtgggtgcagtatgtgtggcacacagagcggggcgtgtgcctgcccaccgtgtccctgtggatcctgtttgtgtacatcgaggccgccatccgcttcaaggacctgaagaacttccacgtggacctgtgccggccctttgctgcccactgcatcggctaccctgtggtgaccctgggcttcggcttcaagagctatgtgtcctacaagatgaggctgaggaagcagaaggaggtgcagaaggaaaatgagttctacatgcagctgctgcagcaggccctgcccccagagcagcagatgctgcagaagcaggagaaggaggccgaggaggccgccaagggcctgcctgacatggacagcagcatcctgatccaccacaacggcggcatcccagccaacaagaagctgagcaccaccctgcctgagattgagtaccgggagaagggcaaggagaaggacaaggatgccaagaagcacaacctgggcatcaacaacaacaacatcctgcagcctgtggacagcaagatccaggagattgagtacatggagaaccacatcaacagcaagaggctgaacaatgacctggtgggcagcacagagaacctgctgaaggaggacagctgcacagccagcagcaagaactacaagaatgccagcggcgtggtgaacagcagccccaggagccacagcgccaccaacggcagcatccccagcagcagcagcaagaatgagaagaagcagaagtgcaccagcaagagccccagcacccacaaggacctgatggagaactgcatccccaacaaccagctgagcaagccagatgccctggtgcggctggagcaggacatcaagaagctgaaggctgacctgcaggccagccggcaggtggagcaggagctgcggagccagatcagcagcctgagcagcacagagcggggcatccgctctgagatgggccagctgcggcaggagaatgagctgctgcagaacaagctgcacaatgctgtgcagatgaagcagaaggacaagcagaacatcagccagctggagaagaagctgaaggccgagcaggaggcccggagctttgtggagaagcagctgatggaggagaagaagaggaagaagctggaggaggccacagctgcccgggctgtggcctttgctgctgccagcagaggagaatgtacagagaccctgaggaaccgcatccgggagctggaggccgagggcaagaagctgaccatggacatgaaggtgaaggaggaccagatccgggagctggagctgaaggtgcaggagctgaggaagtacaaggaaaatgagaaggacacagaggtgctgatgtctgccctgagcgccatgcaggacaagacccagcacctggagaacagcctgtctgctgagacccgcatcaagctggacctcttcagcgccctgggagatgccaagaggcagctggagatcgcccagggccagatcctgcagaaggaccaggagatcaaggacctgaagcagaagattgctgaggtgatggctgtgatgcccagcatcacctacagcgctgccaccagccccctgagccctgtgagcccccactacagcagcaagtttgtggagaccagccccagcggcctggaccccaatgcctctgtgtaccagcccctgaagaagtag

SEQ ID NO: 39525 - DNA, 921 bp, Artificial Sequence
  Description of Artificial Sequence: Synthetic coding sequence
atgaagagaagaaatgctgactgcagcaagctgcggcggcccctgaagaggaaccgcatcacagagggcatctacggccgcctggagcaggacatcaagaagctgaaggctgacctgcaggccagccggcaggtggagcaggagctgcggagccagatcagcagcctgagcagcacagagcggggcatccgctctgagatgggccagctgcggcaggagaatgagctgctgcagaacaagctgcacaatgctgtgcagatgaagcagaaggacaagcagaacatcagccagctggagaagaagctgaaggccgagcaggaggcccggagctttgtggagaagcagctgatggaggagaagaagaggaagaagctggaggaggccacagctgcccgggctgtggcctttgctgctgccagcagaggagaatgtacagagaccctgaggaaccgcatccgggagctggaggccgagggcaagaagctgaccatggacatgaaggtgaaggaggaccagatccgggagctggagctgaaggtgcaggagctgaggaagtacaaggaaaatgagaaggacacagaggtgctgatgtctgccctgagcgccatgcaggacaagacccagcacctggagaacagcctgtctgctgagacccgcatcaagctggacctcttcagcgccctgggagatgccaagaggcagctggagatcgcccagggccagatcctgcagaaggaccaggagatcaaggacctgaagcagaagattgctgaggtgatggctgtgatgcccagcatcacctacagcgctgccaccagccccctgagccctgtgagcccccactacagcagcaagtttgtggagaccagccccagcggcctggaccccaatgcctctgtgtaccagcccctgaagaagtag

SEQ ID NO: 39526 - DNA, 1314 bp, Artificial Sequence
  Description of Artificial Sequence: Synthetic coding sequence
atgaagagaagaaatgctgactgcagcaagctgcggcggcccctgaagaggaaccgcatcacagagggcatctacggcagcaccttcctgtacctgaagttcctggtggtgtgggccctggtgctgctggccgactttgtgctggagttccgctttgagtacctgtggcccttctggctgttcatccgctctgtgtatgacagcttccgctaccagggcctggccttctctgtgttctttgtgtgtgtggccttcaccagcaacatcatctgcctgctcttcatccccatccagtggctgttctttgctgccagcacctacgtgtgggtgcagtatgtgtggcacacagagcggggcgtgtgcctgcccaccgtgtccctgtggatcctgtttgtgtacatcgaggccgccatccgcttcaaggacctgaagaacttccacgtggacctgtgccggccctttgctgcccactggctggagcaggacatcaagaagctgaaggctgacctgcaggccagccggcaggtggagcaggagctgcggagccagatcagcagcctgagcagcacagagcggggcatccgctctgagatgggccagctgcggcaggagaatgagctgctgcagaacaagctgcacaatgctgtgcagatgaagcagaaggacaagcagaacatcagccagctggagaagaagctgaaggccgagcaggaggcccggagctttgtggagaagcagctgatggaggagaagaagaggaagaagctggaggaggccacagctgcccgggctgtggcctttgctgctgccagcagaggagagtgcacagagaccctgaggaaccgcatccgggagctggaggccgagggcaagaagctgaccatggacatgaaggtgaaggaggaccagatccgggagctggagctgaaggtgcaggagctgaggaagtacaaggaaaatgagaaggacacagaggtgctgatgtctgccctgagcgccatgcaggacaagacccagcacctggagaacagcctgtctgctgagacccgcatcaagctggacctcttcagcgccctgggagatgccaagaggcagctggagatcgcccagggccagatcctgcagaaggaccaggagatcaaggacctgaagcagaagattgctgaggtgatggctgtgatgcccagcatcacctacagcgctgccaccagccccctgagccctgtgagcccccactacagcagcaagtttgtggagaccagccccagcggcctggaccccaatgcctctgtgtaccagcccctgaagaagtag

SEQ ID NO: 39527 - DNA, 627 bp, Artificial Sequence
  Description of Artificial Sequence: Synthetic coding sequence
atggacaagtttgtgatccgcaccccccgcatccagaacagcccccagaagaaggacagcggcggcaaggtgtacaagcaggccaccatcgagagcctgaagagggtggtggtggtggaggacatcaagcgctggaagaccatgctggagctgcctgaccagaccaaggagaacctggtggaggccctgcaggagctgaagaagaagatccccagccgggaggtgctgaagagcaccagaattggccacacagtgaacaagatgaggaagcacagcgacagcgaggtggccagcctggcccgggaggtgtacacagagtggaagaccttcacagagaagcacagcaaccggcccagcattgaggtgcggagtgaccccaagacagagagcctgaggaagaatgcccagaagctgctgtctgaggccctggagctgaagatggaccacctgctggtggagaacatcgagcgggagaccttccacctgtgcagccgcctcatcaatggcccctacagaagaacagtgcgggccctggtgttcaccctgaagcacagagctgagatccgggcccaggtgaagagcggcagcctgcctgtgggcacctttgtgcagacccacaagaagtag

SEQ ID NO: 39528 - DNA, 438 bp, Artificial Sequence
  Description of Artificial Sequence: Synthetic coding sequence
atggccgcccccaagggcagcctgtgggtgaggacccagctgggcctgccccccctgctgctgctgaccatggccctggccggcggcagcggcacagccagcgctgaggcctttgacagcgtgctgggggacacagccagctgccaccgggcctgccagctgacctaccccctgcacacctaccccaaggaggaggagctgtatgcctgccagaggggctgccgcctcttcagcatctgccagtttgtggatgatggcatcgacctgaacagaaccaagctggagtgtgagagcgcctgcacagaggcctacagccagagtgatgagcagtatgcctgccacctgggctgccagaaccagctgccctttgctgagctgcggcaggagcaggtgaggaacaacacagccttccagaccagcctgctgcgctggcactag

SEQ ID NO: 39529 - DNA, 852 bp, Artificial Sequence
  Description of Artificial Sequence: Synthetic coding sequence
atggccgcccccaagggcagcctgtgggtgaggacccagctgggcctgccccccctgctgctgctgaccatggccctggccggcggcagcggcacagccagcgctgaggcctttgacagcgtgctgggggacacagccagctgccaccgggcctgccagctgacctaccccctgcacacctaccccaaggtgtctgccagcctgtacacagtggaccacatcgaggaggagctgtatgcctgccagaggggctgccgcctcttcagcatctgccagtttgtggatgatggcatcgacctgaacagaaccaagctggagtgtgagagcgcctgcacagaggcctacagccagagtgatgagcagtatgcctgccacctgggctgccagaaccagctgccctttgctgagctgcggcaggagcagctgatgagcctgatgcccaagatgcacctgctcttccccctgaccctggtgcgctccttctggagcgacatgatggacagcgcccagagcttcatcaccagctcctggaccttctacctgcaggctgatgatggcaagatcgtcatcttccagagcaagccagagatccagtatgccccccacctggagcaggagcccaccaacctgcgggagagcagcctgagcaagatgagctacctgcagatgaggaacagccaggcccacaggaacttcctggaggatggagagagtgatggcttcctgcgctgcctgagcctgaacagcggctggatcctgaccaccaccctggtgctgtctgtgatggtgctgctgtggatctgctgtgccaccgtggccacagctgtggagcagtatgtgcccagcgagtag

SEQ ID NO: 39530 - DNA, 579 bp, Artificial Sequence
  Description of Artificial Sequence: Synthetic coding sequence
atgagcctgatgcccaagatgcacctgctcttccccctgaccctggtgcgctccttctggagcgacatgatggacagcgcccagagcttcatcaccagctcctggaccttctacctgcaggctgatgatggcaagatcgtcatcttccagagcaagccagagatccagtatgccccccacctggagcaggagcccaccaacctgcgggagagcagcctgagcaagatgagctacctgcagatgaggaacagccaggcccacaggaacttcctggaggatggagagagtgatggcttcctgcgctgcctgagcctgaacagcggctggatcctgaccaccaccctggtgctgtctgtgatggtgctgctgtggatctgctgtgccaccgtggccacagctgtggagcagtatgtgcccagcgagaagctgagcatctacggggacctggagttcatgaatgagcagaagctgaaccgctacccagccagcagcctggtggtggtgcgcagcaagacagaagatcatgaggaggccggccccctgcccaccaaggtgaacctggcccacagcgagatctag

SEQ ID NO: 39531 - DNA, 579 bp, Artificial Sequence; identical to SEQ ID NO: 39530
  Description of Artificial Sequence: Synthetic coding sequence

SEQ ID NO: 39532 - DNA, 579 bp, Artificial Sequence; identical to SEQ ID NO: 39530
  Description of Artificial Sequence: Synthetic coding sequence

SEQ ID NO: 39533 - DNA, 435 bp, Artificial Sequence
  Description of Artificial Sequence: Synthetic coding sequence
atgagcctgatgcccaagatgcacctgctcttccccctgaccctggtgcgctccttctggagcgacatgatggacagcgcccagagcttcatcaccagctcctggaccttctacctgcaggctgatgatggcaagatcgtcatcttccagagcaagccagagatccagtatgccccccacctggagcaggagcccaccaacctgcgggagagcagcctgagcaagatgagctacctgcagatgaggaacagccaggcccacaggaacttcctggaggatggagagagtgatggcttcctgcgctgcctgagcctgaacagcggctggatcctgaccaccaccctggtgctgtctgtgatggtgctgctgtggatctgctgtgccaccgtggccacagctgtggagcagtatgtgcccagcgaggtgaacctgtag

SEQ ID NO: 39534 - DNA, 435 bp, Artificial Sequence; identical to SEQ ID NO: 39533
  Description of Artificial Sequence: Synthetic coding sequence

SEQ ID NO: 39535 - DNA, 858 bp, Artificial Sequence
  Description of Artificial Sequence: Synthetic coding sequence
atggccgcccccaagggcagcctgtgggtgaggacccagctgggcctgccccccctgctgctgctgaccatggccctggccggcggcagcggcacagccagcgctgaggcctttgacagcgtgctgggggacacagccagctgccaccgggcctgccagctgacctaccccctgcacacctaccccaaggtgtctgccagcctgtacacagtggaccacatcgaggaggagctgtatgcctgccagaggggctgccgcctcttcagcatctgccagtttgtggatgatggcatcgacctgaacagaaccaagctggagtgtgagagcgcctgcacagaggcctacagccagagtgatgagcagtatgcctgccacctgggctgccagaaccagctgccctttgctgagctgcggcaggagcagctgatgagcctgatgcccaagatgcacctgctcttccccctgaccctggtgcgctccttctggagcgacatgatggacagcgcccagagcttcatcaccagctcctggaccttctacctgcaggctgatgatggcaagatcgtcatcttccagagcaagccagagatccagtatgccccccacctggagcaggagcccaccaacctgcgggagagcagcctgagcaagatgagctacctgcagatgaggaacagccaggcccacaggaacttcctggaggatggagagagtgatggcttcctgcgctgcctgagcctgaacagcggctggatcctgaccaccaccctggtgctgtctgtgatggtgctgctgtggatctgctgtgccaccgtggccacagctgtggagcagtatgtgcccagcgaggtgaactag

SEQ ID NO: 39536 - DNA, 1029 bp, Artificial Sequence
  Description of Artificial Sequence: Synthetic coding sequence
atggctgctgtggccctgatgcccccacccctgctgctgctgctgctgctggccagccccccagctgccagcgcccccagcgcccgggacccctttgccccccagctgggggacacccagaactgccagctgcgctgccgggaccgggacctgggcccccagcccagccaggccggcctggagggcgccagcgagagcccctatgacagagctgtgctgatcagcgcctgtgagcggggctgccgcctcttcagcatctgccgctttgtggcccggagcagcaagcccaatgccacccagacagaatgtgaggccgcctgtgtggaggcctacgtgaaggaggccgagcagcaggcctgcagccacggctgctggagccagcctgctgagcctgagcctgagcagaagaggaaggtgctggaggcccccagcggggccctgagcctgctggacctcttcagcaccctgtgcaatgacctggtgaacagcgcccagggctttgtgagcagcacctggacctactacctgcagacagacaacgggaaggtggtggtgttccagacccagcccatcgtggagagcctgggcttccagggcggccgcctgcagagggtggaggtgacctggaggggcagccaccctgaggccctggaggtgcacgtggaccctgtgggccccctggacaaggtgaggaaggccaagatccgggtgaagaccagcagcaaggccaaggtggagagcgaggagccccaggacaatgacttcctgagctgcatgagcagaagaagtggcctgccccgctggatcctggcctgctgcctcttcctgtctgtgctggtgatgctgtggctgagctgcagcaccctggtgacagcccctggccagcacctgaagttccagcccctgaccctggagcagcacaagggcttcatgatggagccagactggcccctgtaccccccacccagccacgcctgtgaggacagcctgcccccctacaagctgaagctggacctgaccaagctgtag

SEQ ID NO: 39537 - DNA, 1029 bp, Artificial Sequence; identical to SEQ ID NO: 39536
  Description of Artificial Sequence: Synthetic coding sequence

SEQ ID NO: 39538 - DNA, 402 bp, Artificial Sequence
  Description of Artificial Sequence: Synthetic coding sequence
atgaggatgagcctggcccagagggtgctgctgacctggctgttcaccctgctcttcctgatcatgctggtgctgaagctggatgagaaggccccctggaactggttcctgatcttcatccctgtgtggatctttgacaccatcctgctggtgctgctgattgtgaagatggccggccgctgcaagagcggctttgaccccaggcatggcagccacaacatcaagaagaaggcctggtacctgattgccatgctgctgaagctggccttctgcctggccctgtgtgccaagctggagcagttcaccaccatgaacctgtcctatgtgttcatccccctgtgggccctgctggccggggccctgacagagctgggctacaacgtgttctttgtgcgggactag

SEQ ID NO: 39539 - DNA, 633 bp, Artificial Sequence
  Description of Artificial Sequence: Synthetic coding sequence
atggccctgccccagatgtgtgatggcagccacctggccagcaccctgcgctactgcatgacagtgtctggaacagtggtgctggtggccggcaccctgtgctttgcctggtggagcgaaggagatgccacagcccagcccggccagctggccccacccacagagtaccctgtgcctgagggccccagccccctgctgcggtctgtgtcctttgtgtgctgcggggccggcggcctgctgctgctgattggcctgctgtggagcgtgaaggccagcatccctggccccccacgctgggacccctaccacctgagccgggacctgtactacctgactgtggagagcagcgagaaggagagctgcaggacccccaaggtggtggacatccccacctatgaggaggccgtgtccttccctgtggccgagggcccccccaccccaccagcctaccccacagaggaggccctggagcccagcggcagcagagatgccctgctgagcacccagcctgcctggcccccacccagctatgagagcatcagcctggccctggatgctgtgtctgctgagaccacccccagcgccaccaggagctgcagcggcctggtgcagacagcccggggcggcagctag

SEQ ID NO: 39540 - DNA, 1932 bp, Artificial Sequence
  Description of Artificial Sequence: Synthetic coding sequence
atggctgctgtgctggccctgcgggtggtggccggcctggccgccgccgccctggtggccatgctgctggagcactacggcctggccggccagcccagccccctgcccaggcctgccccaccccggcggccccacccagcccctggccctggggacagcaacatcttctggggcctgcagatcagtgacatccacctgagccgcttccgggaccccggccgggctgtggacctggagaagttctgcagcgagaccatcgacatcatccagcctgccctggtgctggccactggagacctgacagatgccaagaccaaggagcagctgggcagccggcagcacgaggtggagtggcagacctaccagggcatcctgaagaagaccagggtgatggagaagaccaagtggctggacatcaagggcaaccatgatgccttcaacatccccagcctggacagcatcaagaactactacaggaagtacagcgctgtgagaagagatggcagcttccactacgtgcacagcacccccttcggcaactacagcttcatctgtgtggatgccaccgtgaaccctggccccaagaggccctacaacttcttcggcatcctggacaagaagaagatggaggagctgctgctgctggccaaggagagcagccgcagcaaccacaccatctggtttggccacttcaccaccagcaccatcctgagccccagccctggcatccgcagcatcatgagcagcgccatcgcctacctgtgtggccacctgcacaccctgggcggcctgatgcctgtgctgcacaccaggcacttccagggcaccctggagctggaggtgggggactggaaggacaacagacgctaccgcatctttgcctttgaccatgacctcttctcctttgctgacctgatctttgggaagtggcctgtggtgctgatcaccaaccccaagagcctgctgtacagctgtggggagcacgagcccctggagcggctgctgcacagcacccacatccgggtgctggccttcagcctgagcagcatcacctctgtgacagtgaagattgatggagtgcacctgggccaggccgtgcacgtgtctggccccatctttgtgctgaagtggaaccccaggaactacagcagcggcacccacaacattgaagtcatcgtgcaggacagcgctggccgcagcaagtctgtgcaccacatcttctctgtgcaggagaacaaccacctgagctttgaccccctggccagcttcatcctgaggacagaccactacatcatggcccgggtgctgtttgtgctgattgtgctgagccagctgaccatcctgatcatcttccgctaccggggctacccagagctgaaggagcccagcggcttcatcaacctgaccagcttcagcctgcacgtgctgagcaagatcaacatcttctactacagcgtgctgctgctgaccctgtacacagtgctgggcccctggttcttcggggagatcattgatggcaagtttggctgctgcttctcctttggcatctttgtgaatggccacttcctgcagggcagcatcaccttcatcatcggcatcctgcagctggccttcttcaacatccccctgatggcctacatgtgctggagcctgctgcagcgctgcttcggccacaacttccgcagccacctgcaccagaggaagtacctgaagatcatgcctgtgcacctgctgatgctgctgctgtacatctggcaggtgtacagctgctacttcctgtatgccacctacggcaccctggccttcctgttcagccccctgcggacctggctgaccctgctgacccctgtgctgatccgctacgtgtggaccctgaacagcaccaagtttggcatcttcatggtgcagctgaagagccacctgagcagctag

SEQ ID NO: 39541 - DNA, 2424 bp, Artificial Sequence
  Description of Artificial Sequence: Synthetic coding sequence
atgatggacagccccttcctggagctgtggcagagcaaggctgtgtccatccgggagcagctgggcctgggggaccggcccaatgacagctactgctacaacagcgccaagaacagcacagtgctgcagggcgtgacctttggaggcatccccaccgtgctgctgattgatgtgtcctgcttcctgttcctgatcctggtgttcagcatcatcagaagacgcttctgggactatggaagaattgccctggtgtctgaggccgacagcgagagccgcttccagaggctgagcagcaccagcagcagcggccagcaggactttgaaaatgagctgggctgctgcccctggctgacagccatcttccggctgcatgatgaccagatcctggagtggtgtggggaggatgccatccactacctgtccttccagaggcacatcatcttcctgctggtggtggtgtccttcctgagcctgtgtgtgatcctgcctgtgaacctgagcggggacctgctggacaaggacccctacagctttggccgcaccaccatcgccaacctgcagacagacaatgacctgctgtggctgcacaccatctttgctgtgatctacctgttcctgactgtgggcttcatgaggcaccacacccagagcatcaagtacaaggaggagaacctggtgcggaggaccctcttcatcaccggcctgcccagagatgccaggaaggagaccgtggagagccacttcagagatgcctaccccacctgtgaggtggtggatgtgcagctgtgctacaacgtggccaagctgatctacctgtgcaaggagaagaagaagacagagaagagcctgacctactacaccaacctgcaggtgaagacaggccagaggaccctcatcaaccccaagccctgtggccagttctgctgctgtgaggtgctgggctgtgagtgggaggatgccatctcctactacaccaggatgaaggaccggctgctggagcgcatcacagaggaggagagacatgtgcaggaccagcccctgggcatggcctttgtgaccttccaggagaagtccatggccacctacatcctgaaggacttcaatgcctgcaagtgccagagcctgcagtgcaagggggagccccagcccagcagccacagccgggagctgtacaccagcaagtggacagtgacctttgctgctgaccctgaggacatctgctggaagaacctgagcatccagggcctgcgctggtggctgcagtggctgggcatcaacttcaccctcttcctgggcctcttcttcctgaccacccccagcatcatcctgagcaccatggacaagttcaacgtgaccaagcccatccacgccctgaacaaccccatcatcagccagttcttccccaccctgctgctgtggagcttcagcgccctgctgcccagcatcgtgtactacagcaccctgctggagagccactggaccaagagcggggagaaccagatcatgatgaccaaggtgtacatcttcctgatcttcatggtgctgatcctgcccagcctgggcctgaccagcctggacttcttcttccgctggctgtttgacaagaccagcagcgaggccagcatccggctggagtgtgtgttcctgcctgaccagggcgccttctttgtgaactacgtgattgccagcgccttcatcggaaatggcatggagctgctgcggctgcccggcctcatcctgtacaccttcaggatgatcatggccaagacagctgctgacagaagaaatgtgaagcagaaccaggccttccagtatgaatttggagccatgtatgcctggatgctgtgtgtgttcaccgtgattgtggcctacagcatcacctgccccatcatcgcccccttcggcctcatctacatcctgctgaagcacatggtggacagacacaacctgtactttgtgtacctgcctgccaagctggagaagggcatccactttgctgctgtgaaccaggccctggccgcccccatcctgtgcctcttctggctgtacttcttctccttcctgcggctgggcatgaaggccccagccaccctcttcaccttcctggtgctgctgctgaccatcctggtgtgcctggcccacacctgcttcggctgcttcaagcacctgagccccctgaactacaagacagaggagcccgccagtgacaagggcagcgaggccgaggcccacatgcccccacccttcaccccctacgtgccccgcatcctgaatggcctggccagcgagaggacagccctgagcccccagcagcagcagcagcagacctatggagccatccacaacatcagcggcaccatccctggccagtgcctggcccagagcgccactggatctgtggccgccgccccccaggaggcctag

SEQ ID NO: 39542 - DNA, 357 bp, Artificial Sequence
  Description of Artificial Sequence: Synthetic coding sequence
atgatggacagccccttcctggagctgtggcagagcaaggctgtgtccatccgggagcagctgggcctgggggaccggcccaatgacagctactgctacaacagcgccaagaacagcacagtgctgcagggcgtgacctttggaggcatccccaccgtgctgctgattgatgtgtcctgcttcctgttcctgatcctggtgttcagcatcatcagaagacgcttctgggactatggaagaattgccctggtgtctgaggccgacagcgagagccgcttccagaggctgagcagcaccagcagcagcggccagcaggactttgaaaatgagctgggctgctgcccctggctgacctag

SEQ ID NO: 39543 - DNA, 249 bp, Artificial Sequence
  Description of Artificial Sequence: Synthetic coding sequence
atgaaggaccggctgctggagcgcatcacagaggaggagagacatgtgcaggaccagcccctgggcatggcctttgtgaccttccaggagaagtccatggccacctacatcctgaaggacttcaatgcctgcaagtgccagagcctgcagtgcaagggggagccccagcccagcagccacagccgggagctgtacaccagcaagtggacagtgacctttgctgctgaccctgaggacatctgctggtag

SEQ ID NO: 39544 - DNA, 2499 bp, Artificial Sequence
  Description of Artificial Sequence: Synthetic coding sequence
atgctgcccttcctgctggccaccctgggcaccacagccctgaacaacagcaaccccaaggactactgctacagcgcccgcatccgcagcacagtgctgcagggcctgccctttggaggagtgcccaccgtgctggccctggacttcatgtgcttcctggccctgctcttcctgttcagcatcctgaggaaggtggcctgggactatggccgcctggccctggtgacagatgctgaccggctgcggcggcaggagcgggacagagtggagcaggagtatgtggccagcgccatgcatggagacagccatgacagatatgaaaggctgacctctgtgagcagctctgtggactttgaccagagggacaatggcttctgctcctggctgacagccatcttccgcatcaaggatgatgagatccgggacaagtgtggaggagatgctgtgcactacctgtccttccagaggcacatcatcggcctgctggtggtggtgggcgtgctgtctgtgggcatcgtgctgcctgtgaacttcagcggggacctgctggagaacaatgcctacagctttggccgcaccaccatcgccaacctgaagagcggcaacaacctgctgtggctgcacaccagctttgccttcctgtacctgctgctgactgtgtacagcatgaggaggcacaccagcaagatgagatacaaggaggatgacctggtgaagaggaccctcttcatcaatggcatcagcaaatatgcagagagcgagaagatcaagaagcactttgaggaggcctaccccaactgcaccgtgctggaggcccggccctgctacaacgtggcccggctgatgttcctggatgctgagaggaagaaggccgagcggggcaagctgtacttcaccaacctgcagagcaaagaaaatgtgcccaccatgatcaaccccaagccctgtggccacctgtgctgctgcgtggtgcggggctgtgagcaggtggaggccatcgagtactacaccaagctggagcagaagctgaaggaggactacaagcgggagaaggagaaggtgaatgagaagcccctgggcatggcctttgtgaccttccacaatgagaccatcacagccatcatcctgaaggacttcaacgtgtgcaagtgccagggctgcacctgccgcggggagccccggcccagcagctgcagcgagagcctgcacatcagcaactggacagtgtcctatgccccagacccccagaacatctactgggagcacctgagcatccggggcttcatctggtggctgcgctgcctggtgatcaacgtggtgctcttcatcctgctcttcttcctgaccaccccagccatcatcatcaccaccatggacaagttcaacgtgaccaagcctgtggagtacctgaacaaccccatcatcacccagttcttccccaccctgctgctgtggtgcttcagcgccctgctgcccaccatcgtgtactacagcgccttctttgaggcccactggaccaggtctggagagaacagaaccaccatgcacaagtgctacaccttcctgatcttcatggtgctgctgctgcccagcctgggcctgagcagcctggacctcttcttccgctggctgtttgacaagaagttcctggccgaggccgccatccgctttgaatgtgtgttcctgcctgacaatggagccttctttgtgaactacgtgattgccagcgccttcatcggaaatgccatggacctgctgcgcatccctggcctgctgatgtacatgatccggctgtgcctggcccggtctgctgctgagaggagaaatgtgaagaggcaccaggcctatgagttccagtttggagctgcctatgcctggatgatgtgtgtgttcaccgtggtgatgacctacagcatcacctgccccatcatcgtgcccttcggcctgatgtacatgctgctgaagcacctggtggaccgctacaacctgtactatgcctacctgcctgccaagctggacaagaagatccacagcggggctgtgaaccaggtggtggccgcccccatcctgtgcctcttctggctgctcttcttcagcaccatgaggacaggcttcctggcccccacctccatgttcacctttgtggtgctggtgatcaccatcgtcatctgcctgtgccacgtgtgcttcggccacttcaagtacctgagcgcccacaactacaagattgagcacacagaaacagacacagtggaccccaggagcaatggccggcccccaacagctgctgctgtgcccaagagcgccaagtacatcgcccaggtgctgcaggacagcgaggtggatggagatggagatggagcccctggcagcagtggagatgagccccccagcagcagcagccaggatgaggagctgctgatgcccccagatgccctgacagacacagacttccagagctgtgaggacagcctgattgaaaatgagatccaccagtag

SEQ ID NO: 39545 - DNA, 2499 bp, Artificial Sequence; identical to SEQ ID NO: 39544
  Description of Artificial Sequence: Synthetic coding sequence

SEQ ID NO: 39546 - DNA, 681 bp, Artificial Sequence
  Description of Artificial Sequence: Synthetic coding sequence
atgctgcccttcctgctggccaccctgggcaccacagccctgaacaacagcaaccccaaggactactgctacagcgcccgcatccgcagcacagtgctgcagggcctgccctttggaggagtgcccaccgtgctggccctggacttcatgtgcttcctggccctgctcttcctgttcagcatcctgaggaaggtggcctgggactatggccgcctggccctggtgacagatgctgaccggctgcggcggcaggagcgggacagagtggagcaggagtatgtggccagcgccatgcatggagacagccatgacagatatgaaaggctgacctctgtgagcagctctgtggactttgaccagagggacaatggcttctgctcctggctgacagccatcttccgcatcaaggatgatgagatccgggacaagtgtggaggagatgctgtgcactacctgtccttccagaggcacatcatcggcctgctggtggtggtgggcgtgctgtctgtgggcatcgtgctgcctgtgaacttcagcggggacctgctggagaacaatgcctacagctttggccgcaccaccatcgccaacctgaagagcggcaacaacctgctgtggctgcacaccagctttgccttcctgtacctgctgctgactgtgtacagcatgaggaggcactag

SEQ ID NO: 39547 - DNA, 2421 bp, Artificial Sequence
  Description of Artificial Sequence: Synthetic coding sequence
atgtctgccagcccagatgacctgagcactggaggccgcctgcagaacatgacagtggatgagtgcttccagagcaggaacacagtgctgcagggccagccctttggaggagtgcccaccgtgctgtgcctgaacatcgccctgtgggtgctggtgctggtggtgtacagcttcctgaggaaggccgcctgggactatggccgcctggccctgctgatccacaatgacagcctgaccagcctcatctatggagagcagagcgagaagaccagccccagcgagaccagcctggagatggagcggcgggacaagggcttctgctcctggttcttcaacagcatcaccatgaaggatgaagatctcatcaacaagtgtggagatgatgcccgcatctacatcgtgttccagtaccacctgatcatctttgtgctgatcatctgcatccccagcctgggcatcatcctgcccatcaactacacaggctctgtgctggactggagcagccactttgcccggaccaccatcgtgaatgtgtccacagagagcaagctgctgtggctgcacagcctgctgtccttcttctacttcatcaccaacttcatgttcatggcccaccactgcctgggctttgcccccaggaacagccagaaggtgaccaggaccctgatgatcacctacgtgcccaaggacatcgaggaccctgagctgatcatcaagcacttccacgaggcctacccaggctctgtggtgaccagggtgcacttctgctatgatgtgaggaacctgattgacctggatgaccagaggagacatgccatgaggggccgcctcttctacacagccaaggccaagaagacaggcaaggtgatgatccgcatccacccctgtgcccggctgtgcttctgcaagtgctggacctgcttcaaggaggtggatgctgagcagtactacagcgagctggaggagcagctgacagatgagttcaatgctgagctgaacagagtgcccctgaagaggctggacctgatctttgtgaccttccaggacagcaggatggccaagagggtgaggaaggactacaagtatgtgcagtgtggggtgcagccccagcagagctctgtgaccaccatcgtgaagagctactactggagggtgaccatggccccccaccccaaggacatcatctggaagcacctgtctgtgcggcgcttcttctggtgggcccgcttcatcgccatcaacaccttcctgttcttcctgttcttcttcctgaccaccccagccatcatcatgaacaccatcgacatgtacaacgtgacccggcccatcgagaagctgcagaaccccatcgtgacccagttcttccccagcgtgatgctgtggggcttcaccgtcatcctgcccctcatcgtgtacttcagcgccttcctggaggcccactggaccaggagcagccagaacctggtgatggtgcacaagtgctacatcttcctggtgttcatggtggtgatcctgcccagcatgggcctgaccagcctggatgtgttcctgcgctggctgtttgacatctactacctggagcaggccagcatccgcttccagtgtgtgttcctgcctgacaatggagccttctttgtgaactacgtgatcacagctgccctgctgggcaccggcatggagctgctgcggctgggcagcctcttctgctacagcaccaggctcttcttcagccgctctgagcctgagcgggtgaacatcaggaagaaccaggccatcgacttccagtttggccgggagtatgcctggatgatgaatgtgttttctgtggtgatggcctacagcatcacctgccccatcatcgtgcccttcggcctgctgtacctgtgcatgaagcacctgacagaccgctacaacatgtactacagctttgcccccaccaagctgaatgagcagatccacatggctgctgtgtcccaggccatctttgcccccctgctgggcctcttctggatgctgttcttcagcatcctgcggctgggcagcctgcacgccatcaccatcttcagcctgagcaccctgctgattgccatggtgattgcctttgtgggcatcttcctgggcaagctgaggatggtggccgactatgagcctgaggaggaggagatccagacagtgtttgacatggagcccagcagcaccagcagcacccccaccagcctgctgtatgtggccaccgtgctgcaggagcctgagctgaacctgaccccagccagcagccctgcccggcacacctacggcaccatgaacaaccagcctgaggagggggaggaggagagcggcctgcggggctttgcccgggagctggacagcgcccagttccaggagggcctggagctggagggccagaaccagtaccactag

SEQ ID NO: 39548 - DNA, 1131 bp, Artificial Sequence
  Description of Artificial Sequence: Synthetic coding sequence
atgaacaccatcgacatgtacaacgtgacccggcccatcgagaagctgcagaaccccatcgtgacccagttcttccccagcgtgatgctgtggggcttcaccgtcatcctgcccctcatcgtgtacttcagcgccttcctggaggcccactggaccaggagcagccagaacctggtgatggtgcacaagtgctacatcttcctggtgttcatggtggtgatcctgcccagcatgggcctgaccagcctggatgtgttcctgcgctggctgtttgacatctactacctggagcaggccagcatccgcttccagtgtgtgttcctgcctgacaatggagccttctttgtgaactacgtgatcacagctgccctgctgggcaccggcatggagctgctgcggctgggcagcctcttctgctacagcaccaggctcttcttcagccgctctgagcctgagcgggtgaacatcaggaagaaccaggccatcgacttccagtttggccgggagtatgcctggatgatgaatgtgttttctgtggtgatggcctacagcatcacctgccccatcatcgtgcccttcggcctgctgtacctgtgcatgaagcacctgacagaccgctacaacatgtactacagctttgcccccaccaagctgaatgagcagatccacatggctgctgtgtcccaggccatctttgcccccctgctgggcctcttctggatgctgttcttcagcatcctgcggctgggcagcctgcacgccatcaccatcttcagcctgagcaccctgctgattgccatggtgattgcctttgtgggcatcttcctgggcaagctgaggatggtggccgactatgagcctgaggaggaggagatccagacagtgtttgacatggagcccagcagcaccagcagcacccccaccagcctgctgtatgtggccaccgtgctgcaggagcctgagctgaacctgaccccagccagcagccctgcccggcacacctacggcaccatgaacaaccagcctgaggagggggaggaggagagcggcctgcggggctttgcccgggagctggacagcgcccagttccaggagggcctggagctggagggccagaaccagtaccactag

SEQ ID NO: 39549 - DNA, 153 bp, Artificial Sequence
  Description of Artificial Sequence: Synthetic coding sequence
atgtctgccagcccagatgacctgagcactggaggccgcctgcagaacatgacagtggatgagtgcttccagagcaggaacacagtgctgcagggccagccctttggaggagtgcccaccgtgctgtgcctgaacatcgccctgtgggtgtag

SEQ ID NO: 39550 - DNA, 495 bp, Artificial Sequence
  Description of Artificial Sequence: Synthetic coding sequence
atgtctgccagcccagatgacctgagcactggaggccgcctgcagaacatgacagtggatgagtgcttccagagcaggaacacagtgctgcagggccagccctttggaggagtgcccaccgtgctgtgcctgaacatcgccctgtgggtgctggtgctggtggtgtacagcttcctgaggaaggccgcctgggactatggccgcctggccctgctgatccacaatgacagcctgaccagcctcatctatggagagcagagcgagaagaccagccccagcgagaccagcctggagatggagcggcgggacaagggcttctgctcctggttcttcaacagcatcaccatgaaggatgaagatctcatcaacaagtgtggagatgatgcccgcatctacatcgtgttccagtaccacctgatcatctttgtgctgatcatctgcatccccagcctgggcatcatcctgcccatcaactacacaggctctgtgctgtag

SEQ ID NO: 39551 - DNA, 156 bp, Artificial Sequence
  Description of Artificial Sequence: Synthetic coding sequence
atgtctgccagcccagatgacctgagcactggaggccgcctgcagaacatgacagtggatgagtgcttccagagcaggaacacagtgctgcagggccagccctttggaggagtgcccaccgtgctgtgcctgaacatcgccctgtgggtgctgtag

SEQ ID NO: 39552 - DNA, 111 bp, Artificial Sequence
  Description of Artificial Sequence: Synthetic coding sequence
atgtctgccagcccagatgacctgagcactggaggccgcctgcagaacatgacagtggatgagtgcttccagagcaggaacacagtgctgcagggccagccctttggatag

SEQ ID NO: 39553 - DNA, 72 bp, Artificial Sequence
  Description of Artificial Sequence: Synthetic coding sequence
atgtctgccagcccagatgacctgagcactggaggccgcctgcagaacatgacagtggatgagtgcttctag

SEQ ID NO: 39554 - DNA, 987 bp, Artificial Sequence
  Description of Artificial Sequence: Synthetic coding sequence
atgaggagccctgggggcatcctgctgcaggccctgccccggctgctgcagcacgccgccctgcccggcctggccgagctgcctgcccgctgggccctgcccagaggagctggaggagatggccctgctgaccggctgccccggggcggcggggccagcgctgctgctgctgctgctgctgccagcggggccctgctgggcgcctacctggagagacatggccccccagaggccagcgagctgcctgagcccggcggggccctggccggcggccctggcagcggcggcggcggcgtggtggtgggcgtggccgaggtgaggaactggcgctgctgctgcctgggcagcacctgctggtgccgcagcctggtgctggtgtgtgtgctggccgccctgtgctttgccagcctggccctggtgcggcgctacctgcaccacctgctgctgtgggtggagagcctggacagcctgctgggcgtgctgctgtttgtggtgggcttcatcgtggtgtccttcccctgtggctggggctacatcgtgctgaatgtggccgccggctacctgtatggctttgtgctgggcatgggcctgatgatggtgggcgtgctgattggcaccttcatcgcccacgtggtgtgcaagaggctgctgacagcctgggtggccgcccgcatccagagcagcgagaagctgtctgctgtgatccgggtggtggagggcggcagcggcctgaaggtggtggccctggcccggctgacccccatccccttcggcctgcagaatgctgtgttcagcatcatcatcagcatcggcctgatgttttatgtggtgcaccgggcccaggtggagctgaatgctgccatcgtggcctgtgagatggagctgaagagcagcctggtgaagggcaaccagcccaacaccagcggcagcagcttctacaacaagaggaccctgaccttcagcggcggcggcatcaacgtggtgtag

SEQ ID NO: 39555 - DNA, 1143 bp, Artificial Sequence
  Description of Artificial Sequence: Synthetic coding sequence
atgaggagccctgggggcatcctgctgcaggccctgccccggctgctgcagcacgccgccctgcccggcctggccgagctgcctgcccgctgggccctgcccagaggagctggaggagatggccctgctgaccggctgccccggggcggcggggccagcgctgctgctgctgctgctgctgccagcggggccctgctgggcgcctacctggagagacatggccccccagaggccagcgagctgcctgagcccggcggggccctggccggcggccctggcagcggcggcggcggcgtggtggtgggcgtggccgaggtgaggaactggcgctgctgctgcctgggcagcacctgctggtgccgcagcctggtgctggtgtgtgtgctggccgccctgtgctttgccagcctggccctggtgcggcgctacctgcaccacctgctgctgtgggtggagagcctggacagcctgctgggcgtgctgctgtttgtggtgggcttcatcgtggtgtccttcccctgtggctggggctacatcgtgctgaatgtggccgccggctacctgtatggctttgtgctgggcatgggcctgatgatggtgggcgtgctgattggcaccttcatcgcccacgtggtgtgcaagaggctgctgacagcctgggtggccgcccgcatccagagcagcgagaagctgtctgctgtgatccgggtggtggagggcggcagcggcctgaaggtggtggccctggcccggctgacccccatccccttcggcctgcagaatgctgtgttcagcatcacagacctgagcctgcccaactacctgatggccagctctgtgggcctgctgcccacccagctgctgaacagctacctgggcaccaccctgcggaccatggaggatgtgattgctgagcagagcgtgtctggctactttgtgttctgcctgcagatcatcatcagcatcggcctgatgttttatgtggtgcaccgggcccaggtggagctgaatgctgccatcgtggcctgtgagatggagctgaagagcagcctggtgaagggcaaccagcccaacaccagcggcagcagcttctacaacaagaggaccctgaccttcagcggcggcggcatcaacgtggtgtag

SEQ ID NO: 39556 - DNA, 360 bp, Artificial Sequence
  Description of Artificial Sequence: Synthetic coding sequence
atgccaccccgcatcacagacctgagcctgcccaactacctgatggccagctctgtgggcctgctgcccacccagctgctgaacagctacctgggcaccaccctgcggaccatggaggatgtgattgctgagcagagcgtgtctggctactttgtgttctgcctgcagatcatcatcagcatcggcctgatgttctacgtggtgcaccgggcccaggtggagctgaatgctgccatcgtggcctgtgagatggagctgaagagcagcctggtgaagggcaaccagcccaacaccagcggcagcagcttctacaacaagaggaccctgaccttcagcggcggcggcatcaacgtggtgtag

SEQ ID NO: 39557 - DNA, 156 bp, Artificial Sequence
  Description of Artificial Sequence: Synthetic coding sequence
atgccaccccgcatcacagacctgagcctgcccaactacctgatggccagctctgtgggcctgctgcccacccagctgctgaacagctacctgggcaccaccctgcggaccatggaggatgtgattgctgagcagagcgtgtctggctacttctag

SEQ ID NO: 39558 - DNA, 723 bp, Artificial Sequence
  Description of Artificial Sequence: Synthetic coding sequence
atgagccggctgctgcccctgctgcggagcaggacagcccggagcctgcggcccggccctgctgctgctgctgccccccggccccccagctggtgctgctgcggccggggcctgctggccctggcccctcctgggggcctgcccggcggcccccggcggctgggcacccaccccaagaaggagcccatggaggccctgaacacagcccagggcgcccgggacttcatctacagcctgcacagcacagagaggagctgcctgctgaaggagctgcacagatttgagagcatcgccatcgcccaggagaagctggaggcccccccacccaccccaggccagctgcgctacgtgttcatccacaatgccatccccttcatcggcttcggcttcctggacaatgccatcatgattgtggccggcacccacatcgagatgagcatcggcatcatcctgggcatcagcaccatggctgctgctgccctgggcaacctggtgtctgacctggccggcctgggcctggccggctacgtggaggccctggccagccggctgggcctgagcatcccagacctgacccccaagcaggtggacatgtggcagacccggctgagcacccacctgggcaaggctgtgggcgtgaccatcggctgcatcctgggcatgttccccctcatcttctttggaggaggagaggaggatgagaagctggagaccaagagctag

SEQ ID NO: 39559 - DNA, 1020 bp, Artificial Sequence
  Description of Artificial Sequence: Synthetic coding sequence
atggctgctgcctgtggccctggagctgctggctactgcctgctgctgggcctgcacctgttcctgctgacagctggccctgccctgggctggaatgaccctgacaggatgctgctgagagatgtgaaggccctgaccctgcactatgaccgctacaccaccagccggcggctggaccccatcccccagctgaagtgtgtgggcggcacagctggctgtgacagctacacccccaaggtgatccagtgccagaacaagggctgggatggctatgatgtgcagtgggagtgcaagacagacctggacatcgcctacaagtttgggaagacagtggtgtcctgtgagggctatgagagcagcgaggaccagtatgtgctgcggggcagctgtggcctggagtacaacctggactacacagagctgggcctgcagaagctgaaggagagcggcaagcagcacggctttgccagcttcagtgactactactacaagtggagcagcgctgacagctgcaacatgagcggcctcatcaccatcgtggtgctgctgggcatcgcctttgtggtgtacaagctgttcctgagtgatggccagtacagccccccaccctacagcgagtacccacccttcagccaccgctaccagcgcttcaccaacagcgctggccccccacctcctggcttcaagtctgagttcaccggcccccagaacacaggccacggggccaccagcggcttcggcagcgccttcaccggccagcagggctatgaaaattctggccctggcttctggacaggcctgggcactggaggcatcctgggctacctgtttggcagcaacagagctgccacccccttcagtgacagctggtactaccccagctacccacccagctacccaggcacctggaacagagcctacagccccctgcatggaggcagcggcagctacagcgtgtgcagcaacagcgacaccaagaccaggacagccagcggctatggaggcaccaggagaagatag

SEQ ID NO: 39560 - DNA, 504 bp, Artificial Sequence
  Description of Artificial Sequence: Synthetic coding sequence
atgagcggcctcatcaccatcgtggtgctgctgggcatcgcctttgtggtgtacaagctgttcctgagtgatggccagtacagccccccaccctacagcgagtacccacccttcagccaccgctaccagcgcttcaccaacagcgctggccccccacctcctggcttcaagtctgagttcaccggcccccagaacacaggccacggggccaccagcggcttcggcagcgccttcaccggccagcagggctatgaaaattctggccctggcttctggacaggcctgggcactggaggcatcctgggctacctgtttggcagcaacagagctgccacccccttcagtgacagctggtactaccccagctacccacccagctacccaggcacctggaacagagcctacagccccctgcatggaggcagcggcagctacagcgtgtgcagcaacagcgacaccaagaccaggacagccagcggctatggaggcaccaggagaagatag

SEQ ID NO: 39561 - DNA, 912 bp, Artificial Sequence
  Description of Artificial Sequence: Synthetic coding sequence
atgctgctgagagatgtgaaggccctgaccctgcactatgaccgctacaccaccagccggcggctggaccccatcccccagctgaagtgtgtgggcggcacagctggctgtgacagctacacccccaaggtgatccagtgccagaacaagggctgggatggctatgatgtgcagtgggagtgcaagacagacctggacatcgcctacaagtttgggaagacagtggtgtcctgtgagggctatgagagcagcgaggaccagtatgtgctgcggggcagctgtggcctggagtacaacctggactacacagagctgggcctgcagaagctgaaggagagcggcaagcagcacggctttgccagcttcagtgactactactacaagtggagcagcgctgacagctgcaacatgagcggcctcatcaccatcgtggtgctgctgggcatcgcctttgtggtgtacaagctgttcctgagtgatggccagtacagccccccaccctacagcgagtacccacccttcagccaccgctaccagcgcttcaccaacagcgctggccccccacctcctggcttcaagtctgagttcaccggcccccagaacacaggccacggggccaccagcggcttcggcagcgccttcaccggccagcagggctatgaaaattctggccctggcttctggacaggcctgggcactggaggcatcctgggctacctgtttggcagcaacagagctgccacccccttcagtgacagctggtactaccccagctacccacccagctacccaggcacctggaacagagcctacagccccctgcatggaggcagcggcagctacagcgtgtgcagcaacagcgacaccaagaccaggacagccagcggctatggaggcaccaggagaagatag

SEQ ID NO: 39562 - DNA, 504 bp, Artificial Sequence; identical to SEQ ID NO: 39560
  Description of Artificial Sequence: Synthetic coding sequence

SEQ ID NO: 39563 - DNA, 774 bp, Artificial Sequence
  Description of Artificial Sequence: Synthetic coding sequence
atgattgacaagaaccagacctgtggggtgggccaggacagcgtgccctacatgatctgcctgatccacatcctggaggagtggtttggagtggagcagctggaggactacctgaactttgccaactacctgctgtgggtgttcacccccctcatcctgctgatcctgccctacttcaccatcttcctgctgtacctgaccatcatcttcctgcacatctacaagaggaagaatgtgctgaaggaggcctacagccacaacctgtgggatggagccaggaagacagtggccaccctgtgggatggccacgccgctgtgtggcacggctatgaggtgcacggcatggagaagatcccagaagatggccctgccctgatcatcttctaccacggggccatccccatcgacttctactacttcatggccaagatcttcatccacaagggccgcacctgccgggtggtggccgaccactttgtgttcaagatccctggcttcagcctgctgctggatgtgttctgtgccctgcacggcccccgggagaagtgtgtggagatcctgcggagcggccacctgctggccatcagccctggaggagtgcgggaggccctgatcagtgatgagacctacaacatcgtgtggggccacagaagaggatttgcccaggtggccattgatgccaaggtgaccaagaatgctgtgcaggccctgattgacaagcaccagagaattcctggcaacatcatgtctgccctgctggagcgcttccactag

SEQ ID NO: 39564 - DNA, 975 bp, Artificial Sequence
  Description of Artificial Sequence: Synthetic coding sequence
atgattgacaagaaccagacctgtggggtgggccaggacagcgtgccctacatgatctgcctgatccacatcctggaggagtggtttggagtggagcagctggaggactacctgaactttgccaactacctgctgtgggtgttcacccccctcatcctgctgatcctgccctacttcaccatcttcctgctgtacctgaccatcatcttcctgcacatctacaagaggaagaatgtgctgaaggaggcctacagccacaacctgtgggatggagccaggaagacagtggccaccctgtgggatggccacgccgctgtgtggcacggctatgaggtgcacggcatggagaagatcccagaagatggccctgccctgatcatcttctaccacggggccatccccatcgacttctactacttcatggccaagatcttcatccacaagggccgcacctgccgggtggtggccgaccactttgtgttcaagatccctggcttcagcctgctgctggatgtgttctgtgccctgcacggcccccgggagaagtgtgtggagatcctgcggagcggccacctgctggccatcagccctggaggagtgcgggaggccctgatcagtgatgagacctacaacatcgtgtggggccacagaagaggatttgcccaggtggccattgatgccaaggtgcccatcatccccatgttcacccagaacatccgggagggcttccgcagcctgggcggcaccaggctcttccgctggctgtatgagaagttccgctacccctttgcccccatgtatggaggcttccctgtgaagctgcggacctacctgggggaccccatcccctatgacccccagatcacagctgaggagctggccgagaagaccaagaatgctgtgcaggccctgattgacaagcaccagagaattcctggcaacatcatgtctgccctgctggagcgcttccactag

SEQ ID NO: 39565 - DNA, 381 bp, Artificial Sequence
  Description of Artificial Sequence: Synthetic coding sequence
atgattgacaagaaccagacctgtggggtgggccaggacagcgtgccctacatgatctgcctgatccacatcctggaggagtggtttggagtggagcagctggaggactacctgaactttgccaactacctgctgtgggtgttcacccccctcatcctgctgatcctgccctacttcaccatcttcctgctgtacctgaccatcatcttcctgcacatctacaagaggaagaatgtgctgaaggaggcctacagccacaacctgtgggatggagccaggaagacagtggccaccctgtgggatggccacgccgctgtgtggcacggctatgaggtgcacggcatggagaagatcccagaagatggccctgccctgatctag

SEQ ID NO: 39566 - DNA, 408 bp, Artificial Sequence
  Description of Artificial Sequence: Synthetic coding sequence
atgattgacaagaaccagacctgtggggtgggccaggacagcgtgccctacatgatctgcctgatccacatcctggaggagtggtttggagtggagcagctggaggactacctgaactttgccaactacctgctgtgggtgttcacccccctcatcctgctgatcctgccctacttcaccatcttcctgctgtacctgaccatcatcttcctgcacatctacaagaggaagaatgtgctgaaggaggcctacagccacaacctgtgggatggagccaggaagacagtggccaccctgtgggatggccacgccgctgtgtggcacggcaagcagggctacttccacctgtgtgtggccatccacgtgtgctgcattggaacagtgctgcccttccacttcatcgactag

SEQ ID NO: 39567 - DNA, 732 bp, Artificial Sequence
  Description of Artificial Sequence: Synthetic coding sequence
atgattgacaagaaccagacctgtggggtgggccaggacagcgtgccctacatgatctgcctgatccacatcctggaggagtggtttggagtggagcagctggaggactacctgaactttgccaactacctgctgtgggtgttcacccccctcatcctgctgatcctgccctacttcaccatcttcctgctgtacctgaccatcatcttcctgcacatctacaagaggaagaatgtgctgaaggaggcctacagccacaacctgtgggatggagccaggaagacagtggccaccctgtgggatggccacgccgctgtgtggcacggctatgaggtgcacggcatggagaagatcccagaagatggccctgccctgatcatcttctaccacggggccatccccatcgacttctactacttcatggccaagatcttcatccacaagggccgcacctgccgggtggtggccgaccactttgtgttcaagatccctggcttcagcctgctgctggatgtgttctgtgccctgcacggcccccgggagaagtgtgtggagatcctgcggagcggccacctgctggccatcagccctggaggagtgcgggaggccctgatcagtgatgagacctacaacatcgtgtggggccacagaagaggatttgcccaggtggccattgatgccaaggtgcccatcatccccatgttcacccagaacatccgggagggcttctag

SEQ ID NO: 39568 - DNA, 408 bp, Artificial Sequence; identical to SEQ ID NO: 39566
  Description of Artificial Sequence: Synthetic coding sequence

SEQ ID NO: 39569 - DNA, 9 bp, Artificial Sequence
  Description of Artificial Sequence: Synthetic coding sequence
atgatctag

SEQ ID NO: 39570 - DNA, 495 bp, Artificial Sequence
  Description of Artificial Sequence: Synthetic coding sequence
atgattgacaagaaccagacctgtggggtgggccaggacagcgtgccctacatgatctgcctgatccacatcctggaggagtggtttggagtggagcagctggaggactacctgaactttgccaactacctgctgtgggtgttcacccccctcatcctgctgatcctgccctacttcaccatcttcctgctgtacctgaccatcatcttcctgcacatctacaagaggaagaatgtgctgaaggaggcctacagccacaacctgtgggatggagccaggaagacagtggccaccctgtgggatggccacgccgctgtgtggcacggctatgaggtgcacggcatggagaagatcccagaagatggccctgccctgatcatcttctaccacggggccatccccatcgacttctactacttcatggccaagatcttcatccacaagggccgcacctgccgggtggtggccgaccactttgtgttcaagatcccctag

SEQ ID NO: 39571 - DNA, 276 bp, Artificial Sequence
  Description of Artificial Sequence: Synthetic coding sequence
atgttcacccagaacatccgggagggcttccgcagcctgggcggcaccaggctcttccgctggctgtatgagaagttccgctacccctttgcccccatgtatggaggcttccctgtgaagctgcggacctacctgggggaccccatcccctatgacccccagatcacagctgaggagctggccgagaagaccaagaatgctgtgcaggccctgattgacaagcaccagagaattcctggcaacatcatgtctgccctgctggagcgcttccactag

SEQ ID NO: 39572 - DNA, 744 bp, Artificial Sequence
  Description of Artificial Sequence: Synthetic coding sequence
atgctgcgcttcatccagaagttcagccaggccagcagcaagatcctgaagtacagcttccctgtgggcctgcggaccagcaggacagacatcctgagcctgaagatgagcctgcagcagaacttcagcccctgcccccggccctggctgagcagcagcttccctgcctacatgagcaagacccagtgctaccacaccagcccctgcagcttcaagaagcagcagaagcaggccctgctggcccggcccagcagcaccatcacctacctgacagacagccccaagccagccctgtgtgtgaccctggccggcctcatcccctttgtggccccacccctggtgatgctgatgaccaagacctacatccccatcctggccttcacccagatggcctacggggccagcttcctgtccttcctgggcggcatccgctggggctttgccctgcctgagggcagccctgccaagccagactacctgaacctggccagcagcgctgcccccctcttcttctcctggtttgccttcctgatcagcgagcggctgtctgaggccatcgtgaccgtcatcatgggcatgggcgtggccttccacctggagctgttcctgctgccccactaccccaactggttcaaggccctgcgcatcgtggtgaccctgctggccaccttctccttcatcatcaccctggtggtgaagagcagcttccctgagaagggccacaagaggcctggccaggtgtag

SEQ ID NO: 39573 - DNA, 828 bp, Artificial Sequence
  Description of Artificial Sequence: Synthetic coding sequence
atgcagctgcaggtgttctggacaggcctggagtacacctgccgcctgctgggcatcaccacagctgctgtgctgattggagtgggcacagagaccttcctgcagggccagttcaagagcctggccttctacctgctcttcaccggggctgctgtgtccatctgtgagggcgcctactttgtggcccagctgctggccatctgcttccagtgccagcccggcagcctggccgacagagtgcgggagaaggcccactggctgggctgcttccagaagttcctggcctacctgctgctgtctgtggcctgcttcctgcaccctgtgctggtgtggcacgtgaccatccctggctccatgctgatcatcaccggcctggcctacttcctgctgagcaagaggaagaagaggaaggccgcccctgaggtgctggccagccctgagcagtacacagaccccagcagcagcgctgtgtccaccaccggcagcggggacacagagcagacctacaccttccacggggccctgaaggagggccccagcagcctcttcatccacatgaagagcatcctgaagggcaccaagaagcccagcgccctgcagccccccaacaccctgatggagctgagcctggagcctgctgacagcctggccaagaagaagcaggtgcactttgaggacaacctggtgagaattgtgcccagcctggccgagggcctggatgatggagacagcgagcctgaggagaccaccagtgacaccacccccatcatccccccaccccaggcccccctcttcctgagcagcctgacagccaccggcctcttctag

SEQ ID NO: 39574 - DNA, 474 bp, Artificial Sequence
  Description of Artificial Sequence: Synthetic coding sequence
atgctgatcatcaccggcctggcctacttcctgctgagcaagaggaagaagaggaaggccgcccctgaggtgctggccagccctgagcagtacacagaccccagcagcagcgctgtgtccaccaccggcagcggggacacagagcagacctacaccttccacggggccctgaaggagggccccagcagcctcttcatccacatgaagagcatcctgaagggcaccaagaagcccagcgccctgcagccccccaacaccctgatggagctgagcctggagcctgctgacagcctggccaagaagaagcaggtgcactttgaggacaacctggtgagaattgtgcccagcctggccgagggcctggatgatggagacagcgagcctgaggagaccaccagtgacaccacccccatcatccccccaccccaggcccccctcttcctgagcagcctgacagccaccggcctcttctag

SEQ ID NO: 39575 - DNA, 771 bp, Artificial Sequence
  Description of Artificial Sequence: Synthetic coding sequence
atgcccccagcccagggctatgaatttgctgctgccaagggccccagagatgagctgggccccagcttccccatggccagccccccaggcctggagctgaagaccctgagcaatggcccccaggccccccggcgcagcgcccccctgggccctgtggcccccacccgggagggcgtggagaatgcctgcttcagcagcgaggagcacgagacccacttccagaaccctggcaacacccggctgggcagcagccccagccccccaggcggcgtgagcagcctgcccaggagccagagagatgacctgagcctgcacagcgaggagggccctgccctggagcctgtgtccaggcctgtggactatggctttgtgtctgccctggtgttcctggtgtctggcatcctgctggtggtgacagcctatgccatcccccgggaggcccgggtgaacccagacacagtgacagcccgggagatggagcggctggagatgtactatgcccggctgggcagccacctggaccgctgcatcatcgccggcctgggcctgctgactgtgggcggcatgctgctgtctgtgctgctgatggtgtccctgtgcaagggggagctgtacagaagaaggacctttgtgcctgggaagggcagcaggaagacctacggcagcatcaacctgaggatgaggcagctgaatggagatggcggccaggccctggtggagaatgaggtggtgcaggtgtctgagaccagccacaccctgcagaggagctag

SEQ ID NO: 39576 - DNA, 465 bp, Artificial Sequence
  Description of Artificial Sequence: Synthetic coding sequence
atgcccccagcccagggctatgaatttgctgctgccaagggccccagagatgagctgggccccagcttccccatggccagccccccaggcctggagctgaagaccctgagcaatggcccccaggccccccggcgcagcgcccccctgggccctgtggcccccacccgggagggcgtggagaatgcctgcttcagcagcgaggagcacgagacccacttccagaaccctggcaacacccggctgggcagcagccccagccccccaggcggcgtgagcagcctgcccaggagccagagagatgacctgagcctgcacagcgaggagggccctgccctggagcctgtgtccaggcctgtggactatggctttgtgtctgccctggtgttcctggtgtctggcatcctgctggtggtgacagcctatgccatcccccgggaggcccgggtgaacccagacacagtgtag

SEQ ID NO: 39577 - DNA, 417 bp, Artificial Sequence
  Description of Artificial Sequence: Synthetic coding sequence
atgaggcccacagctgacagcttccggctgaagaagggaaatgtgttccccaactttgacccctgtgcccaggccctgcagaagagctgccactttgccctgtccttcctgattggcaagatgggcatcatcatcctgtctgtgtgcctgatctgcacccggctgctgcaggagggcatcgcccagagcaagtgcctgatcaacgtgtccttcagcctgtacagctgcttcatcgtgtttgtgaccatcagccaggacagcgagaccctgagcctggactgtgaccacaggctcttcttcagcctgcccttcacagatcctgccagcggcggccagagccagcacagctggccctgcccagagaggagcaagaacctgccccaggtgtccaagcagctgaggaacagagctggatag

SEQ ID NO: 39578 - DNA, 411 bp, Artificial Sequence
  Description of Artificial Sequence: Synthetic coding sequence
atgtggctggacaccaggaacctgggcatcgtcatcagctgctggaagggcgtgtgtgtgccccagaccaccaccctggagatgttctacaatgacaatgacagagtggaggagagcagcaacagctaccagatccggcgggagttcctgctgcctgcctgcctgcctgccttcctgtccttcagcaccagcttctccttcttcctgtccttcctgcccctgagcctgagcctcttcctgcccttcttccccagcttcttcctgagcctgagcctgagccccagcttcctgcccagcttcctgcggcagggcctggccctgagcccccggctggagtgtgatggagccatcatgatccactgcagcctgaacatccctggcagcagtgacccccccaccagcgccagctag

SEQ ID NO: 39579 - DNA, 1185 bp, Artificial Sequence
  Description of Artificial Sequence: Synthetic coding sequence
atgacagagcaggagaccctggccctgctggaggtgaagagaagtgacagccctgagaagagcagcccccaggccctggtgcccaacggccggcagcctgagggggagggcggcgctgagagccctggagctgagagcctgcgggtgggcagcagcgctggcagccccacagccattgaaggagcagaagatggcctggacagcacagtgtctgaggccgccaccctgccctggggcaccggcccccagcccagcgcccccttcccagaccccccaggctggagggacatcgagcctgagcccccagagagcgagcccctgaccaagctggaggagctgcctgaagatgatgccaacctgctgcctgagaaggccgcccgggcctttgtgcccatcgacctgcagtgcatcgagcggcagccccaggaggacctgattgtgcgctgtgaggccggggagggagaatgtaggaccttcatgccaccccgggtgacccacccagaccccacagagaggaagtgggccgaggccgtggtgcggcccccaggctgcagctgtggcggctgcggcagctgtggggaccgggagtggctgcgggctgtggcctctgtgggcgccgccctgatcctcttcccctgcctgctgtatggagcctatgccttcctgccctttgatgtgccccggctgcccaccatgagcagccgcctcatctacaccctgcgctgtggggtgtttgccaccttccccatcgtgctgggcatcctggtgtatggcctgagcctgctgtgcttcagcgccctgcggccctttggagagccccggcgggaggtggagatccacagaagatatgtggcccagagcgtgcagctgttcatcctgtacttcttcaacctggccgtgctgagcacctacctgccccaggacaccctgaagctgctgcccctgctgaccggcctgtttgctgtgagccgcctcatctactggctgacctttgctgtgggccgctccttccggggcttcggctacggcctgaccttcctgcccctgctgtccatgctgatgtggaacctgtactacatgtttgtggtggagcctgagaggatgctgacagccacagagagccggctggactacccagaccacgcccggagcgccagtgactaccggccccggccctggggctag

SEQ ID NO: 39580 - DNA, 528 bp, Artificial Sequence
  Description of Artificial Sequence: Synthetic coding sequence
atgacagagcaggagaccctggccctgctggaggtgaagagggaccccggggtgcgggcagagcctgtgatgctgttctgccccagcgccctgtggggcgccacagctgggggcggggaccccccagccatctgtggccctgtgggccctgccctgtacagcctgctgctgcagcccggccgggccttccacctgcctgcccctggctacccccagacagcccccagcgcccactggagcctgtgccgcctgcctgctgacctgctggccgacctgtgccggggccccctgctgccccggctgcggctgcggccagatgtgtctgccacagctgtggatgctgatgtggagcccctgctgcacgtgcggggcggggccggggcccacgcccactgccaccgggagcccccaggcctgcccggcccccggcccctgggcctgcggctgcaggccccacccctgggcctgagcctgagcgccctggccctgggcgtgggcggcagcggcctgggcctgacccacctgtag

SEQ ID NO: 39581 - DNA, 1185 bp, Artificial Sequence; identical to SEQ ID NO: 39579
  Description of Artificial Sequence: Synthetic coding sequence

SEQ ID NO: 39582 - DNA, 399 bp, Artificial Sequence
  Description of Artificial Sequence: Synthetic coding sequence
atgacagagcaggagaccctggccctgctggaggtgaagagggaccccggggtgcgggcagagcctgtgatgctgttctgccccagcgccctgtggggcgccacagctgggggcggggaccccccagccatctgtggccctgtgggccctgccctgtacagcctgctgctgcagcccggccgggccttccacctgcctgcccctggctacccccagacagcccccagcgcccactggagcctgtgccgcctgcctgctgacctgctggccgacctgtgccggggccccctgctgccccggctgcggctgcggccagatgtgtctgccacagctgtggatgctgatgtggagcccctgctgcacgtgcggggcggggccggggcccacgcccactgctag

SEQ ID NO: 39583 - DNA, 507 bp, Artificial Sequence
  Description of Artificial Sequence: Synthetic coding sequence
atggccgagggcgcccgggcccggggcccccggggctgccgggacagagatggccctgctgggggcgccggcaagatggccgccccccggcggggccggggcagcagcacagtgctgagctctgtgcccctgcagatgctgttctacctgagcggcacctactatgccctgtacttcctggccaccctgctgatgatcacctacaagagccaggtgttctcctacccccaccgctacctggtgctggacctggccctgctcttcctgatgggcatcctggaggccgtgcggctgtacctgggcacccggggcaacctgacagaagctgagcggcccctggccgccagcctggccctgacagctggaacagccctgctgagcgcccacttcctgctgtggcaggccctggtgctgtgggccgactgggccctgagcgccaccctgctggccctgcacggcctggaggccgtgctgcaggtggtggccatcgccgccttcaccaggtag

SEQ ID NO: 39584 - DNA, 483 bp, Artificial Sequence
  Description of Artificial Sequence: Synthetic coding sequence
atggccgagggcgcccgggcccggggcccccggggctgccgggacagagatggccctgctgggggcgccggccggggcagcagcacagtgctgagctctgtgcccctgcagatgctgttctacctgagcggcacctactatgccctgtacttcctggccaccctgctgatgatcacctacaagagccaggtgttctcctacccccaccgctacctggtgctggacctggccctgctcttcctgatgggcatcctggaggccgtgcggctgtacctgggcacccggggcaacctgacagaagctgagcggcccctggccgccagcctggccctgacagctggaacagccctgctgagcgcccacttcctgctgtggcaggccctggtgctgtgggccgactgggccctgagcgccaccctgctggccctgcacggcctggaggccgtgctgcaggtggtggccatcgccgccttcaccaggtag

SEQ ID NO: 39585 - DNA, 768 bp, Artificial Sequence
  Description of Artificial Sequence: Synthetic coding sequence
atgaaggtgctggccaccagctttgtgctgggcagcctgggcctggccttctacctgcccctggtggtgaccacccccaagaccctggccatccctgagaagctgcaggaggccgtgggcaaggtgatcatcaatgccaccacctgcaccgtgacctgtggcctgggctacaaggaggagaccgtgtgtgaggtgggcccagatggagtgcggaggaagtgccagacccggcggctggagtgcctgaccaactggatctgtggcatgctgcacttcaccatcctgattggcaaggagtttgagctgagctgcctgagcagtgacatcctggagtttggccaggaggccttccgcttcacctggaggctggcccggggcgtcatcagcacagatgatgaggtgttcaagcccttccaggccaacagccactttgtgaagttcaagtatgcccaggagtatgattctggcacctaccgctgtgatgtgcagctggtgaagaacctgcggctggtgaagaggctgtacttcggcctgcgggtgctgccccccaacctggtgaacctgaacttccaccagagcctgacagaggaccagaagctgattgatgagggcctggaggtgaacctggacagctacagcaagccccaccaccccaagtggaagaagaaggtggccagcgccctgggcatcggcatcgccatcggcgtggtgggcggcgtgctggtgcgcatcgtgctgtgtgccctgcggggcggcctgcagcagtag

SEQ ID NO: 39586 - DNA, 1032 bp, Artificial Sequence
  Description of Artificial Sequence: Synthetic coding sequence
atgttcagcctgcccagcctgcccagctggctgcccggcctgcccagcctggagtggggcagcagcctgctggacagcctgctgcagggcctcatcggggccctgggcgtgctggtgctgaacagcctgctgaaggtgtacttctttgtgggctgtgccaatgacccccagaggaggcctgagaaggagcggctgcgggcccagtgggccagcctggagaccgtgcacctggccggcctggccctcttcctgactgtggtgggcagccgggtggccgccctggtggtgctggagttcagcctgcgggctgtgtccaccctgctgagcctgggcaagggcagccagggcgctgctgagcggctgcagctgtacctgctgtgccagtacagcctgggctgcggcctgacctgtggcctgtccttcctgcaggagggcgccccccacaggaccctgaacctgctgctgagcctgggcctggccaccctgctgggcctgggcgcccggcggctgcacagacatgtgtgccgcctgtatgagctgcacagcagccagcgctactgcggcgtgtgcctgggcctgctggcccacgcccacggcctgccccagctgctgggccgggccctggccatcgcctttgctgtgggggacctggccgctgtggccctgatcaaccaggacttcctgaccaccagcgaggccatgaggttctggacccccctgaccatctgctacaccctgctggtgatctacatgcaggaggagcagaggcagcaccctggcctgcagagccaggtgcagacagtgctggtgaggatgggcggcctgtttgtgctgctgctgactgtgggccgctggctggacctgctgggcatcctggtgtccctgctgggggagctgtggtgcctggtgggcgtgaggaccctgctggacctgtgccagatccaggacttccccagccagaggcctcctgtgtccacccccagccagcccctgcccagcgccccccagagccagagcagcgcccccagctag

SEQ ID NO: 39587 - DNA, 450 bp, Artificial Sequence
  Description of Artificial Sequence: Synthetic coding sequence
atgacagcccagggcggcctggtggccaacagaggaagacgcttcaagtgggccatcgagctgagcggccctgggggcggcagccggggccgcagtgaccggggcagcggccagggcgacagcctgtaccctgtgggctacctggacaagcaggtgcctgacacctctgtgcaggagacagaccgcatcctggtggagaagcgctgctgggacatcgccctgggccccctgaagcagatccccatgaacctcttcatcatgtacatggccggcaacaccatcagcatcttccccaccatgatggtgtgcatgatggcctggaggcccatccaggccctgatggccatcagcgccaagaatggagtgcagtggtggaggacagcctttgtgaacatgaggaagcagaggctggtgcccatgtacctgggcctcatctacatcctgctgtag

SEQ ID NO: 39588 - DNA, 552 bp, Artificial Sequence
  Description of Artificial Sequence: Synthetic coding sequence
atgacagcccagggcggcctggtggccaacagaggaagacgcttcaagtgggccatcgagctgagcggccctgggggcggcagccggggccgcagtgaccggggcagcggccagggcgacagcctgtaccctgtgggctacctggacaagcaggtgcctgacacctctgtgcaggagacagaccgcatcctggtggagaagcgctgctgggacatcgccctgggccccctgaagcagatccccatgaacctcttcatcatgtacatggccggcaacaccatcagcatcttccccaccatgatggtgtgcatgatggcctggaggcccatccaggccctgatggccatcagcgccaccttcaagatgctggagagcagcagccagaagttcctgcagggcctggtgtacctgattggcaacctgatgggcctggccctggccgtgtacaagtgccagagcatgggcctgctgcccacccacgccagtgactggctggccttcatcgagcccccagagaggatggagttcagcggcggcggcctgctgctgtag

SEQ ID NO: 39589 - DNA, 723 bp, Artificial Sequence
  Description of Artificial Sequence: Synthetic coding sequence
atggtgtcccctgtgacagtggtgaagtctgagggccccaagctggtgcccttcttcaaggccacctgtgtgtactttgtgctgtggctgcccagcagcagccccagctgggtgtccaccctcatcaagtgcctgcccatcttctgcctgtggctgttcctgctggcccacggcctgggcttcctgctggcccaccccagcgccacccgcatctttgtgggcctggtgttttctgctgtgggagatgccttcctgatctggcaggaccagggctactttgtgcacggcctgctgatgtttgctgtgacccacatgttttatgccagcgccttcggcatgcagcccctggccctgaggacaggcctggtgatggccgccctgagcggcctgtgctacgccctgctgtacccctgcctgagcggggccttcacctacctggtgggcgtgtatgtggccctgattggcttcatgggctggagggccatggccggcctgcggctggccggggctgactggcgctggacagagctggccgccggcagcggggccctcttcttcatcatcagtgacctgaccatcgccctgaacaagttctgcttccctgtgccctacagccgggccctgatcatgagcacctactacgtggcccagatgctggtggccctgtctgctgtggagagccgggagcctgtggagcactaccgcctgaccaaggccaactag

SEQ ID NO: 39590 - DNA, 723 bp, Artificial Sequence; identical to SEQ ID NO: 39589
  Description of Artificial Sequence: Synthetic coding sequence

SEQ ID NO: 39591 - DNA, 681 bp, Artificial Sequence
  Description of Artificial Sequence: Synthetic coding sequence
atggatgctgggaaggccggccagaccctgaagacccactgcagcgcccagaggccagatgtgtgccgctggctgagccccttcatcctgagctgctgcgtgtacttctgcctgtggatccctgaggaccagctgtcctggtttgctgccctggtgaagtgcctgcctgtgctgtgcctggccggcttcctgtgggtgatgagccccagcggcggctacacccagctgctgcagggcgccctggtgtgcagcgctgtgggagatgcctgcctgatctggccagctgcctttgtgcccggcatggccgcctttgccacagcccacctgctgtatgtgtgggccttcggcttcagccccctgcagcccggcctgctgctgctgatcatcctggcccctggcccctacctgagcctggtgctgcagcacctggagccagacatggtgctgcctgtggccgcctacggcctcatcctgatggccatgctgtggaggggcctggcccagggcggcagcgctggctggggcgccctgctcttcaccctgagtgatggagtgctggcctgggacacctttgcccagcccctgccccacgcccacctggtgatcatgaccacctactatgctgcccagctgctgatcaccctgagcgccctgcggagccctgtgcccaagacagactag

SEQ ID NO: 39592 - DNA, 546 bp, Artificial Sequence
  Description of Artificial Sequence: Synthetic coding sequence
atggctgctgctgcctggctgcaggtgctgcctgtgatcctgctgctgctgggcgcccaccccagccccctgtccttcttctctgctggccctgccaccgtggccgctgctgacaggagcaagtggcacatccccatccccagcggcaagaactacttctcctttgggaagatcctcttcaggaacaccaccatcttcctgaagtttgatggagagccctgtgacctgagcctgaacatcacctggtacctgaagtctgctgactgctacaatgagatctacaacttcaaggccgaggaggtggagctgtacctggagaagctgaaggagaagaggggcctgagcggcaagtaccagaccagcagcaagctgttccagaactgcagcgagctgttcaagacccagaccttcagcggggacttcatgcaccggctgcccctgctgggggagaagcaggaggccaaggaaaatggcaccaacctgaccttcatcggggacaagaccatccagatgcccttcctgaagaagcacttcctggactgctag

SEQ ID NO: 39593 - DNA, 1668 bp, Artificial Sequence
  Description of Artificial Sequence: Synthetic coding sequence
atggctgctgctgcctggctgcaggtgctgcctgtgatcctgctgctgctgggcgcccaccccagccccctgtccttcttctctgctggccctgccaccgtggccgctgctgacaggagcaagtggcacatccccatccccagcggcaagaactacttctcctttgggaagatcctcttcaggaacaccaccatcttcctgaagtttgatggagagccctgtgacctgagcctgaacatcacctggtacctgaagtctgctgactgctacaatgagatctacaacttcaaggccgaggaggtggagctgtacctggagaagctgaaggagaagaggggcctgagcggcaagtaccagaccagcagcaagctgttccagaactgcagcgagctgttcaagacccagaccttcagcggggacttcatgcaccggctgcccctgctgggggagaagcaggaggccaaggaaaatggcaccaacctgaccttcatcggggacaagacagccatgcatgagcccctgcagacctggcaggatgccccctacatcttcatcgtgcacatcggcatcagcagcagcaaggagagcagcaaagaaaacagcctgagcaacctcttcaccatgacagtggaggtgaagggcccctatgagtacctgaccctggaggactaccccctgatgatcttcttcatggtgatgtgcatcgtgtatgtgctgtttggagtgctgtggctggcctggagcgcctgctactggagggacctgctgcgcatccagttctggattggagctgtgatcttcctgggcatgctggagaaggctgtgttctacgccgagttccagaacatccgctacaagggggagagcgtgcagggcgccctgatcctggccgagctgctgtctgctgtgaagaggagcctggcccggaccctggtgatcatcgtgtccctgggctatggaattgtgaagccccggctgggcgtgaccctgcacaaggtggtggtggccggggccctgtacctgctcttcagcggcatggagggcgtgctgcgggtgactggagcccagacagacctggccagcctggccttcatccccctggccttcctggacacagccctgtgctggtggatcttcatcagcctgacccagaccatgaagctgctgaagctgcggagaaatattgtgaagctgagcctgtaccgccacttcaccaacaccctcatcctggccgtggccgccagcatcgtgttcatcatctggaccaccatgaagttccgcatcgtgacctgccagagcgactggagggagctgtgggtggatgatgccatctggaggctgctcttctccatgatcctcttcgtcatcatggtgctgtggaggccttctgccaacaaccagagatttgccttcagccccctgtctgaggaggaggaggaggatgagcagaaggagcccatgctgaaggagagctttgagggcatgaagatgaggagcaccaagcaggagcccaatggaaacagcaaggtgaacaaggcccaggaggatgacctgaagtgggtggaggagaatgtgcccagctctgtgacagatgtggccctgcctgccctgctggacagtgatgaggagaggatgatcacccactttgagaggagcaagatggagtag

SEQ ID NO: 39594 - DNA, 1485 bp, Artificial Sequence
  Description of Artificial Sequence: Synthetic coding sequence
atggcccacagcgacacagtggtggatggagagccctgtgacctgagcctgaacatcacctggtacctgaagtctgctgactgctacaatgagatctacaacttcaaggccgaggaggtggagctgtacctggagaagctgaaggagaagaggggcctgagcggcaagtaccagaccagcagcaagctgttccagaactgcagcgagctgttcaagacccagaccttcagcggggacttcatgcaccggctgcccctgctgggggagaagcaggaggccaaggaaaatggcaccaacctgaccttcatcggggacaagacagccatgcatgagcccctgcagacctggcaggatgccccctacatcttcatcgtgcacatcggcatcagcagcagcaaggagagcagcaaggagaacagcctgagcaacctcttcaccatgacagtggaggtgaagggcccctatgagtacctgaccctggaggactaccccctgatgatcttcttcatggtgatgtgcatcgtgtatgtgctgtttggagtgctgtggctggcctggagcgcctgctactggagggacctgctgcgcatccagttctggattggagctgtgatcttcctgggcatgctggagaaggctgtgttctatgcagagttccagaacatccgctacaagggggagagcgtgcagggcgccctgatcctggccgagctgctgtctgctgtgaagaggagcctggcccggaccctggtgatcatcgtgtccctgggctacggcatcgtgaagccccggctgggcgtgaccctgcacaaggtggtggtggccggggccctgtacctgctcttcagcggcatggagggcgtgctgcgggtgactggagcccagacagacctggccagcctggccttcatccccctggccttcctggacacagccctgtgctggtggatcttcatcagcctgacccagaccatgaagctgctgaagctgcggaggaacatcgtgaagctgagcctgtaccgccacttcaccaacaccctcatcctggccgtggccgccagcatcgtgttcatcatctggaccaccatgaagttcagaattgtgacctgccagagcgactggagggagctgtgggtggatgatgccatctggaggctgctcttctccatgatcctgtttgtgatcatggtgctgtggaggcccagcgccaacaaccagagatttgccttcagccccctgtctgaggaggaggaggaggatgagcagaaggagcccatgctgaaggagagctttgagggcatgaagatgaggagcaccaagcaggagcccaacggcaacagcaaggtgaacaaggcccaggaggatgacctgaagtgggtggaggagaatgtgcccagctctgtgacagatgtggccctgcctgccctgctggacagtgatgaggagaggatgatcacccactttgagaggagcaagatggagtag

SEQ ID NO: 39595 - DNA, 1596 bp, Artificial Sequence
  Description of Artificial Sequence: Synthetic coding sequence
atgtacaagagaagagtggtgtacctgagtgatgtgtcccagaaccctgtgtccccaggctggatcaggaagggcaagaactacttctcctttgggaagatcctcttcaggaacaccaccatcttcctgaagtttgatggagagccctgtgacctgagcctgaacatcacctggtacctgaagtctgctgactgctacaatgagatctacaacttcaaggccgaggaggtggagctgtacctggagaagctgaaggagaagaggggcctgagcggcaagtaccagaccagcagcaagctgttccagaactgcagcgagctgttcaagacccagaccttcagcggggacttcatgcaccggctgcccctgctgggggagaagcaggaggccaaggaaaatggcaccaacctgaccttcatcggggacaagacagccatgcatgagcccctgcagacctggcaggatgccccctacatcttcatcgtgcacatcggcatcagcagcagcaaggagagcagcaaagaaaacagcctgagcaacctcttcaccatgacagtggaggtgaagggcccctatgagtacctgaccctggaggactaccccctgatgatcttcttcatggtgatgtgcatcgtgtatgtgctgtttggagtgctgtggctggcctggagcgcctgctactggagggacctgctgcgcatccagttctggattggagctgtgatcttcctgggcatgctggagaaggctgtgttctacgccgagttccagaacatccgctacaagggggagagcgtgcagggcgccctgatcctggccgagctgctgtctgctgtgaagaggagcctggcccggaccctggtgatcatcgtgtccctgggctatggaattgtgaagccccggctgggcgtgaccctgcacaaggtggtggtggccggggccctgtacctgctcttcagcggcatggagggcgtgctgcgggtgactggagcccagacagacctggccagcctggccttcatccccctggccttcctggacacagccctgtgctggtggatcttcatcagcctgacccagaccatgaagctgctgaagctgcggagaaatattgtgaagctgagcctgtaccgccacttcaccaacaccctcatcctggccgtggccgccagcatcgtgttcatcatctggaccaccatgaagttccgcatcgtgacctgccagagcgactggagggagctgtgggtggatgatgccatctggaggctgctcttctccatgatcctcttcgtcatcatggtgctgtggaggccttctgccaacaaccagagatttgccttcagccccctgtctgaggaggaggaggaggatgagcagaaggagcccatgctgaaggagagctttgagggcatgaagatgaggagcaccaagcaggagcccaatggaaacagcaaggtgaacaaggcccaggaggatgacctgaagtgggtggaggagaatgtgcccagctctgtgacagatgtggccctgcctgccctgctggacagtgatgaggagaggatgatcacccactttgagaggagcaagatggagtag

SEQ ID NO: 39596 - DNA, 1668 bp, Artificial Sequence
  Description of Artificial Sequence: Synthetic coding sequence
atggtggccgcctgccgctctgtggccggcctgctgcccaggagaagacgctgcttccctgcccgggcccccctgctgcgggtggccctgtgcctgctgtgctggaccccagctgctgtgcgggctgtgcctgagctgggcctgtggctggagaccgtgaatgacaagagcggccccctcatcttcaggaagaccatgttcaacagcacagacatcaagctgtctgtgaagagcttccactgcagcggccctgtgaagttcaccatcgtgtggcacctgaagtaccacacctgccacaatgagcacagcaacctggaggagctgttccagaagcacaagctgtctgtggatgaggacttctgccactacctgaagaatgacaactgctggaccaccaagaatgaaaacctggactgcaacagcgacagccaggtgttccccagcctgaacaacaaggagctgatcaacatcagaaatgtgagcaaccaggagaggtccatggatgtggtggcccggacccagaaggatggcttccacatcttcatcgtgtccatcaagacagagaacacagatgcctcctggaacctgaatgtgtccctgtccatgattggcccccacggctacatcagcgccagtgactggcccctgatgatcttctacatggtgatgtgcatcgtgtacatcctgtatggcatcctgtggctgacctggagcgcctgctactggaaggacatcctgcgcatccagttctggattgctgctgtgatcttcctgggcatgctggagaaggctgtgttctacagcgagtaccagaacatcagcaacacaggcctgagcacccagggcctgctgatctttgctgagctgatcagcgccatcaagaggaccctggcccggctgctggtgatcatcgtgtccctgggctatggaattgtgaagccccggctgggcaccgtgatgcacagggtcatcggcctgggcctgctgtacctgatctttgctgctgtggagggcgtgatgagggtgattggaggcagcaaccacctggccgtggtgctggatgacatcatcctggccgtgattgacagcatctttgtgtggttcatcttcatcagcctggcccagaccatgaagaccctgcggctgaggaagaacacagtgaagttcagcctgtaccgccacttcaagaacaccctcatctttgctgtgctggccagcatcgtgttcatgggctggaccaccaagaccttcagaattgccaagtgccagagcgactggatggagcgctgggtggatgatgccttctggagcttcctgttcagcctcatcctgattgtcatcatgttcctgtggaggcccagcgccaacaaccagagatatgccttcatgcccctgattgatgacagtgatgatgaaattgaggagttcatggtgaccagcgagaacctgacagagggcatcaagctgcgggccagcaagtctgtgtccaatggaacagccaagccagccaccagcgagaactttgatgaggacctgaagtgggtggaggagaacatccccagcagcttcacagatgtggccctgcctgtgctggtggacagtgatgaggagatcatgaccaggtctgagatggccgagaagatgttcagcagcgagaagatcatgtag

SEQ ID NO: 39597 - DNA, 480 bp, Artificial Sequence
  Description of Artificial Sequence: Synthetic coding sequence
atggctgatgtgcctggggcccagagagctgtgcctggagatggccctgagccccgggaccccctggactgctgggcctgtgctgtgctggtgacagcccagaacctgctggtggccgccttcaacctgctgctgctggtgctggtgctgggcaccatcctgctgcctgctgtgaccatgctgggcttcggcttcctgtgccacagccagttcctgcggagccaggccccaccctgcacagcccacctgcgggaccccggcttcaccgccctgctggtgacaggcttcctgctgctggtgcccctgctggtgctggccctggccagctacagaaggctgtgcctgcggctgcggctggccgactgcctggtgccctacagccgggccctgtacagaagaagaagagccccccagccccggcagatccgggccagccctggcagccaggccgtgcccaccagcggcaaggtgtgggtgtag

SEQ ID NO: 39598 - DNA, 480 bp, Artificial Sequence
  Description of Artificial Sequence: Synthetic coding sequence
atgctgcacgtgctggccagcctgcccctgctgctgctgctggtgaccagcgccagcacccacgcctggagccggcccctgtggtaccaggtgggcctggacctgcagccctggggctgccagcccaagtctgtggagggctgccggggcggcctgagctgccccggctactggctgggccctggggccagccgcatctaccctgtggccgctgtgatgatcaccaccaccatgctgatgatctgcaggaagatcctgcagggcagaagaagaagccaggccaccaagggggagcacccccaggtgaccacagagccctgtggcccctggaagaggcgggcccccatcagtgaccacaccctgctgcggggcgtgctgcacatgctggatgccctgctggtgcacatcgagggccacctgcggcacctggccacccagaggcagatccagatcaagggcaccagcacccagagcggctag

SEQ ID NO: 39599 - DNA, 780 bp, Artificial Sequence
  Description of Artificial Sequence: Synthetic coding sequence
atgtgcccagaaaatgctgaggactgtgagcaggccgtggtgcacgtggagaccaccctgtacctggtgccctgcctgaatgactgtggcccctacggccagtgcctgctgctgcggcggcacagctacctgtatgccagctgcagctgcaaggccggctggaggggctggagctgcacagacaacagcacagcccagacagtggcccagcagagagctgccaccctgctgctgaccctgagcaacctgatgttcctggcccccatcgctgtgtctgtgcggcgcttcttcctggtggaggcctctgtgtatgcctacaccatgttcttcagcaccttctaccacgcctgtgaccagcccggggaggccgtgctgtgcatcctgtcctatgacaccctgcagtactgtgacttcctgggcagcggggccgccatctgggtgaccatcctgtgcatggcccggctgaagacagtgctgaagtatgcctaccgctgtggccaccggcggcagtgctaccccacctcctggcagcgctgggccttctacctgctgcccggggtgtccatggcctctgtgggcatcgccatctacacctccatgatgaccagtgacaactactactacacccacagcatctggcacatcctgctggccggcagcgctgccctgctgctgcccccaccagaccagcctgctgagccctgggcctgcagccagaagttcccctgccactaccagatctgcaagaatgaccgggaggagctgtatgctgtgacctag

SEQ ID NO: 39600 - DNA, 2316 bp, Artificial Sequence
  Description of Artificial Sequence: Synthetic coding sequence
atgggccgggccggcaccggcaccggcggggaggccgtggccgctgtggtggccggccccctgctgctgctgctgctggcccggcccccaccagccagcgctggctacagcggcaagtctgaggtgggcctggtgtctgagcacttcagccaggccccccagaggctgtccttctacagctggtacggcagcgcccggctcttccgcttccgggtgcccccagatgctgtgctgctgcgctggctgctgcaggtgtcccgggagagcggggccgcctgcacagatgctgagatcaccgtgcacttccgcagcggggcccctcctgtgatcaaccccctgggcaccagcttcccagatgacacagctgtgcagcccagcttccaggtgggcgtgcccctgagcaccacccccaggagcaatgcctctgtgaatgtgagccacccagcccctggggactggtttgtggccgcccacctgccccccagcagccagaagattgagctgaagggcctggcccccacctgtgcctacgtgttccagcctgagctgctggtgaccagggtggtggagatcagcatcatggagccagatgtgcccctgccccagaccctgctgagccaccccagctacctgaaggtgtttgtgcctgactacacccgggagctgctgctggagctgcgggactgtgtgtccaatggcagcctgggctgccctgtgcggctgactgtgggccctgtgaccctgcccagcaacttccagaaggtgctgacctgcacaggagccccctggccctgccgcctgctgctgcccagccccccctgggaccgctggctgcaggtgacagctgagagcctggtgggccccctgggcaccgtggccttctctgctgtggccgccctgacagcctgccggcccaggtctgtgaccatccagcccctgctgcagagcagccagaaccagagcttcaatgccagcagcggcctgctgagccccagcccagaccaccaggacctgggccgcagcggccgggtggacaggagccccttctgcctgaccaactaccctgtgacccgggaggacatggatgtggtgtctgtgcacttccagcccctggacagagtgtctgtgcgggtgtgcagcgacacccccagcgtgatgaggctgcggctgaacacaggcatggacagcggcggcagcctgaccatcagcctgcgggccaacaagacagagatgagaaatgaaacagtggtggtggcctgtgtgaatgctgccagccccttcctgggcttcaacaccagcctgaactgcaccacagccttcttccagggctaccccctgagcctgagcgcctggagcagaagagccaacctgatcatcccctacccagagacagacaactggtacctgagcctgcagctgatgtgcccagaaaatgctgaggactgtgagcaggccgtggtgcacgtggagaccaccctgtacctggtgccctgcctgaatgactgtggcccctacggccagtgcctgctgctgcggcggcacagctacctgtatgccagctgcagctgcaaggccggctggaggggctggagctgcacagacaacagcacagcccagacagtggcccagcagagagctgccaccctgctgctgaccctgagcaacctgatgttcctggcccccatcgctgtgtctgtgcggcgcttcttcctggtggaggcctctgtgtatgcctacaccatgttcttcagcaccttctaccacgcctgtgaccagcctggagaggccgtgctgtgcatcctgtcctatgacaccctgcagtactgtgacttcctgggcagcggggccgccatctgggtgaccatcctgtgcatggcccggctgaagacagtgctgaagtatgtgctcttcctgctgggcaccctggtgattgccatgagcctgcagctggaccggcggggcatgtggaacatgctgggcccctgcctgtttgccttcgtcatcatggcctccatgtgggcctaccgctgtggccaccggcggcagtgctaccccacctcctggcagcgctgggccttctacctgctgcccggggtgtccatggcctctgtgggcatcgccatctacacctccatgatgaccagtgacaactactactacacccacagcatctggcacatcctgctggccggcagcgctgccctgctgctgcccccaccagaccagcctgctgagccctgggcctgcagccagaagttcccctgccactaccagatctgcaagaatgaccgggaggagctgtatgctgtgacctag

SEQ ID NO: 39601 - DNA, 1419 bp, Artificial Sequence
  Description of Artificial Sequence: Synthetic coding sequence
atgaacatgccccagagcctgggcaaccagcccctgcccccagagccccccagcctgggcaccccagctgagggccctggcaccaccagccccccagagcactgctggcctgtgcggcccaccctgagaaatgagctggacaccttctctgtgcacttctacatcttcttcggccccagcgtggccctgcccccagagaggcctgctgtgtttgccatgaggctgctgcctgtgctggacagcggaggagtgctgagcctggagctgcagctgaatgccagctctgtgcggcaggagaatgtgacagtgtttggctgcctgacccatgaggtgcccctgagcctgggagatgctgctgtgacctgcagcaaggagagcctggccggcttcctgctgtctgtgtctgccaccaccagggtggcccggctgcgcatccccttcccccagacaggcacctggttcctggccctgcggagcctgtgtggggtgggccccaggtttgtgcgctgcagaaatgccacagctgaggtgaggatgaggaccttcctgagcccctgtgtggatgactgtggcccctacggccagtgcaagctgctgcggacccacaactacctgtatgctgcctgtgagtgcaaggccggctggaggggctggggctgcacagattctgcagatgccctgacctacggcttccagctgctgagcaccctgctgctgtgcctgagcaacctgatgttcctgccccctgtggtgctggccatccgcagccgctacgtgctggaggccgctgtgtacaccttcaccatgttcttcagcaccttctaccacgcctgtgaccagcccggcatcgtggtgttctgcatcatggactatgatgtgctgcagttctgtgacttcctgggcagcctgatgtctgtgtgggtgacagtgattgccatggcccggctgcagcctgtggtgaagcaggtgctgtacctgctgggcgccatgctgctgtccatggccctgcagctggacagacatggcctgtggaacctgctgggccccagcctgtttgccctgggcatcctggccacagcctggacagtgcgctctgtgagaagaagacactgctacccacccacctggaggcgctggctgttctacctgtgccccggcagcctgattgctggcagcgctgtgctgctgtatgcctttgtggagacccgggacaactacttctacatccacagcatctggcacatgctgattgctggctctgtgggcttcctgctgcccccccgggccaagacagaccatggagtgcccagcggggcccgggcccggggctgcggctaccagctgtgcatcaatgagcaggaggagctgggcctggtgggccctggaggagccaccgtgagcagcatctgtgccagctag

SEQ ID NO: 39602 - DNA, 1419 bp, Artificial Sequence; identical to SEQ ID NO: 39601
  Description of Artificial Sequence: Synthetic coding sequence

SEQ ID NO: 39603 - DNA, 1017 bp, Artificial Sequence
  Description of Artificial Sequence: Synthetic coding sequence
atgaacatgccccagagcctgggcaaccagcccctgcccccagagccccccagcctgggcaccccagctgagggccctggcaccaccagccccccagagcactgctggcctgtgcggcccaccctgagaaatgagctggacaccttctctgtgcacttctacatcttcttcggccccagcgtggccctgcccccagagaggcctgctgtgtttgccatgaggctgctgcctgtgctggacagcggaggagtgctgagcctggagctgcagctgaatgccagctctgtgcggcaggagaatgtgacagtgtttggctgcctgacccatgaggtgcccctgagcctgggagatgctgctgtgacctgcagcaaggagagcctggccggcttcctgctgtctgtgtctgccaccaccagggtggcccggctgcgcatccccttcccccagacaggcacctggttcctggccctgcggagcctgtgtggggtgggccccaggtttgtgcgctgcagaaatgccacagctgaggtgaggatgaggaccttcctgagcccctgtgtggatgactgtggcccctacggccagtgcaagctgctgcggacccacaactacctgtatgctgcctgtgagtgcaaggccggctggaggggctggggctgcacagattctgcagatgccctgacctacggcttccagctgctgagcaccctgctgctgtgcctgagcaacctgatgttcctgccccctgtggtgctggccatccgcagccgctacgtgctggaggccgctgtgtacaccttcaccatgttcttcagcacagtgtgtggcggcgtgtgcatcctgagcctgggcgcctgtgcctggtggtgggtgacagtgtgcatcagcaccaccttcagcgagggcctgggcatgtctgtgcccagcctgtgcctgctgcagacagaaacagctgtgctgcccaagctgagctgcatcgacaatggccacttctgcaagacccactggagcaagtag

SEQ ID NO: 39604 - DNA, 1017 bp, Artificial Sequence; identical to SEQ ID NO: 39603
  Description of Artificial Sequence: Synthetic coding sequence

SEQ ID NO: 39605 - DNA, 552 bp, Artificial Sequence
  Description of Artificial Sequence: Synthetic coding sequence
atgaagctgctgagcctggtggccgtggtgggctgcctgctggtgcccccagctgaggccaacaagagcagcgaggacatccgctgcaagtgcatctgccccccctacagaaacatcagcggccacatctacaaccagaatgtgtcccagaaggactgcaactgcctgcacgtggtggagcccatgcctgtgcccggccatgatgtggaggcctactgcctgctgtgtgaatgtagatatgaggagaggagcaccaccaccatcaaggtgatcatcgtcatctacctgtctgtggtgggcgccctgctgctgtacatggccttcctgatgctggtggaccccctcatcaggaagccagatgcctacacagagcagctgcacaatgaggaggagaatgaagatgcccgctccatggctgctgctgctgccagcctgggcggcccccgggccaacacagtgctggagcgggtggagggcgcccagcagcgctggaagctgcaggtgcaggagcagaggaagacagtgtttgacagacacaagatgctgtcctag

SEQ ID NO: 39606 - DNA, 552 bp, Artificial Sequence; identical to SEQ ID NO: 39605
  Description of Artificial Sequence: Synthetic coding sequence

SEQ ID NO: 39607 - DNA, 561 bp, Artificial Sequence
  Description of Artificial Sequence: Synthetic coding sequence
atgaagctgctgagcctggtggccgtggtgggctgcctgctggtgcccccagctgaggccaacaaggtgcgggagagcagcgaggacatccgctgcaagtgcatctgccccccctacagaaacatcagcggccacatctacaaccagaatgtgtcccagaaggactgcaactgcctgcacgtggtggagcccatgcctgtgcccggccatgatgtggaggcctactgcctgctgtgtgagtgccgctatgaggagaggagcaccaccaccatcaaggtgatcatcgtcatctacctgtctgtggtgggcgccctgctgctgtacatggccttcctgatgctggtggaccccctcatcaggaagccagatgcctacacagagcagctgcacaatgaggaggagaatgaagatgcccgctccatggctgctgctgctgccagcctgggcggcccccgggccaacacagtgctggagcgggtggagggcgcccagcagcgctggaagctgcaggtgcaggagcagaggaagacagtgtttgacagacacaagatgctgtcctag

SEQ ID NO: 39608 - DNA, 561 bp, Artificial Sequence; identical to SEQ ID NO: 39607
  Description of Artificial Sequence: Synthetic coding sequence

SEQ ID NO: 39609 - DNA, 552 bp, Artificial Sequence; identical to SEQ ID NO: 39605
  Description of Artificial Sequence: Synthetic coding sequence

SEQ ID NO: 39610 - DNA, 345 bp, Artificial Sequence
  Description of Artificial Sequence: Synthetic coding sequence
atgaagctgctgagcctggtggccgtggtgggctgcctgctggtgcccccagctgaggccaacaaggtgcgggaggtgtccctgcagcacctggtgaccaccaccgtgcacggccaccctgtgtacagagctgacagcgagagcagcgaggacatccgctgcaagtgcatctgccccccctacagaaacatcagcggccacatctacaaccagaatgtgtcccagaaggactgcaactgcctgcacgtggtggagcccatgcctgtgcccggccatgatgtggaggcctactgcctgctgtgtgagtgccgctatgaggagaggagcaccaccaccatcaagtag

SEQ ID NO: 39611 - DNA, 417 bp, Artificial Sequence
  Description of Artificial Sequence: Synthetic coding sequence
atgaagctgctgagcctggtggccgtggtgggctgcctgctggtgcccccagctgaggccaacaagagcagcgaggacatccgctgcaagtgcatctgccccccctacagaaacatcagcggccacatctacaaccagaatgtgtcccagaaggactgcaactgcctgcacgtggtggagcccatgcctgtgcccggccatgatgtggaggcctactgcctgctgtgtgaatgtagatatgaggagaggagcaccaccaccatcaaggtgatcatcgtcatctacctgtctgtggtgggcgccctgctgctgtacatggccttcctgatgctggtggaccccctcatcaggaagccagatgcctacacagagcagctgcacaatgaggaggagaatgaagatgcccgctccatgtag

SEQ ID NO: 39612 - DNA, 456 bp, Artificial Sequence
  Description of Artificial Sequence: Synthetic coding sequence
atgaagctgctgagcctggtggccgtggtgggctgcctgctggtgcccccagctgaggccaacaagagcagcgaggacatccgctgcaagtgcatctgccccccctacagaaacatcagcggccacatctacaaccagaatgtgtcccagaaggactgccctgtgtccctgtgctgcagcaactgcctgcacgtggtggagcccatgcctgtgcccggccatgatgtggaggcctactgcctgctgtgtgagtgccgctatgaggagaggagcaccaccaccatcaaggtgatcatcgtcatctacctgtctgtggtgggcgccctgctgctgtacatggccttcctgatgctggtggaccccctcatcaggaagccagatgcctacacagagcagctgcacaatgaggaggagaatgaagatgcccgctccatggctgctgctgctgccagctag

SEQ ID NO: 39613 - DNA, 369 bp, Artificial Sequence
  Description of Artificial Sequence: Synthetic coding sequence
atggacagccccagcctgcgggagctgcagcagcccctgctggagggcacagaatgtgagaccccagcccagaagccaggaagacatgagctgggcagccccctgcgggagatcgcctttgctgagagcctgcggggcctgcagttcctgagcccccccctgcccagcgtgtctgctggcctgggggagccccggcccccagatgtggaggacatgagcagcagtgacagcgacagcgactgggatggcggcagccggctgagccccttcctgccccatgaccacctgggcctggccgtgttctccatgctgtgctgcttctggcctgtgggcattgctgccttctgcctggcccagaagaccaactag

SEQ ID NO: 39614 - DNA, 420 bp, Artificial Sequence
  Description of Artificial Sequence: Synthetic coding sequence
atggacagccccagcctgcgggagctgcagcagcccctgctggagggcacagaatgtgagaccccagcccagaagccaggaagacatgagctgggcagccccctgcgggagatcgcctttgctgagagcctgcggggcctgcagttcctgagcccccccctgcccagcgtgtctgctggcctgggggagccccggcccccagatgtggaggacatgagcagcagtgacagcgacagcgactgggatggcggcagccggctgagccccttcctgccccatgaccacctgggcctggccgtgttctccatgctgtgctgcttctggcctgtgggcattgctgccttctgcctggcccagaagcacccccagtgcctgacctacagccgctgctacgtgtctgccttcggcatccacgcctag

SEQ ID NO: 39615 - DNA, 519 bp, Artificial Sequence
  Description of Artificial Sequence: Synthetic coding sequence
atggacagccccagcctgcgggagctgcagcagcccctgctggagggcacagaatgtgagaccccagcccagaagccaggaagacatgagctgggcagccccctgcgggagatcgcctttgctgagagcctgcggggcctgcagttcctgagcccccccctgcccagcgtgtctgctggcctgggggagccccggcccccagatgtggaggacatgagcagcagtgacagcgacagcgactgggatggcggcagccggctgagccccttcctgccccatgaccacctgggcctggccgtgttctccatgctgtgctgcttctggcctgtgggcattgctgccttctgcctggcccagaagaccaacaaggcctgggccaagggggacatccagggcgctggggccgccagccggcgggccttcctgctgggcgtgctggccgtgggcctgggcgtgtgcacctacgccgccgccctggtgaccctggccgcctacctggccagccgggaccccccatag

SEQ ID NO: 39616 - DNA, 402 bp, Artificial Sequence
  Description of Artificial Sequence: Synthetic coding sequence
atggacagccccagcctgcgggagctgcagcagcccctgctggagggcacagaatgtgagaccccagcccagaagccaggaagacatgagctgggcagccccctgcgggagatcgcctttgctgagagcctgcggggcctgcagttcctgagcccccccctgcccagcgtgtctgctggcctgggggagccccggcccccagatgtggaggacatgagcagcagtgacagcgacagcgactgggatggcggcagccggctgagccccttcctgccccatgaccacctgggcctggccgtgttctccatgctgtgctgcttctggcctgtgggcattgctgccttctgcctggcccagaagacccggcccagctgcccctacagcccccactgtgagccctag

SEQ ID NO: 39617 - DNA, 372 bp, Artificial Sequence
  Description of Artificial Sequence: Synthetic coding sequence
atggacagccccagcctgcgggagctgcagcagcccctgctggagggcacagaatgtgagaccccagcccagaagccaggaagacatgagctgggcagccccctgcgggagatcgcctttgctgagagcctgcggggcctgcagttcctgagcccccccctgcccagcgtgtctgctggcctgggggagccccggcccccagatgtggaggacatgagcagcagtgacagcgacagcgactgggatggcggcagccggctgagccccttcctgccccatgaccacctgggcctggccgtgttctccatgctgtgctgcttctggcctgtgggcattgctgccttctgcctggcccagaagcccagcctgtag

SEQ ID NO: 39618 - DNA, 384 bp, Artificial Sequence
  Description of Artificial Sequence: Synthetic coding sequence
atggacagccccagcctgcgggagctgcagcagcccctgctggagggcacagaatgtgagaccccagcccagaagccaggaagacatgagctgggcagccccctgcgggagatcgcctttgctgagagcctgcggggcctgcagttcctgagcccccccctgcccagcgtgtctgctggcctgggggagccccggcccccagatgtggaggacatgagcagcagtgacagcgacagcgactgggatggcggcagccggctgagccccttcctgccccatgaccacctgggcctggccgtgttctccatgctgtgctgcttctggcctgtgggcattgctgccttctgcctggcccagaagctgcccctgcagcccagcctgtag

SEQ ID NO: 39619 - DNA, 183 bp, Artificial Sequence
  Description of Artificial Sequence: Synthetic coding sequence
tgatgggatggcggcagccggctgagccccttcctgccccatgaccacctgggcctggccgtgttctccatgctgtgctgcttctggcctgtgggcattgctgccttctgcctggcccagaagcacccccagtgcctgacctacagccgctgctacgtgtctgccttcggcatccacgcctag

SEQ ID NO: 39620 - DNA, 345 bp, Artificial Sequence
  Description of Artificial Sequence: Synthetic coding sequence
atggacagccccagcctgcgggagctgcagcagcccctgctggagggcacagaatgtgagaccccagcccagaagccaggaagacatgagctgggcagccccctgcgggagatcgcctttgctgagagcctgcggggcctgcagttcctgagcccccccctgcccagcgtgtctgctggcctgggggagccccggcccccagatgtggaggacatgagcagcagtgacagcgacagcgactgggatggcggcagccggctgagccccttcctgccccatgaccacctgggcctggccgtgttctccatgctgtgctgcttctggcctgtgggcattgctgcctag

SEQ ID NO: 39621 - DNA, 402 bp, Artificial Sequence; identical to SEQ ID NO: 39616
  Description of Artificial Sequence: Synthetic coding sequence

SEQ ID NO: 39622 - DNA, 264 bp, Artificial Sequence
  Description of Artificial Sequence: Synthetic coding sequence
tgactgcccagcgtgtctgctggcctgggggagccccggcccccagatgtggaggacatgagcagcagtgacagcgacagcgactgggatggcggcagccggctgagccccttcctgccccatgaccacctgggcctggccgtgttctccatgctgtgctgcttctggcctgtgggcattgctgccttctgcctggcccagaagcacccccagtgcctgacctacagccgctgctacgtgtctgccttcggcatccacgcctag

SEQ ID NO: 39623 - DNA, 480 bp, Artificial Sequence
  Description of Artificial Sequence: Synthetic coding sequence
atgagccaggcctgggtgcccggcctggcccccaccctgctcttcagcctgctggccggcccccagaagattgctgccaagtgtggcctcatcctggcctgccccaagggcttcaagtgctgcggggacagctgctgccaggagaatgaactcttccctggccctgtgcgcatctttgtgatcatcttcctggtgatcctgagcgtcttctgcatctgtggcctggccaagtgcttctgcaggaactgccgggagcctgagccagacagccctgtggactgccggggccccctggagctgcccagcatcatccccccagagcgggtgcgggtgtccctgagcgcccctcctccaccctacagcgaggtgatcctgaagcccagcctgggccccacccccacagagcccccaccaccctacagcttccggcctgaggagtacaccggggaccagaggggcatcgacaacccagccttctag

SEQ ID NO: 39624 - DNA, 480 bp, Artificial Sequence; identical to SEQ ID NO: 39623
  Description of Artificial Sequence: Synthetic coding sequence

SEQ ID NO: 39625 - DNA, 333 bp, Artificial Sequence
  Description of Artificial Sequence: Synthetic coding sequence
atggctgctgtggtggccaagcgggagggcccccccttcatcagcgaggccgctgtgagaggaaatgctgctgtgctggactactgcaggacctctgtgtctgccctgagcggggccacagctggcatcctgggcctgaccggcctgtatggcttcatcttctacctgctggcctctgtgctgctgagcctgctgctgatcctgaaggccggccgccgctggaacaagtacttcaagagcagaagacccctcttcaccggcggcctcatcggcggcctcttcacctacgtgctcttctggaccttcctgtatggcatggtgcacgtgtactag

SEQ ID NO: 39626 - DNA, 333 bp, Artificial Sequence; identical to SEQ ID NO: 39625
  Description of Artificial Sequence: Synthetic coding sequence

SEQ ID NO: 39627 - DNA, 681 bp, Artificial Sequence
  Description of Artificial Sequence: Synthetic coding sequence
atggagaccgtggtgattgtggccatcggcgtgctggccaccatcttcctggccagctttgctgccctggtgctggtgtgccggcagcgctactgccggccccgggacctgctgcagagatatgacagcaagcccatcgtggacctgattggagccatggagacccagagcgagcccagcgagctggagctggatgatgtggtgatcaccaacccccacatcgaggccatcctggagaatgaagactggattgaagatgccagcggcctgatgagccactgcatcgccatcctgaagatctgccacaccctgacagagaagctggtggccatgaccatgggcagcggggccaagatgaagaccagcgcctctgtgtctgacatcatcgtggtggccaagaggatcagcccccgggtggatgatgtggtgaagtccatgtacccacccctggaccccaagctgctggatgcccggaccacagccctgctgctgtctgtgagccacctggtgctggtgaccagaaatgcctgccacctgaccggcggcctggactggattgaccagagcctgtctgctgctgaggagcacctggaggtgctgcgggaggccgccctggccagcgagccagacaagggcctgcccggccctgagggcttcctgcaggagcagagcgccatctag

SEQ ID NO: 39628 - DNA, 681 bp, Artificial Sequence; identical to SEQ ID NO: 39627
  Description of Artificial Sequence: Synthetic coding sequence

SEQ ID NO: 39629 - DNA, 414 bp, Artificial Sequence
  Description of Artificial Sequence: Synthetic coding sequence
atggagaccgtggtgattgtggccatcggcgtgctggccaccatcttcctggccagctttgctgccctggtgctggtgtgccggcagcgctactgccggccccgggacctgctgcagagatatgacagcaagcccatcgtggacctgattggagccatggagacccagagcgagcccagcgagctggagctggatgatgtggtgatcaccaacccccacatcgaggccatcctggagaatgaagactggattgaagatgccagcggcctgatgagccactgcatcgccatcctgaagatctgccacaccctgacagagaagctggtggccatgaccatgggcagcggggccaagatgaagaccagcgcctctgtgtctgacatcatcgtggtggccaagaggatcagcccctag

SEQ ID NO: 39630 - DNA, 669 bp, Artificial Sequence
  Description of Artificial Sequence: Synthetic coding sequence
atggagaccgtggtgattgtggccatcggcgtgctggccaccatcttcctggccagctttgctgccctggtgctggtgtgccggcagcgctactgccggccccgggacctgctgcagagatatgacagcaagcccatcgtggacctgattggagccatggagacccagagcgagcccagcgagctggagctggatgatgtggtgatcaccaacccccacatcgaggccatcctggagaatgaagactggattgaagatgccagcggcctgatgagccactgcatcgccatcctgaagatctgccacaccctgacagagaagctggtggccatgaccatgggcagcggggccaagatgaagaccagcgcctctgtgtctgacatcatcgtggtggccaagaggatcagcccccgggtggatgatgtggtgaagtccatgtacccacccctggaccccaagctgctggatgcccggaccacagccctgctgctgtctgtgagccacctggtgctggtgaccagaaatgcctgccacctgaccggcggcctggactggattgaccagagcctgtctgctgctgaggagcacctggaggtgctgcgggaggccgccctggccagcgagccagacaagggcctgcccggccctgagggcttcctgcaggagtag

SEQ ID NO: 39631 - DNA, 681 bp, Artificial Sequence; identical to SEQ ID NO: 39627
  Description of Artificial Sequence: Synthetic coding sequence

SEQ ID NO: 39632 - DNA, 777 bp, Artificial Sequence
  Description of Artificial Sequence: Synthetic coding sequence
atggtgggcatcctgcccctgtgctgcagcggctgtgtgcccagcctgtgctgcagcagctatgtgcccagcgtggcccccacagctgcccacagcgtgcgggtgccccacagcgctggccactgcggccagagggtgctggcctgcagcctgccccaggtgttcctgaagccctggatctttgtggagcacttcagctcctggctgagcctggagctgttctccttcctgcgctacctgggcaccctgctgtgtgcctgtggccaccggctgcgggagggcctgctgctgccctgcctgctgggcgtgggctcctggctgctcttcaacaactggacaggaggctcctggttcagcctgcacctgcagcaggtgtccctgagccagggcagccacgtggccgccttcctgcctgaggccatcggccctggggtgcctgtgcctgtgtctggagagagcaccagcgcccagcagagccatgctggctggcagctgtctgctgaggctgatgcctgccccagcgtgctgtacagcgaggtgctggagtggaacaagaacatcaacacctacaccagcttccatgacttctgcctgatcctgggcatcttcctgttctgctttgtgctggccgtcatcggcctgccctacatcaagccaggcctgagcctgtctgtggccctgctgtggcagagcctcatcctgctgagcagcctggtgcagcaggacagccaggtgcacacctggggctgcctcttcagcaccttcaccagcacctag

SEQ ID NO: 39633 - DNA, 570 bp, Artificial Sequence
  Description of Artificial Sequence: Synthetic coding sequence
atggtgggcatcctgcccctgtgctgcagcggctgtgtgcccagcctgtgctgcagcagctatgtgcccagcgtggcccccacagctgcccacagcgtgcgggtgccccacagcgctggccactgcggccagagggtgctggcctgcagcctgccccaggtgttcctgaagccctggatctttgtggagcacttcagctcctggctgagcctggagctgttctccttcctgcgctacctgggcaccctgctgtgtgcctgtggccaccggctgcgggagggcctgctgctgccctgcctgctgggcgtgggctcctggctgctcttcaacaactggacaggaggctcctggttcagcctgcacctgcagcaggtgtccctgagccagggcagccacgtggccgccttcctgcctgaggccatcggccctggggtgcctgtgcctgtgtctggagagagcaccagcgcccagcagagccatgctggctggcagctgtctgctgaggctgatgcctgccccagcgtgctgtacagcgaggtgctggagtggaacaagaacatcaacacctag

SEQ ID NO: 39634 - DNA, 507 bp, Artificial Sequence
  Description of Artificial Sequence: Synthetic coding sequence
atgcccaagggctggggcgtgcgcagcagcaccttcctgcccctgtggctgcctgtgaagattgagctgcaccaggtgcagttccacagcagcagccagatgatcttcagcaccctgcggtctgagctgtacaagctgctggccctgtgccagcacgctgtggtgcccatgggcaagttcctgggcaagaccaagacccagagccagggccaggtggtgatcttcagcgagaagggcaaggccatcatctacctgagcctgcccaggacagtgcccatctacacctgcatcttcagccagagcgtgggctgcctcttcatcctgctgatcatcagcctgaacttcctgctcttcatctacttcatcgagacagacctgatcatgctgcccagggtcatcctggacctgctggccagcagtgacccccccaccctggtgtcccagagcgctggcatcacagatgtgaactaccacacccagagcacctgccgccgcttctctgtgtag

SEQ ID NO: 39635 - DNA, 1362 bp, Artificial Sequence
  Description of Artificial Sequence: Synthetic coding sequence
atggccatcttccggcagctgagcctgggcgccaaggccaccctggccgctgtgacagtgtttgtgtccatgattgccagccgcagctacctggccgagagcctggagctgcgggcctggcgctggctgctgcggctgcagctggccctgtttgtgaacagcctgctgctgattggcagcctgtacatctggaggagcacagtgagcaacctgtgccacagccctgctgctgagagcacctgcttccagctgtggaaggtggtggtgctggccttcctggccctggcccacagcagcttcttcaccatgttcttcctggtggccgaggagccctacctgttcagcctggccgcctacagctgcctgggcgcctacatcatcatgctgttcttcctgttcatcctgagcggcatggagcaggcctaccagctgctggcctggaggagcggccgggtggtgggcagcctggagaagaccaggaagctggtgctgcggcctgccctggccgtgggcgtgacagctgtgctgtctgtggccggcatcctgaatgctgcccagcccccagctgtgaagacagtggaggtgcccatccaccagctgcctgcctccatgaacaacctgaagatcgtgctgctgagtgacatccacctgggccccaccgtgggccgcaccaagatggagatgtttgtgaggatggtgaatgtgctggagccagacatcaccgtgattgtgggggacctgagtgacagcgaggcctctgtgctgaggacagctgtggcccccctgggccagctgcacagccacctgggcgcctactttgtgactggaaaccacgagtactacaccagtgatgtgagcaactggtttgccctgctggagagcctgcacgtgcagcccctgcacaatgaaaatgtgaagatcagcgccacccgggcccagagaggaggcggcggcagcggcagcggctctgaagatgaggactggatctgcctggccggcgtggatgacattgaagctgacatcctgcactacagcggccacggcatggacctggacaaggccctggagggctgcagcccagaccacaccatcatcctgctggcccaccagcccctggccgccaagagggccctgcaggcccggccagacatcaacctgatcctgagcggccacacccacgccggccagatcttccccctgaatgtggccgcctacctgctgaaccccttctttgctggcctgtaccaggtggcccaggccacctttgtgtatgtgtccccaggcacagcctactacggcatccccatgaggctgggcagcagagctgagatcacagagctgatcctgcagaggagcccctag

SEQ ID NO: 39636 - DNA, 951 bp, Artificial Sequence
  Description of Artificial Sequence: Synthetic coding sequence
atggagcaggcctaccagctgctggcctggaggagcggccgggtggtgggcagcctggagaagaccaggaagctggtgctgcggcctgccctggccgtgggcgtgacagctgtgctgtctgtggccggcatcctgaatgctgcccagcccccagctgtgaagacagtggaggtgcccatccaccagctgcctgcctccatgaacaacctgaagatcgtgctgctgagtgacatccacctgggccccaccgtgggccgcaccaagatggagatgtttgtgaggatggtgaatgtgctggagccagacatcaccgtcatcgtgggggacctgagtgacagcgaggcctctgtgctgaggacagctgtggcccccctgggccagctgcacagccacctgggcgcctactttgtgacaggcaaccacgagtactacaccagtgatgtgagcaactggtttgccctgctggagagcctgcacgtgcagcccctgcacaatgaaaatgtgaagatcagcgccacccgggcccagaggggcggcggcggcagcggcagcggctctgaagatgaggactggatctgcctggccggcgtggatgacatcgaggccgacatcctgcactacagcggccacggcatggacctggacaaggccctggagggctgcagcccagaccacaccatcatcctgctggcccaccagcccctggccgccaagagggccctgcaggcccggccagacatcaacctgatcctgagcggccacacccatgctggccagatcttccccctgaatgtggccgcctacctgctgaaccccttctttgctggcctgtaccaggtggcccaggccacctttgtgtatgtgtccccaggcacagcctactacggcatccccatgaggctgggcagcagagctgagatcacagagctgatcctgcagaggagcccctag

SEQ ID NO: 39637 - DNA, 882 bp, Artificial Sequence
  Description of Artificial Sequence: Synthetic coding sequence
atggacaccctggaggaggtgacctgggccaacggcagcacagccctgcccccacccctggcccccaacatctctgtgccccaccgctgcctgctgctgctgtatgaggacatcggcaccagccgggtgcgctactgggacctgctgctgctgatccccaacgtgctcttcctgatcttcctgctgtggaagctgcccagcgcccgggccaagatccgcatcaccagcagccccatcttcatcaccttctacatcctggtgtttgtggtggccctggtgggcatcgcccgggctgtggtgtccatgacagtgtccaccagcaatgctgccaccgtggccgacaagatcctgtgggagatcacccgcttcttcctgctggccatcgagctgagcgtcatcatcctgggcctggccttcggccacctggagagcaagagcagcatcaagagggtgctggccatcaccaccgtgctgagcctggcctacagcgtgacccagggcaccctggagatcctgtacccagatgcccacctgtctgctgaggacttcaacatctacggccacggcggccggcagttctggctggtgagcagctgcttcttcttcctgctgtgccgctgccacaacctgcctgtgctgcagctgctgcggagcgcccacctgcggggcttccccccaggcctgctgcggctgggcgcccaggaccccctgctgctgcagatgcccagcggccgggacagaggagcccgctgcacccccaccccagccctgcgctgtggccctgctgggggccctgggggctgccggggctgctggggcctgagctgccagctgctggagcacgctgtgcggctgtgcagaagaggaggcctgcccggctag

SEQ ID NO: 39638 - DNA, 1122 bp, Artificial Sequence
  Description of Artificial Sequence: Synthetic coding sequence
atggacaccctggaggaggtgacctgggccaacggcagcacagccctgcccccacccctggcccccaacatctctgtgccccaccgctgcctgctgctgctgtatgaggacatcggcaccagccgggtgcgctactgggacctgctgctgctgatccccaacgtgctcttcctgatcttcctgctgtggaagctgcccagcgcccgggccaagatccgcatcaccagcagccccatcttcatcaccttctacatcctggtgtttgtggtggccctggtgggcatcgcccgggctgtggtgtccatgacagtgtccaccagcaatgctgccaccgtggccgacaagatcctgtgggagatcacccgcttcttcctgctggccatcgagctgagcgtcatcatcctgggcctggccttcggccacctggagagcaagagcagcatcaagagggtgctggccatcaccaccgtgctgagcctggcctacagcgtgacccagggcaccctggagatcctgtacccagatgcccacctgtctgctgaggacttcaacatctacggccacggcggccggcagttctggctggtgagcagctgcttcttcttcctggtgtacagcctggtggtgatcctgcccaagacccccctgaaggagcgcatcagcctgcccagcagaagaagcttctacgtgtatgccggcatcctggccctgctgaacctgctgcagggcctgggctctgtgctgctgtgctttgacatcatcgagggcctgtgctgcgtggatgccaccaccttcctgtacttctccttctttgcccccctcatctacgtggccttcctgcggggcttcttcggcagcgagcccaagatcctcttctcctacaagtgccaggtggatgaaacagaggagccagatgtgcacctgccccagccctatgctgtggcccggcgggagggcctggaggccgccggggccgccggggccagcgctgccagctacagcagcacccagtttgacagcgctggaggagtggcctacctggatgacatcgcctccatgccctgccacacaggcagcatcaacagcacagattctgagcgctggaaggccatcaatgcctag

SEQ ID NO: 39639 - DNA, 1122 bp, Artificial Sequence; identical to SEQ ID NO: 39638
  Description of Artificial Sequence: Synthetic coding sequence

SEQ ID NO: 39640 - DNA, 126 bp, Artificial Sequence
  Description of Artificial Sequence: Synthetic coding sequence
atggacaccctggaggaggtgacctgggccaacggcagcacagccctgcccccacccctggcccccaacatctctgtgccccaccgctgcctgctgctgctgtatgaggacatcggcaccagctag

SEQ ID NO: 39641 - DNA, 612 bp, Artificial Sequence
  Description of Artificial Sequence: Synthetic coding sequence
atggacaccctggaggaggtgacctgggccaacggcagcacagccctgcccccacccctggcccccaacatctctgtgccccaccgctgcctgctgctgctgtatgaggacatcggcaccagccgggtgcgctactgggacctgctgctgctgatccccaacgtgctcttcctgatcttcctgctgtggaagctgcccagcgcccgggccaagatccgcatcaccagcagccccatcttcatcaccttctacatcctggtgtttgtggtggccctggtgggcatcgcccgggctgtggtgtccatgacagtgtccaccagcaatgctgccaccgtggccgacaagatcctgtgggagatcacccgcttcttcctgctggccatcgagctgagcgtcatcatcctgggcctggccttcggccacctggagagcaagagcagcatcaagagggtgctggccatcaccaccgtgctgagcctggcctacagcgtgacccagggcaccctggagatcctgtacccagatgcccacctgtctgctgaggacttcaacatctacggccacggcggccggcagttctggctggtgagcagctgcttcttcttcctgtag

SEQ ID NO: 39642 - DNA, 1122 bp, Artificial Sequence; identical to SEQ ID NO: 39638
  Description of Artificial Sequence: Synthetic coding sequence

SEQ ID NO: 39643 - DNA, 615 bp, Artificial Sequence
  Description of Artificial Sequence: Synthetic coding sequence
atggacaccctggaggaggtgacctgggccaacggcagcacagccctgcccccacccctggcccccaacatctctgtgccccaccgctgcctgctgctgctgtatgaggacatcggcaccagccgggtgcgctactgggacctgctgctgctgatccccaacgtgctcttcctgatcttcctgctgtggaagctgcccagcgcccgggccaagatccgcatcaccagcagccccatcttcatcaccttctacatcctggtgtttgtggtggccctggtgggcatcgcccgggctgtggtgtccatgacagtgtccaccagcaatgctgccaccgtggccgacaagatcctgtgggagatcacccgcttcttcctgctggccatcgagctgagcgtcatcatcctgggcctggccttcggccacctggagagcaagagcagcatcaagagggtgctggccatcaccaccgtgctgagcctggcctacagcgtgacccagggcaccctggagatcctgtacccagatgcccacctgtctgctgaggacttcaacatctacggccacggcggccggcagttctggctggtgagcagctgcttcttcttcctggtgtag

SEQ ID NO: 39644 - DNA, 501 bp, Artificial Sequence
  Description of Artificial Sequence: Synthetic coding sequence
atggacaccctggaggaggtgacctgggccaacggcagcacagccctgcccccacccctggcccccaacatctctgtgccccaccgctgcctgctgctgctgtatgaggacatcggcaccagccgggtgcgctactgggacctgctgctgctgatccccaacgtgctcttcctgatcttcctgctgtggaagctgcccagcgcccgggccaagatccgcatcaccagcagccccatcttcatcaccttctacatcctggtgtttgtggtggccctggtgggcatcgcccgggctgtggtgtccatgacagtgtccaccagcaatgctgccaccgtggccgacaagatcctgtgggagatcacccgcttcttcctgctggccatcgagctgagcgtcatcatcctgggcctggccttcggccacctggagagcaagagcagcatcaagagggtgctggccatcaccaccgtgctgagcctggcctacagcgtgacccagtag

SEQ ID NO: 39645 - DNA, 390 bp, Artificial Sequence
  Description of Artificial Sequence: Synthetic coding sequence
tgaagtgaggtgcccctgcccccaggggccctggccaccctgagcagcagctgcagcctgggcgtggccctgcacaggagcagccctgccagccggggccctggagagagcagcctgcctgccttctctggagtggccctgctgcccccagcctgcaaggccggcctgccctacaacctgagccggcaggagggccacctgacctgcctgagcatcccagacatcaagacagccttcagtgactgcaccagcaagattggccggcgggactgcctgacccaggcctgcagcgccctgaccgggaagggcgtgcgggagggcatcgagtggatggtgaagtgtgtggtgagaaatgtgcaccggcccccccggcagagggacatcacctag

SEQ ID NO: 39646 - DNA, 1158 bp, Artificial Sequence
  Description of Artificial Sequence: Synthetic coding sequence
atggtgctgatgcacctggccgtgaagaacaacaggatgtctgccaacaatgaccacttcctgacccccacctggcagcagatgagggccacccccctggccgccccagctggcagcctgagcaggaagaagaggctggagctggatgacaacctggacacagagaggcctgtgcagaagagggcccggagcggcccccagccccggctgcccccctgcctgctgcccctgagccccccaacagccccagaccgggccacagctgtggccacagccagccggctgggcccctacgtgctgctggagcctgaggagggcggccgggcctaccaggccctgcactgccccactggaacagagtacacctgcaaggtgtaccctgtgcaggaggccctggccgtgctggagccctatgcccggctgcccccccacaagcacgtggcccggcccacagaggtgctggccggcacccagctgctgtatgccttcttcaccaggacccacggggacatgcacagcctggtgcgcagccgccaccgcatccctgagcctgaggccgctgtgctcttccggcagatggccacagccctggcccactgccaccagcacggcctggtgctgcgggacctgaagctgtgccgctttgtgtttgctgaccgggagaggaagaagctggtgctggagaacctggaggacagctgtgtgctgactggaccagatgacagcctgtgggacaagcacgcctgcccagcctacgtgggccctgagatcctgagcagccgggccagctacagcggcaaggctgctgatgtgtggagcctgggcgtggccctcttcaccatgctggccggccactaccccttccaggacagcgagcctgtgctgctgtttgggaagatcagaagaggagcctatgccctgcctgctggcctgagcgccccagcccgctgcctggtgcgctgcctgctgcggcgggagcctgctgagcggctgacagccaccggcatcctgctgcacccctggctgcggcaggaccccatgcccctggcccccaccaggagccacctgtgggaggccgcccaggtggtgcctgatggcctgggcctggatgaggcccgggaggaggagggggaccgggaggtggtgctgtatggatag

SEQ ID NO: 39647 - DNA, 816 bp, Artificial Sequence
  Description of Artificial Sequence: Synthetic coding sequence
atgagggccacccccctggccgccccagctggcagcctgagcaggaagaagaggctggagctggatgacaacctggacacagagaggcctgtgcagaagagggcccggagcggcccccagccccggctgcccccctgcctgctgcccctgagccccccaacagccccagaccgggccacagctgtggccacagccagccggctgggcccctacgtgctgctggagcctgaggagggcggccgggcctaccaggccctgcactgccccaccggcacagagtacacctgcaaggtgtaccctgtgcaggaggccctggccgtgctggagccctatgcccggctgcccccccacaagcacgtggcccggcccacagaggtgctggccggcacccagctgctgtatgccttcttcaccaggacccatggagacatgcacagcctggtgcgcagccgccaccgcatccctgagcctgaggccgctgtgctcttccggcagatggccacagccctggcccactgccaccagcacggcctggtgctgcgggacctgaagctgtgccgctttgtgtttgctgaccgggagaggaagaagctggtgctggagaacctggaggacagctgtgtgctgaccggcccagatgacagcctgtgggacaagcacgcctgcccagcctacgtgggccctgagatcctgagcagccgggccagctacagcggcaaggccgcagatgtgtggagcctgggcgtggccctcttcaccatgctggccggccactaccccttccaggacagcgagcctgtgctgctgtttggatag

SEQ ID NO: 39648 - DNA, 1188 bp, Artificial Sequence
  Description of Artificial Sequence: Synthetic coding sequence
atggccagcgctgcctctgtgaccagcctggctgatgaggtgaactgccccatctgccagggcaccctgcgggagcctgtgaccatcgactgtggccacaacttctgccgggcctgcctgacccgctactgtgagatccctggccctgacctggaggagagccccacctgccccctgtgcaaggagcccttccggcccggcagcttccggcccaactggcagctggccaacgtggtggagaacatcgagcggctgcagctggtgtccaccctgggcctgggggaggaggatgtgtgccaggagcacggggagaagatctacttcttctgtgaagatgatgagatgcagctgtgtgtggtgtgccgggaggccggggagcacgccacccacaccatgaggttcctggaggatgctgctgccccctaccgggagcagatccacaagtgcctgaagtgcctgaggaaggagcgggaggagatccaggagatccagagccgggagaacaagaggatgcaggtgctgctgacccaggtgtccaccaagaggcagcaggtgatcagcgagtttgcccacctgaggaagttcctggaggagcagcagagcatcctgctggcccagctggagagccaggatggagacatcctgcggcagagagatgaatttgacctgctggtggccggggagatctgccgcttcagcgccctgattgaggagctggaggagaagaatgaaagacctgcccgggagctgctgacagacatccgcagcaccctcatccgctgtgagaccaggaaatgtaggaagcctgtggccgtgtccccagagctgggccagaggatccgggacttcccccagcaggccctgcccctgcagcgggagatgaagatgttcctggagaagctgtgctttgagctggactatgagcccgcccacatcagcctggacccccagaccagccaccccaagctgctgctgtctgaggaccaccagagggcccagttctcctacaagtggcagaacagcccagacaacccccagagatttgaccgggccacctgtgtgctggcccacacaggcatcactggaggccgccacacctgggtgtggatggcccgggtgcctggggacagcggctgctgccagttctgcagccccccatctgtgctgggcacagaggtggccgcctag

SEQ ID NO: 39649 - DNA, 1446 bp, Artificial Sequence
  Description of Artificial Sequence: Synthetic coding sequence
atggccagcgctgcctctgtgaccagcctggctgatgaggtgaactgccccatctgccagggcaccctgcgggagcctgtgaccatcgactgtggccacaacttctgccgggcctgcctgacccgctactgtgagatccctggccctgacctggaggagagccccacctgccccctgtgcaaggagcccttccggcccggcagcttccggcccaactggcagctggccaacgtggtggagaacatcgagcggctgcagctggtgtccaccctgggcctgggggaggaggatgtgtgccaggagcacggggagaagatctacttcttctgtgaagatgatgagatgcagctgtgtgtggtgtgccgggaggccggggagcacgccacccacaccatgaggttcctggaggatgctgctgccccctaccgggagcagatccacaagtgcctgaagtgcctgaggaaggagcgggaggagatccaggagatccagagccgggagaacaagaggatgcaggtgctgctgacccaggtgtccaccaagaggcagcaggtgatcagcgagtttgcccacctgaggaagttcctggaggagcagcagagcatcctgctggcccagctggagagccaggatggagacatcctgcggcagagagatgaatttgacctgctggtggccggggagatctgccgcttcagcgccctgattgaggagctggaggagaagaatgaaagacctgcccgggagctgctgacagacatccgcagcaccctcatccgctgtgagaccaggaaatgtaggaagcctgtggccgtgtccccagagctgggccagaggatccgggacttcccccagcaggccctgcccctgcagcgggagatgaagatgttcctggagaagctgtgctttgagctggactatgagcccgcccacatcagcctggacccccagaccagccaccccaagctgctgctgtctgaggaccaccagagggcccagttctcctacaagtggcagaacagcccagacaacccccagagatttgaccgggccacctgtgtgctggcccacacaggcatcactggaggccgccacacctgggtggtgtccattgacctggcccatggaggcagctgcaccgtgggcgtggtgtctgaagatgtgcagaggaaaggagagctgcggctgcggcctgaggagggcgtgtgggccgtgcggctggcctggggctttgtgtctgccctgggcagcttccccacccggctgaccctgaaggagcagccccggcaggtgcgggtgtccctggactatgaggtgggctgggtgaccttcaccaatgctgtgacccgggagcccatctacaccttcaccgccagcttcaccaggaaggtgatccccttcttcggcctgtggggccggggcagcagcttcagcctgagcagctag

SEQ ID NO: 39650 - DNA, 1446 bp, Artificial Sequence
  Description of Artificial Sequence: Synthetic coding sequence
atggccagcgctgcctctgtgaccagcctggctgatgaggtgaactgccccatctgccagggcaccctgcgggagcctgtgaccatcgactgtggccacaacttctgccgggcctgcctgacccgctactgtgagatccctggccctgacctggaggagagccccacctgccccctgtgcaaggagcccttccggcccggcagcttccggcccaactggcagctggccaacgtggtggagaacatcgagcggctgcagctggtgtccaccctgggcctgggggaggaggatgtgtgccaggagcacggggagaagatctacttcttctgtgaagatgatgagatgcagctgtgtgtggtgtgccgggaggccggggagcacgccacccacaccatgaggttcctggaggatgctgctgccccctaccgggagcagatccacaagtgcctgaagtgcctgaggaaggagcgggaggagatccaggagatccagagccgggagaacaagaggatgcaggtgctgctgacccaggtgtccaccaagaggcagcaggtgatcagcgagtttgcccacctgaggaagttcctggaggagcagcagagcatcctgctggcccagctggagagccaggatggagacatcctgcggcagagagatgaatttgacctgctggtggccggggagatctgccgcttcagcgccctgattgaggagctggaggagaagaatgaaagacctgcccgggagctgctgacagacatccgcagcaccctcatccgctgtgagaccaggaaatgtaggaagcctgtggccgtgtccccagagctgggccagaggatccgggacttcccccagcaggccctgcccctgcagcgggagatgaagatgttcctggagaacctgcccaaccacctggtgatccccacagcccacatcagcctggacccccagaccagccaccccaagctgctgctgtctgaggaccaccagagggcccagttctcctacaagtggcagaacagcccagacaacccccagagatttgaccgggccacctgtgtgctggcccacacaggcatcactggaggccgccacacctgggtggtgtccattgacctggcccatggaggcagctgcaccgtgggcgtggtgtctgaagatgtgcagaggaaaggagagctgcggctgcggcctgaggagggcgtgtgggccgtgcggctggcctggggctttgtgtctgccctgggcagcttccccacccggctgaccctgaaggagcagccccggcaggtgcgggtgtccctggactatgaggtgggctgggtgaccttcaccaatgctgtgacccgggagcccatctacaccttcaccgccagcttcaccaggaaggtgatccccttcttcggcctgtggggccggggcagcagcttcagcctgagcagctag

SEQ ID NO: 39651 - DNA, 1695 bp, Artificial Sequence
  Description of Artificial Sequence: Synthetic coding sequence
atggccgagctggacctgatggcccctggccccctgccccgggccacagcccagcccccagcccccctgagcccagattctggcagccccagcccagacagcggcagcgccagccctgtggaggaggaggatgtgggcagcagcgagaagctgggccgggagacagaggagcaggacagcgacagcgctgagcagggcgaccctgctggggagggcaaggaggtgctgtgtgacttctgcctggatgacaccaggagagtgaaggctgtgaagagctgcctgacctgcatggtgaactactgtgaggagcacctgcagccccaccaggtgaacatcaagctgcagagccacctgctgacagagcctgtgaaggaccacaactggagatactgcccagcccaccacagccccctgagcgccttctgctgcccagaccagcagtgcatctgccaggactgctgccaggagcacagcggccacaccatcgtgtccctggatgctgcccggcgggacaaggaggccgagctgcagtgcacccagctggacctggagaggaagctgaagctgaatgaaaatgccatcagccggctgcaggccaaccagaagtctgtgctggtgtctgtgtctgaggtgaaggctgtggccgagatgcagtttggagagctgctggccgctgtgaggaaggcccaggccaacgtgatgctgttcctggaggagaaggagcaggccgccctgagccaggccaacggcatcaaggcccacctggagtacagatctgctgagatggagaagagcaagcaggagctggagaggatggccgccatcagcaacacagtgcagttcctggaggagtactgcaagttcaagaacacagaggacatcaccttccccagcgtgtatgtgggcctgaaggacaagctgagcggcatcaggaaggtgatcacagagagcacagtgcacctgatccagctgctggagaactacaagaagaagctgcaggagttcagcaaggaggaggagtatgacatccgcacccaggtgtctgctgtggtgcagaggaagtactggaccagcaagccagagcccagcacccgggagcagttcctgcagtatgcctatgacatcacctttgatcctgacacagcccacaagtacctgcggctgcaggaggagaacaggaaggtgaccaacaccaccccctgggagcacccctacccagacctgcccagccgcttcctgcactggaggcaggtgctgagccagcagagcctgtacctgcaccgctactactttgaggtggagatctttggagctggcacctacgtgggcctgacctgcaagggcatcgacaggaagggggaggagaggaacagctgcatcagcggcaacaacttctcctggagcctgcagtggaatggcaaggagttcaccgcctggtacagcgacatggagacccccctgaaggccggccccttccggcggctgggcgtgtacatcgacttccctgggggcatcctgtccttctatggagtggagtatgacaccatgaccctggtgcacaagtttgcctgcaagttcagcgagcctgtgtatgctgccttctggctgagcaagaaggaaaatgccatcagaattgtggacctgggggaggagcctgagaagccagcccccagcctggtgggcacagccccctag

SEQ ID NO: 39652 - DNA, 1695 bp, Artificial Sequence; identical to SEQ ID NO: 39651
  Description of Artificial Sequence: Synthetic coding sequence

SEQ ID NO: 39653 - DNA, 1425 bp, Artificial Sequence
  Description of Artificial Sequence: Synthetic coding sequence
atggaggccgaggacatccaggaggagctgacctgccccatctgcctggactacttccaggaccctgtgtccattgaatgtggccacaacttctgccggggctgcctgcacaggaactgggcccctgggggcggccccttcccctgcccagaatgtcgccaccccagcgccccagctgccctgcggcccaactgggccctggcccggctgacagagaagacccagaggcggcggctgggccctgtgcccccaggcctgtgtggccgccactgggagcccctgcggctcttctgtgaagatgaccagaggcctgtgtgcctggtgtgccgggagagccaggagcaccagacccacgccatggcccccattgatgaggcctttgagagctaccgggagaagctgctgaagagccagaggaacctggtggccaagatgaagaaggtgatgcacctgcaggatgtggaggtgaagaatgccacccagtggaaggacaagatcaagagccagaggatgaggatcagcacagagttcagcaagctgcacaacttcctggtggaggaggaggacctcttcctgcagaggctgaacaaggaggaggaggagaccaagaagaagctgaatgaaaacaccctgaagctgaaccagaccatcgccagcctgaagaagctgatcctggaggtgggggagaagagccaggcccccaccctggagctgctgcagaaccccaaggaggtgctgaccaggtctgagatccaggatgtgaactacagcctggaggccgtgaaggtgaagacagtgtgccagatccccctgatgaaggagatgctgaagcgcttccaggtggccgtgaacctggccgaggacacagcccaccccaagctggtgttcagccaggagggccgctacgtgaagaacacagccagcgccagctcctggcctgtgttcagcagcgcctggaactactttgctggctggaggaacccccagaagacagcctttgtggagcgcttccagcacctgccctgtgtgctgggcaagaatgtgttcaccagcggcaagcactactgggaggtggagagccgggacagcctggaggtggccgtgggcgtgtgcagagaagatgtgatgggcatcacagacaggagcaagatgagcccagatgtgggcatctgggccatctactggagcgctgctggctactggcccctcatcggcttccctggcacccccacccagcaggagcccgccctgcaccgggtgggcgtgtacctggaccggggcactggaaatgtgtccttctacagcgctgtggatggagtgcacctgcacaccttcagctgcagctctgtgtcccggctgcggcccttcttctggctgagccccctggccagcctggtgatcccccctgtgacagacaggaagtag

SEQ ID NO: 39654 - DNA, 885 bp, Artificial Sequence
  Description of Artificial Sequence: Synthetic coding sequence
atggaggccgaggacatccaggaggagctgacctgccccatctgcctggactacttccaggaccctgtgtccattgaatgtggccacaacttctgccggggctgcctgcacaggaactgggcccctgggggcggccccttcccctgcccagaatgtcgccaccccagcgccccagctgccctgcggcccaactgggccctggcccggctgacagagaagacccagaggcggcggctgggccctgtgcccccaggcctgtgtggccgccactgggagcccctgcggctcttctgtgaagatgaccagaggcctgtgtgcctggtgtgccgggagagccaggagcaccagacccacgccatggcccccattgatgaggcctttgagagctaccgggagaagctgctgaagagccagaggaacctggtggccaagatgaagaaggtgatgcacctgcaggatgtggaggtgaagaatgccacccagtggaaggacaagatcaagagccagaggatgaggatcagcacagagttcagcaagctgcacaacttcctggtggaggaggaggacctcttcctgcagaggctgaacaaggaggaggaggagaccaagaagaagctgaatgaaaacaccctgaagctgaaccagaccatcgccagcctgaagaagctgatcctggaggtgggggagaagagccaggcccccaccctggagctgctgcagaaccccaaggaggtgctgaccaggtctgagatccaggatgtgaactacagcctggaggccgtgaaggtgaagacagtgtgccagatccccctgatgaaggagatgctgaagcgcttccaggccaccaagatcaagacccagaagcagaacagacacaacatgtag

SEQ ID NO: 39655 - DNA, 1503 bp, Artificial Sequence
  Description of Artificial Sequence: Synthetic coding sequence
atggaggccgaggacatccaggaggagctgacctgccccatctgcctggactacttccaggaccctgtgtccattgaatgtggccacaacttctgccggggctgcctgcacaggaactgggcccctgggggcggccccttcccctgcccagaatgtcgccaccccagcgccccagctgccctgcggcccaactgggccctggcccggctgacagagaagacccagaggcggcggctgggccctgtgcccccaggcctgtgtggccgccactgggagcccctgcggctcttctgtgaagatgaccagaggcctgtgtgcctggtgtgccgggagagccaggagcaccagacccacgccatggcccccattgatgaggcctttgagagctacagaacaggcaactttgacatccacgtggatgagtggaagaggaggctcatccggctgctgctgtaccacttcaagcaggaggagaagctgctgaagagccagaggaacctggtggccaagatgaagaaggtgatgcacctgcaggatgtggaggtgaagaatgccacccagtggaaggacaagatcaagagccagaggatgaggatcagcacagagttcagcaagctgcacaacttcctggtggaggaggaggacctcttcctgcagaggctgaacaaggaggaggaggagaccaagaagaagctgaatgaaaacaccctgaagctgaaccagaccatcgccagcctgaagaagctgatcctggaggtgggggagaagagccaggcccccaccctggagctgctgcagaaccccaaggaggtgctgaccaggtctgagatccaggatgtgaactacagcctggaggccgtgaaggtgaagacagtgtgccagatccccctgatgaaggagatgctgaagcgcttccaggtggccgtgaacctggccgaggacacagcccaccccaagctggtgttcagccaggagggccgctacgtgaagaacacagccagcgccagctcctggcctgtgttcagcagcgcctggaactactttgctggctggaggaacccccagaagacagcctttgtggagcgcttccagcacctgccctgtgtgctgggcaagaatgtgttcaccagcggcaagcactactgggaggtggagagccgggacagcctggaggtggccgtgggcgtgtgcagagaagatgtgatgggcatcacagacaggagcaagatgagcccagatgtgggcatctgggccatctactggagcgctgctggctactggcccctcatcggcttccctggcacccccacccagcaggagcccgccctgcaccgggtgggcgtgtacctggaccggggcactggaaatgtgtccttctacagcgctgtggatggagtgcacctgcacaccttcagctgcagctctgtgtcccggctgcggcccttcttctggctgagccccctggccagcctggtgatcccccctgtgacagacaggaagtag

SEQ ID NO: 39656 - DNA, 993 bp, Artificial Sequence
  Description of Artificial Sequence: Synthetic coding sequence
atgaagaaggtgatgcacctgcaggatgtggaggtgaagaatgccacccagtggaaggacaagatcaagagccagaggatgaggatcagcacagagttcagcaagctgcacaacttcctggtggaggaggaggacctcttcctgcagaggctgaacaaggaggaggaggagaccaagaagaagctgaatgaaaacaccctgaagctgaaccagaccatcgccagcctgaagaagctgatcctggaggtgggggagaagagccaggcccccaccctggagctgctgcagaaccccaaggaggtgctgaccaggtctgagatccaggatgtgaactacagcctggaggccgtgaaggtgaagacagtgtgccagatccccctgatgaaggagatgctgaagcgcttccaggtggccgtgaacctggccgaggacacagcccaccccaagctggtgttcagccaggagggccgctacgtgaagaacacagccagcgccagctcctggcctgtgttcagcagcgcctggaactactttgctggctggaggaacccccagaagacagcctttgtggagcgcttccagcacctgccctgtgtgctgggcaagaatgtgttcaccagcggcaagcactactgggaggtggagagccgggacagcctggaggtggccgtgggcgtgtgcagagaagatgtgatgggcatcacagacaggagcaagatgagcccagatgtgggcatctgggccatctactggagcgctgctggctactggcccctcatcggcttccctggcacccccacccagcaggagcccgccctgcaccgggtgggcgtgtacctggaccggggcactggaaatgtgtccttctacagcgctgtggatggagtgcacctgcacaccttcagctgcagctctgtgtcccggctgcggcccttcttctggctgagccccctggccagcctggtgatcccccctgtgacagacaggaagtag

SEQ ID NO: 39657 - DNA, 1212 bp, Artificial Sequence
  Description of Artificial Sequence: Synthetic coding sequence
atgcacaactttgaggaggagctgacctgccccatctgctacagcatctttgaggacccccgggtgctgccctgcagccacaccttctgcaggaactgcctggagaacatcctgcaggccagcggcaacttctacatctggaggcccctgcgcatccccctgaagtgccccaactgccgcagcatcacagaaattgcccccaccggcatcgagagcctgcctgtgaactttgccctgcgggccatcatcgagaagtaccagcaggaggaccacccagacatcgtgacctgcccagagcactaccggcagcccctgaatgtgtactgcctgctggacaagaagctggtgtgtggccactgcctgaccatcggccagcaccacggccaccccattgatgacctgcagagcgcctacctgaaggagaaggacaccccccagaagctgctggagcagctgacagacacccactggacagacctgacccacctgattgagaagctgaaggagcagaagagccacagcgagaagatgatccagggcgacaaggaggccgtgctgcagtacttcaaggagctgaatgacaccctggagcagaagaagaagagcttcctgacagccctgtgtgatgtgggcaacctgatcaaccaggagtacaccccccagatcgagaggatgaaggagatccgggagcagcagctggagctgatggccctgaccatcagcctgcaggaggagagccccctgaagttcctggagaaggtggatgatgtgcggcagcacgtgcagatcctgaagcagaggcccctgcctgaggtgcagcctgtggagatctacccccgggtgtccaagatcctgaaggaggagtggagcaggacagagatcggccagatcaagaatgtgctgatccccaagatgaagatcagccccaagaggatgagctgctcctggccaggcaaggatgagaaggaggtggagttcctgaagatcctgaacatcgtggtggtgaccctcatcagcgtcatcctgatgagcatcctcttcttcaaccagcacatcatcaccttcctgtctgagatcaccctcatctggttcagcgaggccagcctgtctgtgtaccagagcctgagcaacagcctgcacaaggtgaagaacatcctgtgccacatcttctacctgctgaaggagtttgtgtggaagatcgtgagccactag

SEQ ID NO: 39658 - DNA, 345 bp, Artificial Sequence
  Description of Artificial Sequence: Synthetic coding sequence
atgcacaactttgaggaggagctgacctgccccatctgctacagcatctttgaggacccccgggtgctgccctgcagccacaccttctgcaggaactgcctggagaacatcctgcaggccagcggcaacttctacatctggaggcccctgcgcatccccctgaagtgccccaactgccgcagcatcacagaaattgcccccaccggcatcgagagcctgcctgtgaactttgccctgcgggccatcatcgagaagtaccagcaggaggaccacccagacatcgtgacctgcccagagcactaccggcagcccctgaatgtgtactgcctgctggacaagaagtag

SEQ ID NO: 39659 - DNA, 468 bp, Artificial Sequence
  Description of Artificial Sequence: Synthetic coding sequence
atgcacaactttgaggaggagctgacctgccccatctgctacagcatctttgaggacccccgggtgctgccctgcagccacaccttctgcaggaactgcctggagaacatcctgcaggccagcggcaacttctacatctggaggcccctgcgcatccccctgaagtgccccaactgccgcagcatcacagaaattgcccccaccggcatcgagagcctgcctgtgaactttgccctgcgggccatcatcgagaagtaccagcaggaggaccacccagacatcgtgacctgcccagagcactaccggcagcccctgaatgtgtactgcctgctggacaagaagctggtgtgtggccactgcctgaccatcggccagcaccacggccaccccattgatgacctgcagagcgcctacctgaaggagaaggacaccccccagaagctgctggagcagctgacagacacctag

SEQ ID NO: 39660 - DNA, 534 bp, Artificial Sequence
  Description of Artificial Sequence: Synthetic coding sequence
atgcacaactttgaggaggagctgacctgccccatctgctacagcatctttgaggacccccgggtgctgccctgcagccacaccttctgcaggaactgcctggagaacatcctgcaggccagcggcaacttctacatctggaggcccctgcgcatccccctgaagtgccccaactgccgcagcatcacagaaattgcccccaccggcatcgagagcctgcctgtgaactttgccctgcgggccatcatcgagaagtaccagcaggaggaccacccagacatcgtgacctgcccagagcactaccggcagcccctgaatgtgtactgcctgctggacaagaagctggtgtgtggccactgcctgaccatcggccagcaccacggccaccccattgatgacctgcagagcgcctacctgaaggagaaggacaccccccagaagctgctggagcagctgacagacacccactggacagacctgacccacctgattgagaagctgaaggagcagaagagccacagcgagaagatgtag

SEQ ID NO: 39661 - DNA, 336 bp, Artificial Sequence
  Description of Artificial Sequence: Synthetic coding sequence
atgcacaactttgaggaggagctgacctgccccatctgctacagcatctttgaggacccccgggtgctgccctgcagccacaccttctgcaggaactgcctggagaacatcctgcaggccagcggcaacttctacatctggaggcccctgcgcatccccctgaagtgccccaactgccgcagcatcacagaaattgcccccaccggcatcgagagcctgcctgtgaactttgccctgcgggccatcatcgagaagtaccagcaggaggaccacccagacatcgtgacctgcccagagcactaccggcagcccctgaatgtgtactgcctgctgtag

SEQ ID NO: 39662 - DNA, 972 bp, Artificial Sequence
  Description of Artificial Sequence: Synthetic coding sequence
atgcacaactttgaggaggagctgacctgccccatctgctacagcatctttgaggacccccgggtgctgccctgcagccacaccttctgcaggaactgcctggagaacatcctgcaggccagcggcaacttctacatctggaggcccctgcgcatccccctgaagtgccccaactgccgcagcatcacagaaattgcccccaccggcatcgagagcctgcctgtgaactttgccctgcgggccatcatcgagaagtaccagcaggaggaccacccagacatcgtgacctgcccagagcactaccggcagcccctgaatgtgtactgcctgctggacaagaagctggtgtgtggccactgcctgaccatcggccagcaccacggccaccccattgatgacctgcagagcgcctacctgaaggagaaggacaccccccagaagctgctggagcagctgacagacacccactggacagacctgacccacctgattgagaagctgaaggagcagaagagccacagcgagaagatgatccagggcgacaaggaggccgtgctgcagtacttcaaggagctgaatgacaccctggagcagaagaagaagagcttcctgacagccctgtgtgatgtgggcaacctgatcaaccaggagtacaccccccagatcgagaggatgaaggagatccgggagcagcagctggagctgatggccctgaccatcagcctgcaggaggagagccccctgaagttcctggagaaggtggatgatgtgcggcagcacgtgcagatcctgaagcagaggcccctgcctgaggtgcagcctgtggagatctacccccgggtgtccaagatcctgaaggaggagtggagcaggacagagatcggccagatcaagaatgtgctgatccccaagatgaagatcagccccaagaggatgagctgctcctggccagatgagggcacagacaagtag

SEQ ID NO: 39663 - DNA, 1380 bp, Artificial Sequence
  Description of Artificial Sequence: Synthetic coding sequence
atggccggcctgaagagaagagtgcccctgcacagcctgcgctacttcatctccatggtgggcctcttcagcaagccaggcctgctgccctggtacgccaggaaccccccaggctggagccagctgttcctgggcaccgtgtgcaagggggacttcaccagggtcatcgccaccaagtgccagaagggccagaagagccagaagaagcccagccacctgggccccctggatggctcctggcaggagcggctggctgatgtggtgacccccctgtggaggctgtcctatgaggagcagctgaagcctgtgatcaatggctacagaaacaagagcaccttctctgtgaacagaggaccagatggcaaccccaagacagtgggcttctacctgggcacctggagagatggaaatgtggtgtgtgtgcagagcaaccacctgaagaacatccctgagaagcacagccaggtggcccagtactatgaggtgttcctgcggcagagccccctggagccctgcctggtgttccacgagggcggctactggagggagctgactgtgaggaccaacagccagggccacaccatggccatcatcaccttccacccccagaagctgagccaggaggagctgcacgtgcagaaggagatcgtgaaggagttcttcatccggggccctggagctgcctgtggcctgaccagcctgtacttccaggagagcaccatgacccgctgcagccaccagcagagcccctaccagctgctgtttggagagccctacatctttgaggagctgctgagcctgaagatccgcatcagcccagatgccttcttccagatcaacacagctggagctgagatgctgtacagaacagtgggggagctgactggagtgaacagcgacaccatcctgctggacatctgctgcggcaccggggtgattggcctgagcctggcccagcacaccagccgggtgctgggcatcgagctgctggagcaggccgtggaggatgcccgctggacagctgccttcaacggcatcaccaacagcgagttccacacaggccaggccgagaagatcctgcccggcctgctgaagagcaaggaggatggccagagcatcgtggccgtggtgaacccagcccgggccggcctgcactacaaggtgatccaggccatccggaacttccgggccatccacaccctggtgtttgtgtcctgcaagctgcatggagagagcaccagaaatgtgattgagctgtgctgccccccagaccctgccaagaagctgctgggggagccctttgtgctgcagcaggccgtgcctgtggacctcttcccccacaccccccactgtgagctggtgctgctcttcaccaggtag

SEQ ID NO: 39664 - DNA, 1485 bp, Artificial Sequence
  Description of Artificial Sequence: Synthetic coding sequence
atggccggcctgaagagaagagtgcccctgcacagcctgcgctacttcatctccatggtgggcctcttcagcaagccaggcctgctgccctggtacgccaggaaccccccaggctggagccagctgttcctgggcaccgtgtgcaagggggacttcaccagggtcatcgccaccaagtgccagaagggccagaagagccagaagaagcccagccacctgggccccctggatggctcctggcaggagcggctggctgatgtggtgacccccctgtggaggctgtcctatgaggagcagctgaaggtgaagtttgctgcccagaagaagatcctgcagaggctggagagctacatccagatgctgaatggagtgtctgtgaccacagctgtgcccaagtctgagcggctgagctgcctgctgcaccccatcatccccagccctgtgatcaatggctacagaaacaagagcaccttctctgtgaacagaggaccagatggcaaccccaagacagtgggcttctacctgggcacctggagagatggaaatgtggtgtgtgtgcagagcaaccacctgaagaacatccctgagaagcacagccaggtggcccagtactatgaggtgttcctgcggcagagccccctggagccctgcctggtgttccatgaaggaggctactggagggagctgactgtgaggaccaacagccagggccacaccatggccatcatcaccttccacccccagaagctgagccaggaggagctgcacgtgcagaaggagatcgtgaaggagttcttcatccggggccctggggccgcctgtggcctgaccagcctgtacttccaggagagcaccatgacccgctgcagccaccagcagagcccctaccagctgctgtttggagagccctacatctttgaggagctgctgagcctgaagatccgcatcagcccagatgccttcttccagatcaacacagctggagctgagatgctgtacagaacagtgggggagctgactggagtgaacagcgacaccatcctgctggacatctgctgcggcactggagtcatcggcctgagcctggcccagcacaccagccgggtgctgggcatcgagctgctggagcaggccgtggaggatgcccgctggacagctgccttcaacggcatcaccaacagcgagttccacacaggccaggccgagaagatcctgcccggcctgctgaagagcaaagaagatggccagagcatcgtggccgtggtgaacccagcccgggccggcctgcactacaaggtgatccaggccatccggaacttccgggccatccacaccctggtgtttgtgtcctgcaagctgcacggggagagcaccagaaatgtcatcgagaggagcctcatcctgctggagtgcagcggcatggtgtctgcccactacagcctgcacctgcccggcagcagtgacagccctgccagcgccagctag

SEQ ID NO: 39665 - DNA, 1515 bp, Artificial Sequence
  Description of Artificial Sequence: Synthetic coding sequence
atggccggcctgaagagaagagtgcccctgcacagcctgcgctacttcatctccatggtgggcctcttcagcaagccaggcctgctgccctggtacgccaggaaccccccaggctggagccagctgttcctgggcaccgtgtgcaagggggacttcaccagggtcatcgccaccaagtgccagaagggccagaagagccagaagaagcccagccacctgggccccctggatggctcctggcaggagcggctggctgatgtggtgacccccctgtggaggctgtcctatgaggagcagctgaaggtgaagtttgctgcccagaagaagatcctgcagaggctggagagctacatccagatgctgaatggagtgtctgtgaccacagctgtgcccaagtctgagcggctgagctgcctgctgcaccccatcatccccagccctgtgatcaatggctacagaaacaagagcaccttctctgtgaacagaggaccagatggcaaccccaagacagtgggcttctacctgggcacctggagagatggaaatgtggtgtgtgtgcagagcaaccacctgaagaacatccctgagaagcacagccaggtggcccagtactatgaggtgttcctgcggcagagccccctggagccctgcctggtgttccatgaaggaggctactggagggagctgactgtgaggaccaacagccagggccacaccatggccatcatcaccttccacccccagaagctgagccaggaggagctgcacgtgcagaaggagatcgtgaaggagttcttcatccggggccctggggccgcctgtggcctgaccagcctgtacttccaggagagcaccatgacccgctgcagccaccagcagagcccctaccagctgctgtttggagagccctacatctttgaggagctgctgagcctgaagatccgcatcagcccagatgccttcttccagatcaacacagctggagctgagatgctgtacagaacagtgggggagctgactggagtgaacagcgacaccatcctgctggacatctgctgcggcactggagtcatcggcctgagcctggcccagcacaccagccgggtgctgggcatcgagctgctggagcaggccgtggaggatgcccgctggacagctgccttcaacggcatcaccaacagcgagttccacacaggccaggccgagaagatcctgcccggcctgctgaagagcaaagaagatggccagagcatcgtggccgtggtgaacccagcccgggccggcctgcactacaaggtgatccaggccatccggaacttccgggccatccacaccctggtgtttgtgtcctgcaagctgcacggggagagcaccagaaatgtcatcgagctgtgctgccccccagaccctgccaagaagctgctgggggagccctttgtgctgcagcaggccgtgcctgtggacctcttcccccacaccccccactgtgagctggtgctgctcttcaccaggtag

SEQ ID NO: 39666 - DNA, 1515 bp, Artificial Sequence; identical to SEQ ID NO: 39665
  Description of Artificial Sequence: Synthetic coding sequence

SEQ ID NO: 39667 - DNA, 1380 bp, Artificial Sequence; identical to SEQ ID NO: 39663
  Description of Artificial Sequence: Synthetic coding sequence

SEQ ID NO: 39668 - DNA, 1515 bp, Artificial Sequence; identical to SEQ ID NO: 39665
  Description of Artificial Sequence: Synthetic coding sequence

SEQ ID NO: 39669 - DNA, 1542 bp, Artificial Sequence
  Description of Artificial Sequence: Synthetic coding sequence
atgtcctatggcagcatcgcccggggcggcggcctgggcagccggggcccctttggaggccccagccggcagggctgccagcccctggagtgtgcccgctgctggacagaatatggcatccgccacttcccctgccccagccctgagagcaagctgcagaacagatgtgtgggcaaggatggagagggggacctgggccctgctggcacccccatcgtgccccgggccaggaagaggggccctggggtggcccctgagggcagcaggatgcctgagcccaccagcagccccaccatcggccccaggaaggacagcgctgctggcccccacggccgcatggccggccccagcaccacccgggccaagaagaggaagcccaacttctgcccccaggagacagaggtgctggtgtccaaggtgtccaagcaccaccagctgctgtttggcaccggcctgctgaaggccgagcccacccggcgctacagagtgtggagccgcatcctgcaggccgtgaatgccctgggctactgcagaagagatgtggtggacctgaagcacaagtggagggacctgcgggctgtggtgcggaggaagctgggggacctgaggaaggccgcccacggccccagccctggcagcggcaagccccaggccctggccctgacccctgtggagcaggtggtggccaagaccttcagctgccaggccctgcccagcgagggcttcagcctggagcccccccgggccacccaggtggacccctgcaacctgcaggagctgttccaggagatgtctgccaacgtgttccgcatcaacagctctgtgaccagcctggagaggagcctgcagagcctgggcacccccagcgacacccaggagctgcgggacagcctgcacacagcccagcaggagaccaacaagaccatcgccgccagcgccagctctgtgaagcagatggccgagctgctgcggagcagctgcccccaggagcggctgcagcaggagcggccccagctggaccggctgaagacccagctgagtgatgccatccagtgctatggagtggtgcagaagaagattgctgagaagagccgggccctgctgcccatggcccagaggggcagcaagcagagcccccaggccccctttgctgagctggctgatgatgagaaggtgttcaacggcagtgacaacatgtggcagggccaggagcaggccctgctgcctgacatcacagaggaggacctggaggccatccggctgcgggaggaggccatcctgcagatggagagcaacctgctggatgtgaaccagatcatcaaggacctggcctccatggtgtctgagcagggcgaggccgtggacagcattgaggccagcctggaggccgccagcagccacgccgaggccgcccggcagctgctggccggggccagccgccaccagctgcagaggcacaagatcaagtgctgcttcctgtctgctggggtgacagccctgctggtgatcatcatcatcatcgccacctctgtgaggaagtag

SEQ ID NO: 39670 - DNA, 834 bp, Artificial Sequence
  Description of Artificial Sequence: Synthetic coding sequence
atgtcctatggcagcatcgcccggggcggcggcctgggcagccggggcccctttggaggccccagccggcagggctgccagcccctggccacccaggtggacccctgcaacctgcaggagctgttccaggagatgtctgccaacgtgttccgcatcaacagctctgtgaccagcctggagaggagcctgcagagcctgggcacccccagcgacacccaggagctgcgggacagcctgcacacagcccagcaggagaccaacaagaccatcgccgccagcgccagctctgtgaagcagatggccgagctgctgcggagcagctgcccagagcggctgcagcaggagcggccccagctggaccggctgaagacccagctgagtgatgccatccagtgctatggagtggtgcagaagaagattgctgagaagagccgggccctgctgcccatggcccagaggggcagcaagcagcagagcccccaggccccctttgctgagctggctgatgatgagaaggtgttcaatggaagtgacaacatgtggcagggccaggagcaggccctgctgcctgacatcacagaggaggacctggaggccatccggctgcgggaggaggccatcctgcagatggagagcaacctgctggatgtgaaccagatcatcaaggacctggcctccatggtgtctgagcagggcgaggccgtggacagcattgaggccagcctggaggccgccagcagccatgctgaggccgcccggcagctgctggccggggccagccgccaccagctgatgaggaggacccggcccccagctgcctgtggctgcccctag

SEQ ID NO: 39671 - DNA, 1542 bp, Artificial Sequence
  Description of Artificial Sequence: Synthetic coding sequence
atgtcctatggcagcatcgcccggggcggcggcctgggcagccggggcccctttggaggccccagccggcagggctgccagcccctggagtgtgcccgctgctggacagaatatggcatccgccacttcccctgccccagccctgagagcaagctgcagaacagatgtgtgggcaaggatggagagggggacctgggccctgctggcacccccatcgtgccccgggccaggaagaggggccctggggtggcccctgagggcagcaggatgcctgagcccaccagcagccccaccatcggccccaggaaggacagcgctgctggcccccacggccgcatggccggccccagcaccacccgggccaagaagaggaagcccaacttctgcccccaggagacagaggtgctggtgtccaaggtgtccaagcaccaccagctgctgtttggcaccggcctgctgaaggccgagcccacccggcgctacagagtgtggagccgcatcctgcaggccgtgaatgccctgggctactgcagaagagatgtggtggacctgaagcacaagtggagggacctgcgggctgtggtgcggaggaagctgggggacctgaggaaggccgcccacggccccagccctggcagcggcaagccccaggccctggccctgacccctgtggagcaggtggtggccaagaccttcagctgccaggccctgcccagcgagggcttcagcctggagcccccccgggccacccaggtggacccctgcaacctgcaggagctgttccaggagatgtctgccaacgtgttccgcatcaacagctctgtgaccagcctggagaggagcctgcagagcctgggcacccccagcgacacccaggagctgcgggacagcctgcacacagcccagcaggagaccaacaagaccatcgccgccagcgccagctctgtgaagcagatggccgagctgctgcggagcagctgcccagagcggctgcagcaggagcggccccagctggaccggctgaagacccagctgagtgatgccatccagtgctacggcgtggtgcagaagaagattgctgagaagagccgggccctgctgcccatggcccagaggggcagcaagcagcagagcccccaggccccctttgctgagctggctgatgatgagaaggtgttcaacggcagtgacaacatgtggcagggccaggagcaggccctgctgcctgacatcacagaggaggacctggaggccatccggctgcgggaggaggccatcctgcagatggagagcaacctgctggatgtgaaccagatcatcaaggacctggcctccatggtgtctgagcagggcgaggccgtggacagcattgaggccagcctggaggccgccagcagccacgccgaggccgcccggcagctgctggccggggccagccgccaccagctgcagaggcacaagatcaagtgctgcttcctgtctgctggggtgacagccctgctggtgatcatcatcatcatcgccacctctgtgaggaagtag

SEQ ID NO: 39672 - DNA, 453 bp, Artificial Sequence
  Description of Artificial Sequence: Synthetic coding sequence
atgtcctatggcagcatcgcccggggcggcggcctgggcagccggggcccctttggaggccccagccggcagggctgccagcccctggagtgtgcccgctgctggacagaatatggcatccgccacttcccctgccccagccctgagagcaagctgcagaacagatgtgtgggcaaggatggagagggggacctgggccctgctggcacccccatcgtgccccgggccaggaagaggggccctggggtggcccctgagggcagcaggatgcctgagcccaccagcagccccaccatcggccccaggaaggacagcgctgctggcccccacggccgcatggccggccccagcaccacccgggccaagaagaggaagcccaacttctgcccccaggagacagaggtgctggtgtccaaggtgtccaagcaccaccagctgctgtttggcacctag

SEQ ID NO: 39673 - DNA, 1539 bp, Artificial Sequence
  Description of Artificial Sequence: Synthetic coding sequence
atgtcctatggcagcatcgcccggggcggcggcctgggcagccggggcccctttggaggccccagccggcagggctgccagcccctggagtgtgcccgctgctggacagaatatggcatccgccacttcccctgccccagccctgagagcaagctgcagaacagatgtgtgggcaaggatggagagggggacctgggccctgctggcacccccatcgtgccccgggccaggaagaggggccctggggtggcccctgagggcagcaggatgcctgagcccaccagcagccccaccatcggccccaggaaggacagcgctgctggcccccacggccgcatggccggccccagcaccacccgggccaagaagaggaagcccaacttctgcccccaggagacagaggtgctggtgtccaaggtgtccaagcaccaccagctgctgtttggcaccggcctgctgaaggccgagcccacccggcgctacagagtgtggagccgcatcctgcaggccgtgaatgccctgggctactgcagaagagatgtggtggacctgaagcacaagtggagggacctgcgggctgtggtgcggaggaagctgggggacctgaggaaggccgcccacggccccagccctggcagcggcaagccccaggccctggccctgacccctgtggagcaggtggtggccaagaccttcagctgccaggccctgcccagcgagggcttcagcctggagcccccccgggccacccaggtggacccctgcaacctgcaggagctgttccaggagatgtctgccaacgtgttccgcatcaacagctctgtgaccagcctggagaggagcctgcagagcctgggcacccccagcgacacccaggagctgcgggacagcctgcacacagcccagcaggagaccaacaagaccatcgccgccagcgccagctctgtgaagcagatggccgagctgctgcggagcagctgcccagagcggctgcagcaggagcggccccagctggaccggctgaagacccagctgagtgatgccatccagtgctacggcgtggtgcagaagaagattgctgagaagagccgggccctgctgcccatggcccagaggggcagcaagcagagcccccaggccccctttgctgagctggctgatgatgagaaggtgttcaatggaagtgacaacatgtggcagggccaggagcaggccctgctgcctgacatcacagaggaggacctggaggccatccggctgcgggaggaggccatcctgcagatggagagcaacctgctggatgtgaaccagatcatcaaggacctggcctccatggtgtctgagcagggcgaggccgtggacagcattgaggccagcctggaggccgccagcagccatgctgaggccgcccggcagctgctggccggggccagccgccaccagctgcagaggcacaagatcaagtgctgcttcctgtctgctggggtgacagccctgctggtgatcatcatcatcatcgccacctctgtgaggaagtag

SEQ ID NO: 39674 - DNA, 1686 bp, Artificial Sequence
  Description of Artificial Sequence: Synthetic coding sequence
atgagcacagagaggacctcctggaccagcctgagcaccatccagaagatcgccctgggcctgggcatcccagccagcgccaccgtggcctacatcctgtaccgccgctaccgggagagccgggaggagcggctgacctttgtgggggaggatgacattgaaattgagatgagggtgccccaggaggccgtgaagctgatcatcggccggcagggcgccaacatcaagcagctgaggaagcagacaggagccagaattgatgtggacacagaagatgtgggagatgagcgggtgctgctgatcagcggcttccctgtgcaggtgtgcaaggccaaggccgccatccaccagatcctgacagagaacacccctgtgtctgagcagctgtctgtgccccagaggtctgtgggccgcatcatcggccggggcggggagaccatccgcagcatctgcaaggccagcggggccaagatcacctgtgacaaggagagcgagggcaccctgctgctgagccgcctcatcaagatcagcggcacccagaaggaggtggccgccgccaagcacctgatcctggagaaggtgtctgaagatgaggagctgaggaagagaattgcccacagcgctgagaccagggtgcccaggaagcagcccatctctgtgagaagagaggacatgacagagcccggcggggccggggagcccgccctgtggaagaacaccagcagctccatggagcccacagcccccctggtgaccccaccacccaagggcggcggggacatggctgtggtggtgtccaaggagggctcctgggagaagcccagtgatgacagcttccagaagtctgaggcccaggccatccctgagatgcccatgtttgagatccccagcccagacttctccttccacgcagatgagtacctggaggtgtatgtgtctgccagcgagcaccccaaccacttctggatccagatcgtgggcagccgcagcctgcagctggacaagctggtgaatgagatgacccagcactatgaaaattctgtgcctgaggacctgactgtgcacgtgggggacatcgtggccgcccccctgcccaccaacggctcctggtaccgggcccgggtgctgggcaccctggagaatggaaacctggacctgtactttgtggactttggagacaacggggactgccccctgaaggacctgcgggccctgcggagtgacttcctgagcctgcccttccaggccatcgagtgcagcctggcccgcatcgcccccagcggggaccagtgggaggaggaggccctggatgaatttgaccggctgacccactgtgccgactggaagcccctggtggccaagatcagcagctatgtgcagacaggcatcagcacctggcccaagatctacctgtatgacaccagcaatggcaagaagctggacatcggcctggagctggtgcacaagggctacgccatcgagctgcctgaagatattgaagaaaatagagctgtgcctgacatgctgaaggacatggccacagaaacagatgccagcctgagcaccctgctgacagagaccaagaagagcagtggagagatcacccacaccctgagctgcctgagcctgtctgaggccgcctccatgtctggagatgacaacctggaggatgactacctgctgtag

SEQ ID NO: 39675 - DNA, 1674 bp, Artificial Sequence
  Description of Artificial Sequence: Synthetic coding sequence
atgagcacagagaggacctcctggaccagcctgagcaccatccagaagatcgccctgggcctgggcatcccagccagcgccaccgtggcctacatcctgtaccgccgctaccgggagagccgggaggagcggctgacctttgtgggggaggatgacattgaaattgagatgagggtgccccaggaggccgtgaagctgatcatcggccggcagggcgccaacatcaagcagacaggagccagaattgatgtggacacagaagatgtgggagatgagcgggtgctgctgatcagcggcttccctgtgcaggtgtgcaaggccaaggccgccatccaccagatcctgacagagaacacccctgtgtctgagcagctgtctgtgccccagaggtctgtgggccgcatcatcggccggggcggggagaccatccgcagcatctgcaaggccagcggggccaagatcacctgtgacaaggagagcgagggcaccctgctgctgagccgcctcatcaagatcagcggcacccagaaggaggtggccgccgccaagcacctgatcctggagaaggtgtctgaagatgaggagctgaggaagagaattgcccacagcgctgagaccagggtgcccaggaagcagcccatctctgtgagaagagaggacatgacagagcccggcggggccggggagcccgccctgtggaagaacaccagcagctccatggagcccacagcccccctggtgaccccaccacccaagggcggcggggacatggctgtggtggtgtccaaggagggctcctgggagaagcccagtgatgacagcttccagaagtctgaggcccaggccatccctgagatgcccatgtttgagatccccagcccagacttctccttccacgcagatgagtacctggaggtgtatgtgtctgccagcgagcaccccaaccacttctggatccagatcgtgggcagccgcagcctgcagctggacaagctggtgaatgagatgacccagcactatgaaaattctgtgcctgaggacctgactgtgcacgtgggggacatcgtggccgcccccctgcccaccaacggctcctggtaccgggcccgggtgctgggcaccctggagaatggaaacctggacctgtactttgtggactttggagacaacggggactgccccctgaaggacctgcgggccctgcggagtgacttcctgagcctgcccttccaggccatcgagtgcagcctggcccgcatcgcccccagcggggaccagtgggaggaggaggccctggatgaatttgaccggctgacccactgtgccgactggaagcccctggtggccaagatcagcagctatgtgcagacaggcatcagcacctggcccaagatctacctgtatgacaccagcaatggcaagaagctggacatcggcctggagctggtgcacaagggctacgccatcgagctgcctgaagatattgaagaaaatagagctgtgcctgacatgctgaaggacatggccacagaaacagatgccagcctgagcaccctgctgacagagaccaagaagagcagtggagagatcacccacaccctgagctgcctgagcctgtctgaggccgcctccatgtctggagatgacaacctggaggatgactacctgctgtag

SEQ ID NO: 39676 - DNA, 1686 bp, Artificial Sequence; identical to SEQ ID NO: 39674
  Description of Artificial Sequence: Synthetic coding sequence

SEQ ID NO: 39677 - DNA, 1551 bp, Artificial Sequence
  Description of Artificial Sequence: Synthetic coding sequence
atgagcacagagaggacctcctggaccagcctgagcaccatccagaagatcgccctgggcctgggcatcccagccagcgccaccgtggcctacatcctgtaccgccgctaccgggagagccgggaggagcggctgacctttgtgggggaggatgacattgaaattgagatgagggtgccccaggaggccgtgaagctgatcatcggccggcagggcgccaacatcaagcagctgaggaagcagacaggagccagaattgatgtggacacagaagatgtgggagatgagcgggtgctgctgatcagcggcttccctgtgcaggccagcggggccaagatcacctgtgacaaggagagcgagggcaccctgctgctgagccgcctcatcaagatcagcggcacccagaaggaggtggccgccgccaagcacctgatcctggagaaggtgtctgaagatgaggagctgaggaagagaattgcccacagcgctgagaccagggtgcccaggaagcagcccatctctgtgcggcgggaggacatgacagagcctggaggagctggggagcccgccctgtggaagaacaccagcagctccatggagcccacagcccccctggtgaccccaccacccaagggcggcggggacatggctgtggtggtgtccaaggagggctcctgggagaagcccagtgatgacagcttccagaagtctgaggcccaggccatccctgagatgcccatgtttgagatccccagcccagacttctccttccacgcagatgagtacctggaggtgtatgtgtctgccagcgagcaccccaaccacttctggatccagatcgtgggcagccgcagcctgcagctggacaagctggtgaatgagatgacccagcactatgagaacagcgtgcctgaggacctgactgtgcacgtgggggacatcgtggccgcccccctgcccaccaacggctcctggtaccgggcccgggtgctgggcaccctggagaatggaaacctggacctgtactttgtggactttggagacaatggagactgccccctgaaggacctgcgggccctgcggagtgacttcctgagcctgcccttccaggccattgaatgttccctggccagaattgcccccagcggggaccagtgggaggaggaggccctggatgaatttgaccggctgacccactgtgccgactggaagcccctggtggccaagatcagcagctatgtgcagacaggcatcagcacctggcccaagatctacctgtatgacaccagcaatggcaagaagctggacatcggcctggagctggtgcacaagggctacgccatcgagctgcctgaggacatcgaggagaacagagctgtgcctgacatgctgaaggacatggccacagaaacagatgccagcctgagcaccctgctgacagagaccaagaagagcagcggggagatcacccacaccctgagctgcctgagcctgtctgaggccgcctccatgtctggagatgacaacctggaggatgactacctgctgtag

SEQ ID NO: 39678 - DNA, 1686 bp, Artificial Sequence; identical to SEQ ID NO: 39674
  Description of Artificial Sequence: Synthetic coding sequence

SEQ ID NO: 39679 - DNA, 1014 bp, Artificial Sequence
  Description of Artificial Sequence: Synthetic coding sequence
atgacagagcccggcggggccggggagcccgccctgtggaagaacaccagcagctccatggagcccacagcccccctggtgaccccaccacccaagggcggcggggacatggctgtggtggtgtccaaggagggctcctgggagaagcccagtgatgacagcttccagaagtctgaggcccaggccatccctgagatgcccatgtttgagatccccagcccagacttctccttccacgcagatgagtacctggaggtgtatgtgtctgccagcgagcaccccaaccacttctggatccagatcgtgggcagccgcagcctgcagctggacaagctggtgaatgagatgacccagcactatgaaaattctgtgcctgaggacctgactgtgcacgtgggggacatcgtggccgcccccctgcccaccaacggctcctggtaccgggcccgggtgctgggcaccctggagaatggaaacctggacctgtactttgtggactttggagacaacggggactgccccctgaaggacctgcgggccctgcggagtgacttcctgagcctgcccttccaggccatcgagtgcagcctggcccgcatcgcccccagcggggaccagtgggaggaggaggccctggatgaatttgaccggctgacccactgtgccgactggaagcccctggtggccaagatcagcagctatgtgcagacaggcatcagcacctggcccaagatctacctgtatgacaccagcaatggcaagaagctggacatcggcctggagctggtgcacaagggctacgccatcgagctgcctgaagatattgaagaaaatagagctgtgcctgacatgctgaaggacatggccacagaaacagatgccagcctgagcaccctgctgacagagaccaagaagagcagtggagagatcacccacaccctgagctgcctgagcctgtctgaggccgcctccatgtctggagatgacaacctggaggatgactacctgctgtag

SEQ ID NO: 39680 - DNA, 1686 bp, Artificial Sequence; identical to SEQ ID NO: 39674
  Description of Artificial Sequence: Synthetic coding sequence

SEQ ID NO: 39681 - DNA, 396 bp, Artificial Sequence
  Description of Artificial Sequence: Synthetic coding sequence
atgagcacagagaggacctcctggaccagcctgagcaccatccagaagatcgccctgggcctgggcatcccagccagcgccaccgtggcctacatcctgtaccgccgctaccgggagagccgggaggagcggctgacctttgtgggggaggatgacattgaaattgagatgagggtgccccaggaggccgtgaagctgatcatcggccggcagggcgccaacatcaagcagctgaggaagcagacaggagccagaattgatgtggacacagaagatgtgggagatgagcgggtgctgctgatcagcggcttccctgtgcaggtgtgcaaggccaaggccgccatccaccagatcctgacagagaacacccctgtgtctgagcagctgtctgtgtag

SEQ ID NO: 39682 - DNA, 1254 bp, Artificial Sequence
  Description of Artificial Sequence: Synthetic coding sequence
atggccctgaaggtgctgctggagcaggagaagaccttcttcaccctgctggtgctgctgggctacctgagctgcaaggtgacctgtgagagcggggactgccggcagcaggagttccgggacagaagtggcaactgtgtgccctgcaaccagtgtggccctggcatggagctgagcaaagaatgtggcttcggctacggggaggatgcccagtgtgtgacctgccgcctgcaccgcttcaaggaggactggggcttccagaagtgcaagccctgcctggactgtgctgtggtgaaccgcttccagaaggccaactgcagcgccaccagtgatgccatctgtggggactgcctgcccggcttctacaggaagaccaagctggtgggcttccaggacatggagtgtgtgccctgtggggaccccccaccaccctatgagccccactgtgccagcaaggtgaacctggtgaagatcgccagcacagccagcagcccccgggacacagccctggccgccgtcatctgcagcgccctggccaccgtgctgctggccctgctgatcctgtgtgtgatctactgcaagaggcagttcatggagaagaagcccagctggagcctgcggagccaggacatccagtacaacggcagcgagctgagctgctttgaccggccccagctgcatgaatatgcccaccgggcctgctgccagtgccggcgggacagcgtgcagacctgtggccctgtgcggctgctgcccagcatgtgctgtgaggaggcctgcagccccaacccagccaccctgggctgcggcgtgcacagcgctgccagcctgcaggccagaaatgccggccctgctggggagatggtgcccaccttcttcggcagcctgacccagagcatctgtggggagttcagtgatgcctggcccctgatgcagaaccccatgggcggggacaacatctccttctgtgacagctacccagagctgaccggggaggacatccacagcctgaaccctgagctggagagcagcaccagcctggacagcaacagcagccaggacctggtgggcggcgctgtgcctgtgcagagccacagcgagaacttcaccgctgccacagacctgagccgctacaacaacaccctggtggagagcgccagcacccaggatgccctgaccatgaggagccagctggaccaggagagcggggccgtcatccacccagccacccagaccagcctgcaggaggcctag

SEQ ID NO: 39683 - DNA, 1272 bp, Artificial Sequence
  Description of Artificial Sequence: Synthetic coding sequence
atggccctgaaggtgctgctggagcaggagaagaccttcttcaccctgctggtgctgctgggctacctgagctgcaaggtgacctgtgagagcggggactgccggcagcaggagttccgggacagaagtggcaactgtgtgccctgcaaccagtgtggccctggcatggagctgagcaaagaatgtggcttcggctacggggaggatgcccagtgtgtgacctgccgcctgcaccgcttcaaggaggactggggcttccagaagtgcaagccctgcctggactgtgctgtggtgaaccgcttccagaaggccaactgcagcgccaccagtgatgccatctgtggggactgcctgcccggcttctacaggaagaccaagctggtgggcttccaggacatggagtgtgtgccctgtggggaccccccaccaccctatgagccccactgtgccagcaaggtgaacctggtgaagatcgccagcacagccagcagcccccgggacacagccctggccgccgtcatctgcagcgccctggccaccgtgctgctggccctgctgatcctgtgtgtgatctactgcaagaggcagttcatggagaagaagcccagctggagcctgcggagccaggacatccagtacaacggcagcgagctgagctgctttgaccggccccagctgcatgaatatgcccaccgggcctgctgccagtgccggcgggacagcgtgcagacctgtggccctgtgcggctgctgcccagcatgtgctgtgaggaggcctgcagccccaacccagccaccctgggctgcggcgtgcacagcgctgccagcctgcaggccagaaatgccggccctgctggggagatggtgcccaccttcttcggcagcctgacccagagcatctgtggggagttcagtgatgcctggcccctgatgcagaaccccatgggcggggacaacatctccttctgtgacagctacccagagctgaccggggaggacatccacagcctgaaccctgagctggagagcagcaccagcctggacagcaacagcagccaggacctggtgggcggcgctgtgcctgtgcagagccacagcgagaacttcaccgctgccacagacctgagccgctacaacaacaccctggtggagagcgccagcacccaggatgccctgaccatgaggagccagctggaccaggagagcggggccgtcatccacccagccacccagaccagcctgcaggtgcggcagaggctgggcagcctgtag

SEQ ID NO: 39684 - DNA, 1254 bp, Artificial Sequence; identical to SEQ ID NO: 39682
  Description of Artificial Sequence: Synthetic coding sequence

SEQ ID NO: 39685 - DNA, 858 bp, Artificial Sequence
  Description of Artificial Sequence: Synthetic coding sequence
atggagtgtgtgccctgtggggaccccccaccaccctatgagccccactgtgccagcaaggtgaacctggtgaagatcgccagcacagccagcagcccccgggacacagccctggccgccgtcatctgcagcgccctggccaccgtgctgctggccctgctgatcctgtgtgtgatctactgcaagaggcagttcatggagaagaagcccagctggagcctgcggagccaggacatccagtacaacggcagcgagctgagctgctttgaccggccccagctgcatgaatatgcccaccgggcctgctgccagtgccggcgggacagcgtgcagacctgtggccctgtgcggctgctgcccagcatgtgctgtgaggaggcctgcagccccaacccagccaccctgggctgcggcgtgcacagcgctgccagcctgcaggccagaaatgccggccctgctggggagatggtgcccaccttcttcggcagcctgacccagagcatctgtggggagttcagtgatgcctggcccctgatgcagaaccccatgggcggggacaacatctccttctgtgacagctacccagagctgaccggggaggacatccacagcctgaaccctgagctggagagcagcaccagcctggacagcaacagcagccaggacctggtgggcggcgctgtgcctgtgcagagccacagcgagaacttcaccgctgccacagacctgagccgctacaacaacaccctggtggagagcgccagcacccaggatgccctgaccatgaggagccagctggaccaggagagcggggccgtcatccacccagccacccagaccagcctgcaggaggcctag

SEQ ID NO: 39686 - DNA, 570 bp, Artificial Sequence
  Description of Artificial Sequence: Synthetic coding sequence
atggccgccaagcagcccccacccctgatgaagaagcacagccagacagacctggtgtcccggctgaagaccaggaagatcctgggcgtgggcggagaagatgatgatggagaggtgcacaggagcaagatcagccaggtgctgggcaatgagatcaagttcaccatccgggagcccctgggcctgcgggtgtggcagtttgtgtctgctgtgctcttcagcggcatcgccatcatggccctggccttcccagaccagctgtatgatgctgtgtttgatggagcccaggtgaccagcaagacccccatccggctgtatggaggagccctgctgagcatcagcctcatcatgtggaatgccctgtacacagctgagaaggtgatcatccgctggaccctgctgacagaggcctgctactttggagtgcagttcctggtggtgacagccaccctggccgagaccggcctgatgagcctgggcatcctgctgctgctggtgtcccggctgctgtttgtggtgatcagcatctactactactaccaggtgggccggcggcccaagaaggcctag

SEQ ID NO: 39687 - DNA, 411 bp, Artificial Sequence
  Description of Artificial Sequence: Synthetic coding sequence
atgaccaccggccgctgcatcgccccccgggtgtggcagtttgtgtctgctgtgctcttctctggaattgccatcatggccctggccttcccagaccagctgtatgatgctgtgtttgatggagcccaggtgaccagcaagacccccatccggctgtatggaggagccctgctgagcatcagcctcatcatgtggaatgccctgtacacagctgagaaggtgatcatccgctggaccctgctgacagaggcctgctactttggagtgcagttcctggtggtgacagccaccctggccgagaccggcctgatgagcctgggcatcctgctgctgctggtgtcccggctgctgtttgtggtgatcagcatctactactactaccaggtgggcagaagacccaagaaggcctag

SEQ ID NO: 39688 - DNA, 570 bp, Artificial Sequence; identical to SEQ ID NO: 39686
  Description of Artificial Sequence: Synthetic coding sequence

SEQ ID NO: 39689 - DNA, 570 bp, Artificial Sequence; identical to SEQ ID NO: 39686
  Description of Artificial Sequence: Synthetic coding sequence

SEQ ID NO: 39690 - DNA, 297 bp, Artificial Sequence
  Description of Artificial Sequence: Synthetic coding sequence
atggccgccaagcagcccccacccctgatgaagaagcacagccagacagacctggtgtcccggctgaagaccaggaagatcctgggcgtgggcggagaagatgatgatggagaggtgcacaggagcaagatcagccaggtgctgggcaatgagatcaagttcaccatccgggagcccctgggcctgcgggtgtggcagtttgtgtctgctgtgctcttcagcggcatcgccatcatggccctggccttcccagaccagctgtatgatgctgtgtttgatggagcccaggtgacctag

SEQ ID NO: 39691 - DNA, 222 bp, Artificial Sequence
  Description of Artificial Sequence: Synthetic coding sequence
atggccgccaagcagcccccacccctgatgaagaagcacagccagacagacctggtgtcccggctgaagaccaggaagatcctgggcgtgggcggagaagatgatgatggagaggtgcacaggagcaagatcagccaggtgctgggcaatgagatcaagttcaccatccgggagcccctgggcctgcgggtgtggcagtttgtgtctgctgtgctcttctag

SEQ ID NO: 39692 - DNA, 477 bp, Artificial Sequence
  Description of Artificial Sequence: Synthetic coding sequence
atggccgccaagcagcccccacccctgatgaagaagcacagccagacagacctggtgtcccggctgaagaccaggaagatcctgggcgtgggcggagaagatgatgatggagaggtgcacaggagcaagatcagccaggtgctgggcaatgagatcaagttcaccatccgggagcccctgggcctgcgggtgtggcagtttgtgtctgctgtgctcttcagcggcatcgccatcatggccctggccttcccagaccagctgtatgatgctgtgtttgatggagcccaggtgaccagcaagacccccatccggctgtatggaggagccctgctgagcatcagcctcatcatgtggaatgccctgtacacagctgagaaggtgatcatccgctggaccctgctgacagaggcctgctactttggagtgcagttcctggtggtgacagccaccctggccgagaccggcctgatgtcctag

SEQ ID NO: 39693 - DNA, 240 bp, Artificial Sequence
  Description of Artificial Sequence: Synthetic coding sequence
atggccgccaagcagcccccacccctgatgaagaagcacagccagacagacctggtgtcccggctgaagaccaggaagatcctgggcgtgggcggagaagatgatgatggagaggtgcacaggagcaagatcagccaggtgctgggcaatgagatcaagttcaccatccgggagcccctgggcctgcgggtgtggcagtttgtgtctgctgtgctcttcagcggcatcgccatcatgtag

SEQ ID NO: 39694 - DNA, 282 bp, Artificial Sequence
  Description of Artificial Sequence: Synthetic coding sequence
atggccgccaagcagcccccacccctgatgaagaagcacagccagacagacctggtgtcccggctgaagaccaggaagatcctgggcgtgggcggagaagatgatgatggagaggtgcacaggagcaagatcagccaggtgctgggcaatgagatcaagttcaccatccgggagcccctgggcctgcgggtgtggcagtttgtgtctgctgtgctcttcagcggcatcgccatcatggccctggccttcccagaccagctgtatgatgctgtgtttgattag

SEQ ID NO: 39695 - DNA, 189 bp, Artificial Sequence
  Description of Artificial Sequence: Synthetic coding sequence
atggccgccaagcagcccccacccctgatgaagaagcacagccagacagacctggtgtcccggctgaagaccaggaagatcctgggcgtgggcggagaagatgatgatggagaggtgcacaggagcaagatcagccaggtgctgggcaatgagatcaagttcaccatccgggagcccctgggcctgtag

SEQ ID NO: 39696 - DNA, 570 bp, Artificial Sequence; identical to SEQ ID NO: 39686
  Description of Artificial Sequence: Synthetic coding sequence

SEQ ID NO: 39697 - DNA, 1182 bp, Artificial Sequence
  Description of Artificial Sequence: Synthetic coding sequence
atggcccctcctccacccagcccccagctgctgctgctggccgccctggcccggctgctgggccccagcgaggtgatggccggccctgctgaggaggccggggcccactgcccagagagcctgtggcccctgcccccccaggtgagcccccgggtgacctacaccagggtgtccccaggccaggctgaagatgtgaccttcctgtaccacccctgtgcccacccctggctgaagctgcagctggccctgctggcctatgcctgcatggccaaccccagcctgaccccagacttcagcctgacccaggaccggcccctggtgctgacagcctggggcctggccctggagatggcctgggtggagcccgcctgggccgcccactggctgatgagaagaagaagaaggaagcagaggaagaagaaggcctggatctactgtgagagcctgagcggccctgcccccagcgagcccaccccaggccggggccgcctgtgccggcggggctgtgtgcaggccctggccctggcctttgccctgcgctcctggaggcctcctggaacagaggtgaccagccagggcccccggcagcccagcagcagcggggccaagagaagaaggctgcgggccgccctgggcccccagcccaccaggtctgccctgcgcttccccagcgccagccctggcagcctgaaggccaagcagagcatggccggcatccctggccgggagagcaatgcccccagcgtgcccaccgtgtccctgctgcccggggcccctggaggaaatgccagcagcaggacagaggcccaggtgcccaacggccagggcagccctgggggctgtgtgtgcagcagccaggccagccctgcccccagggctgctgccccacccagggctgcccggggccccacccccaggacagaggaggccgcctgggccgccatggccctgaccttcctgctggtgctgctgaccctggccaccctgtgcacccggctgcacaggaacttccggcggggggagagcatctactggggccccacagctgacagccaggacacagtggccgctgtgctgaagaggcggctgctgcagcccagccggcgggtgaagaggagcagaagaagacccctgctgccccccaccccagattctggccctgagggggagagcagcgagtag

SEQ ID NO: 39698 - DNA, 414 bp, Artificial Sequence
  Description of Artificial Sequence: Synthetic coding sequence
gccaagcagagcatggccggcatccctggccgggagagcaatgcccccagcgtgcccaccgtgtccctgctgcccggggcccctggaggaaatgccagcagcaggacagaggcccaggtgcccaacggccagggcccccggggcctgtgcctcttcaagagcggcttccctggccccagccgcagcagcccccgggccgcccggggccccacccccaggacagaggaggccgcctgggccgccatggccctgaccttcctgctggtgctgctgaccctggccaccctgtgcacccggctgcacaggaacttcagaagaggagagagcatctactggggccccacagctgacagccaggacaccaccccacctccagcccatgattctggccctgagggggagagcagcgagtag

SEQ ID NO: 39699 - DNA, 1605 bp, Artificial Sequence
  Description of Artificial Sequence: Synthetic coding sequence
atgcaggccgcccgggtggactacatcgccccctggtgggtggtgtggctgcacagcgtgccccacgtgggcctgcggctgcagcctgtgaacagcaccttcagccctggagatgagagctaccaggagagcctgctcttcctgggcctggtggccgctgtgtgcctgggcctgaacctgatcttcctggtggcctacctggtgtgtgcctgccactgcagaagagatgatgctgtgcagaccaagcagcaccacagctgctgcatcacctggacagctgtggtggccggcctcatctgctgtgccgctgtgggcgtgggcttctacggcaacagcgagaccaatgatggagcctaccagctgatgtacagcctggatgatgccaaccacaccttctctggaattgatgccctggtgtctggcaccacccagaagatgaaggtggacctggagcagcacctggcccggctgtctgagatctttgctgcccggggggactacctgcagaccctgaagttcatccagcagatggccggctctgtggtggtgcagctgagcggcctgcctgtgtggagggaggtgaccatggagctgaccaagctgagtgaccagacaggctacgtggagtactaccgctggctgagctacctgctgctcttcatcctggacctggtgatctgcctgattgcctgcctgggcctggccaagaggagcaagtgcctgctggcctccatgctgtgctgcggggccctgagcctgctgctgtcctgggccagcctggccgcagatggcagcgctgctgtggccaccagtgacttctgtgtggccccagacaccttcatcctgaatgtgacagagggccagatcagcacagaggtgacccgctactacctgtactgcagccagagcggcagcagccccttccagcagaccctgaccaccttccagagggccctgaccaccatgcagatccaggtggccggcctgctgcagtttgctgtgcccctcttcagcacagctgaggaggacctgctggccatccagctgctgctgaacagcagcgagagcagcctgcaccagctgacagccatggtggactgccggggcctgcacaaggactacctggatgccctggccggcatctgctatgatggcctgcagggcctgctgtacctgggcctcttctccttcctggccgccctggccttcagcaccatgatctgtgccggcccccgggcctggaagcacttcaccaccaggaacagagattatgatgacattgatgatgatgaccccttcaacccccaggcctggaggatggccgcccacagccccccccggggccagctgcacagcttctgcagctacagcagcggcctgggcagccagaccagcctgcagcccccagcccagaccatcagcaatgcccctgtgtctgagtacatgaaccaggccatgctgtttggaagaaaccccaggtatgaaaatgtgcccctcatcggccgggccagccccccacccacctacagccccagcatgagggccacctacctgtctgtggctgatgagcacctgcggcactacggcaaccagtttcctgcctag

SEQ ID NO: 39700 - DNA, 642 bp, Artificial Sequence
  Description of Artificial Sequence: Synthetic coding sequence
atgcagatccaggtggccggcctgctgcagtttgctgtgcccctcttcagcacagctgaggaggacctgctggccatccagctgctgctgaacagcagcgagagcagcctgcaccagctgacagccatggtggactgccggggcctgcacaaggactacctggatgccctggccggcatctgctatgatggcctgcagggcctgctgtacctgggcctcttctccttcctggccgccctggccttcagcaccatgatctgtgccggcccccgggcctggaagcacttcaccaccaggaacagagattatgatgacattgatgatgatgaccccttcaacccccaggcctggaggatggccgcccacagccccccccggggccagctgcacagcttctgcagctacagcagcggcctgggcagccagaccagcctgcagcccccagcccagaccatcagcaatgcccctgtgtctgagtacatgaaccaggccatgctgtttggaagaaaccccaggtatgaaaatgtgcccctgattggccgggccagccccccacccacctacagccccagcatgagggccacctacctgtctgtggctgatgagcacctgcggcactacggcaaccagtttcctgcctag

SEQ ID NO: 39701 - DNA, 1572 bp, Artificial Sequence
  Description of Artificial Sequence: Synthetic coding sequence
atggccggcgtgtcctatgctgccccctggtgggtgtccctgctgcaccggctgccccactttgacctgtcctgggaggccaccagcagccagttccggcctgaggacacagactaccagcaggccctgctgctgctgggcgctgctgccctggcctgcctggccctggacctgctcttcctgctcttctacagcttctggctgtgctgcagaagaaggaagtctgaggagcacctggatgctgactgctgctgcacagcctggtgtgtgatcatcgccaccctggtgtgcagcgctggcattgctgtgggcttctatggaaatggagagaccagtgatggcatccaccgggccacctacagcctgcggcatgccaacagaacagtggccggcgtgcaggacagagtgtgggacacagctgtgggcctgaaccacacagctgagcccagcctgcagaccctggagcggcagctggccggccggcctgagcccctgcgggctgtgcagaggctgcagggcctgctggagaccctgctgggctacacagctgccatccccttctggaggaacacagctgtgtccctggaggtgctggccgagcaggtggacctgtatgactggtaccgctggctgggctacctgggcctgctgctgctggatgtgatcatctgcctgctggtgctggtgggcctcatccgcagcagcaagggcatcctggtgggcgtgtgcctgctgggcgtgctggccctggtgatctcctggggcgccctgggcctggagctggccgtgtctgtgggcagcagtgacttctgtgtggaccctgatgcctacgtgaccaagatggtggaggagtacagcgtgctgagcggggacatcctgcagtactacctggcctgcagccccagggctgccaaccccttccagcagaagctgagcggcagccacaaggccctggtggagatgcaggatgtggtggccgagctgctgaggacagtgccctgggagcagcctgccaccaaggaccccctgctgcgggtgcaggaggtgctgaatggaacagaggtgaacctgcagcacctgacagccctggtggactgccgcagcctgcacctggactatgtgcaggccctgaccggcttctgctatgatggagtggagggcctcatctacctggccctcttctcctttgtgacagccctgatgttcagcagcatcgtgtgcagcgtgccccacacctggcagcagaagaggggcccagatgaagatggagaggaggaggccgcccctggcccccggcaggcccatgacagcctgtacagagtgcacatgcccagcctgtacagctgtggcagcagctatggcagcgagaccagcatcccagctgctgcccacacagtgtccaatgcccctgtgacagagtacatgagccagaatgccaacttccagaacccccgctgtgagaacacccccctcatcggccgggagagccccccacccagctacaccagctccatgagggccaagtacctggccaccagccagcccaggccagacagcagcggcagccactag

SEQ ID NO: 39702 - DNA, 1059 bp, Artificial Sequence
  Description of Artificial Sequence: Synthetic coding sequence
atgcccagcggcgtgcccggctgctggccccagctgcccctgaagggcccctggaggcccaccccccggccccgggtgcctgtgccctggaggacccccaggtttgcctgccgctggctgggctacctgggcctgctgctgctggatgtgatcatctgcctgctggtgctggtgggcctcatccgcagcagcaagggcatcctggtgggcgtgtgcctgctgggcgtgctggccctggtgatctcctggggcgccctgggcctggagctggccgtgtctgtgggcagcagtgacttctgtgtggaccctgatgcctacgtgaccaagatggtggaggagtacagcgtgctgagcggggacatcctgcagtactacctggcctgcagcccccgggccgccaaccccttccagcagaagctgagcggcagccacaaggccctggtggagatgcaggatgtggtggccgagctgctgaggacagtgccctgggagcagcctgccaccaaggaccccctgctgcgggtgcaggaggtgctgaatggaacagaggtgaacctgcagcacctgacagccctggtggactgccgcagcctgcacctggactatgtgcaggccctgaccggcttctgctatgatggagtggagggcctcatctacctggccctcttctcctttgtgacagccctgatgttcagcagcatcgtgtgcagcgtgccccacacctggcagcagaagaggggcccagatgaagatggagaggaggaggccgcccctggcccccggcaggcccatgacagcctgtacagagtgcacatgcccagcctgtacagctgtggcagcagctatggcagcgagaccagcatcccagctgctgcccacacagtgtccaatgcccctgtgacagagtacatgagccagaatgccaacttccagaacccccgctgtgagaacacccccctgattggccgggagagccccccacccagctacaccagctccatgagggccaagtacctggccaccagccagcccaggccagacagcagcggcagccactag

SEQ ID NO: 39703 - DNA, 1476 bp, Artificial Sequence
  Description of Artificial Sequence: Synthetic coding sequence
atggccggcgtgtcctatgctgccccctggtgggtgtccctgctgcaccggctgccccactttgacctgtcctgggaggccaccagcagccagttccggcctgaggacacagactaccagcaggccctgctgctgctgggcgctgctgccctggcctgcctggccctggacctgctcttcctgctcttctacagcttctggctgtgctgcagaagaaggaagtctgaggagcacctggatgctgactgctgctgcacagcctggtgtgtgatcatcgccaccctggtgtgcagcgctggcattgctgtgggcttctatggaaatggagagaccagtgatggcatccaccgggccacctacagcctgcggcatgccaacagaacagtggccggcgtgcaggacagagtgtgggacacagctgtgggcctgaaccacacagctgagcccagcctgcagaccctggagcggcagctggccggccggcctgagcccctgcgggctgtgcagaggctgcagggcctgctggagaccctgctgggctacacagctgccatccccttctggaggaacacagctgtgtccctggaggtgctggccgagcaggtggacctgtatgactggtacagagtgtgcctgctgggcgtgctggccctggtgatctcctggggcgccctgggcctggagctggccgtgtctgtgggcagcagtgacttctgtgtggaccctgatgcctacgtgaccaagatggtggaggagtacagcgtgctgagcggggacatcctgcagtactacctggcctgcagccccagggctgccaaccccttccagcagaagctgagcggcagccacaaggccctggtggagatgcaggatgtggtggccgagctgctgaggacagtgccctgggagcagcctgccaccaaggaccccctgctgcgggtgcaggaggtgctgaatggaacagaggtgaacctgcagcacctgacagccctggtggactgccgcagcctgcacctggactatgtgcaggccctgaccggcttctgctatgatggagtggagggcctcatctacctggccctcttctcctttgtgacagccctgatgttcagcagcatcgtgtgcagcgtgccccacacctggcagcagaagaggggcccagatgaagatggagaggaggaggccgcccctggcccccggcaggcccatgacagcctgtacagagtgcacatgcccagcctgtacagctgtggcagcagctatggcagcgagaccagcatcccagctgctgcccacacagtgtccaatgcccctgtgacagagtacatgagccagaatgccaacttccagaacccccgctgtgagaacacccccctcatcggccgggagagccccccacccagctacaccagctccatgagggccaagtacctggccaccagccagcccaggccagacagcagcggcagccactag

SEQ ID NO: 39704 - DNA, 609 bp, Artificial Sequence
  Description of Artificial Sequence: Synthetic coding sequence
atggccgagtacctggccagcatctttggaacagagaaggacaaggtgaactgcagcttctacttcaagattggagtgtgcagacatggagaccgctgcagccggctgcacaacaagcccaccttcagccaggaggtgttcacagagctgcaggagaagtacggggagattgaggagatgaatgtgtgtgacaacctgggggaccacctggtgggcaatgtgtatgtgaagttcagaagagaggaggatggagagagagctgtggccgagctgagcaaccgctggttcaacggccaggccgtgcacggcaatgtgcctgaggtggccagcgccaccagctgcatctgtggccccttccccaggaccagccggggcagctccatgggcggggaccccggggccggccacccccggggcagcatcctggccaccatccctgagcggggcaccatcggcgtgcccctcatcaccggcatggccgccagcgaggccctggcccccctgcccttcacccccaacagagaccgctgctcctggcaggacctgagcagcaagccacccagcctgagctgccccatcctgccccggctgcccggcagcatcatgtag

SEQ ID NO: 39705 - DNA, 546 bp, Artificial Sequence
  Description of Artificial Sequence: Synthetic coding sequence
atggccgagtacctggccagcatctttggaacagagaaggacaaggtgaactgcagcttctacttcaagattggagtgtgcagacatggagaccgctgcagccggctgcacaacaagcccaccttcagccaggaggtgttcacagagctgcaggagaagtacggggagattgaggagatgaatgtgtgtgacaacctgggggaccacctggtgggcaatgtgtatgtgaagttcagaagagaggaggatggagagagagctgtggccgagctgagcaaccgctggttcaacggccaggccgtgcacggggagctgagccctgtgacagacttccgggagagctgctgccggcagtatgagatgggagaatgtacccggggcggcttctgcaacttcatgcacctgcggcccatcagccagaacctgcagaggcagctgtatggccggggccccaggagaagaagccccccacgcttccacacaggccaccacccccgggagaggaaccaccgctgcagcccagaccactggcacggccgcttctag

SEQ ID NO: 39706 - DNA, 552 bp, Artificial Sequence
  Description of Artificial Sequence: Synthetic coding sequence
atgtgtgccaccaccctgggcaccacctcctgggccacctccatgagcagcagcggcggccgcaggatggagagcggcccctggctgaacagcgtgacagctggcagcacaggccgcctgtgcaccggcatgtacccccgctggctgctgcagctgcacgccagcgctgcccacttccctgagcccccagaggccgccctgtgggccggcacccaggcccaggtgccccaggaccagcctgccatgagcccccacgtgctgcggcccctgtacccccagatgagcctgaccctgagccccagcaaccacgtgcccaagaacttcttcttcttcttcttctttgagatggagccccacagcgtggcccaggccggcgtgcactggcaccacctgggctcctggcagctgcccccacctggcttcaagcagttcagcgccagcgccagccagattgctggcatcaccggcacctgccaccacgcccggctcatctttgtgttcctggtggagatgggcttccaccacctgggccaggccggcctgaacagctag

SEQ ID NO: 39707 - DNA, 663 bp, Artificial Sequence
  Description of Artificial Sequence: Synthetic coding sequence
atggccgagtacctggccagcatctttggaacagagaaggacaaggtgaactgcagcttctacttcaagattggagtgtgcagacatggagaccgctgcagccggctgcacaacaagcccaccttcagccagaccatcgtgctgctgaacctgtacagaaacccccagaacacagcccagacagcagatggcagccactgccacgtgtctgatgtggaggtgcaggagcactatgacagcttctttgaggaggtgttcacagagctgcaggagaagtatggagaaattgaggagatgaatgtgtgtgacaacctgggggaccacctggtgggcaatgtgtatgtgaagttccggcgggaggaggatggagagagagctgtggccgagctgagcaaccgctggttcaacggccaggccgtgcatggagagctgagccctgtgacagacttccgggagagctgctgccggcagtatgagatgggagagtgcacccggggcggcttctgcaacttcatgcacctgcggcccatcagccagaacctgcagaggcagctgtatggccggggcccccggcggcgcagccccccacgcttccacacaggccaccacccccgggagaggaaccaccgctgcagcccagaccactggcacggccgcttctag

SEQ ID NO: 39708 - DNA, 930 bp, Artificial Sequence
  Description of Artificial Sequence: Synthetic coding sequence
atgtgcttcttcttcagcctgcaggaggagttcctggacaagcacaccctgatgagggtgctgagcagcggcggcaagctgggcagcagaggagagggcgcccagctgtgctgctggatgctgctcttctcctggagggtgtctgggggccagcagacccggcggctgtgccggcgggccttctgctggagccctgtgcccagccccagctgcagccccagcagctgcctgacagcccggagcagcctgtgcatgaccttcacccagagcaggaccaccagcagcctggcccctgtgtttgccctgtttgtgcccttctactgcagcatcccccgggtgcaggtggcccagatcctgggccccctgagcatcaccaacaagaccctcatctacatcctgggcctgcagctgttcaccagcggcagctacatctggatcgtggccatcagcggcctgatgagcggcctgtgctatgacagcaagatgttccaggtgcaccaggtgctgtgcatccccagctggatggccaagttcttctcctggaccctggagcccatcttcagcagcagcgagcccaccagcgaggcccgcatcggcatgggcgccaccctggacatccagaggcagcagaggatggagctgctggaccggcagctgatgttcagccagtttgcccagggccggcggcagaggcagcagcagggcggcatgatcaactggaacagactcttcccccccctgcggcagaggcagaatgtgaactaccagggcggccggcagagcgagcctgctgccccacccctggaggtgtctgaggagcaggtggcccggctgatggagatgggcttcagcagaggagatgccctggaggccctgcgggccagcaacaatgacctgaatgtggccaccaacttcctgctgcagcactag

SEQ ID NO: 39709 - DNA, 1035 bp, Artificial Sequence
  Description of Artificial Sequence: Synthetic coding sequence
atgttcaccagcacaggcagcagcggcctgtacaaggcccccctgagcaagagcctgctgctggtgcccagcgccctgagcctgctgctggccctgctgctgccccactgccagaagctgtttgtgtatgacctgcatgctgtgaagaatgacttccagatctggaggctcatctgtggccgcatcatctgcctggacctgaaggacaccttctgcagcagcctgctgatctacaacttccgcatctttgaaagaagatatggcagcaggaagtttgccagcttcctgctgggctcctgggtgctgagcgccctgtttgacttcctgctgattgaggccatgcagtacttcttcggcatcacagctgccagcaacctgcccagcggcttcctggcccctgtgtttgccctgtttgtgcccttctactgcagcatcccccgggtgcaggtggcccagatcctgggccccctgagcatcaccaacaagaccctcatctacatcctgggcctgcagctgttcaccagcggcagctacatctggatcgtggccatcagcggcctgatgagcggcctgtgctatgacagcaagatgttccaggtgcaccaggtgctgtgcatccccagctggatggccaagttcttctcctggaccctggagcccatcttcagcagcagcgagcccaccagcgaggccagaattggcatgggcgccaccctggacatccagaggcagcagaggatggagctgctggaccggcagctgatgttcagccagtttgcccagggccggcggcagaggcagcagcagggcggcatgatcaactggaacagactcttcccccccctgcggcagaggcagaatgtgaactaccagggcggccggcagagcgagcctgctgccccacccctggaggtgtctgaggagcaggtggcccggctgatggagatgggcttcagcagaggagatgccctggaggccctgcgggccagcaacaatgacctgaatgtggccaccaacttcctgctgcagcactag

SEQ ID NO: 39710 - DNA, 192 bp, Artificial Sequence
  Description of Artificial Sequence: Synthetic coding sequence
atggctgctgccaccctgaccagcaagctgtacagcctgctcttccggaggaccagcacctttgccctgaccatcatcgtgggcgtgatgttctttgagcgggcctttgaccagggcgcagatgccatctatgaccacatcaatgaaggcaagctgtggaagcacatcaagcacaagtatgagaacaagtag

SEQ ID NO: 39711 - DNA, 399 bp, Artificial Sequence
  Description of Artificial Sequence: Synthetic coding sequence
atggctgctgccaccctgaccagcaagctgtacagcctgctcttccggcggcccccacccagccccagccccagctcctgggccagctgcagcagcagcgcccccagcatcaaggcccggaccctgagcaccaccaccagcacccggggcagctgtggcaacaccagcagcacctccatgaggaccagcagcagcctggaggcccccatccaggcccggaggaccaggagcacccagcagctgtttgcccagagctggagcctgagcctgaagatgatgctgaaggtgctcttcatggaccaccacagcctgctggccagaaatggcttcacctacaagacagacagcctgcccagcgctgtgtttgaggtgtgcctggtgtccatgctgaggaagtag

SEQ ID NO: 39712 - DNA, 189 bp, Artificial Sequence
  Description of Artificial Sequence: Synthetic coding sequence
atggctgctgccaccctgaccagcaagctgtacagcctgctcttccggaggaccagcacctttgccctgaccatcatcgtgggcgtgatgttctttgagcgggcctttgaccagggcgcagatgccatctatgaccacatcaatgaaggagtgcgggcctgtgccatcccagacctgggccctgcctag

SEQ ID NO: 39713 - DNA, 249 bp, Artificial Sequence
  Description of Artificial Sequence: Synthetic coding sequence
atggctgctgccaccctgaccagcaagctgtacagcctgctcttccggaggaccagcacctttgccctgaccatcatcgtgggcgtgatgttctttgagcgggcctttgaccagggcgcagatgccatctatgaccacatcaatgaaggagtgcgggcctgtgccatccccccctggacccggctgcggggggacagcggcgtggagaagctgtggaagcacatcaagcacaagtatgagaacaagtag

SEQ ID NO: 39714 - DNA, 171 bp, Artificial Sequence
  Description of Artificial Sequence: Synthetic coding sequence
atggtgacccgcttcctgggcccccgctaccgggagctggtgaagaactgggtgcccacagcctacacctggggcgctgtgggcgctgtgggcctggtgtgggccacagactggaggctcatcctggactgggtgccctacatcaatggcaagttcaagaaggacaactag

SEQ ID NO: 39715 - DNA, 15531 bp, Artificial Sequence
  Description of Artificial Sequence: Synthetic coding sequence
atggccaccagcggcggggaggaggccgctgctgctgccccagcccctggcaccccagccactggagctgacaccaccccaggctgggaggtggccgtgcggcccctgctgagcgccagctacagcgcctttgagatgaaggagctgccccagctggtggcctctgtgattgaaagtgaaagtgagatcctgcaccacgagaagcagtatgagcccttctacagcagctttgtggccctgagcacccactacatcaccaccgtgtgcagcctcatccccaggaaccagctgcagagcgtggccgccgcctgcaaggtgctgattgagttcagcctgctgcggctggagaacccagatgaggcctgtgctgtgtcccagaagcacctgatcctgctgatcaagggcctgtgcaccggctgcagccggctggacagaacagagatcatcaccttcaccgccatgatgaagagcgccaagctgccccagacagtgaagaccctgagtgatgtggaggaccagaaggagctggccagccctgtgtccccagagctgcggcagaaggaggtgcagatgaacttcctgaaccagctgacctctgtgttcaaccccaggacagtggccagccagcccatcagcacccagaccctggtggagggggagaatgatgagcagagcagcacagaccaggccagcgccatcaagaccaagaatgtgttcatcgcccagaatgtggccagcctgcaggagctgggcggcagcgagaagctgctgcgggtgtgcctgaacctgccctacttcctgcgctacatcaaccgcttccaggatgctgtgctggccaacagcttcttcatcatgcctgccaccgtggctgatgccacagctgtgagaaatggcttccacagcctggtgattgatgtgaccatggccctggacaccctgagcctgcctgtgctggagcccctgaaccccagccggctgcaggatgtgacagtgctgagcctgagctgcctgtatgccggcgtgtctgtggccacctgcatggccatcctgcacgtgggcagcgcccagcaggtgaggacaggcagcaccagcagcaaagaagatgattatgaaagtgatgctgccaccatcgtgcagaagtgcctggagatctatgacatgattggccaggccatcagcagcagccggcgggccggcggggagcactaccagaacttccagctgctgggcgcctggtgcctgctgaacagcctcttcctgatcctgaacctgagccccacagccctggccgacaagggcaaggagaaggaccccctggccgccctgcgggtgcgggacatcctgagcaggaccaaggagggcgtgggcagccccaagctgggccctgggaagggccaccagggctttggagtgctgagcgtcatcctggccaaccacgccatcaagctgctgaccagcctcttccaggacctgcaggtggaggccctgcacaagggctgggagacagatggccccccagctgccctgagcatcatggcccagagcaccagcatccagaggatccagaggctgattgattctgtgcccctgatgaacctgctgctgaccctgctgagcaccagctacaggaaggcctgtgtgctgcagaggcagaggaagggctccatgagcagtgatgccagcgccagcacagacagcaacacctactatgaagatgacttcagcagcacagaggaggacagcagccaggatgatgattctgagcccatcctgggccagtggtttgaggagaccatcagccccagcaaggagaaggccgcccctcctcctcctcctcctcctccacccctggagagcagcccccgggtgaagagccccagcaagcaggcccctggagagaagggcaacatcctggccagcaggaaggaccctgagctgttcctgggcctggccagcaacatcctgaacttcatcaccagctccatgctgaacagcaggaacaacttcatccggaactacctgtctgtgtccctgtctgagcaccacatggccaccctggccagcatcatcaaggaggtggacaaggatggcctgaagggcagcagtgatgaggagtttgctgctgccctgtaccacttcaaccacagcctggtgaccagtgacctgcagagccccaacctgcagaacaccctgctgcagcagctgggcgtggcccccttcagcgagggcccctggcccctgtacatccacccccagagcctgtctgtgctgagccggctgctgctgatctggcagcacaaggccagcgcccagggcgaccctgatgtgcctgagtgcctgaaggtgtgggaccgcttcctgagcaccatgaagcagaatgccctgcagggcgtggtgcccagcgagacagaggacctgaatgtggagcacctgcagatgctgctgctgatcttccacaacttcacagagaccggccggcgggccatcctgagcctgtttgtgcagatcatccaggagctgtctgtgaacatggatgcccagatgagatttgtgcccctcatcctggcccggctgctgctgatctttgactacctgctgcaccagtacagcaaggcccctgtgtacctgtttgagcaggtgcagcacaacctgctgagccccccatttggctgggccagcggcagccaggacagcaacagcagaagagccaccacccccctgtaccacggcttcaaggaggtggaggagaactggagcaagcacttcagcagtgatgctgtgccccacccccgcttctactgtgtgctgagccctgaggcctctgaagatgacctgaaccggctggacagcgtggcctgtgatgtgctcttcagcaagctggtgaagtatgatgagctgtatgctgccctgacagccctgctggccgccggcagccagctggacacagtgcggaggaaagaaaacaagaatgtgacagccctggaggcctgtgccctgcagtactacttcctgatcctgtggaggatcctgggcatcctgccccccagcaagacctacatcaaccagctgtccatgaacagccctgagatgtctgaatgtgacatcctgcacaccctgcgctggagcagccggctgcgcatcagcagctatgtgaactggatcaaggaccacctgatcaagcagggcatgaaggccgagcacgccagcagcctgctggagctggccagcaccaccaagtgcagctctgtgaagtatgatgtggagatcgtggaggagtactttgcccggcagatcagcagcttctgcagcattgactgcaccaccatcctgcagctgcacgagatccccagcctgcagagcatctacaccctggatgctgccatcagcaaggtgcaggtgtccctggatgagcacttcagcaagatggctgctgagacagacccccacaagagcagcgagatcaccaagaacctgctgcctgccaccctgcagctgattgacacctacgccagcttcacccgggcctacctgctgcagaacttcaatgaggagggcaccacagagaagcccagcaaggagaagctgcagggctttgctgctgtgctggccatcggcagcagccgctgcaaggccaacaccctgggccccaccctggtgcagaacctgcccagctctgtgcagacagtgtgtgagagctggaacaacatcaacaccaatgagttccccaacatcggctcctggagaaatgcctttgccaatgacaccatccccagcgagagctacatctctgctgtgcaggccgcccacctgggcaccctgtgcagccagagcctgcccctggccgccagcctgaagcacaccctgctgagcctggtgcggctgactggagacctgattgtgtggagcgatgagatgaaccccccccaggtgatccgcaccctgctgcccctgctgctggagagcagcacagaatctgtggccgagatcagcagcaacagcctggagcgcatcctgggccctgctgagagtgatgagttcctggcccgggtgtatgagaagctgatcaccggctgctacaacatcctggccaaccacgccgaccccaacagcggcctggatgagagcatcctggaggagtgcctgcagtacctggagaagcagctggagagcagccaggccaggaaggccatggaggagttcttcagtgacagcggggagctggtgcagatcatgatggccacagccaatgaaaacctgagcgccaagttctgcaacagagtgctgaagttcttcaccaagctgttccagctgacagagaagagccccaaccccagcctgctgcacctgtgtggcagcctggcccagctggcctgtgtggagcctgtgcggctgcaggcctggctgaccaggatgaccaccagcccccccaaggacagcgaccagctggatgtgatccaggagaaccggcagctgctgcagctgctgaccacctacatcgtgcgggagaacagccaggtgggggagggcgtgtgtgctgtgctgctgggcaccctgacccccatggccacagagatgctggccaatggagatggcaccggcttccctgagctgatggtggtgatggccaccctggccagcgctggccagggcgccggccacctgcagctgcacaatgctgctgtggactggctgagccgctgcaagaagtacctgagccagaagaatgtggtggagaagctgaatgccaacgtgatgcacggcaagcacgtgatgatcctggagtgcacctgccacatcatgagctacctggctgatgtgaccaatgccctgagccagagcaatggccagggccccagccacctgtctgtggatggagaggagcgggccatcgaggtggacagcgactgggtggaggagctggccgtggaggaggaggacagccaggccgaggacagtgatgaggacagcctgtgcaacaagctgtgcaccttcaccatcacccagaaggagttcatgaaccagcactggtaccactgccacacctgcaagatggtggatggagtgggcgtgtgcaccgtgtgtgccaaggtgtgccacaaggaccacgagatctcctatgccaagtatggcagcttcttctgtgactgtggggccaaggaggatggcagctgcctggccctggtgaagaggacccccagcagcggcatgagcagcaccatgaaggagagcgccttccagagcgagccccgcatcagcgagagcctggtgagacatgccagcaccagcagccctgctgacaaggccaaggtgaccatcagtgatggcaaggtggctgatgaggagaagcccaagaagagcagcctgtgcaggacagtggagggctgccgggaggagctgcagaaccaggccaacttctcctttgcccccctggtgctggacatgctgaacttcctgatggatgccatccagaccaacttccagcaggccagcgctgtgggcagcagcagccgggcccagcaggccctgtctgagctgcacacagtggagaaggctgtggagatgacagaccagctgatggtgcccaccctgggcagccaggagggcgcctttgaaaatgtgaggatgaactacagcggggaccagggccagaccatccggcagctgatcagcgcccacgtgctgcggcgggtggccatgtgtgtgctgagcagcccccacggccggcggcagcacctggccgtgtcccatgagaagggcaagatcaccgtgctgcagctgagcgccctgctgaagcaggccgacagcagcaagaggaagctgaccctgacccggctggccagcgcccctgtgcccttcaccgtgctgagcctgaccggcaacccctgcaaggaggactacctggccgtgtgtggcctgaaggactgccacgtgctgaccttcagcagcagcggctctgtgtctgaccacctggtgctgcacccccagctggccaccggcaacttcatcatcaaggctgtgtggctgcccggcagccagacagagctggccatcgtgacagctgactttgtgaagatctatgacctgtgtgtggatgccctgagccccaccttctacttcctgctgcccagcagcaagatcagagatgtgaccttcctgttcaatgaggagggcaagaacatcatcgtcatcatgagcagcgctggctacatctacacccagctgatggaggaggccagcagcgcccagcagggccccttctacgtgaccaacgtgctggagatcaaccacgaggacctgaaggacagcaacagccaggtggccggcggcggcgtgtctgtgtactacagccacgtgctgcagatgctgttcttctcctactgccagggcaagagctttgctgccaccatcagcaggaccaccctggaggtgctgcagctgttccccatcaacatcaagagcagcaatggaggcagcaagaccagccctgccctgtgccagtggagcgaggtgatgaaccaccctggcctggtgtgctgcgtgcagcagaccaccggggtgcccctggtggtgatggtgaagccagacaccttcctgatccaggagatcaagaccctgcctgccaaggccaagatccaggacatggtggccatccgccacacagcctgcaatgagcagcagaggaccaccatgatcctgctgtgtgaagatggcagcctgcgcatctacatggccaacgtggagaacaccagctactggctgcagcccagcctgcagcccagcagcgtcatcagcatcatgaagcctgtgaggaagaggaagacagccaccatcaccaccaggaccagcagccaggtgaccttccccatcgacttctttgagcacaaccagcagctgacagatgtggagtttggaggaaatgacctgctgcaggtgtacaatgcccagcagatcaagcaccggctgaacagcacaggcatgtatgtggccaacaccaagccaggcggcttcaccatcgagatcagcaacaacaacagcaccatggtgatgacaggcatgaggatccagatcggcacccaggccatcgagcgggcccccagctacatcgagatctttggaagaaccatgcagctgaacctgagccgcagccgctggtttgacttccccttcacccgggaggaggccctgcaggccgacaagaagctgaacctcttcatcggggcctctgtggaccctgctggggtgaccatgattgatgctgtgaagatctacggcaagaccaaggagcagtttggctggccagatgagcccccagaggagttccccagcgcctctgtgagcaacatctgccccagcaacctgaaccagagcaatggaactggagacagcgacagcgctgcccccaccaccaccagcggcaccgtgctggagcggctggtggtgagcagcctggaggccctggagagctgctttgctgtgggccccatcatcgagaaggagaggaacaagaatgctgcccaggagctggccaccctgctgctgagcctgcctgccccagcctctgtgcagcagcagagcaagagcctgctggccagcctgcacaccagccgcagcgcctaccacagccacaaggaccaggccctgctgagcaaggctgtgcagtgcctgaacaccagcagcaaggagggcaaggacctggaccctgaggtgttccagaggctggtgatcacagcccggagcatcgccatcatgaggcccaacaacctggtgcacttcacagagagcaagctgccccagatggagacagactgcttcttcccccgctgtgcctgctggagcctgggcatcgtgggcatcctgattggagcccccctggagacccccagccctgagggcatggatgagggcaaggagccccagaagcagctggagggggactgctgcagcttcatcacccagctggtgaaccacttctggaagctgcacgccagcaagcccaagaatgccttcctggccccagcctgcctgcccggcctgacccacatcgaggccaccgtgaatgccctggtggacatcatccacggctactgcacctgtgagctggactgcatcaacacagccagcaagatctacatgcagatgctgctgtgcccagaccctgctgtgtccttcagctgcaagcaggccctgatccgggtgctgcggcccaggaacaagagaagacatgtgaccctgcccagcagccccaggagcaacacccccatgggagacaaggatgatgatgatgatgatgatgctgatgagaagatgcagagcagcggcatccccaacggcggccacatccggcaggagagccaggagcagagcgaggtggaccacggggactttgagatggtgtctgagagcatggtgctggagacagcagaaaatgtgaacaacggcaaccccagccccctggaggccctgctggccggggctgagggcttcccccccatgctggacatccccccagatgctgatgatgagaccatggtggagctggccatcgccctgagcctgcagcaggaccagcaggccccagccagtgatgatgagggcagcacagctgccacagatggcagcaccctgcggaccagccctgctgaccacggcggctctgtgggcagcgagagcggcggcagcgctgtggacagcgtggccggggagcacagcgtgtctggccgcagcagcgcctatggagatgccacagctgagggccaccctgctggccctggctctgtgagcagcagcactggagccatcagcaccaccaccggccaccaggagggagatggcagcgagggggagggggagggggagacagaaggagatgtgcacaccagcaaccggctgcacatggtgcggctgatgctgctggagcggctgctgcagaccctgccccagctgagaaatgtgggcggcgtgcgggccatcccctacatgcaggtgatcctgatgctgaccacagacctggatggagaagatgagaaggacaagggggccctggacaacctgctgagccagctgattgctgagctgggcatggacaagaaggatgtgtccaagaagaatgaaagaagtgccctgaatgaggtgcacctggtggtgatgaggctgctgtctgtgttcatgagcaggaccaagagcggcagcaagagcagcatctgtgagagcagcagcctcatcagcagcgccacagctgctgccctgctgagcagtggagctgtggactactgcctgcacgtgctgaagagcctgctggagtactggaagagccagcagaatgatgaggagcctgtggccaccagccagctgctgaagccccacaccaccagcagccccccagacatgagccccttcttcctgcggcagtatgtgaagggccacgccgcagatgtgtttgaggcctacacccagctgctgacagagatggtgctgcggctgccctaccagatcaagaagatcacagacaccaacagccgcatccccccacctgtgtttgaccacagctggttctacttcctgtctgagtacctgatgatccagcagaccccatttgtgcggcggcaggtgaggaagctgctgctcttcatctgtggcagcaaggagaagtaccggcagctgcgggacctgcacaccctggacagccacgtgcggggcatcaagaagctgctggaggagcagggcatcttcctgcgggcctctgtggtgacagccagcagcggcagcgccctgcagtatgacaccctcatcagcctgatggagcacctgaaggcctgtgccgagattgctgcccagaggaccatcaactggcagaagttctgcatcaaggatgacagcgtgctgtacttcctgctgcaggtgtccttcctggtggatgaaggagtgtcccctgtgctgctgcagctgctgagctgtgccctgtgtggcagcaaggtgctggccgccctggccgccagcagcggcagcagcagcgccagcagcagcagcgcccctgtggccgccagcagcggccaggccaccacccagagcaagagcagcaccaagaagagcaagaaggaggagaaggagaaggagaaggatggagagaccagcggcagccaggaggaccagctgtgcacagccctggtgaaccagctgaacaagtttgctgacaaggagaccctcatccagttcctgcgctgcttcctgctggagagcaacagcagctctgtgcgctggcaggcccactgcctgaccctgcacatctacagaaacagcagcaagagccagcaggagctgctgctggacctgatgtggagcatctggccagagctgcctgcctacggcaggaaggccgcccagtttgtggacctgctgggctacttcagcctgaagaccccccagacagagaagaagctgaaggagtacagccagaaggctgtggagatcctgcggacccagaaccacatcctgaccaaccaccccaacagcaacatctacaacaccctgagcggcctggtggagtttgatggctactacctggagagtgacccctgcctggtgtgcaacaaccctgaggtgcccttctgctacatcaagctgagcagcatcaaggtggacacccgctacaccaccacccagcaggtggtgaagctgattggcagccacaccatcagcaaggtgacagtgaagattggagacctgaagaggaccaagatggtgaggaccatcaacctgtactacaacaacagaacagtgcaggccatcgtggagctgaagaacaagccagcccgctggcacaaggccaagaaggtgcagctgaccccaggccagacagaggtgaagattgacctgcccctgcccatcgtggccagcaacctgatgattgaatttgctgacttctatgagaactaccaggccagcacagagaccctgcagtgcccccgctgcagcgcctctgtgcctgccaaccctggggtgtgtggcaactgtggggagaatgtgtaccagtgccacaagtgccgcagcatcaactatgatgagaaggaccccttcctgtgcaatgcctgtggcttctgcaagtatgccaggtttgacttcatgctgtatgccaagccctgctgtgctgtggaccccattgaaaatgaggaggacaggaagaaggctgtgagcaacatcaacaccctgctggacaaggctgacagagtgtaccaccagctgatgggccaccggccccagctggagaacctgctgtgcaaggtgaatgaagctgcccctgagaagccccaggatgacagcggcacagctgggggcatcagcagcaccagcgcctctgtgaaccgctacatcctgcagctggcccaggagtactgtggggactgcaagaacagctttgatgagctgagcaagatcatccagaaggtgtttgccagcaggaaggagctgctggagtatgacctgcagcagcgggaggccgccaccaagagcagcaggacctctgtgcagcccaccttcaccgccagccagtaccgggccctgtctgtgctgggctgcggccacaccagcagcaccaagtgctacggctgtgccagcgctgtgacagagcactgcatcaccctgctgcgggccctggccaccaacccagccctgcggcacatcctggtgtcccagggcctcatccgggagctgtttgactacaacctgcggagaggagctgctgccatgagggaggaggtgcggcagctgatgtgcctgctgacccgggacaaccctgaggccacccagcagatgaatgacctgatcatcggcaaggtgtccacagccctgaagggccactgggccaacccagacctggccagcagcctgcagtatgagatgctgctgctgacagacagcatcagcaaagaagacagctgctgggagctgcggctgcgctgtgccctgagcctcttcctgatggctgtgaacatcaagacccctgtggtggtggagaacatcaccctgatgtgcctgcgcatcctgcagaagctgatcaagcccccagcccccaccagcaagaagaacaaggatgtgcctgtggaggccctgaccaccgtgaagccctactgcaatgagatccacgcccaggcccagctgtggctgaagagggaccccaaggccagctatgatgcctggaagaagtgcctgcccatccggggcattgatggaaatggcaaggcccccagcaagtctgagctgcggcacctgtacctgacagagaagtatgtgtggcgctggaagcagttcctgagccggcggggcaagaggaccagccccctggacctgaagctgggccacaacaactggctgcggcaggtgctcttcaccccagccacccaggccgcccggcaggccgcctgcaccatcgtggaggccctggccaccatccccagcaggaagcagcaggtgctggacctgctgaccagctacctggatgagctgagcattgctggagaatgtgccgctgagtacctggccctgtaccagaagctgatcaccagcgcccactggaaggtgtacctggccgcccggggcgtgctgccctacgtgggcaacctgatcaccaaggagatcgcccggctgctggccctggaggaggccaccctgagcacagacctgcagcagggctacgccctgaagagcctgaccggcctgctgagcagctttgtggaggtggagagcatcaagaggcacttcaagagccggctggtgggcaccgtgctgaatggctacctgtgcctgaggaagctggtggtgcagaggaccaagctgattgatgagacccaggacatgctgctggagatgctggaggacatgaccactggaacagaaagtgagaccaaggccttcatggctgtgtgcattgaaacagccaagcgctacaacctggatgactaccgcacccctgtgttcatctttgagcggctgtgcagcatcatctacccagaggagaatgaggtgacagagttctttgtgaccctggagaaggacccccagcaggaggacttcctgcagggccgcatgcctggcaacccctacagcagcaatgagcccggcatcggccccctgatgagggacatcaagaacaagatctgccaggactgtgacctggtggccctgctggaggatgattctggcatggagctgctggtgaacaacaagatcatcagcctggacctgcctgtggccgaggtgtacaagaaggtgtggtgcaccaccaatgaaggagagcccatgagaattgtgtacaggatgaggggcctgctgggagatgccacagaggagttcatcgagagcctggacagcaccacagatgaggaggaggatgaggaggaggtgtacaagatggccggcgtgatggcccagtgtggcggcctggagtgcatgctgaaccggctggccggcatccgggacttcaagcagggccgccacctgctgactgtgctgctgaagctgttctcctactgtgtgaaggtgaaggtgaaccggcagcagctggtgaagctggagatgaacaccctgaatgtgatgctgggcaccctgaacctggccctggtggccgagcaggagagcaaggacagcggcggcgctgctgtggccgagcaggtgctgagcatcatggagatcatcctggatgagagcaatgctgagcccctgtctgaagataaaggaaacctgctgctgactggagacaaggaccagctggtgatgctgctggaccagatcaacagcacctttgtgcgcagcaaccccagcgtgctgcagggcctgctgcgcatcatcccctacctgagctttggagaggtggagaagatgcagatcctggtggagcgcttcaagccctactgcaactttgacaagtatgatgaggaccacagcggagatgacaaggtgttcctggactgcttctgcaagattgctgctggcatcaagaacaacagcaatggccaccagctgaaggacctgatcctgcagaagggcatcacccagaatgccctggactacatgaagaagcacatccccagcgccaagaacctggatgctgacatctggaagaagttcctgagcaggcctgccctgcccttcatcctgcggctgctgcggggcctggccatccagcaccctggcacccaggtgctgattggaacagacagcatccccaacctgcacaagctggagcaggtgtccagtgatgagggcatcggcaccctggccgagaacctgctggaggccctgcgggagcacccagatgtgaacaagaagattgatgctgcccggcgggagaccagggctgagaagaagaggatggccatggccatgaggcagaaggccctgggcaccctgggcatgaccaccaatgagaagggccaggtggtgaccaagacagccctgctgaagcagatggaggagctgattgaggagcccggcctgacctgctgcatctgccgggagggctacaagttccagcccaccaaggtgctgggcatctacaccttcaccaagagggtggccctggaggagatggagaacaagcccaggaagcagcagggctacagcacagtgagccacttcaacatcgtgcactatgactgccacctggccgctgtgcggctggcccggggccgggaggagtgggagagcgctgccctgcagaatgccaacaccaagtgcaatggcctgctgcctgtgtggggcccccacgtgcctgagagcgcctttgccacctgcctggcccggcacaacacctacctgcaggagtgcaccggccagcgggagcccacctaccagctgaacatccatgacatcaagctgctcttcctgcgctttgccatggagcagagcttctctgctgacacaggaggcggcggccgggagagcaacatccacctgatcccctacatcatccacacagtgctgtatgtgctgaacaccacccgggccaccagccgggaggagaagaacctgcagggcttcctggagcagcccaaggagaagtgggtggagagcgcctttgaggtggatggcccctactacttcaccgtgctggccctgcacatcctgcccccagagcagtggagggccaccagggtggagatcctgcggcggctgctggtgaccagccaggcccgggctgtggcccctgggggcgccacccggctgacagacaaggctgtgaaggactacagcgcctaccgcagcagcctgctcttctgggccctggtggacctgatctacaacatgttcaagaaggtgcccaccagcaacacagagggcggctggagctgcagcctggccgagtacatccgccacaatgacatgcccatctatgaggccgctgacaaggccctgaagaccttccaggaggagttcatgcctgtggagaccttcagcgagttcctggatgtggccggcctgctgtctgagatcacagatcctgagagcttcctgaaggacctgctgaacagcgtgccctag

SEQ ID NO: 39716 - DNA, 639 bp, Artificial Sequence
  Description of Artificial Sequence: Synthetic coding sequence
atggtgaggaccatcaacctgtactacaacaacagaacagtgcaggccatcgtggagctgaagaacaagccagcccgctggcacaaggccaagaaggtgcagctgaccccaggccagacagaggtgaagattgacctgcccctgcccatcgtggccagcaacctgatgattgaatttgctgacttctatgagaactaccaggccagcacagagaccctgcagtgcccccgctgcagcgcctctgtgcctgccaaccctggggtgtgtggcaactgtggggagaatgtgtaccagtgccacaagtgccgcagcatcaactatgatgagaaggaccccttcctgtgcaatgcctgtggcttctgcaagtatgccaggtttgacttcatgctgtatgccaagccctgctgtgctgtggaccccattgaaaatgaggaggacaggaagaaggctgtgagcaacatcaacaccctgctggacaaggctgacagagtgtaccaccagctgatgggccaccggccccagctggagaacctgctgtgcaaggtgaatgaagctgcccctgagaagccccaggtggtgccccgctgcaagggccacctggacaagggcctgggcctggaccagaagacagccagctag

SEQ ID NO: 39717 - DNA, 2673 bp, Artificial Sequence
  Description of Artificial Sequence: Synthetic coding sequence
atgctggaggacatgaccactggaacagaaagtgagaccaaggccttcatggctgtgtgcattgaaacagccaagcgctacaacctggatgactaccgcacccctgtgttcatctttgagcggctgtgcagcatcatctacccagaggagaatgaggtgacagagttctttgtgaccctggagaaggacccccagcaggaggacttcctgcagggccgcatgcctggcaacccctacagcagcaatgagcccggcatcggccccctgatgagggacatcaagaacaagatctgccaggactgtgacctggtggccctgctggaggatgattctggcatggagctgctggtgaacaacaagatcatcagcctggacctgcctgtggccgaggtgtacaagaaggtgtggtgcaccaccaatgaaggagagcccatgagaattgtgtacaggatgaggggcctgctgggagatgccacagaggagttcatcgagagcctggacagcaccacagatgaggaggaggatgaggaggaggtgtacaagatggccggcgtgatggcccagtgtggcggcctggagtgcatgctgaaccggctggccggcatccgggacttcaagcagggccgccacctgctgactgtgctgctgaagctgttctcctactgtgtgaaggtgaaggtgaaccggcagcagctggtgaagctggagatgaacaccctgaatgtgatgctgggcaccctgaacctggccctggtggccgagcaggagagcaaggacagcggcggcgctgctgtggccgagcaggtgctgagcatcatggagatcatcctggatgagagcaatgctgagcccctgtctgaagataaaggaaacctgctgctgactggagacaaggaccagctggtgatgctgctggaccagatcaacagcacctttgtgcgcagcaaccccagcgtgctgcagggcctgctgcgcatcatcccctacctgagctttggagaggtggagaagatgcagatcctggtggagcgcttcaagccctactgcaactttgacaagtatgatgaggaccacagcggagatgacaaggtgttcctggactgcttctgcaagattgctgctggcatcaagaacaacagcaatggccaccagctgaaggacctgatcctgcagaagggcatcacccagaatgccctggactacatgaagaagcacatccccagcgccaagaacctggatgctgacatctggaagaagttcctgagcaggcctgccctgcccttcatcctgcggctgctgcggggcctggccatccagcaccctggcacccaggtgctgattggaacagacagcatccccaacctgcacaagctggagcaggtgtccagtgatgagggcatcggcaccctggccgagaacctgctggaggccctgcgggagcacccagatgtgaacaagaagattgatgctgcccggcgggagaccagggctgagaagaagaggatggccatggccatgaggcagaaggccctgggcaccctgggcatgaccaccaatgagaagggccaggtggtgaccaagacagccctgctgaagcagatggaggagctgattgaggagcccggcctgacctgctgcatctgccgggagggctacaagttccagcccaccaaggtgctgggcatctacaccttcaccaagagggtggccctggaggagatggagaacaagcccaggaagcagcagggctacagcacagtgagccacttcaacatcgtgcactatgactgccacctggccgctgtgcggctggcccggggccgggaggagtgggagagcgctgccctgcagaatgccaacaccaagtgcaatggcctgctgcctgtgtggggcccccacgtgcctgagagcgcctttgccacctgcctggcccggcacaacacctacctgcaggagtgcaccggccagcgggagcccacctaccagctgaacatccatgacatcaagctgctcttcctgcgctttgccatggagcagagcttctctgctgacacaggaggcggcggccgggagagcaacatccacctgatcccctacatcatccacacagtgctgtatgtgctgaacaccacccgggccaccagccgggaggagaagaacctgcagggcttcctggagcagcccaaggagaagtgggtggagagcgcctttgaggtggatggcccctactacttcaccgtgctggccctgcacatcctgcccccagagcagtggagggccaccagggtggagatcctgcggcggctgctggtgaccagccaggcccgggctgtggcccctgggggcgccacccggctgacagacaaggctgtgaaggactacagcgcctaccgcagcagcctgctcttctgggccctggtggacctgatctacaacatgttcaagaaggtgcccaccagcaacacagagggcggctggagctgcagcctggccgagtacatccgccacaatgacatgcccatctatgaggccgctgacaaggccctgaagaccttccaggaggagttcatgcctgtggagaccttcagcgagttcctggatgtggccggcctgctgtctgagatcacagatcctgagagcttcctgaaggacctgctgaacagcgtgccctag

SEQ ID NO: 39718 - DNA, 777 bp, Artificial Sequence
  Description of Artificial Sequence: Synthetic coding sequence
atgggccctgggaagaagggccgctgccgggaggagggccctggccggggccggcgggcctggatcatccggggcagcggcagcagccggcagggctgggtgggctctgtggagagcagcaagaggtctgccaacgtgacccggcagaggcagatcgagcagatcctgcctgccctggccgccggcagctgcttccacccagccttcatcctgagctgccgcttcagcagcaggacccgggccaccagccgggaggagaagaacctgcagggcttcctggagcagcccaaggagaagtgggtggagagcgcctttgaggtggatggcccctactacttcaccgtgctggccctgcacatcctgcccccagagcagtggagggccaccagggtggagatcctgcggcggctgctggtgaccagccaggcccgggctgtggcccctgggggcgccacccggctgacagacaaggctgtgaaggactacagcgcctaccgcagcagcctgctcttctgggccctggtggacctgatctacaacatgttcaagaaggtgcccaccagcaacacagagggcggctggagctgcagcctggccgagtacatccgccacaatgacatgcccatctatgaggccgctgacaaggccctgaagaccttccaggaggagttcatgcctgtggagaccttcagcgagttcctggatgtggccggcctgctgtctgagatcacagatcctgagagcttcctgaaggacctgctgaacagcgtgccctag

SEQ ID NO: 39719 - DNA, 15480 bp, Artificial Sequence
  Description of Artificial Sequence: Synthetic coding sequence
atggccaccagcggcggggaggaggccgctgctgctgccccagcccctggcaccccagccactggagctgacaccaccccaggctgggaggtggccgtgcggcccctgctgagcgccagctacagcgcctttgagatgaaggagctgccccagctggtggcctctgtgattgaaagtgaaagtgagatcctgcaccacgagaagcagtatgagcccttctacagcagctttgtggccctgagcacccactacatcaccaccgtgtgcagcctcatccccaggaaccagctgcagagcgtggccgccgcctgcaaggtgctgattgagttcagcctgctgcggctggagaacccagatgaggcctgtgctgtgtcccagaagcacctgatcctgctgatcaagggcctgtgcaccggctgcagccggctggacagaacagagatcatcaccttcaccgccatgatgaagagcgccaagctgccccagacagtgaagaccctgagtgatgtggaggaccagaaggagctggccagccctgtgtccccagagctgcggcagaaggaggtgcagatgaacttcctgaaccagctgacctctgtgttcaaccccaggacagtggccagccagcccatcagcacccagaccctggtggagggggagaatgatgagcagagcagcacagaccaggccagcgccatcaagaccaagaatgtgttcatcgcccagaatgtggccagcctgcaggagctgggcggcagcgagaagctgctgcgggtgtgcctgaacctgccctacttcctgcgctacatcaaccgcttccaggatgctgtgctggccaacagcttcttcatcatgcctgccaccgtggctgatgccacagctgtgagaaatggcttccacagcctggtgattgatgtgaccatggccctggacaccctgagcctgcctgtgctggagcccctgaaccccagccggctgcaggatgtgacagtgctgagcctgagctgcctgtatgccggcgtgtctgtggccacctgcatggccatcctgcacgtgggcagcgcccagcaggtgaggacaggcagcaccagcagcaaagaagatgattatgaaagtgatgctgccaccatcgtgcagaagtgcctggagatctatgacatgattggccaggccatcagcagcagccggcgggccggcggggagcactaccagaacttccagctgctgggcgcctggtgcctgctgaacagcctcttcctgatcctgaacctgagccccacagccctggccgacaagggcaaggagaaggaccccctggccgccctgcgggtgcgggacatcctgagcaggaccaaggagggcgtgggcagccccaagctgggccctgggaagggccaccagggctttggagtgctgagcgtcatcctggccaaccacgccatcaagctgctgaccagcctcttccaggacctgcaggtggaggccctgcacaagggctgggagacagatggccccccagctgccctgagcatcatggcccagagcaccagcatccagaggatccagaggctgattgattctgtgcccctgatgaacctgctgctgaccctgctgagcaccagctacaggaaggcctgtgtgctgcagaggcagaggaagggctccatgagcagtgatgccagcgccagcacagacagcaacacctactatgaagatgacttcagcagcacagaggaggacagcagccaggatgatgattctgagcccatcctgggccagtggtttgaggagaccatcagccccagcaaggagaaggccgcccctcctcctcctcctcctcctccacccctggagagcagcccccgggtgaagagccccagcaagcaggcccctggagagaagggcaacatcctggccagcaggaaggaccctgagctgttcctgggcctggccagcaacatcctgaacttcatcaccagctccatgctgaacagcaggaacaacttcatccggaactacctgtctgtgtccctgtctgagcaccacatggccaccctggccagcatcatcaaggaggtggacaaggatggcctgaagggcagcagtgatgaggagtttgctgctgccctgtaccacttcaaccacagcctggtgaccagtgacctgcagagccccaacctgcagaacaccctgctgcagcagctgggcgtggcccccttcagcgagggcccctggcccctgtacatccacccccagagcctgtctgtgctgagccggctgctgctgatctggcagcacaaggccagcgcccagggcgaccctgatgtgcctgagtgcctgaaggtgtgggaccgcttcctgagcaccatgaagcagaatgccctgcagggcgtggtgcccagcgagacagaggacctgaatgtggagcacctgcagatgctgctgctgatcttccacaacttcacagagaccggccggcgggccatcctgagcctgtttgtgcagatcatccaggagctgtctgtgaacatggatgcccagatgagatttgtgcccctcatcctggcccggctgctgctgatctttgactacctgctgcaccagtacagcaaggcccctgtgtacctgtttgagcaggtgcagcacaacctgctgagccccccatttggctgggccagcggcagccaggacagcaacagcagaagagccaccacccccctgtaccacggcttcaaggaggtggaggagaactggagcaagcacttcagcagtgatgctgtgccccacccccgcttctactgtgtgctgagccctgaggcctctgaagatgacctgaaccggctggacagcgtggcctgtgatgtgctcttcagcaagctggtgaagtatgatgagctgtatgctgccctgacagccctgctggccgccggcagccagctggacacagtgcggaggaaagaaaacaagaatgtgacagccctggaggcctgtgccctgcagtactacttcctgatcctgtggaggatcctgggcatcctgccccccagcaagacctacatcaaccagctgtccatgaacagccctgagatgtctgaatgtgacatcctgcacaccctgcgctggagcagccggctgcgcatcagcagctatgtgaactggatcaaggaccacctgatcaagcagggcatgaaggccgagcacgccagcagcctgctggagctggccagcaccaccaagtgcagctctgtgaagtatgatgtggagatcgtggaggagtactttgcccggcagatcagcagcttctgcagcattgactgcaccaccatcctgcagctgcacgagatccccagcctgcagagcatctacaccctggatgctgccatcagcaaggtgcaggtgtccctggatgagcacttcagcaagatggctgctgagacagacccccacaagagcagcgagatcaccaagaacctgctgcctgccaccctgcagctgattgacacctacgccagcttcacccgggcctacctgctgcagaacttcaatgaggagggcaccacagagaagcccagcaaggagaagctgcagggctttgctgctgtgctggccatcggcagcagccgctgcaaggccaacaccctgggccccaccctggtgcagaacctgcccagctctgtgcagacagtgtgtgagagctggaacaacatcaacaccaatgagttccccaacatcggctcctggagaaatgcctttgccaatgacaccatccccagcgagagctacatctctgctgtgcaggccgcccacctgggcaccctgtgcagccagagcctgcccctggccgccagcctgaagcacaccctgctgagcctggtgcggctgactggagacctgattgtgtggagcgatgagatgaaccccccccaggtgatccgcaccctgctgcccctgctgctggagagcagcacagaatctgtggccgagatcagcagcaacagcctggagcgcatcctgggccctgctgagagtgatgagttcctggcccgggtgtatgagaagctgatcaccggctgctacaacatcctggccaaccacgccgaccccaacagcggcctggatgagagcatcctggaggagtgcctgcagtacctggagaagcagctggagagcagccaggccaggaaggccatggaggagttcttcagtgacagcggggagctggtgcagatcatgatggccacagccaatgaaaacctgagcgccaagttctgcaacagagtgctgaagttcttcaccaagctgttccagctgacagagaagagccccaaccccagcctgctgcacctgtgtggcagcctggcccagctggcctgtgtggagcctgtgcggctgcaggcctggctgaccaggatgaccaccagcccccccaaggacagcgaccagctggatgtgatccaggagaaccggcagctgctgcagctgctgaccacctacatcgtgcgggagaacagccaggtgggggagggcgtgtgtgctgtgctgctgggcaccctgacccccatggccacagagatgctggccaatggagatggcaccggcttccctgagctgatggtggtgatggccaccctggccagcgctggccagggcgccggccacctgcagctgcacaatgctgctgtggactggctgagccgctgcaagaagtacctgagccagaagaatgtggtggagaagctgaatgccaacgtgatgcacggcaagcacgtgatgatcctggagtgcacctgccacatcatgagctacctggctgatgtgaccaatgccctgagccagagcaatggccagggccccagccacctgtctgtggatggagaggagcgggccatcgaggtggacagcgactgggtggaggagctggccgtggaggaggaggacagccaggccgaggacagtgatgaggacagcctgtgcaacaagctgtgcaccttcaccatcacccagaaggagttcatgaaccagcactggtaccactgccacacctgcaagatggtggatggagtgggcgtgtgcaccgtgtgtgccaaggtgtgccacaaggaccacgagatctcctatgccaagtatggcagcttcttctgtgactgtggggccaaggaggatggcagctgcctggccctggtgaagaggacccccagcagcggcatgagcagcaccatgaaggagagcgccttccagagcgagccccgcatcagcgagagcctggtgagacatgccagcaccagcagccctgctgacaaggccaaggtgaccatcagtgatggcaaggtggctgatgaggagaagcccaagaagagcagcctgtgcaggacagtggagggctgccgggaggagctgcagaaccaggccaacttctcctttgcccccctggtgctggacatgctgaacttcctgatggatgccatccagaccaacttccagcaggccagcgctgtgggcagcagcagccgggcccagcaggccctgtctgagctgcacacagtggagaaggctgtggagatgacagaccagctgatggtgcccaccctgggcagccaggagggcgcctttgaaaatgtgaggatgaactacagcggggaccagggccagaccatccggcagctgatcagcgcccacgtgctgcggcgggtggccatgtgtgtgctgagcagcccccacggccggcggcagcacctggccgtgtcccatgagaagggcaagatcaccgtgctgcagctgagcgccctgctgaagcaggccgacagcagcaagaggaagctgaccctgacccggctggccagcgcccctgtgcccttcaccgtgctgagcctgaccggcaacccctgcaaggaggactacctggccgtgtgtggcctgaaggactgccacgtgctgaccttcagcagcagcggctctgtgtctgaccacctggtgctgcacccccagctggccaccggcaacttcatcatcaaggctgtgtggctgcccggcagccagacagagctggccatcgtgacagctgactttgtgaagatctatgacctgtgtgtggatgccctgagccccaccttctacttcctgctgcccagcagcaagatcagagatgtgaccttcctgttcaatgaggagggcaagaacatcatcgtcatcatgagcagcgctggctacatctacacccagctgatggaggaggccagcagcgcccagcagggccccttctacgtgaccaacgtgctggagatcaaccacgaggacctgaaggacagcaacagccaggtggccggcggcggcgtgtctgtgtactacagccacgtgctgcagatgctgttcttctcctactgccagggcaagagctttgctgccaccatcagcaggaccaccctggaggtgctgcagctgttccccatcaacatcaagagcagcaatggaggcagcaagaccagccctgccctgtgccagtggagcgaggtgatgaaccaccctggcctggtgtgctgcgtgcagcagaccaccggggtgcccctggtggtgatggtgaagccagacaccttcctgatccaggagatcaagaccctgcctgccaaggccaagatccaggacatggtggccatccgccacacagcctgcaatgagcagcagaggaccaccatgatcctgctgtgtgaagatggcagcctgcgcatctacatggccaacgtggagaacaccagctactggctgcagcccagcctgcagcccagcagcgtcatcagcatcatgaagcctgtgaggaagaggaagacagccaccatcaccaccaggaccagcagccaggtgaccttccccatcgacttctttgagcacaaccagcagctgacagatgtggagtttggaggaaatgacctgctgcaggtgtacaatgcccagcagatcaagcaccggctgaacagcacaggcatgtatgtggccaacaccaagccaggcggcttcaccatcgagatcagcaacaacaacagcaccatggtgatgacaggcatgaggatccagatcggcacccaggccatcgagcgggcccccagctacatcgagatctttggaagaaccatgcagctgaacctgagccgcagccgctggtttgacttccccttcacccgggaggaggccctgcaggccgacaagaagctgaacctcttcatcggggcctctgtggaccctgctggggtgaccatgattgatgctgtgaagatctacggcaagaccaaggagcagtttggctggccagatgagcccccagaggagttccccagcgcctctgtgagcaacatctgccccagcaacctgaaccagagcaatggaactggagacagcgacagcgctgcccccaccaccaccagcggcaccgtgctggagagcagcgagacagagagcctgaccaagctggaccggctggtggtgagcagcctggaggccctggagagctgctttgctgtgggccccatcatcgagaaggagaggaacaagaatgctgcccaggagctggccaccctgctgctgagcctgcctgccccagcctctgtgcagcagcagagcaagagcctgctggccagcctgcacaccagccgcagcgcctaccacagccacaaggaccaggccctgctgagcaaggctgtgcagtgcctgaacaccagcagcaaggagggcaaggacctggaccctgaggtgttccagaggctggtgatcacagcccggagcatcgccatcatgaggcccaacaacctggtgcacttcacagagagcaagctgccccagatggagacagagggcatggatgagggcaaggagccccagaagcagctggagggggactgctgcagcttcatcacccagctggtgaaccacttctggaagctgcacgccagcaagcccaagaatgccttcctggccccagcctgcctgcccggcctgacccacatcgaggccaccgtgaatgccctggtggacatcatccacggctactgcacctgtgagctggactgcatcaacacagccagcaagatctacatgcagatgctgctgtgcccagaccctgctgtgtccttcagctgcaagcaggccctgatccgggtgctgcggcccaggaacaagagaagacatgtgaccctgcccagcagccccaggagcaacacccccatgggagacaaggatgatgatgatgatgatgatgctgatgagaagatgcagagcagcggcatccccaatggaggccacatccggcaggagagccaggagcagagcgaggtggaccatggagactttgagatggtgtctgagagcatggtgctggagacagcagaaaatgtgaacaatggaaaccccagccccctggaggccctgctggccggggctgagggcttcccccccatgctggacatccccccagatgctgatgatgagaccatggtggagctggccatcgccctgagcctgcagcaggaccagcaggccccagccagtgatgatgagggcagcacagctgccacagatggcagcaccctgcggaccagccctgctgaccatggaggctctgtgggcagcgagagcggcggcagcgctgtggacagcgtggccggggagcacagcgtgtctggccgcagcagcgcctatggagatgccacagctgagggccaccctgctggccctggctctgtgagcagcagcactggagccatcagcaccaccaccggccaccaggagggagatggcagcgagggggagggggagggggagacagaaggagatgtgcacaccagcaaccggctgcacatggtgcggctgatgctgctggagcggctgctgcagaccctgccccagctgagaaatgtgggcggcgtgcgggccatcccctacatgcaggtgatcctgatgctgaccacagacctggatggagaagatgagaaggacaagggggccctggacaacctgctgagccagctgattgctgagctgggcatggacaagaaggatgtgtccaagaagaatgaaagaagtgccctgaatgaggtgcacctggtggtgatgaggctgctgagcgtcttcatgagcaggaccaagagcggcagcaagagcagcatctgtgagagcagcagcctcatcagcagcgccacagctgctgccctgctgagcagcggggctgtggactactgcctgcacgtgctgaagagcctgctggagtactggaagagccagcagaatgatgaggagcctgtggccaccagccagctgctgaagccccacaccaccagcagccccccagacatgagccccttcttcctgcggcagtatgtgaagggccatgctgctgatgtgtttgaggcctacacccagctgctgacagagatggtgctgcggctgccctaccagatcaagaagatcacagacaccaacagccgcatccccccacctgtgtttgaccacagctggttctacttcctgtctgagtacctgatgatccagcagaccccatttgtgcggcggcaggtgaggaagctgctgctcttcatctgtggcagcaaggagaagtaccggcagctgcgggacctgcacaccctggacagccacgtgcggggcatcaagaagctgctggaggagcagggcatcttcctgcgggcctctgtggtgacagccagcagcggcagcgccctgcagtatgacaccctcatcagcctgatggagcacctgaaggcctgtgccgagattgctgcccagaggaccatcaactggcagaagttctgcatcaaggatgattctgtgctgtacttcctgctgcaggtgtccttcctggtggatgagggcgtgtcccctgtgctgctgcagctgctgagctgtgccctgtgtggcagcaaggtgctggccgccctggccgccagcagcggcagcagcagcgccagcagcagcagcgcccctgtggccgccagcagcggccaggccaccacccagagcaagagcagcaccaagaagagcaagaaggaggagaaggagaaggagaaggatggagagaccagcggcagccaggaggaccagctgtgcacagccctggtgaaccagctgaacaagtttgctgacaaggagaccctcatccagttcctgcgctgcttcctgctggagagcaacagcagctctgtgcgctggcaggcccactgcctgaccctgcacatctacagaaacagcagcaagagccagcaggagctgctgctggacctgatgtggagcatctggccagagctgcctgcctacggcaggaaggccgcccagtttgtggacctgctgggctacttcagcctgaagaccccccagacagagaagaagctgaaggagtacagccagaaggctgtggagatcctgcggacccagaaccacatcctgaccaaccaccccaacagcaacatctacaacaccctgagcggcctggtggagtttgatggctactacctggagagtgacccctgcctggtgtgcaacaaccctgaggtgcccttctgctacatcaagctgagcagcatcaaggtggacacccgctacaccaccacccagcaggtggtgaagctgattggcagccacaccatcagcaaggtgacagtgaagatcggggacctgaagaggaccaagatggtgaggaccatcaacctgtactacaacaacagaacagtgcaggccatcgtggagctgaagaacaagccagcccgctggcacaaggccaagaaggtgcagctgaccccaggccagacagaggtgaagattgacctgcccctgcccatcgtggccagcaacctgatgattgaatttgctgacttctatgagaactaccaggccagcacagagaccctgcagtgcccccgctgcagcgcctctgtgcctgccaaccctggggtgtgtggcaactgtggagaaaatgtgtaccagtgccacaagtgccgcagcatcaactatgatgagaaggaccccttcctgtgcaatgcctgtggcttctgcaagtatgccaggtttgacttcatgctgtatgccaagccctgctgtgctgtggaccccattgaaaatgaggaggacaggaagaaggctgtgagcaacatcaacaccctgctggacaaggctgacagagtgtaccaccagctgatgggccaccggccccagctggagaacctgctgtgcaaggtgaatgaggccgcccctgagaagccccaggatgattctggaacagctgggggcatcagcagcaccagcgcctctgtgaaccgctacatcctgcagctggcccaggagtactgtggggactgcaagaacagctttgatgagctgagcaagatcatccagaaggtgtttgccagcaggaaggagctgctggagtatgacctgcagcagcgggaggccgccaccaagagcagcaggacctctgtgcagcccaccttcaccgccagccagtaccgggccctgtctgtgctgggctgcggccacaccagcagcaccaagtgctacggctgtgccagcgctgtgacagagcactgcatcaccctgctgcgggccctggccaccaacccagccctgcggcacatcctggtgtcccagggcctcatccgggagctgtttgactacaacctgcggagaggagctgctgccatgagggaggaggtgcggcagctgatgtgcctgctgacccgggacaaccctgaggccacccagcagatgaatgacctgatcatcggcaaggtgtccacagccctgaagggccactgggccaacccagacctggccagcagcctgcagtatgagatgctgctgctgacagacagcatcagcaaggaggacagctgctgggagctgcggctgcgctgtgccctgagcctcttcctgatggctgtgaacatcaagacccctgtggtggtggagaacatcaccctgatgtgcctgcgcatcctgcagaagctgatcaagcccccagcccccaccagcaagaagaacaaggatgtgcctgtggaggccctgaccaccgtgaagccctactgcaatgagatccacgcccaggcccagctgtggctgaagagggaccccaaggccagctatgatgcctggaagaagtgcctgcccatccggggcattgatggaaatggcaaggcccccagcaagtctgagctgcggcacctgtacctgacagagaagtatgtgtggcgctggaagcagttcctgagcagaagaggcaagaggaccagccccctggacctgaagctgggccacaacaactggctgcggcaggtgctcttcaccccagccacccaggccgcccggcaggccgcctgcaccatcgtggaggccctggccaccatccccagcaggaagcagcaggtgctggacctgctgaccagctacctggatgagctgagcattgctggggagtgtgccgctgagtacctggccctgtaccagaagctgatcaccagcgcccactggaaggtgtacctggccgcccggggcgtgctgccctacgtgggcaacctgatcaccaaggagatcgcccggctgctggccctggaggaggccaccctgagcacagacctgcagcagggctacgccctgaagagcctgaccggcctgctgagcagctttgtggaggtggagagcatcaagaggcacttcaagagccggctggtgggcaccgtgctgaatggctacctgtgcctgaggaagctggtggtgcagaggaccaagctgattgatgagacccaggacatgctgctggagatgctggaggacatgaccaccggcacagagagcgagaccaaggccttcatggctgtgtgcatcgagacagccaagcgctacaacctggatgactaccgcacccctgtgttcatctttgagcggctgtgcagcatcatctacccagaagaaaatgaggtgacagagttctttgtgaccctggagaaggacccccagcaggaggacttcctgcagggccgcatgcctggcaacccctacagcagcaatgaacctggcatcggccccctgatgagggacatcaagaacaagatctgccaggactgtgacctggtggccctgctggaggatgacagcggcatggagctgctggtgaacaacaagatcatcagcctggacctgcctgtggccgaggtgtacaagaaggtgtggtgcaccaccaatgaaggagagcccatgagaattgtgtacaggatgaggggcctgctgggagatgccacagaggagttcatcgagagcctggacagcaccacagatgaggaggaggatgaggaggaggtgtacaagatggccggcgtgatggcccagtgtggcggcctggagtgcatgctgaaccggctggccggcatccgggacttcaagcagggccgccacctgctgactgtgctgctgaagctgttctcctactgtgtgaaggtgaaggtgaaccggcagcagctggtgaagctggagatgaacaccctgaatgtgatgctgggcaccctgaacctggccctggtggccgagcaggagagcaaggacagcggcggcgctgctgtggccgagcaggtgctgagcatcatggagatcatcctggatgagagcaatgctgagcccctgtctgaggacaagggcaacctgctgctgaccggggacaaggaccagctggtgatgctgctggaccagatcaacagcacctttgtgcgcagcaaccccagcgtgctgcagggcctgctgcgcatcatcccctacctgagctttggagaggtggagaagatgcagatcctggtggagcgcttcaagccctactgcaactttgacaagtatgatgaggaccacagcggagatgacaaggtgttcctggactgcttctgcaagattgctgctggcatcaagaacaacagcaatggccaccagctgaaggacctgatcctgcagaagggcatcacccagaatgccctggactacatgaagaagcacatccccagcgccaagaacctggatgctgacatctggaagaagttcctgagcaggcctgccctgcccttcatcctgcggctgctgcggggcctggccatccagcaccctggcacccaggtgctgattggaacagacagcatccccaacctgcacaagctggagcaggtgtccagtgatgagggcatcggcaccctggccgagaacctgctggaggccctgcgggagcacccagatgtgaacaagaagattgatgctgcccggcgggagaccagggctgagaagaagaggatggccatggccatgaggcagaaggccctgggcaccctgggcatgaccaccaatgagaagggccaggtggtgaccaagacagccctgctgaagcagatggaggagctgattgaggagcccggcctgacctgctgcatctgccgggagggctacaagttccagcccaccaaggtgctgggcatctacaccttcaccaagagggtggccctggaggagatggagaacaagcccaggaagcagcagggctacagcacagtgagccacttcaacatcgtgcactatgactgccacctggccgctgtgcggctggcccggggccgggaggagtgggagagcgctgccctgcagaatgccaacaccaagtgcaatggcctgctgcctgtgtggggcccccacgtgcctgagagcgcctttgccacctgcctggcccggcacaacacctacctgcaggagtgcaccggccagcgggagcccacctaccagctgaacatccatgacatcaagctgctcttcctgcgctttgccatggagcagagcttctctgctgacaccggcggcggcggccgggagagcaacatccacctgatcccctacatcatccacacagtgctgtatgtgctgaacaccacccgggccaccagccgggaggagaagaacctgcagggcttcctggagcagcccaaggagaagtgggtggagagcgcctttgaggtggatggcccctactacttcaccgtgctggccctgcacatcctgcccccagagcagtggagggccaccagggtggagatcctgcggcggctgctggtgaccagccaggcccgggctgtggcccctggaggagccacccggctgacagacaaggctgtgaaggactacagcgcctaccgcagcagcctgctcttctgggccctggtggacctgatctacaacatgttcaagaaggtgcccaccagcaacacagaaggaggctggagctgcagcctggccgagtacatccgccacaatgacatgcccatctatgaagctgctgacaaggccctgaagaccttccaggaggagttcatgcctgtggagaccttcagcgagttcctggatgtggccggcctgctgtctgagatcacagatcctgagagcttcctgaaggacctgctgaacagcgtgccctag

SEQ ID NO: 39720 - DNA, 15552 bp, Artificial Sequence
  Description of Artificial Sequence: Synthetic coding sequence
atggccaccagcggcggggaggaggccgctgctgctgccccagcccctggcaccccagccactggagctgacaccaccccaggctgggaggtggccgtgcggcccctgctgagcgccagctacagcgcctttgagatgaaggagctgccccagctggtggcctctgtgattgaaagtgaaagtgagatcctgcaccacgagaagcagtatgagcccttctacagcagctttgtggccctgagcacccactacatcaccaccgtgtgcagcctcatccccaggaaccagctgcagagcgtggccgccgcctgcaaggtgctgattgagttcagcctgctgcggctggagaacccagatgaggcctgtgctgtgtcccagaagcacctgatcctgctgatcaagggcctgtgcaccggctgcagccggctggacagaacagagatcatcaccttcaccgccatgatgaagagcgccaagctgccccagacagtgaagaccctgagtgatgtggaggaccagaaggagctggccagccctgtgtccccagagctgcggcagaaggaggtgcagatgaacttcctgaaccagctgacctctgtgttcaaccccaggacagtggccagccagcccatcagcacccagaccctggtggagggggagaatgatgagcagagcagcacagaccaggccagcgccatcaagaccaagaatgtgttcatcgcccagaatgtggccagcctgcaggagctgggcggcagcgagaagctgctgcgggtgtgcctgaacctgccctacttcctgcgctacatcaaccgcttccaggatgctgtgctggccaacagcttcttcatcatgcctgccaccgtggctgatgccacagctgtgagaaatggcttccacagcctggtgattgatgtgaccatggccctggacaccctgagcctgcctgtgctggagcccctgaaccccagccggctgcaggatgtgacagtgctgagcctgagctgcctgtatgccggcgtgtctgtggccacctgcatggccatcctgcacgtgggcagcgcccagcaggtgaggacaggcagcaccagcagcaaagaagatgattatgaaagtgatgctgccaccatcgtgcagaagtgcctggagatctatgacatgattggccaggccatcagcagcagccggcgggccggcggggagcactaccagaacttccagctgctgggcgcctggtgcctgctgaacagcctcttcctgatcctgaacctgagccccacagccctggccgacaagggcaaggagaaggaccccctggccgccctgcgggtgcgggacatcctgagcaggaccaaggagggcgtgggcagccccaagctgggccctgggaagggccaccagggctttggagtgctgagcgtcatcctggccaaccacgccatcaagctgctgaccagcctcttccaggacctgcaggtggaggccctgcacaagggctgggagacagatggccccccagctgccctgagcatcatggcccagagcaccagcatccagaggatccagaggctgattgattctgtgcccctgatgaacctgctgctgaccctgctgagcaccagctacaggaaggcctgtgtgctgcagaggcagaggaagggctccatgagcagtgatgccagcgccagcacagacagcaacacctactatgaagatgacttcagcagcacagaggaggacagcagccaggatgatgattctgagcccatcctgggccagtggtttgaggagaccatcagccccagcaaggagaaggccgcccctcctcctcctcctcctcctccacccctggagagcagcccccgggtgaagagccccagcaagcaggcccctggagagaagggcaacatcctggccagcaggaaggaccctgagctgttcctgggcctggccagcaacatcctgaacttcatcaccagctccatgctgaacagcaggaacaacttcatccggaactacctgtctgtgtccctgtctgagcaccacatggccaccctggccagcatcatcaaggaggtggacaaggatggcctgaagggcagcagtgatgaggagtttgctgctgccctgtaccacttcaaccacagcctggtgaccagtgacctgcagagccccaacctgcagaacaccctgctgcagcagctgggcgtggcccccttcagcgagggcccctggcccctgtacatccacccccagagcctgtctgtgctgagccggctgctgctgatctggcagcacaaggccagcgcccagggcgaccctgatgtgcctgagtgcctgaaggtgtgggaccgcttcctgagcaccatgaagcagaatgccctgcagggcgtggtgcccagcgagacagaggacctgaatgtggagcacctgcagatgctgctgctgatcttccacaacttcacagagaccggccggcgggccatcctgagcctgtttgtgcagatcatccaggagctgtctgtgaacatggatgcccagatgagatttgtgcccctcatcctggcccggctgctgctgatctttgactacctgctgcaccagtacagcaaggcccctgtgtacctgtttgagcaggtgcagcacaacctgctgagccccccatttggctgggccagcggcagccaggacagcaacagcagaagagccaccacccccctgtaccacggcttcaaggaggtggaggagaactggagcaagcacttcagcagtgatgctgtgccccacccccgcttctactgtgtgctgagccctgaggcctctgaagatgacctgaaccggctggacagcgtggcctgtgatgtgctcttcagcaagctggtgaagtatgatgagctgtatgctgccctgacagccctgctggccgccggcagccagctggacacagtgcggaggaaagaaaacaagaatgtgacagccctggaggcctgtgccctgcagtactacttcctgatcctgtggaggatcctgggcatcctgccccccagcaagacctacatcaaccagctgtccatgaacagccctgagatgtctgaatgtgacatcctgcacaccctgcgctggagcagccggctgcgcatcagcagctatgtgaactggatcaaggaccacctgatcaagcagggcatgaaggccgagcacgccagcagcctgctggagctggccagcaccaccaagtgcagctctgtgaagtatgatgtggagatcgtggaggagtactttgcccggcagatcagcagcttctgcagcattgactgcaccaccatcctgcagctgcacgagatccccagcctgcagagcatctacaccctggatgctgccatcagcaaggtgcaggtgtccctggatgagcacttcagcaagatggctgctgagacagacccccacaagagcagcgagatcaccaagaacctgctgcctgccaccctgcagctgattgacacctacgccagcttcacccgggcctacctgctgcagaacttcaatgaggagggcaccacagagaagcccagcaaggagaagctgcagggctttgctgctgtgctggccatcggcagcagccgctgcaaggccaacaccctgggccccaccctggtgcagaacctgcccagctctgtgcagacagtgtgtgagagctggaacaacatcaacaccaatgagttccccaacatcggctcctggagaaatgcctttgccaatgacaccatccccagcgagagctacatctctgctgtgcaggccgcccacctgggcaccctgtgcagccagagcctgcccctggccgccagcctgaagcacaccctgctgagcctggtgcggctgactggagacctgattgtgtggagcgatgagatgaaccccccccaggtgatccgcaccctgctgcccctgctgctggagagcagcacagaatctgtggccgagatcagcagcaacagcctggagcgcatcctgggccctgctgagagtgatgagttcctggcccgggtgtatgagaagctgatcaccggctgctacaacatcctggccaaccacgccgaccccaacagcggcctggatgagagcatcctggaggagtgcctgcagtacctggagaagcagctggagagcagccaggccaggaaggccatggaggagttcttcagtgacagcggggagctggtgcagatcatgatggccacagccaatgaaaacctgagcgccaagttctgcaacagagtgctgaagttcttcaccaagctgttccagctgacagagaagagccccaaccccagcctgctgcacctgtgtggcagcctggcccagctggcctgtgtggagcctgtgcggctgcaggcctggctgaccaggatgaccaccagcccccccaaggacagcgaccagctggatgtgatccaggagaaccggcagctgctgcagctgctgaccacctacatcgtgcgggagaacagccaggtgggggagggcgtgtgtgctgtgctgctgggcaccctgacccccatggccacagagatgctggccaatggagatggcaccggcttccctgagctgatggtggtgatggccaccctggccagcgctggccagggcgccggccacctgcagctgcacaatgctgctgtggactggctgagccgctgcaagaagtacctgagccagaagaatgtggtggagaagctgaatgccaacgtgatgcacggcaagcacgtgatgatcctggagtgcacctgccacatcatgagctacctggctgatgtgaccaatgccctgagccagagcaatggccagggccccagccacctgtctgtggatggagaggagcgggccatcgaggtggacagcgactgggtggaggagctggccgtggaggaggaggacagccaggccgaggacagtgatgaggacagcctgtgcaacaagctgtgcaccttcaccatcacccagaaggagttcatgaaccagcactggtaccactgccacacctgcaagatggtggatggagtgggcgtgtgcaccgtgtgtgccaaggtgtgccacaaggaccacgagatctcctatgccaagtatggcagcttcttctgtgactgtggggccaaggaggatggcagctgcctggccctggtgaagaggacccccagcagcggcatgagcagcaccatgaaggagagcgccttccagagcgagccccgcatcagcgagagcctggtgagacatgccagcaccagcagccctgctgacaaggccaaggtgaccatcagtgatggcaaggtggctgatgaggagaagcccaagaagagcagcctgtgcaggacagtggagggctgccgggaggagctgcagaaccaggccaacttctcctttgcccccctggtgctggacatgctgaacttcctgatggatgccatccagaccaacttccagcaggccagcgctgtgggcagcagcagccgggcccagcaggccctgtctgagctgcacacagtggagaaggctgtggagatgacagaccagctgatggtgcccaccctgggcagccaggagggcgcctttgaaaatgtgaggatgaactacagcggggaccagggccagaccatccggcagctgatcagcgcccacgtgctgcggcgggtggccatgtgtgtgctgagcagcccccacggccggcggcagcacctggccgtgtcccatgagaagggcaagatcaccgtgctgcagctgagcgccctgctgaagcaggccgacagcagcaagaggaagctgaccctgacccggctggccagcgcccctgtgcccttcaccgtgctgagcctgaccggcaacccctgcaaggaggactacctggccgtgtgtggcctgaaggactgccacgtgctgaccttcagcagcagcggctctgtgtctgaccacctggtgctgcacccccagctggccaccggcaacttcatcatcaaggctgtgtggctgcccggcagccagacagagctggccatcgtgacagctgactttgtgaagatctatgacctgtgtgtggatgccctgagccccaccttctacttcctgctgcccagcagcaagatcagagatgtgaccttcctgttcaatgaggagggcaagaacatcatcgtcatcatgagcagcgctggctacatctacacccagctgatggaggaggccagcagcgcccagcagggccccttctacgtgaccaacgtgctggagatcaaccacgaggacctgaaggacagcaacagccaggtggccggcggcggcgtgtctgtgtactacagccacgtgctgcagatgctgttcttctcctactgccagggcaagagctttgctgccaccatcagcaggaccaccctggaggtgctgcagctgttccccatcaacatcaagagcagcaatggaggcagcaagaccagccctgccctgtgccagtggagcgaggtgatgaaccaccctggcctggtgtgctgcgtgcagcagaccaccggggtgcccctggtggtgatggtgaagccagacaccttcctgatccaggagatcaagaccctgcctgccaaggccaagatccaggacatggtggccatccgccacacagcctgcaatgagcagcagaggaccaccatgatcctgctgtgtgaagatggcagcctgcgcatctacatggccaacgtggagaacaccagctactggctgcagcccagcctgcagcccagcagcgtcatcagcatcatgaagcctgtgaggaagaggaagacagccaccatcaccaccaggaccagcagccaggtgaccttccccatcgacttctttgagcacaaccagcagctgacagatgtggagtttggaggaaatgacctgctgcaggtgtacaatgcccagcagatcaagcaccggctgaacagcacaggcatgtatgtggccaacaccaagccaggcggcttcaccatcgagatcagcaacaacaacagcaccatggtgatgacaggcatgaggatccagatcggcacccaggccatcgagcgggcccccagctacatcgagatctttggaagaaccatgcagctgaacctgagccgcagccgctggtttgacttccccttcacccgggaggaggccctgcaggccgacaagaagctgaacctcttcatcggggcctctgtggaccctgctggggtgaccatgattgatgctgtgaagatctacggcaagaccaaggagcagtttggctggccagatgagcccccagaggagttccccagcgcctctgtgagcaacatctgccccagcaacctgaaccagagcaatggaactggagacagcgacagcgctgcccccaccaccaccagcggcaccgtgctggagcggctggtggtgagcagcctggaggccctggagagctgctttgctgtgggccccatcatcgagaaggagaggaacaagaatgctgcccaggagctggccaccctgctgctgagcctgcctgccccagcctctgtgcagcagcagagcaagagcctgctggccagcctgcacaccagccgcagcgcctaccacagccacaaggaccaggccctgctgagcaaggctgtgcagtgcctgaacaccagcagcaaggagggcaaggacctggaccctgaggtgttccagaggctggtgatcacagcccggagcatcgccatcatgaggcccaacaacctggtgcacttcacagagagcaagctgccccagatggagacagagggcatggatgagggcaaggagccccagaagcagctggagggggactgctgcagcttcatcacccagctggtgaaccacttctggaagctgcacgccagcaagcccaagaatgccttcctggccccagcctgcctgcccggcctgacccacatcgaggccaccgtgaatgccctggtggacatcatccacggctactgcacctgtgagctggactgcatcaacacagccagcaagatctacatgcagatgctgctgtgcccagaccctgctgtgtccttcagctgcaagcaggccctgatccgggtgctgcggcccaggaacaagagaagacatgtgaccctgcccagcagccccaggagcaacacccccatgggagacaaggatgatgatgatgatgatgatgctgatgagaagatgcagagcagcggcatccccaacggcggccacatccggcaggagagccaggagcagagcgaggtggaccacggggactttgagatggtgtctgagagcatggtgctggagacagcagaaaatgtgaacaacggcaaccccagccccctggaggccctgctggccggggctgagggcttcccccccatgctggacatccccccagatgctgatgatgagaccatggtggagctggccatcgccctgagcctgcagcaggaccagcagggcagcagcagcagcgccctgggcctgcagagcctgggcctgagcggccaggcccccagcagcagcagcctggatgctggcaccctgagtgacaccacagccagcgccccagccagtgatgatgagggcagcacagctgccacagatggcagcaccctgcggaccagccctgctgaccatggaggctctgtgggcagcgagagcggcggcagcgctgtggacagcgtggccggggagcacagcgtgtctggccgcagcagcgcctatggagatgccacagctgagggccaccctgctggccctggctctgtgagcagcagcactggagccatcagcaccaccaccggccaccaggagggagatggcagcgagggggagggggagggggagacagaaggagatgtgcacaccagcaaccggctgcacatggtgcggctgatgctgctggagcggctgctgcagaccctgccccagctgagaaatgtgggcggcgtgcgggccatcccctacatgcaggtgatcctgatgctgaccacagacctggatggagaagatgagaaggacaagggggccctggacaacctgctgagccagctgattgctgagctgggcatggacaagaaggatgtgtccaagaagaatgaaagaagtgccctgaatgaggtgcacctggtggtgatgaggctgctgagcgtcttcatgagcaggaccaagagcggcagcaagagcagcatctgtgagagcagcagcctcatcagcagcgccacagctgctgccctgctgagcagcggggctgtggactactgcctgcacgtgctgaagagcctgctggagtactggaagagccagcagaatgatgaggagcctgtggccaccagccagctgctgaagccccacaccaccagcagccccccagacatgagccccttcttcctgcggcagtatgtgaagggccatgctgctgatgtgtttgaggcctacacccagctgctgacagagatggtgctgcggctgccctaccagatcaagaagatcacagacaccaacagccgcatccccccacctgtgtttgaccacagctggttctacttcctgtctgagtacctgatgatccagcagaccccatttgtgcggcggcaggtgaggaagctgctgctcttcatctgtggcagcaaggagaagtaccggcagctgcgggacctgcacaccctggacagccacgtgcggggcatcaagaagctgctggaggagcagggcatcttcctgcgggcctctgtggtgacagccagcagcggcagcgccctgcagtatgacaccctcatcagcctgatggagcacctgaaggcctgtgccgagattgctgcccagaggaccatcaactggcagaagttctgcatcaaggatgattctgtgctgtacttcctgctgcaggtgtccttcctggtggatgagggcgtgtcccctgtgctgctgcagctgctgagctgtgccctgtgtggcagcaaggtgctggccgccctggccgccagcagcggcagcagcagcgccagcagcagcagcgcccctgtggccgccagcagcggccaggccaccacccagagcaagagcagcaccaagaagagcaagaaggaggagaaggagaaggagaaggatggagagaccagcggcagccaggaggaccagctgtgcacagccctggtgaaccagctgaacaagtttgctgacaaggagaccctcatccagttcctgcgctgcttcctgctggagagcaacagcagctctgtgcgctggcaggcccactgcctgaccctgcacatctacagaaacagcagcaagagccagcaggagctgctgctggacctgatgtggagcatctggccagagctgcctgcctacggcaggaaggccgcccagtttgtggacctgctgggctacttcagcctgaagaccccccagacagagaagaagctgaaggagtacagccagaaggctgtggagatcctgcggacccagaaccacatcctgaccaaccaccccaacagcaacatctacaacaccctgagcggcctggtggagtttgatggctactacctggagagtgacccctgcctggtgtgcaacaaccctgaggtgcccttctgctacatcaagctgagcagcatcaaggtggacacccgctacaccaccacccagcaggtggtgaagctgattggcagccacaccatcagcaaggtgacagtgaagatcggggacctgaagaggaccaagatggtgaggaccatcaacctgtactacaacaacagaacagtgcaggccatcgtggagctgaagaacaagccagcccgctggcacaaggccaagaaggtgcagctgaccccaggccagacagaggtgaagattgacctgcccctgcccatcgtggccagcaacctgatgattgaatttgctgacttctatgagaactaccaggccagcacagagaccctgcagtgcccccgctgcagcgcctctgtgcctgccaaccctggggtgtgtggcaactgtggagaaaatgtgtaccagtgccacaagtgccgcagcatcaactatgatgagaaggaccccttcctgtgcaatgcctgtggcttctgcaagtatgccaggtttgacttcatgctgtatgccaagccctgctgtgctgtggaccccattgaaaatgaggaggacaggaagaaggctgtgagcaacatcaacaccctgctggacaaggctgacagagtgtaccaccagctgatgggccaccggccccagctggagaacctgctgtgcaaggtgaatgaggccgcccctgagaagccccaggatgattctggaacagctgggggcatcagcagcaccagcgcctctgtgaaccgctacatcctgcagctggcccaggagtactgtggggactgcaagaacagctttgatgagctgagcaagatcatccagaaggtgtttgccagcaggaaggagctgctggagtatgacctgcagcagcgggaggccgccaccaagagcagcaggacctctgtgcagcccaccttcaccgccagccagtaccgggccctgtctgtgctgggctgcggccacaccagcagcaccaagtgctacggctgtgccagcgctgtgacagagcactgcatcaccctgctgcgggccctggccaccaacccagccctgcggcacatcctggtgtcccagggcctcatccgggagctgtttgactacaacctgcggagaggagctgctgccatgagggaggaggtgcggcagctgatgtgcctgctgacccgggacaaccctgaggccacccagcagatgaatgacctgatcatcggcaaggtgtccacagccctgaagggccactgggccaacccagacctggccagcagcctgcagtatgagatgctgctgctgacagacagcatcagcaaggaggacagctgctgggagctgcggctgcgctgtgccctgagcctcttcctgatggctgtgaacatcaagacccctgtggtggtggagaacatcaccctgatgtgcctgcgcatcctgcagaagctgatcaagcccccagcccccaccagcaagaagaacaaggatgtgcctgtggaggccctgaccaccgtgaagccctactgcaatgagatccacgcccaggcccagctgtggctgaagagggaccccaaggccagctatgatgcctggaagaagtgcctgcccatccggggcattgatggaaatggcaaggcccccagcaagtctgagctgcggcacctgtacctgacagagaagtatgtgtggcgctggaagcagttcctgagcagaagaggcaagaggaccagccccctggacctgaagctgggccacaacaactggctgcggcaggtgctcttcaccccagccacccaggccgcccggcaggccgcctgcaccatcgtggaggccctggccaccatccccagcaggaagcagcaggtgctggacctgctgaccagctacctggatgagctgagcattgctggggagtgtgccgctgagtacctggccctgtaccagaagctgatcaccagcgcccactggaaggtgtacctggccgcccggggcgtgctgccctacgtgggcaacctgatcaccaaggagatcgcccggctgctggccctggaggaggccaccctgagcacagacctgcagcagggctacgccctgaagagcctgaccggcctgctgagcagctttgtggaggtggagagcatcaagaggcacttcaagagccggctggtgggcaccgtgctgaatggctacctgtgcctgaggaagctggtggtgcagaggaccaagctgattgatgagacccaggacatgctgctggagatgctggaggacatgaccaccggcacagagagcgagaccaaggccttcatggctgtgtgcatcgagacagccaagcgctacaacctggatgactaccgcacccctgtgttcatctttgagcggctgtgcagcatcatctacccagaagaaaatgaggtgacagagttctttgtgaccctggagaaggacccccagcaggaggacttcctgcagggccgcatgcctggcaacccctacagcagcaatgaacctggcatcggccccctgatgagggacatcaagaacaagatctgccaggactgtgacctggtggccctgctggaggatgacagcggcatggagctgctggtgaacaacaagatcatcagcctggacctgcctgtggccgaggtgtacaagaaggtgtggtgcaccaccaatgaaggagagcccatgagaattgtgtacaggatgaggggcctgctgggagatgccacagaggagttcatcgagagcctggacagcaccacagatgaggaggaggatgaggaggaggtgtacaagatggccggcgtgatggcccagtgtggcggcctggagtgcatgctgaaccggctggccggcatccgggacttcaagcagggccgccacctgctgactgtgctgctgaagctgttctcctactgtgtgaaggtgaaggtgaaccggcagcagctggtgaagctggagatgaacaccctgaatgtgatgctgggcaccctgaacctggccctggtggccgagcaggagagcaaggacagcggcggcgctgctgtggccgagcaggtgctgagcatcatggagatcatcctggatgagagcaatgctgagcccctgtctgaggacaagggcaacctgctgctgaccggggacaaggaccagctggtgatgctgctggaccagatcaacagcacctttgtgcgcagcaaccccagcgtgctgcagggcctgctgcgcatcatcccctacctgagctttggagaggtggagaagatgcagatcctggtggagcgcttcaagccctactgcaactttgacaagtatgatgaggaccacagcggagatgacaaggtgttcctggactgcttctgcaagattgctgctggcatcaagaacaacagcaatggccaccagctgaaggacctgatcctgcagaagggcatcacccagaatgccctggactacatgaagaagcacatccccagcgccaagaacctggatgctgacatctggaagaagttcctgagcaggcctgccctgcccttcatcctgcggctgctgcggggcctggccatccagcaccctggcacccaggtgctgattggaacagacagcatccccaacctgcacaagctggagcaggtgtccagtgatgagggcatcggcaccctggccgagaacctgctggaggccctgcgggagcacccagatgtgaacaagaagattgatgctgcccggcgggagaccagggctgagaagaagaggatggccatggccatgaggcagaaggccctgggcaccctgggcatgaccaccaatgagaagggccaggtggtgaccaagacagccctgctgaagcagatggaggagctgattgaggagcccggcctgacctgctgcatctgccgggagggctacaagttccagcccaccaaggtgctgggcatctacaccttcaccaagagggtggccctggaggagatggagaacaagcccaggaagcagcagggctacagcacagtgagccacttcaacatcgtgcactatgactgccacctggccgctgtgcggctggcccggggccgggaggagtgggagagcgctgccctgcagaatgccaacaccaagtgcaatggcctgctgcctgtgtggggcccccacgtgcctgagagcgcctttgccacctgcctggcccggcacaacacctacctgcaggagtgcaccggccagcgggagcccacctaccagctgaacatccatgacatcaagctgctcttcctgcgctttgccatggagcagagcttctctgctgacaccggcggcggcggccgggagagcaacatccacctgatcccctacatcatccacacagtgctgtatgtgctgaacaccacccgggccaccagccgggaggagaagaacctgcagggcttcctggagcagcccaaggagaagtgggtggagagcgcctttgaggtggatggcccctactacttcaccgtgctggccctgcacatcctgcccccagagcagtggagggccaccagggtggagatcctgcggcggctgctggtgaccagccaggcccgggctgtggcccctggaggagccacccggctgacagacaaggctgtgaaggactacagcgcctaccgcagcagcctgctcttctgggccctggtggacctgatctacaacatgttcaagaaggtgcccaccagcaacacagaaggaggctggagctgcagcctggccgagtacatccgccacaatgacatgcccatctatgaagctgctgacaaggccctgaagaccttccaggaggagttcatgcctgtggagaccttcagcgagttcctggatgtggccggcctgctgtctgagatcacagatcctgagagcttcctgaaggacctgctgaacagcgtgccctag

SEQ ID NO: 39721 - DNA, 15615 bp, Artificial Sequence
  Description of Artificial Sequence: Synthetic coding sequence
atggccaccagcggcggggaggaggccgctgctgctgccccagcccctggcaccccagccactggagctgacaccaccccaggctgggaggtggccgtgcggcccctgctgagcgccagctacagcgcctttgagatgaaggagctgccccagctggtggcctctgtgattgaaagtgaaagtgagatcctgcaccacgagaagcagtatgagcccttctacagcagctttgtggccctgagcacccactacatcaccaccgtgtgcagcctcatccccaggaaccagctgcagagcgtggccgccgcctgcaaggtgctgattgagttcagcctgctgcggctggagaacccagatgaggcctgtgctgtgtcccagaagcacctgatcctgctgatcaagggcctgtgcaccggctgcagccggctggacagaacagagatcatcaccttcaccgccatgatgaagagcgccaagctgccccagacagtgaagaccctgagtgatgtggaggaccagaaggagctggccagccctgtgtccccagagctgcggcagaaggaggtgcagatgaacttcctgaaccagctgacctctgtgttcaaccccaggacagtggccagccagcccatcagcacccagaccctggtggagggggagaatgatgagcagagcagcacagaccaggccagcgccatcaagaccaagaatgtgttcatcgcccagaatgtggccagcctgcaggagctgggcggcagcgagaagctgctgcgggtgtgcctgaacctgccctacttcctgcgctacatcaaccgcttccaggatgctgtgctggccaacagcttcttcatcatgcctgccaccgtggctgatgccacagctgtgagaaatggcttccacagcctggtgattgatgtgaccatggccctggacaccctgagcctgcctgtgctggagcccctgaaccccagccggctgcaggatgtgacagtgctgagcctgagctgcctgtatgccggcgtgtctgtggccacctgcatggccatcctgcacgtgggcagcgcccagcaggtgaggacaggcagcaccagcagcaaagaagatgattatgaaagtgatgctgccaccatcgtgcagaagtgcctggagatctatgacatgattggccaggccatcagcagcagccggcgggccggcggggagcactaccagaacttccagctgctgggcgcctggtgcctgctgaacagcctcttcctgatcctgaacctgagccccacagccctggccgacaagggcaaggagaaggaccccctggccgccctgcgggtgcgggacatcctgagcaggaccaaggagggcgtgggcagccccaagctgggccctgggaagggccaccagggctttggagtgctgagcgtcatcctggccaaccacgccatcaagctgctgaccagcctcttccaggacctgcaggtggaggccctgcacaagggctgggagacagatggccccccagctgccctgagcatcatggcccagagcaccagcatccagaggatccagaggctgattgattctgtgcccctgatgaacctgctgctgaccctgctgagcaccagctacaggaaggcctgtgtgctgcagaggcagaggaagggctccatgagcagtgatgccagcgccagcacagacagcaacacctactatgaagatgacttcagcagcacagaggaggacagcagccaggatgatgattctgagcccatcctgggccagtggtttgaggagaccatcagccccagcaaggagaaggccgcccctcctcctcctcctcctcctccacccctggagagcagcccccgggtgaagagccccagcaagcaggcccctggagagaagggcaacatcctggccagcaggaaggaccctgagctgttcctgggcctggccagcaacatcctgaacttcatcaccagctccatgctgaacagcaggaacaacttcatccggaactacctgtctgtgtccctgtctgagcaccacatggccaccctggccagcatcatcaaggaggtggacaaggatggcctgaagggcagcagtgatgaggagtttgctgctgccctgtaccacttcaaccacagcctggtgaccagtgacctgcagagccccaacctgcagaacaccctgctgcagcagctgggcgtggcccccttcagcgagggcccctggcccctgtacatccacccccagagcctgtctgtgctgagccggctgctgctgatctggcagcacaaggccagcgcccagggcgaccctgatgtgcctgagtgcctgaaggtgtgggaccgcttcctgagcaccatgaagcagaatgccctgcagggcgtggtgcccagcgagacagaggacctgaatgtggagcacctgcagatgctgctgctgatcttccacaacttcacagagaccggccggcgggccatcctgagcctgtttgtgcagatcatccaggagctgtctgtgaacatggatgcccagatgagatttgtgcccctcatcctggcccggctgctgctgatctttgactacctgctgcaccagtacagcaaggcccctgtgtacctgtttgagcaggtgcagcacaacctgctgagccccccatttggctgggccagcggcagccaggacagcaacagcagaagagccaccacccccctgtaccacggcttcaaggaggtggaggagaactggagcaagcacttcagcagtgatgctgtgccccacccccgcttctactgtgtgctgagccctgaggcctctgaagatgacctgaaccggctggacagcgtggcctgtgatgtgctcttcagcaagctggtgaagtatgatgagctgtatgctgccctgacagccctgctggccgccggcagccagctggacacagtgcggaggaaagaaaacaagaatgtgacagccctggaggcctgtgccctgcagtactacttcctgatcctgtggaggatcctgggcatcctgccccccagcaagacctacatcaaccagctgtccatgaacagccctgagatgtctgaatgtgacatcctgcacaccctgcgctggagcagccggctgcgcatcagcagctatgtgaactggatcaaggaccacctgatcaagcagggcatgaaggccgagcacgccagcagcctgctggagctggccagcaccaccaagtgcagctctgtgaagtatgatgtggagatcgtggaggagtactttgcccggcagatcagcagcttctgcagcattgactgcaccaccatcctgcagctgcacgagatccccagcctgcagagcatctacaccctggatgctgccatcagcaaggtgcaggtgtccctggatgagcacttcagcaagatggctgctgagacagacccccacaagagcagcgagatcaccaagaacctgctgcctgccaccctgcagctgattgacacctacgccagcttcacccgggcctacctgctgcagaacttcaatgaggagggcaccacagagaagcccagcaaggagaagctgcagggctttgctgctgtgctggccatcggcagcagccgctgcaaggccaacaccctgggccccaccctggtgcagaacctgcccagctctgtgcagacagtgtgtgagagctggaacaacatcaacaccaatgagttccccaacatcggctcctggagaaatgcctttgccaatgacaccatccccagcgagagctacatctctgctgtgcaggccgcccacctgggcaccctgtgcagccagagcctgcccctggccgccagcctgaagcacaccctgctgagcctggtgcggctgactggagacctgattgtgtggagcgatgagatgaaccccccccaggtgatccgcaccctgctgcccctgctgctggagagcagcacagaatctgtggccgagatcagcagcaacagcctggagcgcatcctgggccctgctgagagtgatgagttcctggcccgggtgtatgagaagctgatcaccggctgctacaacatcctggccaaccacgccgaccccaacagcggcctggatgagagcatcctggaggagtgcctgcagtacctggagaagcagctggagagcagccaggccaggaaggccatggaggagttcttcagtgacagcggggagctggtgcagatcatgatggccacagccaatgaaaacctgagcgccaagttctgcaacagagtgctgaagttcttcaccaagctgttccagctgacagagaagagccccaaccccagcctgctgcacctgtgtggcagcctggcccagctggcctgtgtggagcctgtgcggctgcaggcctggctgaccaggatgaccaccagcccccccaaggacagcgaccagctggatgtgatccaggagaaccggcagctgctgcagctgctgaccacctacatcgtgcgggagaacagccaggtgggggagggcgtgtgtgctgtgctgctgggcaccctgacccccatggccacagagatgctggccaatggagatggcaccggcttccctgagctgatggtggtgatggccaccctggccagcgctggccagggcgccggccacctgcagctgcacaatgctgctgtggactggctgagccgctgcaagaagtacctgagccagaagaatgtggtggagaagctgaatgccaacgtgatgcacggcaagcacgtgatgatcctggagtgcacctgccacatcatgagctacctggctgatgtgaccaatgccctgagccagagcaatggccagggccccagccacctgtctgtggatggagaggagcgggccatcgaggtggacagcgactgggtggaggagctggccgtggaggaggaggacagccaggccgaggacagtgatgaggacagcctgtgcaacaagctgtgcaccttcaccatcacccagaaggagttcatgaaccagcactggtaccactgccacacctgcaagatggtggatggagtgggcgtgtgcaccgtgtgtgccaaggtgtgccacaaggaccacgagatctcctatgccaagtatggcagcttcttctgtgactgtggggccaaggaggatggcagctgcctggccctggtgaagaggacccccagcagcggcatgagcagcaccatgaaggagagcgccttccagagcgagccccgcatcagcgagagcctggtgagacatgccagcaccagcagccctgctgacaaggccaaggtgaccatcagtgatggcaaggtggctgatgaggagaagcccaagaagagcagcctgtgcaggacagtggagggctgccgggaggagctgcagaaccaggccaacttctcctttgcccccctggtgctggacatgctgaacttcctgatggatgccatccagaccaacttccagcaggccagcgctgtgggcagcagcagccgggcccagcaggccctgtctgagctgcacacagtggagaaggctgtggagatgacagaccagctgatggtgcccaccctgggcagccaggagggcgcctttgaaaatgtgaggatgaactacagcggggaccagggccagaccatccggcagctgatcagcgcccacgtgctgcggcgggtggccatgtgtgtgctgagcagcccccacggccggcggcagcacctggccgtgtcccatgagaagggcaagatcaccgtgctgcagctgagcgccctgctgaagcaggccgacagcagcaagaggaagctgaccctgacccggctggccagcgcccctgtgcccttcaccgtgctgagcctgaccggcaacccctgcaaggaggactacctggccgtgtgtggcctgaaggactgccacgtgctgaccttcagcagcagcggctctgtgtctgaccacctggtgctgcacccccagctggccaccggcaacttcatcatcaaggctgtgtggctgcccggcagccagacagagctggccatcgtgacagctgactttgtgaagatctatgacctgtgtgtggatgccctgagccccaccttctacttcctgctgcccagcagcaagatcagagatgtgaccttcctgttcaatgaggagggcaagaacatcatcgtcatcatgagcagcgctggctacatctacacccagctgatggaggaggccagcagcgcccagcagggccccttctacgtgaccaacgtgctggagatcaaccacgaggacctgaaggacagcaacagccaggtggccggcggcggcgtgtctgtgtactacagccacgtgctgcagatgctgttcttctcctactgccagggcaagagctttgctgccaccatcagcaggaccaccctggaggtgctgcagctgttccccatcaacatcaagagcagcaatggaggcagcaagaccagccctgccctgtgccagtggagcgaggtgatgaaccaccctggcctggtgtgctgcgtgcagcagaccaccggggtgcccctggtggtgatggtgaagccagacaccttcctgatccaggagatcaagaccctgcctgccaaggccaagatccaggacatggtggccatccgccacacagcctgcaatgagcagcagaggaccaccatgatcctgctgtgtgaagatggcagcctgcgcatctacatggccaacgtggagaacaccagctactggctgcagcccagcctgcagcccagcagcgtcatcagcatcatgaagcctgtgaggaagaggaagacagccaccatcaccaccaggaccagcagccaggtgaccttccccatcgacttctttgagcacaaccagcagctgacagatgtggagtttggaggaaatgacctgctgcaggtgtacaatgcccagcagatcaagcaccggctgaacagcacaggcatgtatgtggccaacaccaagccaggcggcttcaccatcgagatcagcaacaacaacagcaccatggtgatgacaggcatgaggatccagatcggcacccaggccatcgagcgggcccccagctacatcgagatctttggaagaaccatgcagctgaacctgagccgcagccgctggtttgacttccccttcacccgggaggaggccctgcaggccgacaagaagctgaacctcttcatcggggcctctgtggaccctgctggggtgaccatgattgatgctgtgaagatctacggcaagaccaaggagcagtttggctggccagatgagcccccagaggagttccccagcgcctctgtgagcaacatctgccccagcaacctgaaccagagcaatggaactggagacagcgacagcgctgcccccaccaccaccagcggcaccgtgctggagcggctggtggtgagcagcctggaggccctggagagctgctttgctgtgggccccatcatcgagaaggagaggaacaagaatgctgcccaggagctggccaccctgctgctgagcctgcctgccccagcctctgtgcagcagcagagcaagagcctgctggccagcctgcacaccagccgcagcgcctaccacagccacaaggaccaggccctgctgagcaaggctgtgcagtgcctgaacaccagcagcaaggagggcaaggacctggaccctgaggtgttccagaggctggtgatcacagcccggagcatcgccatcatgaggcccaacaacctggtgcacttcacagagagcaagctgccccagatggagacagagggcatggatgagggcaaggagccccagaagcagctggagggggactgctgcagcttcatcacccagctggtgaaccacttctggaagctgcacgccagcaagcccaagaatgccttcctggccccagcctgcctgcccggcctgacccacatcgaggccaccgtgaatgccctggtggacatcatccacggctactgcacctgtgagctggactgcatcaacacagccagcaagatctacatgcagatgctgctgtgcccagaccctgctgtgtccttcagctgcaagcaggccctgatccgggtgctgcggcccaggaacaagagaagacatgtgaccctgcccagcagccccaggagcaacacccccatgggagacaaggatgatgatgatgatgatgatgctgatgagaagatgcagagcagcggcatccccaacggcggccacatccggcaggagagccaggagcagagcgaggtggaccacggggactttgagatggtgtctgagagcatggtgctggagacagcagaaaatgtgaacaacggcaaccccagccccctggaggccctgctggccggggctgagggcttcccccccatgctggacatccccccagatgctgatgatgagaccatggtggagctggccatcgccctgagcctgcagcaggaccagcagggcagcagcagcagcgccctgggcctgcagagcctgggcctgagcggccaggcccccagcagcagcagcctggatgctggcaccctgagtgacaccacagccagcgccccagccagtgatgatgagggcagcacagctgccacagatggcagcaccctgcggaccagccctgctgaccatggaggctctgtgggcagcgagagcggcggcagcgctgtggacagcgtggccggggagcacagcgtgtctggccgcagcagcgcctatggagatgccacagctgagggccaccctgctggccctggctctgtgagcagcagcactggagccatcagcaccaccaccggccaccaggagggagatggcagcgagggggagggggagggggagacagaaggagatgtgcacaccagcaaccggctgcacatggtgcggctgatgctgctggagcggctgctgcagaccctgccccagctgagaaatgtgggcggcgtgcgggccatcccctacatgcaggtgatcctgatgctgaccacagacctggatggagaagatgagaaggacaagggggccctggacaacctgctgagccagctgattgctgagctgggcatggacaagaaggatgtgtccaagaagaatgaaagaagtgccctgaatgaggtgcacctggtggtgatgaggctgctgagcgtcttcatgagcaggaccaagagcggcagcaagagcagcatctgtgagagcagcagcctcatcagcagcgccacagctgctgccctgctgagcagcggggctgtggactactgcctgcacgtgctgaagagcctgctggagtactggaagagccagcagaatgatgaggagcctgtggccaccagccagctgctgaagccccacaccaccagcagccccccagacatgagccccttcttcctgcggcagtatgtgaagggccatgctgctgatgtgtttgaggcctacacccagctgctgacagagatggtgctgcggctgccctaccagatcaagaagatcacagacaccaacagccgcatccccccacctgtgtttgaccacagctggttctacttcctgtctgagtacctgatgatccagcagaccccatttgtgcggcggcaggtgaggaagctgctgctcttcatctgtggcagcaaggagaagtaccggcagctgcgggacctgcacaccctggacagccacgtgcggggcatcaagaagctgctggaggagcagggcatcttcctgcgggcctctgtggtgacagccagcagcggcagcgccctgcagtatgacaccctcatcagcctgatggagcacctgaaggcctgtgccgagattgctgcccagaggaccatcaactggcagaagttctgcatcaaggatgattctgtgctgtacttcctgctgcaggtgtccttcctggtggatgagggcgtgtcccctgtgctgctgcagctgctgagctgtgccctgtgtggcagcaaggtgctggccgccctggccgccagcagcggcagcagcagcgccagcagcagcagcgcccctgtggccgccagcagcggccaggccaccacccagagcaagagcagcaccaagaagagcaagaaggaggagaaggagaaggagaaggatggagagaccagcggcagccaggaggaccagctgtgcacagccctggtgaaccagctgaacaagtttgctgacaaggagaccctcatccagttcctgcgctgcttcctgctggagagcaacagcagctctgtgcgctggcaggcccactgcctgaccctgcacatctacagaaacagcagcaagagccagcaggagctgctgctggacctgatgtggagcatctggccagagctgcctgcctacggcaggaaggccgcccagtttgtggacctgctgggctacttcagcctgaagaccccccagacagagaagaagctgaaggagtacagccagaaggctgtggagatcctgcggacccagaaccacatcctgaccaaccaccccaacagcaacatctacaacaccctgagcggcctggtggagtttgatggctactacctggagagtgacccctgcctggtgtgcaacaaccctgaggtgcccttctgctacatcaagctgagcagcatcaaggtggacacccgctacaccaccacccagcaggtggtgaagctgattggcagccacaccatcagcaaggtgacagtgaagatcggggacctgaagaggaccaagatggtgaggaccatcaacctgtactacaacaacagaacagtgcaggccatcgtggagctgaagaacaagccagcccgctggcacaaggccaagaaggtgcagctgaccccaggccagacagaggtgaagattgacctgcccctgcccatcgtggccagcaacctgatgattgaatttgctgacttctatgagaactaccaggccagcacagagaccctgcagtgcccccgctgcagcgcctctgtgcctgccaaccctggggtgtgtggcaactgtggagaaaatgtgtaccagtgccacaagtgccgcagcatcaactatgatgagaaggaccccttcctgtgcaatgcctgtggcttctgcaagtatgccaggtttgacttcatgctgtatgccaagccctgctgtgctgtggaccccattgaaaatgaggaggacaggaagaaggctgtgagcaacatcaacaccctgctggacaaggctgacagagtgtaccaccagctgatgggccaccggccccagctggagaacctgctgtgcaaggtgaatgaggccgcccctgagaagccccaggatgattctggaacagctgggggcatcagcagcaccagcgcctctgtgaaccgctacatcctgcagctggcccaggagtactgtggggactgcaagaacagctttgatgagctgagcaagatcatccagaaggtgtttgccagcaggaaggagctgctggagtatgacctgcagcagcgggaggccgccaccaagagcagcaggacctctgtgcagcccaccttcaccgccagccagtaccgggccctgtctgtgctgggctgcggccacaccagcagcaccaagtgctacggctgtgccagcgctgtgacagagcactgcatcaccctgctgcgggccctggccaccaacccagccctgcggcacatcctggtgtcccagggcctcatccgggagctgtttgactacaacctgcggagaggagctgctgccatgagggaggaggtgcggcagctgatgtgcctgctgacccgggacaaccctgaggccacccagcagatgaatgacctgatcatcggcaaggtgtccacagccctgaagggccactgggccaacccagacctggccagcagcctgcagtatgagatgctgctgctgacagacagcatcagcaaggaggacagctgctgggagctgcggctgcgctgtgccctgagcctcttcctgatggctgtgaacatcaagacccctgtggtggtggagaacatcaccctgatgtgcctgcgcatcctgcagaagctgatcaagcccccagcccccaccagcaagaagaacaaggatgtgcctgtggaggccctgaccaccgtgaagccctactgcaatgagatccacgcccaggcccagctgtggctgaagagggaccccaaggccagctatgatgcctggaagaagtgcctgcccatccggggcattgatggaaatggcaaggcccccagcaagtctgagctgcggcacctgtacctgacagagaagtatgtgtggcgctggaagcagttcctgagcagaagaggcaagaggaccagccccctggacctgaagctgggccacaacaactggctgcggcaggtgctcttcaccccagccacccaggccgcccggcaggccgcctgcaccatcgtggaggccctggccaccatccccagcaggaagcagcaggtgctggacctgctgaccagctacctggatgagctgagcattgctggggagtgtgccgctgagtacctggccctgtaccagaagctgatcaccagcgcccactggaaggtgtacctggccgcccggggcgtgctgccctacgtgggcaacctgatcaccaaggagatcgcccggctgctggccctggaggaggccaccctgagcacagacctgcagcagggctacgccctgaagagcctgaccggcctgctgagcagctttgtggaggtggagagcatcaagaggcacttcaagagccggctggtgggcaccgtgctgaatggctacctgtgcctgaggaagctggtggtgcagaggaccaagctgattgatgagacccaggacatgctgctggagatgctggaggacatgaccaccggcacagagagcgagaccaaggccttcatggctgtgtgcatcgagacagccaagcgctacaacctggatgactaccgcacccctgtgttcatctttgagcggctgtgcagcatcatctacccagaagaaaatgaggtgacagagttctttgtgaccctggagaaggacccccagcaggaggacttcctgcagggccgcatgcctggcaacccctacagcagcaatgaacctggcatcggccccctgatgagggacatcaagaacaagatctgccaggactgtgacctggtggccctgctggaggatgacagcggcatggagctgctggtgaacaacaagatcatcagcctggacctgcctgtggccgaggtgtacaagaaggtgtggtgcaccaccaatgaaggagagcccatgagaattgtgtacaggatgaggggcctgctgggagatgccacagaggagttcatcgagagcctggacagcaccacagatgaggaggaggatgaggaggaggtgtacaagatggccggcgtgatggcccagtgtggcggcctggagtgcatgctgaaccggctggccggcatccgggacttcaagcagggccgccacctgctgactgtgctgctgaagctgttctcctactgtgtgaaggtgaaggtgaaccggcagcagctggtgaagctggagatgaacaccctgaatgtgatgctgggcaccctgaacctggccctggtggccgagcaggagagcaaggacagcggcggcgctgctgtggccgagcaggtgctgagcatcatggagatcatcctggatgagagcaatgctgagcccctgtctgaggacaagggcaacctgctgctgaccggggacaaggaccagctggtgatgctgctggaccagatcaacagcacctttgtgcgcagcaaccccagcgtgctgcagggcctgctgcgcatcatcccctacctgagctttggagaggtggagaagatgcagatcctggtggagcgcttcaagccctactgcaactttgacaagtatgatgaggaccacagcggagatgacaaggtgttcctggactgcttctgcaagattgctgctggcatcaagaacaacagcaatggccaccagctgaaggacctgatcctgcagaagggcatcacccagaatgccctggactacatgaagaagcacatccccagcgccaagaacctggatgctgacatctggaagaagttcctgagcaggcctgccctgcccttcatcctgcggctgctgcggggcctggccatccagcaccctggcacccaggtgctgattggaacagacagcatccccaacctgcacaagctggagcaggtgtccagtgatgagggcatcggcaccctggccgagaacctgctggaggccctgcgggagcacccagatgtgaacaagaagattgatgctgcccggcgggagaccagggctgagaagaagaggatggccatggccatgaggcagaaggccctgggcaccctgggcatgaccaccaatgagaagggccaggtggtgaccaagacagccctgctgaagcagatggaggagctgattgaggagcccggcctgacctgctgcatctgccgggagggctacaagttccagcccaccaaggtgctgggcatctacaccttcaccaagagggtggccctggaggagatggagaacaagcccaggaagcagcagggctacagcacagtgagccacttcaacatcgtgcactatgactgccacctggccgctgtgcggctggcccggggccgggaggagtgggagagcgctgccctgcagaatgccaacaccaagtgcaatggcctgctgcctgtgtggggcccccacgtgcctgagagcgcctttgccacctgcctggcccggcacaacacctacctgcaggagtgcaccggccagcgggagcccacctaccagctgaacatccatgacatcaagctgctcttcctgcgctttgccatggagcagagcttctctgctgacaccggcggcggcggccgggagagcaacatccacctgatcccctacatcatccacacagtgctgtatgtgctgaacaccacccgggccaccagccgggaggagaagaacctgcagggcttcctggagcagcccaaggagaagtgggtggagagcgcctttgaggtggatggcccctactacttcaccgtgctggccctgcacatcctgcccccagagcagtggagggccaccagggtggagatcctgcggcggctgctggtgaccagccaggcccgggctgtggcccctggaggagccacccggctgacagacaaggctgtgaaggactacagcgcctaccgcagcagcctgctcttctgggccctggtggacctgatctacaacatgttcaagaagcagaccacccccaccgtgggcggcatcgacaccggcagcctggagccctgtgtgtgtgagaaggtgcccaccagcaacacagagggcggctggagctgcagcctggccgagtacatccgccacaatgacatgcccatctatgaggccgctgacaaggccctgaagaccttccaggaggagttcatgcctgtggagaccttcagcgagttcctggatgtggccggcctgctgtctgagatcacagatcctgagagcttcctgaaggacctgctgaacagcgtgccctag

SEQ ID NO: 39722 - DNA, 6177 bp, Artificial Sequence
  Description of Artificial Sequence: Synthetic coding sequence
ctggtgcggctgactggagacctgattgtgtggagcgatgagatgaaccccccccaggtgatccgcaccctgctgcccctgctgctggagagcagcacagaatctgtggccgagatcagcagcaacagcctggagcgcatcctgggccctgctgagagtgatgagttcctggcccgggtgtatgagaagctgatcaccggctgctacaacatcctggccaaccacgccgaccccaacagcggcctggatgagagcatcctggaggagtgcctgcagtacctggagaagcagctggagagcagccaggccaggaaggccatggaggagttcttcagtgacagcggggagctggtgcagatcatgatggccacagccaatgaaaacctgagcgccaagttctgcaacagagtgctgaagttcttcaccaagctgttccagctgacagagaagagccccaaccccagcctgctgcacctgtgtggcagcctggcccagctggcctgtgtggagcctgtgcggctgcaggcctggctgaccaggatgaccaccagcccccccaaggacagcgaccagctggatgtgatccaggagaaccggcagctgctgcagctgctgaccacctacatcgtgcgggagaacagccaggtgggggagggcgtgtgtgctgtgctgctgggcaccctgacccccatggccacagagatgctggccaatggagatggcaccggcttccctgagctgatggtggtgatggccaccctggccagcgctggccagggcgccggccacctgcagctgcacaatgctgctgtggactggctgagccgctgcaagaagtacctgagccagaagaatgtggtggagaagctgaatgccaacgtgatgcacggcaagcacgtgatgatcctggagtgcacctgccacatcatgagctacctggctgatgtgaccaatgccctgagccagagcaatggccagggccccagccacctgtctgtggatggagaggagcgggccatcgaggtggacagcgactgggtggaggagctggccgtggaggaggaggacagccaggccgaggacagtgatgaggacagcctgtgcaacaagctgtgcaccttcaccatcacccagaaggagttcatgaaccagcactggtaccactgccacacctgcaagatggtggatggagtgggcgtgtgcaccgtgtgtgccaaggtgtgccacaaggaccacgagatctcctatgccaagtatggcagcttcttctgtgactgtggggccaaggaggatggcagctgcctggccctggtgaagaggacccccagcagcggcatgagcagcaccatgaaggagagcgccttccagagcgagccccgcatcagcgagagcctggtgagacatgccagcaccagcagccctgctgacaaggccaaggtgaccatcagtgatggcaaggtggctgatgaggagaagcccaagaagagcagcctgtgcaggacagtggagggctgccgggaggagctgcagaaccaggccaacttctcctttgcccccctggtgctggacatgctgaacttcctgatggatgccatccagaccaacttccagcaggccagcgctgtgggcagcagcagccgggcccagcaggccctgtctgagctgcacacagtggagaaggctgtggagatgacagaccagctgatggtgcccaccctgggcagccaggagggcgcctttgaaaatgtgaggatgaactacagcggggaccagggccagaccatccggcagctgatcagcgcccacgtgctgcggcgggtggccatgtgtgtgctgagcagcccccacggccggcggcagcacctggccgtgtcccatgagaagggcaagatcaccgtgctgcagctgagcgccctgctgaagcaggccgacagcagcaagaggaagctgaccctgacccggctggccagcgcccctgtgcccttcaccgtgctgagcctgaccggcaacccctgcaaggaggactacctggccgtgtgtggcctgaaggactgccacgtgctgaccttcagcagcagcggctctgtgtctgaccacctggtgctgcacccccagctggccaccggcaacttcatcatcaaggctgtgtggctgcccggcagccagacagagctggccatcgtgacagctgactttgtgaagatctatgacctgtgtgtggatgccctgagccccaccttctacttcctgctgcccagcagcaagatcagagatgtgaccttcctgttcaatgaggagggcaagaacatcatcgtcatcatgagcagcgctggctacatctacacccagctgatggaggaggccagcagcgcccagcagggccccttctacgtgaccaacgtgctggagatcaaccacgaggacctgaaggacagcaacagccaggtggccggcggcggcgtgtctgtgtactacagccacgtgctgcagatgctgttcttctcctactgccagggcaagagctttgctgccaccatcagcaggaccaccctggaggtgctgcagctgttccccatcaacatcaagagcagcaatggaggcagcaagaccagccctgccctgtgccagtggagcgaggtgatgaaccaccctggcctggtgtgctgcgtgcagcagaccaccggggtgcccctggtggtgatggtgaagccagacaccttcctgatccaggagatcaagaccctgcctgccaaggccaagatccaggacatggtggccatccgccacacagcctgcaatgagcagcagaggaccaccatgatcctgctgtgtgaagatggcagcctgcgcatctacatggccaacgtggagaacaccagctactggctgcagcccagcctgcagcccagcagcgtcatcagcatcatgaagcctgtgaggaagaggaagacagccaccatcaccaccaggaccagcagccaggtgaccttccccatcgacttctttgagcacaaccagcagctgacagatgtggagtttggaggaaatgacctgctgcaggtgtacaatgcccagcagatcaagcaccggctgaacagcacaggcatgtatgtggccaacaccaagccaggcggcttcaccatcgagatcagcaacaacaacagcaccatggtgatgacaggcatgaggatccagatcggcacccaggccatcgagcgggcccccagctacatcgagatctttggaagaaccatgcagctgaacctgagccgcagccgctggtttgacttccccttcacccgggaggaggccctgcaggccgacaagaagctgaacctcttcatcggggcctctgtggaccctgctggggtgaccatgattgatgctgtgaagatctacggcaagaccaaggagcagtttggctggccagatgagcccccagaggagttccccagcgcctctgtgagcaacatctgccccagcaacctgaaccagagcaatggaactggagacagcgacagcgctgcccccaccaccaccagcggcaccgtgctggagagcagcgagacagagagcctgaccaagctggaccggctggtggtgagcagcctggaggccctggagagctgctttgctgtgggccccatcatcgagaaggagaggaacaagaatgctgcccaggagctggccaccctgctgctgagcctgcctgccccagcctctgtgcagcagcagagcaagagcctgctggccagcctgcacaccagccgcagcgcctaccacagccacaaggaccaggccctgctgagcaaggctgtgcagtgcctgaacaccagcagcaaggagggcaaggacctggaccctgaggtgttccagaggctggtgatcacagcccggagcatcgccatcatgaggcccaacaacctggtgcacttcacagagagcaagctgccccagatggagacagagggcatggatgagggcaaggagccccagaagcagctggagggggactgctgcagcttcatcacccagctggtgaaccacttctggaagctgcacgccagcaagcccaagaatgccttcctggccccagcctgcctgcccggcctgacccacatcgaggccaccgtgaatgccctggtggacatcatccacggctactgcacctgtgagctggactgcatcaacacagccagcaagatctacatgcagatgctgctgtgcccagaccctgctgtgtccttcagctgcaagcaggccctgatccgggtgctgcggcccaggaacaagagaagacatgtgaccctgcccagcagccccaggagcaacacccccatgggagacaaggatgatgatgatgatgatgatgctgatgagaagatgcagagcagcggcatccccaatggaggccacatccggcaggagagccaggagcagagcgaggtggaccatggagactttgagatggtgtctgagagcatggtgctggagacagcagaaaatgtgaacaatggaaaccccagccccctggaggccctgctggccggggctgagggcttcccccccatgctggacatccccccagatgctgatgatgagaccatggtggagctggccatcgccctgagcctgcagcaggaccagcaggccccagccagtgatgatgagggcagcacagctgccacagatggcagcaccctgcggaccagccctgctgaccatggaggctctgtgggcagcgagagcggcggcagcgctgtggacagcgtggccggggagcacagcgtgtctggccgcagcagcgcctatggagatgccacagctgagggccaccctgctggccctggctctgtgagcagcagcactggagccatcagcaccaccaccggccaccaggagggagatggcagcgagggggagggggagggggagacagaaggagatgtgcacaccagcaaccggctgcacatggtgcggctgatgctgctggagcggctgctgcagaccctgccccagctgagaaatgtgggcggcgtgcgggccatcccctacatgcaggtgatcctgatgctgaccacagacctggatggagaagatgagaaggacaagggggccctggacaacctgctgagccagctgattgctgagctgggcatggacaagaaggatgtgtccaagaagaatgaaagaagtgccctgaatgaggtgcacctggtggtgatgaggctgctgagcgtcttcatgagcaggaccaagagcggcagcaagagcagcatctgtgagagcagcagcctcatcagcagcgccacagctgctgccctgctgagcagcggggctgtggactactgcctgcacgtgctgaagagcctgctggagtactggaagagccagcagaatgatgaggagcctgtggccaccagccagctgctgaagccccacaccaccagcagccccccagacatgagccccttcttcctgcggcagtatgtgaagggccatgctgctgatgtgtttgaggcctacacccagctgctgacagagatggtgctgcggctgccctaccagatcaagaagatcacagacaccaacagccgcatccccccacctgtgtttgaccacagctggttctacttcctgtctgagtacctgatgatccagcagaccccatttgtgcggcggcaggtgaggaagctgctgctcttcatctgtggcagcaaggagaagtaccggcagctgcgggacctgcacaccctggacagccacgtgcggggcatcaagaagctgctggaggagcagggcatcttcctgcgggcctctgtggtgacagccagcagcggcagcgccctgcagtatgacaccctcatcagcctgatggagcacctgaaggcctgtgccgagattgctgcccagaggaccatcaactggcagaagttctgcatcaaggatgattctgtgctgtacttcctgctgcaggtgtccttcctggtggatgagggcgtgtcccctgtgctgctgcagctgctgagctgtgccctgtgtggcagcaaggtgctggccgccctggccgccagcagcggcagcagcagcgccagcagcagcagcgcccctgtggccgccagcagcggccaggccaccacccagagcaagagcagcaccaagaagagcaagaagtag

SEQ ID NO: 39723 - DNA, 5019 bp, Artificial Sequence
  Description of Artificial Sequence: Synthetic coding sequence
cgcttcctgagcaccatgaagcagaatgccctgcagggcgtggtgcccagcgagacagaggacctgaatgtggagcacctgcagatgctgctgctgatcttccacaacttcacagagaccggccggcgggccatcctgagcctgtttgtgcagatcatccaggagctgtctgtgaacatggatgcccagatgagatttgtgcccctcatcctggcccggctgctgctgatctttgactacctgctgcaccagtacagcaaggcccctgtgtacctgtttgagcaggtgcagcacaacctgctgagccccccatttggctgggccagcggcagccaggacagcaacagcagaagagccaccacccccctgtaccacggcttcaaggaggtggaggagaactggagcaagcacttcagcagtgatgctgtgccccacccccgcttctactgtgtgctgagccctgaggcctctgaagatgacctgaaccggctggacagcgtggcctgtgatgtgctcttcagcaagctggtgaagtatgatgagctgtatgctgccctgacagccctgctggccgccggcagccagctggacacagtgcggaggaaagaaaacaagaatgtgacagccctggaggcctgtgccctgcagtactacttcctgatcctgtggaggatcctgggcatcctgccccccagcaagacctacatcaaccagctgtccatgaacagccctgagatgtctgaatgtgacatcctgcacaccctgcgctggagcagccggctgcgcatcagcagctatgtgaactggatcaaggaccacctgatcaagcagggcatgaaggccgagcacgccagcagcctgctggagctggccagcaccaccaagtgcagctctgtgaagtatgatgtggagatcgtggaggagtactttgcccggcagatcagcagcttctgcagcattgactgcaccaccatcctgcagctgcacgagatccccagcctgcagagcatctacaccctggatgctgccatcagcaaggtgcaggtgtccctggatgagcacttcagcaagatggctgctgagacagacccccacaagagcagcgagatcaccaagaacctgctgcctgccaccctgcagctgattgacacctacgccagcttcacccgggcctacctgctgcagaacttcaatgaggagggcaccacagagaagcccagcaaggagaagctgcagggctttgctgctgtgctggccatcggcagcagccgctgcaaggccaacaccctgggccccaccctggtgcagaacctgcccagctctgtgcagacagtgtgtgagagctggaacaacatcaacaccaatgagttccccaacatcggctcctggagaaatgcctttgccaatgacaccatccccagcgagagctacatctctgctgtgcaggccgcccacctgggcaccctgtgcagccagagcctgcccctggccgccagcctgaagcacaccctgctgagcctggtgcggctgactggagacctgattgtgtggagcgatgagatgaaccccccccaggtgatccgcaccctgctgcccctgctgctggagagcagcacagaatctgtggccgagatcagcagcaacagcctggagcgcatcctgggccctgctgagagtgatgagttcctggcccgggtgtatgagaagctgatcaccggctgctacaacatcctggccaaccacgccgaccccaacagcggcctggatgagagcatcctggaggagtgcctgcagtacctggagaagcagctggagagcagccaggccaggaaggccatggaggagttcttcagtgacagcggggagctggtgcagatcatgatggccacagccaatgaaaacctgagcgccaagttctgcaacagagtgctgaagttcttcaccaagctgttccagctgacagagaagagccccaaccccagcctgctgcacctgtgtggcagcctggcccagctggcctgtgtggagcctgtgcggctgcaggcctggctgaccaggatgaccaccagcccccccaaggacagcgaccagctggatgtgatccaggagaaccggcagctgctgcagctgctgaccacctacatcgtgcgggagaacagccaggtgggggagggcgtgtgtgctgtgctgctgggcaccctgacccccatggccacagagatgctggccaatggagatggcaccggcttccctgagctgatggtggtgatggccaccctggccagcgctggccagggcgccggccacctgcagctgcacaatgctgctgtggactggctgagccgctgcaagaagtacctgagccagaagaatgtggtggagaagctgaatgccaacgtgatgcacggcaagcacgtgatgatcctggagtgcacctgccacatcatgagctacctggctgatgtgaccaatgccctgagccagagcaatggccagggccccagccacctgtctgtggatggagaggagcgggccatcgaggtggacagcgactgggtggaggagctggccgtggaggaggaggacagccaggccgaggacagtgatgaggacagcctgtgcaacaagctgtgcaccttcaccatcacccagaaggagttcatgaaccagcactggtaccactgccacacctgcaagatggtggatggagtgggcgtgtgcaccgtgtgtgccaaggtgtgccacaaggaccacgagatctcctatgccaagtatggcagcttcttctgtgactgtggggccaaggaggatggcagctgcctggccctggtgaagaggacccccagcagcggcatgagcagcaccatgaaggagagcgccttccagagcgagccccgcatcagcgagagcctggtgagacatgccagcaccagcagccctgctgacaaggccaaggtgaccatcagtgatggcaaggtggctgatgaggagaagcccaagaagagcagcctgtgcaggacagtggagggctgccgggaggagctgcagaaccaggccaacttctcctttgcccccctggtgctggacatgctgaacttcctgatggatgccatccagaccaacttccagcaggccagcgctgtgggcagcagcagccgggcccagcaggccctgtctgagctgcacacagtggagaaggctgtggagatgacagaccagctgatggtgcccaccctgggcagccaggagggcgcctttgaaaatgtgaggatgaactacagcggggaccagggccagaccatccggcagctgatcagcgcccacgtgctgcggcgggtggccatgtgtgtgctgagcagcccccacggccggcggcagcacctggccgtgtcccatgagaagggcaagatcaccgtgctgcagctgagcgccctgctgaagcaggccgacagcagcaagaggaagctgaccctgacccggctggccagcgcccctgtgcccttcaccgtgctgagcctgaccggcaacccctgcaaggaggactacctggccgtgtgtggcctgaaggactgccacgtgctgaccttcagcagcagcggctctgtgtctgaccacctggtgctgcacccccagctggccaccggcaacttcatcatcaaggctgtgtggctgcccggcagccagacagagctggccatcgtgacagctgactttgtgaagatctatgacctgtgtgtggatgccctgagccccaccttctacttcctgctgcccagcagcaagatcagagatgtgaccttcctgttcaatgaggagggcaagaacatcatcgtcatcatgagcagcgctggctacatctacacccagctgatggaggaggccagcagcgcccagcagggccccttctacgtgaccaacgtgctggagatcaaccacgaggacctgaagcaggacagcaacagccaggtggccggcggcggcgtgtctgtgtactacagccacgtgctgcagatgctgttcttctcctactgccagggcaagagctttgctgccaccatcagcaggaccaccctggaggtgctgcagctgttccccatcaacatcaagagcagcaatggaggcagcaagaccagccctgccctgtgccagtggagcgaggtgatgaaccaccctggcctggtgtgctgcgtgcagcagaccactggagtgcccctggtggtgatggtgaagccagacaccttcctgatccaggagatcaagaccctgcctgccaaggccaagatccaggacatggtggccatccgccacacagcctgcaatgagcagcagaggaccaccatgatcctgctgtgtgaagatggcagcctgcgcatctacatggccaacgtggagaacaccagctactggctgcagcccagcctgcagcccagcagcgtcatcagcatcatgaagcctgtgaggaagaggaagacagccaccatcaccaccaggaccagcagccaggtgaccttccccatcgacttctttgagcacaaccagcagctgacagatgtggagtttggaggaaatgacctgctgcaggtgtacaatgcccagcagatcaagcaccggctgaacagcacaggcatgtatgtggccaacaccaagccaggcggcttcaccatcgagatcagcaacaacaacagcaccatggtgatgacaggcatgaggatccagatcggcacccaggccatcgagcgggcccccagctacatcgagatcttcggccgcaccatgcagctgaacctgagccgcagccgctggtttgacttccccttcacccgggaggaggccctgcaggccgacaagaagctgaacctcttcagcgagagccccaccccaggagctgacagcgtgctgattgtgacagccaagctgggcgccaccggcctgtggctgagcaacatcctgggcagcctgcacagcgctgacttctctgtgctgagcagcggcaactttgagctgcacctgatgtactag

SEQ ID NO: 39724 - DNA, 2955 bp, Artificial Sequence
  Description of Artificial Sequence: Synthetic coding sequence
gacttccccttcacccgggaggaggccctgcaggccgacaagaagctgaacctcttcatcggggcctctgtggaccctgctggggtgaccatgattgatgctgtgaagatctacggcaagaccaaggagcagtttggctggccagatgagcccccagaggagttccccagcgcctctgtgagcaacatctgccccagcaacctgaaccagagcaatggcaccggggacagcgacagcgctgcccccaccaccaccagcggcaccgtgctggagcggctggtggtgagcagcctggaggccctggagagctgctttgctgtgggccccatcatcgagaaggagaggaacaagaatgctgcccaggagctggccaccctgctgctgagcctgcctgccccagcctctgtgcagcagcagagcaagagcctgctggccagcctgcacaccagccgcagcgcctaccacagccacaaggaccaggccctgctgagcaaggctgtgcagtgcctgaacaccagcagcaaggagggcaaggacctggaccctgaggtgttccagaggctggtgatcacagcccggagcatcgccatcatgaggcccaacaacctggtgcacttcacagagagcaagctgccccagatggagacagactgcttcttcccccgctgtgcctgctggagcctgggcatcgtgggcatcctgattggagcccccctggagacccccagccctgagggcatggatgagggcaaggagccccagaagcagctggagggggactgctgcagcttcatcacccagctggtgaaccacttctggaagctgcacgccagcaagcccaagaatgccttcctggccccagcctgcctgcccggcctgacccacatcgaggccaccgtgaatgccctggtggacatcatccacggctactgcacctgtgagctggactgcatcaacacagccagcaagatctacatgcagatgctgctgtgcccagaccctgctgtgtccttcagctgcaagcaggccctgatccgggtgctgcggcccaggaacaagagaagacatgtgaccctgcccagcagccccaggagcaacacccccatgggagacaaggatgatgatgatgatgatgatgctgatgagaagatgcagagcagcggcatccccaatggaggccacatccggcaggagagccaggagcagagcgaggtggaccatggagactttgagatggtgtctgagagcatggtgctggagacagcagaaaatgtgaacaatggaaaccccagccccctggaggccctgctggccggggctgagggcttcccccccatgctggacatccccccagatgctgatgatgagaccatggtggagctggccatcgccctgagcctgcagcaggaccagcaggccccagccagtgatgatgagggcagcacagctgccacagatggcagcaccctgcggaccagccctgctgaccatggaggctctgtgggcagcgagagcggcggcagcgctgtggacagcgtggccggggagcacagcgtgtctggccgcagcagcgcctatggagatgccacagctgagggccaccctgctggccctggctctgtgagcagcagcactggagccatcagcaccaccaccggccaccaggagggagatggcagcgagggggagggggagggggagacagaaggagatgtgcacaccagcaaccggctgcacatggtgcggctgatgctgctggagcggctgctgcagaccctgccccagctgagaaatgtgggcggcgtgcgggccatcccctacatgcaggtgatcctgatgctgaccacagacctggatggagaagatgagaaggacaagggggccctggacaacctgctgagccagctgattgctgagctgggcatggacaagaaggatgtgtccaagaagaatgaaagaagtgccctgaatgaggtgcacctggtggtgatgaggctgctgagcgtcttcatgagcaggaccaagagcggcagcaagagcagcatctgtgagagcagcagcctcatcagcagcgccacagctgctgccctgctgagcagcggggctgtggactactgcctgcacgtgctgaagagcctgctggagtactggaagagccagcagaatgatgaggagcctgtggccaccagccagctgctgaagccccacaccaccagcagccccccagacatgagccccttcttcctgcggcagtatgtgaagggccatgctgctgatgtgtttgaggcctacacccagctgctgacagagatggtgctgcggctgccctaccagatcaagaagatcacagacaccaacagccgcatccccccacctgtgtttgaccacagctggttctacttcctgtctgagtacctgatgatccagcagaccccatttgtgcggcggcaggtgaggaagctgctgctcttcatctgtggcagcaaggagaagtaccggcagctgcgggacctgcacaccctggacagccacgtgcggggcatcaagaagctgctggaggagcagggcatcttcctgcgggcctctgtggtgacagccagcagcggcagcgccctgcagtatgacaccctcatcagcctgatggagcacctgaaggcctgtgccgagattgctgcccagaggaccatcaactggcagaagttctgcatcaaggatgattctgtgctgtacttcctgctgcaggtgtccttcctggtggatgagggcgtgtcccctgtgctgctgcagctgctgagctgtgccctgtgtggcagcaaggtgctggccgccctggccgccagcagcggcagcagcagcgccagcagcagcagcgcccctgtggccgccagcagcggccaggccaccacccagagcaagagcagcaccaagaagagcaagaaggaggagaaggagtag

SEQ ID NO: 39725 - DNA, 2121 bp, Artificial Sequence
  Description of Artificial Sequence: Synthetic coding sequence
atgagaattgtgtacaggatgaggggcctgctgggagatgccacagaggagttcatcgagagcctggacagcaccacagatgaggaggaggatgaggaggaggtgtacaagatggccggcgtgatggcccagtgtggcggcctggagtgcatgctgaaccggctggccggcatccgggacttcaagcagggccgccacctgctgactgtgctgctgaagctgttctcctactgtgtgaaggtgaaggtgaaccggcagcagctggtgaagctggagatgaacaccctgaatgtgatgctgggcaccctgaacctgggcaacctgctgctgactggagacaaggaccagctggtgatgctgctggaccagatcaacagcacctttgtgcgcagcaaccccagcgtgctgcagggcctgctgcgcatcatcccctacctgagctttggagaggtggagaagatgcagatcctggtggagcgcttcaagccctactgcaactttgacaagtatgatgaggaccacagcggagatgacaaggtgttcctggactgcttctgcaagattgctgctggcatcaagaacaacagcaatggccaccagctgaaggacctgatcctgcagaagggcatcacccagaatgccctggactacatgaagaagcacatccccagcgccaagaacctggatgctgacatctggaagaagttcctgagcaggcctgccctgcccttcatcctgcggctgctgcggggcctggccatccagcaccctggcacccaggtgctgattggaacagacagcatccccaacctgcacaagctggagcaggtgtccagtgatgagggcatcggcaccctggccgagaacctgctggaggccctgcgggagcacccagatgtgaacaagaagattgatgctgcccggcgggagaccagggctgagaagaagaggatggccatggccatgaggcagaaggccctgggcaccctgggcatgaccaccaatgagaagggccaggtggtgaccaagacagccctgctgaagcagatggaggagctgattgaggagcccggcctgacctgctgcatctgccgggagggctacaagttccagcccaccaaggtgctgggcatctacaccttcaccaagagggtggccctggaggagatggagaacaagcccaggaagcagcagggctacagcacagtgagccacttcaacatcgtgcactatgactgccacctggccgctgtgcggctggcccggggccgggaggagtgggagagcgctgccctgcagaatgccaacaccaagtgcaatggcctgctgcctgtgtggggcccccacgtgcctgagagcgcctttgccacctgcctggcccggcacaacacctacctgcaggagtgcaccggccagcgggagcccacctaccagctgaacatccatgacatcaagctgctcttcctgcgctttgccatggagcagagcttctctgctgacacaggaggcggcggccgggagagcaacatccacctgatcccctacatcatccacacagtgctgtatgtgctgaacaccacccgggccaccagccgggaggagaagaacctgcagggcttcctggagcagcccaaggagaagtgggtggagagcgcctttgaggtggatggcccctactacttcaccgtgctggccctgcacatcctgcccccagagcagtggagggccaccagggtggagatcctgcggcggctgctggtgaccagccaggcccgggctgtggcccctgggggcgccacccggctgacagacaaggctgtgaaggactacagcgcctaccgcagcagcctgctcttctgggccctggtggacctgatctacaacatgttcaagaaggtgcccaccagcaacacagagggcggctggagctgcagcctggccgagtacatccgccacaatgacatgcccatctatgaggccgctgacaaggccctgaagaccttccaggaggagttcatgcctgtggagaccttcagcgagttcctggatgtggccggcctgctgtctgagatcacagatcctgagagcttcctgaaggacctgctgaacagcgtgccctag

SEQ ID NO: 39726 - DNA, 2544 bp, Artificial Sequence
  Description of Artificial Sequence: Synthetic coding sequence
atggctgtgtgcattgaaacagccaagcgctacaacctggatgactaccgcacccctgtgttcatctttgagcggctgtgcagcatcatctacccagaggagaatgaggtgacagagttctttgtgaccctggagaaggacccccagcaggaggacttcctgcagggccgcatgcctggcaacccctacagcagcaatgagcccggcatcggccccctgatgagggacatcaagaacaagatctgccaggactgtgacctggtggccctgctggaggatgattctggcatggagggggagcccatgagaattgtgtacaggatgaggggcctgctgggagatgccacagaggagttcatcgagagcctggacagcaccacagatgaggaggaggatgaggaggaggtgtacaagatggccggcgtgatggcccagtgtggcggcctggagtgcatgctgaaccggctggccggcatccgggacttcaagcagggccgccacctgctgactgtgctgctgaagctgttctcctactgtgtgaaggtgaaggtgaaccggcagcagctggtgaagctggagatgaacaccctgaatgtgatgctgggcaccctgaacctggccctggtggccgagcaggagagcaaggacagcggcggcgctgctgtggccgagcaggtgctgagcatcatggagatcatcctggatgagagcaatgctgagcccctgtctgaggacaagggcaacctgctgctgaccggggacaaggaccagctggtgatgctgctggaccagatcaacagcacctttgtgcgcagcaaccccagcgtgctgcagggcctgctgcgcatcatcccctacctgagctttggagaggtggagaagatgcagatcctggtggagcgcttcaagccctactgcaactttgacaagtatgatgaggaccacagcggagatgacaaggtgttcctggactgcttctgcaagattgctgctggcatcaagaacaacagcaatggccaccagctgaaggacctgatcctgcagaagggcatcacccagaatgccctggactacatgaagaagcacatccccagcgccaagaacctggatgctgacatctggaagaagttcctgagcaggcctgccctgcccttcatcctgcggctgctgcggggcctggccatccagcaccctggcacccaggtgctgattggaacagacagcatccccaacctgcacaagctggagcaggtgtccagtgatgagggcatcggcaccctggccgagaacctgctggaggccctgcgggagcacccagatgtgaacaagaagattgatgctgcccggcgggagaccagggctgagaagaagaggatggccatggccatgaggcagaaggccctgggcaccctgggcatgaccaccaatgagaagggccaggtggtgaccaagacagccctgctgaagcagatggaggagctgattgaggagcccggcctgacctgctgcatctgccgggagggctacaagttccagcccaccaaggtgctgggcatctacaccttcaccaagagggtggccctggaggagatggagaacaagcccaggaagcagcagggctacagcacagtgagccacttcaacatcgtgcactatgactgccacctggccgctgtgcggctggcccggggccgggaggagtgggagagcgctgccctgcagaatgccaacaccaagtgcaatggcctgctgcctgtgtggggcccccacgtgcctgagagcgcctttgccacctgcctggcccggcacaacacctacctgcaggagtgcaccggccagcgggagcccacctaccagctgaacatccatgacatcaagctgctcttcctgcgctttgccatggagcagagcttctctgctgacaccggcggcggcggccgggagagcaacatccacctgatcccctacatcatccacacagtgctgtatgtgctgaacaccacccgggccaccagccgggaggagaagaacctgcagggcttcctggagcagcccaaggagaagtgggtggagagcgcctttgaggtggatggcccctactacttcaccgtgctggccctgcacatcctgcccccagagcagtggagggccaccagggtggagatcctgcggcggctgctggtgaccagccaggcccgggctgtggcccctggaggagccacccggctgacagacaaggctgtgaaggactacagcgcctaccgcagcagcctgctcttctgggccctggtggacctgatctacaacatgttcaagaaggtgcccaccagcaacacagaaggaggctggagctgcagcctggccgagtacatccgccacaatgacatgcccatctatgaagctgctgacaaggccctgaagaccttccaggaggagttcatgcctgtggagaccttcagcgagttcctggatgtggccggcctgctgtctgagatcacagatcctgagagcttcctgaaggacctgctgaacagcgtgccctag

SEQ ID NO: 39727 - DNA, 3957 bp, Artificial Sequence
  Description of Artificial Sequence: Synthetic coding sequence
atgtctgggggcgccagcgccaccggcccccggcggggccccccaggcctggaggacaccaccagcaagaagaagcagaaggaccgggccaaccaggagagcaaggatggagaccccaggaaggagaccggcagccgctacgtggcccaggccggcctggagcccctggccagcggggaccccagcgccagcgccagccacgccgccggcatcaccggcagccgccacaggaccaggctcttcttccccagcagcagcggcagcgccagcaccccccaggaggagcagaccaaggagggcgcctgtgaggacccccatgacctgctggccacccccaccccagagctgctgctggactggaggcagagcgctgaggaggtgattgtgaagctgcgggtgggcgtgggccccctgcagctggaggatgtggatgctgccttcacagacacagactgtgtggtgcgctttgctgggggccagcagtggggcggcgtcttctacgccgagatcaagagcagctgtgccaaggtgcagaccaggaagggcagcctgctgcacctgaccctgcccaagaaggtgcccatgctgacctggcccagcctgctggtggaggctgatgagcagctgtgcatcccccccctgaacagccagacctgcctgctgggcagcgaggagaacctggcccccctggccggggagaaggctgtgcccccaggaaatgaccctgtgtccccagccatggtgcgcagcagaaatcctgggaaggatgactgtgccaaggaggagatggctgtggccgcagatgctgccaccctggtggatgagcctgagagcatggtgaacctggcctttgtgaagaatgacagctatgagaagggccctgacagcgtggtggtgcacgtgtatgtgaaggagatctgccgggacaccagccgggtgctcttccgggagcaggacttcaccctcatcttccagaccagagatggcaacttcctgcggctgcaccctggctgcggcccccacaccaccttccgctggcaggtgaagctgaggaacctgattgagcctgagcagtgcaccttctgcttcaccgccagcagaattgacatctgcctgaggaagaggcagagccagcgctggggcggcctggaggccccagctgcccgggtgggcggggccaaggtggccgtgcccaccggccccacccccctggacagcaccccacctggaggagccccccaccccctgaccggccaggaggaggcccgggctgtggagaaggacaagagcaaggcccggtctgaggacaccggcctggacagcgtggccaccaggacccccatggagcacgtgacccccaagccagagacccacctggccagccccaagcccacctgcatggtgccccccatgccccacagccctgtgtctggggacagcgtggaggaggaggaggaggaggagaagaaggtgtgcctgcccggcttcaccggcctggtgaacctgggcaacacctgcttcatgaacagcgtcatccagagcctgagcaacacccgggagctgcgggacttcttccatgacaggagctttgaggccgagatcaactacaacaaccccctgggcaccggcggccgcctggccatcggctttgctgtgctgctgcgggccctgtggaagggcacccaccacgccttccagcccagcaagctgaaggccatcgtggccagcaaggccagccagttcaccggctacgcccagcatgatgcccaggagttcatggccttcctgctggatggcctgcacgaggacctgaaccgcatccagaacaagccctacacagaaacagtggacagtgatggccgcccagatgaggtggtggccgaggaggcctggcagaggcacaagatgagaaatgacagcttcatcgtggacctcttccagggccagtacaagagcaagctggtgtgccctgtgtgtgccaaggtgtccatcacctttgaccccttcctgtacctgcctgtgcccctgccccagaagcagaaggtgctgcccgtcttctactttgcccgggagccccacagcaagcccatcaagttcctggtgtctgtgtccaaggagaacagcacagccagcgaggtgctggacagcctgagccagagcgtgcacgtgaagccagagaacctgcggctggccgaggtgatcaagaaccgcttccacagggtcttcctgcccagccacagcctggacacagtgagccccagcgacaccctgctgtgctttgagctgctgagcagcgagctggccaaggagcgggtggtggtgctggaggtgcagcagaggccccaggtgcccagcgtgcccatcagcaaatgtgccgcctgccagaggaagcagcagagtgaagatgagaagctgaagcgctgcacccgctgctacagagtgggctactgcaaccagctgtgccagaagacccactggccagaccacaagggcctgtgcaggcctgagaacatcggctaccccttcctggtgtctgtgcctgccagccggctgacctacgcccggctggcccagctgctggagggctacgcccgctacagcgtgtctgtgttccagccccccttccagcccggccgcatggccctggagagccagagccctggctgcaccaccctgctgagcacaggcagcctggaggccggggacagcgagcgggaccccatccagcccccagagctgcagctggtgacccccatggccgagggggacaccggcctgccccgggtgtgggccgccccagaccggggccctgtgcccagcaccagcggcatcagcagcgagatgctggccagcggccccatcgaggtgggcagcctgcctgctggggagcgggtgtccaggcctgaggccgctgtgcccggctaccagcaccccagcgaggccatgaatgcccacaccccccagttcttcatctacaagattgacagcagcaaccgggagcagaggctggaggacaagggggacacccccctggagctgggagatgactgcagcctggccctggtgtggaggaacaatgaaaggctgcaggagtttgtgctggtggccagcaaggagctggagtgtgccgaggaccccggcagcgctggggaggccgcccgggccggccacttcaccctggaccagtgcctgaacctcttcaccaggcctgaggtgctggcccctgaggaggcctggtactgcccccagtgcaagcagcaccgggaggccagcaagcagctgctgctgtggaggctgcccaacgtgctgattgtgcagctgaagcgcttctccttccgctccttcatctggagggacaagatcaatgacctggtggagttccctgtgaggaacctggacctgagcaagttctgcatcggccagaaggaggagcagctgcccagctatgacctgtatgctgtgatcaaccactacggcggcatgattggaggccactacacagcctgtgcccggctgcccaatgacaggagcagccagaggagtgatgtgggctggaggctgtttgatgacagcacagtgaccaccgtggatgagagccaggtggtgaccaggtatgcctacgtgctcttctacagaagaagaaacagccctgtggagaggcctccccgggccggccacagcgagcaccacccagacctgggccctgctgctgaggccgccgccagccaggccagccgcatctggcaggagctggaggccgaggaggagcctgtgcctgagggcagcggccccctgggcccctggggcccccaggactgggtgggccccctgccccggggccccaccaccccagatgagggctgcctgcgctactttgtgctgggcaccgtggccgccctggtggccctggtgctgaatgtgttctaccccctggtgtcccagagccgctggaggtag

SEQ ID NO: 39728 - DNA, 1548 bp, Artificial Sequence
  Description of Artificial Sequence: Synthetic coding sequence
atgtctgggggcgccagcgccaccggcccccggcggggccccccaggcctggaggacaccaccagcaagaagaagcagaaggaccgggccaaccaggagagcaaggatggagaccccaggaaggagaccggcagccgctacgtggcccaggccggcctggagcccctggccagcggggaccccagcgccagcgccagccacgccgccggcatcaccggcagccgccacaggaccaggctcttcttccccagcagcagcggcagcgccagcaccccccaggaggagcagaccaaggaggagctgctgctggactggaggcagagcgctgaggaggtgattgtgaagctgcgggtgggcgtgggccccctgcagctggaggatgtggatgctgccttcacagacacagactgtgtggtgcgctttgctgggggccagcagtggggcggcgtcttctatgcagagatcaagagcagctgtgccaaggtgcagaccaggaagggcagcctgctgcacctgaccctgcccaagaaggtgcccatgctgacctggcccagcctgctgaagaagcccctgggcacccaggagctggtgcccggcctgcgctgccaggagaatggccaggagctgagccccatcgccctggagcccggccctgagccccaccgggccaagcaggaggccaggaaccagaagagggcccagggccgcggggaggtgggcgctggggccggccctggggcccaggccggccccagcgccaagagagctgtgcacctgtgccggggcccagaaggagatggcagcagagatgaccccggccccagaggagatgcccccccatttgtggccgaccctgccacccaggtggaggctgatgagcagctgtgcatcccccccctgaacagccagacctgcctgctgggcagcgaggagaacctggcccccctggccggggagaaggctgtgcccccaggaaatgaccctgtgtccccagccatggtgcgcagcagaaatcctgggaaggatgactgtgccaaggaggagatggctgtggccgcagatgctgccaccctggtggatgagcctgagagcatggtgaacctggcctttgtgaagaatgacagctatgagaagggccctgacagcgtggtggtgcacgtgtatgtgaaggagatctgccgggacaccagccgggtgctcttccgggagcaggacttcaccctcatcttccagaccagagatggcaacttcctgcggctgcaccctggctgcggcccccacaccaccttccgctggcaggtgaagctgaggaacctgattgagcctgagcagtgcaccttctgcttcaccgccagcagaattgacatctgcctgaggaagaggcagagccagcgctggggccctgggggccctggctgcacccgctgcagcggctggtgcaagggctgcagagctgacaggagcaaccccagcggcttcaaccccacccggcgctgcagccccccaccagacaggcctgggggcggccctggctgtggggagggctag

SEQ ID NO: 39729 - DNA, 4155 bp, Artificial Sequence
  Description of Artificial Sequence: Synthetic coding sequence
atgtctgggggcgccagcgccaccggcccccggcggggccccccaggcctggaggacaccaccagcaagaagaagcagaaggaccgggccaaccaggagagcaaggatggagaccccaggaaggagaccggcagccgctacgtggcccaggccggcctggagcccctggccagcggggaccccagcgccagcgccagccacgccgccggcatcaccggcagccgccacaggaccaggctcttcttccccagcagcagcggcagcgccagcaccccccaggaggagcagaccaaggagggcgcctgtgaggacccccatgacctgctggccacccccaccccagagctgctgctggactggaggcagagcgctgaggaggtgattgtgaagctgcgggtgggcgtgggccccctgcagctggaggatgtggatgctgccttcacagacacagactgtgtggtgcgctttgctgggggccagcagtggggcggcgtcttctacgccgagatcaagagcagctgtgccaaggtgcagaccaggaagggcagcctgctgcacctgaccctgcccaagaaggtgcccatgctgacctggcccagcctgctgaagaagcccctgggcacccaggagctggtgcccggcctgcgctgccaggagaatggccaggagctgagccccatcgccctggagcccggccctgagccccaccgggccaagcaggaggccaggaaccagaagagggcccagggccgcggggaggtgggcgctggggccggccctggggcccaggccggccccagcgccaagagagctgtgcacctgtgccggggcccagaaggagatggcagcagagatgatcctggccccagaggagatgcccccccatttgtggccgaccctgccacccaggtggaggctgatgagcagctgtgcatcccccccctgaacagccagacctgcctgctgggcagcgaggagaacctggcccccctggccggggagaaggctgtgcccccaggaaatgaccctgtgtccccagccatggtgcgcagcaggaaccctgggaaggatgactgtgccaaggaggagatggctgtggccgcagatgctgccaccctggtggatgagcctgagagcatggtgaacctggcctttgtgaagaatgacagctatgaaaaaggaccagattctgtggtggtgcacgtgtatgtgaaggagatctgccgggacaccagccgggtgctcttccgggagcaggacttcaccctcatcttccagaccagagatggcaacttcctgcggctgcaccctggctgcggcccccacaccaccttccgctggcaggtgaagctgaggaacctgattgagcctgagcagtgcaccttctgcttcaccgccagcagaattgacatctgcctgaggaagaggcagagccagcgctggggcggcctggaggccccagctgcccggggagctgtgggcggggccaaggtggccgtgcccaccggccccacccccctggacagcaccccacctgggggcgccccccaccccctgaccggccaggaggaggcccgggctgtggagaaggacaagagcaaggcccggtctgaggacaccggcctggacagcgtggccaccaggacccccatggagcacgtgacccccaagccagagacccacctggccagccccaagcccacctgcatggtgccccccatgccccacagccctgtgtctggggacagcgtggaggaggaggaggaggaggagaagaaggtgtgcctgcccggcttcaccggcctggtgaacctgggcaacacctgcttcatgaacagcgtcatccagagcctgagcaacacccgggagctgcgggacttcttccatgacaggagctttgaagctgagatcaactacaacaaccccctgggcactggaggccgcctggccatcggctttgctgtgctgctgcgggccctgtggaagggcacccaccacgccttccagcccagcaagctgaaggccatcgtggccagcaaggccagccagttcaccggctacgcccagcatgatgcccaggagttcatggccttcctgctggatggcctgcacgaggacctgaaccgcatccagaacaagccctacacagagaccgtggacagtgatggccgcccagatgaggtggtggccgaggaggcctggcagaggcacaagatgagaaatgacagcttcatcgtggacctcttccagggccagtacaagagcaagctggtgtgccctgtgtgtgccaaggtgtccatcacctttgaccccttcctgtacctgcctgtgcccctgccccagaagcagaaggtgctgcctgtgttctactttgcccgggagccccacagcaagcccatcaagttcctggtgtctgtgtccaaagaaaacagcacagccagcgaggtgctggacagcctgagccagagcgtgcacgtgaagccagagaacctgcggctggccgaggtgatcaagaaccgcttccacagggtcttcctgcccagccacagcctggacacagtgagccccagcgacaccctgctgtgctttgagctgctgagcagcgagctggccaaggagcgggtggtggtgctggaggtgcagcagaggccccaggtgcccagcgtgcccatcagcaaatgtgccgcctgccagaggaagcagcagagtgaagatgagaagctgaagcgctgcacccgctgctacagagtgggctactgcaaccagctgtgccagaagacccactggccagaccacaagggcctgtgcaggccagaaaatattggctaccccttcctggtgtctgtgcctgccagccggctgacctacgcccggctggcccagctgctggagggctacgcccgctacagcgtgtctgtgttccagccccccttccagcccggccgcatggccctggagagccagagccctggctgcaccaccctgctgagcacaggcagcctggaggccggggacagcgagcgggaccccatccagcccccagagctgcagctggtgacccccatggccgagggggacaccggcctgccccgggtgtgggccgccccagaccggggccctgtgcccagcaccagcggcatcagcagcgagatgctggccagcggccccatcgaggtgggcagcctgcctgctggggagcgggtgtccaggcctgaggccgctgtgcccggctaccagcaccccagcgaggccatgaatgcccacaccccccagttcttcatctacaagattgacagcagcaaccgggagcagaggctggaggacaagggggacacccccctggagctgggagatgactgcagcctggccctggtgtggagaaataatgaaaggctgcaggagtttgtgctggtggccagcaaggagctggagtgtgctgaagatcctggcagcgctggggaggccgcccgggccggccacttcaccctggaccagtgcctgaacctcttcaccaggcctgaggtgctggcccctgaggaggcctggtactgcccccagtgcaagcagcaccgggaggccagcaagcagctgctgctgtggaggctgcccaacgtgctgattgtgcagctgaagcgcttctccttccgctccttcatctggagggacaagatcaatgacctggtggagttccctgtgaggaacctggacctgagcaagttctgcatcggccagaaggaggagcagctgcccagctatgacctgtatgctgtgatcaaccactatggaggcatgattggaggccactacacagcctgtgcccggctgcccaatgacaggagcagccagaggagtgatgtgggctggaggctgtttgatgacagcacagtgaccaccgtggatgagagccaggtggtgaccaggtatgcctacgtgctcttctacagaagaagaaacagccctgtggagcggccccccagggctggccacagcgagcaccacccagacctgggccctgctgctgaggccgccgccagccagggcctgggccctggccaggcccctgaggtggcccccaccaggacagcccctgagagatttgcccctcctgtggacaggcctgcccccacctacagcaacatggaggaggtggactag

SEQ ID NO: 39730 - DNA, 4260 bp, Artificial Sequence
  Description of Artificial Sequence: Synthetic coding sequence
atgtctgggggcgccagcgccaccggcccccggcggggccccccaggcctggaggacaccaccagcaagaagaagcagaaggaccgggccaaccaggagagcaaggatggagaccccaggaaggagaccggcagccgctacgtggcccaggccggcctggagcccctggccagcggggaccccagcgccagcgccagccacgccgccggcatcaccggcagccgccacaggaccaggctcttcttccccagcagcagcggcagcgccagcaccccccaggaggagcagaccaaggagggcgcctgtgaggacccccatgacctgctggccacccccaccccagagctgctgctggactggaggcagagcgctgaggaggtgattgtgaagctgcgggtgggcgtgggccccctgcagctggaggatgtggatgctgccttcacagacacagactgtgtggtgcgctttgctgggggccagcagtggggcggcgtcttctacgccgagatcaagagcagctgtgccaaggtgcagaccaggaagggcagcctgctgcacctgaccctgcccaagaaggtgcccatgctgacctggcccagcctgctgaagaagcccctgggcacccaggagctggtgcccggcctgcgctgccaggagaatggccaggagctgagccccatcgccctggagcccggccctgagccccaccgggccaagcaggaggccaggaaccagaagagggcccagggccgcggggaggtgggcgctggggccggccctggggcccaggccggccccagcgccaagagagctgtgcacctgtgccggggcccagaaggagatggcagcagagatgatcctggccccagaggagatgcccccccatttgtggccgaccctgccacccaggtggaggctgatgagcagctgtgcatcccccccctgaacagccagacctgcctgctgggcagcgaggagaacctggcccccctggccggggagaaggctgtgcccccaggaaatgaccctgtgtccccagccatggtgcgcagcaggaaccctgggaaggatgactgtgccaaggaggagatggctgtggccgcagatgctgccaccctggtggatgagcctgagagcatggtgaacctggcctttgtgaagaatgacagctatgaaaaaggaccagattctgtggtggtgcacgtgtatgtgaaggagatctgccgggacaccagccgggtgctcttccgggagcaggacttcaccctcatcttccagaccagagatggcaacttcctgcggctgcaccctggctgcggcccccacaccaccttccgctggcaggtgaagctgaggaacctgattgagcctgagcagtgcaccttctgcttcaccgccagcagaattgacatctgcctgaggaagaggcagagccagcgctggggcggcctggaggccccagctgcccgggtgggcggggccaaggtggccgtgcccaccggccccacccccctggacagcaccccacctgggggcgccccccaccccctgaccggccaggaggaggcccgggctgtggagaaggacaagagcaaggcccggtctgaggacaccggcctggacagcgtggccaccaggacccccatggagcacgtgacccccaagccagagacccacctggccagccccaagcccacctgcatggtgccccccatgccccacagccctgtgtctggggacagcgtggaggaggaggaggaggaggagaagaaggtgtgcctgcccggcttcaccggcctggtgaacctgggcaacacctgcttcatgaacagcgtcatccagagcctgagcaacacccgggagctgcgggacttcttccatgacaggagctttgaagctgagatcaactacaacaaccccctgggcactggaggccgcctggccatcggctttgctgtgctgctgcgggccctgtggaagggcacccaccacgccttccagcccagcaagctgaaggccatcgtggccagcaaggccagccagttcaccggctacgcccagcatgatgcccaggagttcatggccttcctgctggatggcctgcacgaggacctgaaccgcatccagaacaagccctacacagagaccgtggacagtgatggccgcccagatgaggtggtggccgaggaggcctggcagaggcacaagatgagaaatgacagcttcatcgtggacctcttccagggccagtacaagagcaagctggtgtgccctgtgtgtgccaaggtgtccatcacctttgaccccttcctgtacctgcctgtgcccctgccccagaagcagaaggtgctgcctgtgttctactttgcccgggagccccacagcaagcccatcaagttcctggtgtctgtgtccaaagaaaacagcacagccagcgaggtgctggacagcctgagccagagcgtgcacgtgaagccagagaacctgcggctggccgaggtgatcaagaaccgcttccacagggtcttcctgcccagccacagcctggacacagtgagccccagcgacaccctgctgtgctttgagctgctgagcagcgagctggccaaggagcgggtggtggtgctggaggtgcagcagaggccccaggtgcccagcgtgcccatcagcaaatgtgccgcctgccagaggaagcagcagagtgaagatgagaagctgaagcgctgcacccgctgctacagagtgggctactgcaaccagctgtgccagaagacccactggccagaccacaagggcctgtgcaggccagaaaatattggctaccccttcctggtgtctgtgcctgccagccggctgacctacgcccggctggcccagctgctggagggctacgcccgctacagcgtgtctgtgttccagccccccttccagcccggccgcatggccctggagagccagagccctggctgcaccaccctgctgagcacaggcagcctggaggccggggacagcgagcgggaccccatccagcccccagagctgcagctggtgacccccatggccgagggggacaccggcctgccccgggtgtgggccgccccagaccggggccctgtgcccagcaccagcggcatcagcagcgagatgctggccagcggccccatcgaggtgggcagcctgcctgctggggagcgggtgtccaggcctgaggccgctgtgcccggctaccagcaccccagcgaggccatgaatgcccacaccccccagttcttcatctacaagattgacagcagcaaccgggagcagaggctggaggacaagggggacacccccctggagctgggagatgactgcagcctggccctggtgtggagaaataatgaaaggctgcaggagtttgtgctggtggccagcaaggagctggagtgtgctgaagatcctggcagcgctggggaggccgcccgggccggccacttcaccctggaccagtgcctgaacctcttcaccaggcctgaggtgctggcccctgaggaggcctggtactgcccccagtgcaagcagcaccgggaggccagcaagcagctgctgctgtggaggctgcccaacgtgctgattgtgcagctgaagcgcttctccttccgctccttcatctggagggacaagatcaatgacctggtggagttccctgtgaggaacctggacctgagcaagttctgcatcggccagaaggaggagcagctgcccagctatgacctgtatgctgtgatcaaccactatggaggcatgattggaggccactacacagcctgtgcccggctgcccaatgacaggagcagccagaggagtgatgtgggctggaggctgtttgatgacagcacagtgaccaccgtggatgagagccaggtggtgaccaggtatgcctacgtgctcttctacagaagaagaaacagccctgtggagcggccccccagggctggccacagcgagcaccacccagacctgggccctgctgctgaggccgccgccagccaggccagccgcatctggcaggagctggaggccgaggaggagcctgtgcctgagggcagcggccccctgggcccctggggcccccaggactgggtgggccccctgccccggggccccaccaccccagatgagggctgcctgcgctactttgtgctgggcaccgtggccgccctggtggccctggtgctgaatgtgttctaccccctggtgtcccagagccgctggaggtag

SEQ ID NO: 39731 - DNA, 4119 bp, Artificial Sequence
  Description of Artificial Sequence: Synthetic coding sequence
atgtctgggggcgccagcgccaccggcccccggcggggccccccaggcctggaggacaccaccagcaagaagaagcagaaggaccgggccaaccaggagagcaaggatggagaccccaggaaggagaccggcagccgctacgtggcccaggccggcctggagcccctggccagcggggaccccagcgccagcgccagccacgccgccggcatcaccggcagccgccacaggaccaggctcttcttccccagcagcagcggcagcgccagcaccccccaggaggagcagaccaaggagggcgcctgtgaggacccccatgacctgctggccacccccaccccagagctgctgctggactggaggcagagcgctgaggaggtgattgtgaagctgcgggtgggcgtgggccccctgcagctggaggatgtggatgctgccttcacagacacagactgtgtggtgcgctttgctgggggccagcagtggggcggcgtcttctacgccgagatcaagagcagctgtgccaaggtgcagaccaggaagggcagcctgctgcacctgaccctgcccaagaagaagaagcccctgggcacccaggagctggtgcccggcctgcgctgccaggagaatggccaggagctgagccccatcgccctggagcccggccctgagccccaccgggccaagcaggaggccaggaaccagaagagggcccagggccgcggggaggtgggcgctggggccggccctggggcccaggccggccccagcgccaagagagctgtgcacctgtgccggggcccagaaggagatggcagcagagatgatcctggccccagaggagatgcccccccatttgtggccgaccctgccacccaggtggaggctgatgagcagctgtgcatcccccccctgaacagccagacctgcctgctgggcagcgaggagaacctggcccccctggccggggagaaggctgtgcccccaggaaatgaccctgtgtccccagccatggtgcgcagcaggaaccctgggaaggatgactgtgccaaggaggagatggctgtggccgcagatgctgccaccctggtggatgagcctgagagcatggtgaacctggcctttgtgaagaatgacagctatgaaaaaggaccagattctgtggtggtgcacgtgtatgtgaaggagatctgccgggacaccagccgggtgctcttccgggagcaggacttcaccctcatcttccagaccagagatggcaacttcctgcggctgcaccctggctgcggcccccacaccaccttccgctggcaggtgaagctgaggaacctgattgagcctgagcagtgcaccttctgcttcaccgccagcagaattgacatctgcctgaggaagaggcagagccagcgctggggcggcctggaggccccagctgcccgggtgggcggggccaaggtggccgtgcccaccggccccacccccctggacagcaccccacctgggggcgccccccaccccctgaccggccaggaggaggcccgggctgtggagaaggacaagagcaaggcccggtctgaggacaccggcctggacagcgtggccaccaggacccccatggagcacgtgacccccaagccagagacccacctggccagccccaagcccacctgcatggtgccccccatgccccacagccctgtgtctggggacagcgtggaggaggaggaggaggaggagaagaaggtgtgcctgcccggcttcaccggcctggtgaacctgggcaacacctgcttcatgaacagcgtcatccagagcctgagcaacacccgggagctgcgggacttcttccatgacaggagctttgaagctgagatcaactacaacaaccccctgggcactggaggccgcctggccatcggctttgctgtgctgctgcgggccctgtggaagggcacccaccacgccttccagcccagcaagctgaaggccatcgtggccagcaaggccagccagttcaccggctacgcccagcatgatgcccaggagttcatggccttcctgctggatggcctgcacgaggacctgaaccgcatccagaacaagccctacacagagaccgtggacagtgatggccgcccagatgaggtggtggccgaggaggcctggcagaggcacaagatgagaaatgacagcttcatcgtggacctcttccagggccagtacaagagcaagctggtgtgccctgtgtgtgccaaggtgtccatcacctttgaccccttcctgtacctgcctgtgcccctgccccagaagcagaaggtgctgcctgtgttctactttgcccgggagccccacagcaagcccatcaagttcctggtgtctgtgtccaaagaaaacagcacagccagcgaggtgctggacagcctgagccagagcgtgcacgtgaagccagagaacctgcggctggccgaggtgatcaagaaccgcttccacagggtcttcctgcccagccacagcctggacacagtgagccccagcgacaccctgctgtgctttgagctgctgagcagcgagctggccaaggagcgggtggtggtgctggaggtgcagcagaggccccaggtgcccagcgtgcccatcagcaaatgtgccgcctgccagaggaagcagcagagtgaagatgagaagctgaagcgctgcacccgctgctacagagtgggctactgcaaccagctgtgccagaagacccactggccagaccacaagggcctgtgcaggccagaaaatattggctaccccttcctggtgtctgtgcctgccagccggctgacctacgcccggctggcccagctgctggagggctacgcccgctacagcgtgtctgtgttccagccccccttccagcccggccgcatggccctggagagccagagccctggctgcaccaccctgctgagcacaggcagcctggaggccggggacagcgagcgggaccccatccagcccccagagctgcagctggtgacccccatggccgagggggacaccggcctgccccgggtgtgggccgccccagaccggggccctgtgcccagcaccagcggcatcagcagcgagatgctggccagcggccccatcgaggtgggcagcctgcctgctggggagcgggtgtccaggcctgaggccgctgtgcccggctaccagcaccccagcgaggccatgaatgcccacaccccccagttcttcatctacaagattgacagcagcaaccgggagcagaggctggaggacaagggggacacccccctggagctgggagatgactgcagcctggccctggtgtggagaaataatgaaaggctgcaggagtttgtgctggtggccagcaaggagctggagtgtgctgaagatcctggcagcgctggggaggccgcccgggccggccacttcaccctggaccagtgcctgaacctcttcaccaggcctgaggtgctggcccctgaggaggcctggtactgcccccagtgcaagcagcaccgggaggccagcaagcagctgctgctgtggaggctgcccaacgtgctgattgtgcagctgaagcgcttctccttccgctccttcatctggagggacaagatcaatgacctggtggagttccctgtgaggaacctggacctgagcaagttctgcatcggccagaaggaggagcagctgcccagctatgacctgtatgctgtgatcaaccactatggaggcatgattggaggccactacacagcctgtgcccggctgcccaatgacaggagcagccagaggagtgatgtgggctggaggctgtttgatgacagcacagtgaccaccgtggatgagagccaggtggtgaccaggtatgcctacgtgctcttctacagaagaagaaacagccctgtggagcggccccccagggctggccacagcgagcaccacccagacctgggccctgctgctgaggccgccgccagccagggcctgggccctggccaggcccctgaggtggcccccaccaggacagcccctgagagatttgcccctcctgtggacaggcctgcccccacctacagcaacatggaggaggtggactag

SEQ ID NO: 39732 - DNA, 3357 bp, Artificial Sequence
  Description of Artificial Sequence: Synthetic coding sequence
atgcctgctgtggcctctgtgcccaaggagctgtacctgagcagcagcctgaaggacctgaacaagaagacagaggtgaagccagagaagatcagcaccaagagctatgtgcacagcgccctgaagatcttcaagacagcagaagaatgtcggctggacagagatgaggagcgggcctacgtgctgtacatgaagtatgtgacagtgtacaacctgatcaagaagaggccagacttcaagcagcagcaggactacttccacagcatcctgggccctggcaacatcaagaaggctgtggaggaggccgagcggctgtctgagagcctgaagctgcgctatgaggaggccgaggtgaggaagaagctggaggagaaggaccggcaggaggaggcccagaggctgcagcagaagaggcaggagaccggccgggaggatggcggcaccctggccaagggcagcctggagaatgtgctggacagcaaggacaagacccagaagagcaatggagagaagaatgagaagtgtgagaccaaggagaagggggccatcacagccaaggagctgtacaccatgatgacagacaagaacatcagcctcatcatcatggatgcccggaggatgcaggactaccaggacagctgcatcctgcacagcctgtctgtgcctgaggaggccatcagccctggggtgacagcctcctggattgaggcccacctgcctgatgacagcaaggacacctggaagaagagaggaaatgtggagtatgtggtgctgctggactggttcagcagcgccaaggacctgcagatcggcaccaccctgcggagcctgaaggatgccctcttcaagtgggagagcaagacagtgctgagaaatgagcccctggtgctggagggcggctatgagaactggctgctgtgctacccccagtacaccaccaatgccaaggtgaccccaccaccccggcggcagaatgaggaggtgtccatcagcctggacttcacctaccccagcctggaggagagcatccccagcaagccagctgcccagaccccaccagccagcattgaggtggatgagaacatcgagctgatcagcggccagaatgaaagaatgggccccctgaacatcagcacccctgtggagcctgtggccgccagcaagagtgatgtgagccccatcatccagcctgtgcccagcatcaagaatgtgccccagattgacaggaccaagaagccagctgtgaagctgcctgaggagcaccgcatcaagtctgagagcaccaaccacgagcagcagagcccccagagcggcaaggtgatcccagacaggagcaccaagcctgtggtgttcagccccaccctgatgctgacagatgaggagaaggcccgcatccatgctgagacagccctgctgatggagaagaacaagcaggagaaggagctgcgggagcggcagcaggaggagcagaaggagaagctgaggaaggaggagcaggagcagaaggccaagaagaagcaggaggccgaggagaatgagatcacagagaagcagcagaaggccaaggaggagatggagaagaaggagagcgagcaggccaagaaggaggacaaggagaccagcgccaagaggggcaaggagatcactggagtgaagaggcagagcaagtcagaacatgagaccagtgatgccaagaagtctgtggaggaccggggcaagcgctgccccaccccagagatccagaagaagagcactggagatgtgccccacacctctgtgactggagacagcggcagcggcaagcccttcaagatcaagggccagcctgagagcggcatcctgaggacaggcaccttccgggaggacacagatgacacagagaggaacaaggcccagcgggagcccctgacccgggcccggtctgaggagatgggcagaattgtgcccggcctgcccagcggctgggccaagttcctggaccccatcaccggcaccttccgctactaccacagccccaccaacacagtgcacatgtacccacctgagatggcccccagcagcgccccacccagcaccccacccacccacaaggccaagccccagatcccagctgagcgggaccgggagcccagcaagctgaagaggagctacagcagcccagacatcacccaggccatccaggaggaggagaagaggaagcccaccgtgacccccaccgtgaaccgggagaacaagcccacctgctaccccaaggccgagatcagccggctgagcgccagccagatccggaacctgaaccctgtgtttggaggcagcggccctgccctgaccggcctgaggaacctgggcaacacctgctacatgaacagcatcctgcagtgcctgtgcaatgccccccacctggccgactacttcaacagaaactgctaccaggatgacatcaacagaagcaacctgctgggccacaagggggaggtggccgaggagtttggcatcatcatgaaggccctgtggacaggccagtaccgctacatcagccccaaggacttcaagatcaccatcggcaagatcaatgaccagtttgctggctacagccagcaggacagccaggagctgctgctcttcctgatggatggcctgcacgaggacctgaacaaggctgacaacaggaagcgctacaaggaggagaacaatgaccacctggatgacttcaaggctgctgagcacgcctggcagaagcacaagcagctgaatgaaagcatcatcgtggccctcttccagggccagttcaagagcacagtgcagtgcctgacctgccacaagaagagcaggacctttgaggccttcatgtacctgagcctgcccctggccagcaccagcaagtgcaccctgcaggactgcctgcggctcttcagcaaggaggagaagctgacagacaacaaccgcttctactgcagccactgccgggcccggcgggacagcctgaagaagattgagatctggaagctgccccctgtgctgctggtgcacctgaagcgcttctcctatgatggccgctggaagcagaagctgcagacctctgtggacttccccctggagaacctggacctgagccagtatgtgattggccccaagaacaacctgaagaagtacaacctcttctctgtgagcaaccactacggcggcctggatggcggccactacacagcctactgcaagaatgctgcccggcagcgctggttcaagtttgatgaccacgaggtgtctgacatctctgtgtcctctgtgaagagcagcgctgcctacatcctcttctacaccagcctgggcccccgggtgacagatgtggccacctag

SEQ ID NO: 39733 - DNA, 996 bp, Artificial Sequence
  Description of Artificial Sequence: Synthetic coding sequence
ctgaccggcctgaggaacctgggcaacacctgctacatgaacagcatcctgcagtgcctgtgcaatgccccccacctggccgactacttcctgaccgggaagtacatgagcaacctgctgggccacaagggggaggtggccgaggagtttggcatcatcatgaaggccctgtggacaggccagtaccgctacatcagccccaaggacttcaagatcaccatcggcaagatcaatgaccagtttgctggctacagccagcaggacagccaggagctgctgctcttcctgatggatggcctgcacgaggacctgaacaagttccaggccgacaacaggaagcgctacaaggaggagacagctgagcacgcctggcagaagcacaagcagctgaatgaaagcatcatcgtggccctcttccagggccagttcaagagcacagtgcagtgcctgacctgccacaagaagagcaggacctttgaggccttcatgtacctgagcctgcccctggccagcaccagcaagtgcaccctgcaggactgcctgcggctcttcagcaaggaggagaagctgacagacaacaaccgcttctactgcagccactgccgggcccggcgggacagcctgaagaagattgagatctggaagctgccccctgtgctgctggtgcacctgaagcgcttctcctatgatggccgctggaagcagaagctgcagacctctgtggacttccccctggagaacctggacctgagccagtatgtgattggccccaagaacaacctgaagaagtacaacctcttctctgtgagcaaccactatggaggcctggatggcggccactacacagcctactgcaagaatgctgcccggcagcgctggttcaagtttgatgaccacgaggtgtctgacatctctgtgtcctctgtgaagagcagcgctgcctacatcctcttctacaccagcctgggcccccgggtgacagatgtggccacctag

SEQ ID NO: 39734 - DNA, 3357 bp, Artificial Sequence; identical to SEQ ID NO: 39732
  Description of Artificial Sequence: Synthetic coding sequence

SEQ ID NO: 39735 - DNA, 3357 bp, Artificial Sequence; identical to SEQ ID NO: 39732
  Description of Artificial Sequence: Synthetic coding sequence

SEQ ID NO: 39736 - DNA, 408 bp, Artificial Sequence
  Description of Artificial Sequence: Synthetic coding sequence
atgcctgctgtggcctctgtgcccaaggagctgtacctgagcagcagcctgaaggacctgaacaagaagacagaggtgaagccagagaagatcagcaccaagagctatgtgcacagcgccctgaagatcttcaagacagcagaagaatgtcggctggacagagatgaggagcgggcctacgtgctgtacatgaagtatgtgacagtgtacaacctgatcaagaagaggccagacttcaagcagcagcaggactacttccacagcatcctgggccctggcaacatcaagaaggctgtggaggaggccgagcggctgtctgagagcctgaagctgcgctatgaggaggccgaggtgaggaagaagctggaggagaaggaccggcaggaggaggcccagaggctgcagtag

SEQ ID NO: 39737 - DNA, 291 bp, Artificial Sequence
  Description of Artificial Sequence: Synthetic coding sequence
atgcctgctgtggcctctgtgcccaaggagctgtacctgagcagcagcctgaaggacctgaacaagaagacagaggtgaagccagagaagatcagcaccaagagctatgtgcacagcgccctgaagatcttcaagacagcagaagaatgtcggctggacagagatgaggagcgggcctacgtgctgtacatgaagtatgtgacagtgtacaacctgatcaagaagaggccagacttcaagcagcagcaggactacttccacagcatcctgggccctggcaacatcaagtag

SEQ ID NO: 39738 - DNA, 222 bp, Artificial Sequence
  Description of Artificial Sequence: Synthetic coding sequence
atgcctgctgtggcctctgtgcccaaggagctgtacctgagcagcagcctgaaggacctgaacaagaagacagaggtgaagccagagaagatcagcaccaagagctatgtgcacagcgccctgaagatcttcaagacagcagaagaatgtcggctggacagagatgaggagcgggcctacgtgctgtacatgaagtatgtgacagtgtacaacctgatctag

SEQ ID NO: 39739 - DNA, 132 bp, Artificial Sequence
  Description of Artificial Sequence: Synthetic coding sequence
atgagcagcaccagcagcaagagggcccccaccacagccacccagaggctgaagcaggactacctgcgcatcaagaaggaccctgtgccctacatctgtgccgagcccctgcccagcaacatcctggagtag

SEQ ID NO: 39740 - DNA, 957 bp, Artificial Sequence
  Description of Artificial Sequence: Synthetic coding sequence
atggagacccgctacaacctgaagagccctgctgtgaagaggctgatgaaggaggccgctgagctgaaggaccccacagaccactaccacgcccagcccctggaggacaacctgtttgagtggcacttcaccgtgcggggccccccagacagcgactttgatggcggcgtgtaccacggccgcatcgtgctgcccccagagtaccccatgaagccacccagcatcatcctgctgacagccaacggccgctttgaggtgggcaagaagatctgcctgagcatcagcggccaccaccctgagacctggcagcccagctggagcatcagaacagccctgctggccatcatcggcttcatgcccaccaagggggagggcgccatcggcagcctggactacaccccagaggagcggcgggccctggccaagaagagccaggacttctgctgtgagggctgcggcagcgccatgaaggatgtgctgctgcccctgaagagcggcagtgacagcagccaggccgaccaggaggccaaggagctggcccggcagatctccttcaaggccgaggtgaacagcagcggcaagaccatcagcgagagtgacctgaaccacagcttcagcctgacagacctgcaggatgacatccccaccaccttccagggcgccacagccagcaccagctatggcctgcagaacagcagcgctgccagcttccaccagcccacccagcctgtggccaagaacacctccatgagcccccggcagaggcgggcccagcagcagagccagaggcggctgagcaccagcccagatgtgatccagggccaccagccccgggacaaccacacagaccacggcggcagcgctgtgctgattgtcatcctgaccctggccctggccgccctgatcttccgccgcatctacctggccaatgagtacatctttgattttgagctgtag

SEQ ID NO: 39741 - DNA, 912 bp, Artificial Sequence
  Description of Artificial Sequence: Synthetic coding sequence
atgaaggaggccgctgagctgaaggaccccacagaccactaccacgcccagcccctggaggacaacctgtttgagtggcacttcaccgtgcggggccccccagacagcgactttgatggaggagtgtaccacggcagaattgtgctgcccccagagtaccccatgaagcccccatccatcatcctgctgacagccaacggccgctttgaggtgggcaagaagatctgcctgagcatcagcggccaccaccctgagacctggcagcccagctggagcatcagaacagccctgctggccatcatcggcttcatgcccaccaagggggagggcgccatcggcagcctggactacaccccagaggagcggcgggccctggccaagaagagccaggacttctgctgtgagggctgcggcagcgccatgaaggatgtgctgctgcccctgaagagcggcagtgacagcagccaggccgaccaggaggccaaggagctggcccggcagatctccttcaaggccgaggtgaacagcagcggcaagaccatcagcgagagtgacctgaaccacagcttcagcctgacagacctgcaggatgacatccccaccaccttccagggcgccacagccagcaccagctatggcctgcagaacagcagcgctgccagcttccaccagcccacccagcctgtggccaagaacacctccatgagcccccggcagaggcgggcccagcagcagagccagaggcggctgagcaccagcccagatgtgatccagggccaccagccccgggacaaccacacagaccatggaggcagcgctgtgctgattgtcatcctgaccctggccctggccgccctgatcttccgccgcatctacctggccaatgagtacatctttgattttgagctgtag

SEQ ID NO: 39742 - DNA, 675 bp, Artificial Sequence
  Description of Artificial Sequence: Synthetic coding sequence
atgtggccccaggacattgctggccgccactacgtggtgcggggccctgagatgaccccctatgaaggaggctactaccacggcaagctgatcttcccccgggagttccccttcaagccacccagcatctacatgatcaccccaaatggccgcttcaagtgcaacacccggctgtgcctgagcatcacagacttccacccagacacctggaacccagcctggagcgtgtccaccatcctgaccggcctgctgtccttcatggtggagaagggccccaccctgggcagcattgagaccagtgacttcaccaagaggcagctggccgtgcagagcctggccttcaacctgaaggacaaggtgttctgtgagctgtttcctgaggtggtggaggagatcaagcagaagcagaaggcccaggatgagctgagcagccggccccagaccctgcccctgcctgatgtggtgcctgatggagagacccacctggtgcagaatggcatccagctgctgaatggacatgcccctggagctgtgcccaacctggccggcctgcagcaggccaacagacaccacggcctgctgggcggggccctggccaacctcttcgtcatcgtgggctttgctgcctttgcctacacagtgaagtatgtgctgcggagcatcgcccaggagtag

SEQ ID NO: 39743 - DNA, 624 bp, Artificial Sequence
  Description of Artificial Sequence: Synthetic coding sequence
atgaccccctatgagggcggctactaccacggcaagctgatcttcccccgggagttccccttcaagcccccatccatctacatgatcacccccaacggccgcttcaagtgcaacacccggctgtgcctgagcatcacagacttccacccagacacctggaacccagcctggagcgtgtccaccatcctgaccggcctgctgtccttcatggtggagaagggccccaccctgggcagcattgagaccagtgacttcaccaagaggcagctggccgtgcagagcctggccttcaacctgaaggacaaggtgttctgtgagctgtttcctgaggtggtggaggagatcaagcagaagcagaaggcccaggatgagctgagcagccggccccagaccctgcccctgcctgatgtggtgcctgatggagagacccacctggtgcagaatggcatccagctgctgaatggccacgcccctggagctgtgcccaacctggccggcctgcagcaggccaacagacaccacggcctgctgggcggggccctggccaacctgtttgtgattgtgggctttgctgcctttgcctacacagtgaagtatgtgctgcggagcatcgcccaggagtag

SEQ ID NO: 39744 - DNA, 624 bp, Artificial Sequence; identical to SEQ ID NO: 39743
  Description of Artificial Sequence: Synthetic coding sequence

SEQ ID NO: 39745 - DNA, 780 bp, Artificial Sequence
  Description of Artificial Sequence: Synthetic coding sequence
atgagcagcaccagcagcaagagggcccccaccacagccacccagaggctgaagcaggactacctgcgcatcaagaaggaccctgtgccctacatctgtgccgagcccctgcccagcaacatcctggagtggcactacgtggtgcggggccctgagatgaccccctatgagggcggctactaccacggcaagctgatcttcccccgggagttccccttcaagcccccatccatctacatgatcacccccaacggccgcttcaagtgcaacacccggctgtgcctgagcatcacagacttccacccagacacctggaacccagcctggagcgtgtccaccatcctgaccggcctgctgtccttcatggtggagaagggccccaccctgggcagcattgagaccagtgacttcaccaagaggcagctggccgtgcagagcctggccttcaacctgaaggacaaggtgttctgtgagctgtttcctgaggtggtggaggagatcaagcagaagcagaaggcccaggatgagctgagcagccggccccagaccctgcccctgcctgatgtggtgcctgatggagagacccacctggtgcagaatggcatccagctgctgaatggccacgcccctggagctgtgcccaacctggccggcctgcagcaggccaacagacaccacggcctgctgggcggggccctggccaacctgtttgtgattgtgggctttgctgcctttgcctacacagtgaagtatgtgctgcggagcatcgcccaggagtag

SEQ ID NO: 39746 - DNA, 780 bp, Artificial Sequence; identical to SEQ ID NO: 39745
  Description of Artificial Sequence: Synthetic coding sequence

SEQ ID NO: 39747 - DNA, 624 bp, Artificial Sequence; identical to SEQ ID NO: 39743
  Description of Artificial Sequence: Synthetic coding sequence

SEQ ID NO: 39748 - DNA, 828 bp, Artificial Sequence
  Description of Artificial Sequence: Synthetic coding sequence
atgagcagcaccagcagcaagagggcccccaccacagccacccagaggctgaagcaggactacctgcgcatcaagaaggaccctgtgccctacatctgtgccgagcccctgcccagcaacatcctggagtggttcaagcgcttctcctggctgagcctgctgagctcctgggactaccgccactacgtggtgcggggccctgagatgaccccctatgagggcggctactaccacggcaagctgatcttcccccgggagttccccttcaagcccccatccatctacatgatcacccccaacggccgcttcaagtgcaacacccggctgtgcctgagcatcacagacttccacccagacacctggaacccagcctggagcgtgtccaccatcctgaccggcctgctgtccttcatggtggagaagggccccaccctgggcagcattgagaccagtgacttcaccaagaggcagctggccgtgcagagcctggccttcaacctgaaggacaaggtgttctgtgagctgtttcctgaggtggtggaggagatcaagcagaagcagaaggcccaggatgagctgagcagccggccccagaccctgcccctgcctgatgtggtgcctgatggagagacccacctggtgcagaatggcatccagctgctgaatggccacgcccctggagctgtgcccaacctggccggcctgcagcaggccaacagacaccacggcctgctgggcggggccctggccaacctgtttgtgattgtgggctttgctgcctttgcctacacagtgaagtatgtgctgcggagcatcgcccaggagtag

SEQ ID NO: 39749 - DNA, 306 bp, Artificial Sequence
  Description of Artificial Sequence: Synthetic coding sequence
atgagcagcaccagcagcaagagggcccccaccacagccacccagaggctgaagcaggactacctgcgcatcaagaaggaccctgtgccctacatctgtgccgagcccctgcccagcaacatcctggagtggttcaagcgcttctcctggctgagcctgctgagctcctgggactaccgccactacgtggtgcggggccctgagatgaccccctatgagggcggctactaccacggcaagctgatcttcccccgggagttccccttcaagcccccatccatctacatgatcacccccaacggctag

SEQ ID NO: 39750 - DNA, 591 bp, Artificial Sequence
  Description of Artificial Sequence: Synthetic coding sequence
atgagcagcaccagcagcaagagggcccccaccacagccacccagaggctgaagcaggactacctgcgcatcaagaaggaccctgtgccctacatctgtgccgagcccctgcccagcaacatcctggagtggcactacgtggtgcggggccctgagatgaccccctatgagggcggctactaccacggcaagctgatcttcccccgggagttccccttcaagcccccatccatctacatgatcacccccaacggccgcttcaagtgcaacacccggctgtgcctgagcatcacagacttccacccagacacctggaacccagcctggagcgtgtccaccatcctgaccggcctgctgtccttcatggtggagaagggccccaccctgggcagcattgagaccagtgacttcaccaagaggcagctggccgtgcagagcctggccttcaacctgaaggacaaggtgttctgtgagctgtttcctgaggtggtggaggagatcaagcagaagcagaaggcccaggatgagctgagcagccggccccagaccctgcccctgcctgatgtggtgcctgatggagagacccactag

SEQ ID NO: 39751 - DNA, 132 bp, Artificial Sequence; identical to SEQ ID NO: 39739
  Description of Artificial Sequence: Synthetic coding sequence

SEQ ID NO: 39752 - DNA, 216 bp, Artificial Sequence
  Description of Artificial Sequence: Synthetic coding sequence
atgagcagcaccagcagcaagagggcccccaccacagccacccagaggctgaagcaggactacctgcgcatcaagaaggaccctgtgccctacatctgtgccgagcccctgcccagcaacatcctggagtggcactacgtggtgcggggccctgagatgaccccctatgagggcggctactaccacggcaagctgatcttcccccgggagttctag

SEQ ID NO: 39753 - DNA, 444 bp, Artificial Sequence
  Description of Artificial Sequence: Synthetic coding sequence
atggccctgaagaggatcaacaaggagctgagtgacctggcccgggaccccccagcccagtgcagcgctggccctgtgggagatgacatgttccactggcaggccaccatcatgggccccaatgacagcccctaccagggcggcgtcttcttcctgaccatccacttccccacagactaccccttcaagccacccaaggtggccttcaccacccgcatctaccaccccaacatcaacagcaatggcagcatctgcctggacatcctgcggagccagtggagccctgccctgaccatcagcaaggtgctgctgagcatctgcagcctgctgtgtgaccccaacccagatgaccccctggtgcctgagatcgcccgcatctacaagacagaccgggacaagtacaaccgcatcagccgggagtggacccagaagtatgccatgtag

SEQ ID NO: 39754 - DNA, 444 bp, Artificial Sequence; identical to SEQ ID NO: 39753
  Description of Artificial Sequence: Synthetic coding sequence

SEQ ID NO: 39755 - DNA, 447 bp, Artificial Sequence
  Description of Artificial Sequence: Synthetic coding sequence
atggccctgaagaggatcaacaaggagctgagtgacctggcccgggaccccccagcccagtgcagcgctggccctgtgggagatgacatgttccactggcaggccaccatcatgggccccaatgacagcccctaccagggcggcgtcttcttcctgaccatccacttccccacagactaccccttcaagccacccaaggtggccttcaccacccgcatctaccaccccaacatcaacagcaatggcagcatctgcctggacatcctgcggagccagtggagccctgccctgaccatcagcaaggtgctgctgagcatctgcagcctgctgtgtgaccccaacccagatgaccccctggtgcctgagatcgcccgcatctacaagacagaccgggacaagtacaaccggctggcccgggagtggacagagaagtatgccatgctgtag

SEQ ID NO: 39756 - DNA, 444 bp, Artificial Sequence; identical to SEQ ID NO: 39753
  Description of Artificial Sequence: Synthetic coding sequence

SEQ ID NO: 39757 - DNA, 450 bp, Artificial Sequence
  Description of Artificial Sequence: Synthetic coding sequence
atgctgagcaacaggaagtgcctgagcaaggagctgagtgacctggcccgggaccccccagcccagtgcagcgctggccctgtgggagatgacatgttccactggcaggccaccatcatgggccccaatgacagcccctaccagggcggcgtcttcttcctgaccatccacttccccacagactaccccttcaagccacccaaggtggccttcaccacccgcatctaccaccccaacatcaacagcaatggcagcatctgcctggacatcctgcggagccagtggagccctgccctgaccatcagcaaggtgctgctgagcatctgcagcctgctgtgtgaccccaacccagatgaccccctggtgcctgagatcgcccgcatctacaagacagaccgggacaagtacaaccgcatcagccgggagtggacccagaagtatgccatgtag

SEQ ID NO: 39758 - DNA, 444 bp, Artificial Sequence; identical to SEQ ID NO: 39753
  Description of Artificial Sequence: Synthetic coding sequence

SEQ ID NO: 39759 - DNA, 444 bp, Artificial Sequence; identical to SEQ ID NO: 39753
  Description of Artificial Sequence: Synthetic coding sequence

SEQ ID NO: 39760 - DNA, 444 bp, Artificial Sequence; identical to SEQ ID NO: 39753
  Description of Artificial Sequence: Synthetic coding sequence

SEQ ID NO: 39761 - DNA, 444 bp, Artificial Sequence; identical to SEQ ID NO: 39753
  Description of Artificial Sequence: Synthetic coding sequence

SEQ ID NO: 39762 - DNA, 237 bp, Artificial Sequence
  Description of Artificial Sequence: Synthetic coding sequence
atggccctgaagaggatcaacaaggagctgagtgacctggcccgggaccccccagcccagtgcagcgctggccctgtgggagatgacatgttccactggcaggccaccatcatgggccccaatgacagcccctaccagggcggcgtcttcttcctgaccatccacttccccacagactaccccttcaagccacccaaggtggccttcaccacccgcatctaccaccccaacatctag

SEQ ID NO: 39763 - DNA, 291 bp, Artificial Sequence
  Description of Artificial Sequence: Synthetic coding sequence
atggccctgaagaggatcaacaaggagctgagtgacctggcccgggaccccccagcccagtgcagcgctggccctgtgggagatgacatgttccactggcaggccaccatcatgggccccaatgacagcccctaccagggcggcgtcttcttcctgaccatccacttccccacagactaccccttcaagccacccaaggtggccttcaccacccgcatctaccaccccaacatcaacagcaatggcagcatctgcctggacatcctgcggagccagtggagccctgcctag

SEQ ID NO: 39764 - DNA, 150 bp, Artificial Sequence
  Description of Artificial Sequence: Synthetic coding sequence
atggccctgaagaggatcaacaaggagctgagtgacctggcccgggaccccccagcccagtgcagcgctggccctgtgggagatgacatgttccactggcaggccaccatcatgggccccaatgacagcccctaccagggcggcgtgtag

SEQ ID NO: 39765 - DNA, 1527 bp, Artificial Sequence
  Description of Artificial Sequence: Synthetic coding sequence
atgctgtggttccagggcgccatcccagctgccatcgccacagccaagaggtctggagctgtgtttgtggtgtttgtggccggagatgatgagcagagcacccagatggccgcctcctgggaggatgacaaggtgacagaggccagcagcaacagctttgtggccatcaagattgacaccaagtctgaggcctgcctgcagttcagccagatctaccctgtggtgtgtgtgcccagcagcttcttcatcggggacagcggcatccccctggaggtgattgctggctctgtgtctgcagatgagctggtgacccgcatccacaaggtgcggcagatgcacctgctgaagtctgagacctctgtggccaacggcagccagagcgagagctctgtgtccaccccatctgccagctttgagcccaacaacacctgtgagaacagccagagcagaaatgctgagctgtgtgagatcccccccaccagtgacaccaagagtgacacagccactggaggagagagcgctggccacgccaccagcagccaggagcccagcggctgcagcgaccagaggcctgctgaggacctgaacatccgggtggagcggctgaccaagaagctggaggagcggcgggaggagaagaggaaggaggaggagcagcgggagatcaagaaggagattgaaagaaggaagacaggcaaggagatgctggactacaagaggaagcaggaggaggagctgaccaagaggatgctggaggagaggaaccgggagaaggccgaggacagagctgcccgggagcgcatcaagcagcagatcgccctggacagagctgagcgggccgccaggtttgccaagaccaaggaggaggtggaggccgccaaggccgccgccctgctggccaagcaggccgagatggaggtgaagcgggagagctatgcccgggagaggagcacagtggcccgcatccagttccggctgcctgatggcagcagcttcaccaaccagttccccagtgatgcccccctggaggaggcccggcagtttgctgcccagacagtgggcaacacctacggcaacttcagcctggccaccatgttcccccggcgggagttcaccaaggaggactacaagaagaagctgctggacctggagctggcccccagcgcctctgtggtgctgctgcctgctggccggcccacagccagcatcgtgcacagcagcagcggggacatctggaccctgctgggcaccgtgctgtaccccttcctggccatctggaggctcatcagcaacttcctgttcagcaaccccccacccacccagacctctgtgcgggtgaccagcagcgagccccccaacccagccagcagcagcaagtctgagaagcgggagcctgtgaggaagagggtgctggagaagagaggagatgacttcaagaaggagggcaagatctaccgcctgcggacccaggatgatggagaagatgagaacaacacctggaatggaaacagcacccagcagatgtag

SEQ ID NO: 39766 - DNA, 1473 bp, Artificial Sequence
  Description of Artificial Sequence: Synthetic coding sequence
atgctgtggttccagggcgccatcccagctgccatcgccacagccaagaggtctggagctgtgtttgtggtgtttgtggccggagatgatgagcagagcacccagatggccgcctcctgggaggatgacaaggtgacagaggccagcagcaacagctttgtggccatcaagattgacaccaagtctgaggcctgcctgcagttcagccagatctaccctgtggtgtgtgtgcccagcagcttcttcatcggggacagcggcatccccctggaggtgattgctggctctgtgtctgcagatgagctggtgacccgcatccacaaggtgcggcagatgcacctgctgaagacagccagctttgagcccaacaacacctgtgagaacagccagagcagaaatgctgagctgtgtgagatcccccccaccagtgacaccaagagtgacacagccactggaggagagagcgctggccacgccaccagcagccaggagcccagcggctgcagcgaccagaggcctgctgaggacctgaacatccgggtggagcggctgaccaagaagctggaggagcggcgggaggagaagaggaaggaggaggagcagcgggagatcaagaaggagattgaaagaaggaagacaggcaaggagatgctggactacaagaggaagcaggaggaggagctgaccaagaggatgctggaggagaggaaccgggagaaggccgaggacagagctgcccgggagcgcatcaagcagcagatcgccctggacagagctgagcgggccgccaggtttgccaagaccaaggaggaggtggaggccgccaaggccgccgccctgctggccaagcaggccgagatggaggtgaagcgggagagctatgcccgggagaggagcacagtggcccgcatccagttccggctgcctgatggcagcagcttcaccaaccagttccccagtgatgcccccctggaggaggcccggcagtttgctgcccagacagtgggcaacacctacggcaacttcagcctggccaccatgttcccccggcgggagttcaccaaggaggactacaagaagaagctgctggacctggagctggcccccagcgcctctgtggtgctgctgcctgctggccggcccacagccagcatcgtgcacagcagcagcggggacatctggaccctgctgggcaccgtgctgtaccccttcctggccatctggaggctcatcagcaacttcctgttcagcaaccccccacccacccagacctctgtgcgggtgaccagcagcgagccccccaacccagccagcagcagcaagtctgagaagcgggagcctgtgaggaagagggtgctggagaagagaggagatgacttcaagaaggagggcaagatctaccgcctgcggacccaggatgatggagaagatgagaacaacacctggaatggaaacagcacccagcagatgtag

SEQ ID NO: 39767 - DNA, 1470 bp, Artificial Sequence
  Description of Artificial Sequence: Synthetic coding sequence
atggccgcccacggcggcagcgctgccagcagcgccctgaagggcctcatccagcagttcaccaccatcaccggggccagcgagagcgtgggcaagcacatgctggaggcctgcaacaacaacctggagatggctgtgaccatgttcctggatggcggcggcattgctgaggagcccagcaccagcagcgcctctgtgtccacagtgcggccccacacagaggaggaggtgcgggcccccatcccccagaagcaggagatcctggtggagcctgagcccctgtttggagcccccaagagaagaagacctgcccggagcatctttgatggcttccgggacttccagacagagaccatccggcaggagcaggagctgagaaatggaggagccatcgacaagaagctgaccaccctggccgacctcttccggccccccatcgacctgatgcacaagggcagctttgaaacagccaaggaatgtggccagatgcagaacaagtggctgatgatcaacatccagaatgtgcaggactttgcctgccagtgcctgaacagagatgtgtggagcaatgaggccgtgaagaacatcatccgggagcacttcatcttctggcaggtgtaccatgacagcgaggagggccagcgctacatccagttctacaagctgggggacttcccctacgtgtccatcctggaccccaggacaggccagaagctggtggagtggcaccagctggatgtgtcctccttcctggaccaggtgacaggcttcctgggggagcacggccagctggatggcctgagcagcagcccccccaagaagtgtgcccggtctgagagcctgattgatgccagcgaggacagccagctggaggccgccatccgggccagcctgcaggagacccactttgacagcacccagaccaagcaggacagcagaagtgatgaggagagcgagagcgagctgttcagcggcagcgaggagttcatctctgtgtgtggcagtgatgaggaggaggaggtggagaacctggccaagagcaggaagagcccccacaaggacctgggccacaggaaggaggagaacagaagacccctgacagagccccctgtgaggacagatcctggaacagccaccaaccaccagggcctgcctgctgtggacagcgagatcctggagatgcctcctgagaaggcagatggagtggtggagggcattgatgtgaatggccccaaggcccagctgatgctgcgctacccagatggcaagcgggagcagatcaccctgcctgagcaggccaagctgctggccctggtgaagcacgtgcagagcaagggctacccaaatgaaagatttgagctgctgaccaacttccccaggaggaagctgagccacctggactatgacatcaccctgcaggaggccggcctgtgcccccaggagaccgtgtttgtgcaggagaggaactag

SEQ ID NO: 39768 - DNA, 1026 bp, Artificial Sequence
  Description of Artificial Sequence: Synthetic coding sequence
atgcacaagggcagctttgaaacagccaaggaatgtggccagatgcagaacaagtggctgatgatcaacatccagaatgtgcaggactttgcctgccagtgcctgaacagagatgtgtggagcaatgaggccgtgaagaacatcatccgggagcacttcatcttctggcaggtgtaccatgacagcgaggagggccagcgctacatccagttctacaagctgggggacttcccctacgtgtccatcctggaccccaggacaggccagaagctggtggagtggcaccagctggatgtgtcctccttcctggaccaggtgacaggcttcctgggggagcacggccagctggatggcctgagcagcagcccccccaagaagtgtgcccggtctgagagcctgattgatgccagcgaggacagccagctggaggccgccatccgggccagcctgcaggagacccactttgacagcacccagaccaagcaggacagcagaagtgatgaggagagcgagagcgagctgttcagcggcagcgaggagttcatctctgtgtgtggcagtgatgaggaggaggaggtggagaacctggccaagagcaggaagagcccccacaaggacctgggccacaggaaggaggagaacagaagacccctgacagagccccctgtgaggacagatcctggaacagccaccaaccaccagggcctgcctgctgtggacagcgagatcctggagatgcctcctgagaaggcagatggagtggtggagggcattgatgtgaatggccccaaggcccagctgatgctgcgctacccagatggcaagcgggagcagatcaccctgcctgagcaggccaagctgctggccctggtgaagcacgtgcagagcaagggctacccaaatgaaagatttgagctgctgaccaacttccccaggaggaagctgagccacctggactatgacatcaccctgcaggaggccggcctgtgcccccaggagaccgtgtttgtgcaggagaggaactag

SEQ ID NO: 39769 - DNA, 1584 bp, Artificial Sequence
  Description of Artificial Sequence: Synthetic coding sequence
atgagaagtgacaagagcgccctggtgttcctgctgctgcagctgttctgtgtgggctgcggcttctgtgggaaggtgctggtgtggccctgtgacatgagccactggctgaatgtgaaggtgatcctggaggagctgattgtgcggggccacgaggtgacagtgctgacccacagcaagcccagcctgattgactacaggaagcccagcgccctgaagtttgaggtggtgcacatgccccaggacagaacagaggagaatgagatctttgtggacctggccctgaatgtgctgcccggcctgagcacctggcagagcgtcatcaagctgaatgacttctttgtggagatccggggcaccctgaagatgatgtgtgagagcttcatctacaaccagaccctgatgaagaagctgcaggagaccaactatgatgtgatgctgattgaccccgtcatcccctgtggggacctgatggccgagctgctggccgtgccctttgtgctgaccctgcgcatctctgtgggcggcaacatggagaggagctgtgggaagctgcctgcccccctgtcctatgtgcctgtgcccatgacaggcctgacagacaggatgaccttcctggagcgggtgaagaacagcatgctgtctgtgctcttccacttctggatccaggactatgactaccacttctgggaggagttctacagcaaggccctgggccggcccaccaccctgtgtgaaacagtgggcaaggccgagatctggctgatccgcacctactgggactttgagttcccccagccctaccagcccaactttgaatttgtgggcggcctgcactgcaagccagccaaggccctgcccaaggagatggagaactttgtgcagagcagtggagaagatggcatcgtggtgttcagcctgggcagcctcttccagaatgtgacagaggagaaggccaacatcatcgccagcgccctggcccagatcccccagaaggtgctgtggagatacaagggcaagaagcccagcaccctgggcgccaacacccggctgtatgactggatcccccagaatgacctgctgggccaccccaagaccaaggccttcatcacccacggcggcatgaatggcatctatgaggccatctaccacggcgtgcccatggtgggcgtgcccatctttggagaccagctggacaacatcgcccacatgaaggccaagggagctgctgtggagatcaacttcaagaccatgaccagcgaggacctgctgcgggccctgaggacagtcatcacagacagcagctacaaggaaaatgccatgaggctgagccgcatccaccacgaccagcctgtgaagcccctggacagagctgtgttctggattgaatttgtgatgaggcacaagggggccaagcacctgcggtctgctgcccatgacctgacctggttccagcactacagcattgatgtgattggcttcctgctggcctgtgtggccacagccatcttcctgttcaccaagtgcttcctgttcagctgccagaagttcaacaagaccaggaagattgagaagcgggagtag

SEQ ID NO: 39770 - DNA, 717 bp, Artificial Sequence
  Description of Artificial Sequence: Synthetic coding sequence
atggagaactttgtgcagagcagcggggaggatggcatcgtggtgttcagcctgggcagcctcttccagaatgtgacagaggagaaggccaacatcatcgccagcgccctggcccagatcccccagaaggtgctgtggagatacaagggcaagaagcccagcaccctgggcgccaacacccggctgtatgactggatcccccagaatgacctgctgggccaccccaagaccaaggccttcatcacccatggaggcatgaatggcatctatgaggccatctaccatggagtgcccatggtgggcgtgcccatctttggagaccagctggacaacatcgcccacatgaaggccaagggagctgctgtggagatcaacttcaagaccatgaccagcgaggacctgctgcgggccctgaggacagtcatcacagacagcagctacaaggaaaatgccatgaggctgagccgcatccaccacgaccagcctgtgaagcccctggacagagctgtgttctggattgaatttgtgatgaggcacaagggggccaagcacctgcggtctgctgcccatgacctgacctggttccagcactacagcattgatgtgattggcttcctgctggcctgtgtggccacagccatcttcctgttcaccaagtgcttcctgttcagctgccagaagttcaacaagaccaggaagattgagaagcgggagtag

SEQ ID NO: 39771 - DNA, 1587 bp, Artificial Sequence
  Description of Artificial Sequence: Synthetic coding sequence
atggccctgaagtggaccaccgtgctgctgatccagctgtccttctacttcagcagcggcagctgtgggaaggtgctggtgtgggccgctgagtacagcctgtggatgaacatgaagaccatcctgaaggagctggtgcagaggggccacgaggtgacagtgctggccagcagcgccagcatcctgtttgaccccaatgacagcagcaccctgaagctggaggtgtaccccaccagcctgaccaagacagaatttgagaacatcatcatgcagctggtgaagaggctgtctgagatccagaaggacaccttctggctgcccttcagccaggagcaggagatcctgtgggccatcaatgacatcatccggaacttctgcaaggatgtggtgagcaacaagaagctgatgaagaagctgcaggagagcagatttgacatcgtgtttgctgatgcctacctgccctgtggggagctgctggccgagctgttcaacatcccctttgtgtacagccacagcttcagccctggctacagctttgagcggcacagcggcggcttcatcttccccccatcctatgtgcctgtggtgatgagcaagctgagtgaccagatgaccttcatggagcgggtgaagaacatgctgtatgtgctgtactttgacttctggttccagatcttcaacatgaagaagtgggaccagttctacagcgaggtgctgggccggcccaccaccctgtctgagaccatgaggaaggctgacatctggctgatgaggaacagctggaacttcaagttcccccaccccttcctgcccaacgtggactttgtgggcggcctgcactgcaagccagccaagcccctgcccaaggagatggaggagtttgtgcagagcagcggggagaatggagtggtggtgttcagcctgggctccatggtgagcaacatgacagaggagcgggccaacgtgattgccacagccctggccaagatcccccagaaggtgctgtggaggtttgatggcaacaagccagatgccctgggcctgaacacccggctgtacaagtggatcccccagaatgacctgctgggccaccccaagacccgggccttcatcacccatggaggagccaacggcatctatgaggccatctaccacggcatccccatggtgggcatccccctcttctttgaccagcctgacaacatcgcccacatgaaggccaagggagctgctgtgcgggtggacttcaacaccatgagcagcacagacctgctgaatgccctgaagacagtcatcaatgaccccagctacaaggagaacatcatgaagctgagccgcatccagcacgaccagcctgtgaagcccctggacagagctgtgttctggattgaatttgtgatgaggcacaagggggccaagcacctgcgggtggccgcccacaacctgacctggttccagtaccacagcctggatgtgattggcttcctgctggcctgtgtggccaccgtgctcttcatcatcaccaagtgctgcctcttctgcttctggaagtttgccaggaagggcaagaagggcaagagggactag

SEQ ID NO: 39772 - DNA, 1572 bp, Artificial Sequence
  Description of Artificial Sequence: Synthetic coding sequence
atggtgggccagagggtgctgctgctggtggccttcctgctgtctggagtgctgctgtctgaggccgccaagatcctgaccatcagcaccctgggcggcagccactacctgctgctggacagagtgtcccagatcctgcaggagcacggccacaacgtgaccatgctgcaccagagcggcaagttcctgatcccagacatcaaggaggaggagaagagctaccaggtgatccgctggttctccccagaggaccaccagaagaggatcaagaagcactttgacagctacattgaaacagccctggatggcaggaaggagagcgaggccctggtgaagctgatggagatcttcggcacccagtgcagctacctgctgagcaggaaggacatcatggacagcctgaagaatgaaaattatgacctggtgtttgtggaggcctttgacttctgcagcttcctgattgctgagaagctggtgaagccctttgtggccatcctgcccaccaccttcggcagcctggactttggcctgcccagccccctgtcctatgtgcctgtgttccccagcctgctgacagaccacatggacttctggggccgggtgaagaacttcctgatgttcttctccttcagccgcagccagtgggacatgcagagcacctttgacaacaccatcaaggagcacttccctgagggcagcaggcctgtgctgagccacctgctgctgaaggccgagctgtggtttgtgaacagcgactttgcctttgattttgcccggcccctgctgcccaacacagtgtacatcggcggcctgatggagaagcccatcaagcctgtgccccaggacctggacaacttcatcgccaactttggagatgctggctttgtgctggtggccttcggctccatgctgaacacccaccagagccaggaggtgctgaagaagatgcacaatgcctttgcccacctgccccagggcgtcatctggacctgccagagcagccactggcccagagatgtgcacctggccaccaacgtgaagatcgtggactggctgccccagagcgacctgctggcccaccccagcatccggctgtttgtgacccatggaggccagaacagcgtgatggaggccatcagacatggagtgcccatggtgggcctgcctgtgaatggagaccagcacggcaacatggtgcgggtggtggccaagaactacggcgtgtccatccggctgaaccaggtgacagctgacaccctgaccctgaccatgaagcaggtgattgaggacaagcgctacaagtctgctgtggtggccgccagcgtcatcctgcacagccagcccctgagccctgcccagaggctggtgggctggattgaccacatcctgcagacaggaggagccacccacctgaagccctatgccttccagcagccctggcatgagcagtacctgattgatgtgtttgtgttcctgctgggcctgaccctgggcaccatgtggctgtgtgggaagctgctgggcgtggtggcccgctggctgcggggggccaggaaggtgaagaagacctag

SEQ ID NO: 39773 - DNA, 759 bp, Artificial Sequence
  Description of Artificial Sequence: Synthetic coding sequence
atgctgcaccagagcggcaagttcctgatcccagacatcaaggaggaggagaagagctaccaggtgatccgctggttctccccagaggaccaccagaagaggatcaagaagcactttgacagctacattgaaacagccctggatggcaggaaggagagcgaggccctggtgaagctgatggagatcttcggcacccagtgcagctacctgctgagcaggaaggacatcatggacagcctgaagaatgaaaattatgacctggtgtttgtggaggcctttgacttctgcagcttcctgattgctgagaagctggtgaagccctttgtggccatcctgcccaccaccttcggcagcctggactttggcctgcccagccccctgtcctatgtgcctgtgttccccagcctgctgacagaccacatggacttctggggccgggtgaagaacttcctgatgttcttctccttcagccgcagccagtgggacatgcagagcacctttgacaacaccatcaaggagcacttccctgagggcagcaggcctgtgctgagccacctgctgctgaaggccgagctgtggtttgtgaacagcgactttgcctttgattttgcccggcccctgctgcccaacacagtgtacatcggcggcctgatggagaagcccatcaagcctgtgccccagaatggccagcctgccctcttcaccacccccagcctcttcagcagcggcgtgtacccagagcccctgcgctggctgtag

SEQ ID NO: 39774 - DNA, 1626 bp, Artificial Sequence
  Description of Artificial Sequence: Synthetic coding sequence
atgaagagctacaccccctacttcatcctgctgtggagcgctgtgggcatcgccaaggccgccaagatcatcatcgtgccccccatcatgtttgagagccacatgtacatcttcaagaccctggccagcgccctgcacgagcggggccaccacacagtgttcctgctgtctgagggccgggacatcgcccccagcaaccactacagcctgcagcgctacccaggcatcttcaacagcaccaccagtgatgccttcctgcagagcaagatgaggaacatcttcagcggccgcctgacagccatcgagctgtttgacatcctggaccactacaccaagaactgtgacctgatggtgggcaaccacgccctgatccagggcctgaagaaggagaagtttgacctgctgctggtggaccccaatgacatgtgtggctttgtgattgcccacctgctgggcgtgaagtatgctgtgttcagcacaggcctgtggtacccagctgaggtgggcgccccagcccccctggcctacgtgcctgagttcaacagcctgctgacagacaggatgaacctgctgcagaggatgaagaacacaggagtgtacctgatcagccggctgggcgtgtccttcctggtgctgcccaagtatgagcgcatcatgcagaagtacaacctgctgcctgagaagtccatgtatgacctggtgcacggcagcagcctgtggatgctgtgcacagatgtggccctggagttcccccggcccaccctgcccaacgtggtgtatgtgggcggcatcctgaccaagccagccagccccctgcctgaggacctgcagcgctgggtgaatggagccaatgagcacggctttgtgctggtgtcctttggagctggggtgaagtacctgtctgaggacatcgccaacaagctggccggggccctgggccgcctgccccagaaggtgatctggaggttcagcggccccaagcccaagaacctgggcaacaacaccaagctgattgagtggctgccccagaatgacctgctgggccacagcaagatcaaggccttcctgagccacggcggcctgaacagcatctttgagaccatctaccacggcgtgcctgtggtgggcatccccctgtttggagaccactatgacaccatgaccagggtgcaggccaagggcatgggcatcctgctggagtggaagacagtgacagagaaggagctgtatgaggccctggtgaaggtgatcaacaaccccagctaccggcagagggcccagaagctgtctgagatccacaaggaccagcccggccaccctgtgaacagaaccatctactggattgactacatcatccgccacaatggagcccaccacctgcgggctgctgtgcaccagatctccttctgccagtacttcctgctggacatcgcctttgtgctgctgctgggcgccgccctgctgtacttcctgctgtcctgggtgaccaagttcatctacaggaagatcaagagcctgtggagcaggaacaagcacagcacagtgaatggccactaccacaacggcatcctgaatggcaagtacaagagaaatggccacatcaagcatgagaagaaggtgaagtag

SEQ ID NO: 39775 - DNA, 1626 bp, Artificial Sequence; identical to SEQ ID NO: 39774
  Description of Artificial Sequence: Synthetic coding sequence

SEQ ID NO: 39776 - DNA, 426 bp, Artificial Sequence
  Description of Artificial Sequence: Synthetic coding sequence
atgaagagctacaccccctacttcatcctgctgtggagcgctgtgggcatcgccaaggccgccaagatcatcatcgtgccccccatcatgtttgagagccacatgtacatcttcaagaccctggccagcgccctgcacgagcggggccaccacacagtgttcctgctgtctgagggccgggacatcgcccccagcaaccactacagcctgcagcgctacccaggcatcttcaacagcaccaccagtgatgccttcctgcagagcaagatgaggaacatcttcagcggccgcctgacagccatcgagctgtttgacatcctggaccactacaccaagaactgtgacctgatggtgggcaaccacgccctgatccagggcctgaagaaggagaagtttgacctgctgctggtggaccccaatgactag

SEQ ID NO: 39777 - DNA, 990 bp, Artificial Sequence
  Description of Artificial Sequence: Synthetic coding sequence
atgaagctgctgcggcgggcctggaggcggcgggccgccctgggcctgggcaccctggccctgtgtggggccgccctgctgtacctggcccgctgtgccgctgagcccggggacccccgggccatgagcggccgcagccccccacctccagccccagcccgggccgccgccttcctggccgtgctggtggccagcgcccccagggctgctgagcggcgcagcgtcatccgcagcacctggctggccaggagaggagcccctggagatgtgtgggccaggtttgctgtgggcacagctggcctgggcgctgaggagcggcgggccctggagcgggagcaggcccggcacggggacctgctgctgctgcctgccctgagagatgcctatgagaacctgacagccaaggtgctggccatgctggcctggctggatgagcacgtggcctttgaatttgtgctgaaggcagatgatgacagctttgcccggctggatgccctgctggccgagctgcgggcccgggagcccgccaggagaagaagactctactggggcttcttcagcggccggggccgggtgaagccaggcggccgctggagggaggccgcctggcagctgtgtgactactacctgccctatgccctgggcggcggctacgtgctgtctgctgacctggtgcactacctgcggctgagccgggactacctgcgggcctggcacagtgaagatgtgtccctgggcgcctggctggcccctgtggatgtgcagcgggagcatgaccccaggtttgacacagagtaccgcagccggggctgcagcaaccagtacctggtgacccacaagcagagcctggaggacatgctggagaagcacgccaccctggcccgggagggccgcctgtgcaagcgggaggtgcagctgcggctgtcctatgtgtatgactggagcgccccacccagccagtgctgccagaggcgggagggcatcccctag

SEQ ID NO: 39778 - DNA, 981 bp, Artificial Sequence
  Description of Artificial Sequence: Synthetic coding sequence
atggccagcaaggtgtcctgcctgtatgtgctgactgtggtgtgctgggccagcgccctgtggtacctgagcatcacccggcccaccagcagctacacaggcagcaagcccttcagccacctgactgtggccaggaagaacttcaccttcggcaacatccgcacccggcccatcaacccccacagctttgagttcctgatcaatgagcccaacaagtgtgagaagaacatccccttcctggtgatcctgatcagcaccacccacaaggagtttgatgcccggcaggccatccgggagacctggggagatgagaacaacttcaagggcatcaagatcgccaccctcttcctgctgggcaagaatgctgaccctgtgctgaaccagatggtggagcaggagagccagatcttccatgacatcatcgtggaggacttcatcgacagctaccacaacctgaccctgaagaccctgatgggcatgcgctgggtggccaccttctgcagcaaggccaagtatgtgatgaagacagacagcgacatctttgtgaacatggacaacctgatctacaagctgctgaagcccagcaccaagccccggcggcgctacttcaccggctacgtgatcaatggaggccccatcagagatgtgcgcagcaagtggtacatgccccgggacctgtacccagacagcaactacccacccttctgcagcggcaccggctacatcttcagcgcagatgtggccgagctgatctacaagaccagcctgcacacccggctgctgcacctggaggatgtgtatgtgggcctgtgcctgaggaagctgggcatccaccccttccagaacagcggcttcaaccactggaagatggcctacagcctgtgccgctaccgccgggtcatcaccgtgcaccagatcagccctgaggagatgcaccgcatctggaatgacatgagcagcaagaagcacctgcgctgctag

SEQ ID NO: 39779 - DNA, 981 bp, Artificial Sequence; identical to SEQ ID NO: 39778
  Description of Artificial Sequence: Synthetic coding sequence

SEQ ID NO: 39780 - DNA, 1248 bp, Artificial Sequence
  Description of Artificial Sequence: Synthetic coding sequence
atgcagatgtcctatgccatccgctgtgccttctaccagctgctgctggccgccctgatgctggtggccatgctgcagctgctgtacctgagcctgctgagcggcctgcacggccaggaggagcaggaccagtactttgagttcttcccccccagccccaggtctgtggaccaggtgaaggcccagctgaggacagccctggccagcggaggagtgctggatgccagcggggactacagagtgtaccggggcctgctgaagaccaccatggaccccaatgatgtgatcctggccacccacgcctctgtggacaacctgctgcacctgagcggcctgctggagcgctgggagggccccctgtctgtgtctgtgtttgctgccaccaaggaggaggcccagctggccaccgtgctggcctatgccctgagcagccactgcccagacatgagggcccgggtggccatgcacctggtgtgccccagccgctatgaagctgctgtgcctgacccccgggagcctggagaatttgccctgctgcggagctgccaggaggtgtttgacaagctggcccgggtggcccagcccggcatcaactatgccctgggcaccaacgtgtcctaccccaacaacctgctgaggaacctggcccgggagggcgccaactatgccctggtgattgatgtggacatggtgcccagcgagggcctgtggaggggcctgcgggagatgctggaccagagcaaccagtggggcggcacagccctggtggtgcctgcctttgagatcagaagagcccggaggatgcccatgaacaagaatgagctggtgcagctgtaccaggtgggggaggtgcggcccttctactacggcctgtgcaccccctgccaggcccccaccaactacagccgctgggtgaacctgcctgaggagagcctgctgcggcctgcctacgtggtgccctggcaggacccctgggagcccttctacgtggccggcggcaaggtgcccacctttgatgagcgcttccggcagtatggcttcaaccgcatcagccaggcctgtgagctgcacgtggccggctttgattttgaggtgctgaatgaaggcttcctggtgcacaagggcttcaaggaggccctgaagttccacccccagaaggaggccgagaaccagcacaacaagatcctgtaccggcagttcaagcaggagctgaaggccaagtaccccaacagcccccggcgctgctag

SEQ ID NO: 39781 - DNA, 561 bp, Artificial Sequence
  Description of Artificial Sequence: Synthetic coding sequence
atggtgcccagcgagggcctgtggaggggcctgcgggagatgctggaccagagcaaccagtggggcggcacagccctggtggtgcctgcctttgagatccggcgggcccggaggatgcccatgaacaagaatgagctggtgcagctgtaccaggtgggggaggtgcggcccttctactacggcctgtgcaccccctgccaggcccccaccaactacagccgctgggtgaacctgcctgaggagagcctgctgcggcctgcctacgtggtgccctggcaggacccctgggagcccttctacgtggccggcggcaaggtgcccacctttgatgagcgcttccggcagtatggcttcaaccgcatcagccaggcctgtgagctgcacgtggccggctttgattttgaggtgctgaatgaaggcttcctggtgcacaagggcttcaaggaggccctgaagttccacccccagaaggaggccgagaaccagcacaacaagatcctgtaccggcagttcaagcaggagctgaaggccaagtaccccaacagcccccggcgctgctag

SEQ ID NO: 39782 - DNA, 1194 bp, Artificial Sequence
  Description of Artificial Sequence: Synthetic coding sequence
atgtctgtgggcagaagacgcatcaagctgctgggcatcctgatgatggccaacgtgttcatctacttcatcatggaggtgtccaagagcagcagccaggagaagaatggcaagggggaggtgatcatccccaaggagaagttctggaagatcagcaccccacctgaggcctactggaaccgggagcaggagaagctgaaccggcagtacaaccccatcctgtccatgctgaccaaccagacaggagaggccggccgcctgagcaacatcagccacctgaactactgtgagccagacctgcgggtgacctctgtggtgacaggcttcaacaacctgcctgaccgcttcaaggacttcctgctgtacctgcgctgcaggaactacagcctgctgattgaccagcctgacaagtgtgccaagaagcccttcctgctgctggccatcaagagcctgaccccccactttgcccggcggcaggccatccgggagagctggggccaggagagcaatgccggcaaccagacagtggtgcgggtcttcctgctgggccagaccccacctgaggacaaccacccagacctgagtgacatgctgaagtttgagagcgagaagcaccaggacatcctgatgtggaactacagagacaccttcttcaacctgagcctgaaggaggtgctcttcctgcgctgggtgtccaccagctgcccagacacagaatttgtgttcaagggagatgatgatgtgtttgtgaacacccaccacatcctgaactacctgaacagcctgagcaagaccaaggccaaggacctcttcatcggagatgtgatccacaatgccggcccccaccgggacaagaagctgaagtactacatccctgaggtggtgtacagcggcctgtacccaccctatgctgggggcggcggcttcctgtacagcggccacctggccctgcggctgtaccacatcacagaccaggtgcacctgtaccccattgatgatgtgtacacaggcatgtgcctgcagaagctgggcctggtgcctgagaagcacaagggcttccgcacctttgacatcgaggagaagaacaagaacaacatctgcagctatgtggacctgatgctggtgcacagcaggaagccccaggagatgattgacatctggagccagctgcagagcgcccacctgaagtgctag

SEQ ID NO: 39783 - DNA, 1194 bp, Artificial Sequence; identical to SEQ ID NO: 39782
  Description of Artificial Sequence: Synthetic coding sequence

SEQ ID NO: 39784 - DNA, 1137 bp, Artificial Sequence
  Description of Artificial Sequence: Synthetic coding sequence
atgaggatgctggtgtctggccggcgggtgaagaagtggcagctgatcatccagctgtttgccacctgcttcctggccagcctgatgttcttctgggagcccatcgacaaccacatcgtgagccacatgaagagctacagctaccgctacctgatcaacagctatgactttgtgaatgacaccctgagcctgaagcacaccagcgctggcccccgctaccagtacctgatcaaccacaaggagaagtgccaggcccaggatgtgctgctgctgctgtttgtgaagacagccccagaaaattatgacagaagaagtggcatccggaggacctggggcaatgaaaactacgtgcgcagccagctgaatgccaacatcaagaccctgtttgccctgggcacccccaaccccctggagggggaggagctgcagaggaagctggcctgggaggaccagcgctacaatgacatcatccagcaggactttgtggacagcttctacaacctgaccctgaagctgctgatgcagttctcctgggccaacacctactgcccccacgccaagttcctgatgacagcagatgatgacatcttcatccacatgcccaacctgattgagtacctgcagagcctggagcagattggagtgcaggacttctggattggccgggtgcacagaggagccccacccatccgggacaagagcagcaagtactacgtgtcctatgagatgtaccagtggccagcctacccagactacacagctggggccgcctacgtgatctctggagatgtggccgccaaggtgtatgaggccagccagaccctgaacagcagcctgtacattgatgatgtgttcatgggcctgtgtgccaacaagattggaattgtgccccaggaccacgtgttcttcagcggggagggcaagaccccctaccacccctgcatctatgagaagatgatgaccagccacggccacctggaggacctgcaggacctgtggaagaatgccacagaccccaaggtgaagaccatcagcaagggcttcttcggccagatctactgccgcctgatgaagatcatcctgctgtgcaagatctcctatgtggacacctacccctgcagagctgccttcatctag

SEQ ID NO: 39785 - DNA, 1137 bp, Artificial Sequence; identical to SEQ ID NO: 39784
  Description of Artificial Sequence: Synthetic coding sequence

SEQ ID NO: 39786 - DNA, 189 bp, Artificial Sequence
  Description of Artificial Sequence: Synthetic coding sequence
atgaggatgctggtgtctggccggcgggtgaagaagtggcagctgatcatccagctgtttgccacctgcttcctggccagcctgatgttcttctgggagcccatcgacaaccacatcgtgagccacatgaagagctacagctaccgctacctgatcaacagctatgactttgtgaatgacaccctgtag

SEQ ID NO: 39787 - DNA, 246 bp, Artificial Sequence
  Description of Artificial Sequence: Synthetic coding sequence
atgaggatgctggtgtctggccggcgggtgaagaagtggcagctgatcatccagctgtttgccacctgcttcctggccagcctgatgttcttctgggagcccatcgacaaccacatcgtgagccacatgaagagctacagctaccgctacctgatcaacagctatgactttgtgaatgacaccctgagcctgaagcacaccagcgctggcccccgctaccagtacctgatcaaccacaaggagtag

SEQ ID NO: 39788 - DNA, 1137 bp, Artificial Sequence; identical to SEQ ID NO: 39784
  Description of Artificial Sequence: Synthetic coding sequence

SEQ ID NO: 39789 - DNA, 153 bp, Artificial Sequence
  Description of Artificial Sequence: Synthetic coding sequence
atgaggatgctggtgtctggccggcgggtgaagaagtggcagctgatcatccagctgtttgccacctgcttcctggccagcctgatgttcttctgggagcccatcgacaaccacatcgtgagccacatgaagagctacagctaccgctactag

SEQ ID NO: 39790 - DNA, 1206 bp, Artificial Sequence
  Description of Artificial Sequence: Synthetic coding sequence
atgagcctgtggaagaagacagtgtaccgcagcctgtgcctggccctggccctgctggtggccgtgacagtgttccagaggagcctgaccccaggccagttcctgcaggagcccccaccacccaccctggagccccagaaggcccagaagcccaacggccagctggtgaaccccaacaacttctggaagaaccccaaggatgtggccgcccccacccccatggccagccagggcccccaggcctgggatgtgaccaccaccaactgcagcgccaacatcaacctgacccaccagccctggttccaggtgctggagccccagttccggcagttcctgttctaccgccactgccgctacttccccatgctgctgaaccaccctgagaagtgcagaggagatgtgtacctgctggtggtggtgaagagcgtcatcacccagcacgacagaagagaggccatccggcagacctggggccgggagcggcagagcgctgggggcggccgcggggctgtgaggaccctcttcctgctgggcacagccagcaagcaggaggagaggacccactaccagcagctgctggcctatgaggaccggctgtatggagacatcctgcagtggggcttcctggacaccttcttcaacctgaccctgaaggagatccacttcctgaagtggctggacatctactgcccccacgtgcccttcatcttcaagggagatgatgatgtgtttgtgaaccccaccaacctgctggagttcctggccgaccggcagccccaggagaacctgtttgtgggagatgtgctgcagcacgcccggcccatccggaggaaggacaacaagtactacatccctggggccctgtatggcaaggccagctacccaccctatgctgggggcggcggcttcctgatggccggcagcctggcccggcggctgcaccacgcctgtgacaccctggagctgtaccccattgatgatgtgttcctgggcatgtgcctggaggtgctgggcgtgcagcccacagcccacgagggcttcaagaccttcggcatcagcaggaacagaaacagcaggatgaacaaggagccctgcttcttccgggccatgctggtggtgcacaagctgctgcccccagagctgctggccatgtggggcctggtgcacagcaacctgacctgcagcaggaagctgcaggtgctgtag

SEQ ID NO: 39791 - DNA, 1194 bp, Artificial Sequence
  Description of Artificial Sequence: Synthetic coding sequence
atgcgctgccccaagtgcctgctgtgcctgagcgccctgctgaccctgctgggcctgaaggtgtacatcgagtggaccagcgagagccggctgagcaaggcctaccccagcccccggggcaccccacccagccccaccccagccaaccctgagcccaccctgcctgccaacctgagcacccggctgggccagaccatccccctgccctttgcctactggaaccagcagcagtggaggctgggcagcctgcccagcggggacagcacagaaacaggaggctgccaggcctggggcgctgctgctgccacagagatcccagactttgccagctaccccaaggacctgcggcgcttcctgctgtctgctgcctgccgctccttcccccagtggctgcccggcggcggcggcagccaggtgagcagctgcagcgacacagatgtgccctacctgctgctggccgtgaagtctgagcccggccgctttgctgagcggcaggccgtgcgggagacctggggcagccctgcccctggcatccggctgctcttcctgctgggcagccctgtgggggaggccggccctgacctggacagcctggtggcctgggagagccgccgctacagcgacctgctgctgtgggacttcctggatgtgcccttcaaccagaccctgaaggacctgctgctgctggcctggctgggccgccactgccccaccgtgtcctttgtgctgcgggcccaggatgatgcctttgtgcacaccccagccctgctggcccacctgcgggccctgcccccagccagcgcccggagcctgtacctgggggaggtgttcacccaggccatgcccctgaggaagccaggcggccccttctacgtgcctgagagcttctttgaaggaggctacccagcctatgccagcggcggcggctacgtgattgctggccgcctggccccctggctgctgcgggccgccgcccgggtggcccccttcccctttgaagatgtgtacacaggcctgtgcatccgggccctgggcctggtgccccaggcccaccctggcttcctgacagcctggccagctgacagaacagctgaccactgtgccttcaggaacctgctgctggtgcggcccctgggcccccaggccagcatccggctgtggaagcagctgcaggacccccggctgcagtgctag

SEQ ID NO: 39792 - DNA, 1209 bp, Artificial Sequence
  Description of Artificial Sequence: Synthetic coding sequence
atgagaagaaggctgcggctgcggagagatgccctgctgaccctgctgctgggcgccagcctgggcctgctgctgtatgcccagagagatggagctgcccccacagccagcgccccccggggccggggccgggccgccccccggcccaccccaggcccccgggccttccagctgcctgatgctggagctgcccccccagcctatgaaggagacaccccagccccacccacccccaccggcccctttgattttgcccgctacctgcgggccaaggaccagaggcgcttccccctgctgatcaaccagccccacaagtgcagaggagatggagcccctgggggccgcccagacctgctgattgctgtgaagtctgtggctgaagattttgaaagacggcaggccgtgcggcagacctggggcgctgagggccgggtgcagggcgccctggtgagaagagtcttcctgctgggcgtgcccaggggggccggcagcggcggcgcagatgaggtgggggagggcgcccggacccactggagggccctgctgcgggcagagagcctggcctatgctgacatcctgctgtgggcctttgatgacaccttcttcaacctgaccctgaaggagatccacttcctggcctgggccagcgccttctgcccagatgtgcgctttgtgttcaagggagatgctgatgtgtttgtgaatgtgggcaacctgctggagttcctggccccccgggaccctgcccaggacctgctggccggagatgtgattgtgcacgcccggcccatccgcacccgggccagcaagtactacatccctgaggccgtgtatggcctgcctgcctacccagcctatgccggcggcggcggctttgtgctgagcggggccaccctgcaccggctggccggggcctgtgcccaggtggagctgttccccattgatgatgtgttcctgggcatgtgcctgcagaggctgcggctgaccccagagccccacccagccttccgcaccttcggcatcccccagcccagcgctgccccccacctgagcacctttgacccctgcttctaccgggagctggtggtggtgcacggcctgtctgctgctgacatctggctgatgtggaggctgctgcacggcccccacggccctgcctgtgcccacccccagcctgtggccgccggccccttccagtgggacagctag

SEQ ID NO: 39793 - DNA, 1584 bp, Artificial Sequence; identical to SEQ ID NO: 39769
  Description of Artificial Sequence: Synthetic coding sequence

SEQ ID NO: 39794 - DNA, 717 bp, Artificial Sequence; identical to SEQ ID NO: 39770
  Description of Artificial Sequence: Synthetic coding sequence

SEQ ID NO: 39795 - DNA, 1587 bp, Artificial Sequence; identical to SEQ ID NO: 39771
  Description of Artificial Sequence: Synthetic coding sequence

SEQ ID NO: 39796 - DNA, 1827 bp, Artificial Sequence
  Description of Artificial Sequence: Synthetic coding sequence
atgggctctgtgacagtgcgctacttctgctacggctgcctcttcaccagcgccacctggacagtgctgctgtttgtgtacttcaacttcagcgaggtgacccagcccctgaagaatgtgcctgtgaagggcagcggcccccacggccccagccccaagaagttctacccccgcttcacccggggccccagccgggtgctggagccccagttcaaggccaacaagattgatgatgtgattgacagccgggtggaggaccctgaggagggccacctgaagttcagcagcgagctgggcatgatcttcaatgaaagagaccaggagctgcgggacctgggctaccagaagcacgccttcaacatgctgatcagtgaccggctgggctaccacagagatgtgcctgacaccagaaatgctgcctgcaaggagaagttctaccccccagacctgcctgctgcctctgtggtgatctgcttctacaatgaggccttcagcgccctgctgaggacagtgcacagcgtgattgacaggaccccagcccacctgctgcacgagatcatcctggtggatgatgacagcgactttgatgacctgaagggggagctggatgaatatgtgcagaagtacctgcccgggaagatcaaggtgatccggaacaccaagcgggagggcctcatccggggccgcatgattggagctgcccacgccactggagaggtgctggtgttcctggacagccactgtgaggtgaatgtgatgtggctgcagcccctgctggccgccatccgggaggacagacacacagtggtgtgccctgtgattgacatcatctctgctgacaccctggcctacagcagcagccctgtggtgcggggcggcttcaactggggcctgcacttcaagtgggacctggtgcccctgtctgagctgggccgggcagagggcgccacagcccccatcaagagccccaccatggccggcggcctgtttgccatgaaccggcagtacttccacgagctgggccagtatgattctggcatggacatctggggcggggagaacctggagatctccttccgcatctggatgtgtggcggcaagctgttcatcatcccctgcagccgggtgggccacatcttcaggaagagaagaccctacggcagccctgagggccaggacaccatgacccacaacagcctgcggctggcccacgtgtggctggatgagtacaaggagcagtacttcagcctgcggccagacctgaagaccaagagctatggcaacatcagcgagcgggtggagctgaggaagaagctgggctgcaagagcttcaagtggtacctggacaacgtgtacccagagatgcagatcagcggcagccacgccaagccccagcagcccatctttgtgaacagaggccccaagaggcccaaggtgctgcagaggggccgcctgtaccacctgcagaccaacaagtgcctggtggcccagggccggcccagccagaagggcggcctggtggtgctgaaggcctgtgactacagcgaccccaaccagatctggatctacaatgaggagcacgagctggtgctgaacagcctgctgtgcctggacatgtctgagaccaggagcagtgaccccccccggctgatgaagtgccacggcagcggcggcagccagcagtggaccttcggcaagaacaaccggctgtaccaggtgtctgtgggccagtgcctgcgggctgtggaccccctgggccagaagggctctgtggccatggccatctgtgatggcagcagcagccagcagtggcacctggagggctag

SEQ ID NO: 39797 - DNA, 609 bp, Artificial Sequence
  Description of Artificial Sequence: Synthetic coding sequence
atgggctctgtgacagtgcgctacttctgctacggctgcctcttcaccagcgccacctggacagtgctgctgtttgtgtacttcaacttcagcgaggtgacccagcccctgaagaatgtgcctgtgaagggcagcggcccccacggccccagccccaagaagttctacccccgcttcacccggggccccagccgggtgctggagccccagttcaaggccaacaagattgatgatgtgattgacagccgggtggaggaccctgaggagggccacctgaagttcagcagcgagctgggcatgatcttcaatgaaagagaccaggagctgcgggacctgggctaccagaagcacgccttcaacatgctgatcagtgaccggctgggctaccacagagatgtgcctgacaccagaaatgctgcctgcaaggagaagttctaccccccagacctgcctgctgcctctgtggtgatctgcttctacaatgaggccttcagcgccctgctgaggacagtgcacagcgtgattgacaggaccccagcccacctgctgcacgagatcatcctggtggatgatgacagcgactttgggaaggagtgctgcacctggtag

SEQ ID NO: 39798 - DNA, 561 bp, Artificial Sequence
  Description of Artificial Sequence: Synthetic coding sequence
atgggctctgtgacagtgcgctacttctgctacggctgcctcttcaccagcgccacctggacagtgctgctgtttgtgtacttcaacttcagcgaggtgacccagcccctgaagaatgtgcctgtgaagggcagcggcccccacggccccagccccaagaagttctacccccgcttcacccggggccccagccgggtgctggagccccagttcaaggccaacaagattgatgatgtgattgacagccgggtggaggaccctgaggagggccacctgaagttcagcagcgagctgggcatgatcttcaatgaaagagaccaggagctgcgggacctgggctaccagaagcacgccttcaacatgctgatcagtgaccggctgggctaccacagagatgtgcctgacaccagaaatgctgcctgcaaggagaagttctaccccccagacctgcctgctgcctctgtggtgatctgcttctacaatgaggccttcagcgccctgctgaggacagtgcacagcgtgattgacaggaccccagcccacctgctgcacgagatctag

SEQ ID NO: 39799 - DNA, 402 bp, Artificial Sequence
  Description of Artificial Sequence: Synthetic coding sequence
atgggctctgtgacagtgcgctacttctgctacggctgcctcttcaccagcgccacctggacagtgctgctgtttgtgtacttcaacttcagcgaggtgacccagcccctgaagaatgtgcctgtgaagggcagcggcccccacggccccagccccaagaagttctacccccgcttcacccggggccccagccgggtgctggagccccagttcaaggccaacaagattgatgatgtgattgacagccgggtggaggaccctgaggagggccacctgaagttcagcagcgagctggatgtgaagaagagcagcacccacctgacctgccagctgctggtgctgctgtctgtgtccatcatgaagcgcttcctgccctgcttcggccagtgcaccgtgtcctag

SEQ ID NO: 39800 - DNA, 1827 bp, Artificial Sequence; identical to SEQ ID NO: 39796
  Description of Artificial Sequence: Synthetic coding sequence

SEQ ID NO: 39801 - DNA, 297 bp, Artificial Sequence
  Description of Artificial Sequence: Synthetic coding sequence
atgggctctgtgacagtgcgctacttctgctacggctgcctcttcaccagcgccacctggacagtgctgctgtttgtgtacttcaacttcagcgaggtgacccagcccctgaagaatgtgcctgtgaagggcagcggcccccacggccccagccccaagaagttctacccccgcttcacccggggccccagccgggtgctggagccccagttcaaggccaacaagattgatgatgtgattgacagccgggtggaggaccctgaggagggccacctgaagttcagcagcgagctgtag

SEQ ID NO: 39802 - DNA, 1827 bp, Artificial Sequence; identical to SEQ ID NO: 39796
  Description of Artificial Sequence: Synthetic coding sequence

SEQ ID NO: 39803 - DNA, 1827 bp, Artificial Sequence; identical to SEQ ID NO: 39796
  Description of Artificial Sequence: Synthetic coding sequence

SEQ ID NO: 39804 - DNA, 483 bp, Artificial Sequence
  Description of Artificial Sequence: Synthetic coding sequence
atgggctctgtgacagtgcgctacttctgctacggctgcctcttcaccagcgccacctggacagtgctgctgtttgtgtacttcaacttcagcgaggtgacccagcccctgaagaatgtgcctgtgaagggcagcggcccccacggccccagccccaagaagttctacccccgcttcacccggggccccagccgggtgctggagccccagttcaaggccaacaagattgatgatgtgattgacagccgggtggaggaccctgaggagggccacctgaagttcagcagcgagctgggcatgatcttcaatgaaagagaccaggagctgcgggacctgggctaccagaagcacgccttcaacatgctgatcagtgaccggctgggctaccacagagatgtgcctgacaccagaaatgctgcctgcaaggagaagttctaccccccagacctgcctgctgcctctgtggtgatctgcttctactag

SEQ ID NO: 39805 - DNA, 1584 bp, Artificial Sequence
  Description of Artificial Sequence: Synthetic coding sequence
atgccccagcctgagagccagaaggccgccatcctgggctgcggccagggcggcatgatcttcaatgaaagagaccaggagctgcgggacctgggctaccagaagcacgccttcaacatgctgatcagtgaccggctgggctaccacagagatgtgcctgacaccagaaatgctgcctgcaaggagaagttctaccccccagacctgcctgctgcctctgtggtgatctgcttctacaatgaggccttcagcgccctgctgaggacagtgcacagcgtcatcgacaggaccccagcccacctgctgcacgagatcatcctggtggatgatgacagcgactttgatgacctgaagggggagctggatgaatatgtgcagaagtacctgcccgggaagatcaaggtgatccggaacaccaagcgggagggcctcatccggggccgcatgattggagctgcccacgccaccggggaggtgctggtgttcctggacagccactgtgaggtgaatgtgatgtggctgcagcccctgctggccgccatcagagaagatagacacacagtggtgtgccctgtgattgacatcatctctgctgacaccctggcctacagcagcagccctgtggtgcggggcggcttcaactggggcctgcacttcaagtgggacctggtgcccctgtctgagctgggccgggcagagggcgccacagcccccatcaagagccccaccatggccggcggcctgtttgccatgaaccggcagtacttccacgagctgggccagtatgacagcggcatggacatctggggcggggagaacctggagatctccttccgcatctggatgtgtggcggcaagctgttcatcatcccctgcagccgggtgggccacatcttcaggaagaggcggccctacggcagccctgagggccaggacaccatgacccacaacagcctgcggctggcccacgtgtggctggatgagtacaaggagcagtacttcagcctgcggccagacctgaagaccaagagctatggcaacatcagcgagcgggtggagctgaggaagaagctgggctgcaagagcttcaagtggtacctggacaacgtgtacccagagatgcagatcagcggcagccacgccaagccccagcagcccatctttgtgaacagaggccccaagaggcccaaggtgctgcagaggggccgcctgtaccacctgcagaccaacaagtgcctggtggcccagggccggcccagccagaagggcggcctggtggtgctgaaggcctgtgactacagcgaccccaaccagatctggatctacaatgaggagcacgagctggtgctgaacagcctgctgtgcctggacatgtctgagaccaggagcagtgaccccccccggctgatgaagtgccacggcagcggcggcagccagcagtggaccttcggcaagaacaacagactctaccaggtgtctgtgggccagtgcctgcgggctgtggaccccctgggccagaagggctctgtggccatggccatctgtgatggcagcagcagccagcagtggcacctggagggctag

SEQ ID NO: 39806 - DNA, 2823 bp, Artificial Sequence
  Description of Artificial Sequence: Synthetic coding sequence
atgaaccgcatcaggaagttcttccggggcagcggccgggtgctggccttcatctttgtggccagcgtcatctggctgctgtttgacatggccgccctgcggctgtccttcagcgagatcaacaccagggtcatcaaggaggacatcgtgagaagagaaagaattggcttccgggtgcagcctgaccagggcaagatcttctacagcagcatcaaggagatgaagccacccctgcggggccatggaaaaggagcctggggcaaggaaaatgtgaggaagacagaggagagcgtgctgaaggtggaggtggacctggaccagacccagcgggagaggaagatgcagaatgccctgggccggggcaaggtggtgcccctgtggcacccagcccacctgcagaccctgcctgtgacccccaacaagcagaagacagatggccggggcaccaagccagaggccagcagccaccagggcacccccaagcagaccacagcccagggcgcccccaagaccagcttcatcgccgccaagggcacccaggtggtgaagatctctgtgcacatgggccgggtgtccctgaagcaggagcccaggaagagccacagccccagcagtgacaccagcaagctggccgctgagcgggacctgaatgtgaccatcagcctgagcacagaccggcccaagcagaggagccaggccgtggccaatgaaagagcccacccagccagcacagctgtgcccaagtctggagaggccatggccctgaacaagaccaagacccagagcaaggaggtgaatgccaacaagcacaaggccaacaccagcctgcccttccccaagttcaccgtgaacagcaaccggctgaggaagcagagcatcaatgagacccccctgggcagcctgagcaaggatgatggagcccggggggcccacggcaagaagctgaacttcagcgagagccacctggtgatcatcaccaaggaggaggagcagaaggctgaccccaaggaggtgagcaacagcaagaccaagaccatcttccccaaggtgctgggcaagagccagagcaagcacatcagcaggaacagaagtgagatgagcagcagcagcctggccccccaccgggtgcccctgagccagaccaaccacgccctgaccggcggcctggagcccgccaagatcaacatcacagccaaggcccccagcacagagtacaaccagagccacatcaaggccctgctgcctgaggacagcggcacccaccaggtgctgagaattgatgtgaccctgagcccccgggaccccaaggcccctggccagtttggccggcctgtggtggtgccccacggcaaggagaaggaggccgagcggcgctggaaggagggcaacttcaacgtgtacctgagtgacctgatccctgtggaccgggccatcgaggacaccaggcctgctggctgtgccgagcagctggtgcacaacaacctgcccaccaccagcgtcatcatgtgctttgtggatgaggtgtggagcaccctgctgcggtctgtgcacagcgtcatcaacagaagccccccccacctgatcaaggagatcctgctggtggatgacttcagcaccaaggactacctgaaggacaacctggacaagtacatgagccagttccccaaggtgcgcatcctgcggctgaaggagcggcacggcctcatccgggcccggctggccggggcccagaatgccactggagatgtgctgaccttcctggacagccacgtggagtgcaatgtgggctggctggagcccctgctggagcgggtgtacctgagcaggaagaaggtggcctgccctgtgattgaagtcatcaatgacaaggacatgagctacatgacagtggacaacttccagaggggcatctttgtgtggcccatgaactttggctggaggaccatccccccagatgtgattgccaagaaccgcatcaaggagacagacaccatccgctgccctgtgatggccggcggcctcttcagcattgacaagagctacttctttgagctgggcacctatgaccccggcctggatgtgtggggcggggagaacatggagctgtccttcaaggtgtggatgtgtggcggggagattgagatcatcccctgcagccgggtgggccacatcttcagaaatgacaacccctacagcttccccaaggacaggatgaagacagtggagaggaacctggtgcgggtggccgaggtgtggctggatgagtacaaggagctgttctacggccatggagaccacctgattgaccagggcctggatgtgggcaacctgacccagcagcgggagctgaggaagaagctgaagtgcaagagcttcaagtggtacctggagaatgtgtttcctgacctgcgggcccccatcgtgcgggccagcggcgtgctgatcaacgtggccctgggcaagtgcatcagcattgagaacaccaccgtcatcctggaggactgtgatggcagcaaggagctgcagcagttcaactacacctggctgcggctcatcaagtgtggggagtggtgcatcgcccccatcccagacaagggagctgtgcggctgcacccctgtgacaacagaaacaagggcctgaagtggctgcacaagagcaccagcgtcttccaccctgagctggtgaaccacatcgtgtttgagaacaaccagcagctgctgtgcctggagggcaacttcagccagaagatcctgaaggtggccgcctgtgaccctgtgaagccctaccagaagtggaagtttgagaagtactatgaggcctag

SEQ ID NO: 39807 - DNA, 1677 bp, Artificial Sequence
  Description of Artificial Sequence: Synthetic coding sequence
atgaggaagatccgggccaatgccatcgccatcctgactgtggcctggatcctgggcaccttctactacctgtggcaggacaacagagcccacgccgccagcagcggcggccgcggggcccagagagctggaagaagaagtgagcagctgcgggaggacaggaccatccccctgattgtgacaggcacccccagcaagggctttgatgagaaggcctacctgagcgccaagcagctgaaggccggggaggacccctaccggcagcacgccttcaaccagctggagagtgacaagctgagcccagaccggcccatccgggacaccaggcactacagctgccccagcgtgtcctacagcagtgacctgcctgccaccagcgtcatcatcaccttccacaatgaggcccggagcaccctgctgaggacagtgaagtctgtgctgaacagaacaccagccaacctgatccaggagatcatcctggtggatgacttcagcagtgaccctgaggactgcctgctgctgacccgcatccccaaggtgaagtgcctgagaaatgacagaagagagggcctcatccgcagccgggtgagaggagcagatgtggccgccgccaccgtgctgaccttcctggacagccactgtgaggtgaacacagagtggctgccccccatgctgcagagggtgaaggaggaccacaccagggtggtgagccccatcattgatgtgatcagcctggacaactttgcctacctggccgccagcgctgacctgcggggcggctttgactggagcctgcacttcaagtgggagcagatccccctggagcagaagatgaccaggacagaccccacccggcccatccgcacccctgtgattgctgggggcatctttgtgattgacaagtcctggttcaaccacctgggcaagtatgatgcccagatggacatctggggcggggagaactttgagctgtccttccgggtgtggatgtgtggcggcagcctggagatcgtgccctgcagccgggtgggccacgtgttcaggaagaggcacccctacaacttccctgagggcaatgccctgacctacatccggaacaccaagaggacagctgaggtgtggatggatgagtacaagcagtactactatgaggcccggcccagcgccatcggcaaggccttcggctctgtggccaccagaattgagcagaggaagaagatgaactgcaagagcttccgctggtacctggagaatgtgtacccagagctgactgtgcctgtgaaggaggccctgcccggcatcatcaagcagggcgtgaactgcctggagagccagggccagaacacagctggggacttcctgctgggcatgggcatctgccggggcagcgccaagaacccccagcctgcccaggcctggctgttcagtgaccacctgatccagcagcagggcaagtgcctggccgccaccagcaccctgatgagcagccctggcagccctgtgatcctgcagatgtgcaacccccgggagggcaagcagaagtggaggaggaagggcagcttcatccagcacagcgtgtctggcctgtgcctggagaccaagccagcccagctggtgaccagcaagtgccaggctgatgcccaggcccagcagtggcagctgctgccccacacctag

SEQ ID NO: 39808 - DNA, 1677 bp, Artificial Sequence; identical to SEQ ID NO: 39807
  Description of Artificial Sequence: Synthetic coding sequence

SEQ ID NO: 39809 - DNA, 555 bp, Artificial Sequence
  Description of Artificial Sequence: Synthetic coding sequence
atggatgagtacaagcagtactactatgaggcccggcccagcgccatcggcaaggccttcggctctgtggccaccagaattgagcagaggaagaagatgaactgcaagagcttccgctggtacctggagaatgtgtacccagagctgactgtgcctgtgaaggaggccctgcccggcatcatcaagcagggcgtgaactgcctggagagccagggccagaacacagctggggacttcctgctgggcatgggcatctgccggggcagcgccaagaacccccagcctgcccaggcctggctgttcagtgaccacctgatccagcagcagggcaagtgcctggccgccaccagcaccctgatgagcagccctggcagccctgtgatcctgcagatgtgcaacccccgggagggcaagcagaagtggaggaggaagggcagcttcatccagcacagcgtgtctggcctgtgcctggagaccaagccagcccagctggtgaccagcaagtgccaggctgatgcccaggcccagcagtggcagctgctgccccacacctag

SEQ ID NO: 39810 - DNA, 1629 bp, Artificial Sequence
  Description of Artificial Sequence: Synthetic coding sequence
atgaggaagatccgggccaatgccatcgccatcctgactgtggcctggatcctgggcaccttctactacctgtggcaggacaacagagcccacgccgccagcagcggcggccgcggggcccagagagctggaagaagaagtgagcagctgcgggaggacaggaccatccccctgattgtgacaggcacccccagcaagggctttgatgagaaggcctacctgagcgccaagcagctgaaggccggggaggacccctaccggcagcacgccttcaaccagctggagagtgacaagctgagcccagaccggcccatccgggacaccaggcactacagctgccccagcgtgtcctacagcagtgacctgcctgccaccagcgtcatcatcaccttccacaatgaggcccggagcaccctgctgaggacagtgaagtctgtgctgaacagaacaccagccaacctgatccaggagatcatcctggtggatgacttcagcagtgaccctgaggactgcctgctgctgacccgcatccccaaggtgaagtgcctgagaaatgacagaagagagggcctcatccgcagccgggtgagaggagcagatgtggccgccgccaccgtgctgaccttcctggacagccactgtgaggtgaacacagagtggctgccccccatgctgcagagggtgaaggaggaccacaccagggtggtgagccccatcattgatgtgatcagcctggacaactttgcctacctggccgccagcgctgacctgcggggcggctttgactggagcctgcacttcaagtgggagcagatccccctggagcagaagatgaccaggacagaccccacccggcccatccgcacccctgtgattgctgggggcatctttgtgattgacaagtcctggttcaaccacctgggcaagtatgatgcccagatggacatctggggcggggagaactttgagctgtccttccgggtgtggatgtgtggcggcagcctggagatcgtgccctgcagccgggtgggccacgtgttcaggaagaggcacccctacaacttccctgagggcaatgccctgacctacatccggaacaccaagaggacagctgaggtgtggatggatgagtacaagcagtactactatgaggcccggcccagcgccatcggcaaggccttcggctctgtggccaccagaattgagcagaggaagaagatgaactgcaagagcttccgctggtacctggagaatgtgtacccagagctgactgtgcctgtgaaggaggccctgcccggcatcatcaagcagggcgtgaactgcctggagagccagggccagaacacagctggggacttcctgctgggcatgggcatctgccggggcagcgccaagaacccccagcctgcccaggcctggctgttcagtgaccacctgatccagcagcagggcaagtgcctggccgccaccagcaccctgatgagcagccctggcagccctgtgatcctgcagatgtgcaacccccgggagggcaagcaggtgtccctgctggccagcggccctgaggcccagcagcctgagggcccctgcctgcgggtggccgacctgggccggcgggccccagactag

SEQ ID NO: 39811 - DNA, 1920 bp, Artificial Sequence
  Description of Artificial Sequence: Synthetic coding sequence
atgctgctgaggaagcgctaccgccaccggccctgccgcctgcagttcctgctgctgctgctgatgctgggctgtgtgctgatgatggtggccatgctgcaccccccccaccacaccctgcaccagacagtgacagcccaggccagcaagcacagccctgaggcccgctaccgcctggactttggagagagccaggactgggtgctggaggccgaggatgaaggagaggagtacagccccctggagggcctgccccccttcatcagcctgcgggaggaccagctgctggtggccgtggccctgccccaggcccggaggaaccagagccagggccggcggggcggcagctaccgcctcatcaagcagccccggcggcaggacaaggaggcccccaagagggactggggcgcagatgaagatggagaggtgtctgaggaggaggagctgacccccttcagcctggacccccggggcctgcaggaggccctgagcgcccgcatccccctgcagagggccctgcctgaggtgcgccaccccctgtgcctgcagcagcacccccaggacagcctgcccacagccagcgtcatcctgtgcttccatgatgaggcctggagcaccctgctgaggacagtgcacagcatcctggacacagtgccccgggccttcctgaaggagatcatcctggtggatgacctgagccagcagggccagctgaagagcgccctgtctgaatatgtggcccggctggagggcgtgaagctgctgcggagcaacaagaggctgggcgccatccgggccaggatgctgggcgccacccgggccactggagatgtgctggtgttcatggatgcccactgtgagtgccaccctggctggctggagcccctgctgagcagaattgctggggacaggagccgggtggtgtcccctgtgattgatgtgattgactggaagaccttccagtactaccccagcaaggacctgcagaggggcgtgctggactggaagctggacttccactgggagcccctgcctgagcacgtgaggaaggccctgcagagccccatcagccccatccgcagccctgtggtgcctggagaggtggtggccatggacagacactacttccagaacacaggagcctatgacagcctgatgagcctgcggggcggggagaacctggagctgtccttcaaggcctggctgtgtggcggctctgtggagatcctgccctgcagccgggtgggccacatctaccagaaccaggacagccacagccccctggaccaggaggccaccctgaggaacagagtgagaattgctgagacctggctgggcagcttcaaggagaccttctacaagcacagccctgaggccttcagcctgagcaaggccgagaagccagactgcatggagcggctgcagctgcagaggcggctgggctgcaggaccttccactggttcctggccaacgtgtacccagagctgtaccccagcgagccccggcccagcttcagcggcaagctgcacaacacaggcctgggcctgtgtgccgactgccaggccgagggggacatcctgggctgccccatggtgctggccccctgcagcgacagccggcagcagcagtacctgcagcacaccagcaggaaggagatccacttcggcagcccccagcacctgtgctttgctgtgcggcaggagcaggtgatcctgcagaactgcacagaggagggcctggccatccaccagcagcactgggacttccaggagaatggcatgattgtgcacatcctgagcggcaagtgcatggaggccgtggtgcaggagaacaacaaggacctgtacctgcggccctgtgatggcaaggcccggcagcagtggaggtttgaccagatcaatgctgtggatgaaagatag

SEQ ID NO: 39812 - DNA, 591 bp, Artificial Sequence
  Description of Artificial Sequence: Synthetic coding sequence
atggagcggctgcagctgcagaggcggctgggctgcaggaccttccactggttcctggccaacgtgtacccagagctgtaccccagcgagccccggcccagcttcagcggcaagctgcacaacacaggcctgggcctgtgtgccgactgccaggccgagggggacatcctgggctgccccatggtgctggccccctgcagcgacagccggcagcagcagtacctgcagcacaccagcaggaaggagatccacttcggcagcccccagcacctgtgctttgctgtgcggcaggagcaggtgatcctgcagaactgcacagaggagggcctggccatccaccagcagcactgggacttccaggagaatggcatgattgtgcacatcctgagcggcaagtgcatggaggccgtggtgcaggagaacaacaaggacctgtacctgcggccctgtgatgagaagccagccagcagtggagtgctgaccaggtccatgctgtggatgaatgatgagtgccagtgccagaaggagaagaggatcctggccatcaagatccagctgcaggtgaacctgaagagcctgtacatctcctag

SEQ ID NO: 39813 - DNA, 1737 bp, Artificial Sequence
  Description of Artificial Sequence: Synthetic coding sequence
atgctgccctgcctggtggtgctgctggccgccctgctgagcctgcggctgggcagtgatgcccacggcacagagctgcccagccccccatctgtgtggtttgaggccgagttcttccaccacatcctgcactggacccccatccccaaccagagcgagagcacctgctatgaggtggccctgctgcgctatggcatcgagagctggaacagcatcagcaactgcagccagaccctgtcctatgacctgacagctgtgaccctggacctgtaccacagcaatggctaccgggcccgggtgcgggctgtggatggcagccgccacagcaactggacagtgaccaacacccgcttctctgtggatgaggtgaccctgactgtgggctctgtgaacctggagatccacaacggcttcatcctgggcaagatccagctgccccggcccaagatggccccagccaatgacacctatgagagcatcttcagccacttccgggagtatgaaattgccatcaggaaggtgcccggcaacttcaccttcacccacaagaaggtgaagcatgagaacttcagcctgctgaccagcggggaggtgggggagttctgtgtgcaggtgaagcccagcgtggccagccgcagcaacaagggcatgtggagcaaggaggagtgcatcagcctgacccggcagtacttcaccgtgaccaacgtcatcatcttctttgcctttgtgctgctgctgagcggggccctggcctactgcctggccctgcagctgtatgtgagaagaaggaagaagctgcccagcgtgctgctcttcaagaagcccagccccttcatcttcatcagccagaggcccagccctgagacccaggacaccatccaccccctggatgaggaggccttcctgaaggtgtccccagagctgaagaacctggacctgcacggcagcacagattctggcttcggcagcaccaagcccagcctgcagacagaggagccccagttcctgctgcctgacccccacccccaggccgacaggaccctgggcaaccgggagccccctgtgctgggggacagctgcagcagcggcagcagcaacagcacagacagcggcatctgcctgcaggagcccagcctgagccccagcacaggccccacctgggagcagcaggtgggcagcaacagccggggccaggatgattctggaattgacctggtgcagaacagcgagggccgggccggggacacccagggcggcagcgccctgggccaccacagccccccagagcctgaggtgcctggagaggaggaccctgctgctgtggccttccagggctacctgcggcagacccgctgtgccgaggagaaggccaccaagacaggctgcctggaggaggagagccccctgacagatggcctgggccccaagtttggccgctgcctggtggatgaagctggcctgcaccccccagccctggccaagggctacctgaagcaggaccccctggagatgaccctggccagcagcggggcccccaccggccagtggaaccagcccacagaggagtggagcctgctggccctgagcagctgcagcgacctgggcatcagtgactggagctttgcccatgacctggcccccctgggctgtgtggccgcccctgggggcctgctgggcagcttcaacagcgacctggtgaccctgcccctcatcagcagcctgcagagcagcgagtag

SEQ ID NO: 39814 - DNA, 1332 bp, Artificial Sequence
  Description of Artificial Sequence: Synthetic coding sequence
atgagaaatgccatcatccagggcctcttctacggcagcctgaccttcggcatctggacagccctgctcttcatctacctgcaccacaaccacgtgtcctcctggcagaagaagagccaggagcccctgagcgcctggagccctgggaagaaggtgcaccagcagatcatctacggcagcgagcagatccccaagccccacgtgattgtgaagaggacagatgaggacaaggccaagtccatgctgggcacagacttcaaccacaccaaccctgagctgcacaaggagctgctgaagtatggcttcaacgtcatcatcagccgcagcctgggcatcgagcgggaggtgcctgacaccaggagcaagatgtgcctgcagaagcactacccagcccggctgcccacagccagcatcgtcatctgcttctacaatgaggagtgcaatgccctcttccagaccatgagctctgtgaccaacctgaccccccactacttcctggaggagatcatcctggtggatgacatgagcaaggtggatgacctgaaggagaagctggactaccacctggagaccttccggggcaaggtgaagatcatccggaacaagaagcgggagggcctcatccgggcccggctgattggagccagccacgccagcggagatgtgctggtgttcctggacagccactgtgaggtgaacagagtgtggctggagcccctgctgcacgccatcgccaaggaccccaagatggtggtgtgccccctgattgatgtgattgatgacaggaccctggagtacaagcccagccccctggtgcggggcacctttgactggaacctgcagttcaagtgggacaacgtgttctcctatgagatggatggccctgagggcagcaccaagcccatccgcagccctgccatgtctgggggcatctttgccatcagaagacactacttcaatgagatcggccagtatgacaaggacatggacttctggggccgggagaacctggagctgagcctgcgcatctggatgtgtggcggccagctgttcatcatcccctgcagccgggtgggccacatcagcaagaagcagacaggcaagcccagcaccatcatcagcgccatgacccacaactacctgcggctggtgcacgtgtggctggatgagtacaaggagcagttcttcctgaggaagccaggcctgaagtatgtgacctacggcaacatccgggagcgggtggagctgaggaagaggctgggctgcaagagcttccagtggtacctggacaacgtgtttcctgagctggaggcctctgtgaacagcctgtag

SEQ ID NO: 39815 - DNA, 1332 bp, Artificial Sequence; identical to SEQ ID NO: 39814
  Description of Artificial Sequence: Synthetic coding sequence

SEQ ID NO: 39816 - DNA, 681 bp, Artificial Sequence
  Description of Artificial Sequence: Synthetic coding sequence
atgaagaggaagcagaagcgcttcctgcagatgaccctgctcttcaccgtggccctgatcttcctgcccaacgtgggcctgtggagcctgtacaaggacaagcacctggtgaagtctgctgagcccggggagcagcagaccttccccctgggcctgggagatggccagttctacagctggacagatggcctgcggaggaaggactggcatgactatgagagcatccagaaggaggccatgaggtctgggaagggggagcacggcaagccctaccccctgacagaggaggaccatgatgattctgcctacagagaaaatggcttcaacatctttgtgagcaacaacatcgccctggagaggagcctgcctgacatcagacatgccaactgcaagcacaagatgtacctggagcggctgcccaacaccagcatcatcatccccttccacaatgaaggctggaccagcctgctgcggaccatccacagcatcatcaacagaacacctggcagcctgattgctgagatcatcctggtggatgacttcagcgagcgggagcacctgaaggacaagctggaggagtacatggcccgcttcagcaaggtgagaattgtgaggaccaagaagcgggagggcagcggccctgtgtcctggggccacctgtggccagaggagaagagctag

SEQ ID NO: 39817 - DNA, 1806 bp, Artificial Sequence
  Description of Artificial Sequence: Synthetic coding sequence
atgaagaggaagcagaagcgcttcctgcagatgaccctgctcttcaccgtggccctgatcttcctgcccaacgtgggcctgtggagcctgtacaaggacaagcacctggtgaagtctgctgagcccggggagcagcagaccttccccctgggcctgggagatggccagttctacagctggacagatggcctgcggaggaaggactggcatgactatgagagcatccagaaggaggccatgaggtctgggaagggggagcacggcaagccctaccccctgacagaggaggaccatgatgattctgcctacagagaaaatggcttcaacatctttgtgagcaacaacatcgccctggagaggagcctgcctgacatcagacatgccaactgcaagcacaagatgtacctggagcggctgcccaacaccagcatcatcatccccttccacaatgaaggctggaccagcctgctgcggaccatccacagcatcatcaacagaacacctggcagcctgattgctgagatcatcctggtggatgacttcagcgagcgggagcacctgaaggacaagctggaggagtacatggcccgcttcagcaaggtgagaattgtgaggaccaagaagcgggagggcctcatccgcacccggctgctgggcgcctccatggcccggggggaggtgctgaccttcctggacagccactgtgaggtgaatgtgaactggctgccccccctgctgaaccagatcgccctgaaccacaagaccatcgtgtgccccatgattgatgtgattgaccacaaccacttcggctatgaggcccaggccggagatgccatgagaggagcctttgactgggagatgtactacaagaggatccccatccccccagagctgcagagagctgaccccagcgacccctttgagagccctgtgatggccggcggcctgtttgctgtggacaggaagtggttctgggagctgggcggctatgaccccggcctggagatctggggcggggagcagtatgagatctccttcaaggtgtggatgtgtggcggggagatgtttgatgtgccctgcagccgggtgggccacatctacagaaaatatgtgccctacaaggtgcccagcggcaccagcctggccaggaacctgaagagggtggccgagacctggatggatgaatttgctgagtacatctaccagaggaggcctgagtaccgccacctgagcactggagacatcagcgcccagaaggagctgaggaagcagctgaagtgcaaggacttcaagtggttcatggctgctgtggcctgggatgtgcccaagtactacccacctgtggagcccccacctgctgcctggggcgagatcagaaatgtggccgccaacctgtgtgtggacagcaagcatggagccaccggcacagagctgcggctggacatctgtgtgaaggatggcagcgagaggacctggagccatgagcagctgttcaccttcggctggagggaggacatccggcctggagagcccctgcacaccaggaagttctgctttgatgccatcagccacaacagccctgtgaccctgtatgactgccacggcatgaagggcaaccagctgtggggctacaggaaggacaggaccctcttccaccctgtgagcaacagctgcatggactgcaacccagctgagaagaagatcttcatggcccgctgtgaccccctgtctgagacccagcagtggatctttgagcacatcaacatgacagtgctggagaagttcaaccaccacgccaacagctag

SEQ ID NO: 39818 - DNA, 1569 bp, Artificial Sequence
  Description of Artificial Sequence: Synthetic coding sequence
atgaacatcaatgacctgaagctgaccctgagcaaggccggccaggagcacctgctgcgcttctggaatgagctggaggaggcccagcaggtggagctgtatgcagagctgcaggccatgaactttgaggagctgaacttcttcttccagaaggccatcgagggcttcaaccagagcagccaccagaagaatgtggatgccaggatggagcctgtgccccgggaggtgctgggcagcgccacccgggaccaggaccagctgcaggcctgggagagcgagggcctcttccagatcagccagaacaaggtggccgtgctgctgctggccggcggccagggcacccggctgggcgtggcctaccccaagggcatgtatgatgtgggcctgcccagcaggaagaccctcttccagatccaggccgagcgcatcctgaagctgcagcaggtggccgagaagtactacggcaacaagtgcatcatcccctggtacatcatgaccagcggccgcaccatggagagcaccaaggagttcttcaccaagcacaagtacttcggcctgaagaaggaaaatgtcatcttcttccagcagggcatgctgcctgccatgagctttgatggcaagatcatcctggaggagaagaacaaggtgtccatggccccagatggaaatggaggcctgtaccgggccctggccgcccagaacatcgtggaggacatggagcagaggggcatctggagcatccacgtgtactgtgtggacaacatcctggtgaaggtggccgacccccgcttcatcggcttctgcatccagaagggagctgactgtggggccaaggtggtggagaagaccaaccccacagagcctgtgggcgtggtgtgccgggtggatggagtgtaccaggtggtggagtacagcgagatcagcctggccacagcccagaagaggagcagtgatggccgcctgctcttcaatgccggcaacatcgccaaccacttcttcaccgtgcccttcctgagagatgtggtgaatgtgtatgagccccagctgcagcaccacgtggcccagaagaagatcccctacgtggacacccagggccagctgatcaagccagacaagcccaacggcatcaagatggagaagtttgtgtttgacatcttccagtttgccaagaagtttgtggtgtatgaggtgctgcgggaggatgagttcagccccctgaagaatgctgacagccagaatggcaaggacaaccccaccacagcccggcatgccctgatgagcctgcaccactgctgggtgctgaatgctgggggccacttcattgatgaaaatggcagccggctgcctgccatccccaggtctgccaccaacgggaagtctgagaccatcacagcagatgtgaaccacaacctgaaggatgccaatgatgtgcccatccagtgtgagatcagccccctcatctcctatgctggggagggcctggagagctatgtggccgacaaggagttccacgcccccctcatcattgatgaaaatggagtgcatgagctggtgaagaatggcatctag

SEQ ID NO: 39819 - DNA, 1566 bp, Artificial Sequence
  Description of Artificial Sequence: Synthetic coding sequence
atgaacatcaatgacctgaagctgaccctgagcaaggccggccaggagcacctgctgcgcttctggaatgagctggaggaggcccagcaggtggagctgtatgcagagctgcaggccatgaactttgaggagctgaacttcttcttccagaaggccatcgagggcttcaaccagagcagccaccagaagaatgtggatgccaggatggagcctgtgccccgggaggtgctgggcagcgccacccgggaccaggaccagctgcaggcctgggagagcgagggcctcttccagatcagccagaacaaggtggccgtgctgctgctggccggcggccagggcacccggctgggcgtggcctaccccaagggcatgtatgatgtgggcctgcccagcaggaagaccctcttccagatccaggccgagcgcatcctgaagctgcagcaggtggccgagaagtactacggcaacaagtgcatcatcccctggtacatcatgaccagcggccgcaccatggagagcaccaaggagttcttcaccaagcacaagtacttcggcctgaagaaggaaaatgtcatcttcttccagcagggcatgctgcctgccatgagctttgatggcaagatcatcctggaggagaagaacaaggtgtccatggccccagatggaaatggaggcctgtaccgggccctggccgcccagaacatcgtggaggacatggagcagaggggcatctggagcatccacgtgtactgtgtggacaacatcctggtgaaggtggccgacccccgcttcatcggcttctgcatccagaagggagctgactgtggggccaaggtggtggagaagaccaaccccacagagcctgtgggcgtggtgtgccgggtggatggagtgtaccaggtggtggagtacagcgagatcagcctggccacagcccagaagaggagcagtgatggccgcctgctcttcaatgccggcaacatcgccaaccacttcttcaccgtgcccttcctgagagatgtggtgaatgtgtatgagccccagctgcagcaccacgtggcccagaagaagatcccctacgtggacacccagggccagctgatcaagccagacaagcccaacggcatcaagatggagaagtttgtgtttgacatcttccagtttgccaagaagtttgtggtgtatgaggtgctgcgggaggatgagttcagccccctgaagaatgctgacagccagaatggcaaggacaaccccaccacagcccggcatgccctgatgagcctgcaccactgctgggtgctgaatgctgggggccacttcattgatgaaaatggcagccggctgcctgccatcccccgggccaccaacgggaagtctgagaccatcacagcagatgtgaaccacaacctgaaggatgccaatgatgtgcccatccagtgtgagatcagccccctcatctcctatgctggggagggcctggagagctatgtggccgacaaggagttccacgcccccctcatcattgatgaaaatggagtgcatgagctggtgaagaatggcatctag

SEQ ID NO: 39820 - DNA, 1569 bp, Artificial Sequence; identical to SEQ ID NO: 39818
  Description of Artificial Sequence: Synthetic coding sequence

SEQ ID NO: 39821 - DNA, 1518 bp, Artificial Sequence
  Description of Artificial Sequence: Synthetic coding sequence
atgaacatcaatgacctgaagctgaccctgagcaaggccggccaggagcacctgctgcgcttctggaatgagctggaggaggcccagcaggtggagctgtatgcagagctgcaggccatgaactttgaggagctgaacttcttcttccagaaggccatcgagggcttcaaccagagcagccaccagaagaatgtggatgccaggatggagcctgtgccccgggaggtgctgggcagcgccacccgggaccaggaccagctgcaggcctgggagagcgagggcctcttccagatcagccagaacaaggtggccgtgctgctgctggccggcggccagggcacccggctgggcgtggcctaccccaagggcatgtatgatgtgggcctgcccagcaggaagaccctcttccagatccaggccgagcgcatcctgaagctgcagcaggtggccgagaagtactacggcaacaagtgcatcatcccctggtacatcatgaccagcggccgcaccatggagagcaccaaggagttcttcaccaagcacaagtacttcggcctgaagaaggaaaatgtcatcttcttccagcagggcatgctgcctgccatgagctttgatggcaagatcatcctggaggagaagaacaaggtgtccatggccccagatggaaatggaggcctgtaccgggccctggccgcccagaacatcgtggaggacatggagcagaggggcatctggagcatccacgtgtactgtgtggacaacatcctggtgaaggtggccgacccccgcttcatcggcttctgcatccagaagggagctgactgtggggccaaggtggtggagaagaccaaccccacagagcctgtgggcgtggtgtgccgggtggatggagtgtaccaggtggtggagtacagcgagatcagcctggccacagcccagaagaggagcagtgatggccgcctgctcttcaatgccggcaacatcgccaaccacttcttcaccgtgcccttcctgagagatgtggtgaatgtgtatgagccccagctgcagcaccacgtggcccagaagaagatcccctacgtggacacccagggccagctgatcaagccagacaagcccaacggcatcaagatggagaagtttgtgtttgacatcttccagtttgccaagaagtttgtggtgtatgaggtgctgcgggaggatgagttcagccccctgaagaatgctgacagccagaatggcaaggacaaccccaccacagcccggcatgccctgatgagcctgcaccactgctgggtgctgaatgctgggggccacttcattgatgaaaatggcagccggctgcctgccatcccccggctgaaggatgccaatgatgtgcccatccagtgtgagatcagccccctcatctcctatgctggggagggcctggagagctatgtggccgacaaggagttccacgcccccctcatcattgatgaaaatggagtgcatgagctggtgaagaatggcatctag

SEQ ID NO: 39822 - DNA, 663 bp, Artificial Sequence
  Description of Artificial Sequence: Synthetic coding sequence
atgaacatcaatgacctgaagctgaccctgagcaaggccggccaggagcacctgctgcgcttctggaatgagctggaggaggcccagcaggtggagctgtatgcagagctgcaggccatgaactttgaggagctgaacttcttcttccagaaggccatcgagggcttcaaccagagcagccaccagaagaatgtggatgccaggatggagcctgtgccccgggaggtgctgggcagcgccacccgggaccaggaccagctgcaggcctgggagagcgagggcctcttccagatcagccagaacaaggtggccgtgctgctgctggccggcggccagggcacccggctgggcgtggcctaccccaagggcatgtatgatgtgggcctgcccagcaggaagaccctcttccagatccaggccgagcgcatcctgaagctgcagcaggtggccgagaagtactacggcaacaagtgcatcatcccctggtacatcatgaccagcggccgcaccatggagagcaccaaggagttcttcaccaagcacaagtacttcggcctgaagaaggaaaatgtcatcttcttccagcagggcatgctgcctgccatgagctttgatggcaagatcatcctggaggagaagaacaaggtgtccatggccccctag

SEQ ID NO: 39823 - DNA, 4776 bp, Artificial Sequence
  Description of Artificial Sequence: Synthetic coding sequence
atgagcctgctgtgtgtgcgggtgaagagggccaagttccagggcagcccagacaagttcaacacctacgtgaccctgaaggtgcagaatgtgaagagcaccaccgtggccgtgcggggggaccagcccagctgggagcaggacttcatgtttgagatcagccggctggacctgggcctgtctgtggaggtgtggaacaagggcctcatctgggacaccatggtgggcaccgtgtggatcgccctgaagaccatccggcagagtgatgaggagggccctggagagtggagcaccctggaggccgagaccctgatgaaggatgatgagatctgtggcaccaggaaccccaccccccacaagatcctgctggacaccaggtttgagctgccctttgacatccctgaggaggaggcccgctactggacctacaagtgggagcagatcaatgccctgggcgctgacaatgagtacagcagccaggaggagagccagaggaagcccctgcccacagctgctgcccagtgcagctttgaggaccctgacagcgctgtggatgaccgggacagcgactacagaagtgagaccagcaacagcttccccccaccctaccacacagccagccagcccaatgcctctgtgcaccagtttcctgtgcctgtgcgcagcccccagcagctgctgctgcagggcagcagccgggacagctgcaatgacagcatgcagagctatgacctggactacccagagcggcgggccatcagccccaccagcagcagccgctatggcagcagctgcaatgtgtcccagggcagcagccagctgtctgagctggaccagtaccacgagcaggatgatgaccaccgggagacagacagcatccacagctgccacagcagccacagcctgagcagagatggccaggccggctttggagagcaggagaagcccctggaggtgacaggccaggccgagaaggaggccgcctgtgagcccaaggagatgaaggaggatgccaccacccaccccccaccagacctggtgctgcagaaggaccacttcctgggcccccaggagagcttcccagaagaaaatgccagcagccccttcacccaggcccgggcccactggatccgggctgtgaccaaggtgcggctgcagctgcaggagatcccagatgatggagaccccagcctgccccagtggctgcctgagggccctgctgggggcctgtatggaattgacagcatgccagacctgcggaggaagaagcccctgcccctggtgtctgacctgagcctggtgcagagcaggaaggccggcatcaccagcgccatggccaccaggaccagcctgaaggatgaggagctgaagagccacgtgtacaagaagaccctgcaggccctgatctaccccatcagctgcaccaccccccacaactttgaggtgtggacagccaccacccccacctactgctatgaatgtgagggcctgctgtggggcatcgcccggcagggcatgcgctgcagtgaatgtggggtgaagtgccacgagaagtgccaggacctgctgaatgctgactgcctgcagagagctgctgagaagagctgcaagcacggggctgaggacaggacccagaacatcatcatggccatgaaggacaggatgaagatccgggagaggaacaagccagagatctttgaggtgatcagagatgtgttcaccgtgaacaaggccgcccacgtgcagcagatgaagacagtgaagcagagcgtgctggatggcaccagcaagtggagcgccaagatcaccatcaccgtggtgtgtgcccagggcctgcaggccaaggacaagacaggcagcagtgacccctacgtgacagtgcaggtgtccaagaccaagaagaggaccaagaccatcttcggcaacctgaaccctgtgtgggaggagaagttccactttgagtgccacaacagcagtgaccgcatcaaggtgcgggtgtgggatgaagatgatgacatcaagagccgggtgaagcagaggctgaagcgggagagtgatgacttcctgggccagaccatcatcgaggtgaggaccctgagcggggagatggatgtgtggtacaacctggagaagaggacagacaagtctgctgtgtctggggccatccggctgcagatctctgtggagatcaagggggaggagaaggtggccccctaccacgtgcagtacacctgcctgcacgagaacctcttccactacctgacagacatccagggcagcggcggcgtgcgcatccctgaggcccggggagatgatgcctggaaggtgtactttgatgaaacagcccaggagatcgtggatgaatttgccatgagatatggaattgagagcatctaccaggccatgacccactttgcctgcctgagcagcaagtacatgtgccctggggtgcctgctgtgatgagcaccctgctggccaacatcaatgcctactatgcccacaccacagccagcaccaacgtgtctgccagtgacagatttgctgccagcaactttgggaaggagagatttgtgaagctgctggaccagctgcacaacagcctgagaattgacctgagcacctacagaaacaacttccctgctggcagccctgagcggctgcaggacctgaagagcacagtggacctgctgaccagcatcaccttcttcaggatgaaggtgcaggagctgcagagccccccccgggccagccaggtggtgaaggactgtgtgaaggcctgcctgaacagcacctatgagtacatcttcaacaactgccacgacctgtacagccggcagtaccagctgaagcaggagctgcccccagaggagcagggccccagcatccggaacctggacttctggcccaagctgatcaccctgattgtgtccatcatcgaggaggacaagaacagctacacccctgtgctgaaccagttcccccaggagctgaatgtgggcaaggtgtctgctgaggtgatgtggcacctgtttgcccaggacatgaagtatgccctggaggagcacgagaaggaccacctgtgcaagtctgctgactacatgaacctgcacttcaaggtgaagtggctgcacaatgaatatgtgcgggacctgcctgtgctgcagggccaggtgcctgagtacccagcctggtttgagcagtttgtgctgcagtggctggatgaaaatgaagatgtgtccctggagttcctgcggggggccctggagcgggacaagaaggatggcttccagcagaccagcgagcacgccctcttcagctgcagcgtggtggatgtgttcacccagctgaaccagagctttgagatcatcaggaagctggagtgcccagaccccagcatcctggcccactacatgagaagatttgccaagaccatcggcaaggtgctgatgcagtatgctgacatcctgagcaaggacttccctgcctactgcaccaaggagaagctgccctgcatcctgatgaacaacgtgcagcagctgcgggtgcagctggagaagatgtttgaggccatgggcggcaaggagctggacctggaggccgctgacagcctgaaggagctgcaggtgaagctgaacacagtgctggatgagctgtccatggtgtttggaaacagcttccaggtgagaattgatgaatgtgtgcggcagatggctgacatcctgggccaggtgcggggcactggaaatgccagcccagatgcccgggccagcgctgcccaggatgctgacagcgtgctgcggcccctgatggacttcctggatggcaacctgaccctgtttgccaccgtgtgtgagaagacagtgctgaagagggtgctgaaggagctgtggagggtggtgatgaacaccatggagaggatgattgtgctgccccccctgacagaccagacaggcacccagctgatcttcaccgctgccaaggagctgagccacctgagcaagctgaaggaccacatggtgcgggaggagaccaggaacctgacccccaagcagtgtgctgtgctggacctggccctggacaccatcaagcagtacttccacgccggcggcaatggcctgaagaagaccttcctggagaagagcccagacctgcagagcctgcgctatgccctgagcctgtacacccagaccacagacaccctcatcaagacctttgtgcgcagccagaccacccagggcagcggcgtggatgatcctgtgggggaggtgtccatccaggtggacctcttcacccaccctggcactggagagcacaaggtgacagtgaaggtggtggccgccaatgacctgaagtggcagacagctggcatgttccggccctttgtggaggtgaccatggtgggcccccaccagagcgacaagaagaggaagttcaccaccaagagcaagagcaacaactgggcccccaagtacaatgagaccttccacttcctgctgggcaatgaggagggccctgagagctatgagctgcagatctgtgtgaaggactactgctttgcccgggaggacagagtgctgggcctggccgtgatgcccctgagagatgtgacagccaagggcagctgtgcctgctggtgccccctgggcaggaagatccacatggatgaaacaggcctgaccatcctgcgcatcctgagccagaggagcaatgatgaggtggcccgggagtttgtgaagctgaagtctgagagccgcagcacagaggagggcagctag

SEQ ID NO: 39824 - DNA, 4833 bp, Artificial Sequence
  Description of Artificial Sequence: Synthetic coding sequence
atgagcctgctgtgtgtgcgggtgaagagggccaagttccagggcagcccagacaagttcaacacctacgtgaccctgaaggtgcagaatgtgaagagcaccaccgtggccgtgcggggggaccagcccagctgggagcaggacttcatgtttgagatcagccggctggacctgggcctgtctgtggaggtgtggaacaagggcctcatctgggacaccatggtgggcaccgtgtggatcgccctgaagaccatccggcagagtgatgaggagggccctggagagtggagcaccctggaggccgagaccctgatgaaggatgatgagatctgtggcaccaggaaccccaccccccacaagatcctgctggacaccaggtttgagctgccctttgacatccctgaggaggaggcccgctactggacctacaagtgggagcagatcaatgccctgggcgctgacaatgagtacagcagccaggaggagagccagaggaagcccctgcccacagctgctgcccagtgcagctttgaggaccctgacagcgctgtggatgaccgggacagcgactacagaagtgagaccagcaacagcttccccccaccctaccacacagccagccagcccaatgcctctgtgcaccagtttcctgtgcctgtgcgcagcccccagcagctgctgctgcagggcagcagccgggacagctgcaatgacagcatgcagagctatgacctggactacccagagcggcgggccatcagccccaccagcagcagccgctatggcagcagctgcaatgtgtcccagggcagcagccagctgtctgagctggaccagtaccacgagcaggatgatgaccaccgggagacagacagcatccacagctgccacagcagccacagcctgagcagagatggccaggccggctttggagagcaggagaagcccctggaggtgacaggccaggccgagaaggaggccgcctgtgagcccaaggagatgaaggaggatgccaccacccaccccccaccagacctggtgctgcagaaggaccacttcctgggcccccaggagagcttcccagaagaaaatgccagcagccccttcacccaggcccgggcccactggatccgggctgtgaccaaggtgcggctgcagctgcaggagatcccagatgatggagaccccagcctgccccagtggctgcctgagggccctgctgggggcctgtatggaattgacagcatgccagacctgcggaggaagaagcccctgcccctggtgtctgacctgagcctggtgcagagcaggaaggccggcatcaccagcgccatggccaccaggaccagcctgaaggatgaggagctgaagagccacgtgtacaagaagaccctgcaggccctgatctaccccatcagctgcaccaccccccacaactttgaggtgtggacagccaccacccccacctactgctatgaatgtgagggcctgctgtggggcatcgcccggcagggcatgcgctgcagtgaatgtggggtgaagtgccacgagaagtgccaggacctgctgaatgctgactgcctgcagagagctgctgagaagagctgcaagcacggggctgaggacaggacccagaacatcatcatggccatgaaggacaggatgaagatccgggagaggaacaagccagagatctttgaggtgatcagagatgtgttcaccgtgaacaaggccgcccacgtgcagcagatgaagacagtgaagcagagcgtgctggatggcaccagcaagtggagcgccaagatcaccatcaccgtggtgtgtgcccagggcctgcaggccaaggacaagacaggcagcagtgacccctacgtgacagtgcaggtgtccaagaccaagaagaggaccaagaccatcttcggcaacctgaaccctgtgtgggaggagaagttccactttgagtgccacaacagcagtgaccgcatcaaggtgcgggtgtgggatgaagatgatgacatcaagagccgggtgaagcagaggctgaagcgggagagtgatgacttcctgggccagaccatcatcgaggtgaggaccctgagcggggagatggatgtgtggtacaacctggagaagaggacagacaagtctgctgtgtctggggccatccggctgcagatctctgtggagatcaagggggaggagaaggtggccccctaccacgtgcagtacacctgcctgcacgagaacctcttccactacctgacagacatccagggcagcggcggcgtgcgcatccctgaggcccggggagatgatgcctggaaggtgtactttgatgaaacagcccaggagatcgtggatgaatttgccatgagatatggaattgagagcatctaccaggccatgacccactttgcctgcctgagcagcaagtacatgtgccctggggtgcctgctgtgatgagcaccctgctggccaacatcaatgcctactatgcccacaccacagccagcaccaacgtgtctgccagtgacagatttgctgccagcaactttgggaaggagagatttgtgaagctgctggaccagctgcacaacagcctgagaattgacctgagcacctacagaaacaacttccctgctggcagccctgagcggctgcaggacctgaagagcacagtggacctgctgaccagcatcaccttcttcaggatgaaggtgcaggagctgcagagccccccccgggccagccaggtggtgaaggactgtgtgaaggcctgcctgaacagcacctatgagtacatcttcaacaactgccacgacctgtacagccggcagtaccagctgaagcaggagctgcccccagaggagcagggccccagcatccggaacctggacttctggcccaagctgatcaccctgattgtgtccatcatcgaggaggacaagaacagctacacccctgtgctgaaccagttcccccaggagctgaatgtgggcaaggtgtctgctgaggtgatgtggcacctgtttgcccaggacatgaagtatgccctggaggagcacgagaaggaccacctgtgcaagtctgctgactacatgaacctgcacttcaaggtgaagtggctgcacaatgaatatgtgcgggacctgcctgtgctgcagggccaggtgcctgagtacccagcctggtttgagcagtttgtgctgcagtggctggatgaaaatgaagatgtgtccctggagttcctgcggggggccctggagcgggacaagaaggatggcttccagcagaccagcgagcacgccctcttcagctgcagcgtggtggatgtgttcacccagctgaaccagagctttgagatcatcaggaagctggagtgcccagaccccagcatcctggcccactacatgagaagatttgccaagaccatcggcaaggtgctgatgcagtatgctgacatcctgagcaaggacttccctgcctactgcaccaaggagaagctgccctgcatcctgatgaacaacgtgcagcagctgcgggtgcagctggagaagatgtttgaggccatgggcggcaaggagctggacctggaggccgctgacagcctgaaggagctgcaggtgaagctgaacacagtgctggatgagctgtccatggtgtttggaaacagcttccaggtgagaattgatgaatgtgtgcggcagatggctgacatcctgggccaggtgcggggcactggaaatgccagcccagatgcccgggccagcgctgcccaggatgctgacagcgtgctgcggcccctgatggacttcctggatggcaacctgaccctgtttgccaccgtgtgtgagaagacagtgctgaagagggtgctgaaggagctgtggagggtggtgatgaacaccatggagaggatgattgtgctgccccccctgacagaccagacaggcacccagctgatcttcaccgctgccaaggagctgagccacctgagcaagctgaaggaccacatggtgcgggaggagaccaggaacctgacccccaagcagtgtgctgtgctggacctggccctggacaccatcaagcagtacttccacgccggcggcaatggcctgaagaagaccttcctggagaagagcccagacctgcagagcctgcgctatgccctgagcctgtacacccagaccacagacaccctcatcaagacctttgtgcgcagccagaccacccaggtgcatgatggcaagggcatccgcttcaccgccaatgaagacatccggcctgagaagggcagcggcgtggatgatcctgtgggggaggtgtccatccaggtggacctcttcacccaccctggcaccggggagcacaaggtgacagtgaaggtggtggccgccaatgacctgaagtggcagacagctggcatgttccggccctttgtggaggtgaccatggtgggcccccaccagagcgacaagaagaggaagttcaccaccaagagcaagagcaacaactgggcccccaagtacaatgagaccttccacttcctgctgggcaatgaggagggccctgagagctatgagctgcagatctgtgtgaaggactactgctttgccagagaagatagagtgctgggcctggccgtgatgcccctgagagatgtgacagccaagggcagctgtgcctgctggtgccccctgggcaggaagatccacatggatgagaccggcctgaccatcctgcgcatcctgagccagaggagcaatgatgaggtggcccgggagtttgtgaagctgaagtctgagagccgcagcacagaggagggcagctag

SEQ ID NO: 39825 - DNA, 4869 bp, Artificial Sequence
  Description of Artificial Sequence: Synthetic coding sequence
atgagcctgctgtgtgtgcgggtgaagagggccaagttccagggcagcccagacaagttcaacacctacgtgaccctgaaggtgcagaatgtgaagagcaccaccgtggccgtgcggggggaccagcccagctgggagcaggacttcatgtttgagatcagccggctggacctgggcctgtctgtggaggtgtggaacaagggcctcatctgggacaccatggtgggcaccgtgtggatcgccctgaagaccatccggcagagtgatgaggagggccctggagagtggagcaccctggaggccgagaccctgatgaaggatgatgagatctgtggcaccaggaaccccaccccccacaagatcctgctggacaccaggtttgagctgccctttgacatccctgaggaggaggcccgctactggacctacaagtgggagcagatcaatgccctgggcgctgacaatgagtacagcagccaggaggagagccagaggaagcccctgcccacagctgctgcccagtgctgccactggacctacctgggctggggcgagcagcagacctttgaggaccctgacagcgctgtggatgaccgggacagcgactacagaagtgagaccagcaacagcttccccccaccctaccacacagccagccagcccaatgcctctgtgcaccagtttcctgtgcctgtgcgcagcccccagcagctgctgctgcagggcagcagccgggacagctgcaatgacagcatgcagagctatgacctggactacccagagcggcgggccatcagccccaccagcagcagccgctatggcagcagctgcaatgtgtcccagggcagcagccagctgtctgagctggaccagtaccacgagcaggatgatgaccaccgggagacagacagcatccacagctgccacagcagccacagcctgagcagagatggccaggccggctttggagagcaggagaagcccctggaggtgacaggccaggccgagaaggaggccgcctgtgagcccaaggagatgaaggaggatgccaccacccaccccccaccagacctggtgctgcagaaggaccacttcctgggcccccaggagagcttcccagaagaaaatgccagcagccccttcacccaggcccgggcccactggatccgggctgtgaccaaggtgcggctgcagctgcaggagatcccagatgatggagaccccagcctgccccagtggctgcctgagggccctgctgggggcctgtatggaattgacagcatgccagacctgcggaggaagaagcccctgcccctggtgtctgacctgagcctggtgcagagcaggaaggccggcatcaccagcgccatggccaccaggaccagcctgaaggatgaggagctgaagagccacgtgtacaagaagaccctgcaggccctgatctaccccatcagctgcaccaccccccacaactttgaggtgtggacagccaccacccccacctactgctatgaatgtgagggcctgctgtggggcatcgcccggcagggcatgcgctgcagtgaatgtggggtgaagtgccacgagaagtgccaggacctgctgaatgctgactgcctgcagagagctgctgagaagagctgcaagcacggggctgaggacaggacccagaacatcatcatggccatgaaggacaggatgaagatccgggagaggaacaagccagagatctttgaggtgatcagagatgtgttcaccgtgaacaaggccgcccacgtgcagcagatgaagacagtgaagcagagcgtgctggatggcaccagcaagtggagcgccaagatcaccatcaccgtggtgtgtgcccagggcctgcaggccaaggacaagacaggcagcagtgacccctacgtgacagtgcaggtgtccaagaccaagaagaggaccaagaccatcttcggcaacctgaaccctgtgtgggaggagaagttccactttgagtgccacaacagcagtgaccgcatcaaggtgcgggtgtgggatgaagatgatgacatcaagagccgggtgaagcagaggctgaagcgggagagtgatgacttcctgggccagaccatcatcgaggtgaggaccctgagcggggagatggatgtgtggtacaacctggagaagaggacagacaagtctgctgtgtctggggccatccggctgcagatctctgtggagatcaagggggaggagaaggtggccccctaccacgtgcagtacacctgcctgcacgagaacctcttccactacctgacagacatccagggcagcggcggcgtgcgcatccctgaggcccggggagatgatgcctggaaggtgtactttgatgaaacagcccaggagatcgtggatgaatttgccatgagatatggaattgagagcatctaccaggccatgacccactttgcctgcctgagcagcaagtacatgtgccctggggtgcctgctgtgatgagcaccctgctggccaacatcaatgcctactatgcccacaccacagccagcaccaacgtgtctgccagtgacagatttgctgccagcaactttgggaaggagagatttgtgaagctgctggaccagctgcacaacagcctgagaattgacctgagcacctacagaaacaacttccctgctggcagccctgagcggctgcaggacctgaagagcacagtggacctgctgaccagcatcaccttcttcaggatgaaggtgcaggagctgcagagccccccccgggccagccaggtggtgaaggactgtgtgaaggcctgcctgaacagcacctatgagtacatcttcaacaactgccacgacctgtacagccggcagtaccagctgaagcaggagctgcccccagaggagcagggccccagcatccggaacctggacttctggcccaagctgatcaccctgattgtgtccatcatcgaggaggacaagaacagctacacccctgtgctgaaccagttcccccaggagctgaatgtgggcaaggtgtctgctgaggtgatgtggcacctgtttgcccaggacatgaagtatgccctggaggagcacgagaaggaccacctgtgcaagtctgctgactacatgaacctgcacttcaaggtgaagtggctgcacaatgaatatgtgcgggacctgcctgtgctgcagggccaggtgcctgagtacccagcctggtttgagcagtttgtgctgcagtggctggatgaaaatgaagatgtgtccctggagttcctgcggggggccctggagcgggacaagaaggatggcttccagcagaccagcgagcacgccctcttcagctgcagcgtggtggatgtgttcacccagctgaaccagagctttgagatcatcaggaagctggagtgcccagaccccagcatcctggcccactacatgagaagatttgccaagaccatcggcaaggtgctgatgcagtatgctgacatcctgagcaaggacttccctgcctactgcaccaaggagaagctgccctgcatcctgatgaacaacgtgcagcagctgcgggtgcagctggagaagatgtttgaggccatgggcggcaaggagctggacctggaggccgctgacagcctgaaggagctgcaggtgaagctgaacacagtgctggatgagctgtccatggtgtttggaaacagcttccaggtgagaattgatgaatgtgtgcggcagatggctgacatcctgggccaggtgcggggcactggaaatgccagcccagatgcccgggccagcgctgcccaggatgctgacagcgtgctgcggcccctgatggacttcctggatggcaacctgaccctgtttgccaccgtgtgtgagaagacagtgctgaagagggtgctgaaggagctgtggagggtggtgatgaacaccatggagaggatgattgtgctgccccccctgacagaccagacaggcacccagctgatcttcaccgctgccaaggagctgagccacctgagcaagctgaaggaccacatggtgcgggaggagaccaggaacctgacccccaagcagtgtgctgtgctggacctggccctggacaccatcaagcagtacttccacgccggcggcaatggcctgaagaagaccttcctggagaagagcccagacctgcagagcctgcgctatgccctgagcctgtacacccagaccacagacaccctcatcaagacctttgtgcgcagccagaccacccaggtgcatgatggcaagggcatccgcttcaccgccaatgaagacatccggcctgagaagggcagcggcgtggatgatcctgtgggggaggtgtccatccaggtggacctcttcacccaccctggcaccggggagcacaaggtgacagtgaaggtggtggccgccaatgacctgaagtggcagacagctggcatgttccggccctttgtggaggtgaccatggtgggcccccaccagagcgacaagaagaggaagttcaccaccaagagcaagagcaacaactgggcccccaagtacaatgagaccttccacttcctgctgggcaatgaggagggccctgagagctatgagctgcagatctgtgtgaaggactactgctttgccagagaagatagagtgctgggcctggccgtgatgcccctgagagatgtgacagccaagggcagctgtgcctgctggtgccccctgggcaggaagatccacatggatgagaccggcctgaccatcctgcgcatcctgagccagaggagcaatgatgaggtggcccgggagtttgtgaagctgaagtctgagagccgcagcacagaggagggcagctag

SEQ ID NO: 39826 - DNA, 3594 bp, Artificial Sequence
  Description of Artificial Sequence: Synthetic coding sequence
atgccagacctgcggaggaagaagcccctgcccctggtgtctgacctggtgaagagcctggtgcagagcaggaaggccggcatcaccagcgccatggccaccaggaccagcctgaaggatgaggagctgaagagccacgtgtacaagaagaccctgcaggccctgatctaccccatcagctgcaccaccccccacaactttgaggtgtggacagccaccacccccacctactgctatgaatgtgagggcctgctgtggggcatcgcccggcagggcatgcgctgcagtgaatgtggggtgaagtgccacgagaagtgccaggacctgctgaatgctgactgcctgcagagagctgctgagaagagctgcaagcatggagctgaggacaggacccagaacatcatcatggccatgaaggacaggatgaagatccgggagaggaacaagccagagatctttgaagtcatcagagatgtgttcaccgtgaacaaggccgcccacgtgcagcagatgaagacagtgaagcagagcgtgctggatggcaccagcaagtggagcgccaagatcaccatcaccgtggtgtgtgcccagggcctgcaggccaaggacaagacaggcagcagtgacccctacgtgacagtgcaggtgtccaagaccaagaagaggaccaagaccatctttggaaacctgaaccctgtgtgggaggagaagttccactttgagtgccacaacagcagtgaccgcatcaaggtgcgggtgtgggatgaagatgatgacatcaagagccgggtgaagcagaggctgaagcgggagagtgatgacttcctgggccagaccatcatcgaggtgaggaccctgtctggagagatggatgtgtggtacaacctggagaagaggacagacaagtctgctgtgtctggggccatccggctgcagatctctgtggagatcaagggggaggagaaggtggccccctaccacgtgcagtacacctgcctgcatgaaaatctcttccactacctgacagacatccagggcagcggaggagtgcgcatccctgaggcccggggagatgatgcctggaaggtgtactttgatgaaacagcccaggagatcgtggatgaatttgccatgagatatggcatcgagagcatctaccaggccatgacccactttgcctgcctgagcagcaagtacatgtgccctggggtgcctgctgtgatgagcaccctgctggccaacatcaatgcctactatgcccacaccacagccagcaccaacgtgtctgccagtgacagatttgctgccagcaactttgggaaggagagatttgtgaagctgctggaccagctgcacaacagcctgagaattgacctgagcacctacagaaacaacttccctgctggcagccctgagcggctgcaggacctgaagagcacagtggacctgctgaccagcatcaccttcttcaggatgaaggtgcaggagctgcagagccccccccgggccagccaggtggtgaaggactgtgtgaaggcctgcctgaacagcacctatgagtacatcttcaacaactgccacgacctgtacagccggcagtaccagctgaagcaggagctgcccccagaggagcagggccccagcatccggaacctggacttctggcccaagctgatcaccctcatcgtgtccatcatcgaggaggacaagaacagctacacccctgtgctgaaccagttcccccaggagctgaatgtgggcaaggtgtctgctgaggtgatgtggcacctgtttgcccaggacatgaagtatgccctggaggagcacgagaaggaccacctgtgcaagtctgctgactacatgaacctgcacttcaaggtgaagtggctgcacaatgaatatgtgcgggacctgcctgtgctgcagggccaggtgcctgagtacccagcctggtttgagcagtttgtgctgcagtggctggatgaaaatgaagatgtgtccctggagttcctgcggggggccctggagcgggacaagaaggatggcttccagcagaccagcgagcacgccctcttcagctgcagcgtggtggatgtgttcacccagctgaaccagagctttgagatcatcaggaagctggagtgcccagaccccagcatcctggcccactacatgagaagatttgccaagaccatcggcaaggtgctgatgcagtatgctgacatcctgagcaaggacttccctgcctactgcaccaaggagaagctgccctgcatcctgatgaacaacgtgcagcagctgcgggtgcagctggagaagatgtttgaggccatgggcggcaaggagctggacctggaggccgctgacagcctgaaggagctgcaggtgaagctgaacacagtgctggatgagctgtccatggtgtttggaaacagcttccaggtgagaattgatgaatgtgtgcggcagatggctgacatcctgggccaggtgcggggcactggaaatgccagcccagatgcccgggccagcgctgcccaggatgctgacagcgtgctgcggcccctgatggacttcctggatggcaacctgaccctgtttgccaccgtgtgtgagaagacagtgctgaagagggtgctgaaggagctgtggagggtggtgatgaacaccatggagaggatgattgtgctgccccccctgacagaccagacaggcacccagctgatcttcaccgctgccaaggagctgagccacctgagcaagctgaaggaccacatggtgcgggaggagaccaggaacctgacccccaagcagtgtgctgtgctggacctggccctggacaccatcaagcagtacttccacgccggcggcaatggcctgaagaagaccttcctggagaagagcccagacctgcagagcctgcgctatgccctgagcctgtacacccagaccacagacaccctcatcaagacctttgtgcgcagccagaccacccaggtgcatgatggcaagggcatccgcttcaccgccaatgaagacatccggcctgagaagggcagcggcgtggatgatcctgtgggggaggtgtccatccaggtggacctcttcacccaccctggcactggagagcacaaggtgacagtgaaggtggtggccgccaatgacctgaagtggcagacagctggcatgttccggccctttgtggaggtgaccatggtgggcccccaccagagcgacaagaagaggaagttcaccaccaagagcaagagcaacaactgggcccccaagtacaatgagaccttccacttcctgctgggcaatgaggagggccctgagagctatgagctgcagatctgtgtgaaggactactgctttgcccgggaggacagagtgctgggcctggccgtgatgcccctgagagatgtgacagccaagggcagctgtgcctgctggtgccccctgggcaggaagatccacatggatgaaacaggcctgaccatcctgcgcatcctgagccagaggagcaatgatgaggtggcccgggagtttgtgaagctgaagtctgagagccgcagcacagaggagggcagctag

SEQ ID NO: 39827 - DNA, 6645 bp, Artificial Sequence
  Description of Artificial Sequence: Synthetic coding sequence
atggtggccaacttcttcaagagcctcatcctgccctacatccacaagctgtgcaagggcatgttcaccaagaagctgggcaacaccaacaagaacaaggagtaccggcagcagaagaaggaccaggacttccccacagctggccagaccaagagccccaagttctcctacaccttcaagagcacagtgaagaagatcgccaagtgcagcagcacccacaacctgagcacagaagaagatgaggccagcaaggagttcagcctgagccccaccttctcctacagagtggccatcgccaacggcctgcagaagaatgccaaggtgaccaacagcgacaatgaagacctgctgcaggagctgagcagcattgagagcagctacagcgagagcctgaatgagctgcggagcagcacagagaaccaggcccagagcacccacaccatgcctgtgagaagaaacaggaagagcagcagcagcctggcccccagcgagggcagcagtgatggagagaggaccctgcacggcctgaagctgggcgccctgaggaagctgaggaagtggaagaagagccaggagtgtgtgtccagtgacagcgagctgagcaccatgaagaagtcctggggcatccgcagcaagagcctggacagaacagtgaggaaccccaagaccaatgccctggagcccggcttcagcagcagcggctgcatcagccagacccatgatgtgatggagatgatcttcaaggagctgcagggcatcagccagatcgagacagagctgtctgagctgcggggccacgtgaatgccctgaagcacagcattgatgagatcagcagctctgtggaggtggtgcagagcgagattgagcagctgaggactggatttgtgcagagcagaagagagacccgggacatccatgactacatcaagcacctgggccacatgggcagcaaggccagcctgcgcttcctgaatgtgacagaggagagatttgaatatgtggagagcgtggtgtaccagatcctgattgacaagatgggcttcagtgatgccccaaatgccatcaagattgaatttgcccagagaattggccaccagagggactgccccaatgccaagccccggcccatcctggtgtactttgagaccccccagcagagggacagcgtgctgaagaagagctacaagctgaagggcaccggcatcggcatcagcacagacatcctgacccatgacatccgggagaggaaggagaagggcatccccagcagccagacctatgaatccatggccatcaagctgagcaccccagagcccaagatcaagaagaacaactggcagagcccagatgacagtgatgaggacctggagagtgacctgaacagaaacagctatgctgtgctgagcaagtctgagctgctgaccaagggcagcaccagcaagcccagcagcaagagccacagcgcccggagcaagaacaagacagccaacagcagccgcatcagcaacaagagtgactatgacaagatcagcagccagctgcctgagagtgacatcctggagaagcagaccaccacccactatgcagatgccacccccctgtggcacagccagagcgacttcttcaccgccaagctgagccgctctgagagtgacttcagcaagctgtgccagagctacagcgaggacttcagcgagaaccagttcttcaccaggaccaacggcagcagcctgctgagcagcagtgaccgggagctgtggcagaggaagcaggagggcacagccaccctgtatgacagccccaaggaccagcacctgaatggaggagtgcagggcatccagggccagacagaaacagagaacacagagaccgtggacagcggcatgagcaatggcatggtgtgtgccagcggggacaggagccactacagcgacagccagctgagcctgcacgaggacctgagcccctggaaggagtggaaccagggcgctgacctgggcctggacagcagcacccaggagggctttgattatgagaccaacagcctgtttgaccagcagctggatgtgtacaacaaggacctggagtacctgggcaagtgccacagcgacctgcaggatgattctgagagctatgacctgacccaggatgacaacagcagcccctgccccggcctggacaatgagccccagggccagtgggtgggccagtatgacagctaccagggcgccaacagcaatgagctgtaccagaaccagaaccagctgtccatgatgtaccgcagccagagcgagctgcagagtgatgattctgaagatgccccacccaagtcctggcacagccggctgagcattgacctgagtgacaagaccttctccttccccaagtttggcagcaccctgcagagggccaagagcgccctggaggtggtgtggaacaagagcacccagagcctgagcggctatgaagattctggcagcagcctgatgggccgcttccgcaccctgagccagagcacagccaatgaaagcagcaccaccctggacagtgatgtgtacacagagccctactactacaaggccgaggatgaggaggactacacagagcctgtggccgacaatgaaacagattatgtggaggtgatggagcaggtgctggccaagctggagaacagaaccagcatcacagaaacagatgagcagatgcaggcctatgaccacctgtcctatgagaccccctatgagaccccccaggatgagggctatgatggccctgcagatgacatggtgtctgaggagggcctggagcccctgaatgagaccagcgctgagatggagatcagagaagatgagaaccagaacatccctgagcagcctgtggagatcaccaagcccaagaggatccggcccagcttcaaggaggccgccctgcgggcctacaagaagcagatggccgagctggaggagaagatcctggccggggacagcagctctgtggatgagaaggccagaattgtgtctggaaatgacctggatgccagcaagttcagcgccctgcaggtgtgtggcggggccggcggcggcctgtatggcatcgacagcatgccagacctgcggaggaagaagaccctgcccatcgtgagagatgtggccatgaccctggccgccaggaagagcggcctgagcctggccatggtgatccgcaccagcctgaacaatgaggagctgaagatgcacgtgttcaagaagaccctgcaggccctgatctaccccatgagcagcaccatcccccacaactttgaggtgtggacagccaccacccccacctactgctatgaatgtgagggcctgctgtggggcatcgcccggcagggcatgaagtgcctggagtgtggggtgaagtgccacgagaagtgccaggacctgctgaatgctgactgcctgcagagagctgctgagaagagcagcaagcacggggctgaggacaagacccagaccatcatcacagccatgaaggagaggatgaagatccgggagaagaacagacctgaggtgtttgaggtgatccaggagatgttccagatcagcaaggaggactttgtgcagttcaccaaggccgccaagcagagcgtgctggatggcaccagcaagtggagcgccaagatcaccatcaccgtggtgtctgcccagggcctgcaggccaaggacaagacaggcagcagtgacccctacgtgacagtgcaggtgggcaagaacaagaggaggaccaagaccatcttcggcaacctgaaccctgtgtgggatgagaagttctactttgagtgccacaacagcacagaccgcatcaaggtgcgggtgtgggatgaagatgatgacatcaagagccgggtgaagcagcacttcaagaaggagagtgatgacttcctgggccagaccatcgtggaggtgaggaccctgagcggggagatggatgtgtggtacaacctggagaagaggacagacaagtctgctgtgtctggggccatccggctgaagatcaacgtggagatcaagggggaggagaaggtggccccctaccacatccagtacacctgcctgcacgagaacctcttccactacctgacagaggtgaagagcaatggaggagtgaagatccctgaggtgaagggagatgaggcctggaaggtgttctttgatgatgccagccaggagatcgtggatgaatttgccatgagatatggaattgagagcatctaccaggccatgacccacttcagctgcctgagcagcaagtacatgtgccctggggtgcctgctgtgatgagcaccctgctggccaacatcaatgccttctacgcccacaccaccgtgtccaccaacatccaggtgtctgccagtgacagatttgctgccaccaactttggccgggagaagttcatcaagctgctggaccagctgcacaacagcctgagaattgacctgagcaagtaccgggagaacttccctgccagcaacacagagcggctgcaggacctgaagagcacagtggacctgctgaccagcatcaccttcttcaggatgaaggtgctggagctgcagagcccccccaaggcctccatggtggtgaaggactgtgtgcgggcctgcctggacagcacctacaagtacatctttgacaactgccacgagctgtacagccagctgacagaccccagcaagaagcaggacatcccccgggaggaccagggccccaccaccaagaacctggacttctggccccagctgatcaccctgatggtgaccatcattgatgaggacaagacagcctacacccctgtgctgaaccagttcccccaggagctgaacatgggcaagatctctgctgagatcatgtggaccctgtttgccctggacatgaagtatgccctggaggagcacgagaaccagaggctgtgcaagagcacagactacatgaacctgcacttcaaggtgaagtggttctacaatgaatatgtgcgggagctgcctgccttcaaggatgctgtgcctgagtacagcctgtggtttgagccctttgtgatgcagtggctggatgaaaatgaagatgtgtccatggagttcctgcatggagccctgggccgggacaagaaggatggcttccagcagaccagcgagcacgccctcttcagctgcagcgtggtggatgtgtttgcccagctgaaccagagctttgagatcatcaagaagctggagtgccccaaccctgaggccctgagccacctgatgagaagatttgccaagaccatcaacaaggtgctgctgcagtatgctgccatcgtgtccagtgacttcagcagccactgtgacaaggaaaatgtgccctgcatcctgatgaacaacatccagcagctgcgggtgcagctggagaagatgtttgagagcatgggcggcaaggagctggacagcgaggccagcaccatcctgaaggagctgcaggtgaagctgagcggcgtgctggatgagctgtctgtgacctacggggagagcttccaggtgatcatcgaggagtgcatcaagcagatgagctttgagctgaaccagatgagggccaatggaaacaccaccagcaacaagaacagcgctgccatggatgctgagatcgtgctgcggagcctgatggacttcctggacaagaccctgagcctgagcgccaagatctgtgagaagacagtgctgaagagggtgctgaaggagctgtggaagctggtgctgaacaagattgagaagcagatcgtgctgccccccctgacagaccagacaggcccccagatgatcttcatcgccgccaaggacctgggccagctgagcaagctgaaggagcacatgatcagagaagatgcccggggcctgaccccccggcagtgtgccatcatggaggtggtgctggccaccatcaagcagtacttccacgccggcggcaatggcctgaagaagaacttcctggagaagagcccagacctgcagagcctgcgctatgccctgagcctgtacacccagaccacagatgccctgatcaagaagttcatcgacacccagaccagccagagccgcagcagcaaggatgctgtgggccagatctctgtgcacgtggacatcacagccaccccaggcaccggggaccacaaggtgacagtgaaggtgattgccatcaatgacctgaactggcagaccacagccatgttccggccctttgtggaggtgtgcatcctgggccccaacctgggggacaagaagaggaagcagggcaccaagaccaagagcaacacctggagccccaagtacaatgagaccttccagttcatcctgggcaaggaaaatagacctggggcctatgagctgcacctgtctgtgaaggactactgctttgccagagaagatcgcatcatcggcatgaccgtcatccagctgcagaacattgctgagaagggcagctatggagcctggtaccccctgctgaagaacatctccatggatgagaccggcctgaccatcctgcgcatcctgagccagaggaccagtgatgatgtggccaaggagtttgtgcggctgaagtctgagaccaggagcacagaggagagcgcctag

SEQ ID NO: 39828 - DNA, 6639 bp, Artificial Sequence
  Description of Artificial Sequence: Synthetic coding sequence
atggtggccaacttcttcaagagcctcatcctgccctacatccacaagctgtgcaagggcatgttcaccaagaagctgggcaacaccaacaagaacaaggagtaccggcagcagaagaaggaccaggacttccccacagctggccagaccaagagccccaagttctcctacaccttcaagagcacagtgaagaagatcgccaagtgcagcagcacccacaacctgagcacagaagaagatgaggccagcaaggagttcagcctgagccccaccttctcctacagagtggccatcgccaacggcctgcagaagaatgccaaggtgaccaacagcgacaatgaagacctgctgcaggagctgagcagcattgagagcagctacagcgagagcctgaatgagctgcggagcagcacagagaaccaggcccagagcacccacaccatgcctgtgagaagaaacaggaagagcagcagcagcctggcccccagcgagggcagcagtgatggagagaggaccctgcacggcctgaagctgggcgccctgaggaagctgaggaagtggaagaagagccaggagtgtgtgtccagtgacagcgagctgagcaccatgaagaagtcctggggcatccgcagcaagagcctggacagaacagtgaggaaccccaagaccaatgccctggagcccggcttcagcagcagcggctgcatcagccagacccatgatgtgatggagatgatcttcaaggagctgcagggcatcagccagatcgagacagagctgtctgagctgcggggccacgtgaatgccctgaagcacagcattgatgagatcagcagctctgtggaggtggtgcagagcgagattgagcagctgaggactggatttgtgcagagcagaagagagacccgggacatccatgactacatcaagcacctgggccacatgggcagcaaggccagcctgcgcttcctgaatgtgacagaggagagatttgaatatgtggagagcgtggtgtaccagatcctgattgacaagatgggcttcagtgatgccccaaatgccatcaagattgaatttgcccagagaattggccaccagagggactgccccaatgccaagccccggcccatcctggtgtactttgagaccccccagcagagggacagcgtgctgaagaagagctacaagctgaagggcaccggcatcggcatcagcacagacatcctgacccatgacatccgggagaggaaggagaagggcatccccagcagccagacctatgaatccatggccatcaagctgagcaccccagagcccaagatcaagaagaacaactggcagagcccagatgacagtgatgaggacctggagagtgacctgaacagaaacagctatgctgtgctgagcaagtctgagctgctgaccaagggcagcaccagcaagcccagcagcaagagccacagcgcccggagcaagaacaagacagccaacagcagccgcatcagcaacaagagtgactatgacaagatcagcagccagctgcctgagagtgacatcctggagaagcagaccaccacccactatgcagatgccacccccctgtggcacagccagagcgacttcttcaccgccaagctgagccgctctgagagtgacttcagcaagctgtgccagagctacagcgaggacttcagcgagaaccagttcttcaccaggaccaacggcagcagcctgctgagcagcagtgaccgggagctgtggcagaggaagcaggagggcacagccaccctgtatgacagccccaaggaccagcacctgaatggaggagtgcagggcatccagggccagacagaaacagagaacacagagaccgtggacagcggcatgagcaatggcatggtgtgtgccagcggggacaggagccactacagcgacagccagctgagcctgcacgaggacctgagcccctggaaggagtggaaccagggcgctgacctgggcctggacagcagcacccaggagggctttgattatgagaccaacagcctgtttgaccagcagctggatgtgtacaacaaggacctggagtacctgggcaagtgccacagcgacctgcaggatgattctgagagctatgacctgacccaggatgacaacagcagcccctgccccggcctggacaatgagccccagggccagtgggtgggccagtatgacagctaccagggcgccaacagcaatgagctgtaccagaaccagaaccagctgtccatgatgtaccgcagccagagcgagctgcagagtgatgattctgaagatgccccacccaagtcctggcacagccggctgagcattgacctgagtgacaagaccttctccttccccaagtttggcagcaccctgcagagggccaagagcgccctggaggtggtgtggaacaagagcacccagagcctgagcggctatgaagattctggcagcagcctgatgggccgcttccgcaccctgagccagagcacagccaatgaaagcagcaccaccctggacagtgatgtgtacacagagccctactactacaaggccgaggatgaggaggactacacagagcctgtggccgacaatgaaacagattatgtggaggtgatggagcaggtgctggccaagctggagaacagaaccagcatcacagaaacagatgagcagatgcaggcctatgaccacctgtcctatgagaccccctatgagaccccccaggatgagggctatgatggccctgcagatgacatggtgtctgaggagggcctggagcccctgaatgagaccagcgctgagatggagatcagagaagatgagaaccagaacatccctgagcagcctgtggagatcaccaagcccaagaggatccggcccagcttcaaggaggccgccctgcgggcctacaagaagcagatggccgagctggaggagaagatcctggccggggacagcagctctgtggatgagaaggccagaattgtgtctggaaatgacctggatgccagcaagttcagcgccctgcaggtgtgtggcggggccggcggcggcctgtatggcatcgacagcatgccagacctgcggaggaagaagaccctgcccatcgtgagagatgtgaccctggccgccaggaagagcggcctgagcctggccatggtgatccgcaccagcctgaacaatgaggagctgaagatgcacgtgttcaagaagaccctgcaggccctgatctaccccatgagcagcaccatcccccacaactttgaggtgtggacagccaccacccccacctactgctatgaatgtgagggcctgctgtggggcatcgcccggcagggcatgaagtgcctggagtgtggggtgaagtgccacgagaagtgccaggacctgctgaatgctgactgcctgcagagagctgctgagaagagcagcaagcacggggctgaggacaagacccagaccatcatcacagccatgaaggagaggatgaagatccgggagaagaacagacctgaggtgtttgaggtgatccaggagatgttccagatcagcaaggaggactttgtgcagttcaccaaggccgccaagcagagcgtgctggatggcaccagcaagtggagcgccaagatcaccatcaccgtggtgtctgcccagggcctgcaggccaaggacaagacaggcagcagtgacccctacgtgacagtgcaggtgggcaagaacaagaggaggaccaagaccatcttcggcaacctgaaccctgtgtgggatgagaagttctactttgagtgccacaacagcacagaccgcatcaaggtgcgggtgtgggatgaagatgatgacatcaagagccgggtgaagcagcacttcaagaaggagagtgatgacttcctgggccagaccatcgtggaggtgaggaccctgagcggggagatggatgtgtggtacaacctggagaagaggacagacaagtctgctgtgtctggggccatccggctgaagatcaacgtggagatcaagggggaggagaaggtggccccctaccacatccagtacacctgcctgcacgagaacctcttccactacctgacagaggtgaagagcaatggaggagtgaagatccctgaggtgaagggagatgaggcctggaaggtgttctttgatgatgccagccaggagatcgtggatgaatttgccatgagatatggaattgagagcatctaccaggccatgacccacttcagctgcctgagcagcaagtacatgtgccctggggtgcctgctgtgatgagcaccctgctggccaacatcaatgccttctacgcccacaccaccgtgtccaccaacatccaggtgtctgccagtgacagatttgctgccaccaactttggccgggagaagttcatcaagctgctggaccagctgcacaacagcctgagaattgacctgagcaagtaccgggagaacttccctgccagcaacacagagcggctgcaggacctgaagagcacagtggacctgctgaccagcatcaccttcttcaggatgaaggtgctggagctgcagagcccccccaaggcctccatggtggtgaaggactgtgtgcgggcctgcctggacagcacctacaagtacatctttgacaactgccacgagctgtacagccagctgacagaccccagcaagaagcaggacatcccccgggaggaccagggccccaccaccaagaacctggacttctggccccagctgatcaccctgatggtgaccatcattgatgaggacaagacagcctacacccctgtgctgaaccagttcccccaggagctgaacatgggcaagatctctgctgagatcatgtggaccctgtttgccctggacatgaagtatgccctggaggagcacgagaaccagaggctgtgcaagagcacagactacatgaacctgcacttcaaggtgaagtggttctacaatgaatatgtgcgggagctgcctgccttcaaggatgctgtgcctgagtacagcctgtggtttgagccctttgtgatgcagtggctggatgaaaatgaagatgtgtccatggagttcctgcatggagccctgggccgggacaagaaggatggcttccagcagaccagcgagcacgccctcttcagctgcagcgtggtggatgtgtttgcccagctgaaccagagctttgagatcatcaagaagctggagtgccccaaccctgaggccctgagccacctgatgagaagatttgccaagaccatcaacaaggtgctgctgcagtatgctgccatcgtgtccagtgacttcagcagccactgtgacaaggaaaatgtgccctgcatcctgatgaacaacatccagcagctgcgggtgcagctggagaagatgtttgagagcatgggcggcaaggagctggacagcgaggccagcaccatcctgaaggagctgcaggtgaagctgagcggcgtgctggatgagctgtctgtgacctacggggagagcttccaggtgatcatcgaggagtgcatcaagcagatgagctttgagctgaaccagatgagggccaatggaaacaccaccagcaacaagaacagcgctgccatggatgctgagatcgtgctgcggagcctgatggacttcctggacaagaccctgagcctgagcgccaagatctgtgagaagacagtgctgaagagggtgctgaaggagctgtggaagctggtgctgaacaagattgagaagcagatcgtgctgccccccctgacagaccagacaggcccccagatgatcttcatcgccgccaaggacctgggccagctgagcaagctgaaggagcacatgatcagagaagatgcccggggcctgaccccccggcagtgtgccatcatggaggtggtgctggccaccatcaagcagtacttccacgccggcggcaatggcctgaagaagaacttcctggagaagagcccagacctgcagagcctgcgctatgccctgagcctgtacacccagaccacagatgccctgatcaagaagttcatcgacacccagaccagccagagccgcagcagcaaggatgctgtgggccagatctctgtgcacgtggacatcacagccaccccaggcaccggggaccacaaggtgacagtgaaggtgattgccatcaatgacctgaactggcagaccacagccatgttccggccctttgtggaggtgtgcatcctgggccccaacctgggggacaagaagaggaagcagggcaccaagaccaagagcaacacctggagccccaagtacaatgagaccttccagttcatcctgggcaaggaaaatagacctggggcctatgagctgcacctgtctgtgaaggactactgctttgccagagaagatcgcatcatcggcatgaccgtcatccagctgcagaacattgctgagaagggcagctatggagcctggtaccccctgctgaagaacatctccatggatgagaccggcctgaccatcctgcgcatcctgagccagaggaccagtgatgatgtggccaaggagtttgtgcggctgaagtctgagaccaggagcacagaggagagcgcctag

SEQ ID NO: 39829 - DNA, 6645 bp, Artificial Sequence
  Description of Artificial Sequence: Synthetic coding sequence
atggtggccaacttcttcaagagcctcatcctgccctacatccacaagctgtgcaagggcatgttcaccaagaagctgggcaacaccaacaagaacaaggagtaccggcagcagaagaaggaccaggacttccccacagctggccagaccaagagccccaagttctcctacaccttcaagagcacagtgaagaagatcgccaagtgcagcagcacccacaacctgagcacagaagaagatgaggccagcaaggagttcagcctgagccccaccttctcctacagagtggccatcgccaacggcctgcagaagaatgccaaggtgaccaacagcgacaatgaagacctgctgcaggagctgagcagcattgagagcagctacagcgagagcctgaatgagctgcggagcagcacagagaaccaggcccagagcacccacaccatgcctgtgagaagaaacaggaagagcagcagcagcctggcccccagcgagggcagcagtgatggagagaggaccctgcacggcctgaagctgggcgccctgaggaagctgaggaagtggaagaagagccaggagtgtgtgtccagtgacagcgagctgagcaccatgaagaagtcctggggcatccgcagcaagagcctggacagaacagtgaggaaccccaagaccaatgccctggagcccggcttcagcagcagcggctgcatcagccagacccatgatgtgatggagatgatcttcaaggagctgcagggcatcagccagatcgagacagagctgtctgagctgcggggccacgtgaatgccctgaagcacagcattgatgagatcagcagctctgtggaggtggtgcagagcgagattgagcagctgaggactggatttgtgcagagcagaagagagacccgggacatccatgactacatcaagcacctgggccacatgggcagcaaggccagcctgcgcttcctgaatgtgacagaggagagatttgaatatgtggagagcgtggtgtaccagatcctgattgacaagatgggcttcagtgatgccccaaatgccatcaagattgaatttgcccagagaattggccaccagagggactgccccaatgccaagccccggcccatcctggtgtactttgagaccccccagcagagggacagcgtgctgaagaagagctacaagctgaagggcaccggcatcggcatcagcacagacatcctgacccatgacatccgggagaggaaggagaagggcatccccagcagccagacctatgaatccatggccatcaagctgagcaccccagagcccaagatcaagaagaacaactggcagagcccagatgacagtgatgaggacctggagagtgacctgaacagaaacagctatgctgtgctgagcaagtctgagctgctgaccaagggcagcaccagcaagcccagcagcaagagccacagcgcccggagcaagaacaagacagccaacagcagccgcatcagcaacaagagtgactatgacaagatcagcagccagctgcctgagagtgacatcctggagaagcagaccaccacccactatgcagatgccacccccctgtggcacagccagagcgacttcttcaccgccaagctgagccgctctgagagtgacttcagcaagctgtgccagagctacagcgaggacttcagcgagaaccagttcttcaccaggaccaacggcagcagcctgctgagcagcagtgaccgggagctgtggcagaggaagcaggagggcacagccaccctgtatgacagccccaaggaccagcacctgaatggaggagtgcagggcatccagggccagacagaaacagagaacacagagaccgtggacagcggcatgagcaatggcatggtgtgtgccagcggggacaggagccactacagcgacagccagctgagcctgcacgaggacctgagcccctggaaggagtggaaccagggcgctgacctgggcctggacagcagcacccaggagggctttgattatgagaccaacagcctgtttgaccagcagctggatgtgtacaacaaggacctggagtacctgggcaagtgccacagcgacctgcaggatgattctgagagctatgacctgacccaggatgacaacagcagcccctgccccggcctggacaatgagccccagggccagtgggtgggccagtatgacagctaccagggcgccaacagcaatgagctgtaccagaaccagaaccagctgtccatgatgtaccgcagccagagcgagctgcagagtgatgattctgaagatgccccacccaagtcctggcacagccggctgagcattgacctgagtgacaagaccttctccttccccaagtttggcagcaccctgcagagggccaagagcgccctggaggtggtgtggaacaagagcacccagagcctgagcggctatgaagattctggcagcagcctgatgggccgcttccgcaccctgagccagagcacagccaatgaaagcagcaccaccctggacagtgatgtgtacacagagccctactactacaaggccgaggatgaggaggactacacagagcctgtggccgacaatgaaacagattatgtggaggtgatggagcaggtgctggccaagctggagaacagaaccagcatcacagaaacagatgagcagatgcaggcctatgaccacctgtcctatgagaccccctatgagaccccccaggatgagggctatgatggccctgcagatgacatggtgtctgaggagggcctggagcccctgaatgagaccagcgctgagatggagatcagagaagatgagaaccagaacatccctgagcagcctgtggagatcaccaagcccaagaggatccggcccagcttcaaggaggccgccctgcgggcctacaagaagcagatggccgagctggaggagaagatcctggccggcgtgtccctggatgtggacctggaggccagaattgtgtctggaaatgacctggatgccagcaagttcagcgccctgcaggtgtgtggcggggccggcggcggcctgtatggcatcgacagcatgccagacctgcggaggaagaagaccctgcccatcgtgagagatgtgctgctgaccctggccgccaggaagagcggcctgagcctggccatggtgatccgcaccagcctgaacaatgaggagctgaagatgcacgtgttcaagaagaccctgcaggccctgatctaccccatgagcagcaccatcccccacaactttgaggtgtggacagccaccacccccacctactgctatgaatgtgagggcctgctgtggggcatcgcccggcagggcatgaagtgcctggagtgtggggtgaagtgccacgagaagtgccaggacctgctgaatgctgactgcctgcagagagctgctgagaagagcagcaagcacggggctgaggacaagacccagaccatcatcacagccatgaaggagaggatgaagatccgggagaagaacagacctgaggtgtttgaggtgatccaggagatgttccagatcagcaaggaggactttgtgcagttcaccaaggccgccaagcagagcgtgctggatggcaccagcaagtggagcgccaagatcaccatcaccgtggtgtctgcccagggcctgcaggccaaggacaagacaggcagcagtgacccctacgtgacagtgcaggtgggcaagaacaagaggaggaccaagaccatcttcggcaacctgaaccctgtgtgggatgagaagttctactttgagtgccacaacagcacagaccgcatcaaggtgcgggtgtgggatgaagatgatgacatcaagagccgggtgaagcagcacttcaagaaggagagtgatgacttcctgggccagaccatcgtggaggtgaggaccctgagcggggagatggatgtgtggtacaacctggagaagaggacagacaagtctgctgtgtctggggccatccggctgaagatcaacgtggagatcaagggggaggagaaggtggccccctaccacatccagtacacctgcctgcacgagaacctcttccactacctgacagaggtgaagagcaatggaggagtgaagatccctgaggtgaagggagatgaggcctggaaggtgttctttgatgatgccagccaggagatcgtggatgaatttgccatgagatatggaattgagagcatctaccaggccatgacccacttcagctgcctgagcagcaagtacatgtgccctggggtgcctgctgtgatgagcaccctgctggccaacatcaatgccttctacgcccacaccaccgtgtccaccaacatccaggtgtctgccagtgacagatttgctgccaccaactttggccgggagaagttcatcaagctgctggaccagctgcacaacagcctgagaattgacctgagcaagtaccgggagaacttccctgccagcaacacagagcggctgcaggacctgaagagcacagtggacctgctgaccagcatcaccttcttcaggatgaaggtgctggagctgcagagcccccccaaggcctccatggtggtgaaggactgtgtgcgggcctgcctggacagcacctacaagtacatctttgacaactgccacgagctgtacagccagctgacagaccccagcaagaagcaggacatcccccgggaggaccagggccccaccaccaagaacctggacttctggccccagctgatcaccctgatggtgaccatcattgatgaggacaagacagcctacacccctgtgctgaaccagttcccccaggagctgaacatgggcaagatctctgctgagatcatgtggaccctgtttgccctggacatgaagtatgccctggaggagcacgagaaccagaggctgtgcaagagcacagactacatgaacctgcacttcaaggtgaagtggttctacaatgaatatgtgcgggagctgcctgccttcaaggatgctgtgcctgagtacagcctgtggtttgagccctttgtgatgcagtggctggatgaaaatgaagatgtgtccatggagttcctgcatggagccctgggccgggacaagaaggatggcttccagcagaccagcgagcacgccctcttcagctgcagcgtggtggatgtgtttgcccagctgaaccagagctttgagatcatcaagaagctggagtgccccaaccctgaggccctgagccacctgatgagaagatttgccaagaccatcaacaaggtgctgctgcagtatgctgccatcgtgtccagtgacttcagcagccactgtgacaaggaaaatgtgccctgcatcctgatgaacaacatccagcagctgcgggtgcagctggagaagatgtttgagagcatgggcggcaaggagctggacagcgaggccagcaccatcctgaaggagctgcaggtgaagctgagcggcgtgctggatgagctgtctgtgacctacggggagagcttccaggtgatcatcgaggagtgcatcaagcagatgagctttgagctgaaccagatgagggccaatggaaacaccaccagcaacaagaacagcgctgccatggatgctgagatcgtgctgcggagcctgatggacttcctggacaagaccctgagcctgagcgccaagatctgtgagaagacagtgctgaagagggtgctgaaggagctgtggaagctggtgctgaacaagattgagaagcagatcgtgctgccccccctgacagaccagacaggcccccagatgatcttcatcgccgccaaggacctgggccagctgagcaagctgaaggagcacatgatcagagaagatgcccggggcctgaccccccggcagtgtgccatcatggaggtggtgctggccaccatcaagcagtacttccacgccggcggcaatggcctgaagaagaacttcctggagaagagcccagacctgcagagcctgcgctatgccctgagcctgtacacccagaccacagatgccctgatcaagaagttcatcgacacccagaccagccagagccgcagcagcaaggatgctgtgggccagatctctgtgcacgtggacatcacagccaccccaggcaccggggaccacaaggtgacagtgaaggtgattgccatcaatgacctgaactggcagaccacagccatgttccggccctttgtggaggtgtgcatcctgggccccaacctgggggacaagaagaggaagcagggcaccaagaccaagagcaacacctggagccccaagtacaatgagaccttccagttcatcctgggcaaggaaaatagacctggggcctatgagctgcacctgtctgtgaaggactactgctttgccagagaagatcgcatcatcggcatgaccgtcatccagctgcagaacattgctgagaagggcagctatggagcctggtaccccctgctgaagaacatctccatggatgagaccggcctgaccatcctgcgcatcctgagccagaggaccagtgatgatgtggccaaggagtttgtgcggctgaagtctgagaccaggagcacagaggagagcgcctag

SEQ ID NO: 39830 - DNA, 1557 bp, Artificial Sequence
  Description of Artificial Sequence: Synthetic coding sequence
atgtgcccccaggagagcagcttccagcccagccagttcctgctgctggtgggcgtgcctgtggcctctgtgctgctgctggcccagtgcctgcgctggcactgcccccggcggctgctgggcgcctgctggaccctgaatggccaggaggagcctgtgtcccagcccaccccccagctggagaatgaggtgtcccggcagcacctgcctgccaccctgcctgagatggtggccttctaccaggagctgcacacccccacccagggccagaccatggtgcggcagctgatgcacaagctgctggtgttcagcgcccgggaggtggaccaccggggcggctgcctgatgctgcaggacaccggcatcagcctgctgatccccccaggagctgtggccgtgggccggcaggagcgggtgtccctcatcctggtgtgggacctgagtgatgcccccagcctgagccaggcccagggcctggtgtcccctgtggtggcctgtggcccccatggagccagcttcctgaagccctgcaccctgaccttcaagcactgtgccgagcagcccagccacgcccggacctacagcagcaacaccaccctgctggatgccaaggtgtggaggcccctgggccggcctggggcccacgccagcagagatgagtgccgcatccacctgagccacttcagcctgtacacctgtgtgctggaggcccctgtgggccgggaggccaggaagtggctgcagctggccgtgttctgcagccccctggtgcccggccagagccacctgcagctgcgcatctacttcctgaacaacaccccctgtgccctgcagtgggccctgaccaatgagcagccccatggaggccgcctgcggggcccctgccagctgtttgacttcaatggagcccggggggaccagtgcctgaagctgacctacatcagcgagggctgggagaatgtggatgacagcagctgccagctggtgccccacctgcacatctggcacggcaagtgccccttccgctccttctgcttccggaggaaggctgctgatgaaaatgaagactgcagcgccctgaccaatgagatcatcgtgaccatgcacaccttccaggacggcctggagaccaagtacatggagatcctgcgcttccaggccagcgaggaggagagctgggccgcccctcctcctgtgtcccagcccccaccctgcaaccggctgcccccagagctgtttgagcagctgaggatgctgctggagcccaacagcatcactggaaatgactggaggcggctggccagccacctgggcctgtgtggcatgaagatccgcttcctgagctgccagaggagccctgctgctgccatcctggagctgtttgaggagcagaatggcagcctgcaggagctgcactacctgatgacagtgatggagcggctggactgtgccagcgccatccagaactacctgagcggcacccatggaggcagccctggccctgagcggggcggggcccgggacaaccagggcctggagctggatgagaagctgtag

SEQ ID NO: 39831 - DNA, 1557 bp, Artificial Sequence; identical to SEQ ID NO: 39830
  Description of Artificial Sequence: Synthetic coding sequence

SEQ ID NO: 39832 - DNA, 2862 bp, Artificial Sequence
  Description of Artificial Sequence: Synthetic coding sequence
atgggccgggctgctgccacagctgggggcggcggcggggcccggcgctggctgccctggctgggcctgtgcttctgggccgccggcacagctgctgcccggggcacagacaacggggaggccctgcctgagagcatccccagcgcccctggcaccctgccccacttcatcgaggagccagatgatgcctacatcatcaagagcaaccccatcgccctgcgctgcaaggcccggcctgccatgcagatcttcttcaagtgcaatggagagtgggtgcaccagaatgaacatgtgtctgaggagaccctggatgagagcagcggcctgaaggtgcgggaggtgttcatcaacgtgacccggcagcaggtggaggacttccacggccctgaggactactggtgccagtgtgtggcctggagccacctgggcaccagcaagagcaggaaggcctctgtgcgcatcgcctacctgaggaagaactttgagcaggacccccagggccgggaggtgcccatcgagggcatgattgtgctgcactgccggcccccagagggcgtgcctgctgctgaggtggagtggctgaagaatgaggagcccatcgacagcgagcaggatgagaacatcgacaccagggctgaccacaacctgatcatccggcaggcccggctgagtgacagcggcaactacacctgcatggccgccaacatcgtggccaagaggaggagcctgagcgccaccgtggtggtgtatgtgaatggaggctggagctcctggacagagtggagcgcctgcaatgtgcgctgtggccggggctggcagaagaggagcaggacctgcaccaacccagcccccctgaatggaggagccttctgtgagggcatgtctgtgcagaagatcacctgcaccagcctgtgccctgtggatggctcctgggaggtgtggagcgagtggagcgtgtgcagcccagaatgtgagcacctgcgcatcagagaatgtacagcccccccaccaagaaatggaggcaagttctgtgagggcctgagccaggagagcgagaactgcacagatggcctgtgcatcctggacaagaagcccctgcacgagatcaagccccagagcattgaaaatgccagtgacatcgccctgtacagcggcctgggcgctgctgtggtggccgtggccgtgctggtgattggagtgaccctgtaccgccgcagccagagcgactatggagtggatgtgattgacagcagcgccctgactggaggcttccagaccttcaacttcaagacagtgcggcagggcaacagcctgctgctgaacagcgccatgcagcctgacctgactgtgtccaggacctacagcggccccatctgcctgcaggaccccctggacaaggagctgatgacagagagcagcctcttcaaccccctgagtgacatcaaggtgaaggtgcagagcagcttcatggtgtccctgggcgtgtctgaaagagctgagtaccacggcaagaaccacagcaggaccttcccccacggcaacaaccacagcttcagcaccatgcaccccaggaacaagatgccctacatccagaacctgagcagcctgcccaccaggacagagctgcggaccactggagtgtttggccacctgggcggccgcctggtgatgcccaacacaggagtgtccctgctgatcccccacggggccatccctgaggagaacagctgggagatctacatgagcatcaaccagggcgagcccagcctgcagagtgatggcagcgaggtgctgctgagccctgaggtgacctgtggccccccagacatgattgtgaccaccccatttgccctgaccatcccccactgtgctgatgtgagcagcgagcactggaacatccacctgaagaagaggacccagcagggcaagtgggaggaggtgatgtctgtggaggatgagagcaccagctgctactgcctgctggacccctttgcctgccacgtgctgctggacagctttggcacctacgccctgactggagagcccatcacagactgtgctgtgaagcagctgaaggtggccgtgtttggctgcatgagctgcaacagcctggactacaacctgcgggtgtactgtgtggacaacaccccctgtgccttccaggaggtggtgtctgatgagcggcaccagggcggccagctgctggaggagcccaagctgctgcacttcaagggcaacaccttcagcctgcagatctctgtgctggacatcccccccttcctgtggaggatcaagcccttcaccgcctgccaggaggtgcccttcagccgggtgtggtgcagcaaccggcagcccctgcactgtgccttcagcctggagcgctacacccccaccaccacccagctgagctgcaagatctgcatccggcagctgaagggccacgagcagatcctgcaggtgcagaccagcatcctggagagcgagcgggagaccatcaccttctttgcccaggaggacagcaccttccctgcccagacaggccccaaggccttcaagatcccctacagcatccggcagaggatctgtgccacctttgacaccccaaatgccaagggcaaggactggcagatgctggcccagaagaacagcatcaacagaaacctgagctactttgccacccagagcagccccagcgctgtgatcctgaacctgtgggaggcccggcaccagcatgatggagacctggacagcctggcctgtgccctggaggagattggaagaacccacaccaagctgagcaacatcagcgagagccagctggatgaagctgacttcaactacagccggcagaatggcctgtag

SEQ ID NO: 39833 - DNA, 2847 bp, Artificial Sequence
  Description of Artificial Sequence: Synthetic coding sequence
atgatcctggtgctggtgaaggccctgagtgatgtgtgtgccggcaccagcggcttcctgctggacttcagcagccagaccagccctggaacagacaatggagaggccctgcctgagagcatccccagcgcccctggcaccctgccccacttcatcgaggagccagatgatgcctacatcatcaagagcaaccccatcgccctgcgctgcaaggcccggcctgccatgcagatcttcttcaagtgcaatggagagtgggtgcaccagaatgagcacgtgtctgaggagaccctggatgagagcagcggcctgaaggtgcgggaggtgttcatcaacgtgacccggcagcaggtggaggacttccacggccctgaggactactggtgccagtgtgtggcctggagccacctgggcaccagcaagagcaggaaggcctctgtgagaattgcctacctgaggaagaactttgagcaggacccccagggccgggaggtgcccatcgagggcatgattgtgctgcactgcaggcctcctgagggcgtgcctgctgctgaggtggagtggctgaagaatgaggagcccattgattctgagcaggatgaaaatattgacaccagggctgaccacaacctgatcatccggcaggcccggctgagtgacagcggcaactacacctgcatggccgccaacatcgtggccaagagaagaagcctgagcgccaccgtggtggtgtatgtgaatggaggctggagctcctggacagagtggagcgcctgcaatgtgcgctgtggccggggctggcagaagaggagcaggacctgcaccaacccagcccccctgaatggaggagccttctgtgagggcatgtctgtgcagaagatcacctgcaccagcctgtgccctgtggatggctcctgggaggtgtggagcgagtggagcgtgtgcagcccagaatgtgagcacctgcgcatccgggagtgcacagcccctcctccaagaaatggaggcaagttctgtgagggcctgagccaggagagcgagaactgcacagatggcctgtgcatcctggacaagaagcccctgcacgagatcaagccccagagcattgaaaatgccagtgacatcgccctgtacagcggcctgggcgctgctgtggtggccgtggccgtgctggtgattggagtgaccctgtacagaagaagccagagcgactatggagtggatgtgattgacagcagcgccctgaccggcggcttccagaccttcaacttcaagacagtgcggcagggcaacagcctgctgctgaacagcgccatgcagcctgacctgactgtgtccaggacctacagcggccccatctgcctgcaggaccccctggacaaggagctgatgacagagagcagcctcttcaaccccctgagtgacatcaaggtgaaggtgcagagcagcttcatggtgtccctgggcgtgtctgagcgggcagagtaccacggcaagaaccacagcaggaccttcccccacggcaacaaccacagcttcagcaccatgcaccccaggaacaagatgccctacatccagaacctgagcagcctgcccaccaggacagagctgcggaccaccggggtgtttggccacctgggcggccgcctggtgatgcccaacacaggagtgtccctgctgatcccccatggagccatcccagaagaaaattcctgggagatctacatgagcatcaaccagggcgagcccagcctgcagagtgatggcagcgaggtgctgctgagccctgaggtgacctgtggccccccagacatgattgtgaccaccccatttgccctgaccatcccccactgtgctgatgtgtcctctgagcactggaacatccacctgaagaagaggacccagcagggcaagtgggaggaggtgatgtctgtggaggatgagagcaccagctgctactgcctgctggacccctttgcctgccacgtgctgctggacagctttggcacctacgccctgaccggggagcccatcacagactgtgctgtgaagcagctgaaggtggccgtgtttggctgcatgagctgcaacagcctggactacaacctgcgggtgtactgtgtggacaacaccccctgtgccttccaggaggtggtgtctgatgagcggcaccagggcggccagctgctggaggagcccaagctgctgcacttcaagggcaacaccttcagcctgcagatctctgtgctggacatcccccccttcctgtggaggatcaagcccttcaccgcctgccaggaggtgcccttcagccgggtgtggtgcagcaaccggcagcccctgcactgtgccttcagcctggagcgctacacccccaccaccacccagctgagctgcaagatctgcatccggcagctgaagggccacgagcagatcctgcaggtgcagaccagcatcctggagagcgagcgggagaccatcaccttctttgcccaggaggacagcaccttccctgcccagacaggccccaaggccttcaagatcccctacagcatccggcagaggatctgtgccacctttgacaccccaaatgccaagggcaaggactggcagatgctggcccagaagaacagcatcaacagaaacctgagctactttgccacccagagcagccccagcgctgtgatcctgaacctgtgggaggcccggcaccagcatgatggagacctggacagcctggcctgtgccctggaggagatcggccgcacccacaccaagctgagcaacatcagcgagagccagctggatgaggccgacttcaactacagccggcagaatggcctgtag

SEQ ID NO: 39834 - DNA, 780 bp, Artificial Sequence
  Description of Artificial Sequence: Synthetic coding sequence
atgctgcccagcacctctgtgaacagcctggtgcagggcaatggagtgctgaacagcagagatgctgcccggcacacagctggggccaagcgctacaagtacctgcggcggctcttccgcttccggcagatggactttgaatttgctgcctggcagatgctgtacctgttcaccagcccccagagggtgtacagaaacttccactacaggaagcagaccaaggaccagtgggccagagatgatcctgccttcctggtgctgctgagcatctggctgtgtgtgtccaccatcggctttggatttgtgctggacatgggcttctttgagaccatcaagctgctgctgtgggtggtgctgattgactgtgtgggcgtgggcctgctgattgccaccctgatgtggttcatcagcaacaagtacctggtgaagaggcagagccgggactatgatgtggagtggggctacgcctttgatgtgcacctgaatgccttctaccccctgctggtgatcctgcacttcatccagctgttcttcatcaaccacgtgatcctgacagacaccttcatcggctacctggtgggcaacaccctgtggctggtggccgtgggctactacatctacgtgaccttcctgggctacagcgccctgcccttcctgaagaacacagtcatcctgctgtacccctttgcccccctcatcctgctgtatggcctgagcctggccctgggctggaacttcacccacaccctgtgcagcttctacaagtacagagtgaagtag

SEQ ID NO: 39835 - DNA, 831 bp, Artificial Sequence
  Description of Artificial Sequence: Synthetic coding sequence
atgttcctgcagaacacctgcaagagaaatgtgttcctgcccagcaggaagatgctgcccagcacctctgtgaacagcctggtgcagggcaatggagtgctgaacagcagagatgctgcccggcacacagctggggccaagcgctacaagtacctgcggcggctcttccgcttccggcagatggactttgaatttgctgcctggcagatgctgtacctgttcaccagcccccagagggtgtacagaaacttccactacaggaagcagaccaaggaccagtgggccagagatgatcctgccttcctggtgctgctgagcatctggctgtgtgtgtccaccatcggcttcggctttgtgctggacatgggcttctttgagaccatcaagctgctgctgtgggtggtgctgattgactgtgtgggcgtgggcctgctgattgccaccctgatgtggttcatcagcaacaagtacctggtgaagaggcagagccgggactatgatgtggagtggggctacgcctttgatgtgcacctgaatgccttctaccccctgctggtgatcctgcacttcatccagctgttcttcatcaaccacgtgatcctgacagacaccttcatcggctacctggtgggcaacaccctgtggctggtggccgtgggctactacatctacgtgaccttcctgggctacagcgccctgcccttcctgaagaacacagtcatcctgctgtacccctttgcccccctcatcctgctgtatggcctgagcctggccctgggctggaacttcacccacaccctgtgcagcttctacaagtacagagtgaagtag

SEQ ID NO: 39836 - DNA, 831 bp, Artificial Sequence; identical to SEQ ID NO: 39835
  Description of Artificial Sequence: Synthetic coding sequence

SEQ ID NO: 39837 - DNA, 3111 bp, Artificial Sequence
  Description of Artificial Sequence: Synthetic coding sequence
atggaggtggtgggggactttgagtacagcaagagggacctggtgggccatggagcctttgctgtggtgttccggggccgccaccggcagaagacagactgggaggtggccatcaagagcatcaacaagaagaacctgagcaagagccagatcctgctgggcaaggagatcaagatcctgaaggagctgcagcacgagaacatcgtggccctgtatgatgtgcaggagctgcccaacagcgtcttcctggtgatggagtactgcaatggaggagacctggccgactacctgcaggccaagggcaccctgtctgaggacaccatccgggtcttcctgcaccagattgctgctgccatgaggatcctgcacagcaagggcatcatccaccgggacctgaagccccagaacatcctgctgtcctatgccaacagaaggaagagctctgtgtctggcatccgcatcaagattgctgactttggatttgcccgctacctgcacagcaacatgatggccgccaccctgtgtggcagccccatgtacatggcccctgaggtgatcatgagccagcactatgatgccaaggctgacctgtggagcatcggcaccgtcatctaccagtgcctggtgggcaagccacccttccaggccaacagcccccaggacctgaggatgttttatgagaagaacagaagcctgatgcccagcatcccccgggagaccagcccctacctggccaacctgctgctgggcctgctgcagaggaaccagaaggacaggatggactttgaggccttcttcagccaccccttcctggagcagggccctgtgaagaagagctgccctgtgcctgtgcccatgtacagcggctctgtgtctggcagcagctgtggcagcagccccagctgccgctttgccagcccccccagcctgcctgacatgcagcacatccaggaggagaacctgagcagcccccccctgggcccccccaactacctgcaggtgtccaaggacagcgccagcaccagcagcaagaacagcagctgtgacacagatgactttgtgctggtgccccacaacatcagcagtgaccacagctgtgacatgcctgtgggcacagctggaagaagagccagcaatgagttcctggtgtgtggcggccagtgccagcccaccgtgagcccccacagcgagacagcccccatccctgtgcccacccagatccggaactaccagagaattgagcagaacctgaccagcacagccagcagcggcaccaacgtgcacggcagccccaggtctgctgtggtgagaagaagcaacaccagccccatgggcttcctgcggcccggcagctgcagccctgtgcctgctgacacagcccagacagtgggccgccgcctgagcacaggcagcagccggccctacagccccagccccctggtgggcaccatccctgagcagttcagccagtgctgctgcggccacccccagggccatgacagccgcagcaggaacagcagcggcagccctgtgccccaggcccagagcccccagagcctgctgagcggggcccggctgcagagcgcccccaccctgacagacatctaccagaacaagcagaagctgaggaagcagcacagcgaccctgtgtgccccagccacactggagctggctacagctacagcccccagcccagccggcccggcagcctgggcaccagccccaccaagcacctgggcagcagccccaggagcagtgactggttcttcaagacccccctgcccaccatcatcggcagccccaccaagaccacagcccccttcaagatccccaagacccaggccagcagcaacctgctggccctggtgaccaggcatggccctgctgaggagcagagcaaggatggaaatgagcccagagaatgtgcccactgcctgctggtgcagggcagcgagcggcagagagctgagcagcagagcaaggctgtgtttggccgctctgtgtccacaggcaagctgagtgaccagcagggcaagacccccatctgccgccaccagggcagcacagacagcctgaacacagagcggcccatggacatcgccccagctggggcctgtggcggcgtgctggcccccccagctggaacagctgccagcagcaaggctgtgctcttcaccgtgggcagccccccccacagcgctgctgcccccacctgcacccacatgttcctgcggaccaggaccacctctgtgggccccagcaacagcggcggcagcctgtgtgccatgagcggccgggtgtgtgtgggcagccccccaggccctggcttcggcagcagccccccaggagctgaggccgcccccagcctgcgctacgtgccctatggagccagcccccccagcctggagggcctcatcacctttgaggcccctgagctgcctgaggagaccctgatggagcgggagcacacagacaccctgcggcacctgaatgtgatgctgatgttcacagaatgtgtgctggacctgacagccatgaggggcggcaaccctgagctgtgcaccagcgctgtgtccctgtaccagatccaggagagcgtggtggtggaccagatcagccagctgagcaaggactggggccgggtggagcagctggtgctgtacatgaaggccgcccagctgctggccgccagcctgcacctggccaaggcccagatcaagagcggcaagctgagccccagcacagctgtgaagcaggtggtgaagaacctgaatgaaagatacaagttctgcatcaccatgtgcaagaagctgacagagaagctgaaccgcttcttcagtgacaagcagcgcttcattgatgagatcaacagcgtgacagctgagaagctgatctacaactgtgctgtggagatggtgcagagcgctgccctggatgagatgttccagcagacagaggacatcgtgtaccgctaccacaaggccgccctgctgctggagggcctgagccgcatcctgcaggaccctgctgacattgaaaatgtgcacaagtacaagtgcagcattgaaagaaggctgagcgccctgtgccacagcacagccaccgtgtag

SEQ ID NO: 39838 - DNA, 3111 bp, Artificial Sequence; identical to SEQ ID NO: 39837
  Description of Artificial Sequence: Synthetic coding sequence

SEQ ID NO: 39839 - DNA, 2532 bp, Artificial Sequence
  Description of Artificial Sequence: Synthetic coding sequence
atgaggctgcctgacctgcggccctggaccagcctgctgctggtggatgctgccctgctgtggctgctgcagggccccctgggcaccctgctgccccagggcctgcccggcctgtggctggagggcaccctgcggctgggcggcctgtggggcctgctgaagctgcggggcctgctgggctttgtgggcaccctgctgctgcccctgtgcctggccacccccctgactgtgtccctgcgggccctggtggccggggccagccgggcccccccagcccgggtggccagcgccccctggagctggctgctggtgggctacggggctgctggcctgtcctggagcctgtgggccgtgctgagccccccaggggcccaggagaaggagcaggaccaggtgaacaacaaggtgctgatgtggaggctgctgaagctgagcaggccagacctgcccctgctggtggccgccttcttcttcctggtgctggccgtgctgggggagaccctcatcccccactacagcggccgggtgattgacatcctgggcggggactttgacccccacgcctttgccagcgccatcttcttcatgtgcctcttctcctttggcagcagcctgtctgctggctgccggggcggctgcttcacctacaccatgagccgcatcaacctgcgcatccgggagcagctgttcagcagcctgctgcggcaggacctgggcttcttccaggagaccaagacaggagagctgaacagccggctgagcagtgacaccaccctgatgagcaactggctgcccctgaatgccaacgtgctgctgcggagcctggtgaaggtggtgggcctgtatggcttcatgctgagcatcagcccccggctgaccctgctgagcctgctgcacatgcccttcaccatcgctgctgagaaggtgtacaacaccaggcaccaggaggtgctgcgggagatccaggatgctgtggcccgggccggccaggtggtgcgggaggccgtgggcggcctgcagacagtgcgcagctttggagctgaggagcacgaggtgtgccgctacaaggaggccctggagcagtgccggcagctgtactggaggcgggacctggagcgggccctgtacctgctggtgcggcgggtgctgcacctgggcgtgcagatgctgatgctgagctgtggcctgcagcagatgcaggatggagagctgacccagggcagcctgctgtccttcatgatctaccaggagagcgtgggcagctatgtgcagaccctggtgtacatctacggggacatgctgagcaatgtgggcgctgctgagaaggtgttctcctacatggaccggcagcccaacctgcccagccctggcaccctggcccccaccaccctgcagggcgtggtgaagttccaggatgtgtcctttgcctaccccaacagaccagacaggcctgtgctgaagggcctgaccttcaccctgcggcctggagaggtgacagccctggtgggccccaatggaagtggcaagagcacagtggccgccctgctgcagaacctgtaccagcccactggaggccaggtgctgctggatgagaagcccatcagccagtatgagcactgctacctgcacagccaggtggtgtctgtgggccaggagcctgtgctcttcagcggctctgtgaggaacaacatcgcctacggcctgcagagctgtgaagatgacaaggtgatggctgctgcccaggccgcccatgctgatgacttcatccaggagatggagcacggcatctacacagatgtgggggagaagggcagccagctggccgccggccagaagcagaggctggccatcgcccgggccctggtgcgggacccccgggtgctgatcctggatgaggccaccagcgccctggatgtgcagtgtgagcaggccaacggcttctgggtgggccccctgggcggcggcagcgccagcgagagtgaccccaccggcttcctgcatgacagccgccaccggctgagcagtgatgtgggcatgtttgtggccctgaccaagctgggccagccagatgctgagcagtggaacagccggctggacctgctggagaggagccggcaggccgtggatggagtgtgccgccacaactaccgcctgggcgcccccttcaccgtgggcaggaaggtgcagcctgaggtgacagtgtacccagagaggacccccctgctgcaccagcacaacctgctgcactgcagcgtgacaggcttctacccaggggacatcaagatcaagtggttcctgaatggccaggaggagagagctggggtgatgagcacaggccccatcagaaatggagactggaccttccagacagtggtgatgctggagatgaccccagagctgggccacgtgtacacctgcctggtggaccacagcagcctgctgagccctgtgtctgtggagtggagggcccagagcgagtacagctggaggaagatgctgagcggcattgctgccttcctgctgggcctgtag

SEQ ID NO: 39840 - DNA, 2247 bp, Artificial Sequence
  Description of Artificial Sequence: Synthetic coding sequence
atggaccagcaccagcacctgaacaagacagctgagagcgccagcagcgagaagaagaagacccggcgctgcaatggcttcaagatgttcctggccgccctgtccttctcctacatcgccaaggccctgggcggcatcatcatgaagatcagcatcacccagattgaaagaagatttgacatcagcagcagcctggccggcctgattgatggcagctttgaaattggcaacctgctggtgattgtgtttgtgtcctacttcggcagcaagctgcaccggcccaagctgattggaattggctgcctgctgatgggcaccggcagcatcctgaccagcctgccccacttcttcatgggctactaccgctacagcaaggagacccacatcaaccccagcgagaacagcaccagcagcctgagcacctgcctgatcaaccagaccctgtccttcaacggcaccagccctgagatcgtggagaaggactgtgtgaaggagagcggcagccacatgtggatctacgtgttcatgggcaacatgctgcggggcattggagagacccccatcgtgcccctgggcatctcctacattgatgactttgccaaggagggccacagcagcctgtacctgggcagcctgaatgccatcggcatgattggccctgtgattggatttgccctgggcagcctgtttgccaagatgtatgtggacatcggctacgtggacctgagcaccatccgcatcacccccaaggacagccgctgggtgggcgcctggtggctgggcttcctggtgtctggcctcttcagcatcatcagcagcatccccttcttcttcctgcccaagaaccccaacaagccccagaaggagaggaagatcagcctgagcctgcacgtgctgaagaccaatgatgacaggaaccagacagccaacctgaccaaccagggcaagaatgtgaccaagaatgtgacaggcttcttccagagcctgaagagcatcctgaccaaccccctgtatgtgatcttcctgctgctgaccctgctgcaggtgtcctccttcatcggcagcttcacctacgtgttcaagtacatggagcagcagtatggccagagcgccagccacgccaacttcctgctgggcatcatcaccatccccaccgtggccaccggcatgttcctgggcggcttcatcatcaagaagttcaagctgagcctggtgggcatcgccaagttctccttcctgacctccatgatctccttcctgttccagctgctgtacttccccctcatctgtgagagcaagtctgtggccggcctgaccctgacctatgatggcaacaacagcgtggccagccacgtggatgtgcccctgagctactgcaacagcgagtgcaactgtgatgagagccagtgggagcctgtgtgtggcaacaacggcatcacctacctgagcccctgcctggccggctgcaagagcagcagcggcatcaagaagcacacagtgttctacaactgcagctgtgtggaggtgacaggcctgcagaacagaaactacagcgcccacctgggagaatgtccccgggacaacacctgcaccaggaagttcttcatctacgtggccatccaggtgatcaacagcctcttcagcgccaccggcggcaccaccttcatcctgctgactgtgaagatcgtgcagcctgagctgaaggccctggccatgggcttccagagcatggtgatccgcaccctgggcggcatcctggcccccatctactttggagccctgattgacaagacctgcatgaagtggagcaccaacagctgtggggcccagggcgcctgccgcatctacaacagcgtcttctttggaattgtgcagcctgagctgaaggccctggccatcggcttccacagcatgatcatgaggagcctgggcggcatcctggtgcccatctactttggagccctgattgacaccacctgcatgaagtggagcaccaacagctgtggggcccggggggcctgccgcatctacaacagcacctacctgggccgggccttcttcggcctgaaggtggccctgatcttccctgtgctggtgctgctgaccgtcttcatctttgtggtgaggaagaagagccacggcaaggacaccaaggtgctggagaatgaaaggcaggtgatggatgaggccaacctggagttcctgaatgacagcgagcactttgtgcccagcgctgaggagcagtag

SEQ ID NO: 39841 - DNA, 582 bp, Artificial Sequence
  Description of Artificial Sequence: Synthetic coding sequence
atgagcccctgtggaggagaagatattgtggccgaccacgtggccagctatggagtgaacctgtaccagagctatggccccagcggccagtacacccatgaatttgatggagatgagcagttctacgtggacctgggcaggaaggagaccgtgtggtgcctgcctgtgctgcggcagttccgctttgacccccagtttgccctgaccaacattgctgtgctgaagcacaacctgaacagcctcatcaagaggagcaacagcacagctgccaccaatgaggtgcctgaggtgaccgtcttcagcaagagccctgtgaccctgggccagcccaacatcctgatctgcctggtggacaacatcttcccccctgtggtgaacatcacctggctgagcaatggccacagcgtgacagaaggagtgtctgagaccagcttcctgagcaagagtgaccacagcttcttcaagatctcctacctgaccctgctgcccagcgctgaggagagctatgactgcaaggtggagcactggggcctggacaagcccctgctgaagcactgggtgcacggcttcctgtccttctag

SEQ ID NO: 39842 - DNA, 762 bp, Artificial Sequence
  Description of Artificial Sequence: Synthetic coding sequence
ggctgcctgggcaagaggatgatcctgaacaaggccctgatgctgggcgccctggccctgaccaccgtgatgagcccctgtggcggggaggacatcgtggccgaccacgtggccagctatggagtgaacctgtaccagagctatggccccagcggccagtacacccatgaatttgatggagatgagcagttctacgtggacctgggcaggaaggagaccgtgtggtgcctgcctgtgctgcggcagttccgctttgacccccagtttgccctgaccaacattgctgtgctgaagcacaacctgaacagcctcatcaagaggagcaacagcacagctgccaccaatgaggtgcctgaggtgacagtgttcagcaagagccctgtgaccctgggccagcccaacatcctgatctgcctggtggacaacatcttcccccctgtggtgaacatcacctggctgagcaatggccacagcgtgacagagggcgtgtctgagaccagcttcctgagcaagagtgaccacagcttcttcaagatctcctacctgaccctgctgcccagcgctgaggagagctatgactgcaaggtggagcactggggcctggacaagcccctgctgaagcactggggcaaggatgagttccaccacttcctgatgctgagctgcctgagcagcagcgagctgcctgccttctacagctacatccccaagctggtgttccacacctcctgggtgtccttcttcctgatcttcttcttctag

SEQ ID NO: 39843 - DNA, 441 bp, Artificial Sequence
  Description of Artificial Sequence: Synthetic coding sequence
atgatcctgaacaaggccctgatgctgggcgccctggccctgaccaccgtgatgagcccctgtggcggggaggacatcgtggccgaccacgtggccagctatggagtgaacctgtaccagagctatggccccagcggccagtacacccatgaatttgatggagatgagcagttctacgtggacctgggcaggaaggagaccgtgtggtgcctgcctgtgctgcggcagttccgctttgacccccagtttgccctgaccaacatgtgcatcgccatctaccgcagccggcgggtggacctgctgcatgacctggccctcttcagcggccccatctaccacatccccttcctgctgcagatgttcctgctgagccccctgctgtgggacctgaactgctacatctgcagcgagctgaccaatgcctttgagctgttcccctag

SEQ ID NO: 39844 - DNA, 765 bp, Artificial Sequence
  Description of Artificial Sequence: Synthetic coding sequence
atgatcctgaacaaggccctgatgctgggcgccctggccctgaccaccgtgatgagcccctgtggcggggaggacatcgtggccgaccacgtggccagctatggagtgaacctgtaccagagctatggccccagcggccagtacacccatgaatttgatggagatgagcagttctacgtggacctgggcaggaaggagaccgtgtggtgcctgcctgtgctgcggcagttccgctttgacccccagtttgccctgaccaacattgctgtgctgaagcacaacctgaacagcctcatcaagaggagcaacagcacagctgccaccaatgaggtgcctgaggtgacagtgttcagcaagagccctgtgaccctgggccagcccaacatcctgatctgcctggtggacaacatcttcccccctgtggtgaacatcacctggctgagcaatggccacagcgtgacagagggcgtgtctgagaccagcttcctgagcaagagtgaccacagcttcttcaagatctcctacctgaccctgctgcccagcgctgaggagagctatgactgcaaggtggagcactggggcctggacaagcccctgctgaagcactgggagcctgagatcccagcccccatgtctgagctgacagaaacagtggtgtgtgccctgggcctgtctgtgggcctggtgggcatcgtggtgggcaccgtcttcatcatccggggcctgcggtctgtgggcgccagccgccaccagggccccctgtag

SEQ ID NO: 39845 - DNA, 498 bp, Artificial Sequence
  Description of Artificial Sequence: Synthetic coding sequence
atgacccggctgtgcctgcccaggcctgaggcccgggaggaccccatccctgtgcccccccggggcctgggcgctggggagggcagcggcagccctgtgcggccccctgtgtccacctggggccccagctgggcccagctgctggacagcgtgctgtggctgggcgccctgggcctgaccatccaggccgtgttcagcaccaccggccctgccctgctgctgctgctggtgtccttcctgacctttgacctgctgcacaggcctgctggccacaccctgccccagaggaagctgctgacccggggccagagccagggcgctggggagggccctggccagcaggaggccctgctgctgcagatgggcaccgtgtctggccagctgagcctgcaggatgccctgctgctgctgctgatgggcctgggccccctgctgcgggcctgtggcatgcccctgaccctgctgggcctggccttctgcctgcacccctgggcctag

SEQ ID NO: 39846 - DNA, 513 bp, Artificial Sequence
  Description of Artificial Sequence: Synthetic coding sequence
atggtgacagtgctggaccagatgaaggccggcacctacaagctgacctttgacacagagggctactggaggaagaggggccaggagagcttctacccccacgtggaggtggtgctgaccatcaccagcaaggcccagaagttccacgtgcccctggtgctgcaccacctgccccgggagctggagcggcggctggccgccggcggctgcctgcctgtgcctgcccgctggctgcacccccccagcccccagcagagcggcctgtgtgcccaccagggcgccctggcccaccacttcctgggcaagagcaggcctcctggagagagccactgggccgctgtgacccaggtgtccatgaagctggtgcctgccccagccaagctgagcatccgctgggacaacagcggggccaagacaggcagcacagcccggcactgccccaacccccaggtgtctgctggccacagcgagaaggtgccccccaccgtggtgggcggggagacccgggagtag

SEQ ID NO: 39847 - DNA, 780 bp, Artificial Sequence
  Description of Artificial Sequence: Synthetic coding sequence
atggccgccagccggctggagctgaacctggtgcggctgctgagccgctgtgaggccatggctgctgagaagagggaccctgatgagtggaggctggagaagtatgtgggcgccctggaggacatgctgcaggccctgaaggtgcacgccagcaagccagccagcgaggtgatcaatgagtacagctggaaggtggacttcctgaagggcatgctgcaggccgagaagctgaccagcagcagcgagaaggccctggccaaccagttcctggcccctggccgggtgcccaccacagcccgggagcgggtgcctgccaccaagacagtgcacctgcagagccgggcccgctacaccagcgagatgaggtctgagctgctgggcacagacagcgctgagcctgagatggatgtgaggaagaggactggagtggccggcagccagcctgtgtctgagaagcagctggccgctgagctggacctggtgctgcagaggcaccagaacctgcaggagaagctggccgaggagatgctgggcctggcccggagcctgaagaccaacaccctggccgcccagagcgtcatcaagaaggacaaccagaccctgagccacagcctgaagatggctgaccagaacctggagaagctgaagacagaaagtgagcggctggagcagcacacccagaagtctgtgaactggctgctgtgggccatgctgatcatcgtgtgcttcatcttcatctccatgatcctcttcatccgcatcatgcccaagctgaagtag

SEQ ID NO: 39848 - DNA, 177 bp, Artificial Sequence
  Description of Artificial Sequence: Synthetic coding sequence
atggccggccctgagagtgatgcccagtaccagttcaccggcatcaagaagtacttcaacagctacaccctgactggaaggatgaactgtgtgctggccacctacggcagcatcgccctgattgtgctgtacttcaagctgcggagcaagaagaccccagctgtgaaggccacctag

SEQ ID NO: 39849 - DNA, 177 bp, Artificial Sequence; identical to SEQ ID NO: 39848
  Description of Artificial Sequence: Synthetic coding sequence

SEQ ID NO: 39850 - DNA, 177 bp, Artificial Sequence; identical to SEQ ID NO: 39848
  Description of Artificial Sequence: Synthetic coding sequence

SEQ ID NO: 39851 - DNA, 177 bp, Artificial Sequence; identical to SEQ ID NO: 39848
  Description of Artificial Sequence: Synthetic coding sequence

SEQ ID NO: 39852 - DNA, 177 bp, Artificial Sequence; identical to SEQ ID NO: 39848
  Description of Artificial Sequence: Synthetic coding sequence

SEQ ID NO: 39853 - DNA, 792 bp, Artificial Sequence; identical to SEQ ID NO: 36911
  Description of Artificial Sequence: Synthetic coding sequence

SEQ ID NO: 39854 - DNA, 1170 bp, Artificial Sequence
  Description of Artificial Sequence: Synthetic coding sequence
atggccctgaccccagagagccccagcagcttccctggcctggccgccaccggcagctctgtgcctgagcccccaggcggccccaatgccaccctgaacagctcctgggccagccccacagagcccagcagcctggaggacctggtggccaccggcaccatcggcaccctgctgagcgccatgggcgtggtgggcgtggtgggcaatgcctacaccctggtggtgacctgccgcagcctgcgggctgtggcctccatgtatgtgtatgtggtgaacctggccctggccgacctgctgtacctgctgagcatccccttcatcgtggccacctacgtgaccaaggagtggcactttggagatgtgggctgccgggtgctgtttggcctggacttcctgaccatgcacgccagcatcttcaccctgactgtgatgagcagcgagagatatgctgctgtgctgcggcccctggacacagtgcagaggcccaagggctacaggaagctgctggccctgggcacctggctgctggccctgctgctgaccctgcctgtgatgctggccatgaggctggtgcggcggggccccaagagcctgtgcctgcctgcctggggcccccgggcccaccgggcctacctgaccctgctgtttgccaccagcattgctggccctggcctgctgattggcctgctgtatgcccggctggcccgggcctacagaagaagccagagggccagcttcaagagggcccggcggcctggggcccgggccctgcggctggtgctgggcatcgtgctgctcttctgggcctgcttcctgcccttctggctgtggcagctgctggcccagtaccaccaggcccccctggcccccaggacagccagaattgtgaactacctgaccacctgcctgacctacggcaacagctgtgccaaccccttcctgtacaccctgctgaccaggaactacagagaccacctgcggggccgggtgcggggccctggcagcggcggcggccggggccctgtgcccagcctgcagccccgggcccgcttccagcgctgcagcggccgcagcctgagcagctgcagcccccagcccacagacagcctggtgctggccccagctgccccagcccggcctgcccctgagggcccccgggccccagcctag

SEQ ID NO: 39855 - DNA, 1578 bp, Artificial Sequence
  Description of Artificial Sequence: Synthetic coding sequence
atgatgccctggctgtggacagccccccaccagaaggagagccagaaggcagatgagtacctgcgggagatccaggagctgggccagctgacccaggccgtgcagcagtgcatcgaggccgccggccacgagcaccagcctgacatgcagaagagcctgctgcgggtgggcctggatggccgggccggggagggcggggccggccggggctgggatggccagcagggcagcagcctgctgagccccagcggcagcagccaggccgccagctttgggaagtgcttcctggaccgcttccccccagacagctttgtgcacatgtgccaggacctgcgggtgctgaatgctgtgcgggactaccacatcggcatccccctgacctacagccagtacaagcagctgaccatccaggtgctgctggaccggctggtgctgcggcggctgtaccccctggccatccagatctgtgagtacctgcggctgcctgaggtgcagggcgtgagccgcatcctggcccactgggcctgctacaaggtgcagcagaaggatgtgtctgatgaagatgtggcccgggccatcaaccagaagctgggggacaccccaggagtgtcctacagcgacattgctgcccgggcctacggctgcggccgcacagagctggccatcaagctgctggagtatgagcccaggtctggagagcaggtgcccctgctgctgaagatgaagaggagcaagctggccctgagcaaggccatcgagagcggggacacagacctggtgttcaccgtgctgctgcacctgaagaatgagctgaacagaggagacttcttcatgaccctgaggaaccagcccatggccctgagcctgtaccggcagttctgcaagcaccaggagctggagaccctgaaggacctgtacaaccaggatgacaaccaccaggagctgggcagcttccacatccgggccagctatgctgctgaggagcgcatcgagggccgggtggccgccctgcagacagctgctgatgccttctacaaggccaagaatgaatttgctgccaaggccacagaggaccagatgaggctgctgcggctgcagaggcggctggaggatgagctgggcggccagttcctggacctgagcctgcatgacacagtgaccaccctcatcctgggcggccacaacaagagagctgagcagctggcccgggacttccgcatcccagacaagaggctgtggtggctgaagctgacagccctggccgacctggaggactgggaggagctggagaagttcagcaagagcaagaagagccccatcggctacctgccctttgtggagatctgcatgaagcagcacaacaagtatgaggccaagaagtatgccagccgggtgggccctgagcagaaggtgaaggccctgctgctggtgggagatgtggcccaggccgcagatgtggccatcgagcacagaaatgaggccgagctgagcctggtgctgagccactgcaccggggccacagatggagccacagctgacaagatccagagggcccgggcccaggcccagaagaagtag

SEQ ID NO: 39856 - DNA, 2520 bp, Artificial Sequence
  Description of Artificial Sequence: Synthetic coding sequence
atggactgctacacagccaactggaaccccctgggggacagcgccttctacagaaaatatgagctgtacagcatggactgggacctgaaggaggagctgcgggactgcctggtggccgccgccccctatggaggccccatcgccctgctgaggaacccctggaggaaggagaaggccgcctctgtgcggcctgtgctggacatctacagcgccagcggcatgcccctggccagcctgctgtggaagagcggccctgtggtgtccctgggctggagcgctgaggaggagctgctgtgtgtgcaggaggatggagctgtgctggtgtatggcctgcacggggacttccgccgccacttctccatgggaaatgaggtgctgcagaacagagtgctggatgcccgcatcttccacacagaatttggcagcggcgtggccatcctgaccggggcccaccgcttcaccctgagcgccaacgtgggggacctgaagctgcggaggatgcctgaggtgcccggcctgcagagcgcccccagctgctggacagtgctgtgccaggacagagtggcccacatcctgctggccgtgggccctgacctgtacctgctggaccatgctgcctgcagcgctgtgaccccacctggcctggcccctggggtgtcctccttcctgcagatggctgtgtccttcacctaccgccacctggccctcttcacagacaccggctacatctggatgggcacagccagcctgaaggagaagctgtgtgagttcaactgcaacatccgggccccacccaagcagatggtgtggtgcagccggcccaggagcaaggagagagctgtggtggtggcctgggagcggcggctgatggtggtgggagatgcccctgagagcatccagtttgtgctggatgaagattcctacctggtgcctgagctggatggagtgcgcatcttcagccgcagcacccatgagttcctgcacgaggtgcctgctgccagcgaggagatcttcaagatcgcctccatggcccctggggccctgctgctggaggcccagaaggagtatgagaaggagagccagaaggcagatgagtacctgcgggagatccaggagctgggccagctgacccaggccgtgcagcagtgcatcgaggccgccggccacgagcaccagcctgacatgcagaagagcctgctgcgggccgccagctttgggaagtgcttcctggaccgcttccccccagacagctttgtgcacatgtgccaggacctgcgggtgctgaatgctgtgcgggactaccacatcggcatccccctgacctacagccagtacaagcagctgaccatccaggtgctgctggaccggctggtgctgcggcggctgtaccccctggccatccagatctgtgagtacctgcggctgcctgaggtgcagggcgtgagccgcatcctggcccactgggcctgctacaaggtgcagcagaaggatgtgtctgatgaagatgtggcccgggccatcaaccagaagctgggggacaccccaggagtgtcctacagcgacattgctgcccgggcctacggctgcggccgcacagagctggccatcaagctgctggagtatgagcccaggtctggagagcaggtgcccctgctgctgaagatgaagaggagcaagctggccctgagcaaggccatcgagagcggggacacagacctggtgttcaccgtgctgctgcacctgaagaatgagctgaacagaggagacttcttcatgaccctgaggaaccagcccatggccctgagcctgtaccggcagttctgcaagcaccaggagctggagaccctgaaggacctgtacaaccaggatgacaaccaccaggagctgggcagcttccacatccgggccagctatgctgctgaggagcgcatcgagggccgggtggccgccctgcagacagctgctgatgccttctacaaggccaagaatgaatttgctgccaaggccacagaggaccagatgaggctgctgcggctgcagaggcggctggaggatgagctgggcggccagttcctggacctgagcctgcatgacacagtgaccaccctcatcctgggcggccacaacaagagagctgagcagctggcccgggacttccgcatcccagacaagaggctgtggtggctgaagctgacagccctggccgacctggaggactgggaggagctggagaagttcagcaagagcaagaagagccccatcggctacctgccctttgtggagatctgcatgaagcagcacaacaagtatgaggccaagaagtatgccagccgggtgggccctgagcagaaggtgaaggccctgctgctggtgggagatgtggcccaggccgcagatgtggccatcgagcacagaaatgaggccgagctgagcctggtgctgagccactgcaccggggccacagatggagccacagctgacaagatccagagggcccgggcccaggcccagaagaagtag

SEQ ID NO: 39857 - DNA, 2088 bp, Artificial Sequence
  Description of Artificial Sequence: Synthetic coding sequence
atggactgctacacagccaactggaaccccctgggggacagcgccttctacagaaaatatgagctgtacagcatggactgggacctgaaggaggagctgcgggactgcctggtggccgccgccccctatggaggccccatcgccctgctgaggaacccctggaggaaggagaaggccgcctctgtgcggcctgtgctggacatctacagcgccagcggcatgcccctggccagcctgctgtggaagagcggccctgtggtgtccctgggctggagcgctgaggaggagctgctgtgtgtgcaggaggatggagctgtgctggtgtatggcctgcacggggacttccgccgccacttctccatgggaaatgaggtgctgcagaacagagtgctggatgcccgcatcttccacacagaatttggcagcggcgtggccatcctgaccggggcccaccgcttcaccctgagcgccaacgtgggggacctgaagctgcggaggatgcctgaggtgcccggcctgcagagcgcccccagctgctggacagtgctgtgccaggacagagtggcccacatcctgctggccgtgggccctgacctgtacctgctggaccatgctgcctgcagcgctgtgaccccacctggcctggcccctggggtgtcctccttcctgcagatggctgtgtccttcacctaccgccacctggccctcttcacagacaccggctacatctggatgggcacagccagcctgaaggagaagctgtgtgagttcaactgcaacatccgggccccacccaagcagatggtgtggtgcagccggcccaggagcaaggagagagctgtggtggtggcctgggagcggcggctgatggtggtgggagatgcccctgagagcatccagtacaagcagctgaccatccaggtgctgctggaccggctggtgctgcggcggctgtaccccctggccatccagatctgtgagtacctgcggctgcctgaggtgcagggcgtgagccgcatcctggcccactgggcctgctacaaggtgcagcagaaggatgtgtctgatgaagatgtggcccgggccatcaaccagaagctgggggacaccccaggagtgtcctacagcgacattgctgcccgggcctacggctgcggccgcacagagctggccatcaagctgctggagtatgagcccaggtctggagagcaggtgcccctgctgctgaagatgaagaggagcaagctggccctgagcaaggccatcgagagcggggacacagacctggtgttcaccgtgctgctgcacctgaagaatgagctgaacagaggagacttcttcatgaccctgaggaaccagcccatggccctgagcctgtaccggcagttctgcaagcaccaggagctggagaccctgaaggacctgtacaaccaggatgacaaccaccaggagctgggcagcttccacatccgggccagctatgctgctgaggagcgcatcgagggccgggtggccgccctgcagacagctgctgatgccttctacaaggccaagaatgaatttgctgccaaggccacagaggaccagatgaggctgctgcggctgcagaggcggctggaggatgagctgggcggccagttcctggacctgagcctgcatgacacagtgaccaccctcatcctgggcggccacaacaagagagctgagcagctggcccgggacttccgcatcccagacaagaggctgtggtggctgaagctgacagccctggccgacctggaggactgggaggagctggagaagttcagcaagagcaagaagagccccatcggctacctgccctttgtggagatctgcatgaagcagcacaacaagtatgaggccaagaagtatgccagccgggtgggccctgagcagaaggtgaaggccctgctgctggtgggagatgtggcccaggccgcagatgtggccatcgagcacagaaatgaggccgagctgagcctggtgctgagccactgcaccggggccacagatggagccacagctgacaagatccagagggcccgggcccaggcccagaagaagtag

SEQ ID NO: 39858 - DNA, 684 bp, Artificial Sequence
  Description of Artificial Sequence: Synthetic coding sequence
atgggcgcccccctggaggtgctgcagaacagagtgctggatgcccgcatcttccacacagaatttggcagcggcgtggccatcctgaccggggcccaccgcttcaccctgagcgccaacgtgggggacctgaagctgcggaggatgcctgaggtgcccggcctgcagagcgcccccagctgctggacagtgctgtgccaggacagagtggcccacatcctgctggccgtgggccctgacctgtacctgctggaccatgctgcctgcagcgctgtgaccccacctggcctggcccctggggtgtcctccttcctgcagatggctgtgtccttcacctaccgccacctggccctcttcacagacaccggctacatctggatgggcacagccagcctgaaggagaagctgtgtgagttcaactgcaacatccgggccccacccaagcagatggtgtggtgcagccggcccaggagcaaggagagagctgtggtggtggcctgggagcggcggctgatggtggtgggagatgcccctgagagcatccagtttgtgctggatgaagattcctacctggtgcctgagctggatggagtgcgcatcttcagccgcagcacccatgagttcctgcacgaggtgcctgctgccagcgaggagatcttcaagatcgcctccatggccccctag

SEQ ID NO: 39859 - DNA, 825 bp, Artificial Sequence
  Description of Artificial Sequence: Synthetic coding sequence
atgggcgcccccctggaggtgctgcagaacagagtgctggatgcccgcatcttccacacagaatttggcagcggcgtggccatcctgaccggggcccaccgcttcaccctgagcgccaacgtgggggacctgaagctgcggaggatgcctgaggtgcccggcctgcagagcgcccccagctgctggacagtgctgtgccaggacagagtggcccacatcctgctggccgtgggccctgacctgtacctgctggaccatgctgcctgcagcgctgtgaccccacctggcctggcccctggggtgtcctccttcctgcagatggctgtgtccttcacctaccgccacctggccctcttcacagacaccggctacatctggatgggcacagccagcctgaaggagaagctgtgtgagttcaactgcaacatccgggccccacccaagcagatggtgtggtgcagccggcccaggagcaaggagagagctgtggtggtggcctgggagcggcggctgatggtggtgggagatgcccctgagagcatccagtacaagcagctgaccatccaggtgctgctggaccggctggtgctgcggcggctgtaccccctggccatccagatctgtgagtacctgcggctgcctgaggtgcagggcgtgagccgcatcctggcccactgggcctgctacaaggtgcagcagaaggatgtgtctgatgaagatgtggcccgggccatcaaccagaagctgggggacaccccaggagtgtcctacagcgacattgctgcccgggcctacggctgcggccgcacagagctggccatctag

SEQ ID NO: 39860 - DNA, 711 bp, Artificial Sequence
  Description of Artificial Sequence: Synthetic coding sequence
atgccaccccgggagctgtctgaggccgagcccccacccctgcgggcccccaccccaccacccaggagaagaagtgcccctcctgagctgggcatcaagtgtgtgctggtgggagatggagctgtgggcaagagcagcctcatcgtgtcctacacctgcaatggctacccagcccgctaccggcccacagccctggacaccttctctgtgcaggtgctggtggatggagcccctgtgagaattgagctgtgggacacagctggccaggaggactttgaccggctgcggagcctgtgctacccagacacagatgtgttcctggcctgcttctctgtggtgcagcccagcagcttccagaacatcacagagaagtggctgcctgagatccgcacccacaacccccaggcccctgtgctgctggtgggcacccaggccgacctgagagatgatgtgaatgtgctgatccagctggaccagggcggccgggagggccctgtgccccagccccaggcccagggcctggccgagaagatccgggcctgctgctacctggagtgcagcgccctgacccagaagaacctgaaggaggtgtttgacagcgccatcctgagcgccatcgagcacaaggcccggctggagaagaagctgaatgccaagggcgtgaggaccctgagccgctgccgctggaagaagttcttctgctttgtgtag

SEQ ID NO: 39861 - DNA, 561 bp, Artificial Sequence
  Description of Artificial Sequence: Synthetic coding sequence
atggccggccaccggctggtgctggtgctgggggacctgcacatcccccaccgctgcaacagcctgcctgccaagttcaagaagctgctggtgcctgggaagatccagcacatcctgtgcaccggcaacctgtgcaccaaggagagctatgactacctgaagaccctggccggagatgtgcacatcgtgcggggggactttgatgagaacctgaactacccagagcagaaggtggtgacagtgggccagttcaagattggcctcatccacggccaccaggtgatcccctggggagacatggccagcctggccctgctgcagaggcagtttgatgtggacatcctgatcagcggccacacccacaagtttgaggcctttgaacatgagaacaagttctacatcaaccctggcagcgccaccggggcctacaatgccctggagaccaacatcatccccagctttgtgctgatggacatccaggccagcacagtggtgacctacgtgtaccagctgattggagatgatgtgaaggtggagagaattgagtacaagaagccctag

SEQ ID NO: 39862 - DNA, 264 bp, Artificial Sequence
  Description of Artificial Sequence: Synthetic coding sequence
atggccagcctggccctgctgcagaggcagtttgatgtggacatcctgatcagcggccacacccacaagtttgaggcctttgaacatgagaacaagttctacatcaaccctggcagcgccactggagcctacaatgccctggagaccaacatcatccccagctttgtgctgatggacatccaggccagcacagtggtgacctacgtgtaccagctgattggagatgatgtgaaggtggagcgcatcgagtacaagaagccctag

SEQ ID NO: 39863 - DNA, 549 bp, Artificial Sequence
  Description of Artificial Sequence: Synthetic coding sequence
atgctggtgctggtgctgggggacctgcacatcccccaccgctgcaacagcctgcctgccaagttcaagaagctgctggtgcctgggaagatccagcacatcctgtgcaccggcaacctgtgcaccaaggagagctatgactacctgaagaccctggccggagatgtgcacatcgtgcggggggactttgatgagaacctgaactacccagagcagaaggtggtgacagtgggccagttcaagattggcctcatccacggccaccaggtgatcccctggggagacatggccagcctggccctgctgcagaggcagtttgatgtggacatcctgatcagcggccacacccacaagtttgaggcctttgaacatgagaacaagttctacatcaaccctggcagcgccaccggggcctacaatgccctggagaccaacatcatccccagctttgtgctgatggacatccaggccagcacagtggtgacctacgtgtaccagctgattggagatgatgtgaaggtggagagaattgagtacaagaagccctag

SEQ ID NO: 39864 - DNA, 2172 bp, Artificial Sequence
  Description of Artificial Sequence: Synthetic coding sequence
atggctgctgctgccaccatggctgctgctgcccgggagctggtgctgcgggccggcaccagtgacatggaggaggaggagggccccctggccggcggccctggcctgcaggagcccctgcagctgggggagctggacatcaccagtgatgagttcatcctggatgaggtggatgtgcacatccaggccaacctggaggatgagctggtgaaggaggccctgaagacaggagtggacctgcggcactacagcaagcaggtggagctggagctgcagcagatcgagcagaagagcatccgggactacatccaggagagtgaaaatattgccagcctgcacaaccagatcacagcctgtgatgctgtgctggagaggatggagcagatgctgggcgccttccagagcgacctgagcagcatcagcagcgagatccgcaccctgcaggagcagagcggggccatgaacatccggctgaggaaccggcaggccgtgcggggcaagctgggggagctggtggatggcctggtggtgcccagcgccctggtgacagccatcctggaggcccctgtgacagagccccgcttcctggagcagctgcaggagctggatgccaaggctgctgctgtgcgggagcaggaggcccggggcacagctgcctgtgctgatgtgcggggcgtgctggaccggctgcgggtgaaggctgtgaccaagatccgggagttcatcctgcagaagatctacagcttcaggaagcccatgaccaactaccagatcccccagacagccctgctgaagtaccgcttcttctaccagttcctgctgggcaatgaaagagccacagccaaggagatcagagatgaatatgtggagaccctgagcaagatctacctgagctactaccgcagctacctgggccgcctgatgaaggtgcagtatgaggaggtggccgagaaggatgacctgatgggcgtggaggacacagccaagaagggcttcttcagcaagcccagcctgcggagcaggaacaccatcttcaccctgggcacccggggcagcgtcatcagccccacagagctggaggcccccatcctggtgccccacacagcccagagaggagagcagcgctacccctttgaggccctcttccgcagccagcactacgccctgctggacaacagctgccgggagtacctgttcatctgtgagttctttgtggtgtctggccctgctgcccatgacctcttccacgctgtgatgggccgcaccctgtccatgaccctgaagcacctggacagctacctggccgactgctatgatgccatcgctgtgttcctgtgcatccacatcgtgctgcgcttcaggaacattgctgccaagagagatgtgcctgccctggaccgctactgggagcaggtgctggccctgctgtggcccaggtttgagctgatcctggagatgaatgtgcagagcgtgcgcagcacagacccccagaggctgggcggcctggacacccggccccactacatcaccaggagatatgcagagttcagcagcgccctggtgtccatcaaccagaccatccccaatgaaagaaccatgcagctgctgggccagctgcaggtggaggtggagaactttgtgctgcgggtggccgctgagttcagcagcaggaaggagcagctggtgttcctgatcaacaactatgacatgatgctgggcgtgctgatggagagagctgctgatgacagcaaggaggtggagagcttccagcagctgctgaatgcccggacccaggagttcatcgaggagctgctgagccccccatttggaggcctggtggcctttgtgaaggaggccgaggccctgattgagcggggccaggccgagcggctgcggggggaggaggcccgggtgacccagctgatccggggcttcggcagctcctggaagagctctgtggagagcctgagccaggatgtgatgaggagcttcaccaacttcagaaatggcaccagcatcatccagggcgccctgacccagctgatccagctgtaccaccgcttccaccgggtgctgagccagccccagctgcgggccctgcctgcccgggcagagctgatcaacatccaccacctgatggtggagctgaagaagcacaagcccaacttctag

SEQ ID NO: 39865 - DNA, 2106 bp, Artificial Sequence
  Description of Artificial Sequence: Synthetic coding sequence
atggaggaggaggagggccccctggccggcggccctggcctgcaggagcccctgcagctgggggagctggacatcaccagtgatgagttcatcctggatgaggtggatgtgcacatccaggccaacctggaggatgagctggtgaaggaggccctgaagacaggagtggacctgcggcactacagcaagcaggtggagctggagctgcagcagatcgagcagaagagcatccgggactacatccaggagagtgaaaatattgccagcctgcacaaccagatcacagcctgtgatgctgtgctggagaggatggagcagatgctgggcgccttccagagcgacctgagcagcatcagcagcgagatccgcaccctgcaggagcagagcggggccatgaacatccggctgaggaaccggcaggccgtgcggggcaagctgggggagctggtggatggcctggtggtgcccagcgccctggtgacagccatcctggaggcccctgtgacagagccccgcttcctggagcagctgcaggagctggatgccaaggctgctgctgtgcgggagcaggaggcccggggcacagctgcctgtgctgatgtgcggggcgtgctggaccggctgcgggtgaaggctgtgaccaagatccgggagttcatcctgcagaagatctacagcttcaggaagcccatgaccaactaccagatcccccagacagccctgctgaagtaccgcttcttctaccagttcctgctgggcaatgaaagagccacagccaaggagatcagagatgaatatgtggagaccctgagcaagatctacctgagctactaccgcagctacctgggccgcctgatgaaggtgcagtatgaggaggtggccgagaaggatgacctgatgggcgtggaggacacagccaagaagggcttcttcagcaagcccagcctgcggagcaggaacaccatcttcaccctgggcacccggggcagcgtcatcagccccacagagctggaggcccccatcctggtgccccacacagcccagagaggagagcagcgctacccctttgaggccctcttccgcagccagcactacgccctgctggacaacagctgccgggagtacctgttcatctgtgagttctttgtggtgtctggccctgctgcccatgacctcttccacgctgtgatgggccgcaccctgtccatgaccctgaagcacctggacagctacctggccgactgctatgatgccatcgctgtgttcctgtgcatccacatcgtgctgcgcttcaggaacattgctgccaagagagatgtgcctgccctggaccgctactgggagcaggtgctggccctgctgtggcccaggtttgagctgatcctggagatgaatgtgcagagcgtgcgcagcacagacccccagaggctgggcggcctggacacccggccccactacatcaccaggagatatgcagagttcagcagcgccctggtgtccatcaaccagaccatccccaatgaaagaaccatgcagctgctgggccagctgcaggtggaggtggagaactttgtgctgcgggtggccgctgagttcagcagcaggaaggagcagctggtgttcctgatcaacaactatgacatgatgctgggcgtgctgatggagagagctgctgatgacagcaaggaggtggagagcttccagcagctgctgaatgcccggacccaggagttcatcgaggagctgctgagccccccatttggaggcctggtggcctttgtgaaggaggccgaggccctgattgagcggggccaggccgagcggctgcggggggaggaggcccgggtgacccagctgatccggggcttcggcagctcctggaagagctctgtggagagcctgagccaggatgtgatgaggagcttcaccaacttcagaaatggcaccagcatcatccagggcgccctgacccagctgatccagctgtaccaccgcttccaccgggtgctgagccagccccagctgcgggccctgcctgcccgggcagagctgatcaacatccaccacctgatggtggagctgaagaagcacaagcccaacttctag

SEQ ID NO: 39866 - DNA, 2172 bp, Artificial Sequence; identical to SEQ ID NO: 39864
  Description of Artificial Sequence: Synthetic coding sequence

SEQ ID NO: 39867 - DNA, 1797 bp, Artificial Sequence
  Description of Artificial Sequence: Synthetic coding sequence
atggagcagatgctgggcgccttccagagcgacctgagcagcatcagcagcgagatccgcaccctgcaggagcagagcggggccatgaacatccggctgaggaaccggcaggccgtgcggggcaagctgggggagctggtggatggcctggtggtgcccagcgccctggtgacagccatcctggaggcccctgtgacagagccccgcttcctggagcagctgcaggagctggatgccaaggctgctgctgtgcgggagcaggaggcccggggcacagctgcctgtgctgatgtgcggggcgtgctggaccggctgcgggtgaaggctgtgaccaagatccgggagttcatcctgcagaagatctacagcttcaggaagcccatgaccaactaccagatcccccagacagccctgctgaagtaccgcttcttctaccagttcctgctgggcaatgaaagagccacagccaaggagatcagagatgaatatgtggagaccctgagcaagatctacctgagctactaccgcagctacctgggccgcctgatgaaggtgcagtatgaggaggtggccgagaaggatgacctgatgggcgtggaggacacagccaagaagggcttcttcagcaagcccagcctgcggagcaggaacaccatcttcaccctgggcacccggggcagcgtcatcagccccacagagctggaggcccccatcctggtgccccacacagcccagagaggagagcagcgctacccctttgaggccctcttccgcagccagcactacgccctgctggacaacagctgccgggagtacctgttcatctgtgagttctttgtggtgtctggccctgctgcccatgacctcttccacgctgtgatgggccgcaccctgtccatgaccctgaagcacctggacagctacctggccgactgctatgatgccatcgctgtgttcctgtgcatccacatcgtgctgcgcttcagaaatattgctgccaagagagatgtgcctgccctggaccgctactgggagcaggtgctggccctgctgtggcccaggtttgagctgatcctggagatgaatgtgcagagcgtgcgcagcacagacccccagaggctgggcggcctggacacccggccccactacatcacccggcgctatgcagagttcagcagcgccctggtgtccatcaaccagaccatccccaatgaaagaaccatgcagctgctgggccagctgcaggtggaggtggagaactttgtgctgcgggtggccgctgagttcagcagcaggaaggagcagctggtgttcctgatcaacaactatgacatgatgctgggcgtgctgatggagagagctgctgatgacagcaaggaggtggagagcttccagcagctgctgaatgcccggacccaggagttcatcgaggagctgctgagccccccatttggaggcctggtggcctttgtgaaggaggccgaggccctgattgaaagaggccaggccgagcggctgcggggggaggaggcccgggtgacccagctgatccggggcttcggcagctcctggaagagctctgtggagagcctgagccaggatgtgatgaggagcttcaccaacttcagaaatggcaccagcatcatccagggcgccctgacccagctgatccagctgtaccaccgcttccaccgggtgctgagccagccccagctgcgggccctgcctgcccgggcagagctgatcaacatccaccacctgatggtggagctgaagaagcacaagcccaacttctag

SEQ ID NO: 39868 - DNA, 2172 bp, Artificial Sequence; identical to SEQ ID NO: 39864
  Description of Artificial Sequence: Synthetic coding sequence

SEQ ID NO: 39869 - DNA, 2172 bp, Artificial Sequence; identical to SEQ ID NO: 39864
  Description of Artificial Sequence: Synthetic coding sequence

SEQ ID NO: 39870 - DNA, 2172 bp, Artificial Sequence; identical to SEQ ID NO: 39864
  Description of Artificial Sequence: Synthetic coding sequence

SEQ ID NO: 39871 - DNA, 2172 bp, Artificial Sequence; identical to SEQ ID NO: 39864
  Description of Artificial Sequence: Synthetic coding sequence

SEQ ID NO: 39872 - DNA, 2106 bp, Artificial Sequence; identical to SEQ ID NO: 39865
  Description of Artificial Sequence: Synthetic coding sequence

SEQ ID NO: 39873 - DNA, 2106 bp, Artificial Sequence; identical to SEQ ID NO: 39865
  Description of Artificial Sequence: Synthetic coding sequence

SEQ ID NO: 39874 - DNA, 1797 bp, Artificial Sequence; identical to SEQ ID NO: 39867
  Description of Artificial Sequence: Synthetic coding sequence

SEQ ID NO: 39875 - DNA, 1797 bp, Artificial Sequence; identical to SEQ ID NO: 39867
  Description of Artificial Sequence: Synthetic coding sequence

SEQ ID NO: 39876 - DNA, 1443 bp, Artificial Sequence
  Description of Artificial Sequence: Synthetic coding sequence
atgtctgatgtggccatcgtgaaggagggctggctgcacaagagaggagagtacatcaagacctggaggccccgctacttcctgctgaagaatgatggcaccttcatcggctacaaggagcggccccaggatgtggaccagcgggaggcccccctgaacaacttctctgtggcccagtgccagctgatgaagacagagcggccccggcccaacaccttcatcatccgctgcctgcagtggaccaccgtcatcgagaggaccttccacgtggagaccccagaggagcgggaggagtggaccacagccatccagacagtggctgatggcctgaagaagcaggaggaggaggagatggacttccgcagcggcagccccagcgacaacagcggggctgaggagatggaggtgtccctggccaagcccaagcaccgggtgaccatgaatgaatttgagtacctgaagctgctgggcaagggcaccttcggcaaggtgatcctggtgaaggagaaggccaccggccgctactatgccatgaagatcctgaagaaggaggtgattgtggccaaggatgaggtggcccacaccctgacagagaacagagtgctgcagaacagccgccaccccttcctgacagccctgaagtacagcttccagacccatgaccggctgtgctttgtgatggagtatgccaatggaggagagctgttcttccacctgagccgggagagggtcttctctgaagatcgggcccgcttctatggagctgagatcgtgtctgccctggactacctgcacagcgagaagaatgtggtgtacagagacctgaagctggagaacctgatgctggacaaggatggccacatcaagatcacagactttggcctgtgcaaggagggcatcaaggatggagccaccatgaagaccttctgtggcaccccagagtacctggcccctgaggtgctggaggacaatgactatggccgggctgtggactggtggggcctgggcgtggtgatgtatgagatgatgtgtggccgcctgcccttctacaaccaggaccacgagaagctgtttgagctgatcctgatggaggagatccgcttccccaggaccctgggccctgaggccaagagcctgctgagcggcctgctgaagaaggaccccaagcagaggctgggcggcggctctgaagatgccaaggagatcatgcagcaccgcttctttgctggcatcgtgtggcagcacgtgtatgagaagaagctgagcccccccttcaagccccaggtgaccagcgagacagacacccgctactttgatgaggagttcaccgcccagatgatcaccatcaccccaccagaccaggatgacagcatggagtgtgtggacagcgagcggcggccccacttcccccagttctcctacagcgccagcggcacagcctag

SEQ ID NO: 39877 - DNA, 3192 bp, Artificial Sequence
  Description of Artificial Sequence: Synthetic coding sequence
atgccccacctgcccctggccagcttccggccccccttctggggcctgcggcacagccggggcctgccccgcttccacagcgtgtccacccagagcgagccccacggcagccccatcagcagaagaaaccgggaggccaagcagaagaggctgcgggagaagcaggccaccctggaggccgagattgctggggagagcaagagccctgctgagagcatcaaggcctggaggcccaaggagctggtgctgtatgagatccccaccaagccaggagagaagaaggatgtgtctggccccctgcccccagcctacagcccccgctacgtggaggccgcctggtacccctggtgggtgcgggagggcttcttcaagccagagtaccaggcccggctgccccaggccactggagagaccttctccatgtgcatccccccaccaaatgtgacaggcagcctgcacatcggccacgccctgactgtggccatccaggatgccctggtgcgctggcacaggatgagaggagaccaggtgctgtgggtgcccggcagtgaccacgccggcatcgccacccaggccgtggtggagaagcagctgtggaaggagcggggcgtgagaagacatgagctgagccgggaggccttcctgcgggaggtgtggcagtggaaggaggccaagggcggggagatctgtgagcagctgcgggccctgggcgccagcctggactgggaccgggagtgcttcaccatggatgtgggcagctctgtggccgtgacagaggcctttgtgcggctgtacaaggccggcctgctgtacagaaaccaccagctggtgaactggagctgtgccctgcggagcgccatcagtgacatcgaggtggagaaccggcccctgcccggccacacccagctgcggctgcccggctgccccacccctgtgtcctttggcctgctcttctctgtggccttccctgtggatggagagccagatgctgaggtggtggtgggcaccaccaggcctgagaccctgcctggagatgtggccgtggccgtgcacccagatgacagccgctacacccacctgcacggccggcagctgcggcaccccctgatgggccagcccctgcccctcatcacagattatgctgtgcagccccacgtgggcaccggggctgtgaaggtgaccccagcccacagccctgcagatgctgagatgggcgcccggcacggcctgagccccctgaatgtgattgctgaagatggcaccatgaccagcctgtgtggggactggctgcagggcctgcacagatttgtggcccgggagaagatcatgtctgtgctgtctgagtggggcctcttccggggcctgcagaaccaccccatggtgctgcccatctgcagccgctctggagatgtgattgagtacctgctgaagaaccagtggtttgtgcgctgccaggagatgggcgcccgggccgccaaggctgtggagagcggggccctggagctgagccccagcttccaccagaagaactggcagcactggttcagccacatcggggactggtgtgtgtcccggcagctgtggtggggccaccagatcccagcctacctggtggtggaggaccacgcccagggcgaggaggactgctgggtggtgggccgctctgaggccgaggcccgggaggtggccgctgagctgaccggccggcctggagctgagctgaccctggagcgggaccctgatgtgctggacacctggttcagcagcgccctcttccccttcagcgccctgggctggccccaggagaccccagacctggcccgcttctaccccctgagcctgctggagactggaagtgacctgctgctcttctgggtgggccgcatggtgatgctgggcacccagctgaccggccagctgcccttcagcaaggtgctgctgcaccccatggtgcgggaccggcagggcaggaagatgagcaagagcctgggcaatgtgctggacccccgggacatcatcagcggcgtggagatgcaggtgctgcaggagaagctgcggagcggcaacctggaccctgctgagctggccatcgtggccgccgcccagaagaaggacttcccccacggcatcccagaatgtggcacagatgccctgcgcttcaccctgtgcagccatggagtgcaggccggggacctgcacctgtctgtgtctgaggtgcagagctgccgccacttctgcaacaagatctggaatgccctgcgcttcatcctgaatgccctgggggagaagtttgtgccccagcctgctgaggagctgagccccagcagccccatggatgcctggatcctgagccggctggccctggccgcccaggagtgtgagcggggcttcctgacccgggagctgagcctggtgacccacgccctgcaccacttctggctgcacaacctgtgtgatgtgtacctggaggccgtgaagcctgtgctgtggcacagcccccggcccctgggccccccccaggtgctcttcagctgtgccgacctgggcctgcggctgctggcccccctgatgcccttcctggccgaggagctgtggcagaggctgcccccccggcccggctgccccccagcccccagcatctctgtggccccctaccccagcgcctgcagcctggagcactggaggcagcctgagctggagcggcgcttcagccgggtgcaggaggtggtgcaggtgctgcgggccctgcgggccacctaccagctgaccaaggcccggccccgggtgctgctgcagagcagcgagcccggggaccagggcctgtttgaggccttcctggagcccctgggcaccctgggctactgtggggctgtgggcctgctgcccccaggagctgctgcccccagcggctgggcccaggcccccctgagtgacacagcccaggtgtacatggagctgcagggcctggtggacccccagatccagctgcccctgctggccgcccggcgctacaagctgcagaagcagctggacagcctgacagcccggaccccatctgagggggaggccggcacccagaggcagcagaagctgagcagcctgcagctggagctgagcaagctggacaaggccgccagccacctgcagcagctgatggatgagcccccagcccctggcagccctgagctgtag

SEQ ID NO: 39878 - DNA, 348 bp, Artificial Sequence
  Description of Artificial Sequence: Synthetic coding sequence
atgccccacctgcccctggccagcttccggccccccttctggggcctgcggcacagccggggcctgccccgcttccacagcgtgtccacccagagcgagccccacggcagccccatcagcagaagaaaccgggaggccaagcagaagaggctgcgggagaagcaggccaccctggaggccgagattgctggggagagcaagagccctgctgagagcatcaaggcctggaggcccaaggagctggtgctgtatgagatccccaccaagccaggagagaagaaggatgtgtctggccccctgcccccagcctacagcccccgctacgtggaggccgcctggtacccctag

SEQ ID NO: 39879 - DNA, 981 bp, Artificial Sequence
  Description of Artificial Sequence: Synthetic coding sequence
atgccccacctgcccctggccagcttccggccccccttctggggcctgcggcacagccggggcctgccccgcttccacagcgtgtccacccagagcgagccccacggcagccccatcagcagaagaaaccgggaggccaagcagaagaggctgcgggagaagcaggccaccctggaggccgagattgctggggagagcaagagccctgctgagagcatcaaggcctggaggcccaaggagctggtgctgtatgagatccccaccaagccaggagagaagaaggatgtgtctggccccctgcccccagcctacagcccccgctacgtggaggccgcctggtacccctggtgggtgcgggagggcttcttcaagccagagtaccaggcccggctgccccaggccactggagagaccttctccatgtgcatccccccaccaaatgtgacaggcagcctgcacatcggccacgccctgactgtggccatccaggatgccctggtgcgctggcacaggatgagaggagaccaggtgctgtgggtgcccggcagtgaccacgccggcatcgccacccaggccgtggtggagaagcagctgtggaaggagcggggcgtgagaagacatgagctgagccgggaggccttcctgcgggaggtgtggcagtggaaggaggccaagggcggggagatctgtgagcagctgcgggccctgggcgccagcctggactgggaccgggagtgcttcaccatggatgtgggcagctctgtggccgtgacagaggcctttgtgcggctgtacaaggccggcctgctgtacagaaaccaccagctggtgaactggagctgtgccctgcggagcgccatcagtgacatcgaggtggagaaccggcccctgcccggccacacccagctgcggctgcccggctgccccacccctgtgtcctttggcctgctcttctctgtggccttccctgtggatggatag

SEQ ID NO: 39880 - DNA, 774 bp, Artificial Sequence
  Description of Artificial Sequence: Synthetic coding sequence
atgccccacctgcccctggccagcttccggccccccttctggggcctgcggcacagccggggcctgccccgcttccacagcgtgtccacccagagcgagccccacggcagccccatcagcagaagaaaccgggaggccaagcagaagaggctgcgggagaagcaggccaccctggaggccgagattgctggggagagcaagagccctgctgagagcatcaaggcctggaggcccaaggagctggtgctgtatgagatccccaccaagccaggagagaagaaggatgtgtctggccccctgcccccagcctacagcccccgctacgtggaggccgcctggtacccctggtgggtgcgggagggcttcttcaagccagagtaccaggcccggctgccccaggccactggagagaccttctccatgtgcatccccccaccaaatgtgacaggcagcctgcacatcggccacgccctgactgtggccatccaggatgccctggtgcgctggcacaggatgagaggagaccaggtgctgtgggtgcccggcagtgaccacgccggcatcgccacccaggccgtggtggagaagcagctgtggaaggagcggggcgtgagaagacatgagctgagccgggaggccttcctgcgggaggtgtggcagtggaaggaggccaagggcggggagatctgtgagcagctgcgggccctgggcgccagcctggactgggacagagtcttctaccacggctgctggctgctgagcggctgtgactag

SEQ ID NO: 39881 - DNA, 2772 bp, Artificial Sequence
  Description of Artificial Sequence: Synthetic coding sequence
atgtgcatccccccaccaaatgtgacaggcagcctgcacatcggccacgccctgactgtggccatccaggatgccctggtgcgctggcacaggatgagaggagaccaggtgctgtgggtgcccggcagtgaccacgccggcatcgccacccaggccgtggtggagaagcagctgtggaaggagcggggcgtgagaagacatgagctgagccgggaggccttcctgcgggaggtgtggcagtggaaggaggccaagggcggggagatctgtgagcagctgcgggccctgggcgccagcctggactgggaccgggagtgcttcaccatggatgtgggcagctctgtggccgtgacagaggcctttgtgcggctgtacaaggccggcctgctgtacagaaaccaccagctggtgaactggagctgtgccctgcggagcgccatcagtgacatcgaggtggagaaccggcccctgcccggccacacccagctgcggctgcccggctgccccacccctgtgtcctttggcctgctcttctctgtggccttccctgtggatggagagccagatgctgaggtggtggtgggcaccaccaggcctgagaccctgcctggagatgtggccgtggccgtgcacccagatgacagccgctacacccacctgcacggccggcagctgcggcaccccctgatgggccagcccctgcccctcatcacagattatgctgtgcagccccacgtgggcaccggggctgtgaaggtgaccccagcccacagccctgcagatgctgagatgggcgcccggcacggcctgagccccctgaatgtgattgctgaagatggcaccatgaccagcctgtgtggggactggctgcagggcctgcacagatttgtggcccgggagaagatcatgtctgtgctgtctgagtggggcctcttccggggcctgcagaaccaccccatggtgctgcccatctgcagccgctctggagatgtgattgagtacctgctgaagaaccagtggtttgtgcgctgccaggagatgggcgcccgggccgccaaggctgtggagagcggggccctggagctgagccccagcttccaccagaagaactggcagcactggttcagccacatcggggactggtgtgtgtcccggcagctgtggtggggccaccagatcccagcctacctggtggtggaggaccacgcccagggcgaggaggactgctgggtggtgggccgctctgaggccgaggcccgggaggtggccgctgagctgaccggccggcctggagctgagctgaccctggagcgggaccctgatgtgctggacacctggttcagcagcgccctcttccccttcagcgccctgggctggccccaggagaccccagacctggcccgcttctaccccctgagcctgctggagactggaagtgacctgctgctcttctgggtgggccgcatggtgatgctgggcacccagctgaccggccagctgcccttcagcaaggtgctgctgcaccccatggtgcgggaccggcagggcaggaagatgagcaagagcctgggcaatgtgctggacccccgggacatcatcagcggcgtggagatgcaggtgctgcaggagaagctgcggagcggcaacctggaccctgctgagctggccatcgtggccgccgcccagaagaaggacttcccccacggcatcccagaatgtggcacagatgccctgcgcttcaccctgtgcagccatggagtgcaggccggggacctgcacctgtctgtgtctgaggtgcagagctgccgccacttctgcaacaagatctggaatgccctgcgcttcatcctgaatgccctgggggagaagtttgtgccccagcctgctgaggagctgagccccagcagccccatggatgcctggatcctgagccggctggccctggccgcccaggagtgtgagcggggcttcctgacccgggagctgagcctggtgacccacgccctgcaccacttctggctgcacaacctgtgtgatgtgtacctggaggccgtgaagcctgtgctgtggcacagcccccggcccctgggccccccccaggtgctcttcagctgtgccgacctgggcctgcggctgctggcccccctgatgcccttcctggccgaggagctgtggcagaggctgcccccccggcccggctgccccccagcccccagcatctctgtggccccctaccccagcgcctgcagcctggagcactggaggcagcctgagctggagcggcgcttcagccgggtgcaggaggtggtgcaggtgctgcgggccctgcgggccacctaccagctgaccaaggcccggccccgggtgctgctgcagagcagcgagcccggggaccagggcctgtttgaggccttcctggagcccctgggcaccctgggctactgtggggctgtgggcctgctgcccccaggagctgctgcccccagcggctgggcccaggcccccctgagtgacacagcccaggtgtacatggagctgcagggcctggtggacccccagatccagctgcccctgctggccgcccggcgctacaagctgcagaagcagctggacagcctgacagcccggaccccatctgagggggaggccggcacccagaggcagcagaagctgagcagcctgcagctggagctgagcaagctggacaaggccgccagccacctgcagcagctgatggatgagcccccagcccctggcagccctgagctgtag

SEQ ID NO: 39882 - DNA, 3282 bp, Artificial Sequence
  Description of Artificial Sequence: Synthetic coding sequence
atgggcggcaaggcctggccccggcgggctgtgggcacagctgggggcccctgtgccgagcagatcagcgcccccttccagaccctgctgatgccccacctgcccctggccagcttccggccccccttctggggcctgcggcacagccggggcctgccccgcttccacagcgtgtccacccagagcgagccccacggcagccccatcagcagaagaaaccgggaggccaagcagaagaggctgcgggagaagcaggccaccctggaggccgagattgctggggagagcaagagccctgctgagagcatcaaggcctggaggcccaaggagctggtgctgtatgagatccccaccaagccaggagagaagaaggatgtgtctggccccctgcccccagcctacagcccccgctacgtggaggccgcctggtacccctggtgggtgcgggagggcttcttcaagccagagtaccaggcccggctgccccaggccactggagagaccttctccatgtgcatccccccaccaaatgtgacaggcagcctgcacatcggccacgccctgactgtggccatccaggatgccctggtgcgctggcacaggatgagaggagaccaggtgctgtgggtgcccggcagtgaccacgccggcatcgccacccaggccgtggtggagaagcagctgtggaaggagcggggcgtgagaagacatgagctgagccgggaggccttcctgcgggaggtgtggcagtggaaggaggccaagggcggggagatctgtgagcagctgcgggccctgggcgccagcctggactgggaccgggagtgcttcaccatggatgtgggcagctctgtggccgtgacagaggcctttgtgcggctgtacaaggccggcctgctgtacagaaaccaccagctggtgaactggagctgtgccctgcggagcgccatcagtgacatcgaggtggagaaccggcccctgcccggccacacccagctgcggctgcccggctgccccacccctgtgtcctttggcctgctcttctctgtggccttccctgtggatggagagccagatgctgaggtggtggtgggcaccaccaggcctgagaccctgcctggagatgtggccgtggccgtgcacccagatgacagccgctacacccacctgcacggccggcagctgcggcaccccctgatgggccagcccctgcccctcatcacagattatgctgtgcagccccacgtgggcaccggggctgtgaaggtgaccccagcccacagccctgcagatgctgagatgggcgcccggcacggcctgagccccctgaatgtgattgctgaagatggcaccatgaccagcctgtgtggggactggctgcagggcctgcacagatttgtggcccgggagaagatcatgtctgtgctgtctgagtggggcctcttccggggcctgcagaaccaccccatggtgctgcccatctgcagccgctctggagatgtgattgagtacctgctgaagaaccagtggtttgtgcgctgccaggagatgggcgcccgggccgccaaggctgtggagagcggggccctggagctgagccccagcttccaccagaagaactggcagcactggttcagccacatcggggactggtgtgtgtcccggcagctgtggtggggccaccagatcccagcctacctggtggtggaggaccacgcccagggcgaggaggactgctgggtggtgggccgctctgaggccgaggcccgggaggtggccgctgagctgaccggccggcctggagctgagctgaccctggagcgggaccctgatgtgctggacacctggttcagcagcgccctcttccccttcagcgccctgggctggccccaggagaccccagacctggcccgcttctaccccctgagcctgctggagactggaagtgacctgctgctcttctgggtgggccgcatggtgatgctgggcacccagctgaccggccagctgcccttcagcaaggtgctgctgcaccccatggtgcgggaccggcagggcaggaagatgagcaagagcctgggcaatgtgctggacccccgggacatcatcagcggcgtggagatgcaggtgctgcaggagaagctgcggagcggcaacctggaccctgctgagctggccatcgtggccgccgcccagaagaaggacttcccccacggcatcccagaatgtggcacagatgccctgcgcttcaccctgtgcagccatggagtgcaggccggggacctgcacctgtctgtgtctgaggtgcagagctgccgccacttctgcaacaagatctggaatgccctgcgcttcatcctgaatgccctgggggagaagtttgtgccccagcctgctgaggagctgagccccagcagccccatggatgcctggatcctgagccggctggccctggccgcccaggagtgtgagcggggcttcctgacccgggagctgagcctggtgacccacgccctgcaccacttctggctgcacaacctgtgtgatgtgtacctggaggccgtgaagcctgtgctgtggcacagcccccggcccctgggccccccccaggtgctcttcagctgtgccgacctgggcctgcggctgctggcccccctgatgcccttcctggccgaggagctgtggcagaggctgcccccccggcccggctgccccccagcccccagcatctctgtggccccctaccccagcgcctgcagcctggagcactggaggcagcctgagctggagcggcgcttcagccgggtgcaggaggtggtgcaggtgctgcgggccctgcgggccacctaccagctgaccaaggcccggccccgggtgctgctgcagagcagcgagcccggggaccagggcctgtttgaggccttcctggagcccctgggcaccctgggctactgtggggctgtgggcctgctgcccccaggagctgctgcccccagcggctgggcccaggcccccctgagtgacacagcccaggtgtacatggagctgcagggcctggtggacccccagatccagctgcccctgctggccgcccggcgctacaagctgcagaagcagctggacagcctgacagcccggaccccatctgagggggaggccggcacccagaggcagcagaagctgagcagcctgcagctggagctgagcaagctggacaaggccgccagccacctgcagcagctgatggatgagcccccagcccctggcagccctgagctgtag

SEQ ID NO: 39883 - DNA, 699 bp, Artificial Sequence
  Description of Artificial Sequence: Synthetic coding sequence
atggccagcagcgctgccagcagcgagcactttgagaagctgcacgagatcttccggggcctgcacgaggacctgcagggcgtgcctgagcggctgctgggcacagctggaacagaggagaagaagaagctgatccgggactttgatgagaagcagcaggaggccaatgagaccctggccgagatggaggaggagctgcgctatgcccccctgtccttcaggaaccccatgatgagcaagctgaggaactacaggaaggacctggccaagctgcaccgggaggtgcgcagcacccccctgacagccacccctgggggccgcggggacatgaagtatggcatctatgctgtggagaatgagcacatgaaccggctgcagagccagagggccatgctgctgcagggcacagagagcctgaacagagccacccagagcattgaaagaagccaccgcatcgccacagaaacagaccagatcggcagcgagatcatcgaggagctgggggagcagagggaccagctggagaggaccaagagccggctggtgaacaccagcgagaacctgagcaagagcaggaagatcctgcgctccatgagcaggaaggtgaccaccaacaagctgctgctgagcatcatcatcctgctggagctggccatcctgggcggcctggtgtactacaagttcttccgcagccactag

SEQ ID NO: 39884 - DNA, 426 bp, Artificial Sequence
  Description of Artificial Sequence: Synthetic coding sequence
atgccacccaagttcaagaggcacctgaatgatgatgatgtgactggatctgtgaagtctgagaggaggaacctgctggaggatgacagtgatgaggaggaggacttcttcctgcggggccccagcggcccccgcttcggccccagaaatgacaagatcaagcacgtgcagaaccaggtggatgaggtgattgatgtgatgcaggagaacatcaccaaggtgattgagcggggggagcggctggatgagctgcaggacaagtctgagagcctgagtgacaatgccacagccttcagcaacagaagcaagcagctgcggcggcagatgtggtggaggggctgcaagatcaaggccatcatggccctggtggccgccatcctgctgctggtgatcatcatcctgattgtgatgaagtaccgcacctag

SEQ ID NO: 39885 - DNA, 423 bp, Artificial Sequence
  Description of Artificial Sequence: Synthetic coding sequence
atgccacccaagttcaagaggcacctgaatgatgatgatgtgactggatctgtgaagtctgagaggaggaacctgctggaggatgacagtgatgaggaggaggacttcttcctgggccccagcggccccaggtttggccccagaaatgacaagatcaagcacgtgcagaaccaggtggatgaggtgattgatgtgatgcaggagaacatcaccaaggtgattgaaagaggagagcggctggatgagctgcaggacaagtctgagagcctgagtgacaatgccacagccttcagcaacagaagcaagcagctgcggcggcagatgtggtggaggggctgcaagatcaaggccatcatggccctggtggccgccatcctgctgctggtgatcatcatcctgattgtgatgaagtaccgcacctag

SEQ ID NO: 39886 - DNA, 423 bp, Artificial Sequence; identical to SEQ ID NO: 39885
  Description of Artificial Sequence: Synthetic coding sequence

SEQ ID NO: 39887 - DNA, 426 bp, Artificial Sequence; identical to SEQ ID NO: 39884
  Description of Artificial Sequence: Synthetic coding sequence

SEQ ID NO: 39888 - DNA, 519 bp, Artificial Sequence
  Description of Artificial Sequence: Synthetic coding sequence
atgaggcggcagcctgccaaggtggccgccctgctgctgggcctgctgctggagtgcacagaggccaagaagcactgctggtactttgagggcctgtaccccacctactacatctgccgctcctatgaggactgctgcggcagccgctgctgcgtgcgggccctgagcatccagaggctgtggtacttctggttcctgctgatgatgggcgtgctcttctgctgcggggccggcttcttcatcagaagaaggatgtaccccccacccctgattgaggagcccgccttcaacgtgtcctacacccggcagccccccaaccctggccctggggcccagcagcccggccccccctactacacagaccccggcggccctggcatgaaccctgtgggcaacagcatggccatggccttccaggtgccccccaacagcccccagggctctgtggcctgccccccacctccagcctactgcaacaccccacctccaccctatgagcaggtggtgaaggccaagtag

SEQ ID NO: 39889 - DNA, 510 bp, Artificial Sequence
  Description of Artificial Sequence: Synthetic coding sequence
atgctgtctgagaccctgggctacctgagctctgtgctgctgcagtgcacagaggccaagaagcactgctggtactttgagggcctgtaccccacctactacatctgccgctcctatgaggactgctgcggcagccgctgctgcgtgcgggccctgagcatccagaggctgtggtacttctggttcctgctgatgatgggcgtgctcttctgctgcggggccggcttcttcatcagaagaaggatgtacccacctcctctcatcgaggagcccgccttcaacgtgtcctacacccggcagccccccaaccctggccctggggcccagcagcccggccccccctactacacagatcctgggggccctggcatgaaccctgtgggcaacagcatggccatggccttccaggtgccccccaacagcccccagggctctgtggcctgccccccacctccagcctactgcaacaccccacctccaccctatgagcaggtggtgaaggccaagtag

SEQ ID NO: 39890 - DNA, 2196 bp, Artificial Sequence
  Description of Artificial Sequence: Synthetic coding sequence
atgctgaaggagtgggccatcaagcagggcatcctgctgaaggtggccgagaccatcaagtcctggatcttcttcagccagtgcaacaagaaggatgacctgctgcacaagctggacatcggcttccggctggacagcctgcacaccatcctgcagcaggaggtgctgctgcaggaggatgtggagctgattgagctgctggaccccagcatcctgtctgctggccagagccagcagcaggagaatggccacctgcccaccctgtgcagcctggccacccccaacatctgggacctgtccatgctgtttgccttcatcagcctgctggtgatgctgcccacctggtggatcgtgtcctcctggctggtgtggggcgtcatcctgtttgtgtacctggtgatccgggccctgcggctgtggaggacagccaagctgcaggtgaccctgaagaagtacagcgtgcacctggaggacatggccaccaacagccgggccttcaccaacctggtgaggaaggccctgcggctcatccaggagacagaggtgatcagccggggcttcaccctggtgtctgctgcctgccccttcaacaaggccggccagcaccccagccagcacctgattggcctgaggaaggctgtgtaccgcaccctgcgggccaacttccaggccgcccggctggccaccctgtacatgctgaagaactaccccctgaacagcgagagtgacaacgtgaccaactacatctgtgtggtgcccttcaaggagctgggcctgggcctgtctgaggagcagatcagcgaggaggaggcccacaacttcacagatggcttcagcctgcctgccctgaaggtgctcttccagctgtgggtggcccagagcagcgagttcttccggcggctggccctgctgctgagcacagccaacagccccccaggccccctgctgaccccagccctgctgccccaccgcatcctgagtgatgtgacccagggcctgccccacgcccacagcgcctgcctggaggagctgaagaggagctatgagttctaccgctactttgagacccagcaccagagcgtgccccagtgcctgagcaagacccagcagaagagccgggagctgaacaacgtgcacacagctgtgcgcagcctgcagctgcacctgaaggccctgctgaatgaggtgatcatcctggaggatgagctggagaagctggtgtgcaccaaggagacccaggagctggtgtctgaggcctaccccatcctggagcagaagctgaagctgatccagccccacgtgcaggccagcaacaactgctgggaggaggccatcagccaggtggacaagctgctgcggaggaacacagacaagaagggcaagccagagatcgcctgtgagaacccccactgcaccgtggtgcccctgaagcagcccaccctgcacatcgctgacaaggaccccatccctgaggagcaggagctggaggcctacgtggatgacatcgacatcgacagcgacttcaggaaggatgacttctactacctgagccaggaggacaaggagcggcagaagcgggagcacgaggagagcaagagggtgctgcaggagctgaagtctgtgctgggcttcaaggccagcgaggccgagcggcagaagtggaagcagctgctcttcagtgaccatgctgtgctgaagagcctgagccctgtggaccctgtggagcccatcagcaacagcgagcccagcatgaacagcgacatgggcaaggtgtccaagaatgacacagaggaggagagcaacaagagcgccaccacagacaatgagatcagcaggacagagtacctgtgtgagaacagcctggagggcaagaacaaggacaacagcagcaatgaggtgttcccccagggcgctgaggagaggatgtgctaccagtgtgagagtgaagatgagccccaggctgatggcagcggcctgaccacagccccacccaccccccgggacagcctgcagcccagcatcaagcagaggctggcccggctgcagctgagcccagacttcaccttcaccgctggcctggccgctgaggtggccgcccggagcctgtccttcaccaccatgcaggagcagaccttcggcggggaggaggaggagcagatcatcgaggagaacaagaatgaaattgaggagaagtag

SEQ ID NO: 39891 - DNA, 2340 bp, Artificial Sequence
  Description of Artificial Sequence: Synthetic coding sequence
atgctgcctgacatggaggatgtgcacctgttccagaacagccccctgtaccagtacctgcaggacctgggccacacagactttgagatctgcagcagcctgagccccaagacagagaagtgcaccacagagggccagcagaagccacccaccagggtgctgcccaagcagggcatcctgctgaaggtggccgagaccatcaagtcctggatcttcttcagccagtgcaacaagaaggatgacctgctgcacaagctggacatcggcttccggctggacagcctgcacaccatcctgcagcaggaggtgctgctgcaggaggatgtggagctgattgagctgctggaccccagcatcctgtctgctggccagagccagcagcaggagaatggccacctgcccaccctgtgcagcctggccacccccaacatctgggacctgtccatgctgtttgccttcatcagcctgctggtgatgctgcccacctggtggatcgtgtcctcctggctggtgtggggcgtcatcctgtttgtgtacctggtgatccgggccctgcggctgtggaggacagccaagctgcaggtgaccctgaagaagtacagcgtgcacctggaggacatggccaccaacagccgggccttcaccaacctggtgaggaaggccctgcggctcatccaggagacagaggtgatcagccggggcttcaccctggtgtctgctgcctgccccttcaacaaggccggccagcaccccagccagcacctgattggcctgaggaaggctgtgtaccgcaccctgcgggccaacttccaggccgcccggctggccaccctgtacatgctgaagaactaccccctgaacagcgagagtgacaacgtgaccaactacatctgtgtggtgcccttcaaggagctgggcctgggcctgtctgaggagcagatcagcgaggaggaggcccacaacttcacagatggcttcagcctgcctgccctgaaggtgctcttccagctgtgggtggcccagagcagcgagttcttccggcggctggccctgctgctgagcacagccaacagccccccaggccccctgctgaccccagccctgctgccccaccgcatcctgagtgatgtgacccagggcctgccccacgcccacagcgcctgcctggaggagctgaagaggagctatgagttctaccgctactttgagacccagcaccagagcgtgccccagtgcctgagcaagacccagcagaagagccgggagctgaacaacgtgcacacagctgtgcgcagcctgcagctgcacctgaaggccctgctgaatgaggtgatcatcctggaggatgagctggagaagctggtgtgcaccaaggagacccaggagctggtgtctgaggcctaccccatcctggagcagaagctgaagctgatccagccccacgtgcaggccagcaacaactgctgggaggaggccatcagccaggtggacaagctgctgcggaggaacacagacaagaagggcaagccagagatcgcctgtgagaacccccactgcaccgtggtgcccctgaagcagcccaccctgcacatcgctgacaaggaccccatccctgaggagcaggagctggaggcctacgtggatgacatcgacatcgacagcgacttcaggaaggatgacttctactacctgagccaggaggacaaggagcggcagaagcgggagcacgaggagagcaagagggtgctgcaggagctgaagtctgtgctgggcttcaaggccagcgaggccgagcggcagaagtggaagcagctgctcttcagtgaccatgctgtgctgaagagcctgagccctgtggaccctgtggagcccatcagcaacagcgagcccagcatgaacagcgacatgggcaaggtgtccaagaatgacacagaggaggagagcaacaagagcgccaccacagacaatgagatcagcaggacagagtacctgtgtgagaacagcctggagggcaagaacaaggacaacagcagcaatgaggtgttcccccagggcgctgaggagaggatgtgctaccagtgtgagagtgaagatgagccccaggctgatggcagcggcctgaccacagccccacccaccccccgggacagcctgcagcccagcatcaagcagaggctggcccggctgcagctgagcccagacttcaccttcaccgctggcctggccgctgaggtggccgcccggagcctgtccttcaccaccatgcaggagcagaccttcggcggggaggaggaggagcagatcatcgaggagaacaagaatgaaattgaggagaagtag

SEQ ID NO: 39892 - DNA, 2340 bp, Artificial Sequence
  Description of Artificial Sequence: Synthetic coding sequence
atgaccccagagtttgatgaggaggtggtgtttgagaacagccccctgtaccagtacctgcaggacctgggccacacagactttgagatctgcagcagcctgagccccaagacagagaagtgcaccacagagggccagcagaagccacccaccagggtgctgcccaagcagggcatcctgctgaaggtggccgagaccatcaagtcctggatcttcttcagccagtgcaacaagaaggatgacctgctgcacaagctggacatcggcttccggctggacagcctgcacaccatcctgcagcaggaggtgctgctgcaggaggatgtggagctgattgagctgctggaccccagcatcctgtctgctggccagagccagcagcaggagaatggccacctgcccaccctgtgcagcctggccacccccaacatctgggacctgtccatgctgtttgccttcatcagcctgctggtgatgctgcccacctggtggatcgtgtcctcctggctggtgtggggcgtcatcctgtttgtgtacctggtgatccgggccctgcggctgtggaggacagccaagctgcaggtgaccctgaagaagtacagcgtgcacctggaggacatggccaccaacagccgggccttcaccaacctggtgaggaaggccctgcggctcatccaggagacagaggtgatcagccggggcttcaccctggtgtctgctgcctgccccttcaacaaggccggccagcaccccagccagcacctgattggcctgaggaaggctgtgtaccgcaccctgcgggccaacttccaggccgcccggctggccaccctgtacatgctgaagaactaccccctgaacagcgagagtgacaacgtgaccaactacatctgtgtggtgcccttcaaggagctgggcctgggcctgtctgaggagcagatcagcgaggaggaggcccacaacttcacagatggcttcagcctgcctgccctgaaggtgctcttccagctgtgggtggcccagagcagcgagttcttccggcggctggccctgctgctgagcacagccaacagccccccaggccccctgctgaccccagccctgctgccccaccgcatcctgagtgatgtgacccagggcctgccccacgcccacagcgcctgcctggaggagctgaagaggagctatgagttctaccgctactttgagacccagcaccagagcgtgccccagtgcctgagcaagacccagcagaagagccgggagctgaacaacgtgcacacagctgtgcgcagcctgcagctgcacctgaaggccctgctgaatgaggtgatcatcctggaggatgagctggagaagctggtgtgcaccaaggagacccaggagctggtgtctgaggcctaccccatcctggagcagaagctgaagctgatccagccccacgtgcaggccagcaacaactgctgggaggaggccatcagccaggtggacaagctgctgcggaggaacacagacaagaagggcaagccagagatcgcctgtgagaacccccactgcaccgtggtgcccctgaagcagcccaccctgcacatcgctgacaaggaccccatccctgaggagcaggagctggaggcctacgtggatgacatcgacatcgacagcgacttcaggaaggatgacttctactacctgagccaggaggacaaggagcggcagaagcgggagcacgaggagagcaagagggtgctgcaggagctgaagtctgtgctgggcttcaaggccagcgaggccgagcggcagaagtggaagcagctgctcttcagtgaccatgctgtgctgaagagcctgagccctgtggaccctgtggagcccatcagcaacagcgagcccagcatgaacagcgacatgggcaaggtgtccaagaatgacacagaggaggagagcaacaagagcgccaccacagacaatgagatcagcaggacagagtacctgtgtgagaacagcctggagggcaagaacaaggacaacagcagcaatgaggtgttcccccagggcgctgaggagaggatgtgctaccagtgtgagagtgaagatgagccccaggctgatggcagcggcctgaccacagccccacccaccccccgggacagcctgcagcccagcatcaagcagaggctggcccggctgcagctgagcccagacttcaccttcaccgctggcctggccgctgaggtggccgcccggagcctgtccttcaccaccatgcaggagcagaccttcggcggggaggaggaggagcagatcatcgaggagaacaagaatgaaattgaggagaagtag

SEQ ID NO: 39893 - DNA, 531 bp, Artificial Sequence
  Description of Artificial Sequence: Synthetic coding sequence
atggccgcccctgtgctgctgcgggtgtctgtgccccgctgggagcgggtggcccgctatgctgtgtgtgccgccggcatcctgctgagcatctatgcctaccacgtggagcgggagaaggagcgggaccctgagcaccgggccctgtgtgacctgggcccctgggtgaagtgcagcgctgccctggccagccgctggggccggggcttcggcctgctgggcagcatctttgggaaggatggagtgctgaaccagcccaacagcgtgtttggcctcatcttctacatcctgcagctgctgctgggcatgacagccagcgctgtggccgccctgatcctgatgaccagcagcatcatgtctgtggtgggcagcctgtacctggcctacatcctgtactttgtgctgaaggagttctgcatcatctgcatcgtgacctacgtgctgaacttcctgctgctgatcatcaactacaagaggctggtgtacctgaatgaggcctggaagaggcagctgcagcccaagcaggactag

SEQ ID NO: 39894 - DNA, 306 bp, Artificial Sequence
  Description of Artificial Sequence: Synthetic coding sequence
atggagaggccagacaaggccgccctgaatgccctgcagcccccagagttcagaaatgaaagcagcctggccagcaccctgaagaccctgctcttcttcaccgccctgatgatcaccgtgcccatcggcctgtacttcaccaccaagagctacatctttgaaggagccctgggcatgagcaacagagacagctacttctacgccgccatcgtggccgtggtggccgtgcacgtggtgctggccctgtttgtgtatgtggcctggaatgaaggcagccggcagtggagggagggcaagcaggactag

SEQ ID NO: 39895 - DNA, 471 bp, Artificial Sequence
  Description of Artificial Sequence: Synthetic coding sequence
atgctgggcagcccctgtggcccccagctgagtgacagagatgctgatgaggaccagtgcagccgggagttccggggcagaagaagccggcggccccccaggaggaccatgctgcggggcaagagccggctgaatgtggagtggctgggctacagccctggcctgctgctggagcaccggcccctgctggccggccgcacccccaggagccacagaagaaatgaaagcagcctggccagcaccctgaagaccctgctcttcttcaccgccctgatgatcaccgtgcccatcggcctgtacttcaccaccaagagctacatctttgagggcgccctgggcatgagcaacagagacagctacttctatgctgccatcgtggccgtggtggccgtgcacgtggtgctggccctgtttgtgtatgtggcctggaatgaaggcagccggcagtggagggagggcaagcaggactag

SEQ ID NO: 39896 - DNA, 1188 bp, Artificial Sequence
  Description of Artificial Sequence: Synthetic coding sequence
atgacccacaccctgtaccccaccccatttgccctgtaccccatcaacatctctgctgcctggcacctgggccccctgcctgtgtcctgctttgtgagcaacaagtaccagtgcagcctggccttcggggccaccaccggcctgcgggtgctggtggtggtggtgccccagacccagctgtccttcctgagcagcctgtgcctggtgtccctcttcctgcacagcctggtgtctgcccacggggagaagcccaccaagcctgtgggcctggaccccaccctcttccaggtggtggtgggcatcctgggcaacttcagcctgctgtactactacatgttcctgtacttccggggctacaagcccaggagcacagacctgatcctgcggcacctgactgtggccgacagcctggtgatcctgagcaagagaattcctgagaccatggccaccttcggcctgaagcactttgacaactacttcggctgcaagttcctgctgtatgcccaccgggtgggccggggcgtgtccatcggcagcacctgcctgctgagcgtcttccaggtgatcaccatcaaccccaggaacagccgctgggccgagatgaaggtgaaggcccccacctacatcggcctgagcaacatcctgtgctgggccttccacatgctggtgaatgccatcttccccatctacaccaccgggaagtggagcaacaacaacatcaccaagaagggggacctgggctactgcagcgcccccctgagtgatgaggtgaccaagtctgtgtatgctgccctgaccagcttccatgatgtgctgtgcctgggcctgatgctgtgggccagcagcagcatcgtgctggtgctgtaccgccacaagcagcaggtgcagcacatctgcaggaacaacctgtaccccaacagcagccctggcaacagagccatccagagcatcctggccctggtgtccacctttgccctgtgctacgccctgtccttcatcacctacgtgtacctggccctgtttgacaacagctcctggtggctggtgaacacagctgccctgatcatcgcctgcttccccaccatcagcccctttgtgctgatgtgccgggaccccagccgcagccggctgtgcagcatctgctgcagaagaaacagacgcttcttccatgacttcaggaagatgtag

SEQ ID NO: 39897 - DNA, 8487 bp, Artificial Sequence
  Description of Artificial Sequence: Synthetic coding sequence
atgcccaagagggcccactggggcgccctgtctgtggtgctgatcctgctgtggggccacccccgggtggccctggcctgcccccacccctgtgcctgctacgtgcccagcgaggtgcactgcaccttccgcagcctggcctctgtgcctgctggcatcgccaagcacgtggagcgcatcaacctgggcttcaacagcatccaggccctgtctgagaccagctttgctggcctgaccaagctggagctgctgatgattcatggaaatgagatccccagcatcccagatggagccctgcgggacctgagcagcctgcaggtgttcaagttctcctacaacaagctgcgggtcatcaccggccagaccctgcagggcctgagcaacctgatgaggctgcacatcgaccacaacaagattgagttcatccacccccaggccttcaacggcctgaccagcctgcggctgctgcacctggagggcaacctgctgcaccagctgcaccccagcaccttcagcaccttcaccttcctggactacttccggctgagcaccatccgccacctgtacctggccgagaacatggtgaggaccctgcctgcctccatgctgaggaacatgcccctgctggagaacctgtacctgcagggcaacccctggacctgtgactgtgagatgcgctggttcctggagtgggatgccaagagccggggcatcctgaagtgcaagaaggacaaggcctatgaaggaggccagctgtgtgccatgtgcttcagccccaagaagctgtacaagcatgagatccacaagctgaaggacatgacctgcctgaagcccagcattgagagccccctgcggcagaacagaagccgcagcattgaggaggagcaggagcaggaggaggatggcggcagccagctgatcctggagaagttccagctgccccagtggagcatcagcctgaacatgacagatgagcacggcaacatggtgaacctggtgtgtgacatcaagaagcccatggatgtgtacaagatccacctgaaccagacagaccccccagacatcgacatcaatgccaccgtggccctggactttgagtgccccatgacccgggagaactatgagaagctgtggaagctgattgcctactacagcgaggtgcctgtgaagctgcaccgggagctgatgctgagcaaggacccccgggtgtcctaccagtaccggcaggatgctgatgaggaggccctgtactacacaggagtgcgggcccagatcctggccgagcctgagtgggtgatgcagcccagcattgacatccagctgaacagacggcagagcacagccaagaaggtgctgctgagctactacacccagtacagccagaccatcagcaccaaggacacccggcaggcccggggccgctcctgggtgatgattgagcccagcggggctgtgcagagggaccagacagtgctggagggcggcccctgccagctgagctgcaatgtgaaggccagcgagagccccagcatcttctgggtgctgcctgatggcagcatcctgaaggcccccatggatgatcctgacagcaagttcagcatcctgagcagcggctggctgcgcatcaagtccatggagcccagcgacagcggcctgtaccagtgcatcgcccaggtgagagatgagatggacaggatggtgtacagagtgctggtgcagagccccagcacccagcctgctgagaaggacacagtgaccatcggcaagaaccctggagagagcgtgaccctgccctgcaatgccctggccatccctgaggcccacctgtcctggatcctgcccaacagacgcatcatcaatgacctggccaacaccagccacgtgtacatgctgcccaacggcaccctgagcatccccaaggtgcaggtgtctgacagcggctactaccgctgtgtggccgtgaaccagcagggcgctgaccacttcaccgtgggcatcaccgtgaccaagaagggcagcggcctgcccagcaagagaggaagaagacctggggccaaggccctgagccgggtgagagaagatattgtggaggatgagggcggcagcggcatgggagatgaggagaacaccagccggcggctgctgcaccccaaggaccaggaggtgttcctgaagaccaaggatgatgccatcaacggggacaagaaggccaagaagggccgcaggaagctgaagctgtggaagcacagcgagaaggagcctgagaccaacgtggccgagggccggcgggtgtttgagagcagaagacgcatcaacatggccaacaagcagatcaaccctgagcgctgggccgacatcctggccaaggtgcggggcaagaacctgcccaagggcacagaggtgcccccactcatcaagaccaccagcccccccagcctgagcctggaggtgaccccacccttccctgccatcagcccccccagcgccagccctgtgcagacagtgaccagcgctgaggagagcagcgcagatgtgcccctgctgggggaggaggagcacgtgctgggcaccatcagcagcgcctccatgggcctggagcacaaccacaacggggtcatcctggtggagcctgaggtgaccagcacccccctggaggaggtggtggatgacctgtctgagaagacagaggagatcaccagcacagaaggagacctgaagggcacagctgcccccaccctcatcagcgagccctatgagcccagccccaccctgcacaccctggacacagtgtatgagaagcccacccatgaggagacagccacagagggctggagcgctgctgatgtgggcagcagccctgagcccaccagcagtgaatatgagccccccctggatgctgtgtccctggccgagagcgagcccatgcagtactttgatcctgacctggagaccaagagccagccagatgaggacaagatgaaggaggacacctttgcccacctgacccccacccccaccatctgggtgaatgacagcagcaccagccagctgtttgaggacagcaccatcggggagcccggggtgcccggccagagccacctgcagggcctgacagacaacatccacctggtgaagagcagcctgagcacccaggacaccctgctgatcaagaagggcatgaaggagatgagccagaccctgcagggcggcaacatgctggagggggaccccacccacagccgcagcagcgagagcgagggccaggagagcaagagcatcaccctgcctgacagcaccctgggcatcatgagctccatgagccctgtgaagaagccagctgagaccaccgtgggcaccctgctggacaaggacaccaccacagccaccaccaccccccggcagaaggtggcccccagcagcaccatgagcacccaccccagcagaagaagacccaacggcagaagaaggctgcggcccaacaagttccgccaccgccacaagcagaccccacccaccacctttgcccccagcgagaccttcagcacccagcccacccaggccccagacatcaagatcagcagccaggtggagagcagcctggtgcccacagcctgggtggacaacacagtgaacacccccaagcagctggagatggagaagaatgctgagcccaccagcaagggcacccccaggaggaagcacggcaagaggcccaacaagcaccgctacacccccagcacagtgagcagccgggccagcggcagcaagcccagccccagccctgagaacaagcacaggaacatcgtgacccccagcagcgagaccatcctgctgcccaggacagtgtccctgaagacagagggcccctatgacagcctggactacatgaccaccaccaggaagatctacagcagctaccccaaggtgcaggagaccctgcctgtgacctacaagcccaccagtgatggcaaggagatcaaggatgatgtggccaccaacgtggacaagcacaagagtgacatcctggtgactggagagagcatcaccaatgccatccccaccagccgcagcctggtgtccaccatgggagagttcaaggaggagagcagccctgtgggcttccctggcacccccacctggaaccccagcaggacagcccagcccggccgcctgcagacaggcatccctgtgaccaccagcggggagaacctgacagatcctcccctgctgaaggagctggaggatgtggacttcaccagcgagttcctgagcagcctgactgtgtccacccccttccaccaggaggaggccggcagcagcaccaccctgagcagcatcaaggtggaggtggccagcagccaggccgagaccaccaccctggaccaggaccacctggagaccaccgtggccatcctgctgtctgagacccggccccagaaccacacccccacagctgccaggatgaaggagcccgccagcagcagccccagcaccatcctgatgagcctgggccagaccaccaccaccaagccagccctgcccagcccccgcatcagccaggccagccgggacagcaaagaaaatgtgttcctgaactacgtgggcaaccctgagacagaggccacccctgtgaacaatgaaggcacccagcacatgagcggccccaatgagctgagcacccccagcagtgaccaggatgccttcaacctgagcaccaagctggagctggagaagcaggtgtttggcagccgcagcctgccccggggccctgacagccagaggcaggacggccgggtgcacgccagccaccagctgaccagggtgcctgccaagcccatcctgcccacagccaccgtgcggctgcctgagatgagcacccagagcgccagccgctactttgtgaccagccagagccccaggcactggaccaacaagccagagatcaccacctaccccagcggggccctgcctgagaacaagcagttcaccaccccccggctgagcagcaccaccatccccctgcccctgcacatgagcaagcccagcatccccagcaagttcacagacagaagaacagaccagttcaacggctacagcaaggtgtttggaaacaacaacatccctgaggccagaaatcctgtgggcaagccacccagcccccgcatcccccactacagcaatggccgcctgcccttcttcaccaacaagaccctgtccttcccccagctgggcgtgacccggcggccccagatccccaccagccctgcccctgtgatgagggagaggaaggtgattcctggcagctacaaccgcatccacagccacagcaccttccacctggactttggccccccagccccacccctgctgcacaccccccagaccaccggcagccccagcaccaacctgcagaacatccccatggtgagcagcacccagagcagcatctccttcatcaccagctctgtgcagagcagcggcagcttccaccagagcagcagcaagttctttgctgggggccccccagccagcaagttctggagcctgggggagaagccccagatcctgaccaagagcccccagacagtgtctgtgacagctgagacagacacagtgttcccctgtgaggccaccgggaagcccaagccctttgtgacctggaccaaggtgtccactggagccctgatgacccccaacacccgcatccagagatttgaggtgctgaagaatggcaccctggtgatcaggaaggtgcaggtgcaggaccggggccagtacatgtgcacagccagcaacctgcacggcctggacaggatggtggtgctgctgtctgtgacagtgcagcagccccagatcctggccagccactaccaggatgtgacagtgtacctgggggacaccatcgccatggagtgcctggccaagggcaccccagccccccagatctcctggatcttcccagacagaagagtgtggcagacagtgtcccctgtggagggccgcatcaccctgcacgagaacagaaccctgagcatcaaggaggccagcttcagtgacagaggagtgtacaagtgtgtggccagcaatgctgctggagctgacagcctggccatccggctgcacgtggccgccctgccccctgtgatccaccaggagaagctggagaacatcagcctgcccccaggcctgagcatccacatccactgcacagccaaggccgcccccctgcccagcgtgcgctgggtgctgggagatggcacccagatccggcccagccagttcctgcacggcaacctgtttgtgttccccaacggcaccctgtacatccggaacctggcccccaaggacagcggccgctatgaatgtgtggccgccaacctggtgggcagcgcccggaggacagtgcagctgaatgtgcagagagctgctgccaatgcccgcatcaccggcaccagccccaggagaacagatgtgcgctatggaggcaccctgaagctggactgcagcgccagcggggacccctggccccgcatcctgtggaggctgcccagcaagaggatgattgatgccctcttctcctttgacagccgcatcaaggtgtttgccaacggcaccctggtggtgaagtctgtgacagacaaggatgctggggactacctgtgtgtggccaggaacaaggtgggagatgattatgtggtgctgaaggtggatgtggtgatgaagccagccaagattgagcacaaggaggagaatgaccacaaggtgttctatggaggagacctgaaggtggactgtgtggccaccggcctgcccaaccctgagatctcctggagcctgcctgatggcagcctggtgaacagcttcatgcagagtgatgacagcggcggccgcaccaagagatatgtggtgttcaacaacggcaccctgtacttcaatgaggtgggcatgagggaggagggggactacacctgctttgctgagaaccaggtgggcaaggatgagatgagggtgcgggtgaaggtggtgacagccccagccaccatccggaacaagacctacctggccgtgcaggtgccctatggagatgtggtgacagtggcctgtgaggccaagggggagcccatgcccaaggtgacctggctgagccccaccaacaaggtgatccccaccagcagcgagaagtaccagatctaccaggacggcaccctgctgatccagaaggcccagaggagtgacagcggcaactacacctgcctggtgagaaattctgctggggaggacaggaagacagtgtggatccacgtgaatgtgcagccccccaagatcaatggaaaccccaaccccatcaccaccgtgcgggagattgctgctgggggcagcaggaagctgattgactgcaaggccgagggcatccccaccccccgggtgctgtgggccttccctgagggcgtggtgctgcctgccccctactacggcaaccgcatcaccgtgcacggcaatggcagcctggacatccgcagcctgaggaagagtgacagcgtgcagctggtgtgcatggccagaaatgaaggaggagaggcccggctcatcctgcagctgactgtgctggagcccatggagaagcccatcttccatgaccccatcagcgagaagatcacagccatggccggccacaccatcagcctgaactgcagcgctgctggcacccccacccccagcctggtgtgggtgctgcccaacggcacagacctgcagagcggccagcagctgcagcgcttctaccacaaggcagatggcatgctgcacatcagcggcctgagctctgtggatgctggggcctaccgctgtgtggccagaaatgctgctggccacacagagcggctggtgtccctgaaggtgggcctgaagccagaggccaacaagcagtaccacaacctggtgtccatcatcaatggagagaccctgaagctgccctgcaccccacctggggccggccagggccgcttctcctggaccctgcccaacggcatgcacctggagggcccccagaccctgggccgggtgtccctgctggacaatggcaccctgactgtgcgggaggcctctgtgtttgaccggggcacctacgtgtgcaggatggagacagaatatggccccagcgtgaccagcatccctgtgattgtgattgcctacccaccccgcatcaccagcgagcccacccctgtgatctacaccaggcctggcaacacagtgaagctgaactgcatggccatgggcatccccaaggctgacatcacctgggagctgcctgacaagagccacctgaaggccggcgtgcaggcccggctgtatggcaaccgcttcctgcacccccagggcagcctgaccatccagcacgccacccagagagatgctggcttctacaagtgcatggccaagaacatcctgggcagtgacagcaagaccacctacatccacgtgttctag

SEQ ID NO: 39898 - DNA, 1272 bp, Artificial Sequence
  Description of Artificial Sequence: Synthetic coding sequence
atggtgtttgccttctggaaggtgttcctgatcctgagctgcctggccggccaggtgtctgtggtgcaggtgaccatcccagatggctttgtgaatgtgacagtgggcagcaatgtgaccctcatctgcatctacaccaccaccgtggccagccgggagcagctgagcatccagtggagcttcttccacaagaaggagatggagcccatcagccacagcagctgcctgagcacagagggcatggaggagaaggctgtgtcccagtgcctgaagatgacccacgccagagatgcccggggccgctgctcctggaccagcgagatctacttcagccagggcggccaggccgtggccatcggccagttcaaggaccgcatcaccggcagcaatgaccctggaaatgccagcatcaccatcagccacatgcagcctgctgacagcggcatctacatctgtgatgtgaacaaccccccagacttcctgggccagaaccagggcatcctgaatgtgtctgtgctggtgaagcccagcaagcccctgtgcagcgtgcagggccggcctgagaccggccacaccatcagcctgagctgcctgagcgccctgggcacccccagccctgtgtactactggcacaagctggagggccgggacatcgtgcctgtgaaggagaacttcaaccccaccaccggcatcctggtgattggcaacctgaccaactttgagcagggctactaccagtgcacagccatcaaccggctgggcaacagcagctgtgaaattgacctgaccagcagccaccctgaggtgggcatcatcgtgggcgccctgattggcagcctggtgggcgccgccatcatcatctctgtggtgtgctttgccaggaacaaggccaaggccaaggccaaggagaggaacagcaagaccatcgccgagctggagcccatgaccaagatcaaccccagaggagagagcgaggccatgccccgggaggatgccacccagctggaggtgaccctgcccagcagcatccacgagaccggccctgacaccatccaggagccagactatgagcccaagcccacccaggagcccgcccctgagcccgcccctggcagcgagcccatggctgtgcctgacctggacatcgagctggagctggagcctgagacccagagcgagctggagcctgagcctgagcctgagcctgagagcgagcccggggtggtggtggagcccctgtctgaagatgagaagggcgtggtgaaggcctag

SEQ ID NO: 39899 - DNA, 1623 bp, Artificial Sequence
  Description of Artificial Sequence: Synthetic coding sequence
atggctgctgggggcagcgcccctgagccccgggtgctggtgtgcctgggcgccctgctggccggctgggtggccgtgggcctggaggccgtggtgattggagaggtgcatgaaaatgtgaccctgcactgcggcaacatcagcggcctgcggggccaggtgacctggtacagaaacaacagcgagcctgtgttcctgctgagcagcaacagcagcctgcggcctgctgagccccgcttcagcctggtggatgccaccagcctgcacatcgagagcctgagcctgggagatgagggcatctacacctgccaggagatcctgaatgtgacccagtggttccaggtgtggctgcaggtggccagcggcccctaccagatcgaggtgcacatcgtggccaccggcaccctgcccaacggcaccctgtatgctgcccggggcagccaggtggacttcagctgcaacagcagcagcaggcctcctcctgtggtggagtggtggttccaggccctgaacagcagcagcgagagctttggccacaacctgactgtgaacttcttcagcctgctgctgatcagccccaacctgcagggcaactacacctgcctggccctgaaccagctgagcaagaggcacaggaaggtgaccacagagctgctggtgtactaccccccacccagcgccccccagtgctgggcccagatggccagcggcagcttcatgctgcagctgacctgccgctgggatggcggctacccagaccctgacttcctgtggattgaggagcccggcggcgtcatcgtgggcaagagcaagctgggcgtggagatgctgtctgagagccagctgagtgatggcaagaagttcaagtgtgtgaccagccacatcgtgggccctgagagcggggccagctgcatggtgcagatccggggccccagcctgctgtctgagcccatgaagacctgcttcaccggcggcaatgtgaccctgacctgccaggtgtctggggcctaccccccagccaagatcctgtggctgaggaacctgacccagcctgaggtgatcatccagcccagcagccgccacctgatcacccaggacggccagaacagcaccctgaccatccacaactgcagccaggacctggatgagggctactacatctgcagagctgacagccctgtgggcgtgcgggagatggagatctggctgtctgtgaaggagcccctgaacattggaggcatcgtgggcaccatcgtgtccctgctgctgctgggcctggccatcatcagcggcctgctgctgcactacagccctgtgttctgctggaaggtgggcaacaccagccggggccagaacatggatgatgtgatggtgctggtggacagcgaggaggaggaggaggaggaggaggaggaggaggaggatgctgctgtgggggagcaggagggcgcccgggagcgggaggagctgcccaaggagatccccaagcaggaccacatccaccgggtgacagccctggtgaatggaaatattgagcagatgggaaatggcttccaggacctgcaggatgacagcagcgaggagcagagcgacatcgtgcaggaggaggacaggcctgtgtag

SEQ ID NO: 39900 - DNA, 2604 bp, Artificial Sequence
  Description of Artificial Sequence: Synthetic coding sequence
atggacaacccccaggccctgcccctcttcctgctgctggccagcctggtgggcatcctgaccctgcgggccagcagcggcctgcagcagaccaacttcagcagcgccttcagcagtgacagcaagagcagcagccagggcctgggcgtggaggtgcccagcatcaagcccccatcctggaaggtgcctgaccagttcctggacagcaaggccagcgctggcatcagtgacagctcctggttccctgaggccctgagcagcaacatgagcggcagcttctggagcaatgtgtctgctgagggccaggacctgagccctgtgagccccttcagcgagaccccaggcagcgaggtgtttcctgacatcagtgacccccaggtgcctgccaaggaccccaagcccagcttcaccgtgaagaccccagccagcaacatcagcacccaggtgagccacaccaagctgtctgtggaggccccagacagcaagttctccccagatgacatggacctgaagctgagcgcccagagccctgagagcaagttctctgctgagacccacagcgctgccagcttcccccagcaggtgggcggccccctggccgtgctggtgggcaccaccatccggctgcccctggtgcccatccccaaccctggcccccccaccagcctggtggtgtggaggcggggcagcaaggtgctggccgccggcggcctgggccctggggcccccctcatcagcctggaccctgcccaccgggaccacctgcgctttgaccaggcccggggcgtgctggagctggccagcgcccagctggatgatgctggggtgtacacagctgaggtgatccgggccggcgtgtcccagcagacccatgagttcaccgtgggcgtgtatgagcccctgccccagctgtctgtgcagcccaaggcccctgagacagaggagggcgctgctgagctgcggctgcgctgcctgggctggggccctggccgcggggagctgtcctggagcagagatggccgggccctggaggccgctgagagcgagggcgctgagacccccaggatgaggtctgagggggaccagctgctgattgtgcggcctgtgcggagtgaccacgcccgctacacctgccgggtgcgcagccccttcggccaccgggaggccgctgctgatgtgtctgtgttctacggccctgacccccccaccatcaccgtgtccagtgacagagatgctgccccagccaggtttgtgacagctggcagcaatgtgaccctgcgctgtgccgccgccagccggcccccagctgacatcacctggagcctggccgaccctgctgaggccgctgtgcctgctggcagccggctgctgctgcctgctgtgggccctggccacgccggcacctacgcctgcctggccgccaaccccaggactggaagaagaagaagaagcctgctgaacctgactgtggccgacctgcccccaggggccccccagtgcagcgtggagggcggccctggggacaggagcctgcgcttccgctgctcctggccaggaggagccccagctgccagcctgcagttccagggcctgcctgagggcatccgggccggccctgtgtcctctgtgctgctggccgctgtgcctgcccacccccggctgtctggagtgcccatcacctgcctggcccggcacctggtggccaccaggacctgcaccgtgaccccagaggccccccgggaggtgctgctgcaccccctggtggccgagacccggctgggggaggccgaggtggccctggaggccagcggctgccccccacccagccgggcctcctgggcccgggagggccggcccctggcccctgggggcggcagccggctgcggctgagccaggacggcaggaagctgcacatcggcaacttcagcctggactgggacctgggcaactacagcgtgctgtgcagcggggccctgggcgccggcggggaccagatcaccctgattggccccagcatcagctcctggaggctgcagagggccagagatgctgctgtgctgacctgggatgtggagcggggggccctgatcagcagctttgagatccaggcctggccagatggccctgccctgggccgcaccagcacctacagagactgggtgtccctgctgatcctgggcccccaggagaggtctgctgtggtgcccctgccccccaggaaccctggcacctggaccttccgcatcctgcccatcctgggcggccagcccggcacccccagccagagccgggtgtaccgggccggccccaccctgagccacggggccatcgccggcatcgtgctgggcagcctgctgggcctggccctgctggccgtgctgctgctgctgtgcatctgctgcctgtgccgcttccggggcaagaccccagagaagaagaagcaccccagcaccctggtgcctgtggtgacccccagcgagaagaagatgcacagcgtgacccctgtggagatctcctggcccctggacctgaaggtgcccctggaggaccacagcagcacccgggcctaccaggcccagacccctgtgcagctgagcctgtag

SEQ ID NO: 39901 - DNA, 147 bp, Artificial Sequence
  Description of Artificial Sequence: Synthetic coding sequence
atggacaacccccaggccctgcccctcttcctgctgctggccagcctggtgggcatcctgaccctgcgggccagcagcggcctgcagcagaccaacttcagcagcgccctgcaccgggccttctgggcccggaccagctacttctag

SEQ ID NO: 39902 - DNA, 1200 bp, Artificial Sequence
  Description of Artificial Sequence: Synthetic coding sequence
atgggcatcctgctgggcctgctgctgctgggccacctgactgtggacacctacggccggcccatcctggaggtgcctgagagcgtgacaggcccctggaagggagatgtgaacctgccctgcacctatgaccccctgcagggctacacccaggtgctggtgaagtggctggtgcagaggggcagtgaccctgtgaccatcttcctgcgggacagcagcggggaccacatccagcaggccaagtaccagggccgcctgcacgtgagccacaaggtgcctggagatgtgtccctgcagctgagcaccctggagatggatgacaggagccactacacctgtgaggtgacctggcagaccccagatggcaaccaggtggtgcgggacaagatcacagagctgcgggtgcagaagctgtctgtgtccaagcccaccgtgaccactggaagtggctacggcttcaccgtgccccagggcatgaggatcagcctgcagtgccaggcccggggcagcccccccatctcctacatctggtacaagcagcagaccaacaaccaggagcccatcaaggtggccaccctgagcaccctgctcttcaagccagctgtgattgctgacagcggcagctacttctgcacagccaagggccaggtgggcagcgagcagcacagcgacatcgtgaagtttgtggtgaaggacagcagcaagctgctgaagaccaagacagaggcccccaccaccatgacctaccccctgaaggccaccagcacagtgaagcagagctgggactggaccacagacatggatggctacctgggggagaccagcgctggccctgggaagagcctgcctgtgtttgccatcatcctgatcatcagcctgtgctgcatggtggtgttcaccatggcctacatcatgctgtgcaggaagaccagccagcaggagcacgtgtatgaagctgcccgggcccacgcccgggaggccaatgacagcggggagaccatgagggtggccatctttgccagcggctgcagcagtgatgagcccaccagccagaacctgggcaacaactacagtgatgagccctgcatcggccaggagtaccagatcatcgcccagatcaatggaaattatgcccggctgctggacacagtgcccctggactatgagttcctggccacagagggcaagtctgtgtgctag

SEQ ID NO: 39903 - DNA, 918 bp, Artificial Sequence
  Description of Artificial Sequence: Synthetic coding sequence
atgggcatcctgctgggcctgctgctgctgggccacctgactgtggacacctacggccggcccatcctggaggtgcctgagagcgtgacaggcccctggaagggagatgtgaacctgccctgcacctatgaccccctgcagggctacacccaggtgctggtgaagtggctggtgcagaggggcagtgaccctgtgaccatcttcctgcgggacagcagcggggaccacatccagcaggccaagtaccagggccgcctgcacgtgagccacaaggtgcctggagatgtgtccctgcagctgagcaccctggagatggatgacaggagccactacacctgtgaggtgacctggcagaccccagatggcaaccaggtggtgcgggacaagatcacagagctgcgggtgcagaagcacagcagcaagctgctgaagaccaagacagaggcccccaccaccatgacctaccccctgaaggccaccagcacagtgaagcagagctgggactggaccacagacatggatggctacctgggggagaccagcgctggccctgggaagagcctgcctgtgtttgccatcatcctgatcatcagcctgtgctgcatggtggtgttcaccatggcctacatcatgctgtgcaggaagaccagccagcaggagcacgtgtatgaagctgcccgggcccacgcccgggaggccaatgacagcggggagaccatgagggtggccatctttgccagcggctgcagcagtgatgagcccaccagccagaacctgggcaacaactacagtgatgagccctgcatcggccaggagtaccagatcatcgcccagatcaatggaaattatgcccggctgctggacacagtgcccctggactatgagttcctggccacagagggcaagtctgtgtgctag

SEQ ID NO: 39904 - DNA, 606 bp, Artificial Sequence
  Description of Artificial Sequence: Synthetic coding sequence
atgggcatcctgctgggcctgctgctgctgggccacctgactgtggacacctacggccggcccatcctggaggtgcctgagagcgtgacaggcccctggaagggagatgtgaacctgccctgcacctatgaccccctgcagggctacacccaggtgctggtgaagtggctggtgcagaggggcagtgaccctgtgaccaccgtgaccaccggcagcggctacggcttcaccgtgccccagggcatgaggatcagcctgcagtgccaggcccggggcagcccccccatctcctacatctggtacaagcagcagaccaacaaccaggagcccatcaaggtggccaccctgagcaccctgctcttcaagccagctgtgattgctgacagcggcagctacttctgcacagccaagggccaggtgggcagcgagcagcacagcgacatcgtgaagtttgtggtgaaggacagcagcaagctgctgaagaccaagacagaggcccccaccaccatgacctaccccctgaaggccaccagcacagtgaagcagagctgggactggaccacagacatggatggctacctgggggagaccagcgctggcccctag

SEQ ID NO: 39905 - DNA, 825 bp, Artificial Sequence
  Description of Artificial Sequence: Synthetic coding sequence
tgagaccacatccagcaggccaagtaccagggccgcctgcacgtgagccacaaggtgcctggagatgtgtccctgcagctgagcaccctggagatggatgacaggagccactacacctgtgaggtgacctggcagaccccagatggcaaccaggtggtgcgggacaagatcacagagctgcgggtgcagaagctgtctgtgtccaagcccaccgtgaccaccggcagcggctacggcttcaccgtgccccagggcatgaggatcagcctgcagtgccaggcccggggcagcccccccatctcctacatctggtacaagcagcagaccaacaaccaggagcccatcaaggtggccaccctgagcaccctgctcttcaagccagctgtgattgctgacagcggcagctacttctgcacagccaagggccaggtgggcagcgagcagcacagcgacatcgtgaagtttgtggtgaaggacagcagcaagctgctgaagaccaagacagaggcccccaccaccatgacctaccccctgaaggccaccagcacagtgaagcagagctgggactggaccacagacatggatggctacctgggggagaccagcgctggccctgggaagagcctgcctgtgtttgccatcatcctgatcatcagcctgtgctgcatggtggtgttcaccatggcctacatcatgctgtgcaggaagaccagccagcaggagcacgtgtatgaggccgccagccccaagtgcccccccaccaacacaggagctgctggcagccactggctgtgccccggcatctgccagatgcacctgaagtag

SEQ ID NO: 39906 - DNA, 966 bp, Artificial Sequence
  Description of Artificial Sequence: Synthetic coding sequence
atgggcatcctgctgggcctgctgctgctgggccacctgactgtggacacctacggccggcccatcctggaggtgcctgagagcgtgacaggcccctggaagggagatgtgaacctgccctgcacctatgaccccctgcagggctacacccaggtgctggtgaagtggctggtgcagaggggcagtgaccctgtgaccatcttcctgcgggacagcagcggggaccacatccagcaggccaagtaccagggccgcctgcacgtgagccacaaggtgcctggagatgtgtccctgcagctgagcaccctggagatggatgacaggagccactacacctgtgaggtgacctggcagaccccagatggcaaccaggtggtgcgggacaagatcacagagctgcgggtgcagaagctgtctgtgtccaagcccaccgtgaccactggaagtggctacggcttcaccgtgccccagggcatgaggatcagcctgcagtgccaggcccggggcagcccccccatctcctacatctggtacaagcagcagaccaacaaccaggagcccatcaaggtggccaccctgagcaccctgctcttcaagccagctgtgattgctgacagcggcagctacttctgcacagccaagggccaggtgggcagcgagcagcacagcgacatcgtgaagtttgtggtgaaggacagcagcaagctgctgaagaccaagacagaggcccccaccaccatgacctaccccctgaaggccaccagcacagtgaagcagagctgggactggaccacagacatggatggctacctgggggagaccagcgctggccctgggaagagcctgcctgtgtttgccatcatcctgatcatcagcctgtgctgcatggtggtgttcaccatggcctacatcatgctgtgcaggaagaccagccagcaggagcacgtgtatgaagctgccaggtag

SEQ ID NO: 39907 - DNA, 1245 bp, Artificial Sequence
  Description of Artificial Sequence: Synthetic coding sequence
atgagggtgggcggggccttccacctgctgctggtgtgcctgagccctgccctgctgtctgctgtgcgcatcaatggagatggccaggaggtgctgtacctggccgagggggacaacgtgcggctgggctgcccctacgtgctggaccctgaagattatggccccaacggcctggacatcgagtggatgcaggtgaacagcgaccctgcccaccaccgggagaatgtgttcctgagctaccaggacaagaggatcaaccacggcagcctgccccacctgcagcagagggtgcgctttgctgccagtgaccccagccagtatgatgccagcatcaacctgatgaacctgcaggtgtctgacacagccacctatgaatgtcgggtgaagaagaccaccatggccaccaggaaggtgattgtgacagtgcaggcccggcctgctgtgcccatgtgctggacagagggccacatgacctatggaaatgatgtggtgctgaagtgctacgccagcggcggcagccagcccctgagctacaagtgggccaagatcagcggccaccactacccctaccgggccggcagctacaccagccagcacagctaccacagcgagctgagctaccaggagagcttccacagcagcatcaaccagggcctgaacaatggagacctggtgctgaaggacatcagcagagcagatgatggcctgtaccagtgcaccgtggccaacaacgtgggctacagcgtgtgtgtggtggaggtgaaggtgtctgacagccgccgcatcggggtcatcatcggcatcgtgctgggcagcctgctggccctgggctgcctggccgtgggcatctggggcctggtgtgctgctgctgcggcggcagcggggccggcggggcccggggggccttcggctatggaaatggaggcggcgtgggcggcggggcctgtggggacctggccagcgagatcagagaagatgctgtggcccctggctgcaaggccagcggccggggcagccgggtgacccacctgctgggctaccccacccagaatgtgagccgcagcctgcggaggaaatatgcccccccaccctgtggcggcccagaagatgtggccctggccccctgcacagctgctgctgcctgtgaggccggccccagccctgtgtatgtgaaggtgaagtctgctgagcctgctgactgtgccgagggccctgtgcagtgcaagaatggcctgctggtgtag

SEQ ID NO: 39908 - DNA, 576 bp, Artificial Sequence
  Description of Artificial Sequence: Synthetic coding sequence
atgaggctgctggccctggccgctgctgccctgctggcccgggccccagcccctgaggtgtgtgccgccctgaatgtgacagtgtccccaggccctgtggtggactacctggagggggagaatgccaccctgctgtgccacgtgtcccagaagaggaggaaggacagcctgctggccgtgcgctggttctttgcccacagctttgacagccaggaggccctgatggtgaagatgaccaagctgcgggtggtgcagtactacggcaacttcagccgcagcgccaagagaagaaggctgcggctgctggaggagcagagaggagccctgtaccgcctgtctgtgctgaccctgcagcccagcgaccagggccactacgtgtgccgggtgcaggagatcagccgccacaggaacaagtggacagcctggagcaatggcagcagcgccacagagatgagaggagtgagcagccaccctgtggagcggggggccttcctgggcatcagcctggtgatcctgccccacagcctgcccttcaccgctgacctgaccatggccagcttcctgcagagcagctag

SEQ ID NO: 39909 - DNA, 963 bp, Artificial Sequence
  Description of Artificial Sequence: Synthetic coding sequence
atgaggctgctggccctggccgctgctgccctgctggcccgggccccagcccctgaggtgtgtgccgccctgaatgtgacagtgtccccaggccctgtggtggactacctggagggggagaatgccaccctgctgtgccacgtgtcccagaagaggaggaaggacagcctgctggccgtgcgctggttctttgcccacagctttgacagccaggaggccctgatggtgaagatgaccaagctgcgggtggtgcagtactacggcaacttcagccgcagcgccaagagaagaaggctgcggctgctggaggagcagagaggagccctgtaccgcctgtctgtgctgaccctgcagcccagcgaccagggccactacgtgtgccgggtgcaggagatcagccgccacaggaacaagtggacagcctggagcaatggcagcagcgccacagagatgagggtcatcagcctgaaggccagcgaggagagcagctttgagaagaccaaggagacctgggccttctttgaggacctgtatgtgtatgctgtgctggtgtgctgcgtgggcatcctgagcatcctgctcttcatgctggtgattgtgtggcagagcgtcttcaacaagaggaagagccgggtgcgccactacctggtgaagtgcccccagaacagcagcggggagaccgtgacctctgtgaccagcctggcccccctgcagcccaagaagggcaagaggcagaaggagaagccagacatccccccagctgtgcctgccaaggcccccatcgcccccaccttccacaagcccaagctgctgaagccccagaggaaggtgaccctgcccaagattgctgaggagaacctgacctacgccgagctggagctgatcaagccccaccgggccgccaagggggcccccaccagcacagtgtatgcccagatcctgtttgaggagaacaagctgtag

SEQ ID NO: 39910 - DNA, 603 bp, Artificial Sequence
  Description of Artificial Sequence: Synthetic coding sequence
atgaggcccctgcccagcggccgcaggaagacccggggcatcagcctgggcctgtttgccctgtgcctggccgccgcccgctgcctgcagagccagggcgtgtccctgtacatcccccaggccaccatcaatgccaccgtgaaggaggacatcctgctgtctgtggagtacagctgccacggcgtgcccaccatcgagtggacctacagcagcaactggggcacccagaagatcgtggagtggaagccaggcacccaggccaacatcagccagagccacaaggacagagtgtgcacctttgacaatggcagcatccagctgttctctgtgggcgtgcgggacagcggctactacgtgatcaccgtgacagagcggctgggcagcagccagtttggcaccatcgtgctgcacgtgtctgagatcctgtatgaggacctgcactttgtggccgtcatcctggccttcctggccgctgtggccgctgtgctgatcagcctgatgtgggtgtgcaacaagtgtgcctacaagttccagaggaagagaagacacaagctgaaggagagcaccacagaggagattgagctggaggatgtggagtgctag

SEQ ID NO: 39911 - DNA, 501 bp, Artificial Sequence
  Description of Artificial Sequence: Synthetic coding sequence
atggccagcctgggccagatcctcttctggagcatcatcagcatcatcatcatcctggccggggccatcgccctgatcattggatttggcatcagcgccttctccatgcctgaggtgaatgtggactacaatgccagcagcgagaccctgcgctgtgaggccccccgctggttcccccagcccaccgtggtgtgggccagccaggtggaccagggcgccaacttcagcgaggtgagcaacaccagctttgagctgaacagtgaaaatgtgaccatgaaggtggtgtctgtgctgtacaacgtgaccatcaacaacacctacagctgcatgattgaaaatgacatcgccaaggccactggagacatcaaggtgacagaaagtgagatcaagagaagaagccacctgcagctgctgaacagcaaggccagcctgtgtgtgagcagcttctttgccatctcctgggccctgctgcccctgagcccctacctgatgctgaagtag

SEQ ID NO: 39912 - DNA, 858 bp, Artificial Sequence
  Description of Artificial Sequence: Synthetic coding sequence
atggtgctgctgaccagcaggatgaagcccctgaccagccgcatcatcagcatcatcatcatcctggccggggccatcgccctgatcatcggcttcggcatcagcggccgccacagcatcaccgtgaccaccgtggccagcgctggcaacattggagaagatggcatcctgagctgcacctttgagccagacatcaagctgagtgacatcgtcatccagtggctgaaggagggcgtgctgggcctggtgcatgagttcaaggagggcaaggatgagctgtctgagcaggatgagatgttccggggccgcacagctgtgtttgctgaccaggtgattgtgggcaatgccagcctgcggctgaagaatgtgcagctgacagatgctggcacctacaagtgctacatcatcaccagcaaaggaaaaggaaatgccaacctggagtacaagacaggagccttctccatgcctgaggtgaatgtggactacaatgccagcagcgagaccctgcgctgtgaggccccccgctggttcccccagcccaccgtggtgtgggccagccaggtggaccagggcgccaacttcagcgaggtgagcaacaccagctttgagctgaacagtgaaaatgtgaccatgaaggtggtgtctgtgctgtacaacgtgaccatcaacaacacctacagctgcatgattgaaaatgacatcgccaaggccaccggggacatcaaggtgacagagagcgagatcaagaggaggagccacctgcagctgctgaacagcaaggccagcctgtgtgtgtcctccttctttgccatctcctgggccctgctgcccctgagcccctacctgatgctgaagtag

SEQ ID NO: 39913 - DNA, 258 bp, Artificial Sequence
  Description of Artificial Sequence: Synthetic coding sequence
gccaccctgaggaacaagctgatgtggaacatcatcagcatcatcatcatcctggccggggccatcgccctgatcatcggcttcggcatcagcgaggtgtctgtgtggctgagcgccatgaagggctgccgcagcagcaaggccagcctgagcattgacctgtgcttcctgaactgccgggagaccctgcaccacagccactactgccgcctgtcctgggagcactggggcggctggaaccctgagctgcacttctag

SEQ ID NO: 39914 - DNA, 849 bp, Artificial Sequence
  Description of Artificial Sequence: Synthetic coding sequence
atggccagcctgggccagatcctcttctggagcatcatcagcatcatcatcatcctggccggggccatcgccctgatcattggatttggcatcagcggccgccacagcatcaccgtgaccaccgtggccagcgctggcaacatcggggaggatggcatcctgagctgcacctttgagccagacatcaagctgagtgacatcgtcatccagtggctgaaggagggcgtgctgggcctggtgcatgagttcaaggagggcaaggatgagctgtctgagcaggatgagatgttccggggccgcacagctgtgtttgctgaccaggtgattgtgggcaatgccagcctgcggctgaagaatgtgcagctgacagatgctggcacctacaagtgctacatcatcaccagcaagggcaaaggaaatgccaacctggagtacaagacaggagccttctccatgcctgaggtgaatgtggactacaatgccagcagcgagaccctgcgctgtgaggccccccgctggttcccccagcccaccgtggtgtgggccagccaggtggaccagggcgccaacttcagcgaggtgagcaacaccagctttgagctgaacagtgaaaatgtgaccatgaaggtggtgtctgtgctgtacaacgtgaccatcaacaacacctacagctgcatgattgaaaatgacatcgccaaggccactggagacatcaaggtgacagaaagtgagatcaagagaagaagccacctgcagctgctgaacagcaaggccagcctgtgtgtgagcagcttctttgccatctcctgggccctgctgcccctgagcccctacctgatgctgaagtag

SEQ ID NO: 39915 - DNA, 564 bp, Artificial Sequence
  Description of Artificial Sequence: Synthetic coding sequence
atgttccggggccgcacagctgtgtttgctgaccaggtgattgtgggcaatgccagcctgcggctgaagaatgtgcagctgacagatgctggcacctacaagtgctacatcatcaccagcaaaggaaaaggaaatgccaacctggagtacaagacaggagccttctccatgcctgaggtgaatgtggactacaatgccagcagcgagaccctgcgctgtgaggccccccgctggttcccccagcccaccgtggtgtgggccagccaggtggaccagggcgccaacttcagcgaggtgagcaacaccagctttgagctgaacagtgaaaatgtgaccatgaaggtggtgtctgtgctgtacaacgtgaccatcaacaacacctacagctgcatgattgaaaatgacatcgccaaggccaccggggacatcaaggtgacagagagcgagatcaagaggaggagccacctgcagctgctgaacagcaaggccagcctgtgtgtgtcctccttctttgccatctcctgggccctgctgcccctgagcccctacctgatgctgaagtag

SEQ ID NO: 39916 - DNA, 1434 bp, Artificial Sequence
  Description of Artificial Sequence: Synthetic coding sequence
atgtctggagtgatgtgcctgaaggccagtgacacctgggccagcggcatccgcagccagccccagggctgcctgggcaagtggaggtccatgcgctgcaagcacaccaggatgcacctggcccacctgggcaacagccggcagctgatcagcctgggcccccccaggaccagagaagatggcagccgcatcagccagcaggtggagcagagccgcagccaggtgcaggccatcggggagaaggtgtccctggcccaggccaagattgagaagatcaagggcagcaagaaggccatcaaggtgttcagcagcgccaagtacccagcccctgagcggctgcaggagtatggcagcatcttcacagatgcccaggaccccggcctgcagaggcggcccaggcaccgcatccagagcaagcagaggcccctggatgagcgggccctgcaggagaagctgaaggacttccctgtgtgtgtgtccaccaagccagagccagaagatgatgctgaggagggcctgggcggcctgcccagcaacatcagctctgtgagcagcctgctgctcttcaacaccacagaaaatctctacaagaagtatgtgttcctggaccccctggccggggctgtgaccaagacccacgtgatgctgggcgctgagacagaggagaagctgtttgatgcccccctgagcatcagcaagcgggagcagctggagcagcaggtgcctgagaactacttctacgtgcctgacctgggccaggtgcctgagattgatgtgcccagctacctgcctgacctgcccggcatcgccaatgacctgatgtacatcgctgacctgggccctggcatcgcccccagcgcccctggcaccatccctgagctgcccaccttccacacagaggtggccgagcccctgaaggtggacctgcaggatggagtgctgaccccacctcctcctcctcctcctcctcctccagcccctgaggtgctggccagcgccccacccctgccccccagcacagctgcccctgtgggccagggcgcccggcaggatgacagcagcagcagcgccagccccagcgtgcagggcgccccccgggaggtggtggaccccagcggcggctgggccaccctgctggagagcatccggcaggccggcggcatcggcaaggccaagctgcgctccatgaaggagaggaagctggagaagcagcagcagaaggagcaggagcaggtgcgggccaccagccagggcggccacctgatgtctgacctcttcaacaagctggtgatgaggaggaagggcatctctggaaaaggacctggagctggagatggccctggaggagcctttgcccgggtgtctgacagcatcccccccctgcccccaccccagcagccccaggccgaggatgaagatgactgggagagctag

SEQ ID NO: 39917 - DNA, 510 bp, Artificial Sequence
  Description of Artificial Sequence: Synthetic coding sequence
atgtctggagagatggccttccacgagatgcaggcccacaagaatgccctgggcaccagcggggagcagcaggccgctgacatcaccggccccaccccccaccagggcggctggaagcaggtggagcagagccgcagccaggtgcaggccatcggggagaaggtgtccctggcccaggccaagattgagaagatcaagggcagcaagaaggccatcaaggtgttcagcagcgccaagtacccagcccctgagcggctgcaggagtatggcagcatcttcacagatgcccaggaccccggcctgcagaggcggcccaggcaccgcatccagagcaagcagaggcccctggatgagcgggccctgcaggagaagctgaaggacttccctgtgtgtgtgtccaccaagccagagccagaagatgatgctgaggagggcctgggcggcctgcccagcaacatcagctctgtgagcagcctgctgctcttcaacaccacagagaacctgtactag

SEQ ID NO: 39918 - DNA, 1344 bp, Artificial Sequence
  Description of Artificial Sequence: Synthetic coding sequence
atggccttccacgagatgcaggcccacaagaatgccctgggcaccagcggggagcagcaggccgctgacatcaccggccccaccccccaccagggcggctggaagcaggtggagcagagccgcagccaggtgcaggccatcggggagaaggtgtccctggcccaggccaagattgagaagatcaagggcagcaagaaggccatcaaggtgttcagcagcgccaagtacccagcccctgagcggctgcaggagtatggcagcatcttcaccggggcccaggaccccggcctgcagaggcggcccaggcaccgcatccagagcaagcaccggcccctggatgagcgggccctgcaggagaagctgaaggacttccctgtgtgtgtgtccaccaagccagagccagaagatgatgctgaggagggcctgggcggcctgcccagcaacatcagctctgtgagcagcctgctgctcttcaacaccacagagaacctgtacaagaagtatgtgttcctggaccccctggccggggctgtgaccaagacccacgtgatgctgggcgctgagacagaggagaagctgtttgatgcccccctgagcatcagcaagcgggagcagctggagcagcaggtgcctgagaactacttctacgtgcctgacctgggccaggtgcctgagattgatgtgcccagctacctgcctgacctgcccagcatcgccaatgacctgatgtacagcgctgacctgggccctggcatcgcccccagcgcccctggcaccatccctgagctgcccaccttccacacagaggtggccgagcccctgaaggctgacctgcaggatggagtgctgaccccacctcctcctcctcctcctcctcctccagcccctgaggtgctggccagcgccccacccctgccccccagcacagctgcccctgtgggccagggcgcccggcaggatgatggcagcagcagcgccagccccagcgtgcagggcgccccccgggaggtggtggaccccagcggcggctgggccaccctgctggagagcatccggcaggccggcggcatcggcaaggccaagctgcgctccatgaaggagaggaagctggagaagaagaagcagaaggagcaggagcaggtgcgggccaccagccagggcggccacctgatgtctgacctcttcaacaagctggtgatgaggaggaagggcatcagcggcaagggccctggggccggggagggccctgggggcgcctttgcccgggtgtctgacagcatcccccctgtgcccccaccccagcagccccaggccgaggaggatgaagatgactgggagagctag

SEQ ID NO: 39919 - DNA, 1437 bp, Artificial Sequence
  Description of Artificial Sequence: Synthetic coding sequence
atgtctggagtgatgtgcctgaaggccagtgacacctgggccagcggcatccgcagccagccccagggctgcctgggcaagtggaggtccatgcgctgcaagcacaccaggatgcacctggcccacctgggcaacagccggcagctgatcagcctgggcccccccaggaccagagaagatggcagccgcatcagccagcaggtggagcagagccgcagccaggtgcaggccatcggggagaaggtgtccctggcccaggccaagattgagaagatcaagggcagcaagaaggccatcaaggtgttcagcagcgccaagtacccagcccctgagcggctgcaggagtatggcagcatcttcaccggggcccaggaccccggcctgcagaggcggcccaggcaccgcatccagagcaagcaccggcccctggatgagcgggccctgcaggagaagctgaaggacttccctgtgtgtgtgtccaccaagccagagccagaagatgatgctgaggagggcctgggcggcctgcccagcaacatcagctctgtgagcagcctgctgctcttcaacaccacagaaaatctctacaagaagtatgtgttcctggaccccctggccggggctgtgaccaagacccacgtgatgctgggcgctgagacagaggagaagctgtttgatgcccccctgagcatcagcaagcgggagcagctggagcagcaggtgcctgagaactacttctacgtgcctgacctgggccaggtgcctgagattgatgtgcccagctacctgcctgacctgcccagcatcgccaatgacctgatgtacagcgctgacctgggccctggcatcgcccccagcgcccctggcaccatccctgagctgcccaccttccacacagaggtggccgagcccctgaaggctgacctgcaggatggagtgctgaccccacctcctcctcctcctcctcctcctccagcccctgaggtgctggccagcgccccacccctgccccccagcacagctgcccctgtgggccagggcgcccggcaggatgatggcagcagcagcgccagccccagcgtgcagggcgccccccgggaggtggtggaccccagcggcggctgggccaccctgctggagagcatccggcaggccggcggcatcggcaaggccaagctgcgctccatgaaggagaggaagctggagaagaagaagcagaaggagcaggagcaggtgcgggccaccagccagggcggccacctgatgtctgacctcttcaacaagctggtgatgaggaggaagggcatctctggaaaaggacctggagctggggagggccctggaggagcctttgcccgggtgtctgacagcatcccccctgtgcccccaccccagcagccccaggccgaggaggatgaagatgactgggagagctag

SEQ ID NO: 39920 - DNA, 10581 bp, Artificial Sequence
  Description of Artificial Sequence: Synthetic coding sequence
atgaacatggtgaagaggatcatgggccggccccggcaggaggagtgcagcccccaggacaatgccctgggcctgatgcacctgcggcggctcttcacagagctgtgccacccccccaggcacatgacccagaaggagcaggaggagaagctgtacatgatgctgcccgtcttcaacagagtgtttggaaatgccccacccaacaccatgacagagaagttcagtgacctgctgcagttcaccacccaggtgtcccggctgatggtgacagagatcagaagaagagccagcaacaagagcacagaagctgccagccgggccatcgtgcagttcctggagatcaaccagagcgaggaggccagccggggctggatgctgctgaccaccatcaacctgctggccagcagcggccagaagacagtggactgcatgaccaccatgtctgtgcccagcaccctggtgaagtgcctgtacctgttctttgacctgccccacgtgcctgaggccgtgggcggggcccagaatgagctgcccctggccgagcggcggggcctgctgcagaaggtgtttgtgcagatcctggtgaagctgtgcagctttgtgtccccagctgaggagctggcccagaaggatgacctgcagctgctcttcagcgccatcacctcctggtgccccccctacaacctgccctggaggaagtctgctggggaggtgctgatgaccatcagcagacatggcctgtctgtgaatgtggtgaagtacatccacgagaaggaatgtctgagcacctgtgtgcagaacatgcagcagagtgatgacctgagccccctggagatcgtggagatgtttgctggcctgagctgcttcctgaaggacagcagtgatgtgtcccagaccctgctggatgacttccgcatctggcagggctacaacttcctgtgtgacctgctgctgcggctggagcaggccaaggaggccgagagcaaggatgccctgaaggacctggtgaacctgatcaccagcctgaccacctatggagtgtctgagctgaagccagctggcatcaccactggagcccccttcctgctgcccggctttgctgtgccccagcctgctgggaagggccacagcgtgagaaatgtgcaggcctttgctgtgctgcagaatgccttcctgaaggccaagaccagcttcctggcccagatcatcctggatgccatcaccaacatctacatggctgacaatgccaactacttcatcctggagagccagcacaccctgagccagtttgctgagaagatcagcaagctgcctgaggtgcagaacaagtactttgagatgctggagtttgtggtgttcagcctgaactacatcccctgcaaggagctgatctctgtgtccatcctgctgaagagcagcagcagctaccactgcagcatcatcgccatgaagaccctgctgaagttcaccaggcatgactacatcttcaaggatgtgttccgggaggtgggcctgctggaggtgatggtgaacctgctgcacaagtatgctgccctgctgaaggaccccacccaggccctgaatgagcagggcgacagcaggaacaacagctctgtggaggaccagaagcacctggccctgctggtgatggagaccctgactgtgctgctgcagggcagcaacaccaatgccggcatcttccgggagtttggaggagcccgctgtgcccacaacatcgtgaagtacccccagtgccggcagcacgccctgatgaccatccagcagctggtgctgagccccaatggagatgatgacatgggcaccctgctgggcctgatgcacagcgccccacccacagagctgcagctgaagacagacatcctgcgggccctgctgtctgtgctgcgggagagccacaggagcaggacagtgttcaggaaggtgggcggctttgtgtacatcaccagcctgctggtggccatggagaggagcctgagctgcccccccaagaatggctgggagaaggtgaaccagaaccaggtgtttgagctgctgcacacagtgttctgcaccctgacagctgccatgagatatgagcccgccaacagccacttcttcaagacagagatccagtatgagaagctggctgatgctgtgcgcttcctgggctgcttcagtgacctgaggaagatcagcgccatgaatgtgttccccagcaacacccagcccttccagaggctgctggaggaggatgtgatcagcattgaatctgtgagccccaccctgcggcactgcagcaagctgttcatctacctgtacaaggtggccacagacagctttgacagcagagctgagcagatccccccctgcctgaccagcgagagcagcctgcccagcccctggggcaccccagccctgagcaggaagagacatgcctaccacagcgtgtccaccccacctgtgtacccacccaagaatgtggccgacctgaagctgcacgtgaccaccagcagcctgcagagcagtgatgctgtgatcatccaccctggggccatgctggccatgctggacctgctggcctctgtgggctctgtgacccagcctgagcacgccctggacctgcagctggccgtggccaacatcctgcagagcctggtgcacacagagaggaaccagcaggtgatgtgtgaggccggcctgcacgcccggctgctgcagcgctgcagcgctgccctggctgatgaggaccacagcctgcacccccccctgcagaggatgtttgagcggctggccagccaggccctggagcccatggtgctgcgggagttcctgcggctggccagccccctgaactgtggggcctgggacaagaagctgctgaagcagtacagagtgcacaagcccagcagcctgtcctatgagcctgagatgaggagctccatgatcaccagcctggagggcctgggcacagacaacgtgttcagcctgcacgaggacaaccactaccgcatcagcaagagcctggtgaagtctgctgagggcagcacagtgcccctgaccagggtgaagtgcctggtgtccatgaccacccctcatgacatccggctgcacggcagctctgtgaccccagcctttgtggagtttgacaccagcctggagggcttcggctgcctcttcctgcccagcctggccccccacaatgcccccaccaacaacacagtgaccaccggcctgattgatggagctgtggtgtctggaattggcagcggggagcgcttcttccccccacccagcggcctgagctacagctcctggttctgcatcgagcacttcagcagcccccccaacaaccaccctgtgcggctgctgactgtggtgagaagagccaacagcagcgagcagcactacgtgtgcctggccatcgtgctgagcgccaaggacaggagcctgattgtgtccaccaaggaggagctgctgcagaactacgtggatgacttcagcgaggagagcagcttctatgagatcctgccctgctgtgcccgcttccgctgtggggagctgatcatcgagggccagtggcaccacctggtgctggtgatgagcaagggcatgctgaagaacagcacagctgccctgtacattgatggccagctggtgaacacagtgaagctgcactacgtgcacagcaccccaggcggcagcggcagcgccaacccccctgtggtgtccacagtgtatgcctacatcggcaccccaccagcccagaggcagatcgccagcctggtgtggaggctgggccccacccacttcctggaggaggtgctgcccagcagcaatgtgaccaccatctatgagctgggccccaactacgtgggcagcttccaggccgtgtgcatgccctgcaaggatgccaagtctgagggcgtggtgcccagccctgtgtccctggtgcctgaggagaaggtgtcctttggcctgtatgccctgtctgtgagcagcctgactgtggcccgcatcaggaaggtgtacaacaagctggacagcaaggccatcgccaagcagctgggcatcagcagccatgaaaatgccacccctgtgaagctgatccacaacagcgctggccacctgaatggaagtgcccggaccatcggggccgccctgattggctacctgggcgtgaggacctttgtgcccaagcctgtggccaccaccctgcagtatgtgggcggggccgccgccatcctgggcctggtggccatggccagtgatgtggagggcctgtatgctgctgtgaaggccctggtgtgtgtggtgaagagcaaccccctggccagcaaggagatggagcgcatcaagggctaccagctgctggccatgctgctgaagaagaagaggagcctgctgaacagccacatcctgcacctgaccttcagcctggtgggcaccgtggacagcggccacgagaccagcatcatccccaacagcacagccttccaggacctgctgtgtgactttgaggtgtggctgcacgccccctatgagctgcacctgagcctgtttgagcacttcatcgagctgctgacagagagcagcgaggccagcaagaatgccaagctgatgagggagttccagctgatccccaagctgctgctgaccctgcgggacatgagcctgagccagcccaccatcgccgccatcagcaatgtgctgtccttcctgctgcagggcttccccagcagcaatgacctgctgcgcttcggccagttcatcagcagcaccctgcccacctttgctgtgtgtgagaagtttgtggtgatggagatcaacaatgaggagaagctggacaccggcacagaggaggagtttggaggcctggtgtctgccaacctgatcctgctgaggaaccggctgctggacatcctgctgaagctgatctacaccagcaaggagaagaccagcatcaacctgcaggcctgtgaggagctggtgaagaccctgggctttgactggatcatgatgttcatggaggagcacctgcacagcaccaccgtgacagctgccatgaggatcctggtggtgctgctgagcaaccagagcatcctgatcaagttcaaggagggcctgagcggcggcggctggctggagcagacagattctgtgctgaccaacaagattggaacagtgctgggcttcaacgtgggccgctctgctgggggccgcagcacagtgcgggagatcaacagagatgcctgccacttccctggcttccctgtgctgcagagcttcctgcccaagcacaccaacgtgcctgccctgtacttcctgctgatggccctcttcctgcagcagcctgtgtctgagctgcctgagaacctgcaggtgtctgtgcctgtgatcagctgccgcagcaagcagggctgccagtttgacctggacagcatctggaccttcatctttggagtgcctgccagcagcggcaccgtggtgagcagcatccacaacgtgtgcacagaagctgtgttcctgctgctgggcatgctgcgctccatgctgaccagcccctggcagagcgaggaggagggctcctggctgcgggagtaccctgtgaccctgatgcagttcttccgctacctgtaccacaacgtgcctgacctggcctccatgtggatgagcccagacttcctgtgtgccctggccgccaccgtcttccccttcaacatccggccctacagcgagatggtgacagacctggatgatgaggtgggcagccctgctgaggagttcaaggcctttgctgctgacaccggcatgaacagaagccagagcgagtactgcaatgtgggcaccaagacctacctgaccaaccacccagccaagaagtttgtgtttgacttcatgagggtgctgatcatcgacaacctgtgcctgaccccagccagcaagcagacccccctgattgacctgctgctggaggccagccctgagaggagcaccaggacccagcagaaggagttccagacctacatcctggacagcgtgatggaccacctgctggccgcagatgtgctgctgggggaggatgccagcctgcccatcaccagcggcggcagctaccaggtgctggtgaacaacgtgttctacttcacccagagggtggtggacaagctgtggcagggcatgttcaacaaggagagcaagctgctgattgacttcatcatccagctgattgcccagagcaagagaagaagccagggcctgagcctggatgctgtgtaccactgcctgaacagaaccatcctgtaccagttcagccgggcccacaagacagtgccccagcaggtggccctgctggacagcctgcgggtgctgactgtgaacagaaacctgatcctgggccctggcaaccacgaccaggagttcatcagctgcctggcccactgcctgatcaacctgcacgtgggcagcaatgtggatggcttcggcctggaggccgaggccaggatgaccacctggcacatcatgatccccagcgacattgaaccagatggcagctacagccaggacatcagcgagggccggcagctgctgatcaaggctgtgaacagagtgtggacagagctgatccacagcaagaagcaggtgctggaggagctgttcaaggtgaccctgcctgtgaatgaaagaggccacgtggacatcgccacagcccggcccctcatcgaggaggccgccctgaagtgctggcagaaccacctggcccacgagaagaagtgcatcagcagaggagaggccctggcccccaccacccagagcaagctgagccgggtgagcagcggcttcggcctgagcaagctgaccggcagcagaagaaacaggaaggagagcggcctgaacaagcacagcctgagcacccaggagatcagccagtggatgttcacccacatcgctgtggtgcgggacctggtggacacccagtacaaggagtaccaggagcggcagcagaatgccctgaagtatgtgacagaggagtggtgccagattgaatgtgagctgctgcgggagcggggcctgtggggcccccccatcggcagccacctggacaagtggatgctggagatgacagagggcccctgcaggatgaggaagaagatggtgagaaatgacatgttctacaaccactacccctacgtgcctgagacagagcaggagaccaacgtggccagcgagatccccagcaagcagcctgagaccccagatgacatcccccagaagaagccagcccgctaccgccgggctgtgtcctatgacagcaaggagtactacatgaggctggccagcggcaacccagccatcgtgcaggatgccatcgtggagagcagcgagggggaggccgcccagcaggagcctgagcacggggaggacaccatcgccaaggtgaagggcctggtgaagccacccctgaagaggagccgcagcgccccagatggaggagatgaggagaaccaggagcagctgcaggaccagattgctgagggcagcagcattgaggaggaggagaagacagacaatgccaccctgctgcggctgctggaggagggggagaagatccagcacatgtaccgctgtgcccgggtgcagggcctggacaccagcgagggcctgctgctgtttgggaaggagcacttctacgtgattgatggcttcaccatgacagccacccgggagatccgggacatcgagaccctgccccccaacatgcatgagcccatcatccccaggggggcccggcagggccccagccagctgaagaggacctgcagcatctttgcctatgaggacatcaaggaggtgcacaagaggcgctacctgctgcagcccatcgctgtggaggtgttttctggagatggaagaaactacctgctggccttccagaagggcatccggaacaaggtgtaccagcgcttcctggccgtggtgcccagcctgacagacagcagcgagagcgtgtctggccagaggcccaacacctctgtggagcagggcagcggcctgctgagcaccctggtgggggagaagtctgtgacccagcgctgggagcggggggagatcagcaacttccagtacctgatgcacctgaacaccctggccggccgcagctacaatgacctgatgcagtaccctgtgttcccctggatcctggccgactatgacagcgaggaggtggacctgaccaaccccaagaccttcaggaacctggccaagcccatgggcgcccagacagatgagcggctggcccagtacaagaagcgctacaaggactgggaggaccccaacggggagaccccagcctaccactacggcacccactacagcagcgccatgattgtggccagctacctggtgaggatggagcccttcacccagatcttcctgcggctgcagggcggccactttgacctggccgacaggatgttccacagcgtgcgggaggcctggtacagcgccagcaagcacaacatggctgatgtgaaggagctgatccctgagttcttctacctgcctgagttcctgttcaacagcaacaactttgacctgggctgcaagcagaatggcaccaagctgggagatgtgatcctgcccccctgggccaagggggacccccgggagttcatccgggtgcaccgggaggccctggagtgtgactatgtgtctgcccacctgcacgagtggattgacctgatcttcggctacaagcagcagggccctgctgctgtggaggccgtgaatgtgttccaccacctgttctatgagggccaggtggacatctacaacatcaatgaccccctgaaggagacagccaccatcggcttcatcaacaactttggccagatccccaagcagctgttcaagaagccccacccccccaagagggtgcgcagccggctgaatggagacaatgccggcatctctgtgctgcccggcagcaccagtgacaagatcttcttccaccacctggacaacctgcggcccagcctgacccctgtgaaggagctgaaggagcctgtgggccagatcgtgtgcacagacaagggcatcctggccgtggagcagaacaaggtgctgatcccccccacctggaacaagacctttgcctggggctatgctgacctgagctgccgcctgggcacctatgaaagtgacaaggccatgacagtgtatgagtgcctgtctgagtggggccagatcctgtgtgccatctgccccaaccccaagctggtgatcactggaggcaccagcacagtggtgtgtgtgtgggagatgggcaccagcaaggagaaggccaagacagtgaccctgaagcaggccctgctgggccacacagacacagtgacctgtgccacagccagcctggcctaccacatcatcgtgtctggcagccgggacaggacctgcatcatctgggacctgaacaagctgtccttcctgacccagctgcggggccaccgggcccctgtgtctgccctgtgcatcaatgagctgactggagacatcgtgtcctgtgccggcacctacatccacgtgtggagcatcaatggaaaccccatcgtgtctgtgaacaccttcaccggccgcagccagcagatcatctgctgctgcatgtctgagatgaatgagtgggacacccagaatgtcatcgtgacaggccacagtgatggagtggtgcgcttctggaggatggagttcctgcaggtgcctgagaccccagcccctgagcctgctgaggtgctggagatgcaggaggactgcccagaggcccagatcggccaggaggcccaggatgaggacagcagtgacagcgaggctgatgagcagagcatcagccaggaccccaaggacacccccagccagcccagcagcaccagccaccggcccagggctgccagctgccgggccacagctgcctggtgcacagacagcggcagtgatgacagccgccgctggagcgaccagctgagcctggatgagaaggatggcttcatctttgtgaactacagcgagggccagacccgggcccacctgcagggccccctgagccacccccaccccaaccccatcgaggtgaggaactacagccggctgaagccaggctaccgctgggagcggcagctggtgttccgcagcaagctgaccatgcacacagcctttgacaggaaggacaatgcccaccctgctgaggtgacagccctgggcatcagcaaggaccacagccgcatcctggtgggggacagccggggccgggtcttctcctggagcgtgtctgaccagcccggccgctctgctgctgaccactgggtgaaggatgagggcggggacagctgcagcggctgcagcgtgcgcttcagcctgacagagcggcggcaccactgcaggaactgtggccagctgttctgccagaagtgcagccgcttccagagcgagatcaagaggctgaagatcagcagccctgtgcgggtgtgccagaactgctactacaacctgcagcacgagcggggctctgaagatggccccaggaactgctag

SEQ ID NO: 39921 - DNA, 10530 bp, Artificial Sequence
  Description of Artificial Sequence: Synthetic coding sequence
atgaacatggtgaagaggatcatgggccggccccggcaggaggagtgcagcccccaggacaatgccctgggcctgatgcacctgcggcggctcttcacagagctgtgccacccccccaggcacatgacccagaaggagcaggaggagaagctgtacatgatgctgcccgtcttcaacagagtgtttggaaatgccccacccaacaccatgacagagaagttcagtgacctgctgcagttcaccacccaggtgtcccggctgatggtgacagagatcagaagaagagccagcaacaagagcacagaagctgccagccgggccatcgtgcagttcctggagatcaaccagagcgaggaggccagccggggctggatgctgctgaccaccatcaacctgctggccagcagcggccagaagacagtggactgcatgaccaccatgtctgtgcccagcaccctggtgaagtgcctgtacctgttctttgacctgccccacgtgcctgaggccgtgggcggggcccagaatgagctgcccctggccgagcggcggggcctgctgcagaaggtgtttgtgcagatcctggtgaagctgtgcagctttgtgtccccagctgaggagctggcccagaaggatgacctgcagctgctcttcagcgccatcacctcctggtgccccccctacaacctgccctggaggaagtctgctggggaggtgctgatgaccatcagcagacatggcctgtctgtgaatgtggtgaagtacatccacgagaaggaatgtctgagcacctgtgtgcagaacatgcagcagagtgatgacctgagccccctggagatcgtggagatgtttgctggcctgagctgcttcctgaaggacagcagtgatgtgtcccagaccctgctggatgacttccgcatctggcagggctacaacttcctgtgtgacctgctgctgcggctggagcaggccaaggaggccgagagcaaggatgccctgaaggacctggtgaacctgatcaccagcctgaccacctatggagtgtctgagctgaagccagctggcatcaccactggagcccccttcctgctgcccggctttgctgtgccccagcctgctgggaagggccacagcgtgagaaatgtgcaggcctttgctgtgctgcagaatgccttcctgaaggccaagaccagcttcctggcccagatcatcctggatgccatcaccaacatctacatggctgacaatgccaactacttcatcctggagagccagcacaccctgagccagtttgctgagaagatcagcaagctgcctgaggtgcagaacaagtactttgagatgctggagtttgtggtgttcagcctgaactacatcccctgcaaggagctgatctctgtgtccatcctgctgaagagcagcagcagctaccactgcagcatcatcgccatgaagaccctgctgaagttcaccaggcatgactacatcttcaaggatgtgttccgggaggtgggcctgctggaggtgatggtgaacctgctgcacaagtatgctgccctgctgaaggaccccacccaggccctgaatgagcagggcgacagcaggaacaacagctctgtggaggaccagaagcacctggccctgctggtgatggagaccctgactgtgctgctgcagggcagcaacaccaatgccggcatcttccgggagtttggaggagcccgctgtgcccacaacatcgtgaagtacccccagtgccggcagcacgccctgatgaccatccagcagctggtgctgagccccaatggagatgatgacatgggcaccctgctgggcctgatgcacagcgccccacccacagagctgcagctgaagacagacatcctgcgggccctgctgtctgtgctgcgggagagccacaggagcaggacagtgttcaggaaggtgggcggctttgtgtacatcaccagcctgctggtggccatggagaggagcctgagctgcccccccaagaatggctgggagaaggtgaaccagaaccaggtgtttgagctgctgcacacagtgttctgcaccctgacagctgccatgagatatgagcccgccaacagccacttcttcaagacagagatccagtatgagaagctggctgatgctgtgcgcttcctgggctgcttcagtgacctgaggaagatcagcgccatgaatgtgttccccagcaacacccagcccttccagaggctgctggaggaggatgtgatcagcattgaatctgtgagccccaccctgcggcactgcagcaagctgttcatctacctgtacaaggtggccacagacagctttgacagcagagctgagcagatccccccctgcctgaccagcgagagcagcctgcccagcccctggggcaccccagccctgagcaggaagagacatgcctaccacagcgtgtccaccccacctgtgtacccacccaagaatgtggccgacctgaagctgcacgtgaccaccagcagcctgcagagcagtgatgctgtgatcatccaccctggggccatgctggccatgctggacctgctggcctctgtgggctctgtgacccagcctgagcacgccctggacctgcagctggccgtggccaacatcctgcagagcctggtgcacacagagaggaaccagcaggtgatgtgtgaggccggcctgcacgcccggctgctgcagcgctgcagcgctgccctggctgatgaggaccacagcctgcacccccccctgcagaggatgtttgagcggctggccagccaggccctggagcccatggtgctgcgggagttcctgcggctggccagccccctgaactgtggggcctgggacaagaagctgctgaagcagtacagagtgcacaagcccagcagcctgtcctatgagcctgagatgaggagctccatgatcaccagcctggagggcctgggcacagacaacgtgttcagcctgcacgaggacaaccactaccgcatcagcaagagcctggtgaagtctgctgagggcagcacagtgcccctgaccagggtgaagtgcctggtgtccatgaccacccctcatgacatccggctgcacggcagctctgtgaccccagcctttgtggagtttgacaccagcctggagggcttcggctgcctcttcctgcccagcctggccccccacaatgcccccaccaacaacacagtgaccaccggcctgattgatggagctgtggtgtctggaattggcagcggggagcgcttcttccccccacccagcggcctgagctacagctcctggttctgcatcgagcacttcagcagcccccccaacaaccaccctgtgcggctgctgactgtggtgagaagagccaacagcagcgagcagcactacgtgtgcctggccatcgtgctgagcgccaaggacaggagcctgattgtgtccaccaaggaggagctgctgcagaactacgtggatgacttcagcgaggagagcagcttctatgagatcctgccctgctgtgcccgcttccgctgtggggagctgatcatcgagggccagtggcaccacctggtgctggtgatgagcaagggcatgctgaagaacagcacagctgccctgtacattgatggccagctggtgaacacagtgaagctgcactacgtgcacagcaccccaggcggcagcggcagcgccaacccccctgtggtgtccacagtgtatgcctacatcggcaccccaccagcccagaggcagatcgccagcctggtgtggaggctgggccccacccacttcctggaggaggtgctgcccagcagcaatgtgaccaccatctatgagctgggccccaactacgtgggcagcttccaggccgtgtgcatgccctgcaaggatgccaagtctgagggcgtggtgcccagccctgtgtccctggtgcctgaggagaaggtgtcctttggcctgtatgccctgtctgtgagcagcctgactgtggcccgcatcaggaaggtgtacaacaagctggacagcaaggccatcgccaagcagctgggcatcagcagccatgaaaatgccacccctgtgaagctgatccacaacagcgctggccacctgaatggaagtgcccggaccatcggggccgccctgattggctacctgggcgtgaggacctttgtgcccaagcctgtggccaccaccctgcagtatgtgggcggggccgccgccatcctgggcctggtggccatggccagtgatgtggagggcctgtatgctgctgtgaaggccctggtgtgtgtggtgaagagcaaccccctggccagcaaggagatggagcgcatcaagggctaccagctgctggccatgctgctgaagaagaagaggagcctgctgaacagccacatcctgcacctgaccttcagcctggtgggcaccgtggacagcggccacgagaccagcatcatccccaacagcacagccttccaggacctgctgtgtgactttgaggtgtggctgcacgccccctatgagctgcacctgagcctgtttgagcacttcatcgagctgctgacagagagcagcgaggccagcaagaatgccaagctgatgagggagttccagctgatccccaagctgctgctgaccctgcgggacatgagcctgagccagcccaccatcgccgccatcagcaatgtgctgtccttcctgctgcagggcttccccagcagcaatgacctgctgcgcttcggccagttcatcagcagcaccctgcccacctttgctgtgtgtgagaagtttgtggtgatggagatcaacaatgaggagaagctggacaccggcacagaggaggagtttggaggcctggtgtctgccaacctgatcctgctgaggaaccggctgctggacatcctgctgaagctgatctacaccagcaaggagaagaccagcatcaacctgcaggcctgtgaggagctggtgaagaccctgggctttgactggatcatgatgttcatggaggagcacctgcacagcaccaccgtgacagctgccatgaggatcctggtggtgctgctgagcaaccagagcatcctgatcaagttcaaggagggcctgagcggcggcggctggctggagcagacagattctgtgctgaccaacaagattggaacagtgctgggcttcaacgtgggccgctctgctgggggccgcagcacagtgcgggagatcaacagagatgcctgccacttccctggcttccctgtgctgcagagcttcctgcccaagcacaccaacgtgcctgccctgtacttcctgctgatggccctcttcctgcagcagcctgtgtctgagctgcctgagaacctgcaggtgtctgtgcctgtgatcagctgccgcagcaagcagggctgccagtttgacctggacagcatctggaccttcatctttggagtgcctgccagcagcggcaccgtggtgagcagcatccacaacgtgtgcacagaagctgtgttcctgctgctgggcatgctgcgctccatgctgaccagcccctggcagagcgaggaggagggctcctggctgcgggagtaccctgtgaccctgatgcagttcttccgctacctgtaccacaacgtgcctgacctggcctccatgtggatgagcccagacttcctgtgtgccctggccgccaccgtcttccccttcaacatccggccctacagcgagatggtgacagacctggatgatgaggtgggcagccctgctgaggagttcaaggcctttgctgctgacaccggcatgaacagaagccagagcgagtactgcaatgtgggcaccaagacctacctgaccaaccacccagccaagaagtttgtgtttgacttcatgagggtgctgatcatcgacaacctgtgcctgaccccagccagcaagcagacccccctgattgacctgctgctggaggccagccctgagaggagcaccaggacccagcagaaggagttccagacctacatcctggacagcgtgatggaccacctgctggccgcagatgtgctgctgggggaggatgccagcctgcccatcaccagcggcggcagctaccaggtgctggtgaacaacgtgttctacttcacccagagggtggtggacaagctgtggcagggcatgttcaacaaggagagcaagctgctgattgacttcatcatccagctgattgcccagagcaagagaagaagccagggcctgagcctggatgctgtgtaccactgcctgaacagaaccatcctgtaccagttcagccgggcccacaagacagtgccccagcaggtggccctgctggacagcctgcgggtgctgactgtgaacagaaacctgatcctgggccctggcaaccacgaccaggagttcatcagctgcctggcccactgcctgatcaacctgcacgtgggcagcaatgtggatggcttcggcctggaggccgaggccaggatgaccacctggcacatcatgatccccagcgacattgaaccagatggcagctacagccaggacatcagcgagggccggcagctgctgatcaaggctgtgaacagagtgtggacagagctgatccacagcaagaagcaggtgctggaggagctgttcaaggtgaccctgcctgtgaatgaaagaggccacgtggacatcgccacagcccggcccctcatcgaggaggccgccctgaagtgctggcagaaccacctggcccacgagaagaagtgcatcagcagaggagaggccctggcccccaccacccagagcaagctgagccgggtgagcagcggcttcggcctgagcaagctgaccggcagcagaagaaacaggaaggagagcggcctgaacaagcacagcctgagcacccaggagatcagccagtggatgttcacccacatcgctgtggtgcgggacctggtggacacccagtacaaggagtaccaggagcggcagcagaatgccctgaagtatgtgacagaggagtggtgccagattgaatgtgagctgctgcgggagcggggcctgtggggcccccccatcggcagccacctggacaagtggatgctggagatgacagagggcccctgcaggatgaggaagaagatggtgagaaatgacatgttctacaaccactacccctacgtgcctgagacagagcaggagaccaacgtggccaagccagcccgctacagaagagctgtgtcctatgacagcaaggagtactacatgaggctggccagcggcaacccagccatcgtgcaggatgccatcgtggagagcagcgagggggaggccgcccagcaggagcctgagcacggggaggacaccatcgccaaggtgaagggcctggtgaagccacccctgaagaggagccgcagcgccccagatggaggagatgaggagaaccaggagcagctgcaggaccagattgctgagggcagcagcattgaggaggaggagaagacagacaatgccaccctgctgcggctgctggaggagggggagaagatccagcacatgtaccgctgtgcccgggtgcagggcctggacaccagcgagggcctgctgctgtttgggaaggagcacttctacgtgattgatggcttcaccatgacagccacccgggagatccgggacatcgagaccctgccccccaacatgcatgagcccatcatccccaggggggcccggcagggccccagccagctgaagaggacctgcagcatctttgcctatgaggacatcaaggaggtgcacaagaggcgctacctgctgcagcccatcgctgtggaggtgttttctggagatggcaggaactacctgctggccttccagaagggcatccggaacaaggtgtaccagcgcttcctggccgtggtgcccagcctgacagacagcagcgagagcgtgtctggccagaggcccaacacctctgtggagcagggcagcggcctgctgagcaccctggtgggggagaagtctgtgacccagcgctgggagcggggggagatcagcaacttccagtacctgatgcacctgaacaccctggccggccgcagctacaatgacctgatgcagtaccctgtgttcccctggatcctggccgactatgattctgaggaggtggacctgaccaaccccaagaccttcaggaacctggccaagcccatgggcgcccagacagatgagcggctggcccagtacaagaagcgctacaaggactgggaggaccccaatggagagaccccagcctaccactacggcacccactacagcagcgccatgattgtggccagctacctggtgaggatggagcccttcacccagatcttcctgcggctgcagggcggccactttgacctggccgacaggatgttccacagcgtgcgggaggcctggtacagcgccagcaagcacaacatggctgatgtgaaggagctgatccctgagttcttctacctgcctgagttcctgttcaacagcaacaactttgacctgggctgcaagcagaatggcaccaagctgggagatgtgatcctgcccccctgggccaagggggacccccgggagttcatccgggtgcaccgggaggccctggagtgtgactatgtgtctgcccacctgcacgagtggattgacctgatcttcggctacaagcagcagggccctgctgctgtggaggccgtgaatgtgttccaccacctgttctatgagggccaggtggacatctacaacatcaatgaccccctgaaggagacagccaccatcggcttcatcaacaactttggccagatccccaagcagctgttcaagaagccccacccccccaagagggtgcgcagccggctgaatggagacaatgccggcatctctgtgctgcccggcagcaccagtgacaagatcttcttccaccacctggacaacctgcggcccagcctgacccctgtgaaggagctgaaggagcctgtgggccagatcgtgtgcacagacaagggcatcctggccgtggagcagaacaaggtgctgatcccccccacctggaacaagacctttgcctggggctacgccgacctgagctgccgcctgggcacctatgaaagtgacaaggccatgacagtgtatgaatgtctgtctgagtggggccagatcctgtgtgccatctgccccaaccccaagctggtgatcaccggcggcaccagcacagtggtgtgtgtgtgggagatgggcaccagcaaggagaaggccaagacagtgaccctgaagcaggccctgctgggccacacagacacagtgacctgtgccacagccagcctggcctaccacatcatcgtgtctggcagccgggacaggacctgcatcatctgggacctgaacaagctgtccttcctgacccagctgcggggccaccgggcccctgtgtctgccctgtgcatcaatgagctgaccggggacatcgtgtcctgtgccggcacctacatccacgtgtggagcatcaatggaaaccccatcgtgtctgtgaacaccttcaccggccgcagccagcagatcatctgctgctgcatgtctgagatgaatgagtgggacacccagaatgtgattgtgacaggccacagtgatggagtggtgcgcttctggaggatggagttcctgcaggtgcctgagaccccagcccctgagcctgctgaggtgctggagatgcaggaggactgcccagaggcccagatcggccaggaggcccaggatgaggacagcagtgacagcgaggctgatgagcagagcatcagccaggaccccaaggacacccccagccagcccagcagcaccagccaccggccccgggccgccagctgccgggccacagctgcctggtgcacagattctggcagtgatgacagccgccgctggagcgaccagctgagcctggatgagaaggatggcttcatctttgtgaactacagcgagggccagacccgggcccacctgcagggccccctgagccacccccaccccaaccccatcgaggtgaggaactacagccggctgaagccaggctaccgctgggagcggcagctggtgttccgcagcaagctgaccatgcacacagcctttgacaggaaggacaatgcccaccctgctgaggtgacagccctgggcatcagcaaggaccacagccgcatcctggtgggggacagccggggccgggtcttctcctggagcgtgtctgaccagcccggccgctctgctgctgaccactgggtgaaggatgaaggaggagacagctgcagcggctgcagcgtgcgcttcagcctgacagaaagaagacaccactgcaggaactgtggccagctgttctgccagaagtgcagccgcttccagagcgagatcaagaggctgaagatcagcagccctgtgcgggtgtgccagaactgctactacaacctgcagcacgagcggggctctgaagatggccccaggaactgctag

SEQ ID NO: 39922 - DNA, 30 bp, Artificial Sequence
  Description of Artificial Sequence: Synthetic coding sequence
atgaacatggtgaagaggatcatgggctag

SEQ ID NO: 39923 - DNA, 183 bp, Artificial Sequence
  Description of Artificial Sequence: Synthetic coding sequence
atgaacatggtgaagaggatcatgggccggccccggcaggaggagtgcagcccccaggacaatgccctgggcctgatgcacctgcggcggctcttcacagagctgtgccacccccccaggcacatgacccagaaggagcaggaggagaagctgtacatgatgctgcccgtcttcaacagatag

SEQ ID NO: 39924 - DNA, 2241 bp, Artificial Sequence
  Description of Artificial Sequence: Synthetic coding sequence
atgaggcgggagttctgctgggatgcctacagcaaggccgccggcagccgggccagcagccccctgccccggcaggaccgggacagcttctgccaccagatgtccttctgcctgacagagctgcacctgtggagcctgaagaacaccctgcacatcgctgaccgggacatcggcatctaccagtactatgacaagaaggaccccccagccacagaacatggcaacctggagaagaagcagaagctggccgagagccgggactacccctggaccctgaagaacagaagacctgagaagctgcgggacagcctgaaggagctggaggagctgatgcagaacagccgctgtgtgctgagcaagtggaagaacaagtatgtgtgccagctgctgtttggaagtggagtgctggtgtccctgagcctgagcggcccccagctggagaaggtggtgattgacaggagcctggtgggcaagctgatcagtgacaccatcagtgatgccctgctgacagacagcttcatcatcctgtccttcctggcccagaacaagctgtgcttcatccagttcaccaagaagatggagagcagtgatgtgaacaagaggctggagaagctgagcgccctggactacaagatcttctactatgagatccctggccccatcaacaagaccacagagcggcacctggccatcaactgtgtgcatgacagagtggtgtgctggtggcccctggtgaatgatgatgcctggccctgggcccccatcagcagcgagaaggaccgggccaacctgctgctgctgggctacgcccagggccgcctggaggtgctgagctctgtgaggacagagtgggaccccctggatgtgcgcttcggcaccaagcagccctaccaggtgttcaccgtggagcacagcgtgtctgtggacaaggagcccatggctgacagctgcatctatgagtgcatccggaacaagatccagtgtgtgtctgtgacccgcatccccctgaagagcaaggccatcagctgctgcagaaatgtgacagaggacaagctgatcctgggctgtgaggacagcagcctcatcctgtatgagacccaccggcgggtgaccctgctggcccagacagagctgctgcccagcctcatcagctgccaccccagcggggccatcctgctggtgggcagcaaccagggcgagctgcagatctttgacatggccctgagccccatcaacatccagctgctggccgaggaccggctgccccgggagaccctgcagttcagcaagctgtttgatgccagcagcagcctggtgcagatgcagtggatcgccccccaggtggtgtcccagaagggggagggcagtgacatctatgacctgctcttcctgcgctttgagcggggccccctgggcgtgctgctcttcaagctgggcgtcttcacccggggccagctgggcctgattgacatcatcttccagtacatccactgtgatgagatctatgaggccatcaacatcctgagctccatgaactgggacaccctgggccaccagtgcttcatctccatgtctgccatcgtgaaccacctgctgcggcagaagctgaccccagagcgggaggcccagctggagaccagcctgggcaccttctacgcccccacccggcccctgctggacagcaccatcctggagtacagagaccagatcagcaaatatgcccggcgcttcttccaccacctgctgcgctaccagagatttgagaaggccttcctgctggccgtggatgtgggcgcccgggacctcttcatggacatccactacctggccctggacaagggggagctggccctggccgaggtggccaggaagagggccagtgacattgatgctgagagcatcaccagcggcgtggagctgctgggccccctggacagaggagacatgctgaatgaggccttcatcggcctgagcctggccccccagggcgaggacagcttcccagacaacctgccccccagctgccccacccaccgccacatcctgcagcagaggatcctgaatggcagcagcaaccggcagatcatcgacagaagaaatgagctggagaaggacatctgcagcggcttcctgatgaccaacacctgcaatgcagaagatggagagctgagagaagatggccgggagcaggagatcagagatggcggcagcctgaagatgatccacttcggcctggtgtag

SEQ ID NO: 39925 - DNA, 2742 bp, Artificial Sequence
  Description of Artificial Sequence: Synthetic coding sequence
atggccagcgagagtgacacagaggagttctatgatgccccagaagatgtgcacctgggcggcggctaccctgtgggcagccctgggaaggtgggcctgagcaccttcaaggagacagagaacacagcctacaaggtgggcaatgaaagccctgtgcaggagctgaagcaggatgtgtccaagaagatcatcgagagcatcatcgaggagagccagaaggtgctgcagctggaggatgacagcctggacagcaagggcaaggagctgagtgaccaggccacagccagccccatcgtggccaggacagacctgagcaacatccctggcctgctggccatcgaccaggtgctgcctgaggagagccagaaggccgagagccagaacacctttgaggagacagagctggagctgaagaagtgcttccccagtgatgagacctgtgagaagcctgtggatgagaccaccaagctgacccagaccagcagcacagagcagctgaatgtgctggagacagaaacagaggtgctgaacaaggaggccgtggaggtgaagggcggcggagatgtgctggagcctgtgtccagtgacagcctgagcaccaaggactttgctgctgtggaggaggtggccccagccaagccacccaggcacctgaccccagagccagacatcgtggccagcaccaagaagcctgtgcctgcccggcccccaccacccaccaacttccccccacccaggcctcctccacccagcaggcctgcccccccacccaggaagaggaagtctgagctggagtttgagaccctgaagaccccagacattgatgtgcccaaggagaacatcaccagtgacagcctgctgacagcctccatggccagcgagagcacagtgaaggacagccagcccagcctggacctggccagcgccaccagcggggacaagatcgtgacagcccaggagaatggcaaggccccagatggccagacagtggccggggaggtgatgggcccccagaggcccaggagcaacagcggccgggagctgacagatgaggagatcctggcctctgtgatgatcaagaacctggacaccggggaggagatccccctgagcctggccgaggagaagctgcccaccggcatcaaccccctgaccctgcacatcatgaggaggaccaaggagtatgtgtccaatgatgctgcccagagtgatgatgaggagaagctgcagagccagcccacagacacagatggcggccgcctgaagcagaagaccacccagctgaagaagttcctgggcaagtctgtgaagagggccaagcacctggccgaggagtatggagagcgggccatcaacaaggtgaagtctgtgagagatgaggtgttccacacagaccaggatgaccccagcagcagtgatgatgagggcatgccctacaccaggcctgtgaagttcaaggccgcccacggcttcaagggcccctatgactttgaccagatcaaggtggtgcaggacctgtctggagagcacatgggcgctgtgtggaccatgaagttcagccactgcggccgcctgctggccagcgctggccaggacaacgtggtgcgcatctgggccctgaagaatgcctttgactacttcaacaacatgaggatgaagtacaacacagagggccgggtgagccccagccccagccaggagagcctgagcagcagcaagagtgacacagacaccggggtgtgcagcggcacagatgaggaccctgatgacaagaatgcccccttccggcagaggcccttctgcaagtacaagggccacacagctgacctgctggacctgtcctggagcaagaactacttcctgctgagcagctccatggacaagacagtgcggctgtggcacatcagcagaagagaatgtctgtgctgcttccagcacatcgactttgtgacagccatcgccttccaccccagagatgaccgctacttcctgagcggcagcctggatggcaagctgcggctgtggaacatcccagacaagaaggtggccctgtggaatgaggtggatggccagaccaagctgatcacagctgccaacttctgccagaatggcaagtatgctgtgattggcacctatgatggccgctgcatcttctatgacacagagcacctgaagtaccacacccagatccacgtgcgcagcacccggggcaggaacaaggtgggcaggaagatcaccggcatcgagcccctgcccggggagaacaagatcctggtgaccagcaatgacagccgcatccggctgtatgacctgcgggacctgagcctgtccatgaagtacaagggctacgtgaacagcagcagccagatcaaggccagcttcagccatgacttcacctacctggtgtctggcagcgaggacaagtatgtgtacatctggagcacctaccatgacctgagcaagttcacctctgtgcggcgggacagaaatgacttctgggagggcatcaaggcccacaatgctgtggtgaccagcgccatctttgcccccaaccccagcctgatgctgagcctggatgtgcagagcgagaagtctgagggcaatgagaagtcagaagatgctgaggtgctggatgccacccccagcggcatcatgaagacagacaacacagaggtgctgctgtctgctgacttcaccggggccatcaaggtgtttgtgaacaagaggaagaatgtgtcctag

SEQ ID NO: 39926 - DNA, 867 bp, Artificial Sequence
  Description of Artificial Sequence: Synthetic coding sequence
tggggcaagaactacttcctgctgagcagctccatggacaagacagtgcggctgtggcacatcagcagaagagaatgtctgtgctgcttccagcacatcgactttgtgacagccatcgccttccaccccagagatgaccgctacttcctgagcggcagcctggatggcaagctgcggctgtggaacatcccagacaagaaggtggccctgtggaatgaggtggatggccagaccaagctgatcacagctgccaacttctgccagaatggcaagtatgctgtgattggcacctatgatggccgctgcatcttctatgacacagagcacctgaagtaccacacccagatccacgtgcgcagcacccggggcaggaacaaggtgggcaggaagatcaccggcatcgagcccctgcccggggagaacaagatcctggtgaccagcaatgacagccgcatccggctgtatgacctgcgggacctgagcctgtccatgaagtacaagggctacgtgaacagcagcagccagatcaaggccagcttcagccatgacttcacctacctggtgtctggcagcgaggacaagtatgtgtacatctggagcacctaccatgacctgagcaagttcacctctgtgcggcgggacagaaatgacttctgggagggcatcaaggcccacaatgctgtggtgaccagcgccatctttgcccccaaccccagcctgatgctgagcctggatgtgcagagcgagaagtctgagggcaatgagaagtcagaagatgctgaggtgctggatgccacccccagcggggctgtggcccacgcctgcaaccccagcaccctgggcggccggggccgccgcatcacctag

SEQ ID NO: 39927 - DNA, 2475 bp, Artificial Sequence
  Description of Artificial Sequence: Synthetic coding sequence
atggccagcgagagtgacacagaggagttctatgatgccccagaagatgtgcacctgggcggcggctaccctgtgggcagccctgggaaggtgggcctgagcaccttcaagatcatcgagagcatcatcgaggagagccagaaggtgctgcagctggaggatgacagcctggacagcaagggcaaggagctgagtgaccaggccacagccagccccatcgtggccaggacagacctgagcaacatccctggcctgctggccatcgaccaggtgctgcctgaggagagccagaaggccgagagccagaacacctttgaggagacagagctggagctgaagaagtgcttccccagtgatgagacctgtgagaagcctgtggatgagaccaccaagctgacccagaccagcagcacagagcagctgaatgtgctggagacagaaacagaggtgctgaacaaggaggccgtggaggtgaagggcggcggagatgtgctggagcctgtgtccagtgacagcctgagcaccaaggactttgctgctgtggaggaggtggccccagccaagcccccaagacacctgaccccagagccagacatcgtggccagcaccaagaagcctgtgcctgcccggcccccaccacccaccaacttccccccaccccggcccccaccacccagcaggcctgcccccccacccaggaagaggaagtctgagctggagtttgagaccctgaagaccccagacattgatgtgcccaaggagaacatcaccagtgacagcctgctgacagcctccatggccagcgagagcacagtgaaggacagccagcccagcctggacctggccagcgccaccagcggggacaagatcgtgacagcccaggagaatggcaaggccccagatggccagacagtggccggggaggtgatgggcccccagaggcccaggagcaacagcggccgggagctgacagatgaggagatcctggcctctgtgatgatcaagaacctggacacaggagaggagatccccctgagcctggccgaggagaagctgcccaccggcatcaaccccctgaccctgcacatcatgaggaggaccaaggagtatgtgtccaatgatgctgcccagagtgatgatgaggagaagctgcagagccagcccacagacacagatggcggccgcctgaagcagaagaccacccagctgaagaagttcctgggcaagtctgtgaagagggccaagcacctggccgaggagtatggagagcgggccatcaacaaggtgaagtctgtgagagatgaggtgttccacacagaccaggatgaccccagcagcagtgatgatgagggcatgccctacaccaggcctgtgaagttcaaggccgcccacggcttcaagggcccctatgactttgaccagatcaaggtggtgcaggacctgagcggggagcacatgggcgctgtgtggaccatgaagttcagccactgcggccgcctgctggccagcgctggccaggacaacgtggtgcgcatctgggccctgaagaatgcctttgactacttcaacaacatgaggatgaagtacaacacagagggccgggtgagccccagccccagccaggagagcctgagcagcagcaagagtgacacagacacaggagtgtgcagcggcacagatgaagatcctgatgacaagaatgcccccttccggcagaggcccttctgcaagtacaagggccacacagctgacctgctggacctgtcctggagcaagaactacttcctgctgagcagctccatggacaagacagtgcggctgtggcacatcagccggcgggagtgcctgtgctgcttccagcacatcgactttgtgacagccatcgccttccaccccaggcacctgaagtaccacacccagatccacgtgcgcagcacccggggcaggaacaaggtgggcaggaagatcactggaattgagcccctgcctggagagaacaagatcctggtgaccagcaatgacagccgcatccggctgtatgacctgcgggacctgagcctgtccatgaagtacaagggctacgtgaacagcagcagccagatcaaggccagcttcagccatgacttcacctacctggtgtctggcagcgaggacaagtatgtgtacatctggagcacctaccatgacctgagcaagttcacctctgtgagaagagacagaaatgacttctgggagggcatcaaggcccacaatgctgtggtgaccagcgccatctttgcccccaaccccagcctgatgctgagcctggatgtgcagagcgagaagtctgagggcaatgagaagtcagaagatgctgaggtgctggatgccaccccatctggcatcatgaagacagacaacacagaggtgctgctgtctgctgacttcaccggggccatcaaggtgtttgtgaacaagaggaagaatgtgtcctag

SEQ ID NO: 39928 - DNA, 2718 bp, Artificial Sequence
  Description of Artificial Sequence: Synthetic coding sequence
atggccagcgagagtgacacagaggagttctatgatgccccagaagatgtgcacctgggcggcggctaccctgtgggcagccctgggaaggtgggcctgagcaccttcaaggagacagagaacacagcctacaaggtgggcaatgaaagccctgtgcaggagctgaagcaggatgtgtccaagaagatcatcgagagcatcatcgaggagagccagaaggtgctgcagctggaggatgacagcctggacagcaagggcaaggagctgagtgaccaggccacagccagccccatcgtggccaggacagacctgagcaacatccctggcctgctggccatcgaccaggtgctgcctgaggagagccagaaggccgagagccagaacacctttgaggagacagagctggagctgaagaagtgcttccccagtgatgagacctgtgagaagcctgtggatgagaccaccaagctgacccagaccagcagcacagagcagctgaatgtgctggagacagaaacagaggtgctgaacaaggaggccgtggaggtgaagggcggcggagatgtgctggagcctgtgtccagtgacagcctgagcaccaaggactttgctgctgtggaggaggtggccccagccaagccacccaggcacctgaccccagagccagacatcgtggccagcaccaagaagcctgtgcctgcccggcccccaccacccaccaacttccccccacccaggcctcctccacccagcaggcctgcccccccacccaggaagaggaagtctgagctggagtttgagaccctgaagaccccagacattgatgtgcccaaggagaacatcaccagtgacagcctgctgacagcctccatggccagcgagagcacagtgaaggacagccagcccagcctggacctggccagcgccaccagcggggacaagatcgtgacagcccaggagaatggcaaggccccagatggccagacagtggccggggaggtgatgggcccccagaggcccaggagcaacagcggccgggagctgacagatgaggagatcctggcctctgtgatgatcaagaacctggacaccggggaggagatccccctgagcctggccgaggagaagctgcccaccggcatcaaccccctgaccctgcacatcatgaggaggaccaaggagtatgtgtccaatgatgctgcccagagtgatgatgaggagaagctgcagagccagcccacagacacagatggcggccgcctgaagcagaagaccacccagctgaagaagttcctgggcaagtctgtgaagagggccaagcacctggccgaggagtatggagagcgggccatcaacaaggtgaagtctgtgagagatgaggtgttccacacagaccaggatgaccccagcagcagtgatgatgagggcatgccctacaccaggcctgtgaagttcaaggccgcccacggcttcaagggcccctatgactttgaccagatcaaggtggtgcaggacctgtctggagagcacatgggcgctgtgtggaccatgaagttcagccactgcggccgcctgctggccagcgctggccaggacaacgtggtgcgcatctgggccctgaagaatgcctttgactacttcaacaacatgaggatgaagtacaacacagagggccgggtgagccccagccccagccaggagagcctgagcagcagcaagagtgacacagacaccggggtgtgcagcggcacagatgaggaccctgatgacaagaatgcccccttccggcagaggcccttctgcaagtacaagggccacacagctgacctgctggacctgtcctggagcaagaactacttcctgctgagcagctccatggacaagacagtgcggctgtggcacatcagcagaagagaatgtctgtgctgcttccagcacatcgactttgtgacagccatcgccttccaccccagagatgaccgctacttcctgagcggcagcctggatggcaagctgcggctgtggaacatcccagacaagaaggtggccctgtggaatgaggtggatggccagaccaagctgatcacagctgccaacttctgccagaatggcaagtatgctgtgattggcacctatgatggccgctgcatcttctatgacacagagcacctgaagtaccacacccagatccacgtgcgcagcacccggggcaggaacaaggtgggcaggaagatcaccggcatcgagcccctgcccggggagaacaagatcctggtgaccagcaatgacagccgcatccggctgtatgacctgcgggacctgagcctgtccatgaagtacaagggctacgtgaacagcagcagccagatcaaggccagcttcagcggcagcgaggacaagtatgtgtacatctggagcacctaccatgacctgagcaagttcacctctgtgcggcgggacagaaatgacttctgggagggcatcaaggcccacaatgctgtggtgaccagcgccatctttgcccccaaccccagcctgatgctgagcctggatgtgcagagcgagaagtctgagggcaatgagaagtcagaagatgctgaggtgctggatgccacccccagcggcatcatgaagacagacaacacagaggtgctgctgtctgctgacttcaccggggccatcaaggtgtttgtgaacaagaggaagaatgtgtcctag

SEQ ID NO: 39929 - DNA, 2421 bp, Artificial Sequence
  Description of Artificial Sequence: Synthetic coding sequence
tgaacagacctgagcaacatccctggcctgctggccatcgaccaggtgctgcctgaggagagccagaaggccgagagccagaacacctttgaggagacagagctggagctgaagaagtgcttccccagtgatgagacctgtgagaagcctgtggatgagaccaccaagctgacccagaccagcagcacagagcagctgaatgtgctggagacagaaacagaggtgctgaacaaggaggccgtggaggtgaagggcggcggagatgtgctggagcctgtgtccagtgacagcctgagcaccaaggactttgctgctgtggaggaggtggccccagccaagccacccaggcacctgaccccagagccagacatcgtggccagcaccaagaagcctgtgcctgcccggcccccaccacccaccaacttccccccacccaggcctcctccacccagcaggcctgcccccccacccaggaagaggaagtctgagctggagtttgagaccctgaagaccccagacattgatgtgcccaaggagaacatcaccagtgacagcctgctgacagcctccatggccagcgagagcacagtgaaggacagccagcccagcctggacctggccagcgccaccagcggggacaagatcgtgacagcccaggagaatggcaaggccccagatggccagacagtggccggggaggtgatgggcccccagaggcccaggagcaacagcggccgggagctgacagatgaggagatcctggcctctgtgatgatcaagaacctggacaccggggaggagatccccctgagcctggccgaggagaagctgcccaccggcatcaaccccctgaccctgcacatcatgaggaggaccaaggagtatgtgtccaatgatgctgcccagagtgatgatgaggagaagctgcagagccagcccacagacacagatggcggccgcctgaagcagaagaccacccagctgaagaagttcctgggcaagtctgtgaagagggccaagcacctggccgaggagtatggagagcgggccatcaacaaggtgaagtctgtgagagatgaggtgttccacacagaccaggatgaccccagcagcagtgatgatgagggcatgccctacaccaggcctgtgaagttcaaggccgcccacggcttcaagggcccctatgactttgaccagatcaaggtggtgcaggacctgtctggagagcacatgggcgctgtgtggaccatgaagttcagccactgcggccgcctgctggccagcgctggccaggacaacgtggtgcgcatctgggccctgaagaatgcctttgactacttcaacaacatgaggatgaagtacaacacagagggccgggtgagccccagccccagccaggagagcctgagcagcagcaagagtgacacagacaccggggtgtgcagcggcacagatgaggaccctgatgacaagaatgcccccttccggcagaggcccttctgcaagtacaagggccacacagctgacctgctggacctgtcctggagcaagaactacttcctgctgagcagctccatggacaagacagtgcggctgtggcacatcagcagaagagaatgtctgtgctgcttccagcacatcgactttgtgacagccatcgccttccaccccagagatgaccgctacttcctgagcggcagcctggatggcaagctgcggctgtggaacatcccagacaagaaggtggccctgtggaatgaggtggatggccagaccaagctgatcacagctgccaacttctgccagaatggcaagtatgctgtgattggcacctatgatggccgctgcatcttctatgacacagagcacctgaagtaccacacccagatccacgtgcgcagcacccggggcaggaacaaggtgggcaggaagatcaccggcatcgagcccctgcccggggagaacaagatcctggtgaccagcaatgacagccgcatccggctgtatgacctgcgggacctgagcctgtccatgaagtacaagggctacgtgaacagcagcagccagatcaaggccagcttcagccatgacttcacctacctggtgtctggcagcgaggacaagtatgtgtacatctggagcacctaccatgacctgagcaagttcacctctgtgcggcgggacagaaatgacttctgggagggcatcaaggcccacaatgctgtggtgaccagcgccatctttgcccccaaccccagcctgatgctgagcctggatgtgcagagcgagaagtctgagggcaatgagaagtcagaagatgctgaggtgctggatgccacccccagcgccatgagcagccgctacgtggcccaggccggcctggagctgctggccagcaagcgctactatgaggacagatag

SEQ ID NO: 39930 - DNA, 1116 bp, Artificial Sequence
  Description of Artificial Sequence: Synthetic coding sequence
atgacccagcagcccctgcggggcgtgaccagcctgcgcttcaaccaggaccagagctgcttctgctgtgccatggagactggagtgcgcatctacaacgtggagcccctgatggagaagggccacctggaccacgagcaggtgggctccatgggcctggtggagatgctgcacaggagcaacctgctggccctggtgggcggcggcagcagccccaagttcagcgagatctctgtgctgatctgggatgatgcccgggagggcaaggacagcaaggagaagctggtgctggagttcaccttcaccaagcctgtgctgtctgtgaggatgagacatgacaagatcgtgattgtgctgaagaaccgcatctacgtgtacagcttcccagacaaccccaggaagctgtttgaatttgacacccgggacaaccccaaggccgcccaccccaccccccacctgcacaccctgggcctgtgtgacctgtgccccagcctggagaagcagctgctggtgtttcctggccacaagtgtggcagcctgcagctggtggacctggccagcaccaagccaggcaccagcagcgcccccttcaccatcaatgcccaccagagcgacatcgcctgtgtgtccctgaaccagcccggcaccgtggtggccagcgccagccagaagggcaccctcatccggctgtttgacacccagagcaaggagaagctggtggagctgcggcggggcacagatcctgccaccctgtactgcatcaacttcagccatgacagcagcttcctgtgtgccagcagtgacaagggcaccgtgcacatctttgccctgaaggacacccggctgaacagaagaagtgccctggcccgggtgggcaaggtgggccccatgattggccagtatgtggacagccagtggagcctggccagcttcaccgtgcctgctgagagcgcctgcatctgtgcctttggaagaaacaccagcaagaatgtgaacagcgtgattgccatctgtgtggatggcaccttccacaagtatgtgttcaccccagatggcaactgcaaccgggaggcctttgatgtgtacctggacatctgtgatgatgatgacttctag

SEQ ID NO: 39931 - DNA, 1086 bp, Artificial Sequence
  Description of Artificial Sequence: Synthetic coding sequence
atgacccagcagcccctgcggggcgtgaccagcctgcgcttcaaccaggaccagagctgcttctgctgtgccatggagactggagtgcgcatctacaacgtggagcccctgatggagaagggccacctggaccacgagcaggtgggctccatgggcctggtggagatgctgcacaggagcaacctgctggccctggtgggcggcggcagcagccccaagttcagcgagatctctgctgtgctgatctgggatgatgcccgggagggcaaggacagcaaggagaagctggtgctggagttcaccttcaccaagcctgtgctgtctgtgaggatgagacatgacaagatcgtcatcgtgctgaagaaccgcatctacgtgtacagcttcccagacaaccccaggaagctgtttgaatttgacacccgggacaaccccaagggcctgtgtgacctgtgccccagcctggagaagcagctgctggtgtttcctggccacaagtgtggcagcctgcagctggtggacctggccagcaccaagccaggcaccagcagcgcccccttcaccatcaatgcccaccagagcgacatcgcctgtgtgtccctgaaccagcccggcaccgtggtggccagcgccagccagaagggcaccctcatccggctgtttgacacccagagcaaggagaagctggtggagctgcggcggggcacagatcctgccaccctgtactgcatcaacttcagccatgacagcagcttcctgtgtgccagcagtgacaagggcaccgtgcacatctttgccctgaaggacacccggctgaacagaagaagtgccctggcccgggtgggcaaggtgggccccatgattggccagtatgtggacagccagtggagcctggccagcttcaccgtgcctgctgagagcgcctgcatctgtgcctttggaagaaacaccagcaagaatgtgaacagcgtgattgccatctgtgtggatggcaccttccacaagtatgtgttcaccccagatggcaactgcaaccgggaggcctttgatgtgtacctggacatctgtgatgatgatgacttctag

SEQ ID NO: 39932 - DNA, 1086 bp, Artificial Sequence; identical to SEQ ID NO: 39931
  Description of Artificial Sequence: Synthetic coding sequence

SEQ ID NO: 39933 - DNA, 1083 bp, Artificial Sequence
  Description of Artificial Sequence: Synthetic coding sequence
atgacccagcagcccctgcggggcgtgaccagcctgcgcttcaaccaggaccagagctgcttctgctgtgccatggagactggagtgcgcatctacaacgtggagcccctgatggagaagggccacctggaccacgagcaggtgggctccatgggcctggtggagatgctgcacaggagcaacctgctggccctggtgggcggcggcagcagccccaagttcagcgagatctctgtgctgatctgggatgatgcccgggagggcaaggacagcaaggagaagctggtgctggagttcaccttcaccaagcctgtgctgtctgtgaggatgagacatgacaagatcgtgattgtgctgaagaaccgcatctacgtgtacagcttcccagacaaccccaggaagctgtttgaatttgacacccgggacaaccccaagggcctgtgtgacctgtgccccagcctggagaagcagctgctggtgtttcctggccacaagtgtggcagcctgcagctggtggacctggccagcaccaagccaggcaccagcagcgcccccttcaccatcaatgcccaccagagcgacatcgcctgtgtgtccctgaaccagcccggcaccgtggtggccagcgccagccagaagggcaccctcatccggctgtttgacacccagagcaaggagaagctggtggagctgcggcggggcacagatcctgccaccctgtactgcatcaacttcagccatgacagcagcttcctgtgtgccagcagtgacaagggcaccgtgcacatctttgccctgaaggacacccggctgaacagaagaagtgccctggcccgggtgggcaaggtgggccccatgattggccagtatgtggacagccagtggagcctggccagcttcaccgtgcctgctgagagcgcctgcatctgtgccttcggcaggaacaccagcaagaatgtgaacagcgtcatcgccatctgtgtggatggcaccttccacaagtatgtgttcaccccagatggcaactgcaaccgggaggcctttgatgtgtacctggacatctgtgatgatgatgacttctag

SEQ ID NO: 39934 - DNA, 168 bp, Artificial Sequence
  Description of Artificial Sequence: Synthetic coding sequence
atgacccagcagcccctgcggggcgtgaccagcctgcgcttcaaccaggaccagagctgcttctgctgtgccatggagactggagtgcgcatctacaacgtggagcccctgatggagaagggccacctggaccacgagcaggtgggctccatgggcctggtggagtag

SEQ ID NO: 39935 - DNA, 477 bp, Artificial Sequence
  Description of Artificial Sequence: Synthetic coding sequence
atgacccagcagcccctgcggggcgtgaccagcctgcgcttcaaccaggaccagagctgcttctgctgtgccatggagactggagtgcgcatctacaacgtggagcccctgatggagaagggccacctggaccacgagcaggtgggctccatgggcctggtggagatgctgcacaggagcaacctgctggccctggtgggcggcggcagcagccccaagttcagcgagatctctgtgctgatctgggatgatgcccgggagggcaaggacagcaaggagaagctggtgctggagttcaccttcaccaagcctgtgctgtctgtgaggatgagacatgacaagatcgtgattgtgctgaagaaccgcatctacgtgtacagcttcccagacaaccccaggaagctgtttgaatttgacacccgggacaaccccaaggccgcccaccccaccccccacctgcacaccctgggcctgtag

SEQ ID NO: 39936 - DNA, 879 bp, Artificial Sequence
  Description of Artificial Sequence: Synthetic coding sequence
atgacccagcagcccctgcggggcgtgaccagcctgcgcttcaaccaggaccagagctgcttctgctgtgccatggagactggagtgcgcatctacaacgtggagcccctgatggagaagggccacctgggcctgtgtgacctgtgccccagcctggagaagcagctgctggtgtttcctggccacaagtgtggcagcctgcagctggtggacctggccagcaccaagccaggcaccagcagcgcccccttcaccatcaatgcccaccagagcgacatcgcctgtgtgtccctgaaccagcccggcaccgtggtggccagcgccagccagaagggcaccctcatccggctgtttgacacccagagcaaggagaagctggtggagctgcggcggggcacagatcctgccaccctgtactgcatcaacttcagccatgacagcagcttcctgtgtgccagcagtgacaagggcaccgtgcacatctttgccctgaaggacacccggctgaacagaagaagtgcctacgtgcggcccctgcacaccctgctgagcgccctggtggtggccgtggccctgggcgtgctggtgtgggccgctgagaccagggctgctgtgcggcgctgcagaagaagccaccctgctgcctgcctggccgctgtgctggccgtgggcctgctggtgctgtgggtggccggcggggcctgcaccttcctgttcagcattgctggccctgtgctgctgatcctggtgcacgccagcctgcggctgaggaacctgaagaacaagattgagaacaagattgagagcatcggcctgaagaggacccccatgggcctgctgctggaggccctgggccaggagcaggaggccggcagctag

SEQ ID NO: 39937 - DNA, 630 bp, Artificial Sequence
  Description of Artificial Sequence: Synthetic coding sequence
atggacagtgatgagaccggctttgagcacagcggcctgtgggtgtctgtgctggccggcctgctgctgggcgcctgccaggcccaccccatcccagacagcagccccctgctgcagtttggaggccaggtgcggcagcgctacctgtacacagatgatgcccagcagacagaggcccacctggagatcagagaagatggcaccgtgggcggcgctgctgaccagagccctgagagcctgctgcagctgaaggccctgaagccaggagtcatccagatcctgggcgtgaagaccagccgcttcctgtgccagaggccagatggagccctgtatggcagcctgcactttgatcctgaggcctgcagcttccgggagctgctgctggaggatggctacaacgtgtaccagagcgaggcccacggcctgcccctgcacctgcccggcaacaagagcccccaccgggaccctgccccccggggccctgcccgcttcctgcccctgcccggcctgcccccagccctgcctgagcccccaggcatcctggccccccagcccccagatgtgggcagcagtgaccccctgtccatggtgggccccagccagggccgcagccccagctatgccagctag

SEQ ID NO: 39938 - DNA, 321 bp, Artificial Sequence
  Description of Artificial Sequence: Synthetic coding sequence
atgagcaccaacaacatgtctgacccccggcggcccaacaaggtgctgcgctacaagcccccaccttctgagtgcaacccagccctggatgaccccaccccagactacatgaacctgctgggcatgatcttctccatgtgtggcctgatgctgaagctgaagtggtgtgcctgggtggccgtgtactgcagcttcatcagctttgccaacagccgcagcagcgaggacaccaagcagatgatgagcagcttcatgctgagcatctctgctgtggtgatgagctacctgcagaacccccagcccatgaccccaccctggtag

SEQ ID NO: 39939 - DNA, 2061 bp, Artificial Sequence
  Description of Artificial Sequence: Synthetic coding sequence
atgtccttcccccggggcagccagacccagaagatcaagcaccccatcggcaccaggaagggccccctggaggtgcccccacccacagagaaggactggcccaaggatgatgagcaggaccacgtgctggtggaccctgatgaggagctggacagcctgccccagccctacaggatgatcaacaagctggtgaacctgctgtttgaccagagctgggagatcatcgaggagagaaatgccctgcgggaggccgagagcagccagatccagcccaccgtgtacccacccctgggggagatccagctgaacaagatgcccaactgcatggctgtgtcccaggactatgtgttcatcggcggggccaagggcttcagcatctacaacctgtacagcgccaagcagatctatgcctgggagaagctgaaggtggatgtgaccagcatctgggccacagacctgggcaatgagatcctgattgcccctgtggatgagatgggcatcatccgcctcttctacttctacaaggagggcctgtacctggtgaaggccatcaatgaggtggatgacaccagcaagcagaccacctgcatcaagatggagatcagccagggcggggactttgctgccttcctgctgcagggcgctggggacatctggctggatgtgtacaagctgcccaaggagacctggctgaagaagctggagcacccccagctgaccagcaaccccaagaagaaggtgcggcagccccagctgaacagcctgggccccatctctgctgaccccctggagatggatgccaacgtgtccttcaagggggacatcaagctgagcctgcctgtgtacatcatgaagatcaagccacccaagcctgtgacaggcaccaccttcaagagccccctggaggtgtttgccaagatcaaggactgctacggcctgggcagcggccagaaccacttcatcaaggacagccagtgggagcagcaggccgagatcttcaatgccagctacaagaagtacctggaccgggagtgggaggaggagcccctgagcacagccaccttctacttcctgctgcccagctgcctgtttgccatgcctcctgaggtgaagggccccagcggcatggcctgtgtgctgggcatccactggaccaggagccacaacttcttcctgtacagcctgaacagaaccctgaaggacaaggctgaccctgagggcgtgtggccctgtgccgcccccatcgctgtgtcccagctgagctgcagcagcagctacctggtgctggcctgtgaagatggagtgctgaccctgtgggacctggccaagggcttccccctgggcgtggccgccctgccccagggctgcttctgccagagcatccacttcctgaagtacttctctgtgcacaagggccagaacatgtacccagagggccaggtgaagagccagatgaagtgtgtggtgctgtgcacagatgccagcctgcacctggtggaggccagcggcacccagggccccaccatctctgtgctggtggagaggcctgtgaagcacctggacaagaccatctgtgctgtggcccctgtgcctgccctgcccggcatggtgctgatcttcagcaagaatggatctgtgtgcctgatggatgtggccaagcgggagatcatctgtgcctttgcccctcctggggccttccccctggaggtgccctggaagcctgtgtttgctgtgtccccagaccacccctgcttcctgctgcggggggactacagccatgaaacagccagcacagatgatgctggcatccagtacagcgtcttctacttcaactttgaggcctgccccctgctggagaacatcagcaagaactgcaccatcccccagagggacctggacaacatggccttcccccaggccctgcccctggagaagagatgtgagcgcttcctgcagaagagctacaggaagctggagaagaaccctgagaaggaggaggagcactgggcccggctgcagcgctacagcctgagcctgcagcgggagaacttcaagaagtag

SEQ ID NO: 39940 - DNA, 1977 bp, Artificial Sequence
  Description of Artificial Sequence: Synthetic coding sequence
atgtccttcccccggggcagccagacccagaagatcaagcaccccatcggcaccaggaagggccccctggaggtgcccccacccacagagaaggactggcccaaggatgatgagcaggaccacgtgctggtggaccctgatgaggagctggacagcctgccccagccctacaggatgatcaacaagctggtgaacctgctgtttgaccagagctgggagatcatcgaggagagaaatgccctgcgggaggccgagagcagccagatccagcccaccgtgtacccacccctgggggagatccagctgaacaagatgcccaactgcatggctgtgtcccaggactatgtgttcatcggcggggccaagggcttcagcatctacaacctgtacagcgccaagcagatctatgcctgggagaagctgaaggtggatgtgaccagcatctgggccacagacctgggcaatgagatcctgattgcccctgtggatgagatgggcatcatccgcctcttctacttctacaaggagggcctgtacctggtgaaggccatcaatgaggtggatgacaccagcaagcagaccacctgcatcaagatggagatcagccagggcggggactttgctgccttcctgctgcagggcgctggggacatctggctggatgtgtacaagctgcccaaggagacctggctgaagaagctggagcacccccagctgaccagcaaccccaagaagaaggtgcggcagccccagctgaacagcctgggccccatctctgctgaccccctggagatggatgccaacgtgtccttcaagggggacatcaagctgagcctgcctgtgtacatcatgaagatcaagccacccaagcctgtgacaggcaccaccttcaagagccccctggaggtgtttgccaagatcaaggactgctacggcctgggcagcggccagaaccacttcatcaaggacagccagtgggagcagcaggccgagatcttcaatgccagctacaagaagtacctggaccgggagtgggaggaggagcccctgagcacagccaccttctacttcctgctgcccagctgcctgtttgccatgcctcctgaggtgaagggccccagcggcatggcctgtgtgctgggcatccactggaccaggagccacaacttcttcctgtacagcctgaacagaaccctgaaggacaaggctgaccctgagggcgtgtggccctgtgccgcccccatcgctgtgtcccagctgagctgcagcagcagctacctggtgctggcctgtgaagatggagtgctgaccctgtgggacctggccaagggccagaacatgtacccagagggccaggtgaagagccagatgaagtgtgtggtgctgtgcacagatgccagcctgcacctggtggaggccagcggcacccagggccccaccatctctgtgctggtggagaggcctgtgaagcacctggacaagaccatctgtgctgtggcccctgtgcctgccctgcccggcatggtgctgatcttcagcaagaatggatctgtgtgcctgatggatgtggccaagcgggagatcatctgtgcctttgcccctcctggggccttccccctggaggtgccctggaagcctgtgtttgctgtgtccccagaccacccctgcttcctgctgcggggggactacagccatgaaacagccagcacagatgatgctggcatccagtacagcgtcttctacttcaactttgaggcctgccccctgctggagaacatcagcaagaactgcaccatcccccagagggacctggacaacatggccttcccccaggccctgcccctggagaagagatgtgagcgcttcctgcagaagagctacaggaagctggagaagaaccctgagaaggaggaggagcactgggcccggctgcagcgctacagcctgagcctgcagcgggagaacttcaagaagtag

SEQ ID NO: 39941 - DNA, 1341 bp, Artificial Sequence
  Description of Artificial Sequence: Synthetic coding sequence
atggaggccgaggccgcagatgcccctcctgggggcgtggagagcgccctgagctgcttctccttcaaccaggactgcaccagcctggccaccggcaccaaggccggctacaagctgttcagcctgagctctgtggagcagctggaccaggtgcacggcagcaatgagatcccagatgtgtacatcgtggagcggctcttcagcagcagcctggtggtggtggtgagccacaccaagccccggcagatgaatgtgtaccacttcaagaagggcacagagatctgcaactacagctacagcagcaacatcctgagcatccggctgaaccggcagaggctgctggtgtgcctggaggagagcatctacatccacaacatcaaggacatgaagctgctgaagaccctgctggacatcccagccaaccccaccggcctgtgtgccctgagcatcaaccacagcaacagctacctggcctacccaggcagcctgaccagcggggagatcgtgctgtatgatggcaacagcctgaagacagtgtgcaccatcgccgcccacgagggcaccctggccgccatcaccttcaatgccagcggcagcaagctggccagcgccagcgagaagggcaccgtcatccgggtcttctctgtgcctgatggccagaagctgtatgagttccggcggggcatgaagcgctacgtgaccatcagcagcctggtgttctccatggacagccagttcctgtgtgccagcagcaacacagaaacagtgcacatcttcaagctggagcaggtgaccaacagcaggcctgaggagcccagcacctggagcggctacatgggcaagatgttcatggccgccaccaactacctgcccacccaggtgtctgacatgatgcaccaggaccgggcctttgccacagcccggctgaacttcagcggccagaggaacatctgcaccctgagcaccatccagaagctgccccggctgctggtggccagcagcagcggccacctgtacatgtacaacctggacccccaggatggaggagaatgtgtgctgatcaagacccacagcctgctgggcagcggcaccacagaggagaacaaggaaaatgacctgcggcccagcctgccccagagctatgctgccaccgtggcccggcccagcgccagcagcgccagcacagtgcccggctacagtgaagatggaggagccctgcggggggaggtgattcctgagcacgagtttgccaccggccctgtgtgcctggatgatgaaaatgagttcccccccatcatcctgtgccggggcaaccagaagggcaagaccaagcagagctag

SEQ ID NO: 39942 - DNA, 1095 bp, Artificial Sequence
  Description of Artificial Sequence: Synthetic coding sequence
atgaatgtgtaccacttcaagaagggcacagagatctgcaactacagctacagcagcaacatcctgagcatccggctgaaccggcagaggctgctggtgtgcctggaggagagcatctacatccacaacatcaaggacatgaagctgctgaagaccctgctggacatcccagccaaccccaccggcctgtgtgccctgagcatcaaccacagcaacagctacctggcctacccaggcagcctgaccagcggggagatcgtgctgtatgatggcaacagcctgaagacagtgtgcaccatcgccgcccacgagggcaccctggccgccatcaccttcaatgccagcggcagcaagctggccagcgccagcgagaagggcaccgtcatccgggtcttctctgtgcctgatggccagaagctgtatgagttccggcggggcatgaagcgctacgtgaccatcagcagcctggtgttctccatggacagccagttcctgtgtgccagcagcaacacagaaacagtgcacatcttcaagctggagcaggtgaccaacagcaggcctgaggagcccagcacctggagcggctacatgggcaagatgttcatggccgccaccaactacctgcccacccaggtgtctgacatgatgcaccaggaccgggcctttgccacagcccggctgaacttcagcggccagaggaacatctgcaccctgagcaccatccagaagctgccccggctgctggtggccagcagcagcggccacctgtacatgtacaacctggacccccaggatggaggagaatgtgtgctgatcaagacccacagcctgctgggcagcggcaccacagaggagaacaaggaaaatgacctgcggcccagcctgccccagagctatgctgccaccgtggcccggcccagcgccagcagcgccagcacagtgcccggctacagtgaagatggaggagccctgcggggggaggtgattcctgagcacgagtttgccaccggccctgtgtgcctggatgatgaaaatgagttcccccccatcatcctgtgccggggcaaccagaagggcaagaccaagcagagctag

SEQ ID NO: 39943 - DNA, 1365 bp, Artificial Sequence
  Description of Artificial Sequence: Synthetic coding sequence
atgaacctggccagccagagcggggaggccggggccggccagctgctgtttgccaacttcaaccaggacaacacagaggtgaagggggccagcagagctgctggcctgggccggcgggctgtggtgtggagcctggccgtgggcagcaagagcggctacaagttcttcagcctgagctctgtggacaagctggagcagatctatgaatgtacagacacagaagatgtgtgcatcgtggagcggctcttcagcagcagcctggtggccatcgtgtccctgaaggcccccaggaagctgaaggtgtgccacttcaagaagggcacagagatctgcaactacagctacagcaacaccatcctggccgtgaagctgaaccggcagaggctcatcgtgtgcctggaggagagcctgtacatccacaacatccgggacatgaaggtgctgcacaccatccgggagaccccacccaacccagctggcctgtgtgccctgagcatcaacaatgacaactgctacctggcctacccaggcagcgccaccatcggggaggtgcaggtgtttgacaccatcaacctgcgggccgccaacatgatcccagcccatgacagccccctggccgccctggcctttgatgccagcggcaccaagctggccacagccagcgagaagggcaccgtcatccgggtcttcagcatccctgagggccagaagctgtttgagttccggcggggcgtgaagagatgtgtgtccatctgcagcctggccttctccatggatggcatgttcctgagcgccagcagcaacacagaaacagtgcacatcttcaagctggagaccgtgaaggagaagcccccagaggagcccaccacctggacaggctactttgggaaggtgctgatggccagcaccagctacctgcccagccaggtgacagagatgttcaaccagggccgggcctttgccaccgtgcggctgcccttctgtggccacaagaacatctgcagcctggccaccatccagaagatcccccggctgctggtgggcgctgctgatggctacctgtacatgtacaacctggacccccaggagggcggggagtgtgccctgatgaagcagcaccggctggatggcagcctggagaccaccaatgagatcctggacagcgccagccatgactgccccctggtgacccagacctacggggctgctgctgggaagggcacctacgtgcccagcagccccacccggctggcctacacagatgacctgggcgctgtgggcggggcctgcctggaggatgaggccagcgccctgcggctggatgaggacagcgagcacccccccatgatcctgaggacagactag

SEQ ID NO: 39944 - DNA, 1314 bp, Artificial Sequence
  Description of Artificial Sequence: Synthetic coding sequence
atgctgctgcggctgcagaggatcaagaccctgcggcccccaggctgcccccaccccatgaccacctgcagcgctggcaccctgtctgctgtgccctgtgtgagcccccggcaggtgtttgtgtttgagcggcgcttctgcctgtggagccacgtggagatgttcacccacgtgctgccctttgtgatctctgctgacacagaagatgtgtgcatcgtggagcggctcttcagcagcagcctggtggccatcgtgtccctgaaggcccccaggaagctgaaggtgtgccacttcaagaagggcacagagatctgcaactacagctacagcaacaccatcctggccgtgaagctgaaccggcagaggctcatcgtgtgcctggaggagagcctgtacatccacaacatccgggacatgaaggtgctgcacaccatccgggagaccccacccaacccagctggcctgtgtgccctgagcatcaacaatgacaactgctacctggcctacccaggcagcgccaccatcggggaggtgcaggtgtttgacaccatcaacctgcgggccgccaacatgatcccagcccatgacagccccctggccgccctggcctttgatgccagcggcaccaagctggccacagccagcgagaagggcaccgtcatccgggtcttcagcatccctgagggccagaagctgtttgagttccggcggggcgtgaagagatgtgtgtccatctgcagcctggccttctccatggatggcatgttcctgagcgccagcagcaacacagaaacagtgcacatcttcaagctggagaccgtgaaggagaagcccccagaggagcccaccacctggacaggctactttgggaaggtgctgatggccagcaccagctacctgcccagccaggtgacagagatgttcaaccagggccgggcctttgccaccgtgcggctgcccttctgtggccacaagaacatctgcagcctggccaccatccagaagatcccccggctgctggtgggcgctgctgatggctacctgtacatgtacaacctggacccccaggagggcggggagtgtgccctgatgaagcagcaccggctggatggcagcctggagaccaccaatgagatcctggacagcgccagccatgactgccccctggtgacccagacctacggggctgctgctgggaaggcctacacagatgacctgggcgctgtgggcggggcctgcctggaggatgaggccagcgccctgcggctggatgaagattctgagcacccccccatgatcctgaggacagactag

SEQ ID NO: 39945 - DNA, 1278 bp, Artificial Sequence
  Description of Artificial Sequence: Synthetic coding sequence
atgaacctggccagccagagcggggaggccggggccggccagctgctgtttgccaacttcaaccaggacaacaccagcctggccgtgggcagcaagagcggctacaagttcttcagcctgagctctgtggacaagctggagcagatctatgaatgtacagacacagaagatgtgtgcatcgtggagcggctcttcagcagcagcctggtggccatcgtgtccctgaaggcccccaggaagctgaaggtgtgccacttcaagaagggcacagagatctgcaactacagctacagcaacaccatcctggccgtgaagctgaaccggcagaggctcatcgtgtgcctggaggagagcctgtacatccacaacatccgggacatgaaggtgctgcacaccatccgggagaccccacccaacccagctggcctgtgtgccctgagcatcaacaatgacaactgctacctggcctacccaggcagcgccaccatcggggaggtgcaggtgtttgacaccatcaacctgcgggccgccaacatgatcccagcccatgacagccccctggccgccctggcctttgatgccagcggcaccaagctggccacagccagcgagaagggcaccgtcatccgggtcttcagcatccctgagggccagaagctgtttgagttccggcggggcgtgaagagatgtgtgtccatctgcagcctggccttctccatggatggcatgttcctgagcgccagcagcaacacagaaacagtgcacatcttcaagctggagaccgtgaaggagaagcccccagaggagcccaccacctggacaggctactttgggaaggtgctgatggccagcaccagctacctgcccagccaggtgacagagatgttcaaccagggccgggcctttgccaccgtgcggctgcccttctgtggccacaagaacatctgcagcctggccaccatccagaagatcccccggctgctggtgggcgctgctgatggctacctgtacatgtacaacctggacccccaggagggcggggagtgtgccctgatgaagcagcaccggctggatggcagcctggagaccaccaatgagatcctggacagcgccagccatgactgccccctggtgacccagacctacggggctgctgctgggaaggcctacacagatgacctgggcgctgtgggcggggcctgcctggaggatgaggccagcgccctgcggctggatgaagattctgagcacccccccatgatcctgaggacagactag

SEQ ID NO: 39946 - DNA, 1311 bp, Artificial Sequence
  Description of Artificial Sequence: Synthetic coding sequence
atgaacctggccagccagagcggggaggccggggccggccagctgctgtttgccaacttcaaccaggacaacaccagcctggccgtgggcagcaagagcggctacaagttcttcagcctgagctctgtggacaagctggagcagatctatgaatgtacagacacagaagatgtgtgcatcgtggagcggctcttcagcagcagcctggtggccatcgtgtccctgaaggcccccaggaagctgaaggtgtgccacttcaagaagggcacagagatctgcaactacagctacagcaacaccatcctggccgtgaagctgaaccggcagaggctcatcgtgtgcctggaggagagcctgtacatccacaacatccgggacatgaaggtgctgcacaccatccgggagaccccacccaacccagctggcctgtgtgccctgagcatcaacaatgacaactgctacctggcctacccaggcagcgccaccatcggggaggtgcaggtgtttgacaccatcaacctgcgggccgccaacatgatcccagcccatgacagccccctggccgccctggcctttgatgccagcggcaccaagctggccacagccagcgagaagggcaccgtcatccgggtcttcagcatccctgagggccagaagctgtttgagttccggcggggcgtgaagagatgtgtgtccatctgcagcctggccttctccatggatggcatgttcctgagcgccagcagcaacacagaaacagtgcacatcttcaagctggagaccgtgaaggagaagcccccagaggagcccaccacctggacaggctactttgggaaggtgctgatggccagcaccagctacctgcccagccaggtgacagagatgttcaaccagggccgggcctttgccaccgtgcggctgcccttctgtggccacaagaacatctgcagcctggccaccatccagaagatcccccggctgctggtgggcgctgctgatggctacctgtacatgtacaacctggacccccaggagggcggggagtgtgccctgatgaagcagcaccggctggatggcagcctggagaccaccaatgagatcctggacagcgccagccatgactgccccctggtgacccagacctacggggctgctgctgggaagggcacctacgtgcccagcagccccacccggctggcctacacagatgacctgggcgctgtgggcggggcctgcctggaggatgaggccagcgccctgcggctggatgaggacagcgagcacccccccatgatcctgaggacagactag

SEQ ID NO: 39947 - DNA, 1332 bp, Artificial Sequence
  Description of Artificial Sequence: Synthetic coding sequence
atgaacctggccagccagagcggggaggccggggccggccagctgctgtttgccaacttcaaccaggacaacacagaggtgaagggggccagcagagctgctggcctgggccggcgggctgtggtgtggagcctggccgtgggcagcaagagcggctacaagttcttcagcctgagctctgtggacaagctggagcagatctatgaatgtacagacacagaagatgtgtgcatcgtggagcggctcttcagcagcagcctggtggccatcgtgtccctgaaggcccccaggaagctgaaggtgtgccacttcaagaagggcacagagatctgcaactacagctacagcaacaccatcctggccgtgaagctgaaccggcagaggctcatcgtgtgcctggaggagagcctgtacatccacaacatccgggacatgaaggtgctgcacaccatccgggagaccccacccaacccagctggcctgtgtgccctgagcatcaacaatgacaactgctacctggcctacccaggcagcgccaccatcggggaggtgcaggtgtttgacaccatcaacctgcgggccgccaacatgatcccagcccatgacagccccctggccgccctggcctttgatgccagcggcaccaagctggccacagccagcgagaagggcaccgtcatccgggtcttcagcatccctgagggccagaagctgtttgagttccggcggggcgtgaagagatgtgtgtccatctgcagcctggccttctccatggatggcatgttcctgagcgccagcagcaacacagaaacagtgcacatcttcaagctggagaccgtgaaggagaagcccccagaggagcccaccacctggacaggctactttgggaaggtgctgatggccagcaccagctacctgcccagccaggtgacagagatgttcaaccagggccgggcctttgccaccgtgcggctgcccttctgtggccacaagaacatctgcagcctggccaccatccagaagatcccccggctgctggtgggcgctgctgatggctacctgtacatgtacaacctggacccccaggagggcggggagtgtgccctgatgaagcagcaccggctggatggcagcctggagaccaccaatgagatcctggacagcgccagccatgactgccccctggtgacccagacctacggggctgctgctgggaaggcctacacagatgacctgggcgctgtgggcggggcctgcctggaggatgaggccagcgccctgcggctggatgaagattctgagcacccccccatgatcctgaggacagactag

SEQ ID NO: 39948 - DNA, 1155 bp, Artificial Sequence
  Description of Artificial Sequence: Synthetic coding sequence
atgttcacccacgtgctgcccttcgtcatctctgctgacacagaagatgtgtgcatcgtggagcggctcttcagcagcagcctggtggccatcgtgtccctgaaggcccccaggaagctgaaggtgtgccacttcaagaagggcacagagatctgcaactacagctacagcaacaccatcctggccgtgaagctgaaccggcagaggctgattgtgtgcctggaggagagcctgtacatccacaacatccgggacatgaaggtgctgcacaccatccgggagaccccacccaacccagctggcctgtgtgccctgagcatcaacaatgacaactgctacctggcctacccaggcagcgccaccatcggggaggtgcaggtgtttgacaccatcaacctgcgggccgccaacatgatcccagcccatgacagccccctggccgccctggcctttgatgccagcggcaccaagctggccacagccagcgagaagggcaccgtcatccgggtcttcagcatccctgagggccagaagctgtttgagttcagaagaggagtgaagagatgtgtgtccatctgcagcctggccttctccatggatggcatgttcctgagcgccagcagcaacacagagaccgtgcacatcttcaagctggagaccgtgaaggagaagcccccagaggagcccaccacctggacaggctactttgggaaggtgctgatggccagcaccagctacctgcccagccaggtgacagagatgttcaaccagggccgggcctttgccaccgtgcggctgcccttctgtggccacaagaacatctgcagcctggccaccatccagaagatcccccggctgctggtgggcgctgctgatggctacctgtacatgtacaacctggacccccaggagggcggagaatgtgccctgatgaagcagcaccggctggatggcagcctggagaccaccaatgagatcctggacagcgccagccatgactgccccctggtgacccagacctatggagctgctgctgggaaggcctacacagatgacctgggcgctgtgggcggggcctgcctggaggatgaggccagcgccctgcggctggatgaggacagcgagcacccccccatgatcctgaggacagactag

SEQ ID NO: 39949 - DNA, 1035 bp, Artificial Sequence
  Description of Artificial Sequence: Synthetic coding sequence
atgaacctgctgccctgcaacccccatggaaatggcctgctgtatgccggcttcaaccaggaccacggctgctttgcctgtggcatggagaatggcttccgggtgtacaacacagaccccctgaaggagaaggagaagcaggagttcctggagggcggcgtgggccacgtggagatgctgttccgctgcaactacctggccctggtgggcggcggcaagaagcccaagtacccacccaacaaggtgatgatctgggatgacctgaagaagaagacagtcatcgagattgagttcagcacagaggtgaaggctgtgaagctgcggcgggaccgcatcgtggtggtgctggacagcatgatcaaggtgttcaccttcacccacaacccccaccagctgcacgtgtttgagacctgctacaaccccaagggcctgtgtgtgctgtgccccaacagcaacaacagcctgctggccttccctggcacccacactggacatgtgcagctggtggacctggccagcacagagaagccccctgtggacatcccagcccacgagggcgtgctgagctgcatcgccctgaacctgcagggcacccgcatcgccacagccagcgagaagggcaccctcatccgcatctttgacaccagcagcggccacctgatccaggagctgcggcggggcagccaggccgccaacatctactgcatcaacttcaaccaggatgccagcctcatctgtgtgtccagtgaccatggaacagtgcacatctttgctgctgaggaccccaagaggaacaagcagagcagcctggccagcgccagcttcctgcccaagtacttcagcagcaagtggagcttcagcaagttccaggtgcccagcggcagcccctgcatctgtgcctttggaacagagcccaatgctgtgattgccatctgtgctgatggcagctactacaagttcctgttcaaccccaagggggagtgcatcagagatgtgtatgcccagttcctggagatgacagatgacaagctgtag

SEQ ID NO: 39950 - DNA, 951 bp, Artificial Sequence
  Description of Artificial Sequence: Synthetic coding sequence
atggagaatggcttccgggtgtacaacacagaccccctgaaggagaaggagaagcaggagttcctggagggcggcgtgggccacgtggagatgctgttccgctgcaactacctggccctggtgggcggcggcaagaagcccaagtacccacccaacaaggtgatgatctgggatgacctgaagaagaagacagtcatcgagattgagttcagcacagaggtgaaggctgtgaagctgcggcgggaccgcatcgtggtggtgctggacagcatgatcaaggtgttcaccttcacccacaacccccaccagctgcacgtgtttgagacctgctacaaccccaagggcctgtgtgtgctgtgccccaacagcaacaacagcctgctggccttccctggcacccacactggacatgtgcagctggtggacctggccagcacagagaagccccctgtggacatcccagcccacgagggcgtgctgagctgcatcgccctgaacctgcagggcacccgcatcgccacagccagcgagaagggcaccctcatccgcatctttgacaccagcagcggccacctgatccaggagctgcggcggggcagccaggccgccaacatctactgcatcaacttcaaccaggatgccagcctcatctgtgtgtccagtgaccatggaacagtgcacatctttgctgctgaggaccccaagaggaacaagcagagcagcctggccagcgccagcttcctgcccaagtacttcagcagcaagtggagcttcagcaagttccaggtgcccagcggcagcccctgcatctgtgcctttggaacagagcccaatgctgtgattgccatctgtgctgatggcagctactacaagttcctgttcaaccccaagggggagtgcatcagagatgtgtatgcccagttcctggagatgacagatgacaagctgtag

SEQ ID NO: 39951 - DNA, 1395 bp, Artificial Sequence
  Description of Artificial Sequence: Synthetic coding sequence
atggccctggtggccctggtggccggggcccggctgggccggcggctgagcggccctggcctgggccggggccactggacagctgcccggcgcagccgcagcagaagagaggccgctgaggccgaggccgaggtgcctgtggtgcagtatgtgggggagagagctgcccgggctgacagagtgtttgtgtggggcttctccttcagcggggccctgggcgtgcccagctttgtggtgcccagcagcggccctggcccccgggccggggcccggccccggcggcgcatccagcctgtgccctaccgcctggagctggaccagaagatcagcagcgctgcctgtggctacggcttcaccctgctgagcagcaagacagcagatgtgaccaaggtgtggggcatgggcctgaacaaggacagccagctgggcttccacaggagcaggaaggacaagacccggggctatgaatatgtgctggagcccagccctgtgtccctgcccctggaccggccccaggagaccagggtgctgcaggtgtcctgtggccgggcccacagcctggtgctgacagaccgggagggcgtcttctccatgggcaacaacagctatggccagtgtggcaggaaggtggtggagaatgagatctacagcgagagccaccgggtgcacaggatgcaggactttgatggccaggtggtgcaggtggcctgtggccaggaccacagcctcttcctgacagacaagggggaggtgtacagctgtggctggggcgcagatggccagacaggcctgggccactacaacatcaccagcagccccaccaagctgggcggggacctggccggcgtgaatgtcatccaggtggccacctatggagactgctgcctggccgtgtctgcagatggcggcctgtttggctggggcaacagcgagtacctgcagctggcctctgtgacagacagcacccaggtgaatgtgccccgctgcctgcacttctctggagtgggcaaggtgcggcaggccgcctgtggcggcaccggctgtgctgtgctgaatggagagggccacgtgtttgtgtggggctacggcatcctgggcaagggccccaacctggtggagagcgctgtgcctgagatgatcccccccaccctgtttggcctgacagagttcaaccctgagatccaggtgagccgcatccgctgtggcctgagccactttgctgccctgaccaacaagggggagctgtttgtgtggggcaagaacatccggggctgcctgggcatcggccgcctggaggaccagtacttcccctggagggtgaccatgcctggagagcctgtggatgtggcctgtggggtggaccacatggtgaccctggccaagagcttcatctag

SEQ ID NO: 39952 - DNA, 1365 bp, Artificial Sequence
  Description of Artificial Sequence: Synthetic coding sequence
atggccctggtggccctggtggccggggcccggctgggccggcggctgagcggccctggcctgggccggggccactggacagctgcccggcgcagccgcagcagaagagaggccgctgaggccgaggccgaggtgcctgtggtgcagtatgtgggggagagagctgcccgggctgacagagtgtttgtgtggggcttctccttcagcggggccctgggcgtgcccagctttgtggtgcccagcagcggccctggcccccgggccggggcccggccccggcggcgcatccagcctgtgccctaccgcctggagctggaccagaagatcagcagcgctgcctgtggctacggcttcaccctgctgagcagcaagacagcagatgtgaccaaggtgtggggcatgggcctgaacaaggacagccagctgggcttccacaggagcaggaaggacaagacccggggctatgaatatgtgctggagcccagccctgtgtccctgcccctggaccggccccaggagaccagggtgctgcaggtgtcctgtggccgggcccacagcctggtgctgacagaccgggagggcgtcttctccatgggcaacaacagctatggccagtgtggcaggaaggtggtggagaatgagatctacagcgagagccaccgggtgcacaggatgcaggactttgatggccaggtggtgcaggtggcctgtggccaggaccacagcctcttcctgacagacaagggggaggtgtacagctgtggctggggcgcagatggccagacaggcctgggccactacaacatcaccagcagccccaccaagctgggcggggacctggccggcgtgaatgtcatccaggtggccacctatggagactgctgcctggccgtgtctgcagatggcggcctgtttggctggggcaacagcgagtacctgcagctggcctctgtgacagacagcacccaggtgaatgtgccccgctgcctgcacttctctggagtgggcaaggtgcggcaggccgcctgtggcggcaccggctgtgctgtgctgaatggagagggccacgtgtttgtgtggggctacggcatcctgggcaagggccccaacctggtggagagcgctgtgcctgagatgatcccccccaccctgtttggcctgacagagttcaaccctgagatccaggtgagccgcatccgctgtggcctgagccactttgctgccctgaccaacaagggggagctgtttgtgtggggcaagaacatccggggctgcctgggcatcggccgcctggaggaccagtacttcccctggagggccccagcccccagcgccagcgccaagaccaccggccccctgctgtag

SEQ ID NO: 39953 - DNA, 1077 bp, Artificial Sequence
  Description of Artificial Sequence: Synthetic coding sequence
atggccctggtggccctggtggccggggcccggctgggccggcggctgagcggccctggcctgggccggggccactggacagctgcccggcgcagccgcagcagaagagaggccgctgaggccgaggccgaggtgcctgtggtgcagtatgtgggggagagagctgcccgggctgacagagtgtttgtgtggggcttctccttcagcggggccctgggcgtgcccagctttgtggtgcccagcagcggccctggcccccgggccggggcccggccccggcggcgcatccagcctgtgccctaccgcctggagctggaccagaagatcagcagcgctgcctgtggctacggcttcaccctgctgagcagcaagacagcagatgtgaccaaggtgtggggcatgggcctgaacaaggacagccagctgggcttccacaggagcaggaaggacaagacccggggctatgaatatgtgctggagcccagccctgtgtccctgcccctggaccggccccaggagaccagggtgctgcaggtgtcctgtggccgggcccacagcctggtgctgacagaccgggagggcgtcttctccatgggcaacaacagctatggccagtgtggcaggaaggtggtggagaatgagatctacagcgagagccaccgggtgcacaggatgcaggactttgatggccaggtggtgcaggtggcctgtggccaggaccacagcctcttcctgacagacaagggggaggtgtacagctgtggctggggcgcagatggccagacaggcctgggccactacaacatcaccagcagccccaccaagctgggcggggacctggccggcgtgaatgtcatccaggtggccacctatggagactgctgcctggccgtgtctgcagatggcggcctgtttggctggggcaacagcgagtacctgcagctggcctctgtgacagacagcacccaggtgaatgtgccccgctgcctgcacttctctggagtgggcaaggtgcggcaggccgcctgtggcggcaccggctgtgctgtgctgaatgacacctggccccagagctag

SEQ ID NO: 39954 - DNA, 1797 bp, Artificial Sequence
  Description of Artificial Sequence: Synthetic coding sequence
atggccagcctgcggcgggtgaaggtgctgctggtgctgaacctgattgctgtggccggctttgtgctcttcctggccaagtgccggcccatcgctgtgcgctctggagatgccttccacgagatccggcccagggctgaggtggccaacctgagcgcccacagcgccagccccatccaggatgctgtgctgaagaggctgagcctgctggaggacatcgtgtaccggcagctgaatggcctgagcaagagcctgggcctcatcgagggctatggaggccggggcaagggcggcctgcctgccaccctgagccctgctgaggaggagaaggccaagggcccccatgagaagtatggctacaacagctacctgtctgagaagatcagcctggacaggagcatcccagactaccggcccaccaagtgcaaggagctgaagtacagcaaggacctgccccagatcagcatcatcttcatctttgtgaatgaggccctgagcgtcatcctgcggtctgtgcacagcgctgtgaaccacacccccacccacctgctgaaggagatcatcctggtggatgacaacagtgatgaggaggagctgaaggtgcccctggaggagtatgtgcacaagcgctacccaggcctggtgaaggtggtgaggaaccagaagcgggagggcctcatccgggccagaattgagggctggaaggtggccaccggccaggtgacaggcttctttgatgcccacgtggagttcaccgctggctgggccgagcctgtgctgagccgcatccaggagaacaggaagagggtcatcctgcccagcattgacaacatcaagcaggacaactttgaggtgcagagatatgaaaattctgcccacggctacagctgggagctgtggtgcatgtacatcagcccccccaaggactggtgggatgctggggaccccagcctgcccatccgcaccccagccatgattggctgcagctttgtggtgaacaggaagttctttggagagatcggcctgctggaccccggcatggatgtgtatggaggagaaaatattgagctgggcatcaaggtgtggctgtgtggcggctccatggaggtgctgccctgcagccgggtggcccacattgaaaggaagaagaagccctacaacagcaacatcggcttctacaccaagagaaatgccctgcgggtggccgaggtgtggatggatgactacaagagccacgtgtacatcgcctggaacctgcccctggagaaccctggcatcgacattggagatgtgtctgagcggcgggccctgaggaagagcctgaagtgcaagaacttccagtggtacctggaccacgtgtacccagagatgaggcgctacaacaacacagtggcctacggggagctgaggaacaacaaggccaaggatgtgtgcctggaccagggccccctggagaaccacacagccatcctgtacccctgccacggctggggcccccagctggcccgctacaccaaggagggcttcctgcacctgggcgccctgggcaccaccaccctgctgcctgacacccgctgcctggtggacaacagcaagagccggctgccccagctgctggactgtgacaaggtgaagagcagcctgtacaagcgctggaacttcatccagaatggagccatcatgaacaagggcaccggccgctgcctggaggtggagaacagaggcctggccggcatcgacctgatcctgcggagctgcaccggccagcgctggaccatcaagaacagcatcaagtag

SEQ ID NO: 39955 - DNA, 1728 bp, Artificial Sequence
  Description of Artificial Sequence: Synthetic coding sequence
atggccaagcccttcttccggctgcagaagttcctgcggaggacccagttcctgctcttcttcctgacagctgcctacctgatgacaggcagcctgctgctgctgcagagggtgcgggtggccctgccccagggcccccgggcccctggccccctgcagaccctgcctgtggccgctgtggccctgggcgtgggcctgctggacagccgggccctgcatgacccccgggtgtccccagagctgctgctgggcgtggacatgctgcagagccccctgacccggcccaggcctggcccccgctggctgcggagcagaaattctgagctgcggcagctgcggcggcgctggttccaccacttcatgtctgacagccagggccccccagccctgggccctgaggccgcccggcctgccatccacagccggggcacctacatcggctgcttcagtgatgatggccacgagaggaccctgaagggagctgtgttctatgacctgaggaagatgacagtgagccactgccaggatgcctgtgccgagaggagctatgtgtatgccggcctggaggccggggctgagtgctactgcggcaaccggctgcctgctgtgtctgtgggcctggaggagtgcaaccatgaatgtaaaggagagaagggctctgtgtgtggggctgtggaccggctgtctgtgtacagagtggatgagctgcagcccggcagcaggaagagaagaacagccacctaccggggctgcttccggctgcctgagaacatcacccacgccttccccagcagcctcatccaggccaacgtgacagtgggcacctgcagcggcttctgcagccagaaggagttccccctggccatcctgcggggctgggagtgctactgtgcctaccccaccccccgcttcaacctgagagatgccatggacagctctgtgtgtggccaggaccctgaggcccagaggctggccgagtactgtgaggtgtaccagacccctgtgcaggacacccgctgcacagaccggcgcttcctgcccaacaagagcaaggtgtttgtggccctgagcagcttccctggggccggcaacacctgggcccggcacctgattgaacatgccaccggcttctacacaggcagctactactttgatggcaccctgtacaacaagggcttcaagggggagaaggaccactggaggagcaggaggaccatctgtgtgaagacccatgaaagtggaagaagagaaattgagatgtttgattctgccatcctgctgatccggaacccctaccgcagcctggtggccgagttcaacagaaaatgtgccggccacctgggctacgccgctgacaggaactggaagagcaaggagtggccagactttgtgaacagctatgcctcctggtggagcagccacgtgctggactggctgaagtatggcaagaggctgctggtggtgcactatgaggagctgcggcgcagcctggtgcccaccctgcgggagatggtggccttcctgaatgtgtctgtgtctgaggagcggctgctgtgtgtggagaacaacaaggagggcagcttcagaagaagaggaagaagaagccatgaccctgagcccttcaccccagagatgaaggacctgatcaatggctacatcagaacagtggaccaggccctgcgggaccacaactggacaggcctgccccgggagtatgtgcccaggtag

SEQ ID NO: 39956 - DNA, 1728 bp, Artificial Sequence; identical to SEQ ID NO: 39955
  Description of Artificial Sequence: Synthetic coding sequence

SEQ ID NO: 39957 - DNA, 1758 bp, Artificial Sequence
  Description of Artificial Sequence: Synthetic coding sequence
atggccaagctgtggttcaagttccagcgctacttccggaggaagcctgtgcgcttcttcaccttcctggccctgtacctgacagctggcagcctggtgttcctgcacagcggctttgtgggccagcctgctgtgtctggcaaccaggccaacccagctgctgctgggggccctgctgagggcgctgagctgtccttcctgggggacatgcacctgggccggggcttccgggacacaggagaggccagcagcatcgccaggagatatggcccctggttcaagggcaaggatggaaatgaaagagccaagctgggggactatggaggagcctggagccgggccctgaagggccgggtggtgcgggagaaggaggaggagcgggccaagtacatcggctgctacctggatgacacccagagccgggccctgcggggcgtgtccttctttgactacaagaagatgaccatcttccgctgccaggacaactgtgccgagcggggctacctgtatggaggcctggagtttggagctgagtgctactgcggccacaagatccaggccaccaacgtgtctgaggccgagtgtgacatggagtgcaagggggagcggggctctgtgtgtggcggggccaaccggctgtctgtgtaccgcctgcagctggcccaggagagcgcccggcgctatggcagcgctgtgttccggggctgcttccggcggccagacaacctgagcctggccctgcctgtgacagctgccatgctgaacatgtctgtggacaagtgtgtggacttctgcacagagaaggagtaccccctggccgccctggccggcacagcctgccactgcggcttccccaccacccgcttccccctgcatgacagagaagatgagcagctgtgtgcccagaagtgcagcgctgaggagtttgagagctgtggcacccccagctacttcatcgtgtaccagacccaggtgcaggacaaccgctgcatggaccggcgcttcctgcccgggaagagcaagcagctgattgccctggccagcttccctggggccggcaacacctgggcccggcacctgattgagctggccaccggcttctacacaggcagctactactttgatggcagcctgtacaacaagggcttcaagggggagcgggaccactggaggagcggccgcaccatctgcatcaagacccatgaaagtggccagaaggagattgaggcctttgatgctgccatcctgctgatccggaacccctacaaggccctgatggccgagttcaacagaaaatatggaggccacatcggctttgctgcccacgcccactggaagggcaaaggagctgtgcccggcagcctgcagatcctcttccgcagcatctgcacagcctctgtgggggagtggccagagtttgtgagaaattatgccccctggtgggccacccacaccctggactggctgaagtttgggaagaaggtgctggtggtgcactttgaggacctgaagcaggacctgtttgtgcagctgggccgcatggtgtccctgctgggcgtggccgtgcgggaggaccggctgctgtgtgtggagagccagaaggatggcaacttcaagaggagcggcctgaggaagctggagtatgacccctacacagctgacatgcagaagaccatcagcgcctacatcaagatggtggatgctgccctgaagggcaggaacctgactggagtgcctgatgactactaccccaggtag

SEQ ID NO: 39958 - DNA, 1698 bp, Artificial Sequence
  Description of Artificial Sequence: Synthetic coding sequence
atggccaagctgtggttcaagttccagcgctacttccggaggaagcctgtgcgcttcttcaccttcctggccctgtacctgacagctggcagcctggtgttcctgcacagcggctttgtgggccagcctgctgtgtctggcaaccaggccaacccagctgctgctgggggccctgctgagggcgctgagctgtccttcctgggggacatgcacctgggccggggcttccgggacacaggagaggccagcagcatcgccaggagatatggcccctggttcaagggcaaggatggaaatgaaagagccaagctgggggactatggaggagcctggagccgggccctgaagggccgggtggtgcgggagaaggaggaggagcgggccaagtacatcggctgctacctggatgacacccagagccgggccctgcggggcgtgtccttctttgactacaagaagatgaccatcttccgctgccaggacaactgtgccgagcggggctacctgtatggaggcctggagtttggagctgagtgctactgcggccacaagatccaggccaccaacgtgtctgaggccgagtgtgacatggagtgcaagggggagcggggctctgtgtgtggcggggccaaccggctgtctgtgtaccgcctgcagctggcccaggagagcgcccggcgctatggcagcgctgtgttccggggctgcttccggcggccagacaacctgagcctggccctgcctgtgacagctgccatgctgaacatgtctgtggacaagtgtgtggacttctgcacagagaaggagtaccccctggccgccctggccggcacagcctgccactgcggcttccccaccacccgcttccccctgcatgacagagaagatgagcagctgtgtgcccagaagtgcagcgctgaggagtttgagagctgtggcacccccagctacttcatcgtgtaccagacccaggtgcaggacaaccgctgcatggaccggcgcttcctgcccgggaagagcaagcagctgattgccctggccagcttccctggggccggcaacacctgggcccggcacctgattgagctggccaccggcttctacacaggcagctactactttgatggcagcctgtacaacaagggcttcaagggggagcgggaccactggaggagcggccgcaccatctgcatcaagacccatgaaagtggccagaaggagattgaggcctttgatgctgccatcctgctgatccggaacccctacaaggccctgatggccgagttcaacagaaaatatggaggccacatcggctttgctgcccacgcccactggaagggcaaggagtggccagagtttgtgagaaattatgccccctggtgggccacccacaccctggactggctgaagtttgggaagaaggtgctggtggtgcactttgaggacctgaagcaggacctgtttgtgcagctgggccgcatggtgtccctgctgggcgtggccgtgcgggaggaccggctgctgtgtgtggagagccagaaggatggcaacttcaagaggagcggcctgaggaagctggagtatgacccctacacagctgacatgcagaagaccatcagcgcctacatcaagatggtggatgctgccctgaagggcaggaacctgactggagtgcctgatgactactaccccaggtag

SEQ ID NO: 39959 - DNA, 1698 bp, Artificial Sequence; identical to SEQ ID NO: 39958
  Description of Artificial Sequence: Synthetic coding sequence

SEQ ID NO: 39960 - DNA, 1758 bp, Artificial Sequence; identical to SEQ ID NO: 39957
  Description of Artificial Sequence: Synthetic coding sequence

SEQ ID NO: 39961 - DNA, 5532 bp, Artificial Sequence
  Description of Artificial Sequence: Synthetic coding sequence
atggctgacacccagacccaggtggcccccacccccaccatgaggatggccacagctgaggacctgcccctgcccccacctccagccctggaggacctgcccctgcccccacccaaggagagcttcagcaagttccaccagcagaggcaggccagcgagctgcggcggctgtaccgccacatccaccctgagctgaggaagaacctggccgaggccgtggccgaggacctggccgaggtgctgggcagcgaggagcccacagaaggagatgtgcagtgcatgcgctggatctttgagaactggaggctggatgccatcggggagcacgagaggcctgctgccaaggagcctgtgctgtgtggagatgtgcaggccaccagcaggaagtttgaggagggcagctttgccaacagcacagaccaggagcccacccggccccagcccggcggcggagatgtgcgggccgcccgctggctgtttgagaccaagcccctggatgagctgaccggccaggccaaggagctggaggccaccgtgcgggagcctgctgccagcggagatgtgcagggcaccaggatgctgtttgagacccggcccctggaccggctgggcagccggcccagcctgcaggagcagagccccctggagctgcggtctgagatccaggagctgaagggagatgtgaagaagacagtgaagctgttccagacagagcccctgtgtgccatccaggatgctgagggcgccatccacgaggtgaaggccgcctgccgggaggagatccagagcaatgctgtgcgcagcgcccgctggctgtttgagacccggcccctggatgccatcaaccaggaccccagccaggtgcgggtcatccggggcatcagcctggaggagggcgcccggccagatgtgtctgccacccgctggatctttgagacccagcccctggatgccatccgggagatcctggtggatgagaaggacttccagcccagcccagacctgatccccccaggcccagatgtgcagcagcagcagcacctgtttgagacccgggccctggacaccctgaagggagatgaggaggccggggctgaggccccacccaaggaggaggtggtgcctggagatgtgcgcagcaccctgtggctgtttgagaccaagcccctggatgccttccgggacaaggtgcaggtgggccacctgcagagggtggacccccaggatggagagggccacctgagcagtgacagcagcagcgccctgcccttcagccagagcgccccccagagagatgagctgaagggagatgtgaagaccttcaagaacctgtttgagaccctgcccctggacagcatcggccagggcgaggtgctggcccacggcagccccagccgggaggagggcacagacagcgctggccaggcccagggcatcggcagccctgtgtatgccatgcaggacagcaagggccgcctgcacgccctgacctctgtgtcccgggagcagatcgtgggcggagatgtgcagggctaccgctggatgtttgagacccagcccctggaccagctgggccgcagccccagcaccattgatgtggtgcggggcatcacccggcaggaggtggtggccggagatgtgggcacagcccgctggctgtttgagacccagcccctggagatgatccaccagcgggagcagcaggagcggcagaaggaggagggcaagagccagggcgacccccagcctgaggccccacccaagggagatgtgcagaccatccgctggctgtttgagacctgccccatgtctgagctggccgagaagcagggcagcgaggtgacagaccccacagccaaggccgaggcccagagctgcacctggatgttcaagccccagcctgtggacaggcctgtgggcagccgggagcagcacctgcaggtgtcccaggtgcctgctggggagcggcagacagacagacatgtgtttgaaacagagcccctgcaggccagcggccggccctgtggcagaagacctgtgcgctactgcagccgggtggagatccccagcggccaggtgtcccggcagaaggaggtgttccaggccctggaggccggcaagaaggaggagcaggagccccgggtgattgctggcagcatcccagctggctctgtgcacaagttcacctggctgtttgagaactgccccatgggcagcctggccgctgagagcatccagggcggcaacctgctggaggagcagcccatgagccccagcggcaacaggatgcaggagagccaggagacagctgctgagggcaccctgcggaccctgcacgccaccccaggcatcctgcaccacggcggcatcctgatggaggcccggggccctggagagctgtgcctggccaagtatgtgctgagcggcaccggccagggccacccctacatcaggaaggaggagctggtgtctggagagctgccccgcatcatctgccaggtgctgcggcggccagatgtggaccagcagggcctgctggtgcaggaggaccccaccggccagctgcagctgaagcccctgcggctgcccaccccaggcagcagcggcaacatcgaggacatggaccctgagctgcagcagctgctggcctgtggcctgggcacctctgtggccaggacaggcctggtgatgcaggagacagagcagggcctggtggccctgacagcctacagcctgcagccccggctgaccagcaaggccagcgagaggagctctgtgcagctgctggccagctgcatcgacaagggggacctgagcggcctgcacagcctgcgctgggagcccccagctgaccccagccctgtgcctgccagcgagggcgcccagagcctgcaccccacagagagcatcatccacgtgccccccctggaccccagcatgggcatgggccacctgcgggccagcggggccaccccctgccccccccaggccatcggcaaggctgtgcccctggccggggaggccgccgccccagcccagctgcagaacacagagaagcaggaggacagccacagcggccagaagggcatggctgtgctgggcaagtctgagggcgccaccaccaccccacctggccctggggccccagacctgctggccgccatgcagagcctgaggatggccacagctgaggcccagagcctgcaccagcaggtgctgaacaagcacaagcagggccccacccccacagccaccagcaaccccatccaggacggcctgaggaaggccggggccacccagagcaacatccggcctgggggcggcagtgacccccgcatcccagctgcccccaggaaggtgtcccgggaggagcaggccctgccccggggcctgcccggcggctgggtgaccatccaggacggcatctacacagcccaccctgtgaggacctttgatcctcctgggggcgtgcagctgagccagcgggagccccagagccgccaccgggagacagccctgtctgtgcaggccccccggcccctgcagggcggccctggccagagcactggacctggccgggaggagcccggcggctgcacccagatggcctggggccccccaggcaaggccatggccgaggtgtgccctgggggcctgcaggccgctgagaccaccctgaagacagcccccctgggccgccacatcctggccagcggcccccaggccgccggggccagcccccacccccacaatgcctttgtgcccccaccacccaccctgcctgctgctgtgactggaccagacttccctgctggggcccacagagcagaagattccatccagcaggccagcgagcccctgaaggaccccctgctgcacagccacagcagccctgctggccagaggacccctgggggcagccagaccaagacccccaagctggaccccaccatgccacccaagaagaagccccagctgccccccaagccagcccacctgacccagagccaccccccccagaggctgcccaagcccctgcccctgagccccagcttcagcagcgaggtgggccagcgggagcaccagagaggagagcgggacacagccatcccccagcctgccaaggtgcccaccaccgtggaccagggccacatccccctggcccgctgccccagcggccacagccagcccagcctgcagcacggcctgagcaccacagccccccggcccaccaagaaccaggccaccggcagcaatgcccagagcagcgagccccccaagctgaatgccctgaaccacgaccccaccagcccccagtggggccctggccccagcggggagcagcccatggagggcagccaccagggcgcccctgagagcccagacagcctgcagaggaaccagaaggagctgcagggcctgctgaaccaggtgcaggccctggagaaggaggccgccagctctgtggatgtgcaggccctgcggcggctgtttgaggccgtgccccagctgggcggggccgccccccaggccccagctgcccaccagaagccagaggcctctgtggagcaggccttcggggagctgaccagggtgtccacagaggtggcccagctgaaggagcagaccctggcccggctgctggacatcgaggaggccgtgcacaaggccctgagctccatgagcagcctgcagcctgaggccagcgcccggggccacttccagggcccccccaaggaccacagcgcccacaagatctctgtgacagtgagcagcagcgcccggcccagcggcagcggccaggaggtgggcggccagacagctgtgaagaaccaggccaaggtggagtgccacacagaggcccagagccaggtgaagatccggaaccacacagaggcccggggccacacagccagcacagcccccagcacccggcggcaggagaccagccgggagtacctgtgccccccccgggtgctgcccagcagccgggacagccccagcagccccaccttcatcagcatccagagcgccaccaggaagcccctggagacccccagcttcaagggcaacccagatgtgtctgtgaagagcacccagctggcccaggacatcggccaggccctgctgcaccagaagggcgtgcaggacaagacaggcaagaaggacatcacccagtgcagcgtgcagcctgagcccgcccctccttctgccagccccctgccccggggctggcagaagtctgtgctggagctgcagacaggccctggcagcagccagcactacggggccatgaggacagtgacagagcagtatgaggaggtggaccagtttggaaacacagtgctgatgagcagcaccaccgtgacagagcaggccgagcccccaagaaatcctggcagccacctgggcctgcacgccagccccctgctgcggcagttcctgcacagccctgctggcttcagcagtgacctgacagaggccgagaccgtgcaggtgtcctgcagctacagccagcctgctgcccagtag

SEQ ID NO: 39962 - DNA, 3366 bp, Artificial Sequence
  Description of Artificial Sequence: Synthetic coding sequence
atggctgacacccagacccaggtggcccccacccccaccatgaggatggccacagctgaggacctgcccctgcccccacctccagccctggaggacctgcccctgcccccacccaaggagagcttcagcaagttccaccagcagaggcaggccagcgagctgcggcggctgtaccgccacatccaccctgagctgaggaagaacctggccgaggccgtggccgaggacctggccgaggtgctgggcagcgaggagcccacagaaggagatgtgcagtgcatgcgctggatctttgagaactggaggctggatgccatcggggagcacgagaggcctgctgccaaggagcctgtgctgtgtggagatgtgcaggccaccagcaggaagtttgaggagggcagctttgccaacagcacagaccaggagcccacccggccccagcccggcggcggagatgtgcgggccgcccgctggctgtttgagaccaagcccctggatgagctgaccggccaggccaaggagctggaggccaccgtgcgggagcctgctgccagcggagatgtgcagggcaccaggatgctgtttgagacccggcccctggaccggctgggcagccggcccagcctgcaggagcagagccccctggagctgcggtctgagatccaggagctgaagggagatgtgaagaagacagtgaagctgttccagacagagcccctgtgtgccatccaggatgctgagggcgccatccacgaggtgaaggccgcctgccgggaggagatccagagcaatgctgtgcgcagcgcccgctggctgtttgagacccggcccctggatgccatcaaccaggaccccagccaggtgcgggtcatccggggcatcagcctggaggagggcgcccggccagatgtgtctgccacccgctggatctttgagacccagcccctggatgccatccgggagatcctggtggatgagaaggacttccagcccagcccagacctgatccccccaggcccagatgtgcagcagcagcagcacctgtttgagacccgggccctggacaccctgaagggagatgaggaggccggggctgaggccccacccaaggaggaggtggtgcctggagatgtgcgcagcaccctgtggctgtttgagaccaagcccctggatgccttccgggacaaggtgcaggtgggccacctgcagagggtggacccccaggatggagagggccacctgagcagtgacagcagcagcgccctgcccttcagccagagcgccccccagagagatgagctgaagggagatgtgaagaccttcaagaacctgtttgagaccctgcccctggacagcatcggccagggcgaggtgctggcccacggcagccccagccgggaggagggcacagacagcgctggccaggcccagggcatcggcagccctgtgtatgccatgcaggacagcaagggccgcctgcacgccctgacctctgtgtcccgggagcagatcgtgggcggagatgtgcagggctaccgctggatgtttgagacccagcccctggaccagctgggccgcagccccagcaccattgatgtggtgcggggcatcacccggcaggaggtggtggccggagatgtgggcacagcccgctggctgtttgagacccagcccctggagatgatccaccagcgggagcagcaggagcggcagaaggaggagggcaagagccagggcgacccccagcctgaggccccacccaagggagatgtgcagaccatccgctggctgtttgagacctgccccatgtctgagctggccgagaagcagggcagcgaggtgacagaccccacagccaaggccgaggcccagagctgcacctggatgttcaagccccagcctgtggacaggcctgtgggcagccgggagcagcacctgcaggtgtcccaggtgcctgctggggagcggcagacagacagacatgtgtttgaaacagagcccctgcaggccagcggccggccctgtggcagaagacctgtgcgctactgcagccgggtggagatccccagcggccaggtgtcccggcagaaggaggtgttccaggccctggaggccggcaagaaggaggagcaggagccccgggtgattgctggcagcatcccagctggctctgtgcacaagttcacctggctgtttgagaactgccccatgggcagcctggccgctgagagcatccagggcggcaacctgctggaggagcagcccatgagccccagcggcaacaggatgcaggagagccaggagacagctgctgagggcaccctgcggaccctgcacgccaccccaggcatcctgcaccacggcggcatcctgatggaggcccggggccctggagagctgtgcctggccaagtatgtgctgagcggcaccggccagggccacccctacatcaggaaggaggagctggtgtctggagagctgccccgcatcatctgccaggtgctgcggcggccagatgtggaccagcagggcctgctggtgcaggaggaccccaccggccagctgcagctgaagcccctgcggctgcccaccccaggcagcagcggcaacatcgaggacatggaccctgagctgcagcagctgctggcctgtggcctgggcacctctgtggccaggacaggcctggtgatgcaggagacagagcagggcctggtggccctgacagcctacagcctgcagccccggctgaccagcaaggccagcgagaggagctctgtgcagctgctggccagctgcatcgacaagggggacctgagcggcctgcacagcctgcgctgggagcccccagctgaccccagccctgtgcctgccagcgagggcgcccagagcctgcaccccacagagagcatcatccacgtgccccccctggaccccagcatgggcatgggccacctgcgggccagcggggccaccccctgccccccccaggccatcggcaaggctgtgcccctggccggggaggccgccgccccagcccagctgcagaacacagagaagcaggaggacagccacagcggccagaagggcatggctgtgctgggcaagtctgagggcgccaccaccaccccacctggccctggggccccagacctgctggccgccatgcagagcctgaggatggccacagctgaggcccagagcctgcaccagcaggtgctgaacaagcacaagcagggccccacccccacagccaccagcaaccccatccaggacggcctgaggaaggccggggccacccagagcaacatccggcctgggggcggcagtgacccccgcatcccagctgcccccaggaagctgctgtag

SEQ ID NO: 39963 - DNA, 1581 bp, Artificial Sequence
  Description of Artificial Sequence: Synthetic coding sequence
atgccacccaagaagaagccccagctgccccccaagccagcccacctgacccagagccaccccccccagaggctgcccaagcccctgcccctgagccccagcttcagcagcgaggtgggccagcgggagcaccagagaggagagcgggacacagccatcccccagcctgccaaggtgcccaccaccgtggaccagggccacatccccctggcccgctgccccagcggccacagccagcccagcctgcagcacggcctgagcaccacagccccccggcccaccaagaaccaggccaccggcagcaatgcccagagcagcgagccccccaagctgaatgccctgaaccacgaccccaccagcccccagtggggccctggccccagcggggagcagcccatggagggcagccaccagggcgcccctgagagcccagacagcctgcagaggaaccagaaggagctgcagggcctgctgaaccaggtgcaggccctggagaaggaggccgccagctctgtggatgtgcaggccctgcggcggctgtttgaagctgtgccccagctgggcggggccgccccccaggccccagctgcccaccagaagccagaggcctctgtggagcaggcctttggagagctgaccagggtgtccacagaggtggcccagctgaaggagcagaccctggcccggctgctggacatcgaggaggccgtgcacaaggccctgagctccatgagcagcctgcagcctgaggccagcgcccggggccacttccagggcccccccaaggaccacagcgcccacaagatctctgtgacagtgagcagcagcgcccggcccagcggcagcggccaggaggtgggcggccagacagctgtgaagaaccaggccaaggtggagtgccacacagaggcccagagccaggtgaagatccggaaccacacagaggcccggggccacacagccagcacagcccccagcacccggcggcaggagaccagccgggagtacctgtgccccccccgggtgctgcccagcagccgggacagccccagcagccccaccttcatcagcatccagagcgccaccaggaagcccctggagacccccagcttcaagggcaacccagatgtgtctgtgaagagcacccagctggcccaggacatcggccaggccctgctgcaccagaagggcgtgcaggacaagacaggcaagaaggacatcacccagtgcagcgtgcagcctgagcccgccccacccagcgccagccccctgccccggggctggcagaagtctgtgctggagctgcagacaggccctggcagcagccagcactatggagccatgaggacagtgacagagcagtatgaggaggtggaccagtttggaaacacagtgctgatgagcagcaccaccgtgacagagcaggccgagccccccaggaaccctggcagccacctgggcctgcacgccagccccctgctgcggcagttcctgcacagccctgctggcttcagcagtgacctgacagaagctgagaccgtgcaggtgtcctgcagctacagccagcctgctgcccagtag

SEQ ID NO: 39964 - DNA, 1953 bp, Artificial Sequence
  Description of Artificial Sequence: Synthetic coding sequence
atggccgccaagagtgatggccgcctgaagatgaagaagagcagtgatgtggccttcacccccctgcagaacagcgaccacagcggctctgtgcagggcctggcccctggcctgcccagcggcagcggggctgaagatgaggaggccgccggcggcggctgctgcccagatggcggcggctgcagccgctgctgctgctgctgtgccggcagcggcggcagcgctggcagcggcggcagcggcggcgtggccggccctgggggcggcggggccggcagcgctgccctgtgcctgcggctgggccgggagcagaggcgctacagcctgtgggactgcctgtggatcctggccgctgtggccgtgtactttgctgatgtgggcacagatgtgtggctggccgtggactactacctgcggggccagcgctggtggtttggcctgaccctcttctttgtggtgctgggcagcctgtctgtgcaggtgttctccttccgctggtttgtgcatgacttcagcacagaggacagcgccacagctgctgctgccagcagctgcccccagcccggggctgactgcaagacagtggtgggcggcggcagcgctgctggggagggggaggcccggcccagcaccccccagaggcaggccagcaatgccagcaagagcaacattgctgctgccaacagcggcagcaacagcagcggggccacccgggccagcggcaagcacaggtctgccagctgcagcttctgcatctggctgctgcagagcctcatccacatcctgcagctgggccagatctggagatacttccacaccatctacctgggcatccgcagccggcagagcggagaaaatgaccgctggaggttctactggaagatggtgtatgaatatgcagatgtgtccatgctgcacctgctggccaccttcctggagagcgccccccagctggtgctgcagctgtgcatcatcgtgcagacccacagcctgcaggccctgcagggcttcaccgctgctgccagcctggtgtccctggcctgggccctggccagctaccagaaggccctgcgggacagcagagatgacaagaagcccatctcctacatggctgtgatcatccagttctgctggcacttcttcaccatcgccgcccgggtcatcacctttgccctgtttgcctctgtgttccagctgtacttcggcatcttcatcgtgctgcactggtgcatcatgaccttctggatcgtgcactgtgaaacagagttctgcatcaccaagtgggaggagatcgtgtttgacatggtggtgggcatcatctacatcttctcctggttcaacgtgaaggagggccgcacccgctgccgcctcttcatctactacttcgtcatcctgctggagaacacagccctgagcgccctgtggtacctgtacaaggccccccagattgctgatgcctttgccatcccagccctgtgtgtggtgttcagcagcttcctgactggagtggtgttcatgctgatgtactatgccttcttccaccccaacggcccccgcttcggccagagccccagctgtgcctgtgaagatcctgctgctgccttcaccctgcccccagatgtggccaccagcaccctgcggagcatcagcaacaacagatctgtggtgtctgaccgggaccagaagtttgctgagagagatggctgtgtgcctgtgttccaggtgcggcccacagcccccagcacccccagcagcaggcctccccgcatcgaggagagcgtcatcaagattgacctcttcaggaaccgctacccagcctgggagcggcacgtgctggacaggagcctgaggaaggccatcctggcctttgagtgcagccccagccccccccggctgcagtacaaggatgatgccctgatccaggagcggctggagtatgagaccaccctgtag

SEQ ID NO: 39965 - DNA, 1953 bp, Artificial Sequence; identical to SEQ ID NO: 39964
  Description of Artificial Sequence: Synthetic coding sequence

SEQ ID NO: 39966 - DNA, 1089 bp, Artificial Sequence
  Description of Artificial Sequence: Synthetic coding sequence
atgatgtatgaatatgcagatgtgaacatgctgcggctgctggagaccttcctggagagcgccccccagctggtgctgcagctgtacatcatgctgcagaagaacagcgctgagaccctgccctgtgtgtcctctgtgaccagcctgatgagcctggcctgggtgctggccagctaccacaagctgctgcgggacagcagagatgacaagaagtccatgagctacagaggagccatcatccaggtgttctggaggctcttcaccatcagcagcagggtcatcagctttgccctgtttgccagcatcttccagctgtacttcggcatctttgtggtggtgcactggtgtgccatggccttctggatcatccacggcggcacagacttctgcatgagcaagtgggaggagatcctcttcaacatggtggtgggcatcgtgtacatcttctgctggttcaacgtgaaggagggccgcacccgctacaggatgtttgcctactacaccatcgtgctgacagaaaatgctgccctgaccttcctgtggtacttctacagagatcctgagaccacagacagctatgctgtgcctgccctgtgctgcgtgttcatcagctttgtggccggcatcgccatgatgctgctgtactacggcgtgctgcaccccaccggcccccgggccaagatcctggccagcagctgctgtgccgagctgctgtggggcatccccctgcccccagatgtggagcccatggcccctgagatccctggctaccggggcacccaggtgacccccaccagggctgtgacagagcagcaggaggacctgacagctgacacctgcctgcccgtcttccaggtgcggcccatgggcccccccacccccctgggccggccctacctgcctgagggccccctcatcaagattgacatgcccaggaagcgctacccagcctgggatgcccactttgtggaccggcggctgcggaggaccatcaacatcctgcagtatgtgacccccacagctgtgggcatccgctacagagatggccccctgctgtatgagctgctgcagtatgagagcagcctgtag

SEQ ID NO: 39967 - DNA, 1926 bp, Artificial Sequence
  Description of Artificial Sequence: Synthetic coding sequence
atggccgccaagagtgatggcggcggcgtgggcgtgggctttgcccagctgcacaacctggatgaagctgtgggcagcggcggggaggaggatggagagcccggcggcggcggctgcggcggcggcggagatggcagcgagcccggggagagcagctccatgcacatctgccactgctgcaacaccagcagctgctactggggctgccgcagcgcctgcctgcggagcctgctgggcaggaagcccaggagatctgctgctgctgatggaggagaccagcccctgcagcccccagctgcccctggagctggccggcagccccccaccccatctgctgcccggcctgagcccccaccaccccaggtggagcggccctggctggactgcctgtggatcgtgctggccctgctggtgttctttggagatgtgggcacagacctgtggctggccctggactactacaggaagggggactatgtgtacttcggcctgaccctcttctttgtgctggtgcccagcctgctggtgcagagcctgtccttccgctggtttgtgcaggactacacaggaggcggcctgggcgctgtggagggcctgaccagccggggcccccccatgatgggcgccggctacgtgcatggagctgcccggggcggccctggggtgcgggtgagccccacccctggggcccagaggctgtgccgcctgtctgtgtggatctggcagagcgtcatccacctgctgcagatgggccaggtgtggagatacatccgcaccatgtacctgggcatccagagccagaggaggaaggagcaccagaggcgcttctactgggccatgatgtatgaatatgcagatgtgaacatgctgcggctgctggagaccttcctggagagcgccccccagctggtgctgcagctgtacatcatgctgcagaagaacagcgctgagaccctgccctgtgtgtcctctgtgaccagcctgatgagcctggcctgggtgctggccagctaccacaagctgctgcgggacagcagagatgacaagaagtccatgagctacagaggagccatcatccaggtgttctggaggctcttcaccatcagcagcagggtcatcagctttgccctgtttgccagcatcttccagctgtacttcggcatctttgtggtggtgcactggtgtgccatggccttctggatcatccatggaggaacagacttctgcatgagcaagtgggaggagatcctcttcaacatggtggtgggcatcgtgtacatcttctgctggttcaacgtgaaggagggccgcacccgctacaggatgtttgcctactacaccatcgtgctgacagaaaatgctgccctgaccttcctgtggtacttctacagagatcctgagaccacagacagctatgctgtgcctgccctgtgctgcgtgttcatcagctttgtggccggcatcgccatgatgctgctgtactatggagtgctgcaccccaccggcccccgggccaagatcctggccagcagctgctgtgccgagctgctgtggggcatccccctgcccccagatgtggagcccatggcccctgagatccctggctaccggggcacccaggtgacccccaccagggctgtgacagagcagcaggaggacctgacagctgacacctgcctgcctgtgttccaggtgcggcccatgggcccccccacccccctgggccggccctacctgcctgagggccccctcatcaagattgacatgcccaggaagcgctacccagcctgggatgcccactttgtggaccggcggctgcggaggaccatcaacatcctgcagtatgtgacccccacagctgtgggcatccgctacagagatggccccctgctgtatgagctgctgcagtatgagagcagcctgtag

SEQ ID NO: 39968 - DNA, 2034 bp, Artificial Sequence
  Description of Artificial Sequence: Synthetic coding sequence
atgctgagcagcacagacttcacctttgcctcctgggagctggtggtgcgggtggaccaccccaatgaggagcagcagaaggatgtgaccctgcgggtgtctggggacctgcacgtgggcggcgtgatgctgaagctggtggagcagatcaacatcagccaggactggagcgactttgccctgtggtgggagcagaagcactgctggctgctgaagacccactggaccctggacaagtatggagtgcaggctgatgccaagctgctcttcaccccccagcacaagatgctgcggctgcggctgcccaacctgaagatggtgcggctgcgggtgtccttctctgctgtggtgttcaaggctgtgtctgacatctgcaagatcctgaacatcagaagaagtgaggagctgagcctgctgaagcccagcggggactacttcaagaagaagaagaagaaggacaagaacaacaaggagcccatcatcgaggacatcctgaacctggagagcagccccacagccagcggcagctctgtgtccccaggcctgtacagcaagaccatgacccccatctatgaccccatcaatggcaccccagccagcagcaccatgacctggttcagtgacagccccctgacagagcagaactgcagcatcctggccttcagccagcccccccagagccctgaggccctggccgacatgtaccagcccaggagcctggtggacaaggccaagctgaatgccggctggctggacagcagccgcagcctgatggagcagggcatccaggaggatgagcagctgctgctgcgcttcaagtactacagcttctttgacctgaaccccaagtatgatgctgtgcgcatcaaccagctgtatgagcaggcccgctgggccatcctgctggaggagattgactgcacagaggaggagatgctgatctttgctgccctgcagtaccacatcagcaagctgagcctgtctgctgagacccaggactttgctggggagagcgaggtggatgaaattgaagctgccctgagcaacctggaggtgaccctggagggcggcaaggctgacagcctgctggaggacatcacagacatccccaagctggccgacaacctgaagctgttccggcccaagaagctgctgcccaaggccttcaagcagtactggttcatcttcaaggacaccagcatcgcctacttcaagaacaaggagctggagcagggcgagcccctggagaagctgaacctgcggggctgtgaggtggtgcctgatgtgaatgtggccggcaggaagtttggcatcaagctgctgatccctgtggctgatggcatgaatgagatgtacctgcgctgtgaccacgagaaccagtatgcccagtggatggccgcctgcatgctggccagcaagggcaagaccatggctgacagcagctaccagcctgaggtgctgaacatcctgtccttcctgaggatgaagaacagaaacagcgccagccaggtggccagcagcctggagaacatggacatgaaccctgagtgctttgtgagcccccgctgtgccaagaggcacaagagcaagcagctggccgcccgcatcctggaggcccaccagaatgtggcccagatgcccctggtggaggccaagctgcgcttcatccaggcctggcagagcctgcctgagtttggcctgacctactacctggtgcgcttcaagggcagcaagaaggatgacatcctgggcgtgtcctacaacagactcatcaagattgatgctgccaccggcatccctgtgaccacctggaggttcaccaacatcaagcagtggaatgtgaactgggagacccggcaggtggtgattgaatttgaccagaatgtgttcaccgccttcacctgcctgtctgctgactgcaagatcgtgcatgagtacatcggcggctacatcttcctgagcaccaggagcaaggaccagaatgagaccctggatgaggacctcttccacaagctgactggaggccaggactag

SEQ ID NO: 39969 - DNA, 1188 bp, Artificial Sequence
  Description of Artificial Sequence: Synthetic coding sequence
atgccctggagcagcagaggagccctgctgcgggacctggtgctgggcgtgctgggcacagctgccttcctgctggacctgggcacagacctgtgggccgctgtgcagtatgccctgggcggccgctacctgtgggccgccctggtgctggccctgctgggcctggcctctgtggccctgcagctgttctcctggctgtggctgcgggctgaccctgctggcctgcacggcagccagcccccccggcgctgcctggccctgctgcacctgctgcagctgggctacctgtaccgctgtgtgcaggagctgcggcagggcctgctggtgtggcagcaggaggagcccagcgagtttgacctggcctatgctgacttcctggccctggacatctccatgctgcggctgtttgagaccttcctggagacagccccccagctgaccctggtgctggccatcatgctgcagagcggccgggcagagtactaccagtgggtgggcatctgcaccagcttcctgggcatctcctgggccctgctggactaccaccgggccctgcggacctgcctgcccagcaagcccctgctgggcctgggcagcagcgtcatctacttcctgtggaacctgctgctgctgtggccccgggtgctggccgtggccctcttcagcgccctcttccccagctatgtggccctgcacttcctgggcctgtggctggtgctgctgctgtgggtgtggctgcagggcacagacttcatgccagaccccagcagcgagtggctgtacagagtgacagtggccaccatcctgtacttctcctggttcaacgtggccgagggccgcacccggggccgggccatcatccactttgccttcctgctgagtgacagcatcctgctggtggccacctgggtgacccacagctcctggctgcccagcggcatccccctgcagctgtggctgcctgtgggctgcggctgcttcttcctgggcctggccctgcggctggtgtactaccactggctgcaccccagctgctgctggaagccagaccctgaccaggtggatggagcccggagcctgctgagccctgagggctaccagctgccccagaacagaaggatgacccacctggcccagaagttcttccccaaggccaaggatgaagctgccagccctgtgaagggctag

SEQ ID NO: 39970 - DNA, 1122 bp, Artificial Sequence
  Description of Artificial Sequence: Synthetic coding sequence
atgaagtacaccaagcagaacttcatgatgtctgtgctgggcatcatcatctacgtgacagacctgattgtggacatctgggtgtctgtgcgcttcttccacgagggccagtatgtgttttctgccctggccctgtccttcatgctgtttggcaccctggtggcccagtgcttctcctacagctggttcaaggctgacctgaagaaggccggccaggagagccagcactgcttcctgctgctgcactgcctgcagggcggcgtcttcacccgctactggtttgccctgaagaggggctaccacgccgccttcaagtatgacagcaacaccagcaactttgtggaggagcagattgacctgcacaaggaggtgattgacagagtgacagacctgtccatgctgcggctgtttgagacctacctggagggctgcccccagctgatcctgcagctgtacatcctgctggagcacggccaggccaacttcagccagtatgctgccatcatggtgtcctgctgtgccatctcctggagcacagtggactaccaggtggccctgaggaagagcctgcctgacaagaagctgctgaatggcctgtgccccaagatcacctacctgttctacaagctgttcaccctgctgtcctggatgctgtctgtggtgctgctgctcttcctgaatgtgaagatcgccctcttcctgctgctcttcctgtggctgctgggcatcatctgggccttcaagaacaacacccagttctgcacctgcatctccatggagttcctgtacagaattgtggtgggcttcatcctgatcttcaccttcttcaacatcaagggccagaacaccaagtgccccatgagctgctactacatcgtgcgggtgctgggcaccctgggcatcctgactgtgttctgggtgtgccccctgaccatcttcaacccagactacttcatccccatcagcatcaccatcgtgctgaccctgctgctgggcatcctcttcctgattgtgtactacggcagcttccaccccaacagatctgctgagaccaagtgtgatgaaattgatggcaagcctgtgctgcgggagtgcaggatgagatacttcctgatggagtag

SEQ ID NO: 39971 - DNA, 1122 bp, Artificial Sequence; identical to SEQ ID NO: 39970
  Description of Artificial Sequence: Synthetic coding sequence

SEQ ID NO: 39972 - DNA, 1182 bp, Artificial Sequence
  Description of Artificial Sequence: Synthetic coding sequence
atgggcctgctgcggggcggcctgccctgtgcccgggccatggcccggctgggcgctgtgcgcagccactactgtgccctgctgctggccgccgccctggccgtgtgtgccttctactacctgggcagcggccgggagaccttcagcagcgccaccaagaggctgaaggaggcccgggccggggccccagctgcccccagccccccagccctggagctggcccggggctctgtggccccagcccctggggccaaggccaagagcctggagggcggcggggccggccctgtggactaccacctgctgatgatgttcaccaaggccgagcacaatgctgccctgcaggccaaggcccgggtggccctgcggagcctgctgcggctggccaagtttgaggcccacgaggtgctgaacctgcactttgtgtctgaggaggccagccgggaggtggccaagggcctgctgcgggagctgctgcccccagctgctggcttcaagtgcaaggtgatcttccatgatgtggccgtgctgacagacaagctgttccccatcgtggaggccatgcagaagcacttctctgctggcctgggcacctactacagcgacagcatcttcttcctgtctgtggccatgcaccagatcatgcccaaggagatcctgcagatcatccagctggacctggacctgaagttcaagaccaacatccgggagctgtttgaggagtttgacagcttcctgcccggggccatcattggaattgcccgggagatgcagcctgtgtaccgccacaccttctggcagttcagacatgagaacccccagaccagggtgggcggccccccacctgagggcctgcccggcttcaacagcggcgtgatgctgctgaacctggaggccatgaggcagagccccctgtacagccggctgctggagcccgcccaggtgcagcagctggccgacaagtaccacttccggggccacctgggggaccaggacttcttcaccatgattggcatggagcaccccaagctgttccacgtgctggactgcacctggaaccggcagctgtgcacctggtggagggaccacggctacagtgatgtgtttgaggcctacttccgctgtgagggccacgtgaagatctaccacggcaactgcaacacccccatccctgaggactag

SEQ ID NO: 39973 - DNA, 573 bp, Artificial Sequence
  Description of Artificial Sequence: Synthetic coding sequence
atgtggcccccacgctgcaaggaccccggccggcagagcgctgagatcctgcagatcatccagctggacctggacctgaagttcaagaccaacatccgggagctgtttgaggagtttgacagcttcctgcccggggccatcatcggcatcgcccgggagatgcagcctgtgtaccgccacaccttctggcagttcagacatgagaacccccagaccagggtgggcggccccccacctgagggcctgcccggcttcaacagcggcgtgatgctgctgaacctggaggccatgaggcagagccccctgtacagccggctgctggagcccgcccaggtgcagcagctggccgacaagtaccacttccggggccacctgggggaccaggacttcttcaccatgattggcatggagcaccccaagctgttccacgtgctggactgcacctggaaccggcagctgtgcacctggtggagggaccacggctacagtgatgtgtttgaggcctacttccgctgtgagggccacgtgaagatctaccacggcaactgcaacacccccatcccagaagattag

SEQ ID NO: 39974 - DNA, 564 bp, Artificial Sequence
  Description of Artificial Sequence: Synthetic coding sequence
atgaatggcatgtctgtgctgatgaaggagaccctgaagagctctgtgacccccagcccctatgaggagaccggggagcggcagcccagcgtgaactgggccgtgagcccccaccagacccagaaccagtgggcccgctggagctggaccagccagcccctggagctgcacaccttctggcagttcagacatgagaacccccagaccagggtgggcggccccccacctgagggcctgcccggcttcaacagcggcgtgatgctgctgaacctggaggccatgaggcagagccccctgtacagccggctgctggagcccgcccaggtgcagcagctggccgacaagtaccacttccggggccacctgggggaccaggacttcttcaccatgattggcatggagcaccccaagctgttccacgtgctggactgcacctggaaccggcagctgtgcacctggtggagggaccacggctacagtgatgtgtttgaggcctacttccgctgtgagggccacgtgaagatctaccacggcaactgcaacacccccatccctgaggactag

SEQ ID NO: 39975 - DNA, 573 bp, Artificial Sequence; identical to SEQ ID NO: 39973
  Description of Artificial Sequence: Synthetic coding sequence

SEQ ID NO: 39976 - DNA, 570 bp, Artificial Sequence
  Description of Artificial Sequence: Synthetic coding sequence
atggtgcgctgtgtgcccagcgctgtgattgtgtgcttcctgcggcccccccagcccggccgcaccgtcatcttccatgatgtggccgtgctgacagacaagctgttccccatcgtggaggccatgcagaagcacttctctgctggcctgggcacctactacagcgacagcatcttcttcctgtctgtggccatgcaccagatcatgcccaaggagatcctgcagatcatccagctggacctggacctgaagttcaagaccaacatccgggagctgtttgaggagtttgacagcttcctgcccggggccatcattggaattgcccgggagatgcagcagctggccgacaagtaccacttccggggccacctgggggaccaggacttcttcaccatgattggcatggagcaccccaagctgttccacgtgctggactgcacctggaaccggcagctgtgcacctggtggagggaccacggctacagtgatgtgtttgaggcctacttccgctgtgagggccacgtgaagatctaccacggcaactgcaacacccccatccctgaggactag

SEQ ID NO: 39977 - DNA, 504 bp, Artificial Sequence
  Description of Artificial Sequence: Synthetic coding sequence
atgagcctggtgatccggaacctgcagagggtcatccccatcagaagagcccccctgcggagcaagattgaaattgtgcggcgcatcctgggcgtgcagaagtttgacctgggcatcatctgtgtggacaacaagaacatccagcacatcaaccgcatctacagagacagaaatgtgcccacagatgtgctgtccttccccttccacgagcacctgaaggccggggagttcccccagcctgacttcccagatgactacaacctgggggacatcttcctgggcgtggagtacatcttccaccagtgcaaggaaaatgaagactacaatgatgtgctgactgtgacagccacccacggcctgtgccacctgctgggcttcacccacggcacagaggccgagtggcagcagatgttccagaaggagaaggctgtgctggatgagctgggccgcaggacaggcacccggctgcagcccctgacccggggcctgtttggaggcagctag

SEQ ID NO: 39978 - DNA, 375 bp, Artificial Sequence
  Description of Artificial Sequence: Synthetic coding sequence
atgagcctggtgatccggaacctgcagagggtcatccccatcagaagagcccccctgcggagcaagattgaaattgtgcggcgcatcctgggcgtgcagaagtttgacctgggcatcatctgtgtggacaacaagaacatccagcacatcaaccgcatctacagagacagaaatgtgcccacagatgtgctgtccttccccttccacgaggtgacagccacccacggcctgtgccacctgctgggcttcacccatggaacagaagctgagtggcagcagatgttccagaaggagaaggctgtgctggatgagctgggcagaagaacaggcacccggctgcagcccctgacccggggcctgtttggaggcagctag

SEQ ID NO: 39979 - DNA, 504 bp, Artificial Sequence; identical to SEQ ID NO: 39977
  Description of Artificial Sequence: Synthetic coding sequence

SEQ ID NO: 39980 - DNA, 240 bp, Artificial Sequence
  Description of Artificial Sequence: Synthetic coding sequence
atgagcctggtgatccggaacctgcagagggtcatccccatcagaagagcccccctgcggagcaagattgaaattgtgacagccacccacggcctgtgccacctgctgggcttcacccacggcacagaggccgagtggcagcagatgttccagaaggagaaggctgtgctggatgagctgggccgcaggacaggcacccggctgcagcccctgacccggggcctgtttggaggcagctag

SEQ ID NO: 39981 - DNA, 369 bp, Artificial Sequence
  Description of Artificial Sequence: Synthetic coding sequence
atgagcctggtgatccggaacctgcagagggtcatccccatcagaagagcccccctgcggagcaagattgagatccacctgaaggccggggagttcccccagcctgacttcccagatgactacaacctgggggacatcttcctgggcgtggagtacatcttccaccagtgcaaggaaaatgaagactacaatgatgtgctgactgtgacagccacccacggcctgtgccacctgctgggcttcacccatggaacagaagctgagtggcagcagatgttccagaaggagaaggctgtgctggatgagctgggcagaagaacaggcacccggctgcagcccctgacccggggcctgtttggaggcagctag

SEQ ID NO: 39982 - DNA, 504 bp, Artificial Sequence; identical to SEQ ID NO: 39977
  Description of Artificial Sequence: Synthetic coding sequence

SEQ ID NO: 39983 - DNA, 921 bp, Artificial Sequence
  Description of Artificial Sequence: Synthetic coding sequence
atggctgctgtggatgacctgcagtttgaggagtttggaaatgctgccaccagcctgacagccaacccagatgccaccaccgtgaacattgaagatcctggagagacccccaagcaccagcccggcagcccccggggcagcggccgggaggaggatgatgagctgctgggcaatgatgacagcgacaagacagagctgctggccggccagaagaagagcagccccttctggacctttgagtactaccagaccttctttgatgtggacacctaccaggtgtttgaccgcatcaagggcagcctgctgcccatccctgggaagaactttgtgcggctgtacatccgcagcaacccagacctgtatggccccttctggatctgtgccaccctggtgtttgccatcgccatcagcggcaacctgagcaacttcctgatccacctgggggagaagacctaccactacgtgcctgagttcaggaaggtgtccattgctgccaccatcatctatgcctatgcctggctggtgcccctggccctgtggggcttcctgatgtggaggaacagcaaggtgatgaacatcgtgtcctacagcttcctggagatcgtgtgtgtgtatggctacagcctcttcatctacatccccacagccatcctgtggatcatcccccagaaggctgtgcgctggatcctggtgatgattgccctgggcatcagcggcagcctgctggccatgaccttctggccagctgtgcgggaggacaacagaagagtggccctggccaccatcgtgaccatcgtgctgctgcacatgctgctgtctgtgggctgcctggcctacttctttgatgcccctgagatggaccacctgcccaccaccacagccacccccaaccagacagtggccgccgccaagagcagctag

SEQ ID NO: 39984 - DNA, 372 bp, Artificial Sequence
  Description of Artificial Sequence: Synthetic coding sequence
atgtggaggaacagcaaggtgatgaacatcgtgtcctacagcttcctggagatcgtgtgtgtgtatggctacagcctcttcatctacatccccacagccatcctgtggatcatcccccagaaggctgtgcgctggatcctggtgatgattgccctgggcatcagcggcagcctgctggccatgaccttctggccagctgtgcgggaggacaacagaagagtggccctggccaccatcgtgaccatcgtgctgctgcacatgctgctgtctgtgggctgcctggcctacttctttgatgcccctgagatggaccacctgcccaccaccacagccacccccaaccagacagtggccgccgccaagagcagctag

SEQ ID NO: 39985 - DNA, 654 bp, Artificial Sequence
  Description of Artificial Sequence: Synthetic coding sequence
atggctgctgtggatgacctgcagtttgaggagtttggaaatgctgccaccagcctgacagccaacccagatgccaccaccgtgaacattgaagatcctggagagacccccaagcaccagcccggcagcccccggggcagcggccgggaggaggatgatgagctgctgggcaatgatgacagcgacaagacagagctgctggccggccagaagaagagcagccccttctggacctttgagtactaccagaccttctttgatgtggacacctaccaggtgtttgaccgcatcaagggcagcctgctgcccatccctgggaagaactttgtgcggctgtacatccgcagcaacccagacctgtatggccccttctggatctgtgccaccctggtgtttgccatcgccatcagcggcaacctgagcaacttcctgatccacctgggggagaagacctaccactacgtgcctgagttcaggaaggtgtccattgctgccaccatcatctatgcctatgcctggctggtgcccctggccctgtggggcttcctgatgtggaggaacagcaaggtgatgaacatcgtgtcctacagcttcctggagatcgtgtgtgtgtatggctacagcctcttcatctacatccccacagctgtgtag

SEQ ID NO: 39986 - DNA, 921 bp, Artificial Sequence; identical to SEQ ID NO: 39983
  Description of Artificial Sequence: Synthetic coding sequence

SEQ ID NO: 39987 - DNA, 996 bp, Artificial Sequence
  Description of Artificial Sequence: Synthetic coding sequence
atgtctggaggagagatcagcagcaggaccctgcagatcttcttcctgatcatcggccggcggctgactggaaggatggctgctgtggatgacctgcagtttgaggagtttggaaatgctgccaccagcctgacagccaacccagatgccaccaccgtgaacatcgaggaccccggggagacccccaagcaccagcccggcagcccccggggcagcggccgggaggaggatgatgagctgctgggcaatgatgacagcgacaagacagagctgctggccggccagaagaagagcagccccttctggacctttgagtactaccagaccttctttgatgtggacacctaccaggtgtttgaccgcatcaagggcagcctgctgcccatccctgggaagaactttgtgcggctgtacatccgcagcaacccagacctgtatggccccttctggatctgtgccaccctggtgtttgccatcgccatcagcggcaacctgagcaacttcctgatccacctgggggagaagacctaccactacgtgcctgagttcaggaaggtgtccattgctgccaccatcatctatgcctatgcctggctggtgcccctggccctgtggggcttcctgatgtggaggaacagcaaggtgatgaacatcgtgtcctacagcttcctggagatcgtgtgtgtgtatggctacagcctcttcatctacatccccacagccatcctgtggatcatcccccagaaggctgtgcgctggatcctggtgatgattgccctgggcatcagcggcagcctgctggccatgaccttctggccagctgtgcgggaggacaacagaagagtggccctggccaccatcgtgaccatcgtgctgctgcacatgctgctgtctgtgggctgcctggcctacttctttgatgcccctgagatggaccacctgcccaccaccacagccacccccaaccagacagtggccgccgccaagagcagctag

SEQ ID NO: 39988 - DNA, 951 bp, Artificial Sequence
  Description of Artificial Sequence: Synthetic coding sequence
atggccagcgcagatgagctgaccttccacgagtttgaggaggccaccaacctgctggccgacaccccagatgctgccaccaccagcagaagtgaccagctgaccccccagggccacgtggccgtggccgtgggcagcggcggcagctatggagcagaagatgaggtggaggaggagagtgacaaggccgccctgctgcaggagcagcagcagcagcagcagcccggcttctggaccttctcctactaccagagcttctttgatgtggacaccagccaggtgctggaccgcatcaagggcagcctgctgccccggcccggccacaactttgtgcgccaccacctgaggaacagaccagacctgtatggccccttctggatctgtgccaccctggcctttgtgctggccgtgacaggcaacctgaccctggtgctggcccagaggcgggaccccagcatccactacagcccccagttccacaaggtgacagtggccggcatcagcatctactgctacgcctggctggtgcccctggccctgtggggcttcctgcgctggaggaagggcgtgcaggagaggatgggcccctacaccttcctggagaccgtgtgcatctacggctacagcctgtttgtgttcatccccatggtggtgctgtggctgatccctgtgccctggctgcagtggctgtttggagccctggccctgggcctgtctgctgctggcctggtgttcaccctgtggcctgtggtgcgggaggacacccggctggtggccaccgtgctgctgtctgtggtggtgctgctgcacgccctgctggccatgggctgcaagctgtacttcttccagagcctgcccccagaaaatgtggcccccccaccccagatcaccagcctgcccagcaacatcgccctgagccccaccctgccccagagcctggcccccagctag

SEQ ID NO: 39989 - DNA, 735 bp, Artificial Sequence
  Description of Artificial Sequence: Synthetic coding sequence
atgcagcccccaggccccccaccagcctatgcccccaccaacggggacttcacctttgtgagcagcgcagatgctgaggacctgagcggcagcatcgccagcccagatgtgaagctgaacctgggcggggacttcatcaaggagagcacagccaccaccttcctgcggcagaggggctacggctggctgctggaggtggaggatgatgatcctgaggacaacaagcccctgctggaggagctggacatcgacctgaaggacatctactacaagatccgctgtgtgctgatgcccatgcccagcctgggcttcaaccggcaggtggtgcgggacaacccagacttctggggccccctggccgtggtgctcttcttctccatgatcagcctgtatggccagttccgggtggtgtcctggatcatcaccatctggatcttcggcagcctgaccatcttcctgctggcccgggtgctgggcggggaggtggcctacggccaggtgctgggcgtgattggctacagcctgctgcccctgattgtgattgcccctgtgctgctggtggtgggcagctttgaggtggtgtccaccctcatcaagctgtttggagtcttctgggccgcctacagcgctgccagcctgctggtgggggaggagttcaagaccaagaagcccctgctgatctaccccatcttcctgctgtacatctacttcctgagcctgtacacaggagtgtag

SEQ ID NO: 39990 - DNA, 582 bp, Artificial Sequence
  Description of Artificial Sequence: Synthetic coding sequence
atggccgaggccgaggagagccctggggaccctggaacagccagcccccggcccctgatgagggacctgaaggctgtgggcaagaagttcatgcacgtgctgtaccccaggaagagcaacaccctgctgcgggactgggacctgtggggccccctcatcctgtgtgtgaccctggccctgatgctgcagagggacagcgctgacagcgagaaggatggcggcccccagtttgctgaggtgtttgtgattgtgtggtttggagctgtgaccatcaccctgaacagcaagctgctgggcggcaacatctccttcttccagagcctgtgtgtgctgggctactgcatcctgcccctgactgtggccatgctgatctgccgcctggtgctgctggccgaccccggccctgtgaacttcatggtgcggctgtttgtggtgattgtgatgtttgcctggagcatcgtggccagcacagccttcctggccgacagccagccccccaacagaagagccctggccgtgtaccctgtgttcctgttctactttgtgatctcctggatgatcctgaccttcaccccccagtag

SEQ ID NO: 39991 - DNA, 567 bp, Artificial Sequence
  Description of Artificial Sequence: Synthetic coding sequence
atggccgaggccgaggagagccctggggaccctggaacagccagcccccggcccctgatgagggacctgaaggctgtgggcaagaagttcatgcacgtgctgtaccccaggaagagcaacaccctgctgcgggactgggacctgtggggccccctcatcctgtgtgtgaccctggccctgatgctgcagagggacagcgctgacagcgagaaggatggcggcccccagtttgctgaggtgtttgtgattgtgtggtttggagctgtgaccatcaccctgaacagcaagctgctgggcggcaacatctccttcttccagagcctgtgtgtgctgggctactgcatcctgcccctgactgtggccatgctgatctgccgcctggtgctgctggccgaccccggccctgtgaacttcatggtgcggctgtttgtggtgattgtgatgtttgcctggagcatcgtggccagcacagccttcctggccgacagccagccccccaacagaagagccctggccgtgtaccctgtgttcctgttctactttgtgatctcctggatgatcctgtag
